United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 46

SEQ ID NO: 1928688 - DNA, 22 bp, Homo sapiens
gattacctagtagtcatttcat

SEQ ID NO: 1928689 - DNA, 15 bp, Homo sapiens
gattagtaaagaaat

SEQ ID NO: 1928690 - DNA, 19 bp, Homo sapiens
gattatgtagcaaaataca

SEQ ID NO: 1928691 - DNA, 18 bp, Homo sapiens
gattcccggctggacttt

SEQ ID NO: 1928692 - DNA, 19 bp, Homo sapiens
gattctaaaggggacagat

SEQ ID NO: 1928693 - DNA, 13 bp, Homo sapiens
gattctcctctcc

SEQ ID NO: 1928694 - DNA, 20 bp, Homo sapiens
gattctttcccaattcacat

SEQ ID NO: 1928695 - DNA, 19 bp, Homo sapiens
gattgaagtatctgtacct

SEQ ID NO: 1928696 - DNA, 16 bp, Homo sapiens
gattgagtctgtgcca

SEQ ID NO: 1928697 - DNA, 19 bp, Homo sapiens
gattgatagagtgttatca

SEQ ID NO: 1928698 - DNA, 20 bp, Homo sapiens
gattgccatttcttcccaag

SEQ ID NO: 1928699 - DNA, 20 bp, Homo sapiens
gattgctgccccatcagtgc

SEQ ID NO: 1928700 - DNA, 14 bp, Homo sapiens
gattggtaccagag

SEQ ID NO: 1928701 - DNA, 15 bp, Homo sapiens
gatttcactgacact

SEQ ID NO: 1928702 - DNA, 21 bp, Homo sapiens
gatttcatttcaactgtttgc

SEQ ID NO: 1928703 - DNA, 23 bp, Homo sapiens
gatttccacctttatgttttaat

SEQ ID NO: 1928704 - DNA, 15 bp, Homo sapiens
gatttgaaacttggt

SEQ ID NO: 1928705 - DNA, 19 bp, Homo sapiens
gatttgaaacttggtgtgt

SEQ ID NO: 1928706 - DNA, 11 bp, Homo sapiens
gcaaaaatatt

SEQ ID NO: 1928707 - DNA, 20 bp, Homo sapiens
gcaaacactttggccacagc

SEQ ID NO: 1928708 - DNA, 19 bp, Homo sapiens
gcaaacccatcaacaaaaa

SEQ ID NO: 1928709 - DNA, 23 bp, Homo sapiens
gcaaagaaaagaactgcttgcat

SEQ ID NO: 1928710 - DNA, 20 bp, Homo sapiens
gcaaaggggtcccatagagg

SEQ ID NO: 1928711 - DNA, 16 bp, Homo sapiens
gcaaatccgaaatcag

SEQ ID NO: 1928712 - DNA, 15 bp, Homo sapiens
gcaacaaaggatttg

SEQ ID NO: 1928713 - DNA, 11 bp, Homo sapiens
gcaacagcctg

SEQ ID NO: 1928714 - DNA, 23 bp, Homo sapiens
gcaacaggttgaggctaaaacaa

SEQ ID NO: 1928715 - DNA, 17 bp, Homo sapiens
gcaacagtagcatagga

SEQ ID NO: 1928716 - DNA, 14 bp, Homo sapiens
gcaacttcccaggc

SEQ ID NO: 1928717 - DNA, 19 bp, Homo sapiens
gcaagacaccttcccagct

SEQ ID NO: 1928718 - DNA, 17 bp, Homo sapiens
gcaagagatgagaaaca

SEQ ID NO: 1928719 - DNA, 14 bp, Homo sapiens
gcaagagctcagga

SEQ ID NO: 1928720 - DNA, 18 bp, Homo sapiens
gcaagcaagaaacactgg

SEQ ID NO: 1928721 - DNA, 21 bp, Homo sapiens
gcaagcactgcatgggcaagc

SEQ ID NO: 1928722 - DNA, 13 bp, Homo sapiens
gcaagccacagaa

SEQ ID NO: 1928723 - DNA, 19 bp, Homo sapiens
gcaagcgacacaggctgcc

SEQ ID NO: 1928724 - DNA, 13 bp, Homo sapiens
gcaagctggcagg

SEQ ID NO: 1928725 - DNA, 15 bp, Homo sapiens
gcaagctggcaggag

SEQ ID NO: 1928726 - DNA, 16 bp, Homo sapiens
gcaaggcaagaagtgg

SEQ ID NO: 1928727 - DNA, 19 bp, Homo sapiens
gcaaggcaagaagtgggat

SEQ ID NO: 1928728 - DNA, 18 bp, Homo sapiens
gcaagtccatagctgagc

SEQ ID NO: 1928729 - DNA, 20 bp, Homo sapiens
gcaagtccatagctgagctg

SEQ ID NO: 1928730 - DNA, 23 bp, Homo sapiens
gcaagtcccagggagctctgcat

SEQ ID NO: 1928731 - DNA, 15 bp, Homo sapiens
gcaatgccatcatct

SEQ ID NO: 1928732 - DNA, 13 bp, Homo sapiens
gcacacacactct

SEQ ID NO: 1928733 - DNA, 14 bp, Homo sapiens
gcacactttgccat

SEQ ID NO: 1928734 - DNA, 22 bp, Homo sapiens
gcacactttgccatattttcac

SEQ ID NO: 1928735 - DNA, 21 bp, Homo sapiens
gcacagcaggtttatccagat

SEQ ID NO: 1928736 - DNA, 19 bp, Homo sapiens
gcacagtgcatctcagccc

SEQ ID NO: 1928737 - DNA, 15 bp, Homo sapiens
gcaccaagcaggaaa

SEQ ID NO: 1928738 - DNA, 22 bp, Homo sapiens
gcaccctctgctatgtctgtga

SEQ ID NO: 1928739 - DNA, 23 bp, Homo sapiens
gcacctataaatactaaatatga

SEQ ID NO: 1928740 - DNA, 13 bp, Homo sapiens
gcacctcattcca

SEQ ID NO: 1928741 - DNA, 14 bp, Homo sapiens
gcactggaaaacat

SEQ ID NO: 1928742 - DNA, 21 bp, Homo sapiens
gcactgggccggcagcctggt

SEQ ID NO: 1928743 - DNA, 15 bp, Homo sapiens
gcactgtcatgccca

SEQ ID NO: 1928744 - DNA, 15 bp, Homo sapiens
gcactgttccccctg

SEQ ID NO: 1928745 - DNA, 15 bp, Homo sapiens
gcactttgaaaatat

SEQ ID NO: 1928746 - DNA, 21 bp, Homo sapiens
gcactttgaaaatatttctat

SEQ ID NO: 1928747 - DNA, 21 bp, Homo sapiens
gcagaaccagctctttggtgc

SEQ ID NO: 1928748 - DNA, 19 bp, Homo sapiens
gcagaatggtgggctccag

SEQ ID NO: 1928749 - DNA, 20 bp, Homo sapiens
gcagagattgggggggcttg

SEQ ID NO: 1928750 - DNA, 16 bp, Homo sapiens
gcagagcccaagggaa

SEQ ID NO: 1928751 - DNA, 18 bp, Homo sapiens
gcagaggggagaggaagc

SEQ ID NO: 1928752 - DNA, 15 bp, Homo sapiens
gcagagtaaaattac

SEQ ID NO: 1928753 - DNA, 18 bp, Homo sapiens
gcagatatgtattacttt

SEQ ID NO: 1928754 - DNA, 15 bp, Homo sapiens
gcagatgacccctcc

SEQ ID NO: 1928755 - DNA, 16 bp, Homo sapiens
gcagatgacccctccc

SEQ ID NO: 1928756 - DNA, 14 bp, Homo sapiens
gcagattggagaaa

SEQ ID NO: 1928757 - DNA, 20 bp, Homo sapiens
gcagcagggctaccctgagc

SEQ ID NO: 1928758 - DNA, 15 bp, Homo sapiens
gcagcagtgtgaggc

SEQ ID NO: 1928759 - DNA, 22 bp, Homo sapiens
gcagcagtgtgaggccagggca

SEQ ID NO: 1928760 - DNA, 14 bp, Homo sapiens
gcagcccctcccca

SEQ ID NO: 1928761 - DNA, 24 bp, Homo sapiens
gcagccctgctttgggctgccctg

SEQ ID NO: 1928762 - DNA, 15 bp, Homo sapiens
gcagccgtgccttca

SEQ ID NO: 1928763 - DNA, 23 bp, Homo sapiens
gcagcctggttccctctttcctg

SEQ ID NO: 1928764 - DNA, 16 bp, Homo sapiens
gcagcctgtgggagaa

SEQ ID NO: 1928765 - DNA, 18 bp, Homo sapiens
gcagcctgtgggagaagg

SEQ ID NO: 1928766 - DNA, 21 bp, Homo sapiens
gcagctccggaaggacacagt

SEQ ID NO: 1928767 - DNA, 21 bp, Homo sapiens
gcagctggatggggcggcctg

SEQ ID NO: 1928768 - DNA, 22 bp, Homo sapiens
gcagctgggcactgggccggca

SEQ ID NO: 1928769 - DNA, 23 bp, Homo sapiens
gcagcttccttccaagtcttcct

SEQ ID NO: 1928770 - DNA, 18 bp, Homo sapiens
gcccctccttctcccctc

SEQ ID NO: 1928771 - DNA, 23 bp, Homo sapiens
gcccctctctgtttaccctccct

SEQ ID NO: 1928772 - DNA, 22 bp, Homo sapiens
gcccctgttacctaattagagc

SEQ ID NO: 1928773 - DNA, 17 bp, Homo sapiens
gccccttccccctccaa

SEQ ID NO: 1928774 - DNA, 12 bp, Homo sapiens
gcccgacagcct

SEQ ID NO: 1928775 - DNA, 20 bp, Homo sapiens
gcccggagatgcatctgtgg

SEQ ID NO: 1928776 - DNA, 14 bp, Homo sapiens
gccctcactccact

SEQ ID NO: 1928777 - DNA, 16 bp, Homo sapiens
gccctcactccactcc

SEQ ID NO: 1928778 - DNA, 21 bp, Homo sapiens
gccctcactccactcccctca

SEQ ID NO: 1928779 - DNA, 21 bp, Homo sapiens
gccctctctgcagtcctcggc

SEQ ID NO: 1928780 - DNA, 22 bp, Homo sapiens
gccctctctgcagtcctcggca

SEQ ID NO: 1928781 - DNA, 23 bp, Homo sapiens
gccctctgcccccagctgctcct

SEQ ID NO: 1928782 - DNA, 21 bp, Homo sapiens
gccctgcaaaaggactctcag

SEQ ID NO: 1928783 - DNA, 15 bp, Homo sapiens
gccctgcaagggcgt

SEQ ID NO: 1928784 - DNA, 13 bp, Homo sapiens
gccctgccctcac

SEQ ID NO: 1928785 - DNA, 18 bp, Homo sapiens
gccctgccctcactccac

SEQ ID NO: 1928786 - DNA, 19 bp, Homo sapiens
gccctgccctcactccact

SEQ ID NO: 1928787 - DNA, 23 bp, Homo sapiens
gccctgctgtcagaccttcttcc

SEQ ID NO: 1928788 - DNA, 16 bp, Homo sapiens
gccctgctttgggctg

SEQ ID NO: 1928789 - DNA, 18 bp, Homo sapiens
gccctgctttgggctgcc

SEQ ID NO: 1928790 - DNA, 23 bp, Homo sapiens
gccctgctttgggctgccctggt

SEQ ID NO: 1928791 - DNA, 23 bp, Homo sapiens
gccctgttgtgggggtgtcacag

SEQ ID NO: 1928792 - DNA, 15 bp, Homo sapiens
gcccttcctctccac

SEQ ID NO: 1928793 - DNA, 16 bp, Homo sapiens
gcccttcctctccact

SEQ ID NO: 1928794 - DNA, 20 bp, Homo sapiens
gcccttcctctccactgcct

SEQ ID NO: 1928795 - DNA, 19 bp, Homo sapiens
gccgaggaagggcccccgg

SEQ ID NO: 1928796 - DNA, 17 bp, Homo sapiens
gccgcaacttcccaggc

SEQ ID NO: 1928797 - DNA, 18 bp, Homo sapiens
gccgcaacttcccaggcc

SEQ ID NO: 1928798 - DNA, 15 bp, Homo sapiens
gccgctgagcgagga

SEQ ID NO: 1928799 - DNA, 13 bp, Homo sapiens
gccgctgggagag

SEQ ID NO: 1928800 - DNA, 15 bp, Homo sapiens
gccgctgggagagcc

SEQ ID NO: 1928801 - DNA, 14 bp, Homo sapiens
gccggcagcctggt

SEQ ID NO: 1928802 - DNA, 16 bp, Homo sapiens
gccggcccacgtcctg

SEQ ID NO: 1928803 - DNA, 18 bp, Homo sapiens
gccggcccacgtcctggg

SEQ ID NO: 1928804 - DNA, 14 bp, Homo sapiens
gccgggggtggggg

SEQ ID NO: 1928805 - DNA, 19 bp, Homo sapiens
gccgtgccttcagctctac

SEQ ID NO: 1928806 - DNA, 15 bp, Homo sapiens
gccgtggctgcggca

SEQ ID NO: 1928807 - DNA, 12 bp, Homo sapiens
gccgtggcttcc

SEQ ID NO: 1928808 - DNA, 14 bp, Homo sapiens
gcctagtaggagct

SEQ ID NO: 1928809 - DNA, 22 bp, Homo sapiens
gcctagtgaaggcttctctctg

SEQ ID NO: 1928810 - DNA, 19 bp, Homo sapiens
gcctagtggggaggggcct

SEQ ID NO: 1928811 - DNA, 21 bp, Homo sapiens
gcctagtggggaggggcctgg

SEQ ID NO: 1928812 - DNA, 16 bp, Homo sapiens
gcctatgccacctgca

SEQ ID NO: 1928813 - DNA, 17 bp, Homo sapiens
gcctatgccacctgcag

SEQ ID NO: 1928814 - DNA, 15 bp, Homo sapiens
gcctatggaaagggt

SEQ ID NO: 1928815 - DNA, 20 bp, Homo sapiens
gcctatggaaagggtgtggc

SEQ ID NO: 1928816 - DNA, 22 bp, Homo sapiens
gcctatggaaagggtgtggctt

SEQ ID NO: 1928817 - DNA, 22 bp, Homo sapiens
gcctatgtgcatgcagcatcta

SEQ ID NO: 1928818 - DNA, 16 bp, Homo sapiens
gcctccctggtccctt

SEQ ID NO: 1928819 - DNA, 20 bp, Homo sapiens
gcctctgagccaggagcctc

SEQ ID NO: 1928820 - DNA, 12 bp, Homo sapiens
gcctctgtcctg

SEQ ID NO: 1928821 - DNA, 14 bp, Homo sapiens
ggcagcctgtggga

SEQ ID NO: 1928822 - DNA, 16 bp, Homo sapiens
ggcagcctgtgggaga

SEQ ID NO: 1928823 - DNA, 23 bp, Homo sapiens
ggcagcgcccagcctggccccaa

SEQ ID NO: 1928824 - DNA, 14 bp, Homo sapiens
ggcagcgctcctgg

SEQ ID NO: 1928825 - DNA, 13 bp, Homo sapiens
ggcagctctgtcg

SEQ ID NO: 1928826 - DNA, 14 bp, Homo sapiens
ggcaggaaggctga

SEQ ID NO: 1928827 - DNA, 16 bp, Homo sapiens
ggcagggccccaggca

SEQ ID NO: 1928828 - DNA, 14 bp, Homo sapiens
ggcagggcctggcc

SEQ ID NO: 1928829 - DNA, 15 bp, Homo sapiens
ggcagggcctggcct

SEQ ID NO: 1928830 - DNA, 16 bp, Homo sapiens
ggcagggcctggcctg

SEQ ID NO: 1928831 - DNA, 14 bp, Homo sapiens
ggcaggggctgggc

SEQ ID NO: 1928832 - DNA, 18 bp, Homo sapiens
ggcaggtcccgagccccc

SEQ ID NO: 1928833 - DNA, 19 bp, Homo sapiens
ggcaggtcccgagccccct

SEQ ID NO: 1928834 - DNA, 18 bp, Homo sapiens
ggcagtcacactgctggg

SEQ ID NO: 1928835 - DNA, 14 bp, Homo sapiens
ggcagtggagaggg

SEQ ID NO: 1928836 - DNA, 16 bp, Homo sapiens
ggcatcaaagatgaga

SEQ ID NO: 1928837 - DNA, 16 bp, Homo sapiens
ggcatctctggagtgt

SEQ ID NO: 1928838 - DNA, 16 bp, Homo sapiens
ggcatgagggctgaga

SEQ ID NO: 1928839 - DNA, 24 bp, Homo sapiens
ggcatgcgaatgagctgggccctg

SEQ ID NO: 1928840 - DNA, 18 bp, Homo sapiens
ggcatggcccagcctgga

SEQ ID NO: 1928841 - DNA, 14 bp, Homo sapiens
ggccacagccccaa

SEQ ID NO: 1928842 - DNA, 20 bp, Homo sapiens
ggccacatccaacatttcct

SEQ ID NO: 1928843 - DNA, 21 bp, Homo sapiens
ggccacccccacctccctgca

SEQ ID NO: 1928844 - DNA, 17 bp, Homo sapiens
ggccactccagacccct

SEQ ID NO: 1928845 - DNA, 14 bp, Homo sapiens
ggccactggcatct

SEQ ID NO: 1928846 - DNA, 22 bp, Homo sapiens
ggccactggcatctctggagtg

SEQ ID NO: 1928847 - DNA, 19 bp, Homo sapiens
ggccactttgcagacctgg

SEQ ID NO: 1928848 - DNA, 22 bp, Homo sapiens
ggccactttgcagacctgggac

SEQ ID NO: 1928849 - DNA, 22 bp, Homo sapiens
ggccaggagtgggtttccctgc

SEQ ID NO: 1928850 - DNA, 16 bp, Homo sapiens
ggccaggcatggccca

SEQ ID NO: 1928851 - DNA, 13 bp, Homo sapiens
ggccagggcagag

SEQ ID NO: 1928852 - DNA, 14 bp, Homo sapiens
ggccagtaaaagta

SEQ ID NO: 1928853 - DNA, 18 bp, Homo sapiens
ggccagtctgaacctgag

SEQ ID NO: 1928854 - DNA, 15 bp, Homo sapiens
ggccatctgtaaata

SEQ ID NO: 1928855 - DNA, 23 bp, Homo sapiens
ggcccacccctcttcccccttcc

SEQ ID NO: 1928856 - DNA, 16 bp, Homo sapiens
ggcccacgtcctgggt

SEQ ID NO: 1928857 - DNA, 22 bp, Homo sapiens
ggccccaggcattgccaagggc

SEQ ID NO: 1928858 - DNA, 14 bp, Homo sapiens
ggcccccgccctct

SEQ ID NO: 1928859 - DNA, 11 bp, Homo sapiens
ggcccctcctt

SEQ ID NO: 1928860 - DNA, 23 bp, Homo sapiens
ggcccctccttctcccctccaga

SEQ ID NO: 1928861 - DNA, 16 bp, Homo sapiens
ggcccgacagcctggc

SEQ ID NO: 1928862 - DNA, 18 bp, Homo sapiens
ggcccggaagttgctgtg

SEQ ID NO: 1928863 - DNA, 24 bp, Homo sapiens
ggcccggagatgcatctgtggcct

SEQ ID NO: 1928864 - DNA, 14 bp, Homo sapiens
ggccctctctgcag

SEQ ID NO: 1928865 - DNA, 15 bp, Homo sapiens
ggccctctctgcagt

SEQ ID NO: 1928866 - DNA, 17 bp, Homo sapiens
ggccctgcaagggcgtg

SEQ ID NO: 1928867 - DNA, 13 bp, Homo sapiens
ggccctggctccc

SEQ ID NO: 1928868 - DNA, 22 bp, Homo sapiens
ggccctggctcccacaggccct

SEQ ID NO: 1928869 - DNA, 17 bp, Homo sapiens
ggccctgttgtgggggt

SEQ ID NO: 1928870 - DNA, 13 bp, Homo sapiens
ggcccttcctctc

SEQ ID NO: 1928871 - DNA, 17 bp, Homo sapiens
ggcccttcctctccact

SEQ ID NO: 1928872 - DNA, 19 bp, Homo sapiens
ggcccttcctctccactgc

SEQ ID NO: 1928873 - DNA, 13 bp, Homo sapiens
ggccgaggcaggg

SEQ ID NO: 1928874 - DNA, 22 bp, Homo sapiens
ggccgaggcaggggctgggcag

SEQ ID NO: 1928875 - DNA, 21 bp, Homo sapiens
ggccgagggcttccctagatg

SEQ ID NO: 1928876 - DNA, 16 bp, Homo sapiens
ggccgcaacttcccag

SEQ ID NO: 1928877 - DNA, 19 bp, Homo sapiens
ggccgcaacttcccaggcc

SEQ ID NO: 1928878 - DNA, 13 bp, Homo sapiens
ggccgcctgtcct

SEQ ID NO: 1928879 - DNA, 16 bp, Homo sapiens
ggccgctgctgtgaca

SEQ ID NO: 1928880 - DNA, 21 bp, Homo sapiens
ggccggcccacgtcctgggtg

SEQ ID NO: 1928881 - DNA, 16 bp, Homo sapiens
ggccgtggctgcccac

SEQ ID NO: 1928882 - DNA, 18 bp, Homo sapiens
ggcctatgccacctgcag

SEQ ID NO: 1928883 - DNA, 19 bp, Homo sapiens
ggcctgagttgaggggctt

SEQ ID NO: 1928884 - DNA, 18 bp, Homo sapiens
ggcctgcagaccctgcca

SEQ ID NO: 1928885 - DNA, 23 bp, Homo sapiens
ggcctgccccccttcccacccct

SEQ ID NO: 1928886 - DNA, 12 bp, Homo sapiens
ggcctgctgtgg

SEQ ID NO: 1928887 - DNA, 15 bp, Homo sapiens
ggcctgctgtgggtc

SEQ ID NO: 1928888 - DNA, 14 bp, Homo sapiens
ggcctggcagccgt

SEQ ID NO: 1928889 - DNA, 13 bp, Homo sapiens
ggcctggcctggg

SEQ ID NO: 1928890 - DNA, 13 bp, Homo sapiens
ggcctggcctggt

SEQ ID NO: 1928891 - DNA, 20 bp, Homo sapiens
ggcctgggtggggcagggcc

SEQ ID NO: 1928892 - DNA, 14 bp, Homo sapiens
ggcctggtctggag

SEQ ID NO: 1928893 - DNA, 18 bp, Homo sapiens
ggccttggttcctccagc

SEQ ID NO: 1928894 - DNA, 13 bp, Homo sapiens
ggcgcctctgtcc

SEQ ID NO: 1928895 - DNA, 17 bp, Homo sapiens
ggcgcctctgtcctggc

SEQ ID NO: 1928896 - DNA, 22 bp, Homo sapiens
ggcggtcaataattgtggagag

SEQ ID NO: 1928897 - DNA, 16 bp, Homo sapiens
ggcggtcactgcccac

SEQ ID NO: 1928898 - DNA, 15 bp, Homo sapiens
ggcgtgaggatggga

SEQ ID NO: 1928899 - DNA, 18 bp, Homo sapiens
ggcgtgggatccagagag

SEQ ID NO: 1928900 - DNA, 17 bp, Homo sapiens
ggctccagggccagggt

SEQ ID NO: 1928901 - DNA, 13 bp, Homo sapiens
ggctccattccca

SEQ ID NO: 1928902 - DNA, 17 bp, Homo sapiens
ggctcccacaggccctt

SEQ ID NO: 1928903 - DNA, 21 bp, Homo sapiens
ggctcccacaggcccttcctc

SEQ ID NO: 1928904 - DNA, 21 bp, Homo sapiens
ggctctctggacctgaccaga

SEQ ID NO: 1928905 - DNA, 16 bp, Homo sapiens
ggctctgaaagctgct

SEQ ID NO: 1928906 - DNA, 23 bp, Homo sapiens
ggctctgaaagctgcttctgggg

SEQ ID NO: 1928907 - DNA, 12 bp, Homo sapiens
ggctcttcctgg

SEQ ID NO: 1928908 - DNA, 20 bp, Homo sapiens
ggctgcccacacaccccaat

SEQ ID NO: 1928909 - DNA, 12 bp, Homo sapiens
ggctgccctggt

SEQ ID NO: 1928910 - DNA, 14 bp, Homo sapiens
ggctgccctggtgc

SEQ ID NO: 1928911 - DNA, 10 bp, Homo sapiens
ggctggaaga

SEQ ID NO: 1928912 - DNA, 15 bp, Homo sapiens
ggctggaccacgtct

SEQ ID NO: 1928913 - DNA, 22 bp, Homo sapiens
ggctggacttttgcagcttcct

SEQ ID NO: 1928914 - DNA, 18 bp, Homo sapiens
ggctggcggggtctgctc

SEQ ID NO: 1928915 - DNA, 13 bp, Homo sapiens
ggctgggcagagg

SEQ ID NO: 1928916 - DNA, 16 bp, Homo sapiens
ggctgggcagagggga

SEQ ID NO: 1928917 - DNA, 18 bp, Homo sapiens
ggctgggcagaggggaga

SEQ ID NO: 1928918 - DNA, 13 bp, Homo sapiens
ggctgggcagctg

SEQ ID NO: 1928919 - DNA, 14 bp, Homo sapiens
ggctgggcgcctct

SEQ ID NO: 1928920 - DNA, 22 bp, Homo sapiens
ggctgggcgcctctgtcctggc

SEQ ID NO: 1928921 - DNA, 19 bp, Homo sapiens
ggctgggtttgggcagtgg

SEQ ID NO: 1928922 - DNA, 15 bp, Homo sapiens
ggctgtagaaggaga

SEQ ID NO: 1928923 - DNA, 18 bp, Homo sapiens
ggctgtcagcaggaagca

SEQ ID NO: 1928924 - DNA, 13 bp, Homo sapiens
ggctgtggcccct

SEQ ID NO: 1928925 - DNA, 21 bp, Homo sapiens
ggctgtggcccctccttctcc

SEQ ID NO: 1928926 - DNA, 22 bp, Homo sapiens
ggctgttttaacggcctgcatc

SEQ ID NO: 1928927 - DNA, 20 bp, Homo sapiens
ggcttcaatctacgatgtta

SEQ ID NO: 1928928 - DNA, 14 bp, Homo sapiens
ggcttcccgctcag

SEQ ID NO: 1928929 - DNA, 17 bp, Homo sapiens
ggcttcccgctcagccc

SEQ ID NO: 1928930 - DNA, 17 bp, Homo sapiens
ggcttctgggacttgaa

SEQ ID NO: 1928931 - DNA, 23 bp, Homo sapiens
gggacaagccaggccctctctgc

SEQ ID NO: 1928932 - DNA, 16 bp, Homo sapiens
gggacaatggcaatag

SEQ ID NO: 1928933 - DNA, 13 bp, Homo sapiens
gggacagagcaga

SEQ ID NO: 1928934 - DNA, 20 bp, Homo sapiens
gggacatggtgtgccacagg

SEQ ID NO: 1928935 - DNA, 21 bp, Homo sapiens
gggacatggtgtgccacaggc

SEQ ID NO: 1928936 - DNA, 15 bp, Homo sapiens
gggactggcccaccc

SEQ ID NO: 1928937 - DNA, 14 bp, Homo sapiens
gggagaaggagagg

SEQ ID NO: 1928938 - DNA, 14 bp, Homo sapiens
gggagatgcagctg

SEQ ID NO: 1928939 - DNA, 13 bp, Homo sapiens
gggagccacaggg

SEQ ID NO: 1928940 - DNA, 19 bp, Homo sapiens
gggagccgcaggggcccct

SEQ ID NO: 1928941 - DNA, 20 bp, Homo sapiens
gggaggccgaggcaggggct

SEQ ID NO: 1928942 - DNA, 10 bp, Homo sapiens
gggagtagga

SEQ ID NO: 1928943 - DNA, 12 bp, Homo sapiens
gggagtgggaga

SEQ ID NO: 1928944 - DNA, 13 bp, Homo sapiens
gggagtgggagag

SEQ ID NO: 1928945 - DNA, 15 bp, Homo sapiens
gggagtgggagagga

SEQ ID NO: 1928946 - DNA, 17 bp, Homo sapiens
gggagtgggagaggaag

SEQ ID NO: 1928947 - DNA, 16 bp, Homo sapiens
gggatagcactgagca

SEQ ID NO: 1928948 - DNA, 20 bp, Homo sapiens
gggatccaccgccacactgg

SEQ ID NO: 1928949 - DNA, 16 bp, Homo sapiens
gggatccagagagaag

SEQ ID NO: 1928950 - DNA, 19 bp, Homo sapiens
gggatcttacccacttccc

SEQ ID NO: 1928951 - DNA, 14 bp, Homo sapiens
gggcaaagcctagt

SEQ ID NO: 1928952 - DNA, 17 bp, Homo sapiens
gggcactggaaaacata

SEQ ID NO: 1928953 - DNA, 16 bp, Homo sapiens
gggcactggtggcccg

SEQ ID NO: 1928954 - DNA, 22 bp, Homo sapiens
gggcactgtcatgcccagcttg

SEQ ID NO: 1928955 - DNA, 12 bp, Homo sapiens
gggcagagggga

SEQ ID NO: 1928956 - DNA, 14 bp, Homo sapiens
gggcagaggggaga

SEQ ID NO: 1928957 - DNA, 16 bp, Homo sapiens
gggcagcacagagagg

SEQ ID NO: 1928958 - DNA, 18 bp, Homo sapiens
gggcagcctgtgggagaa

SEQ ID NO: 1928959 - DNA, 14 bp, Homo sapiens
ggagaaggagaggc

SEQ ID NO: 1928960 - DNA, 17 bp, Homo sapiens
ggagaaggcctgccccc

SEQ ID NO: 1928961 - DNA, 16 bp, Homo sapiens
ggagaatggctctggc

SEQ ID NO: 1928962 - DNA, 22 bp, Homo sapiens
ggagagaatgagagagtgtgga

SEQ ID NO: 1928963 - DNA, 13 bp, Homo sapiens
ggagaggagagaa

SEQ ID NO: 1928964 - DNA, 17 bp, Homo sapiens
ggagaggagagaatgag

SEQ ID NO: 1928965 - DNA, 17 bp, Homo sapiens
ggagaggagaggctgct

SEQ ID NO: 1928966 - DNA, 18 bp, Homo sapiens
ggagaggtcttttttaaa

SEQ ID NO: 1928967 - DNA, 14 bp, Homo sapiens
ggagatgcagctgg

SEQ ID NO: 1928968 - DNA, 22 bp, Homo sapiens
ggagatgcatctgtggcctggg

SEQ ID NO: 1928969 - DNA, 15 bp, Homo sapiens
ggagatgctccttgg

SEQ ID NO: 1928970 - DNA, 12 bp, Homo sapiens
ggagcagagggg

SEQ ID NO: 1928971 - DNA, 21 bp, Homo sapiens
ggagcagctgggcactgggcc

SEQ ID NO: 1928972 - DNA, 14 bp, Homo sapiens
ggagcatacccagt

SEQ ID NO: 1928973 - DNA, 19 bp, Homo sapiens
ggagccactcctctgactc

SEQ ID NO: 1928974 - DNA, 20 bp, Homo sapiens
ggagcttcatggcagaaggc

SEQ ID NO: 1928975 - DNA, 13 bp, Homo sapiens
ggagcttccagat

SEQ ID NO: 1928976 - DNA, 14 bp, Homo sapiens
ggagcttccagatg

SEQ ID NO: 1928977 - DNA, 17 bp, Homo sapiens
ggaggattctatgaggc

SEQ ID NO: 1928978 - DNA, 10 bp, Homo sapiens
ggaggcaggt

SEQ ID NO: 1928979 - DNA, 18 bp, Homo sapiens
ggaggccacgggggaggc

SEQ ID NO: 1928980 - DNA, 15 bp, Homo sapiens
ggaggccgaggcagg

SEQ ID NO: 1928981 - DNA, 15 bp, Homo sapiens
ggaggctccagaggg

SEQ ID NO: 1928982 - DNA, 18 bp, Homo sapiens
ggaggctccagagggcac

SEQ ID NO: 1928983 - DNA, 21 bp, Homo sapiens
ggaggggcctggcagccgtgc

SEQ ID NO: 1928984 - DNA, 14 bp, Homo sapiens
ggaggggcctggcc

SEQ ID NO: 1928985 - DNA, 15 bp, Homo sapiens
ggagggtcaggaagg

SEQ ID NO: 1928986 - DNA, 17 bp, Homo sapiens
ggagtctgaaggagagg

SEQ ID NO: 1928987 - DNA, 19 bp, Homo sapiens
ggagtctgaaggagaggag

SEQ ID NO: 1928988 - DNA, 21 bp, Homo sapiens
ggagtgactctggctgccaag

SEQ ID NO: 1928989 - DNA, 22 bp, Homo sapiens
ggagtgactctggctgccaaga

SEQ ID NO: 1928990 - DNA, 17 bp, Homo sapiens
ggagtggaggggtcagc

SEQ ID NO: 1928991 - DNA, 17 bp, Homo sapiens
ggagtgggagaggaagc

SEQ ID NO: 1928992 - DNA, 13 bp, Homo sapiens
ggagtgtgtgggg

SEQ ID NO: 1928993 - DNA, 15 bp, Homo sapiens
ggagtgtgtgggggt

SEQ ID NO: 1928994 - DNA, 23 bp, Homo sapiens
ggagttgatcgcctttcccaggt

SEQ ID NO: 1928995 - DNA, 13 bp, Homo sapiens
ggagttttgttta

SEQ ID NO: 1928996 - DNA, 18 bp, Homo sapiens
ggataggagcttccagat

SEQ ID NO: 1928997 - DNA, 20 bp, Homo sapiens
ggatcaagcttgtgtacttg

SEQ ID NO: 1928998 - DNA, 20 bp, Homo sapiens
ggatccctttcactatgtcc

SEQ ID NO: 1928999 - DNA, 24 bp, Homo sapiens
ggatctcattggacccttccatgg

SEQ ID NO: 1929000 - DNA, 22 bp, Homo sapiens
ggatctggagtctgaaggagag

SEQ ID NO: 1929001 - DNA, 21 bp, Homo sapiens
ggatgagaatttgagtgctct

SEQ ID NO: 1929002 - DNA, 16 bp, Homo sapiens
ggatgcagagtcagca

SEQ ID NO: 1929003 - DNA, 15 bp, Homo sapiens
ggatgggaaggaggg

SEQ ID NO: 1929004 - DNA, 19 bp, Homo sapiens
ggatggggcggcctgcaga

SEQ ID NO: 1929005 - DNA, 20 bp, Homo sapiens
ggatttcatgatttcatttc

SEQ ID NO: 1929006 - DNA, 13 bp, Homo sapiens
ggcaaaccaggct

SEQ ID NO: 1929007 - DNA, 19 bp, Homo sapiens
ggcaaaccaggctgcaggt

SEQ ID NO: 1929008 - DNA, 13 bp, Homo sapiens
ggcaaacccatca

SEQ ID NO: 1929009 - DNA, 22 bp, Homo sapiens
ggcaaagcacgaaatgttattt

SEQ ID NO: 1929010 - DNA, 17 bp, Homo sapiens
ggcaaatccgaaatcag

SEQ ID NO: 1929011 - DNA, 21 bp, Homo sapiens
ggcaaccacaggcagcattta

SEQ ID NO: 1929012 - DNA, 15 bp, Homo sapiens
ggcaagctggcagga

SEQ ID NO: 1929013 - DNA, 16 bp, Homo sapiens
ggcaattcttcttctc

SEQ ID NO: 1929014 - DNA, 16 bp, Homo sapiens
ggcactggaaaacata

SEQ ID NO: 1929015 - DNA, 21 bp, Homo sapiens
ggcactgggccggcagcctgg

SEQ ID NO: 1929016 - DNA, 20 bp, Homo sapiens
ggcactgtcatgcccagctt

SEQ ID NO: 1929017 - DNA, 15 bp, Homo sapiens
ggcagaatggtgggc

SEQ ID NO: 1929018 - DNA, 23 bp, Homo sapiens
ggcagagattgggggggcttggg

SEQ ID NO: 1929019 - DNA, 12 bp, Homo sapiens
ggcagagcccaa

SEQ ID NO: 1929020 - DNA, 16 bp, Homo sapiens
ggcagagcccaaggga

SEQ ID NO: 1929021 - DNA, 13 bp, Homo sapiens
ggcagaggggaga

SEQ ID NO: 1929022 - DNA, 17 bp, Homo sapiens
ggcagaggggagaggaa

SEQ ID NO: 1929023 - DNA, 13 bp, Homo sapiens
ggcagcagggcta

SEQ ID NO: 1929024 - DNA, 13 bp, Homo sapiens
ggcagcagtgtga

SEQ ID NO: 1929025 - DNA, 12 bp, Homo sapiens
ggcagcccctcc

SEQ ID NO: 1929026 - DNA, 19 bp, Homo sapiens
ggcagccgtgccttcagct

SEQ ID NO: 1929027 - DNA, 22 bp, Homo sapiens
ggcagccgtgccttcagctcta

SEQ ID NO: 1929028 - DNA, 11 bp, Homo sapiens
ggcagcctggt

SEQ ID NO: 1929029 - DNA, 19 bp, Homo sapiens
gggcagtggagaggggact

SEQ ID NO: 1929030 - DNA, 17 bp, Homo sapiens
gggcatggccaggtggc

SEQ ID NO: 1929031 - DNA, 24 bp, Homo sapiens
gggccaagccagggttccagacag

SEQ ID NO: 1929032 - DNA, 15 bp, Homo sapiens
gggccacctccccag

SEQ ID NO: 1929033 - DNA, 16 bp, Homo sapiens
gggccacctccccagg

SEQ ID NO: 1929034 - DNA, 21 bp, Homo sapiens
gggccactggcatctctggag

SEQ ID NO: 1929035 - DNA, 16 bp, Homo sapiens
gggcccctcctccaga

SEQ ID NO: 1929036 - DNA, 22 bp, Homo sapiens
gggcccctcctccagagcctgg

SEQ ID NO: 1929037 - DNA, 16 bp, Homo sapiens
gggccggcagcctggt

SEQ ID NO: 1929038 - DNA, 21 bp, Homo sapiens
gggcgcaagcgacacaggctg

SEQ ID NO: 1929039 - DNA, 15 bp, Homo sapiens
gggcgctgagggcag

SEQ ID NO: 1929040 - DNA, 14 bp, Homo sapiens
gggcggcagagagg

SEQ ID NO: 1929041 - DNA, 22 bp, Homo sapiens
gggcggtcaataattgtggaga

SEQ ID NO: 1929042 - DNA, 16 bp, Homo sapiens
gggcgtgacttcagac

SEQ ID NO: 1929043 - DNA, 13 bp, Homo sapiens
gggctaccctgag

SEQ ID NO: 1929044 - DNA, 16 bp, Homo sapiens
gggctaccctgagctg

SEQ ID NO: 1929045 - DNA, 22 bp, Homo sapiens
gggctaccctgagctgaggcag

SEQ ID NO: 1929046 - DNA, 14 bp, Homo sapiens
gggctccctgactg

SEQ ID NO: 1929047 - DNA, 18 bp, Homo sapiens
gggctccctgactgggag

SEQ ID NO: 1929048 - DNA, 21 bp, Homo sapiens
gggctccctgtaacctcttca

SEQ ID NO: 1929049 - DNA, 15 bp, Homo sapiens
gggctctctggacct

SEQ ID NO: 1929050 - DNA, 14 bp, Homo sapiens
gggctgagggagcc

SEQ ID NO: 1929051 - DNA, 15 bp, Homo sapiens
gggctgccctggtgc

SEQ ID NO: 1929052 - DNA, 15 bp, Homo sapiens
gggctgggcagaggg

SEQ ID NO: 1929053 - DNA, 14 bp, Homo sapiens
gggcttagaatggg

SEQ ID NO: 1929054 - DNA, 14 bp, Homo sapiens
gggcttccctctgc

SEQ ID NO: 1929055 - DNA, 19 bp, Homo sapiens
gggcttccctctgctccac

SEQ ID NO: 1929056 - DNA, 13 bp, Homo sapiens
gggcttggggtag

SEQ ID NO: 1929057 - DNA, 19 bp, Homo sapiens
ggggacagatcttgagcaa

SEQ ID NO: 1929058 - DNA, 13 bp, Homo sapiens
ggggagaggaagc

SEQ ID NO: 1929059 - DNA, 16 bp, Homo sapiens
ggggaggggcctggcc

SEQ ID NO: 1929060 - DNA, 22 bp, Homo sapiens
ggggatctaaaaggaggacagg

SEQ ID NO: 1929061 - DNA, 23 bp, Homo sapiens
ggggatctaaaaggaggacaggg

SEQ ID NO: 1929062 - DNA, 13 bp, Homo sapiens
ggggcaagagctc

SEQ ID NO: 1929063 - DNA, 19 bp, Homo sapiens
ggggcaagagctcaggaga

SEQ ID NO: 1929064 - DNA, 12 bp, Homo sapiens
ggggcctccctg

SEQ ID NO: 1929065 - DNA, 12 bp, Homo sapiens
ggggcctggcag

SEQ ID NO: 1929066 - DNA, 18 bp, Homo sapiens
ggggctattccctggaga

SEQ ID NO: 1929067 - DNA, 17 bp, Homo sapiens
ggggcttggaagggcgc

SEQ ID NO: 1929068 - DNA, 20 bp, Homo sapiens
ggggcttggggtagagagga

SEQ ID NO: 1929069 - DNA, 14 bp, Homo sapiens
gggggaggccgagg

SEQ ID NO: 1929070 - DNA, 13 bp, Homo sapiens
gggggatgcaggc

SEQ ID NO: 1929071 - DNA, 14 bp, Homo sapiens
gggggccaggtgca

SEQ ID NO: 1929072 - DNA, 13 bp, Homo sapiens
gggggcctgctgt

SEQ ID NO: 1929073 - DNA, 15 bp, Homo sapiens
gggggttgggttcca

SEQ ID NO: 1929074 - DNA, 23 bp, Homo sapiens
gggggtttgaggaccctcccagg

SEQ ID NO: 1929075 - DNA, 16 bp, Homo sapiens
ggggtagagaggacag

SEQ ID NO: 1929076 - DNA, 18 bp, Homo sapiens
ggttccagacagagtgga

SEQ ID NO: 1929077 - DNA, 23 bp, Homo sapiens
ggttccagacagggtggggctta

SEQ ID NO: 1929078 - DNA, 15 bp, Homo sapiens
ggttcccctgttcac

SEQ ID NO: 1929079 - DNA, 12 bp, Homo sapiens
ggttccctcttt

SEQ ID NO: 1929080 - DNA, 14 bp, Homo sapiens
ggttccctctttcc

SEQ ID NO: 1929081 - DNA, 21 bp, Homo sapiens
ggttccggaatcctgtcctca

SEQ ID NO: 1929082 - DNA, 13 bp, Homo sapiens
ggttctagaaggg

SEQ ID NO: 1929083 - DNA, 13 bp, Homo sapiens
ggttgaggacagg

SEQ ID NO: 1929084 - DNA, 17 bp, Homo sapiens
ggttggaactgctgcca

SEQ ID NO: 1929085 - DNA, 14 bp, Homo sapiens
ggttggaggcctgg

SEQ ID NO: 1929086 - DNA, 15 bp, Homo sapiens
ggttgggttccagac

SEQ ID NO: 1929087 - DNA, 14 bp, Homo sapiens
ggtttgggcagtgg

SEQ ID NO: 1929088 - DNA, 16 bp, Homo sapiens
ggtttgggcagtggag

SEQ ID NO: 1929089 - DNA, 17 bp, Homo sapiens
ggtttgggcagtggaga

SEQ ID NO: 1929090 - DNA, 18 bp, Homo sapiens
ggtttgggcagtggagag

SEQ ID NO: 1929091 - DNA, 22 bp, Homo sapiens
ggtttgggcagtggagagggga

SEQ ID NO: 1929092 - DNA, 18 bp, Homo sapiens
ggttttgtattctctgag

SEQ ID NO: 1929093 - DNA, 16 bp, Homo sapiens
ggtttttaaaacccag

SEQ ID NO: 1929094 - DNA, 13 bp, Homo sapiens
gtaaaaataaaat

SEQ ID NO: 1929095 - DNA, 17 bp, Homo sapiens
gtaaaattacagaagaa

SEQ ID NO: 1929096 - DNA, 20 bp, Homo sapiens
gtaaaattattccctgaatt

SEQ ID NO: 1929097 - DNA, 16 bp, Homo sapiens
gtaaactttttcaatg

SEQ ID NO: 1929098 - DNA, 17 bp, Homo sapiens
gtaaactttttcaatgg

SEQ ID NO: 1929099 - DNA, 19 bp, Homo sapiens
gtaaatatcccagagaaca

SEQ ID NO: 1929100 - DNA, 15 bp, Homo sapiens
gtaaatattgtcaca

SEQ ID NO: 1929101 - DNA, 23 bp, Homo sapiens
gtaaatcaacttgtcacaaagtg

SEQ ID NO: 1929102 - DNA, 19 bp, Homo sapiens
gtaaattattgtaaacttt

SEQ ID NO: 1929103 - DNA, 21 bp, Homo sapiens
gtaaccgagccagcagctgaa

SEQ ID NO: 1929104 - DNA, 14 bp, Homo sapiens
gtaagaacacctga

SEQ ID NO: 1929105 - DNA, 14 bp, Homo sapiens
gtaaggtgagggaa

SEQ ID NO: 1929106 - DNA, 18 bp, Homo sapiens
gtaatgatgtcgtttgaa

SEQ ID NO: 1929107 - DNA, 12 bp, Homo sapiens
gtaattctaaat

SEQ ID NO: 1929108 - DNA, 13 bp, Homo sapiens
gtacagcccaggc

SEQ ID NO: 1929109 - DNA, 13 bp, Homo sapiens
gtacatacattgt

SEQ ID NO: 1929110 - DNA, 15 bp, Homo sapiens
gtacatacattgtat

SEQ ID NO: 1929111 - DNA, 16 bp, Homo sapiens
gtacattttttttcaa

SEQ ID NO: 1929112 - DNA, 14 bp, Homo sapiens
gtaccaatcatttt

SEQ ID NO: 1929113 - DNA, 15 bp, Homo sapiens
gtaccaatcatttta

SEQ ID NO: 1929114 - DNA, 22 bp, Homo sapiens
gtaccagagcctatggaaaggg

SEQ ID NO: 1929115 - DNA, 12 bp, Homo sapiens
gtaccggatgca

SEQ ID NO: 1929116 - DNA, 21 bp, Homo sapiens
gtacgactcttttccaaacac

SEQ ID NO: 1929117 - DNA, 20 bp, Homo sapiens
gtgagtattctatgtaaaaa

SEQ ID NO: 1929118 - DNA, 22 bp, Homo sapiens
gtgagtattctatgtaaaaata

SEQ ID NO: 1929119 - DNA, 21 bp, Homo sapiens
gtgagtgtgacgggggttggg

SEQ ID NO: 1929120 - DNA, 16 bp, Homo sapiens
gtgatggttcccctgt

SEQ ID NO: 1929121 - DNA, 22 bp, Homo sapiens
gtgattgaagtatctgtacctg

SEQ ID NO: 1929122 - DNA, 22 bp, Homo sapiens
gtgattgccatttcttcccaag

SEQ ID NO: 1929123 - DNA, 17 bp, Homo sapiens
gtgattttcctgtgtcc

SEQ ID NO: 1929124 - DNA, 14 bp, Homo sapiens
gtgcaaagaaaaga

SEQ ID NO: 1929125 - DNA, 20 bp, Homo sapiens
gtgcacagacgtccctccac

SEQ ID NO: 1929126 - DNA, 15 bp, Homo sapiens
gtgcacctgccccag

SEQ ID NO: 1929127 - DNA, 16 bp, Homo sapiens
gtgcacctgccccagg

SEQ ID NO: 1929128 - DNA, 22 bp, Homo sapiens
gtgcactgaatcgtttcatgta

SEQ ID NO: 1929129 - DNA, 17 bp, Homo sapiens
gtgcagcatatgaggat

SEQ ID NO: 1929130 - DNA, 15 bp, Homo sapiens
gtgcaggtggggaga

SEQ ID NO: 1929131 - DNA, 13 bp, Homo sapiens
gtgccacgtggcc

SEQ ID NO: 1929132 - DNA, 21 bp, Homo sapiens
gtgccacgtggccgctgccca

SEQ ID NO: 1929133 - DNA, 15 bp, Homo sapiens
gtgcccagtcttgag

SEQ ID NO: 1929134 - DNA, 15 bp, Homo sapiens
gtgccttcagctcta

SEQ ID NO: 1929135 - DNA, 19 bp, Homo sapiens
gtgctaaaaaattaaacca

SEQ ID NO: 1929136 - DNA, 14 bp, Homo sapiens
gtgctcagttccaa

SEQ ID NO: 1929137 - DNA, 21 bp, Homo sapiens
gtgctgccacacttcaggctc

SEQ ID NO: 1929138 - DNA, 21 bp, Homo sapiens
gtgcttatcccatagccagga

SEQ ID NO: 1929139 - DNA, 13 bp, Homo sapiens
gtggactgtgtcc

SEQ ID NO: 1929140 - DNA, 15 bp, Homo sapiens
gtggagaggagagaa

SEQ ID NO: 1929141 - DNA, 16 bp, Homo sapiens
gtggagccacaggcag

SEQ ID NO: 1929142 - DNA, 19 bp, Homo sapiens
gtggagccacaggcagacg

SEQ ID NO: 1929143 - DNA, 13 bp, Homo sapiens
gtggaggggtcag

SEQ ID NO: 1929144 - DNA, 15 bp, Homo sapiens
gtggattttgtggct

SEQ ID NO: 1929145 - DNA, 21 bp, Homo sapiens
gtggccactccagacccctgg

SEQ ID NO: 1929146 - DNA, 11 bp, Homo sapiens
gtggcccctcc

SEQ ID NO: 1929147 - DNA, 17 bp, Homo sapiens
gtggcccctccttctcc

SEQ ID NO: 1929148 - DNA, 22 bp, Homo sapiens
gtggcccctccttctcccctcc

SEQ ID NO: 1929149 - DNA, 18 bp, Homo sapiens
gtggcccgacagcctggc

SEQ ID NO: 1929150 - DNA, 14 bp, Homo sapiens
taaaatctgtcacg

SEQ ID NO: 1929151 - DNA, 13 bp, Homo sapiens
taaaatgtgcagt

SEQ ID NO: 1929152 - DNA, 14 bp, Homo sapiens
taaaatgtgcagta

SEQ ID NO: 1929153 - DNA, 22 bp, Homo sapiens
taaaatgttcacttttgacaaa

SEQ ID NO: 1929154 - DNA, 18 bp, Homo sapiens
taaaattaaagctgaaaa

SEQ ID NO: 1929155 - DNA, 23 bp, Homo sapiens
taaaattattccctgaattgttt

SEQ ID NO: 1929156 - DNA, 14 bp, Homo sapiens
taaactttttcaat

SEQ ID NO: 1929157 - DNA, 15 bp, Homo sapiens
taaactttttcaatg

SEQ ID NO: 1929158 - DNA, 19 bp, Homo sapiens
taaagaggagcctttccag

SEQ ID NO: 1929159 - DNA, 21 bp, Homo sapiens
taaagaggagcctttccagaa

SEQ ID NO: 1929160 - DNA, 18 bp, Homo sapiens
taaagagttagtttgagt

SEQ ID NO: 1929161 - DNA, 17 bp, Homo sapiens
taaagtaacatttaagc

SEQ ID NO: 1929162 - DNA, 18 bp, Homo sapiens
taaataaaaataagtcat

SEQ ID NO: 1929163 - DNA, 20 bp, Homo sapiens
taaatacagtcttccatttg

SEQ ID NO: 1929164 - DNA, 23 bp, Homo sapiens
taaatacagtcttccatttgcaa

SEQ ID NO: 1929165 - DNA, 18 bp, Homo sapiens
taaatagatgagtcctgt

SEQ ID NO: 1929166 - DNA, 19 bp, Homo sapiens
taaatagtaaaaataaaat

SEQ ID NO: 1929167 - DNA, 22 bp, Homo sapiens
taaatatatttaagataattat

SEQ ID NO: 1929168 - DNA, 15 bp, Homo sapiens
taaatatcacaaagt

SEQ ID NO: 1929169 - DNA, 15 bp, Homo sapiens
taaatatcccagaga

SEQ ID NO: 1929170 - DNA, 13 bp, Homo sapiens
taaatattcttgt

SEQ ID NO: 1929171 - DNA, 19 bp, Homo sapiens
taaatcaagttggcttcta

SEQ ID NO: 1929172 - DNA, 17 bp, Homo sapiens
taaatcctttactgtta

SEQ ID NO: 1929173 - DNA, 21 bp, Homo sapiens
taaatggtgagaattaaaata

SEQ ID NO: 1929174 - DNA, 20 bp, Homo sapiens
taaatgtttaatatctgact

SEQ ID NO: 1929175 - DNA, 14 bp, Homo sapiens
taaattattgtaaa

SEQ ID NO: 1929176 - DNA, 15 bp, Homo sapiens
taaattattgtaaac

SEQ ID NO: 1929177 - DNA, 14 bp, Homo sapiens
taacaatcagctcc

SEQ ID NO: 1929178 - DNA, 14 bp, Homo sapiens
taacaattcctcta

SEQ ID NO: 1929179 - DNA, 15 bp, Homo sapiens
taacaggtctttgaa

SEQ ID NO: 1929180 - DNA, 15 bp, Homo sapiens
taacatgtaggaagt

SEQ ID NO: 1929181 - DNA, 22 bp, Homo sapiens
taacatgtgttaagtattttca

SEQ ID NO: 1929182 - DNA, 17 bp, Homo sapiens
taacctcttcagaggcc

SEQ ID NO: 1929183 - DNA, 13 bp, Homo sapiens
taactatttagag

SEQ ID NO: 1929184 - DNA, 20 bp, Homo sapiens
taagaaacaactctttgaga

SEQ ID NO: 1929185 - DNA, 16 bp, Homo sapiens
taagaatccaaagtgg

SEQ ID NO: 1929186 - DNA, 20 bp, Homo sapiens
taagagaatccacataaaag

SEQ ID NO: 1929187 - DNA, 21 bp, Homo sapiens
taagataatatttaaaatagt

SEQ ID NO: 1929188 - DNA, 12 bp, Homo sapiens
taagataattat

SEQ ID NO: 1929189 - DNA, 13 bp, Homo sapiens
taagatgaaattg

SEQ ID NO: 1929190 - DNA, 18 bp, Homo sapiens
taagatgaaattgccaaa

SEQ ID NO: 1929191 - DNA, 21 bp, Homo sapiens
taagattccagagagtggctc

SEQ ID NO: 1929192 - DNA, 21 bp, Homo sapiens
taagcaacatgaattaagaac

SEQ ID NO: 1929193 - DNA, 18 bp, Homo sapiens
taagcacattatgtttgc

SEQ ID NO: 1929194 - DNA, 22 bp, Homo sapiens
taagcactttgaaaatatttct

SEQ ID NO: 1929195 - DNA, 22 bp, Homo sapiens
taaggacttgtgcctcttggga

SEQ ID NO: 1929196 - DNA, 19 bp, Homo sapiens
taaggccattattgtactt

SEQ ID NO: 1929197 - DNA, 15 bp, Homo sapiens
taagtcaacctgcct

SEQ ID NO: 1929198 - DNA, 17 bp, Homo sapiens
taagtcaacctgcctga

SEQ ID NO: 1929199 - DNA, 12 bp, Homo sapiens
taagtgactacc

SEQ ID NO: 1929200 - DNA, 14 bp, Homo sapiens
taagtttctgggac

SEQ ID NO: 1929201 - DNA, 14 bp, Homo sapiens
taataactaaacca

SEQ ID NO: 1929202 - DNA, 15 bp, Homo sapiens
taataactaaaccag

SEQ ID NO: 1929203 - DNA, 21 bp, Homo sapiens
taataatattttagaaaatgt

SEQ ID NO: 1929204 - DNA, 22 bp, Homo sapiens
taataatattttagaaaatgtt

SEQ ID NO: 1929205 - DNA, 19 bp, Homo sapiens
taatacccccgtcggaatg

SEQ ID NO: 1929206 - DNA, 14 bp, Homo sapiens
taatacttaaaaat

SEQ ID NO: 1929207 - DNA, 22 bp, Homo sapiens
taatataactgccttaaaactt

SEQ ID NO: 1929208 - DNA, 23 bp, Homo sapiens
taatataactgccttaaaacttt

SEQ ID NO: 1929209 - DNA, 16 bp, Homo sapiens
taatatactatattta

SEQ ID NO: 1929210 - DNA, 16 bp, Homo sapiens
taatatctgactgaaa

SEQ ID NO: 1929211 - DNA, 14 bp, Homo sapiens
taatattttagaaa

SEQ ID NO: 1929212 - DNA, 22 bp, Homo sapiens
taatcatataataaatgtacat

SEQ ID NO: 1929213 - DNA, 21 bp, Homo sapiens
taatccgaatctctttttgct

SEQ ID NO: 1929214 - DNA, 23 bp, Homo sapiens
taatgaagaaagtggaaaacaag

SEQ ID NO: 1929215 - DNA, 15 bp, Homo sapiens
taatgaatgcataaa

SEQ ID NO: 1929216 - DNA, 17 bp, Homo sapiens
taatgacgtattgtgaa

SEQ ID NO: 1929217 - DNA, 18 bp, Homo sapiens
taatgacgtattgtgaaa

SEQ ID NO: 1929218 - DNA, 21 bp, Homo sapiens
taatgacgtattgtgaaattt

SEQ ID NO: 1929219 - DNA, 17 bp, Homo sapiens
taatgatgtcgtttgaa

SEQ ID NO: 1929220 - DNA, 19 bp, Homo sapiens
taatgcattaacttttgta

SEQ ID NO: 1929221 - DNA, 18 bp, Homo sapiens
taatggtcctgttatgtc

SEQ ID NO: 1929222 - DNA, 18 bp, Homo sapiens
taatgttaattaaagtaa

SEQ ID NO: 1929223 - DNA, 14 bp, Homo sapiens
taattaaaatgtgc

SEQ ID NO: 1929224 - DNA, 17 bp, Homo sapiens
taattaaggcagctgaa

SEQ ID NO: 1929225 - DNA, 23 bp, Homo sapiens
taattaaggcagctgaaaagtaa

SEQ ID NO: 1929226 - DNA, 14 bp, Homo sapiens
taattattatttat

SEQ ID NO: 1929227 - DNA, 11 bp, Homo sapiens
taattctaaat

SEQ ID NO: 1929228 - DNA, 16 bp, Homo sapiens
taattctcttttcaaa

SEQ ID NO: 1929229 - DNA, 21 bp, Homo sapiens
taattctcttttcaaacacac

SEQ ID NO: 1929230 - DNA, 22 bp, Homo sapiens
taattctcttttcaaacacaca

SEQ ID NO: 1929231 - DNA, 22 bp, Homo sapiens
taattgagccttttattaacat

SEQ ID NO: 1929232 - DNA, 20 bp, Homo sapiens
taattggcttttgaatcaaa

SEQ ID NO: 1929233 - DNA, 18 bp, Homo sapiens
taattggtccgatctttg

SEQ ID NO: 1929234 - DNA, 16 bp, Homo sapiens
taattgtggagaggag

SEQ ID NO: 1929235 - DNA, 16 bp, Homo sapiens
taatttgtataaccca

SEQ ID NO: 1929236 - DNA, 20 bp, Homo sapiens
taattttcctctaattaaaa

SEQ ID NO: 1929237 - DNA, 20 bp, Homo sapiens
taattttgtacgtatgaatg

SEQ ID NO: 1929238 - DNA, 19 bp, Homo sapiens
tacaaataaatccaagact

SEQ ID NO: 1929239 - DNA, 19 bp, Homo sapiens
tacaaattgcttgaaagaa

SEQ ID NO: 1929240 - DNA, 18 bp, Homo sapiens
tacaagtgctcagttcca

SEQ ID NO: 1929241 - DNA, 22 bp, Homo sapiens
tacaagtgctcagttccaatgt

SEQ ID NO: 1929242 - DNA, 18 bp, Homo sapiens
tacaatgagtaaaatcac

SEQ ID NO: 1929243 - DNA, 16 bp, Homo sapiens
tacacccttttccagc

SEQ ID NO: 1929244 - DNA, 16 bp, Homo sapiens
tacactctttgtaaga

SEQ ID NO: 1929245 - DNA, 18 bp, Homo sapiens
tacagccagtaaggcagc

SEQ ID NO: 1929246 - DNA, 13 bp, Homo sapiens
tacagcccaggcg

SEQ ID NO: 1929247 - DNA, 18 bp, Homo sapiens
tacagctaatcagcattc

SEQ ID NO: 1929248 - DNA, 15 bp, Homo sapiens
tacaggcatagagtt

SEQ ID NO: 1929249 - DNA, 15 bp, Homo sapiens
tacagggaagaaatc

SEQ ID NO: 1929250 - DNA, 21 bp, Homo sapiens
tacaggtaaggtgagggaata

SEQ ID NO: 1929251 - DNA, 14 bp, Homo sapiens
tacagtaggagccc

SEQ ID NO: 1929252 - DNA, 18 bp, Homo sapiens
tacagtaggagcccagct

SEQ ID NO: 1929253 - DNA, 20 bp, Homo sapiens
tacagtaggagcccagctct

SEQ ID NO: 1929254 - DNA, 22 bp, Homo sapiens
tacagtaggagcccagctctga

SEQ ID NO: 1929255 - DNA, 19 bp, Homo sapiens
tacagtatatcttaagata

SEQ ID NO: 1929256 - DNA, 23 bp, Homo sapiens
tacagtatatcttaagataatat

SEQ ID NO: 1929257 - DNA, 19 bp, Homo sapiens
tacccacttccctgcaagg

SEQ ID NO: 1929258 - DNA, 12 bp, Homo sapiens
taccctccctcg

SEQ ID NO: 1929259 - DNA, 17 bp, Homo sapiens
taccgagtctcttctcc

SEQ ID NO: 1929260 - DNA, 18 bp, Homo sapiens
taccgagtctcttctcca

SEQ ID NO: 1929261 - DNA, 21 bp, Homo sapiens
taccgagtctcttctccactg

SEQ ID NO: 1929262 - DNA, 22 bp, Homo sapiens
taccgagtctcttctccactgg

SEQ ID NO: 1929263 - DNA, 16 bp, Homo sapiens
taccggatgcagaccc

SEQ ID NO: 1929264 - DNA, 14 bp, Homo sapiens
tacctattgaacat

SEQ ID NO: 1929265 - DNA, 13 bp, Homo sapiens
tacctgaaaacac

SEQ ID NO: 1929266 - DNA, 20 bp, Homo sapiens
tacctgaaaacactgtgcac

SEQ ID NO: 1929267 - DNA, 21 bp, Homo sapiens
tacctgaaaacactgtgcaca

SEQ ID NO: 1929268 - DNA, 17 bp, Homo sapiens
tacctgacactcccttg

SEQ ID NO: 1929269 - DNA, 20 bp, Homo sapiens
tacctgacactcccttgggc

SEQ ID NO: 1929270 - DNA, 21 bp, Homo sapiens
tacctgcccccactcagcatt

SEQ ID NO: 1929271 - DNA, 23 bp, Homo sapiens
tacctggatccagccattcctga

SEQ ID NO: 1929272 - DNA, 23 bp, Homo sapiens
tacctgtattgtctgacttctca

SEQ ID NO: 1929273 - DNA, 12 bp, Homo sapiens
taccttaaaatt

SEQ ID NO: 1929274 - DNA, 19 bp, Homo sapiens
taccttcagtaaacaccat

SEQ ID NO: 1929275 - DNA, 21 bp, Homo sapiens
tacgactcttttccaaacaca

SEQ ID NO: 1929276 - DNA, 16 bp, Homo sapiens
tacgatgttaaaacaa

SEQ ID NO: 1929277 - DNA, 20 bp, Homo sapiens
tacgcagaagagaaagtaca

SEQ ID NO: 1929278 - DNA, 22 bp, Homo sapiens
tacggcagtcacactgctggga

SEQ ID NO: 1929279 - DNA, 17 bp, Homo sapiens
tactaaatatgaaattt

SEQ ID NO: 1929280 - DNA, 23 bp, Homo sapiens
tactaacaatcagctccttcctg

SEQ ID NO: 1929281 - DNA, 18 bp, Homo sapiens
tactacatgtgggagctt

SEQ ID NO: 1929282 - DNA, 20 bp, Homo sapiens
tactatcatgtcaaacgtga

SEQ ID NO: 1929283 - DNA, 16 bp, Homo sapiens
tactcaaaatgcagga

SEQ ID NO: 1929284 - DNA, 14 bp, Homo sapiens
tactgactttctca

SEQ ID NO: 1929285 - DNA, 17 bp, Homo sapiens
tactgagttctcatcca

SEQ ID NO: 1929286 - DNA, 20 bp, Homo sapiens
tactgtacattttttttcaa

SEQ ID NO: 1929287 - DNA, 15 bp, Homo sapiens
tacttaaaaatatgt

SEQ ID NO: 1929288 - DNA, 16 bp, Homo sapiens
tacttaaaaatatgtg

SEQ ID NO: 1929289 - DNA, 13 bp, Homo sapiens
tacttattccaga

SEQ ID NO: 1929290 - DNA, 23 bp, Homo sapiens
tacttgccttattagagtgtctt

SEQ ID NO: 1929291 - DNA, 21 bp, Homo sapiens
tacttgggagacctgtaatca

SEQ ID NO: 1929292 - DNA, 23 bp, Homo sapiens
tacttgggagacctgtaatcata

SEQ ID NO: 1929293 - DNA, 19 bp, Homo sapiens
tacttggtgaggaggaggc

SEQ ID NO: 1929294 - DNA, 21 bp, Homo sapiens
tacttggtgaggaggaggcag

SEQ ID NO: 1929295 - DNA, 14 bp, Homo sapiens
tactttgaagtcat

SEQ ID NO: 1929296 - DNA, 22 bp, Homo sapiens
tagaaaatgtttggaatttaag

SEQ ID NO: 1929297 - DNA, 18 bp, Homo sapiens
tagaaactgagtcctgtt

SEQ ID NO: 1929298 - DNA, 15 bp, Homo sapiens
tagaaatgatttcaa

SEQ ID NO: 1929299 - DNA, 23 bp, Homo sapiens
tagaaggagacagagctggttgg

SEQ ID NO: 1929300 - DNA, 20 bp, Homo sapiens
tagacatccccctccttgcc

SEQ ID NO: 1929301 - DNA, 23 bp, Homo sapiens
tagactaaggccattattgtact

SEQ ID NO: 1929302 - DNA, 20 bp, Homo sapiens
tagagaaaatggaacattaa

SEQ ID NO: 1929303 - DNA, 21 bp, Homo sapiens
tagagaaaatggaacattaac

SEQ ID NO: 1929304 - DNA, 22 bp, Homo sapiens
tagagaaggacccggaggggcc

SEQ ID NO: 1929305 - DNA, 17 bp, Homo sapiens
tagagatattttccatt

SEQ ID NO: 1929306 - DNA, 13 bp, Homo sapiens
tagagattcttag

SEQ ID NO: 1929307 - DNA, 19 bp, Homo sapiens
tagagcagatgacccctcc

SEQ ID NO: 1929308 - DNA, 14 bp, Homo sapiens
tagagcctgaggga

SEQ ID NO: 1929309 - DNA, 20 bp, Homo sapiens
tagagctgtattaagccact

SEQ ID NO: 1929310 - DNA, 21 bp, Homo sapiens
tagcaaacagggctttactat

SEQ ID NO: 1929311 - DNA, 23 bp, Homo sapiens
tagcagaaggttgcacctccccc

SEQ ID NO: 1929312 - DNA, 22 bp, Homo sapiens
taggacccaaggtggtcttgga

SEQ ID NO: 1929313 - DNA, 19 bp, Homo sapiens
taggagcttccagatgggt

SEQ ID NO: 1929314 - DNA, 20 bp, Homo sapiens
taggaggaccagagctactg

SEQ ID NO: 1929315 - DNA, 20 bp, Homo sapiens
taggcatctgctgtaataat

SEQ ID NO: 1929316 - DNA, 16 bp, Homo sapiens
taggccatctgtaaat

SEQ ID NO: 1929317 - DNA, 19 bp, Homo sapiens
taggccatctgtaaatatc

SEQ ID NO: 1929318 - DNA, 21 bp, Homo sapiens
taggccatctgtaaatatccc

SEQ ID NO: 1929319 - DNA, 19 bp, Homo sapiens
tagggaaatccaactccag

SEQ ID NO: 1929320 - DNA, 17 bp, Homo sapiens
tagggatccctcatctg

SEQ ID NO: 1929321 - DNA, 16 bp, Homo sapiens
tagggccaagcccagc

SEQ ID NO: 1929322 - DNA, 20 bp, Homo sapiens
taggggtgggggagaatggc

SEQ ID NO: 1929323 - DNA, 16 bp, Homo sapiens
tagggtggagagccac

SEQ ID NO: 1929324 - DNA, 16 bp, Homo sapiens
taggtctccacccctc

SEQ ID NO: 1929325 - DNA, 19 bp, Homo sapiens
taggtgcccagtcttgagt

SEQ ID NO: 1929326 - DNA, 16 bp, Homo sapiens
tagtaaaaataaaatt

SEQ ID NO: 1929327 - DNA, 12 bp, Homo sapiens
tagtaaagaaat

SEQ ID NO: 1929328 - DNA, 13 bp, Homo sapiens
tagtaaagaaatg

SEQ ID NO: 1929329 - DNA, 16 bp, Homo sapiens
tagtaggagctgagct

SEQ ID NO: 1929330 - DNA, 16 bp, Homo sapiens
tagtctgtgcctcagt

SEQ ID NO: 1929331 - DNA, 19 bp, Homo sapiens
tagtgaaggcttctctctg

SEQ ID NO: 1929332 - DNA, 24 bp, Homo sapiens
tagtgcctgtgatcgtgtgttgcc

SEQ ID NO: 1929333 - DNA, 20 bp, Homo sapiens
tagtggggaggggcctggcc

SEQ ID NO: 1929334 - DNA, 23 bp, Homo sapiens
tagtggggaggggcctggcctgg

SEQ ID NO: 1929335 - DNA, 16 bp, Homo sapiens
tagttccagataaaaa

SEQ ID NO: 1929336 - DNA, 12 bp, Homo sapiens
tagtttctgtaa

SEQ ID NO: 1929337 - DNA, 15 bp, Homo sapiens
tataaaaaaattgta

SEQ ID NO: 1929338 - DNA, 20 bp, Homo sapiens
tataaaaaaattgtaaatgt

SEQ ID NO: 1929339 - DNA, 21 bp, Homo sapiens
tataaactaattttgtacgta

SEQ ID NO: 1929340 - DNA, 18 bp, Homo sapiens
tataaatatcacaaagtt

SEQ ID NO: 1929341 - DNA, 15 bp, Homo sapiens
tataaatggtgagaa

SEQ ID NO: 1929342 - DNA, 21 bp, Homo sapiens
tataaatggtgagaattaaaa

SEQ ID NO: 1929343 - DNA, 16 bp, Homo sapiens
tataataaatgtacat

SEQ ID NO: 1929344 - DNA, 20 bp, Homo sapiens
tataatacttaaaaatatgt

SEQ ID NO: 1929345 - DNA, 19 bp, Homo sapiens
tataatgttgttatttaaa

SEQ ID NO: 1929346 - DNA, 14 bp, Homo sapiens
tataccacctgtac

SEQ ID NO: 1929347 - DNA, 19 bp, Homo sapiens
tataccagtataattgagt

SEQ ID NO: 1929348 - DNA, 21 bp, Homo sapiens
tataccctaggtctccacccc

SEQ ID NO: 1929349 - DNA, 13 bp, Homo sapiens
tataggccatctg

SEQ ID NO: 1929350 - DNA, 15 bp, Homo sapiens
tataggccatctgta

SEQ ID NO: 1929351 - DNA, 19 bp, Homo sapiens
tataggccatctgtaaata

SEQ ID NO: 1929352 - DNA, 17 bp, Homo sapiens
tatagttttacactcta

SEQ ID NO: 1929353 - DNA, 12 bp, Homo sapiens
tatataaatggt

SEQ ID NO: 1929354 - DNA, 20 bp, Homo sapiens
tatataatacttaaaaatat

SEQ ID NO: 1929355 - DNA, 22 bp, Homo sapiens
tatatacaatgagtaaaatcac

SEQ ID NO: 1929356 - DNA, 16 bp, Homo sapiens
tatatatgtatataaa

SEQ ID NO: 1929357 - DNA, 13 bp, Homo sapiens
tatatattatata

SEQ ID NO: 1929358 - DNA, 20 bp, Homo sapiens
tatatatttaggatttgtgt

SEQ ID NO: 1929359 - DNA, 14 bp, Homo sapiens
tatatttaaaagaa

SEQ ID NO: 1929360 - DNA, 19 bp, Homo sapiens
tatcaccgtgggctccctg

SEQ ID NO: 1929361 - DNA, 21 bp, Homo sapiens
tatcaggacccagaggaaggg

SEQ ID NO: 1929362 - DNA, 16 bp, Homo sapiens
tatcatgtcaaacgtg

SEQ ID NO: 1929363 - DNA, 21 bp, Homo sapiens
tatcatgtcaaacgtgaaaat

SEQ ID NO: 1929364 - DNA, 21 bp, Homo sapiens
tatcattttctgcatttaacc

SEQ ID NO: 1929365 - DNA, 14 bp, Homo sapiens
tatcccagagaaca

SEQ ID NO: 1929366 - DNA, 18 bp, Homo sapiens
tatcccagagaacaatca

SEQ ID NO: 1929367 - DNA, 20 bp, Homo sapiens
tatcgcaccactgtgtattt

SEQ ID NO: 1929368 - DNA, 18 bp, Homo sapiens
tatctatttatctgtctg

SEQ ID NO: 1929369 - DNA, 21 bp, Homo sapiens
tatctatttatctgtctgagc

SEQ ID NO: 1929370 - DNA, 17 bp, Homo sapiens
tcagtaaacaccatgaa

SEQ ID NO: 1929371 - DNA, 16 bp, Homo sapiens
tcagtagtgcctgtga

SEQ ID NO: 1929372 - DNA, 19 bp, Homo sapiens
tcagtcaagttccgtctcc

SEQ ID NO: 1929373 - DNA, 13 bp, Homo sapiens
tcagtctctgagc

SEQ ID NO: 1929374 - DNA, 17 bp, Homo sapiens
tcagtctctgagcagtg

SEQ ID NO: 1929375 - DNA, 19 bp, Homo sapiens
tcagtgaagcccaggagga

SEQ ID NO: 1929376 - DNA, 19 bp, Homo sapiens
tcagtgagatcagtcagct

SEQ ID NO: 1929377 - DNA, 15 bp, Homo sapiens
tcagtgatgggagta

SEQ ID NO: 1929378 - DNA, 13 bp, Homo sapiens
tcagtgctccctc

SEQ ID NO: 1929379 - DNA, 14 bp, Homo sapiens
tcagtggggcagtc

SEQ ID NO: 1929380 - DNA, 17 bp, Homo sapiens
tcagtgtcaaatatatt

SEQ ID NO: 1929381 - DNA, 15 bp, Homo sapiens
tcagtgtgcaaagaa

SEQ ID NO: 1929382 - DNA, 20 bp, Homo sapiens
tcagtgtgccaccctctgca

SEQ ID NO: 1929383 - DNA, 24 bp, Homo sapiens
tcagtgtgccaccctctgcagggc

SEQ ID NO: 1929384 - DNA, 15 bp, Homo sapiens
tcagtgttaaatgtg

SEQ ID NO: 1929385 - DNA, 17 bp, Homo sapiens
tcagtgttaaatgtgat

SEQ ID NO: 1929386 - DNA, 16 bp, Homo sapiens
tcatataataaatgta

SEQ ID NO: 1929387 - DNA, 22 bp, Homo sapiens
tcatatgtaccatgtacatgaa

SEQ ID NO: 1929388 - DNA, 18 bp, Homo sapiens
tcatcattctctgtctca

SEQ ID NO: 1929389 - DNA, 16 bp, Homo sapiens
tcatccacagaggcca

SEQ ID NO: 1929390 - DNA, 18 bp, Homo sapiens
tcatccaggtcctttcct

SEQ ID NO: 1929391 - DNA, 12 bp, Homo sapiens
tcatccatcatc

SEQ ID NO: 1929392 - DNA, 21 bp, Homo sapiens
tcatcccgagcacctccacat

SEQ ID NO: 1929393 - DNA, 20 bp, Homo sapiens
tcatctcattaattcaatta

SEQ ID NO: 1929394 - DNA, 18 bp, Homo sapiens
tcatgacatttctcaaag

SEQ ID NO: 1929395 - DNA, 17 bp, Homo sapiens
tcatgatttgcaacttt

SEQ ID NO: 1929396 - DNA, 15 bp, Homo sapiens
tcatgcccagcttgg

SEQ ID NO: 1929397 - DNA, 21 bp, Homo sapiens
tcatgcttataagcaacatga

SEQ ID NO: 1929398 - DNA, 14 bp, Homo sapiens
tcatgtaaactgtg

SEQ ID NO: 1929399 - DNA, 17 bp, Homo sapiens
tcatgtaaactgtgcac

SEQ ID NO: 1929400 - DNA, 16 bp, Homo sapiens
tcatgtgtgtccacga

SEQ ID NO: 1929401 - DNA, 21 bp, Homo sapiens
tcatgtgtgtccacgactgtc

SEQ ID NO: 1929402 - DNA, 23 bp, Homo sapiens
tcatgtgtgtccacgactgtctc

SEQ ID NO: 1929403 - DNA, 13 bp, Homo sapiens
tcattggatgcag

SEQ ID NO: 1929404 - DNA, 13 bp, Homo sapiens
tcattttaattat

SEQ ID NO: 1929405 - DNA, 14 bp, Homo sapiens
tccaaacacaggca

SEQ ID NO: 1929406 - DNA, 18 bp, Homo sapiens
tccaacgtggggcagcac

SEQ ID NO: 1929407 - DNA, 19 bp, Homo sapiens
tccaacgtggggcagcaca

SEQ ID NO: 1929408 - DNA, 15 bp, Homo sapiens
tccaagcctgggcca

SEQ ID NO: 1929409 - DNA, 18 bp, Homo sapiens
tccaatcccaccaaccct

SEQ ID NO: 1929410 - DNA, 15 bp, Homo sapiens
tccaatgtgcccagt

SEQ ID NO: 1929411 - DNA, 22 bp, Homo sapiens
tccacacaagacagcagagcca

SEQ ID NO: 1929412 - DNA, 21 bp, Homo sapiens
tccacacctccacccgtcctg

SEQ ID NO: 1929413 - DNA, 18 bp, Homo sapiens
tccacagaaaccctgttt

SEQ ID NO: 1929414 - DNA, 19 bp, Homo sapiens
tccacagaaaccctgtttt

SEQ ID NO: 1929415 - DNA, 12 bp, Homo sapiens
tccacataaaag

SEQ ID NO: 1929416 - DNA, 19 bp, Homo sapiens
tccacataaaagaagaaac

SEQ ID NO: 1929417 - DNA, 19 bp, Homo sapiens
tccacatcctccacgttct

SEQ ID NO: 1929418 - DNA, 17 bp, Homo sapiens
tccacatctaacaaagt

SEQ ID NO: 1929419 - DNA, 20 bp, Homo sapiens
tccacccctcaagccaggag

SEQ ID NO: 1929420 - DNA, 21 bp, Homo sapiens
tccacccctcaagccaggaga

SEQ ID NO: 1929421 - DNA, 16 bp, Homo sapiens
tccacccgtttccaag

SEQ ID NO: 1929422 - DNA, 18 bp, Homo sapiens
tccacccgtttccaagcc

SEQ ID NO: 1929423 - DNA, 23 bp, Homo sapiens
tccacccgtttccaagcctgggc

SEQ ID NO: 1929424 - DNA, 16 bp, Homo sapiens
tccacgactgtctcca

SEQ ID NO: 1929425 - DNA, 18 bp, Homo sapiens
tccacgcttagggtctgt

SEQ ID NO: 1929426 - DNA, 17 bp, Homo sapiens
tccactaccctccctcg

SEQ ID NO: 1929427 - DNA, 19 bp, Homo sapiens
tccactaccctccctcgca

SEQ ID NO: 1929428 - DNA, 19 bp, Homo sapiens
tccactaggtgcccagtct

SEQ ID NO: 1929429 - DNA, 13 bp, Homo sapiens
tccactcccctca

SEQ ID NO: 1929430 - DNA, 15 bp, Homo sapiens
tccactcccctcatc

SEQ ID NO: 1929431 - DNA, 13 bp, Homo sapiens
tccactcctccca

SEQ ID NO: 1929432 - DNA, 18 bp, Homo sapiens
tccactcctcccaactct

SEQ ID NO: 1929433 - DNA, 22 bp, Homo sapiens
tccactcctcccaactctggcc

SEQ ID NO: 1929434 - DNA, 24 bp, Homo sapiens
tccagacaaaccagaagcaacaga

SEQ ID NO: 1929435 - DNA, 10 bp, Homo sapiens
tccagacaga

SEQ ID NO: 1929436 - DNA, 23 bp, Homo sapiens
tccagacagagtggatctggagt

SEQ ID NO: 1929437 - DNA, 22 bp, Homo sapiens
tccagacccctaccctttccca

SEQ ID NO: 1929438 - DNA, 16 bp, Homo sapiens
tccagagagtggctcc

SEQ ID NO: 1929439 - DNA, 17 bp, Homo sapiens
tccagagggcactctgc

SEQ ID NO: 1929440 - DNA, 22 bp, Homo sapiens
tccagagtaggtgggtcttgga

SEQ ID NO: 1929441 - DNA, 23 bp, Homo sapiens
tccagagtaggtgggtcttggat

SEQ ID NO: 1929442 - DNA, 21 bp, Homo sapiens
tccagatgccttctccagaca

SEQ ID NO: 1929443 - DNA, 17 bp, Homo sapiens
tccagcaatgcctgcct

SEQ ID NO: 1929444 - DNA, 16 bp, Homo sapiens
tccagcagtgaaactt

SEQ ID NO: 1929445 - DNA, 23 bp, Homo sapiens
tccagcagtgaaacttgtgctat

SEQ ID NO: 1929446 - DNA, 11 bp, Homo sapiens
tccagccgtgt

SEQ ID NO: 1929447 - DNA, 11 bp, Homo sapiens
tccagcttccc

SEQ ID NO: 1929448 - DNA, 20 bp, Homo sapiens
tccaggagaaggccaattcc

SEQ ID NO: 1929449 - DNA, 14 bp, Homo sapiens
tccaggcactgaga

SEQ ID NO: 1929450 - DNA, 17 bp, Homo sapiens
tccatagctgagctgga

SEQ ID NO: 1929451 - DNA, 14 bp, Homo sapiens
tccatcagcagtga

SEQ ID NO: 1929452 - DNA, 18 bp, Homo sapiens
tccatgaaaaacagcaga

SEQ ID NO: 1929453 - DNA, 20 bp, Homo sapiens
tccatggccctgcaaaagga

SEQ ID NO: 1929454 - DNA, 15 bp, Homo sapiens
tccatgggcagagcc

SEQ ID NO: 1929455 - DNA, 17 bp, Homo sapiens
tccatgggcagagccca

SEQ ID NO: 1929456 - DNA, 18 bp, Homo sapiens
tccatgggcagagcccaa

SEQ ID NO: 1929457 - DNA, 22 bp, Homo sapiens
tccatgggcagagcccaaggga

SEQ ID NO: 1929458 - DNA, 23 bp, Homo sapiens
tccatgtagaagagggagaagga

SEQ ID NO: 1929459 - DNA, 12 bp, Homo sapiens
tccatttgcaag

SEQ ID NO: 1929460 - DNA, 15 bp, Homo sapiens
tccatttgcaaggga

SEQ ID NO: 1929461 - DNA, 17 bp, Homo sapiens
tcccaaagaaccccagg

SEQ ID NO: 1929462 - DNA, 17 bp, Homo sapiens
tcccaaataaactcctt

SEQ ID NO: 1929463 - DNA, 14 bp, Homo sapiens
tcccacacaagcag

SEQ ID NO: 1929464 - DNA, 19 bp, Homo sapiens
tcccaccaaccctcagagc

SEQ ID NO: 1929465 - DNA, 15 bp, Homo sapiens
tcccacttgcccctg

SEQ ID NO: 1929466 - DNA, 13 bp, Homo sapiens
tcccagagaacaa

SEQ ID NO: 1929467 - DNA, 23 bp, Homo sapiens
tcccagagaacaatcactattct

SEQ ID NO: 1929468 - DNA, 18 bp, Homo sapiens
tcccagggagctctgcat

SEQ ID NO: 1929469 - DNA, 15 bp, Homo sapiens
tcccatttgtgtttc

SEQ ID NO: 1929470 - DNA, 13 bp, Homo sapiens
tccccactcccgt

SEQ ID NO: 1929471 - DNA, 19 bp, Homo sapiens
tccccaggccgtggctgcc

SEQ ID NO: 1929472 - DNA, 16 bp, Homo sapiens
tcccccagccctcagt

SEQ ID NO: 1929473 - DNA, 13 bp, Homo sapiens
tccccctccttgc

SEQ ID NO: 1929474 - DNA, 10 bp, Homo sapiens
tcccccttcc

SEQ ID NO: 1929475 - DNA, 20 bp, Homo sapiens
tcccctaagcagaccactga

SEQ ID NO: 1929476 - DNA, 14 bp, Homo sapiens
tcccctgccagggc

SEQ ID NO: 1929477 - DNA, 15 bp, Homo sapiens
tcccgaatcctgagg

SEQ ID NO: 1929478 - DNA, 21 bp, Homo sapiens
tcccgaatctttttaggccac

SEQ ID NO: 1929479 - DNA, 22 bp, Homo sapiens
tcccgagcacctccacatcctc

SEQ ID NO: 1929480 - DNA, 13 bp, Homo sapiens
tcccgagccccct

SEQ ID NO: 1929481 - DNA, 17 bp, Homo sapiens
tcccgagccccctgtcc

SEQ ID NO: 1929482 - DNA, 22 bp, Homo sapiens
tcccgggcactgtcatgcccag

SEQ ID NO: 1929483 - DNA, 15 bp, Homo sapiens
tcccgtataataaaa

SEQ ID NO: 1929484 - DNA, 23 bp, Homo sapiens
tccctaccgagtctcttctccac

SEQ ID NO: 1929485 - DNA, 20 bp, Homo sapiens
tccctagaaagccatattcc

SEQ ID NO: 1929486 - DNA, 21 bp, Homo sapiens
tccctcatctgtccctccggg

SEQ ID NO: 1929487 - DNA, 9 bp, Homo sapiens
tccctccac

SEQ ID NO: 1929488 - DNA, 15 bp, Homo sapiens
tccctccacacctcc

SEQ ID NO: 1929489 - DNA, 18 bp, Homo sapiens
tccctccacacctccacc

SEQ ID NO: 1929490 - DNA, 22 bp, Homo sapiens
tccctccacacctccacccgtc

SEQ ID NO: 1929491 - DNA, 20 bp, Homo sapiens
tccctccacgttcacccctc

SEQ ID NO: 1929492 - DNA, 17 bp, Homo sapiens
tccctccactcctccca

SEQ ID NO: 1929493 - DNA, 12 bp, Homo sapiens
tccctccctcca

SEQ ID NO: 1929494 - DNA, 15 bp, Homo sapiens
tccctccctccacac

SEQ ID NO: 1929495 - DNA, 18 bp, Homo sapiens
tccctccctgcagggtag

SEQ ID NO: 1929496 - DNA, 21 bp, Homo sapiens
tccctctacagagcttccctg

SEQ ID NO: 1929497 - DNA, 13 bp, Homo sapiens
tccctctcatcca

SEQ ID NO: 1929498 - DNA, 14 bp, Homo sapiens
tccctctcatccag

SEQ ID NO: 1929499 - DNA, 14 bp, Homo sapiens
tccctgactcattc

SEQ ID NO: 1929500 - DNA, 12 bp, Homo sapiens
tccctgcaaggt

SEQ ID NO: 1929501 - DNA, 14 bp, Homo sapiens
tccctgcaaggtgc

SEQ ID NO: 1929502 - DNA, 20 bp, Homo sapiens
tccctgcaaggtgcacctgc

SEQ ID NO: 1929503 - DNA, 21 bp, Homo sapiens
tccctgcagctttgaggctgg

SEQ ID NO: 1929504 - DNA, 10 bp, Homo sapiens
tccctgcagg

SEQ ID NO: 1929505 - DNA, 15 bp, Homo sapiens
tccctgcagggtagg

SEQ ID NO: 1929506 - DNA, 22 bp, Homo sapiens
tccctgcagggtagggggcctg

SEQ ID NO: 1929507 - DNA, 21 bp, Homo sapiens
tgaaaatatttctatgtaaat

SEQ ID NO: 1929508 - DNA, 22 bp, Homo sapiens
tgaaaatatttctatgtaaatt

SEQ ID NO: 1929509 - DNA, 20 bp, Homo sapiens
tgaaaccagtgttagggaag

SEQ ID NO: 1929510 - DNA, 21 bp, Homo sapiens
tgaaagtatcaccaaaaaatc

SEQ ID NO: 1929511 - DNA, 18 bp, Homo sapiens
tgaaatatgcatgtactt

SEQ ID NO: 1929512 - DNA, 19 bp, Homo sapiens
tgaaatatgcatgtacttt

SEQ ID NO: 1929513 - DNA, 14 bp, Homo sapiens
tgaaatttgttaat

SEQ ID NO: 1929514 - DNA, 18 bp, Homo sapiens
tgaaatttgttaatatat

SEQ ID NO: 1929515 - DNA, 14 bp, Homo sapiens
tgaactcttaatca

SEQ ID NO: 1929516 - DNA, 15 bp, Homo sapiens
tgaactcttaatcaa

SEQ ID NO: 1929517 - DNA, 21 bp, Homo sapiens
tgaactcttaatcaaatagca

SEQ ID NO: 1929518 - DNA, 16 bp, Homo sapiens
tgaactggccccagct

SEQ ID NO: 1929519 - DNA, 23 bp, Homo sapiens
tgaagacacgcccgactctctcc

SEQ ID NO: 1929520 - DNA, 23 bp, Homo sapiens
tgaagagtaagtcaacctgcctg

SEQ ID NO: 1929521 - DNA, 11 bp, Homo sapiens
tgaaggagccc

SEQ ID NO: 1929522 - DNA, 22 bp, Homo sapiens
tgaaggagccccattcctggga

SEQ ID NO: 1929523 - DNA, 23 bp, Homo sapiens
tgaaggagccccattcctgggaa

SEQ ID NO: 1929524 - DNA, 16 bp, Homo sapiens
tgaagtatctgtacct

SEQ ID NO: 1929525 - DNA, 14 bp, Homo sapiens
tgaagtcactgcac

SEQ ID NO: 1929526 - DNA, 18 bp, Homo sapiens
tgaagtgaatacatggta

SEQ ID NO: 1929527 - DNA, 18 bp, Homo sapiens
tgaatacatggtagcagg

SEQ ID NO: 1929528 - DNA, 20 bp, Homo sapiens
tgaatatgaacggtgagcat

SEQ ID NO: 1929529 - DNA, 19 bp, Homo sapiens
tgaatatgattagtaaaga

SEQ ID NO: 1929530 - DNA, 13 bp, Homo sapiens
tgaatcaaagaat

SEQ ID NO: 1929531 - DNA, 12 bp, Homo sapiens
tgaatccctttc

SEQ ID NO: 1929532 - DNA, 15 bp, Homo sapiens
tgaatcggtgctgtc

SEQ ID NO: 1929533 - DNA, 16 bp, Homo sapiens
tgaatcgtttcatgta

SEQ ID NO: 1929534 - DNA, 15 bp, Homo sapiens
tgaatgatatctttg

SEQ ID NO: 1929535 - DNA, 20 bp, Homo sapiens
tgaatgctgtacctttctga

SEQ ID NO: 1929536 - DNA, 22 bp, Homo sapiens
tgaatgctgtacctttctgaca

SEQ ID NO: 1929537 - DNA, 16 bp, Homo sapiens
tgaattacagggaaga

SEQ ID NO: 1929538 - DNA, 16 bp, Homo sapiens
tgaattagtaactgta

SEQ ID NO: 1929539 - DNA, 18 bp, Homo sapiens
tgaattgtaactgttctt

SEQ ID NO: 1929540 - DNA, 23 bp, Homo sapiens
tgaatttctagacagtattgcca

SEQ ID NO: 1929541 - DNA, 19 bp, Homo sapiens
tgacaaggtgtttctctgt

SEQ ID NO: 1929542 - DNA, 22 bp, Homo sapiens
tgacacaaataccagagcacag

SEQ ID NO: 1929543 - DNA, 20 bp, Homo sapiens
tgacaggcagtgttcttggg

SEQ ID NO: 1929544 - DNA, 17 bp, Homo sapiens
tgacatcttagtatttg

SEQ ID NO: 1929545 - DNA, 17 bp, Homo sapiens
tgacatgcgggctgggc

SEQ ID NO: 1929546 - DNA, 22 bp, Homo sapiens
tgacatgcgggctgggcagctg

SEQ ID NO: 1929547 - DNA, 22 bp, Homo sapiens
tgacatggattggatttcagtt

SEQ ID NO: 1929548 - DNA, 13 bp, Homo sapiens
tgacatttctcaa

SEQ ID NO: 1929549 - DNA, 16 bp, Homo sapiens
tgacatttctcaaagt

SEQ ID NO: 1929550 - DNA, 15 bp, Homo sapiens
tgaccagactgtggg

SEQ ID NO: 1929551 - DNA, 16 bp, Homo sapiens
tgaccaggcatcctcc

SEQ ID NO: 1929552 - DNA, 16 bp, Homo sapiens
tgaccttgatgtcttg

SEQ ID NO: 1929553 - DNA, 20 bp, Homo sapiens
tgaccttgatgtcttgagag

SEQ ID NO: 1929554 - DNA, 23 bp, Homo sapiens
tgacggcagtaaatccacagtga

SEQ ID NO: 1929555 - DNA, 16 bp, Homo sapiens
tgactacagtcaggaa

SEQ ID NO: 1929556 - DNA, 18 bp, Homo sapiens
tgactacagtcaggaaag

SEQ ID NO: 1929557 - DNA, 15 bp, Homo sapiens
tgactcagggctcct

SEQ ID NO: 1929558 - DNA, 15 bp, Homo sapiens
tgactctggctgcca

SEQ ID NO: 1929559 - DNA, 18 bp, Homo sapiens
tgactctggctgccaaga

SEQ ID NO: 1929560 - DNA, 17 bp, Homo sapiens
tgactggtcccccatgg

SEQ ID NO: 1929561 - DNA, 23 bp, Homo sapiens
tgactggtgttatcaccgtgggc

SEQ ID NO: 1929562 - DNA, 16 bp, Homo sapiens
tgactgtactcctccc

SEQ ID NO: 1929563 - DNA, 18 bp, Homo sapiens
tgactgtactcctcccag

SEQ ID NO: 1929564 - DNA, 22 bp, Homo sapiens
tgacttcagactctctcctctc

SEQ ID NO: 1929565 - DNA, 13 bp, Homo sapiens
tgactttctcagc

SEQ ID NO: 1929566 - DNA, 20 bp, Homo sapiens
tgagaaacaacaatttctac

SEQ ID NO: 1929567 - DNA, 20 bp, Homo sapiens
tgagaaattatgaaagttaa

SEQ ID NO: 1929568 - DNA, 17 bp, Homo sapiens
tgagaaggaatttgagt

SEQ ID NO: 1929569 - DNA, 16 bp, Homo sapiens
tgagaaggccccaggg

SEQ ID NO: 1929570 - DNA, 18 bp, Homo sapiens
tgagacccagccctcatc

SEQ ID NO: 1929571 - DNA, 15 bp, Homo sapiens
tgagagcgctggcct

SEQ ID NO: 1929572 - DNA, 13 bp, Homo sapiens
tgagcaaggcaag

SEQ ID NO: 1929573 - DNA, 23 bp, Homo sapiens
tgagcattgtggctgtcagcagg

SEQ ID NO: 1929574 - DNA, 19 bp, Homo sapiens
tgagccaccgcgagggcct

SEQ ID NO: 1929575 - DNA, 13 bp, Homo sapiens
tgagccctgccct

SEQ ID NO: 1929576 - DNA, 13 bp, Homo sapiens
tgagctgagcagg

SEQ ID NO: 1929577 - DNA, 16 bp, Homo sapiens
tgagctgagcagggag

SEQ ID NO: 1929578 - DNA, 21 bp, Homo sapiens
tgagctgggccctgggtgagg

SEQ ID NO: 1929579 - DNA, 15 bp, Homo sapiens
tgagcttgattctaa

SEQ ID NO: 1929580 - DNA, 15 bp, Homo sapiens
tgaggacaggagagg

SEQ ID NO: 1929581 - DNA, 12 bp, Homo sapiens
tgaggatgggaa

SEQ ID NO: 1929582 - DNA, 20 bp, Homo sapiens
tgaggatgggaaggagggag

SEQ ID NO: 1929583 - DNA, 13 bp, Homo sapiens
tgaggccagggca

SEQ ID NO: 1929584 - DNA, 15 bp, Homo sapiens
tgaggccagggcaga

SEQ ID NO: 1929585 - DNA, 22 bp, Homo sapiens
tgaggcgtgggatccagagaga

SEQ ID NO: 1929586 - DNA, 14 bp, Homo sapiens
tgaggctaaaacaa

SEQ ID NO: 1929587 - DNA, 16 bp, Homo sapiens
tgaggctaaaacaaat

SEQ ID NO: 1929588 - DNA, 23 bp, Homo sapiens
tgagggacgaggtcaaggagata

SEQ ID NO: 1929589 - DNA, 17 bp, Homo sapiens
tgagggcaaaccaggct

SEQ ID NO: 1929590 - DNA, 18 bp, Homo sapiens
tgagggcaaaccaggctg

SEQ ID NO: 1929591 - DNA, 14 bp, Homo sapiens
tgaggggcttccct

SEQ ID NO: 1929592 - DNA, 17 bp, Homo sapiens
tgaggtctaaacaaata

SEQ ID NO: 1929593 - DNA, 23 bp, Homo sapiens
tgaggtctaggaacatacttcag

SEQ ID NO: 1929594 - DNA, 22 bp, Homo sapiens
tgagtaaaatcacagatttttt

SEQ ID NO: 1929595 - DNA, 17 bp, Homo sapiens
tgagtattcattttgca

SEQ ID NO: 1929596 - DNA, 14 bp, Homo sapiens
tgagttctcatcca

SEQ ID NO: 1929597 - DNA, 22 bp, Homo sapiens
tgagttgaggggcttccctctg

SEQ ID NO: 1929598 - DNA, 12 bp, Homo sapiens
tgatacagcctt

SEQ ID NO: 1929599 - DNA, 22 bp, Homo sapiens
tgatattttcaacgcagccctg

SEQ ID NO: 1929600 - DNA, 22 bp, Homo sapiens
tgatcagagccgtggtcctttg

SEQ ID NO: 1929601 - DNA, 18 bp, Homo sapiens
tgatcggagcctcctctc

SEQ ID NO: 1929602 - DNA, 16 bp, Homo sapiens
tgatcgtgtgttgcca

SEQ ID NO: 1929603 - DNA, 17 bp, Homo sapiens
tgatgcatgcactgttc

SEQ ID NO: 1929604 - DNA, 18 bp, Homo sapiens
tgatgcatgcactgttcc

SEQ ID NO: 1929605 - DNA, 13 bp, Homo sapiens
tgatgccagctgt

SEQ ID NO: 1929606 - DNA, 21 bp, Homo sapiens
tgatgccagctgtactgagtt

SEQ ID NO: 1929607 - DNA, 11 bp, Homo sapiens
tgatgggagta

SEQ ID NO: 1929608 - DNA, 16 bp, Homo sapiens
tgatgggcactggaaa

SEQ ID NO: 1929609 - DNA, 15 bp, Homo sapiens
tgatggtgatgaaat

SEQ ID NO: 1929610 - DNA, 16 bp, Homo sapiens
tgatggtgatgaaatg

SEQ ID NO: 1929611 - DNA, 14 bp, Homo sapiens
tgatggttcccctg

SEQ ID NO: 1929612 - DNA, 22 bp, Homo sapiens
tgatgtcttgagagcgctggcc

SEQ ID NO: 1929613 - DNA, 17 bp, Homo sapiens
tgattagtaaagaaatg

SEQ ID NO: 1929614 - DNA, 20 bp, Homo sapiens
tgattcttgagtttagtgat

SEQ ID NO: 1929615 - DNA, 13 bp, Homo sapiens
tgattgatttgaa

SEQ ID NO: 1929616 - DNA, 17 bp, Homo sapiens
tgattgatttgaagtgg

SEQ ID NO: 1929617 - DNA, 17 bp, Homo sapiens
tgatttcatttcaactg

SEQ ID NO: 1929618 - DNA, 16 bp, Homo sapiens
tgattttcctgtgtcc

SEQ ID NO: 1929619 - DNA, 22 bp, Homo sapiens
tgcaaaaggactctcaggacca

SEQ ID NO: 1929620 - DNA, 13 bp, Homo sapiens
tgcaacagtagca

SEQ ID NO: 1929621 - DNA, 14 bp, Homo sapiens
tgcaacctcgctgg

SEQ ID NO: 1929622 - DNA, 19 bp, Homo sapiens
tgcaacctcgctggactct

SEQ ID NO: 1929623 - DNA, 22 bp, Homo sapiens
tgcaacctcgctggactctcag

SEQ ID NO: 1929624 - DNA, 16 bp, Homo sapiens
tgcaactttagaaaga

SEQ ID NO: 1929625 - DNA, 19 bp, Homo sapiens
tgcaactttagaaagaaat

SEQ ID NO: 1929626 - DNA, 14 bp, Homo sapiens
tgcaagctgcaggg

SEQ ID NO: 1929627 - DNA, 11 bp, Homo sapiens
tgcaagggaaa

SEQ ID NO: 1929628 - DNA, 17 bp, Homo sapiens
tgcaaggtgcacctgcc

SEQ ID NO: 1929629 - DNA, 18 bp, Homo sapiens
tgcaaggtgcacctgccc

SEQ ID NO: 1929630 - DNA, 12 bp, Homo sapiens
tgcaatggaata

SEQ ID NO: 1929631 - DNA, 17 bp, Homo sapiens
tgcaatggaatataaat

SEQ ID NO: 1929632 - DNA, 18 bp, Homo sapiens
tgcaatggaatataaata

SEQ ID NO: 1929633 - DNA, 15 bp, Homo sapiens
tgcaatgttattatt

SEQ ID NO: 1929634 - DNA, 14 bp, Homo sapiens
tgcacactttgcca

SEQ ID NO: 1929635 - DNA, 19 bp, Homo sapiens
tgcacagacgtccctccac

SEQ ID NO: 1929636 - DNA, 20 bp, Homo sapiens
tgcacagtgcatctcagccc

SEQ ID NO: 1929637 - DNA, 15 bp, Homo sapiens
tgcacatacttgaga

SEQ ID NO: 1929638 - DNA, 23 bp, Homo sapiens
tgcaccagggttgaccccagagg

SEQ ID NO: 1929639 - DNA, 14 bp, Homo sapiens
tgcacctcattcca

SEQ ID NO: 1929640 - DNA, 14 bp, Homo sapiens
tgcacctgccccag

SEQ ID NO: 1929641 - DNA, 21 bp, Homo sapiens
tgcactgttccccctgtgcag

SEQ ID NO: 1929642 - DNA, 19 bp, Homo sapiens
tgcactttccctagaaagc

SEQ ID NO: 1929643 - DNA, 22 bp, Homo sapiens
tgcactttgtgagtattctatg

SEQ ID NO: 1929644 - DNA, 14 bp, Homo sapiens
tgcagaccctgcca

SEQ ID NO: 1929645 - DNA, 16 bp, Homo sapiens
tgcagaccctgccagg

SEQ ID NO: 1929646 - DNA, 15 bp, Homo sapiens
tgcagagtcagcaga

SEQ ID NO: 1929647 - DNA, 17 bp, Homo sapiens
tgcagagtcagcagaac

SEQ ID NO: 1929648 - DNA, 15 bp, Homo sapiens
tgcagcatatgagga

SEQ ID NO: 1929649 - DNA, 17 bp, Homo sapiens
tgcagcttccttccaag

SEQ ID NO: 1929650 - DNA, 20 bp, Homo sapiens
tgcaggcaagacaccttccc

SEQ ID NO: 1929651 - DNA, 21 bp, Homo sapiens
tgcaggccacccccacctccc

SEQ ID NO: 1929652 - DNA, 20 bp, Homo sapiens
tgcagggaaaattatttgca

SEQ ID NO: 1929653 - DNA, 23 bp, Homo sapiens
tgcagggacagttgggtgtgaga

SEQ ID NO: 1929654 - DNA, 19 bp, Homo sapiens
tgcagggcagcctgtggga

SEQ ID NO: 1929655 - DNA, 14 bp, Homo sapiens
tgcagttgtatagt

SEQ ID NO: 1929656 - DNA, 16 bp, Homo sapiens
tgcagttgtgaaagca

SEQ ID NO: 1929657 - DNA, 11 bp, Homo sapiens
tgcataaaatg

SEQ ID NO: 1929658 - DNA, 15 bp, Homo sapiens
tgcatacgtaaaaat

SEQ ID NO: 1929659 - DNA, 22 bp, Homo sapiens
tgcatagtaccaatcattttaa

SEQ ID NO: 1929660 - DNA, 23 bp, Homo sapiens
tgcatattcttatgtatgtgaaa

SEQ ID NO: 1929661 - DNA, 19 bp, Homo sapiens
tgcatcccttggcccctct

SEQ ID NO: 1929662 - DNA, 18 bp, Homo sapiens
tgcatctgtggcctgggg

SEQ ID NO: 1929663 - DNA, 19 bp, Homo sapiens
tgcatctgtggcctggggc

SEQ ID NO: 1929664 - DNA, 21 bp, Homo sapiens
tgcatgttcttgttttgttat

SEQ ID NO: 1929665 - DNA, 16 bp, Homo sapiens
tgcatttaaatacagt

SEQ ID NO: 1929666 - DNA, 22 bp, Homo sapiens
tgcatttaaatacagtcttcca

SEQ ID NO: 1929667 - DNA, 14 bp, Homo sapiens
tgcatttcctgaca

SEQ ID NO: 1929668 - DNA, 13 bp, Homo sapiens
tgcatttctttat

SEQ ID NO: 1929669 - DNA, 19 bp, Homo sapiens
tgcatttctttatttctgt

SEQ ID NO: 1929670 - DNA, 21 bp, Homo sapiens
tgcatttctttatttctgtct

SEQ ID NO: 1929671 - DNA, 15 bp, Homo sapiens
tgcatttgtgtctgc

SEQ ID NO: 1929672 - DNA, 19 bp, Homo sapiens
tgcatttgtgtctgcctgc

SEQ ID NO: 1929673 - DNA, 16 bp, Homo sapiens
tgccaaccacctctgg

SEQ ID NO: 1929674 - DNA, 21 bp, Homo sapiens
tgccaagggctttgttttgca

SEQ ID NO: 1929675 - DNA, 12 bp, Homo sapiens
tgccacacttca

SEQ ID NO: 1929676 - DNA, 14 bp, Homo sapiens
tgccacacttcagg

SEQ ID NO: 1929677 - DNA, 23 bp, Homo sapiens
tgccacacttcaggctcttctcc

SEQ ID NO: 1929678 - DNA, 21 bp, Homo sapiens
tgccacagcctcccctgccag

SEQ ID NO: 1929679 - DNA, 19 bp, Homo sapiens
tgccaccctctgcagggca

SEQ ID NO: 1929680 - DNA, 13 bp, Homo sapiens
tgccacctgcagc

SEQ ID NO: 1929681 - DNA, 15 bp, Homo sapiens
tgccacgtggccgct

SEQ ID NO: 1929682 - DNA, 18 bp, Homo sapiens
tgccacttggccaccagg

SEQ ID NO: 1929683 - DNA, 21 bp, Homo sapiens
tgccacttggccaccaggact

SEQ ID NO: 1929684 - DNA, 12 bp, Homo sapiens
tgccagaagtgt

SEQ ID NO: 1929685 - DNA, 20 bp, Homo sapiens
tgccaggaccagtcaacctg

SEQ ID NO: 1929686 - DNA, 17 bp, Homo sapiens
tgccaggctgcagggac

SEQ ID NO: 1929687 - DNA, 19 bp, Homo sapiens
tgccaggctgcagggacag

SEQ ID NO: 1929688 - DNA, 11 bp, Homo sapiens
tgccagggcag

SEQ ID NO: 1929689 - DNA, 12 bp, Homo sapiens
tgccagggcagg

SEQ ID NO: 1929690 - DNA, 15 bp, Homo sapiens
tgccagggcagggcc

SEQ ID NO: 1929691 - DNA, 16 bp, Homo sapiens
tgccagggcagggccc

SEQ ID NO: 1929692 - DNA, 13 bp, Homo sapiens
tgccatattttca

SEQ ID NO: 1929693 - DNA, 14 bp, Homo sapiens
tgccatattttcac

SEQ ID NO: 1929694 - DNA, 15 bp, Homo sapiens
tgccatcatctcctg

SEQ ID NO: 1929695 - DNA, 15 bp, Homo sapiens
tgccatccctgagag

SEQ ID NO: 1929696 - DNA, 17 bp, Homo sapiens
tgccatggaggcacaca

SEQ ID NO: 1929697 - DNA, 15 bp, Homo sapiens
tgccatttcttccca

SEQ ID NO: 1929698 - DNA, 14 bp, Homo sapiens
tgccattttgtctg

SEQ ID NO: 1929699 - DNA, 18 bp, Homo sapiens
tgccattttgtctggctg

SEQ ID NO: 1929700 - DNA, 22 bp, Homo sapiens
tgccattttgtctggctgtggc

SEQ ID NO: 1929701 - DNA, 17 bp, Homo sapiens
tgcccacctgccaggct

SEQ ID NO: 1929702 - DNA, 18 bp, Homo sapiens
tgcccacctgccaggctg

SEQ ID NO: 1929703 - DNA, 16 bp, Homo sapiens
tgcccacgtcccgggc

SEQ ID NO: 1929704 - DNA, 15 bp, Homo sapiens
tgcccagcttggagt

SEQ ID NO: 1929705 - DNA, 22 bp, Homo sapiens
tgcccagcttggagtgccacgt

SEQ ID NO: 1929706 - DNA, 23 bp, Homo sapiens
tgccccaggctcaggctgcccag

SEQ ID NO: 1929707 - DNA, 14 bp, Homo sapiens
tgccccccttccca

SEQ ID NO: 1929708 - DNA, 20 bp, Homo sapiens
tgccccccttcccaccccta

SEQ ID NO: 1929709 - DNA, 20 bp, Homo sapiens
tgccctcactccactcccct

SEQ ID NO: 1929710 - DNA, 18 bp, Homo sapiens
tgccctggtgctgccaca

SEQ ID NO: 1929711 - DNA, 19 bp, Homo sapiens
tgccgctgctctcccaggt

SEQ ID NO: 1929712 - DNA, 16 bp, Homo sapiens
tgcctcatgctctcta

SEQ ID NO: 1929713 - DNA, 15 bp, Homo sapiens
tgcctcctctgtcct

SEQ ID NO: 1929714 - DNA, 16 bp, Homo sapiens
tgcctcctctgtcctc

SEQ ID NO: 1929715 - DNA, 17 bp, Homo sapiens
tgcctctacctgacact

SEQ ID NO: 1929716 - DNA, 15 bp, Homo sapiens
tgcctcttgggagac

SEQ ID NO: 1929717 - DNA, 19 bp, Homo sapiens
tgcctgcggagttgtgcac

SEQ ID NO: 1929718 - DNA, 17 bp, Homo sapiens
tgccttagaacctttct

SEQ ID NO: 1929719 - DNA, 21 bp, Homo sapiens
tgccttattagagtgtctttc

SEQ ID NO: 1929720 - DNA, 17 bp, Homo sapiens
tgccttcctcctgggcc

SEQ ID NO: 1929721 - DNA, 18 bp, Homo sapiens
tgccttctcttctatcct

SEQ ID NO: 1929722 - DNA, 11 bp, Homo sapiens
tgcgatgtgtt

SEQ ID NO: 1929723 - DNA, 13 bp, Homo sapiens
tgcgccctccctc

SEQ ID NO: 1929724 - DNA, 21 bp, Homo sapiens
tgcgccctccctccctccaca

SEQ ID NO: 1929725 - DNA, 17 bp, Homo sapiens
tgcgcttttgctggtca

SEQ ID NO: 1929726 - DNA, 18 bp, Homo sapiens
tgcgcttttgctggtcac

SEQ ID NO: 1929727 - DNA, 15 bp, Homo sapiens
tgcggaacaggagtg

SEQ ID NO: 1929728 - DNA, 13 bp, Homo sapiens
tgcgggctgggca

SEQ ID NO: 1929729 - DNA, 20 bp, Homo sapiens
tgcggttagaatcccatgga

SEQ ID NO: 1929730 - DNA, 13 bp, Homo sapiens
tgcgtaaatcaac

SEQ ID NO: 1929731 - DNA, 14 bp, Homo sapiens
tgcgtaaatcaact

SEQ ID NO: 1929732 - DNA, 17 bp, Homo sapiens
tgctaatacatttggct

SEQ ID NO: 1929733 - DNA, 23 bp, Homo sapiens
tgctaatcagggaggtcattttg

SEQ ID NO: 1929734 - DNA, 16 bp, Homo sapiens
tgctatattaggcctg

SEQ ID NO: 1929735 - DNA, 14 bp, Homo sapiens
tgctcacattccct

SEQ ID NO: 1929736 - DNA, 19 bp, Homo sapiens
tgctcatcattctctgtct

SEQ ID NO: 1929737 - DNA, 15 bp, Homo sapiens
tgctccctcacatgt

SEQ ID NO: 1929738 - DNA, 16 bp, Homo sapiens
tgctccttgggccctt

SEQ ID NO: 1929739 - DNA, 21 bp, Homo sapiens
tgctccttgggccctttgagt

SEQ ID NO: 1929740 - DNA, 15 bp, Homo sapiens
tgctctcccaggtga

SEQ ID NO: 1929741 - DNA, 13 bp, Homo sapiens
tgctctgatccct

SEQ ID NO: 1929742 - DNA, 19 bp, Homo sapiens
tgctctgatccctctacag

SEQ ID NO: 1929743 - DNA, 22 bp, Homo sapiens
tgctggaaaggcccggagatgc

SEQ ID NO: 1929744 - DNA, 14 bp, Homo sapiens
tgctggctgcctta

SEQ ID NO: 1929745 - DNA, 21 bp, Homo sapiens
tgctggctgccttagaacctt

SEQ ID NO: 1929746 - DNA, 14 bp, Homo sapiens
tgctgggaagtggc

SEQ ID NO: 1929747 - DNA, 16 bp, Homo sapiens
tgctgtaataatattt

SEQ ID NO: 1929748 - DNA, 20 bp, Homo sapiens
tgctgtcagccctgctgtca

SEQ ID NO: 1929749 - DNA, 17 bp, Homo sapiens
tgctgtcatgcccagct

SEQ ID NO: 1929750 - DNA, 19 bp, Homo sapiens
tgctgtcatgcccagcttg

SEQ ID NO: 1929751 - DNA, 14 bp, Homo sapiens
tgctgtctggcttt

SEQ ID NO: 1929752 - DNA, 12 bp, Homo sapiens
tgctgtggattt

SEQ ID NO: 1929753 - DNA, 15 bp, Homo sapiens
tgctgtggtgtgtcc

SEQ ID NO: 1929754 - DNA, 17 bp, Homo sapiens
tgctgtggtgtgtcccc

SEQ ID NO: 1929755 - DNA, 14 bp, Homo sapiens
tgctgttgtctgcc

SEQ ID NO: 1929756 - DNA, 18 bp, Homo sapiens
tgctgttgttcagaagtt

SEQ ID NO: 1929757 - DNA, 17 bp, Homo sapiens
tgctgttgtttaaaata

SEQ ID NO: 1929758 - DNA, 18 bp, Homo sapiens
tgctgttgtttaaaataa

SEQ ID NO: 1929759 - DNA, 12 bp, Homo sapiens
tgcttctgctca

SEQ ID NO: 1929760 - DNA, 13 bp, Homo sapiens
tgctttggaaatc

SEQ ID NO: 1929761 - DNA, 20 bp, Homo sapiens
tgctttgggctgccctggtg

SEQ ID NO: 1929762 - DNA, 12 bp, Homo sapiens
tggaaaccagaa

SEQ ID NO: 1929763 - DNA, 14 bp, Homo sapiens
tggaactgctgcca

SEQ ID NO: 1929764 - DNA, 23 bp, Homo sapiens
tggaactgctgccatgattttgg

SEQ ID NO: 1929765 - DNA, 18 bp, Homo sapiens
tggaagaacatcaagata

SEQ ID NO: 1929766 - DNA, 16 bp, Homo sapiens
tggaatataaatatca

SEQ ID NO: 1929767 - DNA, 22 bp, Homo sapiens
tggacatgaagattctttccca

SEQ ID NO: 1929768 - DNA, 19 bp, Homo sapiens
tggacttttgcagcttcct

SEQ ID NO: 1929769 - DNA, 22 bp, Homo sapiens
tggagaggagagaatgagagag

SEQ ID NO: 1929770 - DNA, 23 bp, Homo sapiens
tggagaggagagaatgagagagt

SEQ ID NO: 1929771 - DNA, 18 bp, Homo sapiens
tggagatgacagaaatat

SEQ ID NO: 1929772 - DNA, 13 bp, Homo sapiens
tggagcagagggg

SEQ ID NO: 1929773 - DNA, 16 bp, Homo sapiens
tggagccacaggcaga

SEQ ID NO: 1929774 - DNA, 18 bp, Homo sapiens
tggaggcacacagctgca

SEQ ID NO: 1929775 - DNA, 21 bp, Homo sapiens
tggaggcctggtctggagccc

SEQ ID NO: 1929776 - DNA, 18 bp, Homo sapiens
tggagtctgaaggagagg

SEQ ID NO: 1929777 - DNA, 19 bp, Homo sapiens
tggagtctgaaggagagga

SEQ ID NO: 1929778 - DNA, 11 bp, Homo sapiens
tggagtggagg

SEQ ID NO: 1929779 - DNA, 14 bp, Homo sapiens
tggagtgtgtgggg

SEQ ID NO: 1929780 - DNA, 21 bp, Homo sapiens
tggatgcagttgtatagtttt

SEQ ID NO: 1929781 - DNA, 17 bp, Homo sapiens
tggatggggcggcctgc

SEQ ID NO: 1929782 - DNA, 20 bp, Homo sapiens
tggatggggcggcctgcaga

SEQ ID NO: 1929783 - DNA, 16 bp, Homo sapiens
tggatgtttcttcttt

SEQ ID NO: 1929784 - DNA, 12 bp, Homo sapiens
tggatttagaga

SEQ ID NO: 1929785 - DNA, 13 bp, Homo sapiens
tggatttagagac

SEQ ID NO: 1929786 - DNA, 19 bp, Homo sapiens
tggatttagagactgtaaa

SEQ ID NO: 1929787 - DNA, 13 bp, Homo sapiens
tggcaaagacaga

SEQ ID NO: 1929788 - DNA, 19 bp, Homo sapiens
tggcaagagactactctgc

SEQ ID NO: 1929789 - DNA, 21 bp, Homo sapiens
tggcaagagactactctgcct

SEQ ID NO: 1929790 - DNA, 16 bp, Homo sapiens
tggcacagggcagtgg

SEQ ID NO: 1929791 - DNA, 17 bp, Homo sapiens
tggcagccgtgccttca

SEQ ID NO: 1929792 - DNA, 19 bp, Homo sapiens
tggcagccgtgccttcagc

SEQ ID NO: 1929793 - DNA, 20 bp, Homo sapiens
tggcagccgtgccttcagct

SEQ ID NO: 1929794 - DNA, 22 bp, Homo sapiens
tggcagccgtgccttcagctct

SEQ ID NO: 1929795 - DNA, 23 bp, Homo sapiens
tggcagccgtgccttcagctcta

SEQ ID NO: 1929796 - DNA, 14 bp, Homo sapiens
tggcagcgcccagc

SEQ ID NO: 1929797 - DNA, 16 bp, Homo sapiens
tggcagcgcccagcct

SEQ ID NO: 1929798 - DNA, 18 bp, Homo sapiens
tggcagcgcccagcctgg

SEQ ID NO: 1929799 - DNA, 15 bp, Homo sapiens
tggcattcctttctt

SEQ ID NO: 1929800 - DNA, 17 bp, Homo sapiens
tggccaaatatgcactt

SEQ ID NO: 1929801 - DNA, 19 bp, Homo sapiens
tggccaaatatgcactttc

SEQ ID NO: 1929802 - DNA, 19 bp, Homo sapiens
tggccaggtggccactcca

SEQ ID NO: 1929803 - DNA, 21 bp, Homo sapiens
tggcccacccctcttccccct

SEQ ID NO: 1929804 - DNA, 22 bp, Homo sapiens
tggccccagctcctcttcctgc

SEQ ID NO: 1929805 - DNA, 12 bp, Homo sapiens
tggccccagtga

SEQ ID NO: 1929806 - DNA, 20 bp, Homo sapiens
tggcccctccttctcccctc

SEQ ID NO: 1929807 - DNA, 19 bp, Homo sapiens
tggcccgacagcctggcac

SEQ ID NO: 1929808 - DNA, 16 bp, Homo sapiens
tggccgcaacttccca

SEQ ID NO: 1929809 - DNA, 18 bp, Homo sapiens
tggccgctgctgtgacag

SEQ ID NO: 1929810 - DNA, 20 bp, Homo sapiens
tggccggcccacgtcctggg

SEQ ID NO: 1929811 - DNA, 20 bp, Homo sapiens
tggccgggggtgggggcctg

SEQ ID NO: 1929812 - DNA, 22 bp, Homo sapiens
tggccgggggtgggggcctgct

SEQ ID NO: 1929813 - DNA, 22 bp, Homo sapiens
tggcctcttcctccctccctgc

SEQ ID NO: 1929814 - DNA, 13 bp, Homo sapiens
tggcctgggagag

SEQ ID NO: 1929815 - DNA, 15 bp, Homo sapiens
tggcctggtccaggc

SEQ ID NO: 1929816 - DNA, 19 bp, Homo sapiens
tggccttggttcctccagc

SEQ ID NO: 1929817 - DNA, 19 bp, Homo sapiens
tggcggggtctgctcctgg

SEQ ID NO: 1929818 - DNA, 21 bp, Homo sapiens
tggcggggtctgctcctggga

SEQ ID NO: 1929819 - DNA, 19 bp, Homo sapiens
tggctcctcccggtgccca

SEQ ID NO: 1929820 - DNA, 15 bp, Homo sapiens
tggctcgggacttca

SEQ ID NO: 1929821 - DNA, 20 bp, Homo sapiens
tggctgtagaaggagacaga

SEQ ID NO: 1929822 - DNA, 17 bp, Homo sapiens
tggctgtcagcaggaag

SEQ ID NO: 1929823 - DNA, 17 bp, Homo sapiens
tggcttcccgctcagcc

SEQ ID NO: 1929824 - DNA, 18 bp, Homo sapiens
tggcttcccgctcagccc

SEQ ID NO: 1929825 - DNA, 22 bp, Homo sapiens
tggcttcccgctcagccctccc

SEQ ID NO: 1929826 - DNA, 17 bp, Homo sapiens
tggcttgcactttgtga

SEQ ID NO: 1929827 - DNA, 18 bp, Homo sapiens
tggcttttcactgctggc

SEQ ID NO: 1929828 - DNA, 19 bp, Homo sapiens
tggcttttcactgctggct

SEQ ID NO: 1929829 - DNA, 22 bp, Homo sapiens
tggcttttgaatcaaagaatag

SEQ ID NO: 1929830 - DNA, 21 bp, Homo sapiens
tgggaaacccttttgcgtggt

SEQ ID NO: 1929831 - DNA, 21 bp, Homo sapiens
tgggaagacatggggaggaag

SEQ ID NO: 1929832 - DNA, 18 bp, Homo sapiens
tgggacaatggcaatagg

SEQ ID NO: 1929833 - DNA, 15 bp, Homo sapiens
tgggacggaagtggc

SEQ ID NO: 1929834 - DNA, 22 bp, Homo sapiens
tgggacggaagtggcctgagaa

SEQ ID NO: 1929835 - DNA, 17 bp, Homo sapiens
tgggactggcccacccc

SEQ ID NO: 1929836 - DNA, 14 bp, Homo sapiens
tgggagaagggaca

SEQ ID NO: 1929837 - DNA, 16 bp, Homo sapiens
tgggagaagggacagc

SEQ ID NO: 1929838 - DNA, 18 bp, Homo sapiens
tgggagacctgtaatcat

SEQ ID NO: 1929839 - DNA, 16 bp, Homo sapiens
tgggagactgagcttg

SEQ ID NO: 1929840 - DNA, 12 bp, Homo sapiens
tgggagaggaag

SEQ ID NO: 1929841 - DNA, 15 bp, Homo sapiens
tgggagaggaagcca

SEQ ID NO: 1929842 - DNA, 17 bp, Homo sapiens
tgggagaggaagccacg

SEQ ID NO: 1929843 - DNA, 15 bp, Homo sapiens
tgggagaggagaggc

SEQ ID NO: 1929844 - DNA, 16 bp, Homo sapiens
tgggagatgcagctgg

SEQ ID NO: 1929845 - DNA, 20 bp, Homo sapiens
tgggagtaggagttgctcct

SEQ ID NO: 1929846 - DNA, 19 bp, Homo sapiens
tgggagtgggagaggaagc

SEQ ID NO: 1929847 - DNA, 16 bp, Homo sapiens
tgggatggtggagggc

SEQ ID NO: 1929848 - DNA, 17 bp, Homo sapiens
tgggatggtggagggcc

SEQ ID NO: 1929849 - DNA, 14 bp, Homo sapiens
tgggattcaggaat

SEQ ID NO: 1929850 - DNA, 18 bp, Homo sapiens
tgggattcaggaatgggc

SEQ ID NO: 1929851 - DNA, 17 bp, Homo sapiens
tgggcactggaaaacat

SEQ ID NO: 1929852 - DNA, 13 bp, Homo sapiens
tgggcagagccca

SEQ ID NO: 1929853 - DNA, 21 bp, Homo sapiens
tgggcagaggggagaggaagc

SEQ ID NO: 1929854 - DNA, 20 bp, Homo sapiens
tgggcaggggttccagcttc

SEQ ID NO: 1929855 - DNA, 18 bp, Homo sapiens
tgggcagtggagagggga

SEQ ID NO: 1929856 - DNA, 13 bp, Homo sapiens
tgggccaagccag

SEQ ID NO: 1929857 - DNA, 22 bp, Homo sapiens
tgggccaagccagggttccaga

SEQ ID NO: 1929858 - DNA, 20 bp, Homo sapiens
tgggccaagtcaaagacatt

SEQ ID NO: 1929859 - DNA, 18 bp, Homo sapiens
tgggccccctctcttacc

SEQ ID NO: 1929860 - DNA, 13 bp, Homo sapiens
tgggcggcagaga

SEQ ID NO: 1929861 - DNA, 13 bp, Homo sapiens
tgggcgtgacttc

SEQ ID NO: 1929862 - DNA, 11 bp, Homo sapiens
tgggctccctg

SEQ ID NO: 1929863 - DNA, 12 bp, Homo sapiens
tgggctgaggga

SEQ ID NO: 1929864 - DNA, 16 bp, Homo sapiens
tgggctgccctggtgc

SEQ ID NO: 1929865 - DNA, 19 bp, Homo sapiens
tgggctgccctggtgctgc

SEQ ID NO: 1929866 - DNA, 20 bp, Homo sapiens
tggggaggggcctggcctgg

SEQ ID NO: 1929867 - DNA, 18 bp, Homo sapiens
tggggcagcacagagagg

SEQ ID NO: 1929868 - DNA, 22 bp, Homo sapiens
tggggcggcctgcagaccctgc

SEQ ID NO: 1929869 - DNA, 13 bp, Homo sapiens
tggggctgcatcc

SEQ ID NO: 1929870 - DNA, 19 bp, Homo sapiens
tgggggagaatggctctgg

SEQ ID NO: 1929871 - DNA, 22 bp, Homo sapiens
tgggggatttcaagggactggg

SEQ ID NO: 1929872 - DNA, 16 bp, Homo sapiens
tgggggtctggcctag

SEQ ID NO: 1929873 - DNA, 16 bp, Homo sapiens
tgggggtctgggaggc

SEQ ID NO: 1929874 - DNA, 19 bp, Homo sapiens
tgggggtctgggaggcagg

SEQ ID NO: 1929875 - DNA, 23 bp, Homo sapiens
tgggggtgccaaccacctctggc

SEQ ID NO: 1929876 - DNA, 13 bp, Homo sapiens
tggggtagagagg

SEQ ID NO: 1929877 - DNA, 14 bp, Homo sapiens
tggggtagagagga

SEQ ID NO: 1929878 - DNA, 21 bp, Homo sapiens
tggggtcttagggtacagccc

SEQ ID NO: 1929879 - DNA, 15 bp, Homo sapiens
tggggtgggagaggt

SEQ ID NO: 1929880 - DNA, 18 bp, Homo sapiens
tggggtgggagccacagg

SEQ ID NO: 1929881 - DNA, 15 bp, Homo sapiens
tggggtgttgaagac

SEQ ID NO: 1929882 - DNA, 14 bp, Homo sapiens
tgggtaacactgat

SEQ ID NO: 1929883 - DNA, 16 bp, Homo sapiens
tgggtagtgccatggc

SEQ ID NO: 1929884 - DNA, 22 bp, Homo sapiens
tgggtagtgccatggccaggag

SEQ ID NO: 1929885 - DNA, 15 bp, Homo sapiens
tgggtatattcattt

SEQ ID NO: 1929886 - DNA, 14 bp, Homo sapiens
tgggtcctcccagc

SEQ ID NO: 1929887 - DNA, 15 bp, Homo sapiens
tgggttccagacaga

SEQ ID NO: 1929888 - DNA, 21 bp, Homo sapiens
tgggttccagacagagtggat

SEQ ID NO: 1929889 - DNA, 13 bp, Homo sapiens
tggtaccagagcc

SEQ ID NO: 1929890 - DNA, 20 bp, Homo sapiens
tggtcaagccccctttgatt

SEQ ID NO: 1929891 - DNA, 13 bp, Homo sapiens
tggtcactgccat

SEQ ID NO: 1929892 - DNA, 14 bp, Homo sapiens
tggtcactgccatg

SEQ ID NO: 1929893 - DNA, 12 bp, Homo sapiens
tggtccaggaga

SEQ ID NO: 1929894 - DNA, 17 bp, Homo sapiens
tggtctggagcccctat

SEQ ID NO: 1929895 - DNA, 12 bp, Homo sapiens
tggtcttggaga

SEQ ID NO: 1929896 - DNA, 22 bp, Homo sapiens
tggtgagaactactcagggaat

SEQ ID NO: 1929897 - DNA, 23 bp, Homo sapiens
tggtgagaactactcagggaatg

SEQ ID NO: 1929898 - DNA, 18 bp, Homo sapiens
tggtgctgccacacttca

SEQ ID NO: 1929899 - DNA, 15 bp, Homo sapiens
tggtgggctccagag

SEQ ID NO: 1929900 - DNA, 19 bp, Homo sapiens
tggtgggctccagagtagg

SEQ ID NO: 1929901 - DNA, 16 bp, Homo sapiens
tggtgggtccatgggc

SEQ ID NO: 1929902 - DNA, 18 bp, Homo sapiens
tggtgggtccatgggcag

SEQ ID NO: 1929903 - DNA, 16 bp, Homo sapiens
tggtgtgatcgtctga

SEQ ID NO: 1929904 - DNA, 18 bp, Homo sapiens
tggtgtgatcgtctgact

SEQ ID NO: 1929905 - DNA, 15 bp, Homo sapiens
tggtgtgttcgtgga

SEQ ID NO: 1929906 - DNA, 20 bp, Homo sapiens
tggtgtgttcgtggagccac

SEQ ID NO: 1929907 - DNA, 17 bp, Homo sapiens
tggtgttgcagaaggtt

SEQ ID NO: 1929908 - DNA, 21 bp, Homo sapiens
tggttaccgagtatctgtaac

SEQ ID NO: 1929909 - DNA, 20 bp, Homo sapiens
tggttcccctgttcactcta

SEQ ID NO: 1929910 - DNA, 12 bp, Homo sapiens
tggttccctctt

SEQ ID NO: 1929911 - DNA, 17 bp, Homo sapiens
tggttccctctttcctg

SEQ ID NO: 1929912 - DNA, 13 bp, Homo sapiens
tggttcctccagc

SEQ ID NO: 1929913 - DNA, 22 bp, Homo sapiens
tggttggaggcctggtctggag

SEQ ID NO: 1929914 - DNA, 20 bp, Homo sapiens
tggttgggacaatggcaata

SEQ ID NO: 1929915 - DNA, 15 bp, Homo sapiens
tgtaaactgtgcacc

SEQ ID NO: 1929916 - DNA, 21 bp, Homo sapiens
tgtaaatactgtttttaacaa

SEQ ID NO: 1929917 - DNA, 14 bp, Homo sapiens
tgtaaatattcttg

SEQ ID NO: 1929918 - DNA, 18 bp, Homo sapiens
tgtaaatattcttgtcca

SEQ ID NO: 1929919 - DNA, 19 bp, Homo sapiens
tgtaaatgtttaatatctg

SEQ ID NO: 1929920 - DNA, 20 bp, Homo sapiens
tgtaaatgtttaatatctga

SEQ ID NO: 1929921 - DNA, 22 bp, Homo sapiens
tgtaaattattgtaaacttttt

SEQ ID NO: 1929922 - DNA, 11 bp, Homo sapiens
tgtaacatgta

SEQ ID NO: 1929923 - DNA, 16 bp, Homo sapiens
tgtaactttgcatgtt

SEQ ID NO: 1929924 - DNA, 21 bp, Homo sapiens
tgtaagtagcaaacagggctt

SEQ ID NO: 1929925 - DNA, 21 bp, Homo sapiens
tgtaatcttgaattgtaactg

SEQ ID NO: 1929926 - DNA, 18 bp, Homo sapiens
tgtaattggcttttgaat

SEQ ID NO: 1929927 - DNA, 14 bp, Homo sapiens
tgtacattaattac

SEQ ID NO: 1929928 - DNA, 15 bp, Homo sapiens
tgtaccgagaactgg

SEQ ID NO: 1929929 - DNA, 18 bp, Homo sapiens
tgtacgtatgaatgatat

SEQ ID NO: 1929930 - DNA, 20 bp, Homo sapiens
tgtacgtatgaatgatatct

SEQ ID NO: 1929931 - DNA, 22 bp, Homo sapiens
tgtacgtatgaatgatatcttt

SEQ ID NO: 1929932 - DNA, 12 bp, Homo sapiens
tgtactcctccc

SEQ ID NO: 1929933 - DNA, 13 bp, Homo sapiens
tgtactcctccca

SEQ ID NO: 1929934 - DNA, 20 bp, Homo sapiens
tgtactgagccttgtaattc

SEQ ID NO: 1929935 - DNA, 22 bp, Homo sapiens
tgtactgagccttgtaattcta

SEQ ID NO: 1929936 - DNA, 18 bp, Homo sapiens
tgtactgagttctcatcc

SEQ ID NO: 1929937 - DNA, 19 bp, Homo sapiens
tgtactttcattccctttc

SEQ ID NO: 1929938 - DNA, 18 bp, Homo sapiens
tgtagaagagggagaagg

SEQ ID NO: 1929939 - DNA, 19 bp, Homo sapiens
tgtagaagagggagaagga

SEQ ID NO: 1929940 - DNA, 21 bp, Homo sapiens
tgtagaaggagacagagctgg

SEQ ID NO: 1929941 - DNA, 20 bp, Homo sapiens
tgtagctaattaggaagctt

SEQ ID NO: 1929942 - DNA, 15 bp, Homo sapiens
tgtataggccatctg

SEQ ID NO: 1929943 - DNA, 17 bp, Homo sapiens
tgtataggccatctgta

SEQ ID NO: 1929944 - DNA, 18 bp, Homo sapiens
tgtatatttaaaagaaag

SEQ ID NO: 1929945 - DNA, 14 bp, Homo sapiens
tgtatgcccaaaga

SEQ ID NO: 1929946 - DNA, 15 bp, Homo sapiens
tgtattagtcacaga

SEQ ID NO: 1929947 - DNA, 20 bp, Homo sapiens
tgtattctgcaacagcctgt

SEQ ID NO: 1929948 - DNA, 21 bp, Homo sapiens
tgtatttataaatatatttaa

SEQ ID NO: 1929949 - DNA, 15 bp, Homo sapiens
tgtcaaaaaccagaa

SEQ ID NO: 1929950 - DNA, 21 bp, Homo sapiens
tgtcaaccttgtgtgagtgtg

SEQ ID NO: 1929951 - DNA, 21 bp, Homo sapiens
tgtcaaggaatgttatcagta

SEQ ID NO: 1929952 - DNA, 15 bp, Homo sapiens
tgtcaatgtttgctt

SEQ ID NO: 1929953 - DNA, 13 bp, Homo sapiens
tgtcacagaggca

SEQ ID NO: 1929954 - DNA, 21 bp, Homo sapiens
tgtcacctagcagatatgtat

SEQ ID NO: 1929955 - DNA, 14 bp, Homo sapiens
tgtcacctgtgctt

SEQ ID NO: 1929956 - DNA, 19 bp, Homo sapiens
tgtcagaccttcttccaca

SEQ ID NO: 1929957 - DNA, 22 bp, Homo sapiens
tgtcagccctgctgtcagacct

SEQ ID NO: 1929958 - DNA, 16 bp, Homo sapiens
tgtccaatcacattca

SEQ ID NO: 1929959 - DNA, 21 bp, Homo sapiens
tgtccacacaagacagcagag

SEQ ID NO: 1929960 - DNA, 22 bp, Homo sapiens
tgtccacacaagacagcagagc

SEQ ID NO: 1929961 - DNA, 14 bp, Homo sapiens
tgtccacattctac

SEQ ID NO: 1929962 - DNA, 18 bp, Homo sapiens
tgtccacgactgtctcca

SEQ ID NO: 1929963 - DNA, 18 bp, Homo sapiens
tgtccatgaaaaacagca

SEQ ID NO: 1929964 - DNA, 21 bp, Homo sapiens
tgtccatgaaaaacagcagag

SEQ ID NO: 1929965 - DNA, 14 bp, Homo sapiens
tgtccattgtccaa

SEQ ID NO: 1929966 - DNA, 18 bp, Homo sapiens
tgtcccgggtactcagtc

SEQ ID NO: 1929967 - DNA, 19 bp, Homo sapiens
tgtcccgggtactcagtca

SEQ ID NO: 1929968 - DNA, 21 bp, Homo sapiens
tgtccctaccgagtctcttct

SEQ ID NO: 1929969 - DNA, 12 bp, Homo sapiens
tgtccctccggg

SEQ ID NO: 1929970 - DNA, 21 bp, Homo sapiens
tgtccttctctcacctcctaa

SEQ ID NO: 1929971 - DNA, 24 bp, Homo sapiens
tgtcgttcccttgtgtctgttgct

SEQ ID NO: 1929972 - DNA, 17 bp, Homo sapiens
tgtctaatgcattaact

SEQ ID NO: 1929973 - DNA, 18 bp, Homo sapiens
tgtctcaagagggcactg

SEQ ID NO: 1929974 - DNA, 20 bp, Homo sapiens
tgtctcaagagggcactggt

SEQ ID NO: 1929975 - DNA, 21 bp, Homo sapiens
tgtctcaagagggcactggtg

SEQ ID NO: 1929976 - DNA, 16 bp, Homo sapiens
tgtctcatccatcatc

SEQ ID NO: 1929977 - DNA, 17 bp, Homo sapiens
tgtctcatccatcatca

SEQ ID NO: 1929978 - DNA, 21 bp, Homo sapiens
tgtctcatccatcatcatgtg

SEQ ID NO: 1929979 - DNA, 20 bp, Homo sapiens
tgtctcgaaataatttttta

SEQ ID NO: 1929980 - DNA, 18 bp, Homo sapiens
tgtctgaagtcactgcac

SEQ ID NO: 1929981 - DNA, 19 bp, Homo sapiens
tgtctgaagtcactgcaca

SEQ ID NO: 1929982 - DNA, 20 bp, Homo sapiens
tgtctgaagtcactgcacag

SEQ ID NO: 1929983 - DNA, 20 bp, Homo sapiens
tgtctgagccctgccctcac

SEQ ID NO: 1929984 - DNA, 12 bp, Homo sapiens
tgtctgatattg

SEQ ID NO: 1929985 - DNA, 21 bp, Homo sapiens
tgtctgcgccgctgtgctgtt

SEQ ID NO: 1929986 - DNA, 19 bp, Homo sapiens
tgtctggctgtggcccctc

SEQ ID NO: 1929987 - DNA, 20 bp, Homo sapiens
tgtctggctgtggcccctcc

SEQ ID NO: 1929988 - DNA, 15 bp, Homo sapiens
tgtctggctttcccg

SEQ ID NO: 1929989 - DNA, 14 bp, Homo sapiens
tgtcttttaatgat

SEQ ID NO: 1929990 - DNA, 23 bp, Homo sapiens
tgtcttttaatgatactgtctaa

SEQ ID NO: 1929991 - DNA, 18 bp, Homo sapiens
tgtgaaaatggtccagga

SEQ ID NO: 1929992 - DNA, 22 bp, Homo sapiens
tgtgaatgctgtacctttctga

SEQ ID NO: 1929993 - DNA, 19 bp, Homo sapiens
tgtgacatgcgggctgggc

SEQ ID NO: 1929994 - DNA, 15 bp, Homo sapiens
tgtgaccaatgtctt

SEQ ID NO: 1929995 - DNA, 19 bp, Homo sapiens
tgtgacgggggttggggtg

SEQ ID NO: 1929996 - DNA, 13 bp, Homo sapiens
tgtgaggccaggg

SEQ ID NO: 1929997 - DNA, 15 bp, Homo sapiens
tgtgaggccagggca

SEQ ID NO: 1929998 - DNA, 15 bp, Homo sapiens
tgtgagtattctatg

SEQ ID NO: 1929999 - DNA, 17 bp, Homo sapiens
tgtgagtattctatgta

SEQ ID NO: 1930000 - DNA, 14 bp, Homo sapiens
tgtgatgaatactg

SEQ ID NO: 1930001 - DNA, 17 bp, Homo sapiens
tgtgcacatctgtgtct

SEQ ID NO: 1930002 - DNA, 22 bp, Homo sapiens
tgtgcactgaatcgtttcatgt

SEQ ID NO: 1930003 - DNA, 16 bp, Homo sapiens
tgtgccaccctctgca

SEQ ID NO: 1930004 - DNA, 22 bp, Homo sapiens
tgtgccaccctctgcagggcag

SEQ ID NO: 1930005 - DNA, 23 bp, Homo sapiens
tgtgccaccctctgcagggcagc

SEQ ID NO: 1930006 - DNA, 13 bp, Homo sapiens
tgtgcccagtcat

SEQ ID NO: 1930007 - DNA, 19 bp, Homo sapiens
tgtgcttcgggcccttccc

SEQ ID NO: 1930008 - DNA, 14 bp, Homo sapiens
tgtggagaggagag

SEQ ID NO: 1930009 - DNA, 19 bp, Homo sapiens
tgtggagaggagagaatga

SEQ ID NO: 1930010 - DNA, 19 bp, Homo sapiens
tgtggagagtgcaacagta

SEQ ID NO: 1930011 - DNA, 12 bp, Homo sapiens
tgtggagtggag

SEQ ID NO: 1930012 - DNA, 16 bp, Homo sapiens
tgtggagtggaggggt

SEQ ID NO: 1930013 - DNA, 19 bp, Homo sapiens
tgtggattttgtggcttca

SEQ ID NO: 1930014 - DNA, 16 bp, Homo sapiens
tgtggccaaaggaggg

SEQ ID NO: 1930015 - DNA, 24 bp, Homo sapiens
tgtggccaaaggagggtcaggaag

SEQ ID NO: 1930016 - DNA, 17 bp, Homo sapiens
tgtggcccctccttctc

SEQ ID NO: 1930017 - DNA, 19 bp, Homo sapiens
tgtggcccctccttctccc

SEQ ID NO: 1930018 - DNA, 19 bp, Homo sapiens
tgtggctgtcagcaggaag

SEQ ID NO: 1930019 - DNA, 21 bp, Homo sapiens
tgtggctgtcagcaggaagca

SEQ ID NO: 1930020 - DNA, 16 bp, Homo sapiens
tgtgggactggcccac

SEQ ID NO: 1930021 - DNA, 16 bp, Homo sapiens
tgtgggagaagggaca

SEQ ID NO: 1930022 - DNA, 17 bp, Homo sapiens
tgtgggagaagggacag

SEQ ID NO: 1930023 - DNA, 18 bp, Homo sapiens
tgtgggagaagggacagc

SEQ ID NO: 1930024 - DNA, 13 bp, Homo sapiens
tgtggggagggtg

SEQ ID NO: 1930025 - DNA, 18 bp, Homo sapiens
tgtgggggtctgggaggc

SEQ ID NO: 1930026 - DNA, 22 bp, Homo sapiens
tgtgggggtctgggaggcaggt

SEQ ID NO: 1930027 - DNA, 13 bp, Homo sapiens
tgtgggtccctgc

SEQ ID NO: 1930028 - DNA, 21 bp, Homo sapiens
tgtggttaccgagtatctgta

SEQ ID NO: 1930029 - DNA, 17 bp, Homo sapiens
tgtgtccacgactgtct

SEQ ID NO: 1930030 - DNA, 16 bp, Homo sapiens
tgtgtccccctctgtc

SEQ ID NO: 1930031 - DNA, 12 bp, Homo sapiens
tgtgtctgcctg

SEQ ID NO: 1930032 - DNA, 15 bp, Homo sapiens
tgtgtctgcctgcct

SEQ ID NO: 1930033 - DNA, 23 bp, Homo sapiens
tgtgtctgcctgcctcatgctct

SEQ ID NO: 1930034 - DNA, 23 bp, Homo sapiens
tgtgtgaagatcacgttccttcc

SEQ ID NO: 1930035 - DNA, 23 bp, Homo sapiens
tgtgtgagggcaaaccaggctgc

SEQ ID NO: 1930036 - DNA, 19 bp, Homo sapiens
tgtgtttcaggacagctgc

SEQ ID NO: 1930037 - DNA, 23 bp, Homo sapiens
tgtgtttcaggacagctgcttct

SEQ ID NO: 1930038 - DNA, 14 bp, Homo sapiens
tgtgtttgtatata

SEQ ID NO: 1930039 - DNA, 20 bp, Homo sapiens
tgtgttttattcacttgtgt

SEQ ID NO: 1930040 - DNA, 15 bp, Homo sapiens
tgttaagtattttca

SEQ ID NO: 1930041 - DNA, 17 bp, Homo sapiens
tgttatgtcattgtgtt

SEQ ID NO: 1930042 - DNA, 21 bp, Homo sapiens
tgttattagagattacctcct

SEQ ID NO: 1930043 - DNA, 14 bp, Homo sapiens
tgttattattggct

SEQ ID NO: 1930044 - DNA, 14 bp, Homo sapiens
tgttattttgcaac

SEQ ID NO: 1930045 - DNA, 16 bp, Homo sapiens
tgttcaaactactgta

SEQ ID NO: 1930046 - DNA, 22 bp, Homo sapiens
tgttcaaagccagcgtcctcct

SEQ ID NO: 1930047 - DNA, 13 bp, Homo sapiens
tgttcagaagttg

SEQ ID NO: 1930048 - DNA, 17 bp, Homo sapiens
tgttccatcctgtacaa

SEQ ID NO: 1930049 - DNA, 12 bp, Homo sapiens
tgttcctgcctt

SEQ ID NO: 1930050 - DNA, 21 bp, Homo sapiens
tgttcttgggggtggggctgc

SEQ ID NO: 1930051 - DNA, 16 bp, Homo sapiens
tgttgctgtctggctt

SEQ ID NO: 1930052 - DNA, 19 bp, Homo sapiens
tgtttaatatctgactgaa

SEQ ID NO: 1930053 - DNA, 19 bp, Homo sapiens
tgtttactagggatccctc

SEQ ID NO: 1930054 - DNA, 16 bp, Homo sapiens
tgtttgatgtgtatgt

SEQ ID NO: 1930055 - DNA, 18 bp, Homo sapiens
tgtttgatgtgtatgtgt

SEQ ID NO: 1930056 - DNA, 19 bp, Homo sapiens
tgtttgatgtgtatgtgtt

SEQ ID NO: 1930057 - DNA, 18 bp, Homo sapiens
tgtttgcaactggtatat

SEQ ID NO: 1930058 - DNA, 20 bp, Homo sapiens
tgtttgcaactggtatatat

SEQ ID NO: 1930059 - DNA, 18 bp, Homo sapiens
tgtttggaatattgtcca

SEQ ID NO: 1930060 - DNA, 17 bp, Homo sapiens
tgtttggaatttaagaa

SEQ ID NO: 1930061 - DNA, 23 bp, Homo sapiens
tgtttgggaatggtgcccttgga

SEQ ID NO: 1930062 - DNA, 18 bp, Homo sapiens
tgtttgggaggctggagt

SEQ ID NO: 1930063 - DNA, 15 bp, Homo sapiens
tgtttgtgctgtggt

SEQ ID NO: 1930064 - DNA, 14 bp, Homo sapiens
tgttttgttatata

SEQ ID NO: 1930065 - DNA, 19 bp, Homo sapiens
tgttttttttttccactta

SEQ ID NO: 1930066 - DNA, 23 bp, Homo sapiens
ttaaaaacacctaagtgactacc

SEQ ID NO: 1930067 - DNA, 15 bp, Homo sapiens
ttaaaacaaattaaa

SEQ ID NO: 1930068 - DNA, 13 bp, Homo sapiens
ttaaaataaaagt

SEQ ID NO: 1930069 - DNA, 22 bp, Homo sapiens
ttaaagaggagcctttccagaa

SEQ ID NO: 1930070 - DNA, 19 bp, Homo sapiens
ttaaaggaccctatatgtg

SEQ ID NO: 1930071 - DNA, 12 bp, Homo sapiens
ttaaatgagaag

SEQ ID NO: 1930072 - DNA, 14 bp, Homo sapiens
ttaaattttcagaa

SEQ ID NO: 1930073 - DNA, 17 bp, Homo sapiens
ttaaattttcagaaagc

SEQ ID NO: 1930074 - DNA, 16 bp, Homo sapiens
ttaacaggtctttgaa

SEQ ID NO: 1930075 - DNA, 15 bp, Homo sapiens
ttaagaactgacaca

SEQ ID NO: 1930076 - DNA, 22 bp, Homo sapiens
ttaagataatatttaaaatagt

SEQ ID NO: 1930077 - DNA, 13 bp, Homo sapiens
ttaagcactttga

SEQ ID NO: 1930078 - DNA, 20 bp, Homo sapiens
ttaagcactttgaaaatatt

SEQ ID NO: 1930079 - DNA, 21 bp, Homo sapiens
ttaagccacttaaaatgttca

SEQ ID NO: 1930080 - DNA, 20 bp, Homo sapiens
ttaagtggctgtgattaatt

SEQ ID NO: 1930081 - DNA, 18 bp, Homo sapiens
ttaagttgctgatgaact

SEQ ID NO: 1930082 - DNA, 17 bp, Homo sapiens
ttaataggaggacagaa

SEQ ID NO: 1930083 - DNA, 15 bp, Homo sapiens
ttaatataactgcct

SEQ ID NO: 1930084 - DNA, 23 bp, Homo sapiens
ttaatataactgccttaaaactt

SEQ ID NO: 1930085 - DNA, 19 bp, Homo sapiens
ttaattcaattaaaaccat

SEQ ID NO: 1930086 - DNA, 21 bp, Homo sapiens
ttaattttcctctaattaaaa

SEQ ID NO: 1930087 - DNA, 16 bp, Homo sapiens
ttacaatgtgcactga

SEQ ID NO: 1930088 - DNA, 15 bp, Homo sapiens
ttacaatttctttaa

SEQ ID NO: 1930089 - DNA, 11 bp, Homo sapiens
ttacagaagaa

SEQ ID NO: 1930090 - DNA, 15 bp, Homo sapiens
ttacagggaagaaat

SEQ ID NO: 1930091 - DNA, 16 bp, Homo sapiens
ttacagggaagaaatc

SEQ ID NO: 1930092 - DNA, 19 bp, Homo sapiens
ttacagtaggagcccagct

SEQ ID NO: 1930093 - DNA, 22 bp, Homo sapiens
ttacagtgtatctcgaagtctt

SEQ ID NO: 1930094 - DNA, 19 bp, Homo sapiens
ttacattattatcaacaat

SEQ ID NO: 1930095 - DNA, 21 bp, Homo sapiens
ttaccagcctccgtatttcag

SEQ ID NO: 1930096 - DNA, 22 bp, Homo sapiens
ttaccagcctccgtatttcaga

SEQ ID NO: 1930097 - DNA, 23 bp, Homo sapiens
ttaccagcctccgtatttcagac

SEQ ID NO: 1930098 - DNA, 22 bp, Homo sapiens
ttaccattttgcgatgtgtttt

SEQ ID NO: 1930099 - DNA, 21 bp, Homo sapiens
ttacccacactacgcagaaga

SEQ ID NO: 1930100 - DNA, 23 bp, Homo sapiens
ttacccacactacgcagaagaga

SEQ ID NO: 1930101 - DNA, 17 bp, Homo sapiens
ttaccgagtatctgtaa

SEQ ID NO: 1930102 - DNA, 20 bp, Homo sapiens
ttaccgagtatctgtaaccc

SEQ ID NO: 1930103 - DNA, 11 bp, Homo sapiens
ttacctcctga

SEQ ID NO: 1930104 - DNA, 19 bp, Homo sapiens
ttacctcctgagaaaaaag

SEQ ID NO: 1930105 - DNA, 20 bp, Homo sapiens
ttactaagatgaaattgcca

SEQ ID NO: 1930106 - DNA, 15 bp, Homo sapiens
ttacttttgtaaata

SEQ ID NO: 1930107 - DNA, 13 bp, Homo sapiens
ttagaacctttct

SEQ ID NO: 1930108 - DNA, 17 bp, Homo sapiens
ttagaatcccatggatg

SEQ ID NO: 1930109 - DNA, 16 bp, Homo sapiens
ttagatgtagcactga

SEQ ID NO: 1930110 - DNA, 16 bp, Homo sapiens
ttagcagtttgctttg

SEQ ID NO: 1930111 - DNA, 14 bp, Homo sapiens
ttagggaagggcct

SEQ ID NO: 1930112 - DNA, 21 bp, Homo sapiens
ttaggtagtaggaagaattac

SEQ ID NO: 1930113 - DNA, 14 bp, Homo sapiens
ttagtaaagaaatg

SEQ ID NO: 1930114 - DNA, 13 bp, Homo sapiens
ttagtatttgcat

SEQ ID NO: 1930115 - DNA, 14 bp, Homo sapiens
ttagtgatttgcta

SEQ ID NO: 1930116 - DNA, 15 bp, Homo sapiens
ttataagcaacatga

SEQ ID NO: 1930117 - DNA, 20 bp, Homo sapiens
ttataagcaacatgaattaa

SEQ ID NO: 1930118 - DNA, 22 bp, Homo sapiens
ttatataaaaaaattgtaaatg

SEQ ID NO: 1930119 - DNA, 14 bp, Homo sapiens
ttatatataaatat

SEQ ID NO: 1930120 - DNA, 14 bp, Homo sapiens
ttatatatgtattt

SEQ ID NO: 1930121 - DNA, 17 bp, Homo sapiens
ttatatatgtatttata

SEQ ID NO: 1930122 - DNA, 15 bp, Homo sapiens
ttatcaaaactttct

SEQ ID NO: 1930123 - DNA, 12 bp, Homo sapiens
ttatcattttca

SEQ ID NO: 1930124 - DNA, 16 bp, Homo sapiens
ttatcattttcaaaat

SEQ ID NO: 1930125 - DNA, 23 bp, Homo sapiens
ttatcccatctcactttaataat

SEQ ID NO: 1930126 - DNA, 21 bp, Homo sapiens
ttatctccccttcacatgcat

SEQ ID NO: 1930127 - DNA, 17 bp, Homo sapiens
ttatctgtctgagccct

SEQ ID NO: 1930128 - DNA, 20 bp, Homo sapiens
ttatctgtctgagccctgcc

SEQ ID NO: 1930129 - DNA, 21 bp, Homo sapiens
ttatgtatatttaaaagaaag

SEQ ID NO: 1930130 - DNA, 22 bp, Homo sapiens
ttattaaatcagaatctttaaa

SEQ ID NO: 1930131 - DNA, 23 bp, Homo sapiens
ttattgaggaaaattaatatcac

SEQ ID NO: 1930132 - DNA, 14 bp, Homo sapiens
ttattgagttctga

SEQ ID NO: 1930133 - DNA, 18 bp, Homo sapiens
ttattgagttctgaaggt

SEQ ID NO: 1930134 - DNA, 22 bp, Homo sapiens
ttattgcctttagaaactgagt

SEQ ID NO: 1930135 - DNA, 12 bp, Homo sapiens
ttattgtaaact

SEQ ID NO: 1930136 - DNA, 13 bp, Homo sapiens
ttattgtaaactt

SEQ ID NO: 1930137 - DNA, 17 bp, Homo sapiens
ttatttaaattttcaga

SEQ ID NO: 1930138 - DNA, 14 bp, Homo sapiens
ttatttatgcctct

SEQ ID NO: 1930139 - DNA, 17 bp, Homo sapiens
ttatttcagaaatgtac

SEQ ID NO: 1930140 - DNA, 14 bp, Homo sapiens
ttatttttggactt

SEQ ID NO: 1930141 - DNA, 14 bp, Homo sapiens
ttattttttaatta

SEQ ID NO: 1930142 - DNA, 19 bp, Homo sapiens
ttcaaaatcagtgatggga

SEQ ID NO: 1930143 - DNA, 20 bp, Homo sapiens
ttcaaaatgatattcaatct

SEQ ID NO: 1930144 - DNA, 18 bp, Homo sapiens
ttcaaagaacccccctcc

SEQ ID NO: 1930145 - DNA, 19 bp, Homo sapiens
ttcaaagaacccccctccc

SEQ ID NO: 1930146 - DNA, 13 bp, Homo sapiens
ttcaaagccagcg

SEQ ID NO: 1930147 - DNA, 20 bp, Homo sapiens
ttcaacgcagccctgctttg

SEQ ID NO: 1930148 - DNA, 17 bp, Homo sapiens
ttcaagcagattggaga

SEQ ID NO: 1930149 - DNA, 19 bp, Homo sapiens
ttcaagtcgcggctgcagg

SEQ ID NO: 1930150 - DNA, 14 bp, Homo sapiens
ttcaagtgctaaaa

SEQ ID NO: 1930151 - DNA, 20 bp, Homo sapiens
ttcaataagcatcaaactct

SEQ ID NO: 1930152 - DNA, 13 bp, Homo sapiens
ttcactgctggct

SEQ ID NO: 1930153 - DNA, 15 bp, Homo sapiens
ttcactgctggctgc

SEQ ID NO: 1930154 - DNA, 17 bp, Homo sapiens
ttcactgctggctgcct

SEQ ID NO: 1930155 - DNA, 15 bp, Homo sapiens
ttcacttgtgtttgt

SEQ ID NO: 1930156 - DNA, 17 bp, Homo sapiens
ttcacttttgacaaagg

SEQ ID NO: 1930157 - DNA, 20 bp, Homo sapiens
ttcacttttgacaaaggcaa

SEQ ID NO: 1930158 - DNA, 21 bp, Homo sapiens
ttcagaagttgttagtgattt

SEQ ID NO: 1930159 - DNA, 24 bp, Homo sapiens
ttcagactctctcctctctctccc

SEQ ID NO: 1930160 - DNA, 14 bp, Homo sapiens
ttcagccattcaca

SEQ ID NO: 1930161 - DNA, 12 bp, Homo sapiens
ttcagtgttaaa

SEQ ID NO: 1930162 - DNA, 15 bp, Homo sapiens
ttcagttcaatcaaa

SEQ ID NO: 1930163 - DNA, 17 bp, Homo sapiens
ttcataagtatttcaaa

SEQ ID NO: 1930164 - DNA, 14 bp, Homo sapiens
ttcatagatttcct

SEQ ID NO: 1930165 - DNA, 20 bp, Homo sapiens
ttcatatgtaccatgtacat

SEQ ID NO: 1930166 - DNA, 20 bp, Homo sapiens
ttcatcaccagactttggct

SEQ ID NO: 1930167 - DNA, 18 bp, Homo sapiens
ttcatgtaaactgtgcac

SEQ ID NO: 1930168 - DNA, 16 bp, Homo sapiens
ttcatgtaagtagcaa

SEQ ID NO: 1930169 - DNA, 13 bp, Homo sapiens
ttcattggatgca

SEQ ID NO: 1930170 - DNA, 15 bp, Homo sapiens
ttcatttcaactgtt

SEQ ID NO: 1930171 - DNA, 20 bp, Homo sapiens
ttccaagcctgggccactgg

SEQ ID NO: 1930172 - DNA, 21 bp, Homo sapiens
ttccacggagccactcctctg

SEQ ID NO: 1930173 - DNA, 21 bp, Homo sapiens
ttccatctatataaatcgcat

SEQ ID NO: 1930174 - DNA, 16 bp, Homo sapiens
ttccattggatctcat

SEQ ID NO: 1930175 - DNA, 17 bp, Homo sapiens
ttccattggatctcatt

SEQ ID NO: 1930176 - DNA, 21 bp, Homo sapiens
ttcccaaggccagtctgaacc

SEQ ID NO: 1930177 - DNA, 16 bp, Homo sapiens
ttcccacggccactgc

SEQ ID NO: 1930178 - DNA, 17 bp, Homo sapiens
ttcccacggccactgca

SEQ ID NO: 1930179 - DNA, 23 bp, Homo sapiens
ttcccactgcggaacaggagtga

SEQ ID NO: 1930180 - DNA, 17 bp, Homo sapiens
ttcccatcactgctgtc

SEQ ID NO: 1930181 - DNA, 16 bp, Homo sapiens
ttcccccttcccctgc

SEQ ID NO: 1930182 - DNA, 17 bp, Homo sapiens
ttcccccttcccctgcg

SEQ ID NO: 1930183 - DNA, 19 bp, Homo sapiens
ttcccctgcgccctccctc

SEQ ID NO: 1930184 - DNA, 21 bp, Homo sapiens
ttcccctgcgccctccctccc

SEQ ID NO: 1930185 - DNA, 18 bp, Homo sapiens
ttcccgctcagccctccc

SEQ ID NO: 1930186 - DNA, 16 bp, Homo sapiens
ttcccgtataataaaa

SEQ ID NO: 1930187 - DNA, 16 bp, Homo sapiens
ttccctagatggttcc

SEQ ID NO: 1930188 - DNA, 19 bp, Homo sapiens
ttccctctttcctgtgcca

SEQ ID NO: 1930189 - DNA, 13 bp, Homo sapiens
ttccctgactcat

SEQ ID NO: 1930190 - DNA, 11 bp, Homo sapiens
ttccctggaga

SEQ ID NO: 1930191 - DNA, 18 bp, Homo sapiens
ttccctttgttgctgtct

SEQ ID NO: 1930192 - DNA, 21 bp, Homo sapiens
ttccggaatcctgtcctcagc

SEQ ID NO: 1930193 - DNA, 19 bp, Homo sapiens
ttcctaacaggattagaca

SEQ ID NO: 1930194 - DNA, 19 bp, Homo sapiens
ttcctaataaagttctgta

SEQ ID NO: 1930195 - DNA, 22 bp, Homo sapiens
ttcctaataaagttctgtactc

SEQ ID NO: 1930196 - DNA, 13 bp, Homo sapiens
ttcctatacgcag

SEQ ID NO: 1930197 - DNA, 15 bp, Homo sapiens
ttcctccctccctgc

SEQ ID NO: 1930198 - DNA, 13 bp, Homo sapiens
ttcctctccactg

SEQ ID NO: 1930199 - DNA, 18 bp, Homo sapiens
ttcctgccttctcttcta

SEQ ID NO: 1930200 - DNA, 17 bp, Homo sapiens
ttcctggacagtgagag

SEQ ID NO: 1930201 - DNA, 17 bp, Homo sapiens
ttcctgtgccaggactc

SEQ ID NO: 1930202 - DNA, 18 bp, Homo sapiens
ttccttaagtggctgtga

SEQ ID NO: 1930203 - DNA, 21 bp, Homo sapiens
ttccttctcgtcttcctctct

SEQ ID NO: 1930204 - DNA, 21 bp, Homo sapiens
ttcctttgtttttttttcctg

SEQ ID NO: 1930205 - DNA, 20 bp, Homo sapiens
ttcgatacaccgggcctgga

SEQ ID NO: 1930206 - DNA, 14 bp, Homo sapiens
ttcgccgtggctgc

SEQ ID NO: 1930207 - DNA, 21 bp, Homo sapiens
ttcgccgtggctgcggcaccc

SEQ ID NO: 1930208 - DNA, 15 bp, Homo sapiens
ttctaaatgaatgtt

SEQ ID NO: 1930209 - DNA, 15 bp, Homo sapiens
ttctaagtctttcca

SEQ ID NO: 1930210 - DNA, 23 bp, Homo sapiens
ttctatatatacaatgagtaaaa

SEQ ID NO: 1930211 - DNA, 16 bp, Homo sapiens
ttctatatttgtaact

SEQ ID NO: 1930212 - DNA, 23 bp, Homo sapiens
ttctatgtaaattattgtaaact

SEQ ID NO: 1930213 - DNA, 17 bp, Homo sapiens
ttctatttctcctccat

SEQ ID NO: 1930214 - DNA, 21 bp, Homo sapiens
ttctcaaagtttttacagtgt

SEQ ID NO: 1930215 - DNA, 16 bp, Homo sapiens
ttctcactcctacctg

SEQ ID NO: 1930216 - DNA, 15 bp, Homo sapiens
ttctcagcctccgga

SEQ ID NO: 1930217 - DNA, 23 bp, Homo sapiens
ttctcctccatgggagaaaatag

SEQ ID NO: 1930218 - DNA, 12 bp, Homo sapiens
ttctcctctccc

SEQ ID NO: 1930219 - DNA, 17 bp, Homo sapiens
ttctcctttcacaacct

SEQ ID NO: 1930220 - DNA, 18 bp, Homo sapiens
ttctcgtcttcctctctc

SEQ ID NO: 1930221 - DNA, 19 bp, Homo sapiens
ttctctaagagaacaatgt

SEQ ID NO: 1930222 - DNA, 18 bp, Homo sapiens
ttctctgagctgtgcagg

SEQ ID NO: 1930223 - DNA, 13 bp, Homo sapiens
ttctctgtctcat

SEQ ID NO: 1930224 - DNA, 15 bp, Homo sapiens
ttctcttctatcctg

SEQ ID NO: 1930225 - DNA, 18 bp, Homo sapiens
ttctgaaggttggaactg

SEQ ID NO: 1930226 - DNA, 21 bp, Homo sapiens
ttctgaaggttggaactgctg

SEQ ID NO: 1930227 - DNA, 22 bp, Homo sapiens
ttctgacttcatagatttcctt

SEQ ID NO: 1930228 - DNA, 14 bp, Homo sapiens
ttctgggacttgaa

SEQ ID NO: 1930229 - DNA, 23 bp, Homo sapiens
ttctgggggatttcaagggactg

SEQ ID NO: 1930230 - DNA, 12 bp, Homo sapiens
ttctgtggctca

SEQ ID NO: 1930231 - DNA, 19 bp, Homo sapiens
ttcttaagcactttgaaaa

SEQ ID NO: 1930232 - DNA, 17 bp, Homo sapiens
ttcttagctcttgggat

SEQ ID NO: 1930233 - DNA, 21 bp, Homo sapiens
ttcttatttaaattttcagaa

SEQ ID NO: 1930234 - DNA, 22 bp, Homo sapiens
ttcttatttaaattttcagaaa

SEQ ID NO: 1930235 - DNA, 18 bp, Homo sapiens
ttcttctaggttctaaaa

SEQ ID NO: 1930236 - DNA, 22 bp, Homo sapiens
ttcttggttgaggaaacaaaca

SEQ ID NO: 1930237 - DNA, 17 bp, Homo sapiens
ttcttgtccacattcta

SEQ ID NO: 1930238 - DNA, 21 bp, Homo sapiens
ttcttttctggaatgtaatca

SEQ ID NO: 1930239 - DNA, 20 bp, Homo sapiens
ttgaaaaaatagagcctgag

SEQ ID NO: 1930240 - DNA, 13 bp, Homo sapiens
ttgaaaagacatc

SEQ ID NO: 1930241 - DNA, 22 bp, Homo sapiens
ttgaaaatatttctatgtaaat

SEQ ID NO: 1930242 - DNA, 15 bp, Homo sapiens
ttgaaagaaaatatg

SEQ ID NO: 1930243 - DNA, 16 bp, Homo sapiens
ttgaagggggatgcag

SEQ ID NO: 1930244 - DNA, 21 bp, Homo sapiens
ttgaattacagggaagaaatc

SEQ ID NO: 1930245 - DNA, 21 bp, Homo sapiens
ttgaattcttggttgaggaaa

SEQ ID NO: 1930246 - DNA, 13 bp, Homo sapiens
ttgacaaactctc

SEQ ID NO: 1930247 - DNA, 18 bp, Homo sapiens
ttgacaaaggcaagcact

SEQ ID NO: 1930248 - DNA, 16 bp, Homo sapiens
ttgacaaccatgagac

SEQ ID NO: 1930249 - DNA, 22 bp, Homo sapiens
ttgaccgtttttatattacttt

SEQ ID NO: 1930250 - DNA, 15 bp, Homo sapiens
ttgactcttttgcca

SEQ ID NO: 1930251 - DNA, 18 bp, Homo sapiens
ttgagcaaggcaagaagt

SEQ ID NO: 1930252 - DNA, 20 bp, Homo sapiens
ttgaggggcttccctctgct

SEQ ID NO: 1930253 - DNA, 19 bp, Homo sapiens
ttgagttttcagtggggca

SEQ ID NO: 1930254 - DNA, 21 bp, Homo sapiens
ttgatgccagctgtactgagt

SEQ ID NO: 1930255 - DNA, 19 bp, Homo sapiens
ttgatgtgtatgtgtttat

SEQ ID NO: 1930256 - DNA, 16 bp, Homo sapiens
ttgatttgaagtggaa

SEQ ID NO: 1930257 - DNA, 14 bp, Homo sapiens
ttgcaacctcgctg

SEQ ID NO: 1930258 - DNA, 12 bp, Homo sapiens
ttgcagacctgg

SEQ ID NO: 1930259 - DNA, 16 bp, Homo sapiens
ttgcagacctgggact

SEQ ID NO: 1930260 - DNA, 19 bp, Homo sapiens
ttgcagacctgggacttta

SEQ ID NO: 1930261 - DNA, 21 bp, Homo sapiens
ttgcagcctagtaggagctga

SEQ ID NO: 1930262 - DNA, 12 bp, Homo sapiens
ttgcagcttcct

SEQ ID NO: 1930263 - DNA, 19 bp, Homo sapiens
ttgcataacaattcctcta

SEQ ID NO: 1930264 - DNA, 22 bp, Homo sapiens
ttgcatagtaccaatcatttta

SEQ ID NO: 1930265 - DNA, 15 bp, Homo sapiens
ttgcatgttcttgtt

SEQ ID NO: 1930266 - DNA, 18 bp, Homo sapiens
ttgccatttcttcccaag

SEQ ID NO: 1930267 - DNA, 24 bp, Homo sapiens
ttgccatttcttcccaaggccagt

SEQ ID NO: 1930268 - DNA, 12 bp, Homo sapiens
ttgccgctggga

SEQ ID NO: 1930269 - DNA, 15 bp, Homo sapiens
ttgccgctgggagag

SEQ ID NO: 1930270 - DNA, 16 bp, Homo sapiens
ttgccgctgggagagc

SEQ ID NO: 1930271 - DNA, 17 bp, Homo sapiens
ttgccttctacttttaa

SEQ ID NO: 1930272 - DNA, 19 bp, Homo sapiens
ttgcgtggtccttaggctt

SEQ ID NO: 1930273 - DNA, 13 bp, Homo sapiens
ttgctcccagttt

SEQ ID NO: 1930274 - DNA, 12 bp, Homo sapiens
ttgctcctaccc

SEQ ID NO: 1930275 - DNA, 19 bp, Homo sapiens
ttgctcctacccctgtcct

SEQ ID NO: 1930276 - DNA, 19 bp, Homo sapiens
ttgctcttaagttgtggag

SEQ ID NO: 1930277 - DNA, 18 bp, Homo sapiens
ttgctgtctggctttccc

SEQ ID NO: 1930278 - DNA, 19 bp, Homo sapiens
ttgctgtctggctttcccg

SEQ ID NO: 1930279 - DNA, 17 bp, Homo sapiens
ttgctgtttatatatat

SEQ ID NO: 1930280 - DNA, 22 bp, Homo sapiens
ttgcttgaaagaaaatatgcat

SEQ ID NO: 1930281 - DNA, 13 bp, Homo sapiens
ttgctttgtatgc

SEQ ID NO: 1930282 - DNA, 13 bp, Homo sapiens
ttggacccttcca

SEQ ID NO: 1930283 - DNA, 14 bp, Homo sapiens
ttggacccttccat

SEQ ID NO: 1930284 - DNA, 12 bp, Homo sapiens
ttggagaggagg

SEQ ID NO: 1930285 - DNA, 20 bp, Homo sapiens
ttggagatgacagaaatatg

SEQ ID NO: 1930286 - DNA, 17 bp, Homo sapiens
ttggagcgtttttgctg

SEQ ID NO: 1930287 - DNA, 22 bp, Homo sapiens
ttggaggcaacctcccatttta

SEQ ID NO: 1930288 - DNA, 19 bp, Homo sapiens
ttggataggagcttccaga

SEQ ID NO: 1930289 - DNA, 15 bp, Homo sapiens
ttggatgcagttgta

SEQ ID NO: 1930290 - DNA, 22 bp, Homo sapiens
ttggccactttgcagacctggg

SEQ ID NO: 1930291 - DNA, 17 bp, Homo sapiens
ttggctcgggacttcaa

SEQ ID NO: 1930292 - DNA, 21 bp, Homo sapiens
ttggctcgggacttcaaaatc

SEQ ID NO: 1930293 - DNA, 12 bp, Homo sapiens
ttgggttccaga

SEQ ID NO: 1930294 - DNA, 14 bp, Homo sapiens
ttgggttccagaca

SEQ ID NO: 1930295 - DNA, 18 bp, Homo sapiens
ttggtggccgggggtggg

SEQ ID NO: 1930296 - DNA, 17 bp, Homo sapiens
ttggttaatcacttaac

SEQ ID NO: 1930297 - DNA, 22 bp, Homo sapiens
ttggttaatcacttaacctgct

SEQ ID NO: 1930298 - DNA, 14 bp, Homo sapiens
ttgtaaactttttc

SEQ ID NO: 1930299 - DNA, 21 bp, Homo sapiens
ttgtaaactttttcaatggtt

SEQ ID NO: 1930300 - DNA, 11 bp, Homo sapiens
ttgtaaatatt

SEQ ID NO: 1930301 - DNA, 13 bp, Homo sapiens
ttgtaaatattct

SEQ ID NO: 1930302 - DNA, 21 bp, Homo sapiens
ttgtaaatgtggtaaagagtt

SEQ ID NO: 1930303 - DNA, 20 bp, Homo sapiens
ttgtaagagtggaaccaaca

SEQ ID NO: 1930304 - DNA, 23 bp, Homo sapiens
ttgtaattctaaatgaatgttta

SEQ ID NO: 1930305 - DNA, 21 bp, Homo sapiens
ttgtataggccatctgtaaat

SEQ ID NO: 1930306 - DNA, 14 bp, Homo sapiens
ttgtattctctgag

SEQ ID NO: 1930307 - DNA, 15 bp, Homo sapiens
ttgtattctctgagc

SEQ ID NO: 1930308 - DNA, 16 bp, Homo sapiens
ttgtattgtttcaatt

SEQ ID NO: 1930309 - DNA, 15 bp, Homo sapiens
ttgtcaaaaaccaga

SEQ ID NO: 1930310 - DNA, 20 bp, Homo sapiens
ttgtccacacaagacagcag

SEQ ID NO: 1930311 - DNA, 18 bp, Homo sapiens
ttgtccatttacctggaa

SEQ ID NO: 1930312 - DNA, 20 bp, Homo sapiens
ttgtctgaagtcactgcaca

SEQ ID NO: 1930313 - DNA, 16 bp, Homo sapiens
ttgtctggctgtggcc

SEQ ID NO: 1930314 - DNA, 17 bp, Homo sapiens
ttgtcttgatcctcact

SEQ ID NO: 1930315 - DNA, 20 bp, Homo sapiens
ttgtggctgtcagcaggaag

SEQ ID NO: 1930316 - DNA, 15 bp, Homo sapiens
ttgtgtacagttatt

SEQ ID NO: 1930317 - DNA, 13 bp, Homo sapiens
ttgtgtctgcctg

SEQ ID NO: 1930318 - DNA, 12 bp, Homo sapiens
ttgtgtttgtat

SEQ ID NO: 1930319 - DNA, 19 bp, Homo sapiens
ttgttaatatatataatac

SEQ ID NO: 1930320 - DNA, 21 bp, Homo sapiens
ttgttcaaagaacccccctcc

SEQ ID NO: 1930321 - DNA, 16 bp, Homo sapiens
ttgttcagaagttgtt

SEQ ID NO: 1930322 - DNA, 17 bp, Homo sapiens
ttgtttaaaataaaagt

SEQ ID NO: 1930323 - DNA, 13 bp, Homo sapiens
ttgtttgatgtgt

SEQ ID NO: 1930324 - DNA, 15 bp, Homo sapiens
tttaaaatctgtcac

SEQ ID NO: 1930325 - DNA, 14 bp, Homo sapiens
tttaacagtaatgt

SEQ ID NO: 1930326 - DNA, 16 bp, Homo sapiens
tttaactatttagaga

SEQ ID NO: 1930327 - DNA, 15 bp, Homo sapiens
tttaagaaataactt

SEQ ID NO: 1930328 - DNA, 13 bp, Homo sapiens
tttaataataaaa

SEQ ID NO: 1930329 - DNA, 14 bp, Homo sapiens
tttaattattattc

SEQ ID NO: 1930330 - DNA, 23 bp, Homo sapiens
tttactagggatccctcatctgt

SEQ ID NO: 1930331 - DNA, 16 bp, Homo sapiens
tttagaaaatgtttgg

SEQ ID NO: 1930332 - DNA, 18 bp, Homo sapiens
tttagaaaatgtttggaa

SEQ ID NO: 1930333 - DNA, 19 bp, Homo sapiens
tttagtggtggtgtctcac

SEQ ID NO: 1930334 - DNA, 13 bp, Homo sapiens
tttatatatgtat

SEQ ID NO: 1930335 - DNA, 13 bp, Homo sapiens
tttatattacttt

SEQ ID NO: 1930336 - DNA, 18 bp, Homo sapiens
tttatattacttttgtaa

SEQ ID NO: 1930337 - DNA, 23 bp, Homo sapiens
tttatctgtctgagccctgccct

SEQ ID NO: 1930338 - DNA, 17 bp, Homo sapiens
tttatttttcatttagt

SEQ ID NO: 1930339 - DNA, 15 bp, Homo sapiens
tttcaaacacacaca

SEQ ID NO: 1930340 - DNA, 21 bp, Homo sapiens
tttcaaattggagcttcatgg

SEQ ID NO: 1930341 - DNA, 18 bp, Homo sapiens
tttcaatggttgggacaa

SEQ ID NO: 1930342 - DNA, 20 bp, Homo sapiens
tttcaattgcatctcccaga

SEQ ID NO: 1930343 - DNA, 22 bp, Homo sapiens
tttcacaaccttctgtggctca

SEQ ID NO: 1930344 - DNA, 22 bp, Homo sapiens
tttcaccatttgattatgtagc

SEQ ID NO: 1930345 - DNA, 18 bp, Homo sapiens
tttcactgctggctgcct

SEQ ID NO: 1930346 - DNA, 22 bp, Homo sapiens
tttcactgctggctgccttaga

SEQ ID NO: 1930347 - DNA, 21 bp, Homo sapiens
tttcagaaagaagtggggaca

SEQ ID NO: 1930348 - DNA, 19 bp, Homo sapiens
tttcagaaagggcagcccc

SEQ ID NO: 1930349 - DNA, 11 bp, Homo sapiens
tttcaggacag

SEQ ID NO: 1930350 - DNA, 23 bp, Homo sapiens
tttcagtcaagttccgtctcctc

SEQ ID NO: 1930351 - DNA, 21 bp, Homo sapiens
tttccaaattgatgggtgggc

SEQ ID NO: 1930352 - DNA, 22 bp, Homo sapiens
tttccaagcctgggccactggc

SEQ ID NO: 1930353 - DNA, 22 bp, Homo sapiens
tttccacctttatgttttaata

SEQ ID NO: 1930354 - DNA, 12 bp, Homo sapiens
tttcccaattca

SEQ ID NO: 1930355 - DNA, 15 bp, Homo sapiens
tttcccaattcacat

SEQ ID NO: 1930356 - DNA, 22 bp, Homo sapiens
tttccctagaaagccatattcc

SEQ ID NO: 1930357 - DNA, 22 bp, Homo sapiens
tttcctaacaggattagacagt

SEQ ID NO: 1930358 - DNA, 23 bp, Homo sapiens
tttcctaataaagttctgtactc

SEQ ID NO: 1930359 - DNA, 23 bp, Homo sapiens
tttcctgacagaaggactcaggt

SEQ ID NO: 1930360 - DNA, 22 bp, Homo sapiens
tttcctgtgccaggactctctt

SEQ ID NO: 1930361 - DNA, 22 bp, Homo sapiens
tttccttctcgtcttcctctct

SEQ ID NO: 1930362 - DNA, 21 bp, Homo sapiens
tttctcaaagtttttacagtg

SEQ ID NO: 1930363 - DNA, 20 bp, Homo sapiens
tttctgaaagtatcaccaaa

SEQ ID NO: 1930364 - DNA, 19 bp, Homo sapiens
tttctttaaataaaaataa

SEQ ID NO: 1930365 - DNA, 17 bp, Homo sapiens
tttctttatttctgtct

SEQ ID NO: 1930366 - DNA, 18 bp, Homo sapiens
tttgaaaatatttctatg

SEQ ID NO: 1930367 - DNA, 15 bp, Homo sapiens
tttgaaatatgcatg

SEQ ID NO: 1930368 - DNA, 19 bp, Homo sapiens
tttgaaatatgcatgtact

SEQ ID NO: 1930369 - DNA, 22 bp, Homo sapiens
tttgaagtcataccaatgaaaa

SEQ ID NO: 1930370 - DNA, 18 bp, Homo sapiens
tttgaataacaaggaaaa

SEQ ID NO: 1930371 - DNA, 22 bp, Homo sapiens
tttgaattacagggaagaaatc

SEQ ID NO: 1930372 - DNA, 13 bp, Homo sapiens
tttgagtgctctg

SEQ ID NO: 1930373 - DNA, 20 bp, Homo sapiens
tttgattttttgctgcagac

SEQ ID NO: 1930374 - DNA, 20 bp, Homo sapiens
tttgcaagggaaaagtctct

SEQ ID NO: 1930375 - DNA, 16 bp, Homo sapiens
tttgcagacctgggac

SEQ ID NO: 1930376 - DNA, 18 bp, Homo sapiens
tttgcataacaattcctc

SEQ ID NO: 1930377 - DNA, 18 bp, Homo sapiens
tttgctatcatatattat

SEQ ID NO: 1930378 - DNA, 14 bp, Homo sapiens
tttgtaaatattct

SEQ ID NO: 1930379 - DNA, 16 bp, Homo sapiens
tttgtaactttgcatg

SEQ ID NO: 1930380 - DNA, 17 bp, Homo sapiens
tttgtaactttgcatgt

SEQ ID NO: 1930381 - DNA, 16 bp, Homo sapiens
tttgtatataaatggt

SEQ ID NO: 1930382 - DNA, 14 bp, Homo sapiens
tttgtattctctga

SEQ ID NO: 1930383 - DNA, 15 bp, Homo sapiens
tttgtccacacaaga

SEQ ID NO: 1930384 - DNA, 20 bp, Homo sapiens
tttgtctgatattggtgtga

SEQ ID NO: 1930385 - DNA, 22 bp, Homo sapiens
tttgtctggctgtggcccctcc

SEQ ID NO: 1930386 - DNA, 12 bp, Homo sapiens
tttgtgtgctgt

SEQ ID NO: 1930387 - DNA, 14 bp, Homo sapiens
tttgtgtgctgtgg

SEQ ID NO: 1930388 - DNA, 16 bp, Homo sapiens
tttgttattttgcaac

SEQ ID NO: 1930389 - DNA, 18 bp, Homo sapiens
tttgtttatccttaagaa

SEQ ID NO: 1930390 - DNA, 12 bp, Homo sapiens
tttgtttttcat

SEQ ID NO: 1930391 - DNA, 14 bp, Homo sapiens
ttttaagttgctga

SEQ ID NO: 1930392 - DNA, 11 bp, Homo sapiens
ttttaattatt

SEQ ID NO: 1930393 - DNA, 16 bp, Homo sapiens
ttttaattattattct

SEQ ID NO: 1930394 - DNA, 20 bp, Homo sapiens
ttttaattattatttatata

SEQ ID NO: 1930395 - DNA, 23 bp, Homo sapiens
ttttaattattatttatatatgt

SEQ ID NO: 1930396 - DNA, 13 bp, Homo sapiens
ttttacagtatat

SEQ ID NO: 1930397 - DNA, 21 bp, Homo sapiens
ttttaccattttgcgatgtgt

SEQ ID NO: 1930398 - DNA, 21 bp, Homo sapiens
ttttaccttcagtaaacacca

SEQ ID NO: 1930399 - DNA, 18 bp, Homo sapiens
ttttatattacttttgta

SEQ ID NO: 1930400 - DNA, 12 bp, Homo sapiens
ttttattagcat

SEQ ID NO: 1930401 - DNA, 17 bp, Homo sapiens
ttttcaacgcagccctg

SEQ ID NO: 1930402 - DNA, 21 bp, Homo sapiens
ttttcaacgcagccctgcttt

SEQ ID NO: 1930403 - DNA, 20 bp, Homo sapiens
ttttccagctggatgagaat

SEQ ID NO: 1930404 - DNA, 15 bp, Homo sapiens
ttttctttccttaaa

SEQ ID NO: 1930405 - DNA, 16 bp, Homo sapiens
ttttctttccttaaaa

SEQ ID NO: 1930406 - DNA, 13 bp, Homo sapiens
ttttgccctttga

SEQ ID NO: 1930407 - DNA, 21 bp, Homo sapiens
ttttggggaactgttgtttga

SEQ ID NO: 1930408 - DNA, 21 bp, Homo sapiens
ttttggtccaagttgtgctta

SEQ ID NO: 1930409 - DNA, 16 bp, Homo sapiens
ttttgttcaaagccag

SEQ ID NO: 1930410 - DNA, 21 bp, Homo sapiens
tttttaagacttttctttcct

SEQ ID NO: 1930411 - DNA, 12 bp, Homo sapiens
tttttacagtgt

SEQ ID NO: 1930412 - DNA, 12 bp, Homo sapiens
tttttaggccac

SEQ ID NO: 1930413 - DNA, 13 bp, Homo sapiens
tttttcagccatt

SEQ ID NO: 1930414 - DNA, 20 bp, Homo sapiens
tttttcccgtataataaaac

SEQ ID NO: 1930415 - DNA, 21 bp, Homo sapiens
tccctgcatcccttggcccct

SEQ ID NO: 1930416 - DNA, 14 bp, Homo sapiens
tccctggtcccttg

SEQ ID NO: 1930417 - DNA, 19 bp, Homo sapiens
tccctgtaacctcttcaga

SEQ ID NO: 1930418 - DNA, 14 bp, Homo sapiens
tccctgtcccctga

SEQ ID NO: 1930419 - DNA, 22 bp, Homo sapiens
tcccttaaacaaaaattaaaat

SEQ ID NO: 1930420 - DNA, 15 bp, Homo sapiens
tcccttggcccctct

SEQ ID NO: 1930421 - DNA, 14 bp, Homo sapiens
tcccttgggctccc

SEQ ID NO: 1930422 - DNA, 13 bp, Homo sapiens
tccctttccctgc

SEQ ID NO: 1930423 - DNA, 17 bp, Homo sapiens
tccctttgttgctgtct

SEQ ID NO: 1930424 - DNA, 18 bp, Homo sapiens
tccgcctctgagccagga

SEQ ID NO: 1930425 - DNA, 18 bp, Homo sapiens
tccggaaaaatggggttt

SEQ ID NO: 1930426 - DNA, 20 bp, Homo sapiens
tccggaaggacacagtcagg

SEQ ID NO: 1930427 - DNA, 18 bp, Homo sapiens
tccggaatcctgtcctca

SEQ ID NO: 1930428 - DNA, 13 bp, Homo sapiens
tccgtatttcaga

SEQ ID NO: 1930429 - DNA, 14 bp, Homo sapiens
tccgtatttcagac

SEQ ID NO: 1930430 - DNA, 18 bp, Homo sapiens
tcctaataaagttctgta

SEQ ID NO: 1930431 - DNA, 22 bp, Homo sapiens
tcctagaggggacaagccaggc

SEQ ID NO: 1930432 - DNA, 17 bp, Homo sapiens
tcctaggcatctgctgt

SEQ ID NO: 1930433 - DNA, 19 bp, Homo sapiens
tcctatacgcagcgtgctt

SEQ ID NO: 1930434 - DNA, 19 bp, Homo sapiens
tcctatgtttttgttcaaa

SEQ ID NO: 1930435 - DNA, 19 bp, Homo sapiens
tcctcactatttttttgtt

SEQ ID NO: 1930436 - DNA, 21 bp, Homo sapiens
tcctcactgagaaggccccag

SEQ ID NO: 1930437 - DNA, 23 bp, Homo sapiens
tcctcactgagaaggccccaggg

SEQ ID NO: 1930438 - DNA, 15 bp, Homo sapiens
tcctccagagcctgg

SEQ ID NO: 1930439 - DNA, 19 bp, Homo sapiens
tcctccagagcctgggcgc

SEQ ID NO: 1930440 - DNA, 13 bp, Homo sapiens
tcctcccaggcgc

SEQ ID NO: 1930441 - DNA, 15 bp, Homo sapiens
tcctcctcctcctgt

SEQ ID NO: 1930442 - DNA, 16 bp, Homo sapiens
tcctcctcctgttcct

SEQ ID NO: 1930443 - DNA, 13 bp, Homo sapiens
tcctcctctgtga

SEQ ID NO: 1930444 - DNA, 14 bp, Homo sapiens
tcctcctgggccct

SEQ ID NO: 1930445 - DNA, 18 bp, Homo sapiens
tcctcctgttcctgcctt

SEQ ID NO: 1930446 - DNA, 15 bp, Homo sapiens
tcctcggcagctccg

SEQ ID NO: 1930447 - DNA, 21 bp, Homo sapiens
tcctctaattaaaatgtgcag

SEQ ID NO: 1930448 - DNA, 22 bp, Homo sapiens
tcctctaattaaaatgtgcagt

SEQ ID NO: 1930449 - DNA, 18 bp, Homo sapiens
tcctctactaacaatcag

SEQ ID NO: 1930450 - DNA, 19 bp, Homo sapiens
tcctctactaacaatcagc

SEQ ID NO: 1930451 - DNA, 13 bp, Homo sapiens
tcctctccagccc

SEQ ID NO: 1930452 - DNA, 16 bp, Homo sapiens
tcctctgactcagggc

SEQ ID NO: 1930453 - DNA, 17 bp, Homo sapiens
tcctctgactcagggct

SEQ ID NO: 1930454 - DNA, 20 bp, Homo sapiens
tcctcttcctgcctctctca

SEQ ID NO: 1930455 - DNA, 15 bp, Homo sapiens
tcctgatcagagccg

SEQ ID NO: 1930456 - DNA, 12 bp, Homo sapiens
tcctgcaccctc

SEQ ID NO: 1930457 - DNA, 14 bp, Homo sapiens
tcctgcaccctctg

SEQ ID NO: 1930458 - DNA, 14 bp, Homo sapiens
tcctgccttcctcc

SEQ ID NO: 1930459 - DNA, 19 bp, Homo sapiens
tcctgccttcctcctgggc

SEQ ID NO: 1930460 - DNA, 23 bp, Homo sapiens
tcctgccttcctcctgggccctc

SEQ ID NO: 1930461 - DNA, 21 bp, Homo sapiens
tcctgccttctcttctatcct

SEQ ID NO: 1930462 - DNA, 22 bp, Homo sapiens
tcctggacatgaagattctttc

SEQ ID NO: 1930463 - DNA, 19 bp, Homo sapiens
tcctggcccgggagccgca

SEQ ID NO: 1930464 - DNA, 20 bp, Homo sapiens
tcctgggaaatattccctag

SEQ ID NO: 1930465 - DNA, 23 bp, Homo sapiens
tcctgggccctctctgctctgcg

SEQ ID NO: 1930466 - DNA, 16 bp, Homo sapiens
tcctgggtgctgtcat

SEQ ID NO: 1930467 - DNA, 22 bp, Homo sapiens
tcctgggtgctgtcatgcccag

SEQ ID NO: 1930468 - DNA, 23 bp, Homo sapiens
tcctgggttttgtattctctgag

SEQ ID NO: 1930469 - DNA, 17 bp, Homo sapiens
tcctgtacaagtgctca

SEQ ID NO: 1930470 - DNA, 12 bp, Homo sapiens
tcctgtcaatgt

SEQ ID NO: 1930471 - DNA, 14 bp, Homo sapiens
tcctgtcaatgttt

SEQ ID NO: 1930472 - DNA, 16 bp, Homo sapiens
tcctgtcctcagcttc

SEQ ID NO: 1930473 - DNA, 21 bp, Homo sapiens
tcctgtgccaggactctcttt

SEQ ID NO: 1930474 - DNA, 22 bp, Homo sapiens
tcctgtgccaggactctctttc

SEQ ID NO: 1930475 - DNA, 13 bp, Homo sapiens
tcctgttcctgcc

SEQ ID NO: 1930476 - DNA, 15 bp, Homo sapiens
tcctgttcctgcctt

SEQ ID NO: 1930477 - DNA, 17 bp, Homo sapiens
tcctgttcctgccttct

SEQ ID NO: 1930478 - DNA, 19 bp, Homo sapiens
tcctgttcctgccttctct

SEQ ID NO: 1930479 - DNA, 11 bp, Homo sapiens
tccttaagaat

SEQ ID NO: 1930480 - DNA, 13 bp, Homo sapiens
tccttaggcttac

SEQ ID NO: 1930481 - DNA, 23 bp, Homo sapiens
tccttaggcttacaatgtgcact

SEQ ID NO: 1930482 - DNA, 22 bp, Homo sapiens
tccttatgtatatttaaaagaa

SEQ ID NO: 1930483 - DNA, 13 bp, Homo sapiens
tccttctcccctc

SEQ ID NO: 1930484 - DNA, 17 bp, Homo sapiens
tccttctcccctccaga

SEQ ID NO: 1930485 - DNA, 17 bp, Homo sapiens
tccttctcgtcttcctc

SEQ ID NO: 1930486 - DNA, 19 bp, Homo sapiens
tccttctcgtcttcctctc

SEQ ID NO: 1930487 - DNA, 18 bp, Homo sapiens
tcctttcacaaccttctg

SEQ ID NO: 1930488 - DNA, 14 bp, Homo sapiens
tcctttctttaaac

SEQ ID NO: 1930489 - DNA, 14 bp, Homo sapiens
tcgaagtcttccat

SEQ ID NO: 1930490 - DNA, 21 bp, Homo sapiens
tcgagacaggcagaatcagta

SEQ ID NO: 1930491 - DNA, 21 bp, Homo sapiens
tcgagtgatatggcttgtagg

SEQ ID NO: 1930492 - DNA, 21 bp, Homo sapiens
tcgcaccactgtgtatttaac

SEQ ID NO: 1930493 - DNA, 14 bp, Homo sapiens
tcgcattaatgaaa

SEQ ID NO: 1930494 - DNA, 20 bp, Homo sapiens
tcgctgccagctctgtatca

SEQ ID NO: 1930495 - DNA, 20 bp, Homo sapiens
tcgctggactctcagtctct

SEQ ID NO: 1930496 - DNA, 22 bp, Homo sapiens
tcgctggactctcagtctctga

SEQ ID NO: 1930497 - DNA, 12 bp, Homo sapiens
tcggctggaaga

SEQ ID NO: 1930498 - DNA, 15 bp, Homo sapiens
tcggctggaagaaca

SEQ ID NO: 1930499 - DNA, 15 bp, Homo sapiens
tcgtcttcctctctc

SEQ ID NO: 1930500 - DNA, 16 bp, Homo sapiens
tcgtggagccacaggc

SEQ ID NO: 1930501 - DNA, 16 bp, Homo sapiens
tctaaaaggaggacag

SEQ ID NO: 1930502 - DNA, 21 bp, Homo sapiens
tctaagattcatccatttatt

SEQ ID NO: 1930503 - DNA, 17 bp, Homo sapiens
tctacagagcttccctg

SEQ ID NO: 1930504 - DNA, 18 bp, Homo sapiens
tctacagagcttccctga

SEQ ID NO: 1930505 - DNA, 19 bp, Homo sapiens
tctacagccagtaaggcag

SEQ ID NO: 1930506 - DNA, 23 bp, Homo sapiens
tctacagccagtaaggcagctct

SEQ ID NO: 1930507 - DNA, 20 bp, Homo sapiens
tctacagctaatcagcattc

SEQ ID NO: 1930508 - DNA, 16 bp, Homo sapiens
tctagacagtattgcc

SEQ ID NO: 1930509 - DNA, 20 bp, Homo sapiens
tctagagggatccaccgcca

SEQ ID NO: 1930510 - DNA, 20 bp, Homo sapiens
tctatagtttgattctgagt

SEQ ID NO: 1930511 - DNA, 12 bp, Homo sapiens
tctatgtaaatt

SEQ ID NO: 1930512 - DNA, 17 bp, Homo sapiens
tctatgtaaattattgt

SEQ ID NO: 1930513 - DNA, 20 bp, Homo sapiens
tctatgtaaattattgtaaa

SEQ ID NO: 1930514 - DNA, 17 bp, Homo sapiens
tctattgctggcaaaga

SEQ ID NO: 1930515 - DNA, 19 bp, Homo sapiens
tctatttatctgtctgagc

SEQ ID NO: 1930516 - DNA, 14 bp, Homo sapiens
tctatttctcctcc

SEQ ID NO: 1930517 - DNA, 16 bp, Homo sapiens
tctatttctcctccat

SEQ ID NO: 1930518 - DNA, 16 bp, Homo sapiens
tctattttgtctgata

SEQ ID NO: 1930519 - DNA, 19 bp, Homo sapiens
tctcaaagtttttacagtg

SEQ ID NO: 1930520 - DNA, 15 bp, Homo sapiens
tctcaagcactgaca

SEQ ID NO: 1930521 - DNA, 18 bp, Homo sapiens
tctcactcctacctggta

SEQ ID NO: 1930522 - DNA, 11 bp, Homo sapiens
tctcagtctct

SEQ ID NO: 1930523 - DNA, 13 bp, Homo sapiens
tctcagtctctga

SEQ ID NO: 1930524 - DNA, 17 bp, Homo sapiens
tctcagtctctgagcag

SEQ ID NO: 1930525 - DNA, 20 bp, Homo sapiens
tctcatccaggtcctttcct

SEQ ID NO: 1930526 - DNA, 13 bp, Homo sapiens
tctcatccatcat

SEQ ID NO: 1930527 - DNA, 14 bp, Homo sapiens
tctcatccatcatc

SEQ ID NO: 1930528 - DNA, 19 bp, Homo sapiens
tctcattaattcaattaaa

SEQ ID NO: 1930529 - DNA, 21 bp, Homo sapiens
tctcattaattcaattaaaac

SEQ ID NO: 1930530 - DNA, 13 bp, Homo sapiens
tctccacccctca

SEQ ID NO: 1930531 - DNA, 14 bp, Homo sapiens
tctccacccctcaa

SEQ ID NO: 1930532 - DNA, 16 bp, Homo sapiens
tctccacccctcaagc

SEQ ID NO: 1930533 - DNA, 21 bp, Homo sapiens
tctccacccctcaagccagga

SEQ ID NO: 1930534 - DNA, 22 bp, Homo sapiens
tctccacccctcaagccaggag

SEQ ID NO: 1930535 - DNA, 15 bp, Homo sapiens
tctccatggccctgc

SEQ ID NO: 1930536 - DNA, 16 bp, Homo sapiens
tctcccagataatgtg

SEQ ID NO: 1930537 - DNA, 21 bp, Homo sapiens
tctcccagataatgtgaaaat

SEQ ID NO: 1930538 - DNA, 18 bp, Homo sapiens
gctcacattccctctcat

SEQ ID NO: 1930539 - DNA, 12 bp, Homo sapiens
gctcagccctcc

SEQ ID NO: 1930540 - DNA, 17 bp, Homo sapiens
gctcagccctccctgcc

SEQ ID NO: 1930541 - DNA, 19 bp, Homo sapiens
gctcagccctccctgcccc

SEQ ID NO: 1930542 - DNA, 21 bp, Homo sapiens
gctcagccctccctgcccctc

SEQ ID NO: 1930543 - DNA, 11 bp, Homo sapiens
gctcaggagaa

SEQ ID NO: 1930544 - DNA, 17 bp, Homo sapiens
gctcaggagaaggcctg

SEQ ID NO: 1930545 - DNA, 15 bp, Homo sapiens
gctcaggctgcccag

SEQ ID NO: 1930546 - DNA, 16 bp, Homo sapiens
gctcatcattctctgt

SEQ ID NO: 1930547 - DNA, 18 bp, Homo sapiens
gctcatcattctctgtct

SEQ ID NO: 1930548 - DNA, 20 bp, Homo sapiens
gctcatcattctctgtctca

SEQ ID NO: 1930549 - DNA, 21 bp, Homo sapiens
gctccacagaaaccctgtttt

SEQ ID NO: 1930550 - DNA, 21 bp, Homo sapiens
gctcccacaggcccttcctct

SEQ ID NO: 1930551 - DNA, 16 bp, Homo sapiens
gctccctgactgggag

SEQ ID NO: 1930552 - DNA, 21 bp, Homo sapiens
gctccctgtaacctcttcaga

SEQ ID NO: 1930553 - DNA, 20 bp, Homo sapiens
gctccgagtggctcccgtgt

SEQ ID NO: 1930554 - DNA, 18 bp, Homo sapiens
gctcctgaatccctttca

SEQ ID NO: 1930555 - DNA, 14 bp, Homo sapiens
gctccttgggccct

SEQ ID NO: 1930556 - DNA, 17 bp, Homo sapiens
gctccttgggccctttg

SEQ ID NO: 1930557 - DNA, 23 bp, Homo sapiens
gctcggcctcttgagagccccac

SEQ ID NO: 1930558 - DNA, 22 bp, Homo sapiens
gctctacagctaatcagcattc

SEQ ID NO: 1930559 - DNA, 12 bp, Homo sapiens
gctctctggacc

SEQ ID NO: 1930560 - DNA, 16 bp, Homo sapiens
gctctgaaaccagtgt

SEQ ID NO: 1930561 - DNA, 19 bp, Homo sapiens
gctctgaaagctgcttctg

SEQ ID NO: 1930562 - DNA, 13 bp, Homo sapiens
gctctgatccctc

SEQ ID NO: 1930563 - DNA, 22 bp, Homo sapiens
gctctgatccctctacagagct

SEQ ID NO: 1930564 - DNA, 17 bp, Homo sapiens
gctctggctggagagga

SEQ ID NO: 1930565 - DNA, 18 bp, Homo sapiens
gctctgtatcaggaccca

SEQ ID NO: 1930566 - DNA, 19 bp, Homo sapiens
gctctgtatcaggacccag

SEQ ID NO: 1930567 - DNA, 22 bp, Homo sapiens
gctctgtatcaggacccagagg

SEQ ID NO: 1930568 - DNA, 14 bp, Homo sapiens
gctctgtattctgc

SEQ ID NO: 1930569 - DNA, 23 bp, Homo sapiens
gctctgtattctgcaacagcctg

SEQ ID NO: 1930570 - DNA, 17 bp, Homo sapiens
gctcttctcctttcaca

SEQ ID NO: 1930571 - DNA, 21 bp, Homo sapiens
gctcttctcctttcacaacct

SEQ ID NO: 1930572 - DNA, 16 bp, Homo sapiens
gctgagaggagagaga

SEQ ID NO: 1930573 - DNA, 23 bp, Homo sapiens
gctgagcgaggagatgctccttg

SEQ ID NO: 1930574 - DNA, 11 bp, Homo sapiens
gctgagctgga

SEQ ID NO: 1930575 - DNA, 16 bp, Homo sapiens
gctgagctttccagcc

SEQ ID NO: 1930576 - DNA, 14 bp, Homo sapiens
gctgagggagcctg

SEQ ID NO: 1930577 - DNA, 15 bp, Homo sapiens
gctgcaagctgcagg

SEQ ID NO: 1930578 - DNA, 16 bp, Homo sapiens
gctgcaagctgcaggg

SEQ ID NO: 1930579 - DNA, 15 bp, Homo sapiens
gctgcatccaaggct

SEQ ID NO: 1930580 - DNA, 16 bp, Homo sapiens
gctgcatccaaggctt

SEQ ID NO: 1930581 - DNA, 21 bp, Homo sapiens
gctgccaagataccttcatgg

SEQ ID NO: 1930582 - DNA, 15 bp, Homo sapiens
gctgccacacttcag

SEQ ID NO: 1930583 - DNA, 17 bp, Homo sapiens
gctgccctggtgctgcc

SEQ ID NO: 1930584 - DNA, 19 bp, Homo sapiens
gctgccctggtgctgccac

SEQ ID NO: 1930585 - DNA, 14 bp, Homo sapiens
gctgcggcaccctt

SEQ ID NO: 1930586 - DNA, 15 bp, Homo sapiens
gctgcggcacccttg

SEQ ID NO: 1930587 - DNA, 13 bp, Homo sapiens
gctgctctcccag

SEQ ID NO: 1930588 - DNA, 15 bp, Homo sapiens
gctgcttctggggga

SEQ ID NO: 1930589 - DNA, 11 bp, Homo sapiens
gctgcttctgt

SEQ ID NO: 1930590 - DNA, 14 bp, Homo sapiens
gctgcttctgtgca

SEQ ID NO: 1930591 - DNA, 14 bp, Homo sapiens
gctggaaaggcccg

SEQ ID NO: 1930592 - DNA, 21 bp, Homo sapiens
gctggaccacgtctccctggc

SEQ ID NO: 1930593 - DNA, 19 bp, Homo sapiens
gctggacttttgcagcttc

SEQ ID NO: 1930594 - DNA, 16 bp, Homo sapiens
gctggatggggcggcc

SEQ ID NO: 1930595 - DNA, 14 bp, Homo sapiens
gctggcctcttcct

SEQ ID NO: 1930596 - DNA, 14 bp, Homo sapiens
gctgggagagccaa

SEQ ID NO: 1930597 - DNA, 16 bp, Homo sapiens
gctgggcgcctctgtc

SEQ ID NO: 1930598 - DNA, 18 bp, Homo sapiens
gctggtcactgccatgga

SEQ ID NO: 1930599 - DNA, 20 bp, Homo sapiens
gctgtactgagttctcatcc

SEQ ID NO: 1930600 - DNA, 17 bp, Homo sapiens
aaatatttctatgtaaa

SEQ ID NO: 1930601 - DNA, 19 bp, Homo sapiens
aaatatttctatgtaaatt

SEQ ID NO: 1930602 - DNA, 22 bp, Homo sapiens
aaatcaattctgatacagcctt

SEQ ID NO: 1930603 - DNA, 14 bp, Homo sapiens
aaatcggcaacagg

SEQ ID NO: 1930604 - DNA, 17 bp, Homo sapiens
aaatctcctttgtccat

SEQ ID NO: 1930605 - DNA, 14 bp, Homo sapiens
aaatgtatatgcac

SEQ ID NO: 1930606 - DNA, 15 bp, Homo sapiens
aaatgtatatgcact

SEQ ID NO: 1930607 - DNA, 13 bp, Homo sapiens
aaatgtcttgtgt

SEQ ID NO: 1930608 - DNA, 20 bp, Homo sapiens
aaatgttaagttgatggtga

SEQ ID NO: 1930609 - DNA, 20 bp, Homo sapiens
aaatgttattttttaattat

SEQ ID NO: 1930610 - DNA, 19 bp, Homo sapiens
aaatgtttggaatttaaga

SEQ ID NO: 1930611 - DNA, 20 bp, Homo sapiens
aaatgttttacaatggctgg

SEQ ID NO: 1930612 - DNA, 21 bp, Homo sapiens
aaatgttttacaatggctggg

SEQ ID NO: 1930613 - DNA, 17 bp, Homo sapiens
aaattaaagctgaaaac

SEQ ID NO: 1930614 - DNA, 14 bp, Homo sapiens
aaattaatatcaca

SEQ ID NO: 1930615 - DNA, 20 bp, Homo sapiens
aaattacagaagaagctcct

SEQ ID NO: 1930616 - DNA, 13 bp, Homo sapiens
aaattattgtaaa

SEQ ID NO: 1930617 - DNA, 21 bp, Homo sapiens
aaattattgtaaactttttca

SEQ ID NO: 1930618 - DNA, 13 bp, Homo sapiens
aaattatttgcat

SEQ ID NO: 1930619 - DNA, 13 bp, Homo sapiens
aaattgcagaaga

SEQ ID NO: 1930620 - DNA, 18 bp, Homo sapiens
aaattgcagaagaaactc

SEQ ID NO: 1930621 - DNA, 13 bp, Homo sapiens
aaattgcttgaaa

SEQ ID NO: 1930622 - DNA, 14 bp, Homo sapiens
aaattgtaaatgtt

SEQ ID NO: 1930623 - DNA, 18 bp, Homo sapiens
aaatttcatctttccaaa

SEQ ID NO: 1930624 - DNA, 19 bp, Homo sapiens
aaatttgttattttgcaac

SEQ ID NO: 1930625 - DNA, 16 bp, Homo sapiens
aaattttcagaaagca

SEQ ID NO: 1930626 - DNA, 12 bp, Homo sapiens
aacaaattaaaa

SEQ ID NO: 1930627 - DNA, 15 bp, Homo sapiens
aacaactctttgaga

SEQ ID NO: 1930628 - DNA, 14 bp, Homo sapiens
aacaaggaagtcaa

SEQ ID NO: 1930629 - DNA, 13 bp, Homo sapiens
aacaatatatgta

SEQ ID NO: 1930630 - DNA, 16 bp, Homo sapiens
aacaatcactattctt

SEQ ID NO: 1930631 - DNA, 17 bp, Homo sapiens
aacaatcactattctta

SEQ ID NO: 1930632 - DNA, 18 bp, Homo sapiens
aacaatcactattcttaa

SEQ ID NO: 1930633 - DNA, 16 bp, Homo sapiens
aacaccctatattttg

SEQ ID NO: 1930634 - DNA, 17 bp, Homo sapiens
aacacgtttagaaatga

SEQ ID NO: 1930635 - DNA, 20 bp, Homo sapiens
aacactgtgcacatctgtgt

SEQ ID NO: 1930636 - DNA, 20 bp, Homo sapiens
aacagcagagtaaaattaca

SEQ ID NO: 1930637 - DNA, 15 bp, Homo sapiens
aacagcttcatgttc

SEQ ID NO: 1930638 - DNA, 20 bp, Homo sapiens
aacaggagtgactctggctg

SEQ ID NO: 1930639 - DNA, 12 bp, Homo sapiens
aacagtagcata

SEQ ID NO: 1930640 - DNA, 12 bp, Homo sapiens
aacataactgta

SEQ ID NO: 1930641 - DNA, 18 bp, Homo sapiens
aacatataatgttgttat

SEQ ID NO: 1930642 - DNA, 22 bp, Homo sapiens
aacatataatgttgttatttaa

SEQ ID NO: 1930643 - DNA, 13 bp, Homo sapiens
aacatatatgaaa

SEQ ID NO: 1930644 - DNA, 22 bp, Homo sapiens
aacatgaattaagaactgacac

SEQ ID NO: 1930645 - DNA, 13 bp, Homo sapiens
aacatttaagcct

SEQ ID NO: 1930646 - DNA, 20 bp, Homo sapiens
aacatttgggagactgagct

SEQ ID NO: 1930647 - DNA, 14 bp, Homo sapiens
aacatttgtttatc

SEQ ID NO: 1930648 - DNA, 21 bp, Homo sapiens
aacatttgtttatccttaaga

SEQ ID NO: 1930649 - DNA, 12 bp, Homo sapiens
aaccaaagaata

SEQ ID NO: 1930650 - DNA, 16 bp, Homo sapiens
aaccaagccgtggctt

SEQ ID NO: 1930651 - DNA, 17 bp, Homo sapiens
aaccagaagcaacagaa

SEQ ID NO: 1930652 - DNA, 18 bp, Homo sapiens
aaccagaatgattttgac

SEQ ID NO: 1930653 - DNA, 22 bp, Homo sapiens
aaccatgagaccactgttatca

SEQ ID NO: 1930654 - DNA, 17 bp, Homo sapiens
aaccatgtagaaaattt

SEQ ID NO: 1930655 - DNA, 20 bp, Homo sapiens
aacccatcaacaaaaattgt

SEQ ID NO: 1930656 - DNA, 14 bp, Homo sapiens
aacccccctcccca

SEQ ID NO: 1930657 - DNA, 15 bp, Homo sapiens
aaccctattggtaaa

SEQ ID NO: 1930658 - DNA, 19 bp, Homo sapiens
aaccgagccagcagctgaa

SEQ ID NO: 1930659 - DNA, 23 bp, Homo sapiens
aaccgagccagcagctgaagtct

SEQ ID NO: 1930660 - DNA, 14 bp, Homo sapiens
aacctcaggttcca

SEQ ID NO: 1930661 - DNA, 14 bp, Homo sapiens
aacctcgctggact

SEQ ID NO: 1930662 - DNA, 12 bp, Homo sapiens
aacgcagccctg

SEQ ID NO: 1930663 - DNA, 16 bp, Homo sapiens
aacgcagccctgcttt

SEQ ID NO: 1930664 - DNA, 12 bp, Homo sapiens
aacgtgaaaatg

SEQ ID NO: 1930665 - DNA, 17 bp, Homo sapiens
aacgtggggcagcacag

SEQ ID NO: 1930666 - DNA, 18 bp, Homo sapiens
aacgtggggcagcacaga

SEQ ID NO: 1930667 - DNA, 22 bp, Homo sapiens
aacgtggggcagcacagagagg

SEQ ID NO: 1930668 - DNA, 17 bp, Homo sapiens
aactaagcacattatgt

SEQ ID NO: 1930669 - DNA, 16 bp, Homo sapiens
aactacagccaaattg

SEQ ID NO: 1930670 - DNA, 13 bp, Homo sapiens
aactaccaaaatg

SEQ ID NO: 1930671 - DNA, 14 bp, Homo sapiens
aactactgtacatt

SEQ ID NO: 1930672 - DNA, 17 bp, Homo sapiens
aactagggccaagccca

SEQ ID NO: 1930673 - DNA, 13 bp, Homo sapiens
aactatttagaga

SEQ ID NO: 1930674 - DNA, 14 bp, Homo sapiens
aactatttagagaa

SEQ ID NO: 1930675 - DNA, 22 bp, Homo sapiens
aactattttttaaaaattcact

SEQ ID NO: 1930676 - DNA, 21 bp, Homo sapiens
aactccagccacccagccagg

SEQ ID NO: 1930677 - DNA, 22 bp, Homo sapiens
aactccagccacccagccagga

SEQ ID NO: 1930678 - DNA, 22 bp, Homo sapiens
aactccagggttaaagaaaggc

SEQ ID NO: 1930679 - DNA, 13 bp, Homo sapiens
aactctcaggact

SEQ ID NO: 1930680 - DNA, 14 bp, Homo sapiens
aactgagtcctgtt

SEQ ID NO: 1930681 - DNA, 23 bp, Homo sapiens
aactgcagggaaaattatttgca

SEQ ID NO: 1930682 - DNA, 20 bp, Homo sapiens
aactgcagtgggttctccaa

SEQ ID NO: 1930683 - DNA, 21 bp, Homo sapiens
aactgcttgcatttctttatt

SEQ ID NO: 1930684 - DNA, 15 bp, Homo sapiens
aactggtatatattt

SEQ ID NO: 1930685 - DNA, 18 bp, Homo sapiens
aactgttgtttgatgtgt

SEQ ID NO: 1930686 - DNA, 12 bp, Homo sapiens
aacttgggaact

SEQ ID NO: 1930687 - DNA, 15 bp, Homo sapiens
aacttgtaaatgtgg

SEQ ID NO: 1930688 - DNA, 12 bp, Homo sapiens
aactttgcatgt

SEQ ID NO: 1930689 - DNA, 23 bp, Homo sapiens
aactttgcatgttcttgttttgt

SEQ ID NO: 1930690 - DNA, 13 bp, Homo sapiens
aagaaaatatgca

SEQ ID NO: 1930691 - DNA, 14 bp, Homo sapiens
aagaaatgacactt

SEQ ID NO: 1930692 - DNA, 15 bp, Homo sapiens
aagaaattgtttttc

SEQ ID NO: 1930693 - DNA, 12 bp, Homo sapiens
aagaacatcaag

SEQ ID NO: 1930694 - DNA, 21 bp, Homo sapiens
aagaaccaggaggcctgggag

SEQ ID NO: 1930695 - DNA, 13 bp, Homo sapiens
aagaaccccaggc

SEQ ID NO: 1930696 - DNA, 16 bp, Homo sapiens
aagaacccccctcccc

SEQ ID NO: 1930697 - DNA, 18 bp, Homo sapiens
aagaacccccctccccaa

SEQ ID NO: 1930698 - DNA, 21 bp, Homo sapiens
aagaacccccctccccaagga

SEQ ID NO: 1930699 - DNA, 15 bp, Homo sapiens
aagaactgcttgcat

SEQ ID NO: 1930700 - DNA, 14 bp, Homo sapiens
aagaagaaactatt

SEQ ID NO: 1930701 - DNA, 15 bp, Homo sapiens
aagaagaaactattt

SEQ ID NO: 1930702 - DNA, 19 bp, Homo sapiens
aagaagtgggagtgggaga

SEQ ID NO: 1930703 - DNA, 23 bp, Homo sapiens
aagaagtgggagtgggagaggaa

SEQ ID NO: 1930704 - DNA, 20 bp, Homo sapiens
aagaattacaatttctttaa

SEQ ID NO: 1930705 - DNA, 14 bp, Homo sapiens
aagacagcagagcc

SEQ ID NO: 1930706 - DNA, 18 bp, Homo sapiens
aagaggagcctttccaga

SEQ ID NO: 1930707 - DNA, 17 bp, Homo sapiens
aagagggacgcctgggg

SEQ ID NO: 1930708 - DNA, 12 bp, Homo sapiens
aagagggagaag

SEQ ID NO: 1930709 - DNA, 22 bp, Homo sapiens
aagagtcgagtgatatggcttg

SEQ ID NO: 1930710 - DNA, 15 bp, Homo sapiens
aagagtgtgctcggg

SEQ ID NO: 1930711 - DNA, 14 bp, Homo sapiens
aagataatatttaa

SEQ ID NO: 1930712 - DNA, 12 bp, Homo sapiens
aagatgaaattg

SEQ ID NO: 1930713 - DNA, 15 bp, Homo sapiens
aagatgaaattgcca

SEQ ID NO: 1930714 - DNA, 16 bp, Homo sapiens
aagatgaaattgccaa

SEQ ID NO: 1930715 - DNA, 20 bp, Homo sapiens
aagattcccggctggacttt

SEQ ID NO: 1930716 - DNA, 15 bp, Homo sapiens
aagcactttgaaaat

SEQ ID NO: 1930717 - DNA, 18 bp, Homo sapiens
aagcactttgaaaatatt

SEQ ID NO: 1930718 - DNA, 20 bp, Homo sapiens
aagcagacagcaagggcttg

SEQ ID NO: 1930719 - DNA, 22 bp, Homo sapiens
aagcaggaaatgaaaatgtctt

SEQ ID NO: 1930720 - DNA, 15 bp, Homo sapiens
aagcatcaaactctt

SEQ ID NO: 1930721 - DNA, 22 bp, Homo sapiens
aagcatctattcccaaagaacc

SEQ ID NO: 1930722 - DNA, 12 bp, Homo sapiens
aagcattcacaa

SEQ ID NO: 1930723 - DNA, 19 bp, Homo sapiens
aagccacgtgctggagagt

SEQ ID NO: 1930724 - DNA, 21 bp, Homo sapiens
aagccacgtgctggagagtag

SEQ ID NO: 1930725 - DNA, 14 bp, Homo sapiens
aagccagcgtcctc

SEQ ID NO: 1930726 - DNA, 19 bp, Homo sapiens
aagccagcgtcctcctctg

SEQ ID NO: 1930727 - DNA, 20 bp, Homo sapiens
aagccagcgtcctcctctgt

SEQ ID NO: 1930728 - DNA, 13 bp, Homo sapiens
aagccaggagacc

SEQ ID NO: 1930729 - DNA, 20 bp, Homo sapiens
aagccaggagaccctgtctt

SEQ ID NO: 1930730 - DNA, 17 bp, Homo sapiens
aagccagggttccagac

SEQ ID NO: 1930731 - DNA, 12 bp, Homo sapiens
aagccatattcc

SEQ ID NO: 1930732 - DNA, 14 bp, Homo sapiens
aagccccctttgat

SEQ ID NO: 1930733 - DNA, 15 bp, Homo sapiens
aagccgtggcttccc

SEQ ID NO: 1930734 - DNA, 22 bp, Homo sapiens
aagcctagtgaaggcttctctc

SEQ ID NO: 1930735 - DNA, 18 bp, Homo sapiens
aagctgcttctgggggat

SEQ ID NO: 1930736 - DNA, 20 bp, Homo sapiens
aagcttcttaaatgagaagg

SEQ ID NO: 1930737 - DNA, 14 bp, Homo sapiens
aagcttgtgtactt

SEQ ID NO: 1930738 - DNA, 18 bp, Homo sapiens
aaggaaacacgtttagaa

SEQ ID NO: 1930739 - DNA, 15 bp, Homo sapiens
aaggacttgtgcctc

SEQ ID NO: 1930740 - DNA, 13 bp, Homo sapiens
aaggagaggagtg

SEQ ID NO: 1930741 - DNA, 20 bp, Homo sapiens
aaggcaaacccatcaacaaa

SEQ ID NO: 1930742 - DNA, 18 bp, Homo sapiens
aaggcaagcacttgtggg

SEQ ID NO: 1930743 - DNA, 16 bp, Homo sapiens
aaggcaagccacagaa

SEQ ID NO: 1930744 - DNA, 15 bp, Homo sapiens
aaggcagctctgtcg

SEQ ID NO: 1930745 - DNA, 18 bp, Homo sapiens
aaggcagctgaaaagtaa

SEQ ID NO: 1930746 - DNA, 21 bp, Homo sapiens
aaggccaattcctatacgcag

SEQ ID NO: 1930747 - DNA, 14 bp, Homo sapiens
aaggccgttaggga

SEQ ID NO: 1930748 - DNA, 16 bp, Homo sapiens
aaggcctatgccacct

SEQ ID NO: 1930749 - DNA, 21 bp, Homo sapiens
aaggcctatgccacctgcagc

SEQ ID NO: 1930750 - DNA, 21 bp, Homo sapiens
aaggctgttttaacggcctgc

SEQ ID NO: 1930751 - DNA, 16 bp, Homo sapiens
aagggaaaagtctctt

SEQ ID NO: 1930752 - DNA, 16 bp, Homo sapiens
aagggagagagagagg

SEQ ID NO: 1930753 - DNA, 14 bp, Homo sapiens
aagggcagcccctc

SEQ ID NO: 1930754 - DNA, 16 bp, Homo sapiens
gttactgttatagagg

SEQ ID NO: 1930755 - DNA, 20 bp, Homo sapiens
gttactttatttgaataaca

SEQ ID NO: 1930756 - DNA, 21 bp, Homo sapiens
gttaggggtgggggagaatgg

SEQ ID NO: 1930757 - DNA, 16 bp, Homo sapiens
gttagtgatttgctat

SEQ ID NO: 1930758 - DNA, 14 bp, Homo sapiens
gttataaagataca

SEQ ID NO: 1930759 - DNA, 15 bp, Homo sapiens
gttataaagatacag

SEQ ID NO: 1930760 - DNA, 22 bp, Homo sapiens
gttatcaccgtgggctccctga

SEQ ID NO: 1930761 - DNA, 13 bp, Homo sapiens
gttatcagtatta

SEQ ID NO: 1930762 - DNA, 13 bp, Homo sapiens
gttatttaaagaa

SEQ ID NO: 1930763 - DNA, 18 bp, Homo sapiens
gttcaaagaacccccctc

SEQ ID NO: 1930764 - DNA, 19 bp, Homo sapiens
gttcaaagaacccccctcc

SEQ ID NO: 1930765 - DNA, 21 bp, Homo sapiens
gttcaaagaacccccctcccc

SEQ ID NO: 1930766 - DNA, 22 bp, Homo sapiens
gttcaaagaacccccctcccca

SEQ ID NO: 1930767 - DNA, 12 bp, Homo sapiens
gttcaaagccag

SEQ ID NO: 1930768 - DNA, 15 bp, Homo sapiens
gttcatagtttctgt

SEQ ID NO: 1930769 - DNA, 19 bp, Homo sapiens
gttcatatgtaccatgtac

SEQ ID NO: 1930770 - DNA, 20 bp, Homo sapiens
gttccaatgtgcccagtcat

SEQ ID NO: 1930771 - DNA, 10 bp, Homo sapiens
gttccagaca

SEQ ID NO: 1930772 - DNA, 15 bp, Homo sapiens
gttccagacagagtg

SEQ ID NO: 1930773 - DNA, 12 bp, Homo sapiens
gttccagacagg

SEQ ID NO: 1930774 - DNA, 20 bp, Homo sapiens
gttccagacagggtggggct

SEQ ID NO: 1930775 - DNA, 21 bp, Homo sapiens
gttccagataaaaacaatata

SEQ ID NO: 1930776 - DNA, 13 bp, Homo sapiens
gttccctctttcc

SEQ ID NO: 1930777 - DNA, 12 bp, Homo sapiens
gttcccttgtgt

SEQ ID NO: 1930778 - DNA, 22 bp, Homo sapiens
gttccggaatcctgtcctcagc

SEQ ID NO: 1930779 - DNA, 14 bp, Homo sapiens
gttccgtctcctct

SEQ ID NO: 1930780 - DNA, 22 bp, Homo sapiens
gttccgtctcctctccagccct

SEQ ID NO: 1930781 - DNA, 15 bp, Homo sapiens
gttcctgccttctct

SEQ ID NO: 1930782 - DNA, 23 bp, Homo sapiens
gttccttaagtggctgtgattaa

SEQ ID NO: 1930783 - DNA, 19 bp, Homo sapiens
gttcgtggagccacaggca

SEQ ID NO: 1930784 - DNA, 21 bp, Homo sapiens
gttcgtggagccacaggcaga

SEQ ID NO: 1930785 - DNA, 22 bp, Homo sapiens
gttcgtggagccacaggcagac

SEQ ID NO: 1930786 - DNA, 17 bp, Homo sapiens
gttctaagtctttccat

SEQ ID NO: 1930787 - DNA, 21 bp, Homo sapiens
gttctagaaggggcgaggctt

SEQ ID NO: 1930788 - DNA, 17 bp, Homo sapiens
gttctgtctcatatgat

SEQ ID NO: 1930789 - DNA, 17 bp, Homo sapiens
gttcttgttacggcagt

SEQ ID NO: 1930790 - DNA, 16 bp, Homo sapiens
gttgaggctaaaacaa

SEQ ID NO: 1930791 - DNA, 21 bp, Homo sapiens
gttgctcctacccctgtcctg

SEQ ID NO: 1930792 - DNA, 13 bp, Homo sapiens
gttggaggcctgg

SEQ ID NO: 1930793 - DNA, 14 bp, Homo sapiens
gttgggaggattct

SEQ ID NO: 1930794 - DNA, 13 bp, Homo sapiens
gttgggttccaga

SEQ ID NO: 1930795 - DNA, 15 bp, Homo sapiens
gttgggttccagaca

SEQ ID NO: 1930796 - DNA, 22 bp, Homo sapiens
gttgggttccagacagagtgga

SEQ ID NO: 1930797 - DNA, 13 bp, Homo sapiens
gttgtctgccgtg

SEQ ID NO: 1930798 - DNA, 15 bp, Homo sapiens
gttgttagtgatttg

SEQ ID NO: 1930799 - DNA, 15 bp, Homo sapiens
gtttaaaataaaagt

SEQ ID NO: 1930800 - DNA, 13 bp, Homo sapiens
gtttaatatctga

SEQ ID NO: 1930801 - DNA, 14 bp, Homo sapiens
gtttaccctccctg

SEQ ID NO: 1930802 - DNA, 15 bp, Homo sapiens
gtttaccctccctgt

SEQ ID NO: 1930803 - DNA, 22 bp, Homo sapiens
gtttactagggatccctcatct

SEQ ID NO: 1930804 - DNA, 19 bp, Homo sapiens
gtttacttggtgaggagga

SEQ ID NO: 1930805 - DNA, 17 bp, Homo sapiens
gtttcaattgcatctcc

SEQ ID NO: 1930806 - DNA, 20 bp, Homo sapiens
gtttcactgacttagaacca

SEQ ID NO: 1930807 - DNA, 22 bp, Homo sapiens
gtttcagaaagggcagcccctc

SEQ ID NO: 1930808 - DNA, 23 bp, Homo sapiens
gtttcagaaagggcagcccctcc

SEQ ID NO: 1930809 - DNA, 16 bp, Homo sapiens
gtttcaggacagctgc

SEQ ID NO: 1930810 - DNA, 17 bp, Homo sapiens
gtttctgtaattggctt

SEQ ID NO: 1930811 - DNA, 19 bp, Homo sapiens
gtttgaggaccctcccagg

SEQ ID NO: 1930812 - DNA, 19 bp, Homo sapiens
gtttgatgtgtatgtgttt

SEQ ID NO: 1930813 - DNA, 15 bp, Homo sapiens
gtttgcaactggtat

SEQ ID NO: 1930814 - DNA, 20 bp, Homo sapiens
gtttgctttgtatgcacttt

SEQ ID NO: 1930815 - DNA, 14 bp, Homo sapiens
gtttgggcagtgga

SEQ ID NO: 1930816 - DNA, 22 bp, Homo sapiens
gttttattcacttgtgtttgta

SEQ ID NO: 1930817 - DNA, 17 bp, Homo sapiens
gttttcaccatctttct

SEQ ID NO: 1930818 - DNA, 13 bp, Homo sapiens
gttttcacttcct

SEQ ID NO: 1930819 - DNA, 19 bp, Homo sapiens
gttttcccctctctttgag

SEQ ID NO: 1930820 - DNA, 12 bp, Homo sapiens
gttttgtattct

SEQ ID NO: 1930821 - DNA, 15 bp, Homo sapiens
gttttgtattctctg

SEQ ID NO: 1930822 - DNA, 14 bp, Homo sapiens
gtttttatattact

SEQ ID NO: 1930823 - DNA, 15 bp, Homo sapiens
gttttttatgctaat

SEQ ID NO: 1930824 - DNA, 19 bp, Homo sapiens
gtttttttttcctgtcctt

SEQ ID NO: 1930825 - DNA, 18 bp, Homo sapiens
taaaaaaaaacattcaaa

SEQ ID NO: 1930826 - DNA, 16 bp, Homo sapiens
taaaaacaatatatgt

SEQ ID NO: 1930827 - DNA, 18 bp, Homo sapiens
taaaaacacctaagtgac

SEQ ID NO: 1930828 - DNA, 22 bp, Homo sapiens
taaaaataagtcattttaataa

SEQ ID NO: 1930829 - DNA, 18 bp, Homo sapiens
taaaaatatgtgagcatg

SEQ ID NO: 1930830 - DNA, 19 bp, Homo sapiens
taaaaatatgtgagcatga

SEQ ID NO: 1930831 - DNA, 14 bp, Homo sapiens
taaaaggaggacag

SEQ ID NO: 1930832 - DNA, 22 bp, Homo sapiens
taaaagtacctattgaacatgt

SEQ ID NO: 1930833 - DNA, 16 bp, Homo sapiens
taaaagtataacagca

SEQ ID NO: 1930834 - DNA, 13 bp, Homo sapiens
taaaataaaagta

SEQ ID NO: 1930835 - DNA, 19 bp, Homo sapiens
taaaatctattttgtctga

SEQ ID NO: 1930836 - DNA, 17 bp, Homo sapiens
taaaatgttcacttttg

SEQ ID NO: 1930837 - DNA, 13 bp, Homo sapiens
taaacaataaatg

SEQ ID NO: 1930838 - DNA, 12 bp, Homo sapiens
taaactgtgcac

SEQ ID NO: 1930839 - DNA, 18 bp, Homo sapiens
taaactttttcaatggtt

SEQ ID NO: 1930840 - DNA, 16 bp, Homo sapiens
taaagaaaggcagaga

SEQ ID NO: 1930841 - DNA, 19 bp, Homo sapiens
taaagaacaccctatattt

SEQ ID NO: 1930842 - DNA, 14 bp, Homo sapiens
taaagaaggtttca

SEQ ID NO: 1930843 - DNA, 15 bp, Homo sapiens
taaagacacctactg

SEQ ID NO: 1930844 - DNA, 23 bp, Homo sapiens
taaagatacagaactctttcaaa

SEQ ID NO: 1930845 - DNA, 17 bp, Homo sapiens
taaagcaatatgcattt

SEQ ID NO: 1930846 - DNA, 21 bp, Homo sapiens
taaagtagattagatctttta

SEQ ID NO: 1930847 - DNA, 23 bp, Homo sapiens
taaagttctgtactcaaatgtag

SEQ ID NO: 1930848 - DNA, 11 bp, Homo sapiens
taaataaaaat

SEQ ID NO: 1930849 - DNA, 14 bp, Homo sapiens
taaataaaaataag

SEQ ID NO: 1930850 - DNA, 17 bp, Homo sapiens
taaatacagtcttccat

SEQ ID NO: 1930851 - DNA, 22 bp, Homo sapiens
taaatacagtcttccatttgca

SEQ ID NO: 1930852 - DNA, 14 bp, Homo sapiens
taaatatcccagag

SEQ ID NO: 1930853 - DNA, 12 bp, Homo sapiens
taaatattcttg

SEQ ID NO: 1930854 - DNA, 23 bp, Homo sapiens
taaatattcttgtccacattcta

SEQ ID NO: 1930855 - DNA, 15 bp, Homo sapiens
taaatccacagtgag

SEQ ID NO: 1930856 - DNA, 12 bp, Homo sapiens
taaatgaatgtt

SEQ ID NO: 1930857 - DNA, 15 bp, Homo sapiens
taaatggtgagaatt

SEQ ID NO: 1930858 - DNA, 18 bp, Homo sapiens
taaatggtgagaattaaa

SEQ ID NO: 1930859 - DNA, 19 bp, Homo sapiens
taaatgtgatgaatactgt

SEQ ID NO: 1930860 - DNA, 13 bp, Homo sapiens
taaatgtggtaaa

SEQ ID NO: 1930861 - DNA, 13 bp, Homo sapiens
taaattttcagaa

SEQ ID NO: 1930862 - DNA, 18 bp, Homo sapiens
taacacctcttttccctt

SEQ ID NO: 1930863 - DNA, 16 bp, Homo sapiens
taacaggattagacag

SEQ ID NO: 1930864 - DNA, 20 bp, Homo sapiens
taaccgagccagcagctgaa

SEQ ID NO: 1930865 - DNA, 17 bp, Homo sapiens
taacctcaggttccaaa

SEQ ID NO: 1930866 - DNA, 14 bp, Homo sapiens
taacctcatcttct

SEQ ID NO: 1930867 - DNA, 20 bp, Homo sapiens
taactaagcacattatgttt

SEQ ID NO: 1930868 - DNA, 15 bp, Homo sapiens
taactatttagagaa

SEQ ID NO: 1930869 - DNA, 15 bp, Homo sapiens
taacttgtgttacta

SEQ ID NO: 1930870 - DNA, 22 bp, Homo sapiens
taagaacacctgacaacttctg

SEQ ID NO: 1930871 - DNA, 23 bp, Homo sapiens
taagaacacctgacaacttctga

SEQ ID NO: 1930872 - DNA, 23 bp, Homo sapiens
taagaataatgacgtattgtgaa

SEQ ID NO: 1930873 - DNA, 18 bp, Homo sapiens
taagacttttctttcctt

SEQ ID NO: 1930874 - DNA, 13 bp, Homo sapiens
taagataattata

SEQ ID NO: 1930875 - DNA, 16 bp, Homo sapiens
taagcaacatgaatta

SEQ ID NO: 1930876 - DNA, 15 bp, Homo sapiens
taagcactttgaaaa

SEQ ID NO: 1930877 - DNA, 17 bp, Homo sapiens
taagcactttgaaaata

SEQ ID NO: 1930878 - DNA, 23 bp, Homo sapiens
taagcactttgaaaatatttcta

SEQ ID NO: 1930879 - DNA, 15 bp, Homo sapiens
taagcatcaaactct

SEQ ID NO: 1930880 - DNA, 16 bp, Homo sapiens
taagcatcaaactctt

SEQ ID NO: 1930881 - DNA, 20 bp, Homo sapiens
taagccacttaaaatgttca

SEQ ID NO: 1930882 - DNA, 19 bp, Homo sapiens
taaggatggagccagctct

SEQ ID NO: 1930883 - DNA, 20 bp, Homo sapiens
taaggatggagccagctctg

SEQ ID NO: 1930884 - DNA, 12 bp, Homo sapiens
taaggatgggaa

SEQ ID NO: 1930885 - DNA, 16 bp, Homo sapiens
taaggatgggaaggag

SEQ ID NO: 1930886 - DNA, 13 bp, Homo sapiens
taagtatttcaaa

SEQ ID NO: 1930887 - DNA, 21 bp, Homo sapiens
tccccaggagagaccttctct

SEQ ID NO: 1930888 - DNA, 21 bp, Homo sapiens
tccccaggccgtggctgccca

SEQ ID NO: 1930889 - DNA, 12 bp, Homo sapiens
tcccccagcctc

SEQ ID NO: 1930890 - DNA, 20 bp, Homo sapiens
tcccccgcaatgtgccccca

SEQ ID NO: 1930891 - DNA, 12 bp, Homo sapiens
tcccctccagac

SEQ ID NO: 1930892 - DNA, 20 bp, Homo sapiens
tcccctgaggttaaggggat

SEQ ID NO: 1930893 - DNA, 12 bp, Homo sapiens
tcccctgccagg

SEQ ID NO: 1930894 - DNA, 15 bp, Homo sapiens
tcccctgccagggca

SEQ ID NO: 1930895 - DNA, 20 bp, Homo sapiens
tcccctgccagggcagggcc

SEQ ID NO: 1930896 - DNA, 13 bp, Homo sapiens
tccccttccactg

SEQ ID NO: 1930897 - DNA, 18 bp, Homo sapiens
tcccgagccccctgtcct

SEQ ID NO: 1930898 - DNA, 19 bp, Homo sapiens
tcccgagggcgcctgggtc

SEQ ID NO: 1930899 - DNA, 16 bp, Homo sapiens
tcccgctcagccctcc

SEQ ID NO: 1930900 - DNA, 19 bp, Homo sapiens
tcccgtataataaaaccaa

SEQ ID NO: 1930901 - DNA, 21 bp, Homo sapiens
tcccgtgtcgtaacagcagga

SEQ ID NO: 1930902 - DNA, 18 bp, Homo sapiens
tccctagaaacttccaaa

SEQ ID NO: 1930903 - DNA, 18 bp, Homo sapiens
tccctagaaagccatatt

SEQ ID NO: 1930904 - DNA, 23 bp, Homo sapiens
tccctagaaagccatattccagc

SEQ ID NO: 1930905 - DNA, 18 bp, Homo sapiens
tccctagtcttcaagcag

SEQ ID NO: 1930906 - DNA, 22 bp, Homo sapiens
tccctatgtcccagcccctggt

SEQ ID NO: 1930907 - DNA, 22 bp, Homo sapiens
tccctccacgcttagggtctgt

SEQ ID NO: 1930908 - DNA, 18 bp, Homo sapiens
tccctccacgttcacccc

SEQ ID NO: 1930909 - DNA, 19 bp, Homo sapiens
tccctccacgttcacccct

SEQ ID NO: 1930910 - DNA, 14 bp, Homo sapiens
tccctccactcctc

SEQ ID NO: 1930911 - DNA, 15 bp, Homo sapiens
tccctccactcctcc

SEQ ID NO: 1930912 - DNA, 18 bp, Homo sapiens
tccctccactcctcccaa

SEQ ID NO: 1930913 - DNA, 22 bp, Homo sapiens
tccctccactcctcccaactct

SEQ ID NO: 1930914 - DNA, 14 bp, Homo sapiens
tccctccctccaca

SEQ ID NO: 1930915 - DNA, 16 bp, Homo sapiens
tccctccctccacacc

SEQ ID NO: 1930916 - DNA, 17 bp, Homo sapiens
tccctccctccacacct

SEQ ID NO: 1930917 - DNA, 17 bp, Homo sapiens
tccctcgcatccgcctc

SEQ ID NO: 1930918 - DNA, 15 bp, Homo sapiens
tccctctttcctgtg

SEQ ID NO: 1930919 - DNA, 14 bp, Homo sapiens
tccctgactgggag

SEQ ID NO: 1930920 - DNA, 11 bp, Homo sapiens
tccctgcagct

SEQ ID NO: 1930921 - DNA, 12 bp, Homo sapiens
tccctgcagctt

SEQ ID NO: 1930922 - DNA, 20 bp, Homo sapiens
tccctgcccctcccttcaac

SEQ ID NO: 1930923 - DNA, 13 bp, Homo sapiens
tccctggccccag

SEQ ID NO: 1930924 - DNA, 17 bp, Homo sapiens
tccctggccccagtgac

SEQ ID NO: 1930925 - DNA, 22 bp, Homo sapiens
tccctgtaacctcttcagaggc

SEQ ID NO: 1930926 - DNA, 22 bp, Homo sapiens
tcccttcaaccattccccatgg

SEQ ID NO: 1930927 - DNA, 19 bp, Homo sapiens
tcccttcaatcctgtcaat

SEQ ID NO: 1930928 - DNA, 13 bp, Homo sapiens
tcccttggcccct

SEQ ID NO: 1930929 - DNA, 21 bp, Homo sapiens
tccctttgttgctgtctggct

SEQ ID NO: 1930930 - DNA, 13 bp, Homo sapiens
tccgcctctgagc

SEQ ID NO: 1930931 - DNA, 16 bp, Homo sapiens
tccgcctctgagccag

SEQ ID NO: 1930932 - DNA, 22 bp, Homo sapiens
tccggaatcctgtcctcagctt

SEQ ID NO: 1930933 - DNA, 21 bp, Homo sapiens
tccggatgacacaaataccag

SEQ ID NO: 1930934 - DNA, 13 bp, Homo sapiens
tccgtctcctctc

SEQ ID NO: 1930935 - DNA, 21 bp, Homo sapiens
tccgtctcctctccagcccta

SEQ ID NO: 1930936 - DNA, 21 bp, Homo sapiens
tcctaaaagttttaacctcag

SEQ ID NO: 1930937 - DNA, 22 bp, Homo sapiens
tcctaatgaatgcataaaatgt

SEQ ID NO: 1930938 - DNA, 22 bp, Homo sapiens
tcctcactgagaaggccccagg

SEQ ID NO: 1930939 - DNA, 22 bp, Homo sapiens
tcctccacgttctgctcatcat

SEQ ID NO: 1930940 - DNA, 18 bp, Homo sapiens
tcctccagagcctgggcg

SEQ ID NO: 1930941 - DNA, 12 bp, Homo sapiens
tcctccatggga

SEQ ID NO: 1930942 - DNA, 18 bp, Homo sapiens
tcctcccaactctggcct

SEQ ID NO: 1930943 - DNA, 19 bp, Homo sapiens
tcctcccaggcgccccttc

SEQ ID NO: 1930944 - DNA, 17 bp, Homo sapiens
tcctccctccctgcagg

SEQ ID NO: 1930945 - DNA, 15 bp, Homo sapiens
tcctcctgggccctc

SEQ ID NO: 1930946 - DNA, 17 bp, Homo sapiens
tcctcctgttcctgcct

SEQ ID NO: 1930947 - DNA, 19 bp, Homo sapiens
tcctcctgttcctgccttc

SEQ ID NO: 1930948 - DNA, 22 bp, Homo sapiens
tcctcctgttcctgccttctct

SEQ ID NO: 1930949 - DNA, 13 bp, Homo sapiens
tcctcggcagctc

SEQ ID NO: 1930950 - DNA, 12 bp, Homo sapiens
tcctctccactg

SEQ ID NO: 1930951 - DNA, 14 bp, Homo sapiens
tcctctccactgcc

SEQ ID NO: 1930952 - DNA, 16 bp, Homo sapiens
tcctctccactgcctt

SEQ ID NO: 1930953 - DNA, 23 bp, Homo sapiens
tcctctcggctggaagaacatca

SEQ ID NO: 1930954 - DNA, 20 bp, Homo sapiens
tcctctctctcacctacttc

SEQ ID NO: 1930955 - DNA, 14 bp, Homo sapiens
tcctctctctccct

SEQ ID NO: 1930956 - DNA, 16 bp, Homo sapiens
tcctctctctccctcc

SEQ ID NO: 1930957 - DNA, 17 bp, Homo sapiens
tcctctctctccctcca

SEQ ID NO: 1930958 - DNA, 19 bp, Homo sapiens
tcctctctctccctccact

SEQ ID NO: 1930959 - DNA, 20 bp, Homo sapiens
tcctctgtgaccaatgtctt

SEQ ID NO: 1930960 - DNA, 21 bp, Homo sapiens
tcctctgtgaccaatgtcttg

SEQ ID NO: 1930961 - DNA, 16 bp, Homo sapiens
tcctgaggtctggatt

SEQ ID NO: 1930962 - DNA, 14 bp, Homo sapiens
tcctgccttctctt

SEQ ID NO: 1930963 - DNA, 18 bp, Homo sapiens
tcctggacagtgagagca

SEQ ID NO: 1930964 - DNA, 21 bp, Homo sapiens
tcctggacatgaagattcttt

SEQ ID NO: 1930965 - DNA, 14 bp, Homo sapiens
tcctggatcccttt

SEQ ID NO: 1930966 - DNA, 14 bp, Homo sapiens
tcctgggaaatatt

SEQ ID NO: 1930967 - DNA, 16 bp, Homo sapiens
tcctgggaaatattcc

SEQ ID NO: 1930968 - DNA, 21 bp, Homo sapiens
tcctggggctgggtgtgtttc

SEQ ID NO: 1930969 - DNA, 17 bp, Homo sapiens
tcctgtcaatgtttgct

SEQ ID NO: 1930970 - DNA, 22 bp, Homo sapiens
tcctgtccttctctcacctcct

SEQ ID NO: 1930971 - DNA, 13 bp, Homo sapiens
tcctgtgccagga

SEQ ID NO: 1930972 - DNA, 21 bp, Homo sapiens
tcctgtgtccacatctaacaa

SEQ ID NO: 1930973 - DNA, 18 bp, Homo sapiens
tcctgtgtttgctcccat

SEQ ID NO: 1930974 - DNA, 14 bp, Homo sapiens
tcctgttcctgcct

SEQ ID NO: 1930975 - DNA, 13 bp, Homo sapiens
tccttagaaaaga

SEQ ID NO: 1930976 - DNA, 14 bp, Homo sapiens
tccttcccacggcc

SEQ ID NO: 1930977 - DNA, 20 bp, Homo sapiens
tccttcccacggccactgca

SEQ ID NO: 1930978 - DNA, 18 bp, Homo sapiens
tccttctcccctccagac

SEQ ID NO: 1930979 - DNA, 19 bp, Homo sapiens
tccttctcccctccagacc

SEQ ID NO: 1930980 - DNA, 16 bp, Homo sapiens
tccttctcgtcttcct

SEQ ID NO: 1930981 - DNA, 20 bp, Homo sapiens
tccttctcgtcttcctctct

SEQ ID NO: 1930982 - DNA, 20 bp, Homo sapiens
tccttctctcacctcctaaa

SEQ ID NO: 1930983 - DNA, 16 bp, Homo sapiens
tccttctgatctgaga

SEQ ID NO: 1930984 - DNA, 16 bp, Homo sapiens
tccttgggccctttga

SEQ ID NO: 1930985 - DNA, 22 bp, Homo sapiens
tccttggtggccgggggtgggg

SEQ ID NO: 1930986 - DNA, 16 bp, Homo sapiens
tcctttcacaaccttc

SEQ ID NO: 1930987 - DNA, 15 bp, Homo sapiens
tcctttccttctcgt

SEQ ID NO: 1930988 - DNA, 23 bp, Homo sapiens
tcctttgtttttttttcctgtcc

SEQ ID NO: 1930989 - DNA, 16 bp, Homo sapiens
tcgaagtcttccatca

SEQ ID NO: 1930990 - DNA, 18 bp, Homo sapiens
tcgagacaggcagaatca

SEQ ID NO: 1930991 - DNA, 23 bp, Homo sapiens
tcgctggactctcagtctctgag

SEQ ID NO: 1930992 - DNA, 19 bp, Homo sapiens
tcggcaacagggcttctct

SEQ ID NO: 1930993 - DNA, 21 bp, Homo sapiens
tcggcaacagggcttctcttt

SEQ ID NO: 1930994 - DNA, 17 bp, Homo sapiens
tcggctggaagaacatc

SEQ ID NO: 1930995 - DNA, 18 bp, Homo sapiens
tcggctggaagaacatca

SEQ ID NO: 1930996 - DNA, 14 bp, Homo sapiens
tcgttcccttgtgt

SEQ ID NO: 1930997 - DNA, 13 bp, Homo sapiens
tctaaacaaataa

SEQ ID NO: 1930998 - DNA, 13 bp, Homo sapiens
tctaattaaaatg

SEQ ID NO: 1930999 - DNA, 14 bp, Homo sapiens
tctaattaaaatgt

SEQ ID NO: 1931000 - DNA, 21 bp, Homo sapiens
tctaattaaaatgtgcagtat

SEQ ID NO: 1931001 - DNA, 19 bp, Homo sapiens
tctacagagcttccctgac

SEQ ID NO: 1931002 - DNA, 18 bp, Homo sapiens
tctacctgtattgtctga

SEQ ID NO: 1931003 - DNA, 13 bp, Homo sapiens
tctacttcagctt

SEQ ID NO: 1931004 - DNA, 16 bp, Homo sapiens
tctatagtttgattct

SEQ ID NO: 1931005 - DNA, 14 bp, Homo sapiens
tctatataaatcgc

SEQ ID NO: 1931006 - DNA, 13 bp, Homo sapiens
tctatatttgtaa

SEQ ID NO: 1931007 - DNA, 22 bp, Homo sapiens
tctatcatgttgaagtcaaatt

SEQ ID NO: 1931008 - DNA, 15 bp, Homo sapiens
tctatgtaaaaatat

SEQ ID NO: 1931009 - DNA, 18 bp, Homo sapiens
tctcaagagggcactggt

SEQ ID NO: 1931010 - DNA, 19 bp, Homo sapiens
tctcaagagggcactggtg

SEQ ID NO: 1931011 - DNA, 16 bp, Homo sapiens
tctcactataccagta

SEQ ID NO: 1931012 - DNA, 13 bp, Homo sapiens
tctcactcctacc

SEQ ID NO: 1931013 - DNA, 16 bp, Homo sapiens
tctcactcctacctgg

SEQ ID NO: 1931014 - DNA, 21 bp, Homo sapiens
tctcactttaataataaaaat

SEQ ID NO: 1931015 - DNA, 23 bp, Homo sapiens
tctcaggaccaaagctttcatgt

SEQ ID NO: 1931016 - DNA, 18 bp, Homo sapiens
tctcagtctctgagcagt

SEQ ID NO: 1931017 - DNA, 19 bp, Homo sapiens
tctcattggacccttccat

SEQ ID NO: 1931018 - DNA, 20 bp, Homo sapiens
tctcattggacccttccatg

SEQ ID NO: 1931019 - DNA, 19 bp, Homo sapiens
tgcaagtccatagctgagc

SEQ ID NO: 1931020 - DNA, 15 bp, Homo sapiens
tgcaagtcccaggga

SEQ ID NO: 1931021 - DNA, 20 bp, Homo sapiens
tgcaatgttattattggctt

SEQ ID NO: 1931022 - DNA, 22 bp, Homo sapiens
tgcacactttgccatattttca

SEQ ID NO: 1931023 - DNA, 16 bp, Homo sapiens
tgcacagtgcatctca

SEQ ID NO: 1931024 - DNA, 18 bp, Homo sapiens
tgcacagtgcatctcagc

SEQ ID NO: 1931025 - DNA, 15 bp, Homo sapiens
tgcacctcattccaa

SEQ ID NO: 1931026 - DNA, 15 bp, Homo sapiens
tgcacctgccccagg

SEQ ID NO: 1931027 - DNA, 17 bp, Homo sapiens
tgcacctgccccaggct

SEQ ID NO: 1931028 - DNA, 13 bp, Homo sapiens
tgcactgttcccc

SEQ ID NO: 1931029 - DNA, 14 bp, Homo sapiens
tgcactgttccccc

SEQ ID NO: 1931030 - DNA, 19 bp, Homo sapiens
tgcactgttccccctgtgc

SEQ ID NO: 1931031 - DNA, 23 bp, Homo sapiens
tgcactgttccccctgtgcagcc

SEQ ID NO: 1931032 - DNA, 16 bp, Homo sapiens
tgcactttccctagaa

SEQ ID NO: 1931033 - DNA, 17 bp, Homo sapiens
tgcactttccctagaaa

SEQ ID NO: 1931034 - DNA, 18 bp, Homo sapiens
tgcactttccctagaaag

SEQ ID NO: 1931035 - DNA, 17 bp, Homo sapiens
tgcagaccctgccaggg

SEQ ID NO: 1931036 - DNA, 11 bp, Homo sapiens
tgcagacctgg

SEQ ID NO: 1931037 - DNA, 15 bp, Homo sapiens
tgcagacctgggact

SEQ ID NO: 1931038 - DNA, 24 bp, Homo sapiens
tgcagagacagagaggacgtgggc

SEQ ID NO: 1931039 - DNA, 13 bp, Homo sapiens
tgcagagtcagca

SEQ ID NO: 1931040 - DNA, 17 bp, Homo sapiens
tgcagcatatgaggatg

SEQ ID NO: 1931041 - DNA, 23 bp, Homo sapiens
tgcagcctagtaggagctgagct

SEQ ID NO: 1931042 - DNA, 23 bp, Homo sapiens
tgcagcgtctgagcggccgcctg

SEQ ID NO: 1931043 - DNA, 15 bp, Homo sapiens
tgcaggacagatcag

SEQ ID NO: 1931044 - DNA, 16 bp, Homo sapiens
tgcaggcaagacacct

SEQ ID NO: 1931045 - DNA, 22 bp, Homo sapiens
tgcagggaaaattatttgcata

SEQ ID NO: 1931046 - DNA, 15 bp, Homo sapiens
tgcagggacagttgg

SEQ ID NO: 1931047 - DNA, 14 bp, Homo sapiens
tgcagggcagcctg

SEQ ID NO: 1931048 - DNA, 18 bp, Homo sapiens
tgcagggcagcctgtggg

SEQ ID NO: 1931049 - DNA, 14 bp, Homo sapiens
tgcaggtggggttt

SEQ ID NO: 1931050 - DNA, 19 bp, Homo sapiens
tgcagtcacccctgtctgc

SEQ ID NO: 1931051 - DNA, 20 bp, Homo sapiens
tgcagtcacccctgtctgcg

SEQ ID NO: 1931052 - DNA, 19 bp, Homo sapiens
tgcagtcctgatcagagcc

SEQ ID NO: 1931053 - DNA, 11 bp, Homo sapiens
tgcagtgatta

SEQ ID NO: 1931054 - DNA, 18 bp, Homo sapiens
tgcagtgggttctccaaa

SEQ ID NO: 1931055 - DNA, 18 bp, Homo sapiens
tgcatacgtaaaaatgga

SEQ ID NO: 1931056 - DNA, 17 bp, Homo sapiens
tgccaaccacctctggc

SEQ ID NO: 1931057 - DNA, 13 bp, Homo sapiens
tgccacacttcag

SEQ ID NO: 1931058 - DNA, 22 bp, Homo sapiens
tgccacacttcaggctcttctc

SEQ ID NO: 1931059 - DNA, 20 bp, Homo sapiens
tgccaccctctgcagggcag

SEQ ID NO: 1931060 - DNA, 20 bp, Homo sapiens
tgccacctctggccaaatat

SEQ ID NO: 1931061 - DNA, 14 bp, Homo sapiens
tgccacctgcagcg

SEQ ID NO: 1931062 - DNA, 15 bp, Homo sapiens
tgccacctgcagcgt

SEQ ID NO: 1931063 - DNA, 19 bp, Homo sapiens
tgccacgtggccgctgccc

SEQ ID NO: 1931064 - DNA, 21 bp, Homo sapiens
tgccacgtggccgctgcccac

SEQ ID NO: 1931065 - DNA, 22 bp, Homo sapiens
tgccagctctgtatcaggaccc

SEQ ID NO: 1931066 - DNA, 23 bp, Homo sapiens
tgccagctctgtatcaggaccca

SEQ ID NO: 1931067 - DNA, 15 bp, Homo sapiens
tgccaggactctctt

SEQ ID NO: 1931068 - DNA, 12 bp, Homo sapiens
tgccaggctgca

SEQ ID NO: 1931069 - DNA, 13 bp, Homo sapiens
tgccaggctgcag

SEQ ID NO: 1931070 - DNA, 15 bp, Homo sapiens
tgccagggggtttga

SEQ ID NO: 1931071 - DNA, 13 bp, Homo sapiens
tgccagtcctgca

SEQ ID NO: 1931072 - DNA, 16 bp, Homo sapiens
tgccatcatctcctgc

SEQ ID NO: 1931073 - DNA, 23 bp, Homo sapiens
tgccatcatctcctgccttcctc

SEQ ID NO: 1931074 - DNA, 14 bp, Homo sapiens
tgccatccctgaga

SEQ ID NO: 1931075 - DNA, 23 bp, Homo sapiens
tgccatggaggcacacagctgca

SEQ ID NO: 1931076 - DNA, 14 bp, Homo sapiens
tgccatttcttccc

SEQ ID NO: 1931077 - DNA, 16 bp, Homo sapiens
tgccatttcttcccaa

SEQ ID NO: 1931078 - DNA, 17 bp, Homo sapiens
tgccatttcttcccaag

SEQ ID NO: 1931079 - DNA, 21 bp, Homo sapiens
tgcccaagaatagatgctgac

SEQ ID NO: 1931080 - DNA, 20 bp, Homo sapiens
tgcccagcggctcttcctgg

SEQ ID NO: 1931081 - DNA, 22 bp, Homo sapiens
tgcccagtcatgacatttctca

SEQ ID NO: 1931082 - DNA, 19 bp, Homo sapiens
tgcccagtcttgagtgggc

SEQ ID NO: 1931083 - DNA, 21 bp, Homo sapiens
tgccccaggctcaggctgccc

SEQ ID NO: 1931084 - DNA, 20 bp, Homo sapiens
tgccccatcagcagcttgac

SEQ ID NO: 1931085 - DNA, 16 bp, Homo sapiens
tgcccccactcagcat

SEQ ID NO: 1931086 - DNA, 11 bp, Homo sapiens
tgccccccttc

SEQ ID NO: 1931087 - DNA, 15 bp, Homo sapiens
tgccccccttcccac

SEQ ID NO: 1931088 - DNA, 15 bp, Homo sapiens
tgccctcactccact

SEQ ID NO: 1931089 - DNA, 16 bp, Homo sapiens
tgccctcactccactc

SEQ ID NO: 1931090 - DNA, 19 bp, Homo sapiens
tgccctcactccactcccc

SEQ ID NO: 1931091 - DNA, 22 bp, Homo sapiens
tgccctcactccactcccctca

SEQ ID NO: 1931092 - DNA, 12 bp, Homo sapiens
tgccctggtgct

SEQ ID NO: 1931093 - DNA, 16 bp, Homo sapiens
tgccctggtgctgcca

SEQ ID NO: 1931094 - DNA, 21 bp, Homo sapiens
tgccctggtgctgccacactt

SEQ ID NO: 1931095 - DNA, 14 bp, Homo sapiens
tgccgctgggagag

SEQ ID NO: 1931096 - DNA, 13 bp, Homo sapiens
tgcctataaagga

SEQ ID NO: 1931097 - DNA, 13 bp, Homo sapiens
tgcctcatgctct

SEQ ID NO: 1931098 - DNA, 14 bp, Homo sapiens
tgcctcctctgtcc

SEQ ID NO: 1931099 - DNA, 15 bp, Homo sapiens
tgcctctacctgaca

SEQ ID NO: 1931100 - DNA, 23 bp, Homo sapiens
tgcctctacctgacactcccttg

SEQ ID NO: 1931101 - DNA, 19 bp, Homo sapiens
tgcctgcctcatgctctct

SEQ ID NO: 1931102 - DNA, 14 bp, Homo sapiens
tgccttagaacctt

SEQ ID NO: 1931103 - DNA, 18 bp, Homo sapiens
tgccttcagctctacagc

SEQ ID NO: 1931104 - DNA, 15 bp, Homo sapiens
tgccttcctcctggg

SEQ ID NO: 1931105 - DNA, 16 bp, Homo sapiens
tgccttcctcctgggc

SEQ ID NO: 1931106 - DNA, 16 bp, Homo sapiens
tgccttctacttttaa

SEQ ID NO: 1931107 - DNA, 23 bp, Homo sapiens
tgccttctccagacaaaccagaa

SEQ ID NO: 1931108 - DNA, 19 bp, Homo sapiens
tgccttgtgtacagttatt

SEQ ID NO: 1931109 - DNA, 19 bp, Homo sapiens
tgcgaatgagctgggccct

SEQ ID NO: 1931110 - DNA, 18 bp, Homo sapiens
tgcgacaccaccaacagg

SEQ ID NO: 1931111 - DNA, 15 bp, Homo sapiens
tgcgccctccctccc

SEQ ID NO: 1931112 - DNA, 22 bp, Homo sapiens
tgcgctagagcattctggggtg

SEQ ID NO: 1931113 - DNA, 19 bp, Homo sapiens
tgcggcttccgagggcact

SEQ ID NO: 1931114 - DNA, 14 bp, Homo sapiens
tgcgggctgggcag

SEQ ID NO: 1931115 - DNA, 19 bp, Homo sapiens
tgcgtccacgagctgttta

SEQ ID NO: 1931116 - DNA, 13 bp, Homo sapiens
tgcgtggatcaag

SEQ ID NO: 1931117 - DNA, 15 bp, Homo sapiens
tgcgtggatcaagct

SEQ ID NO: 1931118 - DNA, 21 bp, Homo sapiens
tgctaaaaaattaaaccaagc

SEQ ID NO: 1931119 - DNA, 21 bp, Homo sapiens
tgctatagtgtataccacctg

SEQ ID NO: 1931120 - DNA, 22 bp, Homo sapiens
tgctatagtgtataccacctgt

SEQ ID NO: 1931121 - DNA, 16 bp, Homo sapiens
tgctatcatatattat

SEQ ID NO: 1931122 - DNA, 21 bp, Homo sapiens
tgctatcatatattataagat

SEQ ID NO: 1931123 - DNA, 19 bp, Homo sapiens
tgctatggggagaaaagac

SEQ ID NO: 1931124 - DNA, 13 bp, Homo sapiens
tgctatgtctgtg

SEQ ID NO: 1931125 - DNA, 14 bp, Homo sapiens
tgctatgtctgtga

SEQ ID NO: 1931126 - DNA, 15 bp, Homo sapiens
tgctatgtctgtgat

SEQ ID NO: 1931127 - DNA, 18 bp, Homo sapiens
tgctcacattccctctca

SEQ ID NO: 1931128 - DNA, 14 bp, Homo sapiens
tgctcagttccaat

SEQ ID NO: 1931129 - DNA, 15 bp, Homo sapiens
tgctcagttccaatg

SEQ ID NO: 1931130 - DNA, 17 bp, Homo sapiens
tgctcatcattctctgt

SEQ ID NO: 1931131 - DNA, 21 bp, Homo sapiens
tgctcatcattctctgtctca

SEQ ID NO: 1931132 - DNA, 23 bp, Homo sapiens
tgctcatcattctctgtctcatc

SEQ ID NO: 1931133 - DNA, 21 bp, Homo sapiens
tgctcctacccctgtcctggg

SEQ ID NO: 1931134 - DNA, 11 bp, Homo sapiens
tgctcctggga

SEQ ID NO: 1931135 - DNA, 12 bp, Homo sapiens
tgctccttgggc

SEQ ID NO: 1931136 - DNA, 18 bp, Homo sapiens
tgctccttgggccctttg

SEQ ID NO: 1931137 - DNA, 22 bp, Homo sapiens
tgctctgcgtgtcacctgtgct

SEQ ID NO: 1931138 - DNA, 14 bp, Homo sapiens
tgctgactgtactc

SEQ ID NO: 1931139 - DNA, 21 bp, Homo sapiens
tgctgactgtactcctcccag

SEQ ID NO: 1931140 - DNA, 21 bp, Homo sapiens
tgctgatgaactcttaatcaa

SEQ ID NO: 1931141 - DNA, 11 bp, Homo sapiens
tgctggagagt

SEQ ID NO: 1931142 - DNA, 13 bp, Homo sapiens
tgctggcttgcac

SEQ ID NO: 1931143 - DNA, 22 bp, Homo sapiens
tgctggtcaagccccctttgat

SEQ ID NO: 1931144 - DNA, 16 bp, Homo sapiens
tgctggtcactgccat

SEQ ID NO: 1931145 - DNA, 20 bp, Homo sapiens
tgctgtaataatattttaga

SEQ ID NO: 1931146 - DNA, 15 bp, Homo sapiens
tgctgtccctcctga

SEQ ID NO: 1931147 - DNA, 17 bp, Homo sapiens
tgctgtctggctttccc

SEQ ID NO: 1931148 - DNA, 13 bp, Homo sapiens
tgctgtgacaggc

SEQ ID NO: 1931149 - DNA, 17 bp, Homo sapiens
tgctgtgacaggcagtg

SEQ ID NO: 1931150 - DNA, 16 bp, Homo sapiens
tgctgtggtgtgtccc

SEQ ID NO: 1931151 - DNA, 23 bp, Homo sapiens
tgctgtggtgtgtccccctctgt

SEQ ID NO: 1931152 - DNA, 19 bp, Homo sapiens
agctgcagttgtgaaagca

SEQ ID NO: 1931153 - DNA, 17 bp, Homo sapiens
agctgctcctagagggg

SEQ ID NO: 1931154 - DNA, 21 bp, Homo sapiens
agctggagagagagttctcac

SEQ ID NO: 1931155 - DNA, 14 bp, Homo sapiens
agctggatgagaat

SEQ ID NO: 1931156 - DNA, 15 bp, Homo sapiens
agctggatggggcgg

SEQ ID NO: 1931157 - DNA, 22 bp, Homo sapiens
agctggatggggcggcctgcag

SEQ ID NO: 1931158 - DNA, 17 bp, Homo sapiens
agctgggcactgggccg

SEQ ID NO: 1931159 - DNA, 20 bp, Homo sapiens
agctggggaagcttcttaaa

SEQ ID NO: 1931160 - DNA, 16 bp, Homo sapiens
agctgtttactaggga

SEQ ID NO: 1931161 - DNA, 22 bp, Homo sapiens
agctgtttactagggatccctc

SEQ ID NO: 1931162 - DNA, 13 bp, Homo sapiens
agcttccagatgg

SEQ ID NO: 1931163 - DNA, 23 bp, Homo sapiens
agcttcctttgtttttttttcct

SEQ ID NO: 1931164 - DNA, 16 bp, Homo sapiens
agcttcttaaatgaga

SEQ ID NO: 1931165 - DNA, 20 bp, Homo sapiens
agcttcttaatataactgcc

SEQ ID NO: 1931166 - DNA, 17 bp, Homo sapiens
agcttggagtgccacgt

SEQ ID NO: 1931167 - DNA, 22 bp, Homo sapiens
aggaaaaccaagccgtggcttc

SEQ ID NO: 1931168 - DNA, 21 bp, Homo sapiens
aggaaactctgcattctagta

SEQ ID NO: 1931169 - DNA, 13 bp, Homo sapiens
aggaagcaacgaa

SEQ ID NO: 1931170 - DNA, 15 bp, Homo sapiens
aggaaggctgagagg

SEQ ID NO: 1931171 - DNA, 13 bp, Homo sapiens
aggaagggccccc

SEQ ID NO: 1931172 - DNA, 16 bp, Homo sapiens
aggaaggggccagagg

SEQ ID NO: 1931173 - DNA, 14 bp, Homo sapiens
aggaagtaggaagt

SEQ ID NO: 1931174 - DNA, 18 bp, Homo sapiens
aggaagtcaaagcaagga

SEQ ID NO: 1931175 - DNA, 20 bp, Homo sapiens
aggaatgggccaagccaggg

SEQ ID NO: 1931176 - DNA, 16 bp, Homo sapiens
aggaatgttatcagta

SEQ ID NO: 1931177 - DNA, 12 bp, Homo sapiens
aggacagggagg

SEQ ID NO: 1931178 - DNA, 19 bp, Homo sapiens
aggacagtaaactcactag

SEQ ID NO: 1931179 - DNA, 14 bp, Homo sapiens
aggacagtttagga

SEQ ID NO: 1931180 - DNA, 13 bp, Homo sapiens
aggacccagagga

SEQ ID NO: 1931181 - DNA, 18 bp, Homo sapiens
aggacccggaggggcctg

SEQ ID NO: 1931182 - DNA, 20 bp, Homo sapiens
aggacccggaggggcctggc

SEQ ID NO: 1931183 - DNA, 21 bp, Homo sapiens
aggacccggaggggcctggca

SEQ ID NO: 1931184 - DNA, 23 bp, Homo sapiens
aggacttgtgcctcttgggagac

SEQ ID NO: 1931185 - DNA, 16 bp, Homo sapiens
aggagaccctgtcttt

SEQ ID NO: 1931186 - DNA, 22 bp, Homo sapiens
aggagagaatgagagagtgtgg

SEQ ID NO: 1931187 - DNA, 16 bp, Homo sapiens
aggagatgctccttgg

SEQ ID NO: 1931188 - DNA, 17 bp, Homo sapiens
aggagatgctccttggg

SEQ ID NO: 1931189 - DNA, 14 bp, Homo sapiens
aggagcttccagat

SEQ ID NO: 1931190 - DNA, 12 bp, Homo sapiens
aggaggacaggg

SEQ ID NO: 1931191 - DNA, 15 bp, Homo sapiens
aggaggacagggagg

SEQ ID NO: 1931192 - DNA, 12 bp, Homo sapiens
aggaggaggagg

SEQ ID NO: 1931193 - DNA, 14 bp, Homo sapiens
aggaggcctgggag

SEQ ID NO: 1931194 - DNA, 23 bp, Homo sapiens
aggagggaggtattcgtgcagca

SEQ ID NO: 1931195 - DNA, 14 bp, Homo sapiens
aggagggtcaggaa

SEQ ID NO: 1931196 - DNA, 17 bp, Homo sapiens
aggaggtgtggagtgga

SEQ ID NO: 1931197 - DNA, 18 bp, Homo sapiens
aggaggtgtggagtggag

SEQ ID NO: 1931198 - DNA, 23 bp, Homo sapiens
aggagtagaatataaacacataa

SEQ ID NO: 1931199 - DNA, 20 bp, Homo sapiens
aggagtgactctggctgcca

SEQ ID NO: 1931200 - DNA, 17 bp, Homo sapiens
aggagtgcgctagagca

SEQ ID NO: 1931201 - DNA, 13 bp, Homo sapiens
aggatgatgtaat

SEQ ID NO: 1931202 - DNA, 19 bp, Homo sapiens
aggatgatgtaattaaaaa

SEQ ID NO: 1931203 - DNA, 18 bp, Homo sapiens
aggatgcttctgctcaca

SEQ ID NO: 1931204 - DNA, 17 bp, Homo sapiens
aggatggagccagctct

SEQ ID NO: 1931205 - DNA, 15 bp, Homo sapiens
aggattctatgaggc

SEQ ID NO: 1931206 - DNA, 16 bp, Homo sapiens
aggattctatgaggca

SEQ ID NO: 1931207 - DNA, 19 bp, Homo sapiens
aggatttcatgatttcatt

SEQ ID NO: 1931208 - DNA, 17 bp, Homo sapiens
aggcaagctggcaggag

SEQ ID NO: 1931209 - DNA, 22 bp, Homo sapiens
aggcaagctggcaggagggtgg

SEQ ID NO: 1931210 - DNA, 14 bp, Homo sapiens
aggcacacagctgc

SEQ ID NO: 1931211 - DNA, 13 bp, Homo sapiens
aggcagaaccagc

SEQ ID NO: 1931212 - DNA, 14 bp, Homo sapiens
aggcagaatggtgg

SEQ ID NO: 1931213 - DNA, 18 bp, Homo sapiens
aggcagctgaaaagtaaa

SEQ ID NO: 1931214 - DNA, 17 bp, Homo sapiens
aggcaggggctgggcag

SEQ ID NO: 1931215 - DNA, 18 bp, Homo sapiens
aggcaggggctgggcaga

SEQ ID NO: 1931216 - DNA, 17 bp, Homo sapiens
aggcatggcccagcctg

SEQ ID NO: 1931217 - DNA, 19 bp, Homo sapiens
aggcatggcccagcctgga

SEQ ID NO: 1931218 - DNA, 21 bp, Homo sapiens
aggcatggcccagcctggagc

SEQ ID NO: 1931219 - DNA, 22 bp, Homo sapiens
aggcatggcccagcctggagcc

SEQ ID NO: 1931220 - DNA, 13 bp, Homo sapiens
aggcattgccaag

SEQ ID NO: 1931221 - DNA, 21 bp, Homo sapiens
aggcattgccaagggctttgt

SEQ ID NO: 1931222 - DNA, 16 bp, Homo sapiens
aggccacgggggaggc

SEQ ID NO: 1931223 - DNA, 23 bp, Homo sapiens
aggccacgggggaggccgaggca

SEQ ID NO: 1931224 - DNA, 13 bp, Homo sapiens
aggccagggcaga

SEQ ID NO: 1931225 - DNA, 18 bp, Homo sapiens
aggccatctgtaaatatc

SEQ ID NO: 1931226 - DNA, 22 bp, Homo sapiens
aggccatctgtaaatatcccag

SEQ ID NO: 1931227 - DNA, 13 bp, Homo sapiens
aggccattattgt

SEQ ID NO: 1931228 - DNA, 17 bp, Homo sapiens
aggccctcgctgccagc

SEQ ID NO: 1931229 - DNA, 15 bp, Homo sapiens
aggcccttcctctcc

SEQ ID NO: 1931230 - DNA, 18 bp, Homo sapiens
aggcccttcctctccact

SEQ ID NO: 1931231 - DNA, 13 bp, Homo sapiens
aggccgaggcagg

SEQ ID NO: 1931232 - DNA, 12 bp, Homo sapiens
aggccgtggctg

SEQ ID NO: 1931233 - DNA, 20 bp, Homo sapiens
aggcctatgccacctgcagc

SEQ ID NO: 1931234 - DNA, 18 bp, Homo sapiens
aggcctgccccccttccc

SEQ ID NO: 1931235 - DNA, 20 bp, Homo sapiens
aggcctgggagatgcagctg

SEQ ID NO: 1931236 - DNA, 23 bp, Homo sapiens
aggcctgtgtgtaagctgactgg

SEQ ID NO: 1931237 - DNA, 14 bp, Homo sapiens
aggcgccccttccc

SEQ ID NO: 1931238 - DNA, 23 bp, Homo sapiens
aggcggtcactgcccacctgcca

SEQ ID NO: 1931239 - DNA, 13 bp, Homo sapiens
aggcgtgaggatg

SEQ ID NO: 1931240 - DNA, 15 bp, Homo sapiens
aggctaatcaatacc

SEQ ID NO: 1931241 - DNA, 18 bp, Homo sapiens
aggctaatcaataccctt

SEQ ID NO: 1931242 - DNA, 16 bp, Homo sapiens
aggctcacccccttct

SEQ ID NO: 1931243 - DNA, 19 bp, Homo sapiens
aggctcacccccttctcca

SEQ ID NO: 1931244 - DNA, 23 bp, Homo sapiens
aggctcacccccttctccatcca

SEQ ID NO: 1931245 - DNA, 18 bp, Homo sapiens
aggctcaggctgcccagc

SEQ ID NO: 1931246 - DNA, 18 bp, Homo sapiens
aggctctgaaagctgctt

SEQ ID NO: 1931247 - DNA, 14 bp, Homo sapiens
aggctcttctcctt

SEQ ID NO: 1931248 - DNA, 17 bp, Homo sapiens
aggctgcaagctgcagg

SEQ ID NO: 1931249 - DNA, 11 bp, Homo sapiens
aggctgcccag

SEQ ID NO: 1931250 - DNA, 21 bp, Homo sapiens
aggctgccgctgctctcccag

SEQ ID NO: 1931251 - DNA, 22 bp, Homo sapiens
aggctgccgctgctctcccagg

SEQ ID NO: 1931252 - DNA, 13 bp, Homo sapiens
aggctgctgtcac

SEQ ID NO: 1931253 - DNA, 16 bp, Homo sapiens
agggaagcctgaaaaa

SEQ ID NO: 1931254 - DNA, 21 bp, Homo sapiens
agggaatgaaggtgtcagaat

SEQ ID NO: 1931255 - DNA, 20 bp, Homo sapiens
agggacagttgggtgtgaga

SEQ ID NO: 1931256 - DNA, 13 bp, Homo sapiens
agggacatattca

SEQ ID NO: 1931257 - DNA, 15 bp, Homo sapiens
agggacatattcatt

SEQ ID NO: 1931258 - DNA, 15 bp, Homo sapiens
agggacgcctggggg

SEQ ID NO: 1931259 - DNA, 22 bp, Homo sapiens
agggacgcctgggggtgccagg

SEQ ID NO: 1931260 - DNA, 23 bp, Homo sapiens
agggacgcctgggggtgccagga

SEQ ID NO: 1931261 - DNA, 12 bp, Homo sapiens
agggagtgggga

SEQ ID NO: 1931262 - DNA, 22 bp, Homo sapiens
agggatagcactgagcaaagca

SEQ ID NO: 1931263 - DNA, 15 bp, Homo sapiens
agggatccctcatct

SEQ ID NO: 1931264 - DNA, 18 bp, Homo sapiens
agggatggggagcagctg

SEQ ID NO: 1931265 - DNA, 17 bp, Homo sapiens
agggcaaaccaggctgc

SEQ ID NO: 1931266 - DNA, 13 bp, Homo sapiens
agggcagcccctc

SEQ ID NO: 1931267 - DNA, 15 bp, Homo sapiens
agggcagcccctccc

SEQ ID NO: 1931268 - DNA, 19 bp, Homo sapiens
agggcagcctgtgggagaa

SEQ ID NO: 1931269 - DNA, 21 bp, Homo sapiens
agggcagcctgtgggagaagg

SEQ ID NO: 1931270 - DNA, 17 bp, Homo sapiens
agggcagggttctagaa

SEQ ID NO: 1931271 - DNA, 20 bp, Homo sapiens
agggcagggttctagaaggg

SEQ ID NO: 1931272 - DNA, 20 bp, Homo sapiens
agggccacatgggaggctca

SEQ ID NO: 1931273 - DNA, 11 bp, Homo sapiens
agggcctggcc

SEQ ID NO: 1931274 - DNA, 13 bp, Homo sapiens
agggcctggcctg

SEQ ID NO: 1931275 - DNA, 15 bp, Homo sapiens
agggcgctgagggca

SEQ ID NO: 1931276 - DNA, 16 bp, Homo sapiens
agggctaaccagttct

SEQ ID NO: 1931277 - DNA, 14 bp, Homo sapiens
agggctccagggcc

SEQ ID NO: 1931278 - DNA, 18 bp, Homo sapiens
aggggacaagccaggccc

SEQ ID NO: 1931279 - DNA, 21 bp, Homo sapiens
aggggacttggataggagctt

SEQ ID NO: 1931280 - DNA, 23 bp, Homo sapiens
aggggcctggcagccgtgccttc

SEQ ID NO: 1931281 - DNA, 15 bp, Homo sapiens
aggggcctggcctgg

SEQ ID NO: 1931282 - DNA, 23 bp, Homo sapiens
aggggctgggcagaggggagagg

SEQ ID NO: 1931283 - DNA, 20 bp, Homo sapiens
aggggctgtccaatcacatt

SEQ ID NO: 1931284 - DNA, 17 bp, Homo sapiens
agggggcctgagttgag

SEQ ID NO: 1931285 - DNA, 20 bp, Homo sapiens
agggggctattccctggaga

SEQ ID NO: 1931286 - DNA, 22 bp, Homo sapiens
aggggtcagcaggggggttggg

SEQ ID NO: 1931287 - DNA, 19 bp, Homo sapiens
aggggtctccaggaggaga

SEQ ID NO: 1931288 - DNA, 23 bp, Homo sapiens
aggggtgggggagaatggctctg

SEQ ID NO: 1931289 - DNA, 17 bp, Homo sapiens
aggggttccagcttccc

SEQ ID NO: 1931290 - DNA, 15 bp, Homo sapiens
agggtacagcccagg

SEQ ID NO: 1931291 - DNA, 15 bp, Homo sapiens
agggtagggggcctg

SEQ ID NO: 1931292 - DNA, 21 bp, Homo sapiens
agggtcagacgcctgaggaac

SEQ ID NO: 1931293 - DNA, 13 bp, Homo sapiens
agggtcagagagg

SEQ ID NO: 1931294 - DNA, 21 bp, Homo sapiens
agggtcagagaggagtcagag

SEQ ID NO: 1931295 - DNA, 21 bp, Homo sapiens
agggtcaggaaggatgagcat

SEQ ID NO: 1931296 - DNA, 13 bp, Homo sapiens
agggtgaggatgg

SEQ ID NO: 1931297 - DNA, 15 bp, Homo sapiens
agggtgaggcgtggg

SEQ ID NO: 1931298 - DNA, 15 bp, Homo sapiens
agggtgtggcttgga

SEQ ID NO: 1931299 - DNA, 20 bp, Homo sapiens
agggtgtggcttggaacatt

SEQ ID NO: 1931300 - DNA, 18 bp, Homo sapiens
agggttgaccccagagga

SEQ ID NO: 1931301 - DNA, 16 bp, Homo sapiens
aggtatgaggtctagg

SEQ ID NO: 1931302 - DNA, 17 bp, Homo sapiens
aggtattcgtgcagcat

SEQ ID NO: 1931303 - DNA, 15 bp, Homo sapiens
aggtcagagcccagg

SEQ ID NO: 1931304 - DNA, 20 bp, Homo sapiens
aggtcccgagccccctgtcc

SEQ ID NO: 1931305 - DNA, 13 bp, Homo sapiens
aggtcctttcctt

SEQ ID NO: 1931306 - DNA, 22 bp, Homo sapiens
aggtctaggaacatacttcagc

SEQ ID NO: 1931307 - DNA, 12 bp, Homo sapiens
aggtctccaccc

SEQ ID NO: 1931308 - DNA, 13 bp, Homo sapiens
aggtctccacccc

SEQ ID NO: 1931309 - DNA, 15 bp, Homo sapiens
aggtctccacccctc

SEQ ID NO: 1931310 - DNA, 21 bp, Homo sapiens
aggtctttgaaatatgcatgt

SEQ ID NO: 1931311 - DNA, 23 bp, Homo sapiens
aggtgcacagacgtccctccacg

SEQ ID NO: 1931312 - DNA, 15 bp, Homo sapiens
aggtgcacctgcccc

SEQ ID NO: 1931313 - DNA, 18 bp, Homo sapiens
aggtgcacctgccccagg

SEQ ID NO: 1931314 - DNA, 20 bp, Homo sapiens
aggtgcccagtcttgagtgg

SEQ ID NO: 1931315 - DNA, 22 bp, Homo sapiens
aggtgcccagtcttgagtgggc

SEQ ID NO: 1931316 - DNA, 17 bp, Homo sapiens
aggtggccactccagac

SEQ ID NO: 1931317 - DNA, 21 bp, Homo sapiens
aggtggggagactgggctgag

SEQ ID NO: 1931318 - DNA, 13 bp, Homo sapiens
aggtggtcttgga

SEQ ID NO: 1931319 - DNA, 15 bp, Homo sapiens
aggtggtcttggaga

SEQ ID NO: 1931320 - DNA, 15 bp, Homo sapiens
aggtgtggagtggag

SEQ ID NO: 1931321 - DNA, 17 bp, Homo sapiens
aggtgtggagtggaggg

SEQ ID NO: 1931322 - DNA, 15 bp, Homo sapiens
aggtgtttctctgta

SEQ ID NO: 1931323 - DNA, 21 bp, Homo sapiens
aggttccgcttggagcagagg

SEQ ID NO: 1931324 - DNA, 11 bp, Homo sapiens
aggttctaaaa

SEQ ID NO: 1931325 - DNA, 15 bp, Homo sapiens
aggttgaggacagga

SEQ ID NO: 1931326 - DNA, 20 bp, Homo sapiens
aggttgtctgaagtcactgc

SEQ ID NO: 1931327 - DNA, 12 bp, Homo sapiens
agtaaaaataaa

SEQ ID NO: 1931328 - DNA, 17 bp, Homo sapiens
agtaaatattgtcacaa

SEQ ID NO: 1931329 - DNA, 18 bp, Homo sapiens
agtaaatccacagtgagt

SEQ ID NO: 1931330 - DNA, 18 bp, Homo sapiens
agtaactaagcacattat

SEQ ID NO: 1931331 - DNA, 15 bp, Homo sapiens
agtaaggcagctctg

SEQ ID NO: 1931332 - DNA, 12 bp, Homo sapiens
agtacagctatt

SEQ ID NO: 1931333 - DNA, 15 bp, Homo sapiens
agtaccaatcatttt

SEQ ID NO: 1931334 - DNA, 22 bp, Homo sapiens
agtacgtgtttacttggtgagg

SEQ ID NO: 1931335 - DNA, 23 bp, Homo sapiens
agtacttgggagacctgtaatca

SEQ ID NO: 1931336 - DNA, 13 bp, Homo sapiens
agtaggagcccag

SEQ ID NO: 1931337 - DNA, 15 bp, Homo sapiens
agtaggagctgagct

SEQ ID NO: 1931338 - DNA, 17 bp, Homo sapiens
agtaggttgaggacagg

SEQ ID NO: 1931339 - DNA, 20 bp, Homo sapiens
agtaggttgaggacaggaga

SEQ ID NO: 1931340 - DNA, 23 bp, Homo sapiens
agtatatcttaagataatattta

SEQ ID NO: 1931341 - DNA, 18 bp, Homo sapiens
agtatctgtaacccttga

SEQ ID NO: 1931342 - DNA, 13 bp, Homo sapiens
agtatctgtacct

SEQ ID NO: 1931343 - DNA, 17 bp, Homo sapiens
agtattcattttgcaac

SEQ ID NO: 1931344 - DNA, 21 bp, Homo sapiens
agtattgccacctctggccaa

SEQ ID NO: 1931345 - DNA, 21 bp, Homo sapiens
agtattttcagtgtcaaatat

SEQ ID NO: 1931346 - DNA, 15 bp, Homo sapiens
agtcaacctgggcaa

SEQ ID NO: 1931347 - DNA, 20 bp, Homo sapiens
agtcaagttccgtctcctct

SEQ ID NO: 1931348 - DNA, 22 bp, Homo sapiens
agtcacagagataattctagct

SEQ ID NO: 1931349 - DNA, 14 bp, Homo sapiens
agtcacccctgtct

SEQ ID NO: 1931350 - DNA, 14 bp, Homo sapiens
agtcagagagaatc

SEQ ID NO: 1931351 - DNA, 14 bp, Homo sapiens
agtcagcccagtgg

SEQ ID NO: 1931352 - DNA, 19 bp, Homo sapiens
agtcagctccgagtggctc

SEQ ID NO: 1931353 - DNA, 14 bp, Homo sapiens
agtcataccaatga

SEQ ID NO: 1931354 - DNA, 19 bp, Homo sapiens
agtcatgacatttctcaaa

SEQ ID NO: 1931355 - DNA, 20 bp, Homo sapiens
agtcatgacatttctcaaag

SEQ ID NO: 1931356 - DNA, 22 bp, Homo sapiens
agtcatgagctgagcagggaga

SEQ ID NO: 1931357 - DNA, 13 bp, Homo sapiens
agtccaactacag

SEQ ID NO: 1931358 - DNA, 15 bp, Homo sapiens
agtccatagctgagc

SEQ ID NO: 1931359 - DNA, 19 bp, Homo sapiens
agtccatagctgagctgga

SEQ ID NO: 1931360 - DNA, 21 bp, Homo sapiens
agtcccagggagctctgcata

SEQ ID NO: 1931361 - DNA, 15 bp, Homo sapiens
agtcctcggcagctc

SEQ ID NO: 1931362 - DNA, 16 bp, Homo sapiens
agtcctcggcagctcc

SEQ ID NO: 1931363 - DNA, 20 bp, Homo sapiens
agtcctgatcagagccgtgg

SEQ ID NO: 1931364 - DNA, 13 bp, Homo sapiens
agtcgcggctgca

SEQ ID NO: 1931365 - DNA, 16 bp, Homo sapiens
agtctctgagcagtga

SEQ ID NO: 1931366 - DNA, 14 bp, Homo sapiens
agtctcttctccac

SEQ ID NO: 1931367 - DNA, 17 bp, Homo sapiens
agtctcttctccactgg

SEQ ID NO: 1931368 - DNA, 19 bp, Homo sapiens
agtctgaaggagaggagtg

SEQ ID NO: 1931369 - DNA, 20 bp, Homo sapiens
agtctgaaggagaggagtgc

SEQ ID NO: 1931370 - DNA, 20 bp, Homo sapiens
agtctgtgccacgtgtttgt

SEQ ID NO: 1931371 - DNA, 12 bp, Homo sapiens
agtctgtgcctc

SEQ ID NO: 1931372 - DNA, 16 bp, Homo sapiens
agtcttccatcagcag

SEQ ID NO: 1931373 - DNA, 19 bp, Homo sapiens
agtcttccatttgcaaggg

SEQ ID NO: 1931374 - DNA, 16 bp, Homo sapiens
agtcttctttcatgta

SEQ ID NO: 1931375 - DNA, 13 bp, Homo sapiens
agtgaaacttgtg

SEQ ID NO: 1931376 - DNA, 14 bp, Homo sapiens
agtgaacataactg

SEQ ID NO: 1931377 - DNA, 22 bp, Homo sapiens
agtgaacattattaaatcagaa

SEQ ID NO: 1931378 - DNA, 13 bp, Homo sapiens
agtgaagaaaatg

SEQ ID NO: 1931379 - DNA, 21 bp, Homo sapiens
agtgaaggcttctctctgtgg

SEQ ID NO: 1931380 - DNA, 16 bp, Homo sapiens
agtgaatacatggtag

SEQ ID NO: 1931381 - DNA, 16 bp, Homo sapiens
agtgaatgattcagtg

SEQ ID NO: 1931382 - DNA, 22 bp, Homo sapiens
agtgaccgggggaagctgagcc

SEQ ID NO: 1931383 - DNA, 21 bp, Homo sapiens
agtgactaccacttatttcta

SEQ ID NO: 1931384 - DNA, 19 bp, Homo sapiens
agtgagaaattatgaaagt

SEQ ID NO: 1931385 - DNA, 13 bp, Homo sapiens
agtgagggtcaga

SEQ ID NO: 1931386 - DNA, 16 bp, Homo sapiens
agtgagggtcagagag

SEQ ID NO: 1931387 - DNA, 23 bp, Homo sapiens
agtgatatggcttgtagggtgag

SEQ ID NO: 1931388 - DNA, 23 bp, Homo sapiens
agtgatttgggggtgcaatgata

SEQ ID NO: 1931389 - DNA, 23 bp, Homo sapiens
agtgcagtcctgatcagagccgt

SEQ ID NO: 1931390 - DNA, 14 bp, Homo sapiens
agtgcatctcagcc

SEQ ID NO: 1931391 - DNA, 17 bp, Homo sapiens
agtgcatctcagcccac

SEQ ID NO: 1931392 - DNA, 18 bp, Homo sapiens
agtgccacatggccgctg

SEQ ID NO: 1931393 - DNA, 23 bp, Homo sapiens
agtgccacatggccgctgcccac

SEQ ID NO: 1931394 - DNA, 15 bp, Homo sapiens
agtgccatggccagg

SEQ ID NO: 1931395 - DNA, 21 bp, Homo sapiens
agtggaaaaagaaattctgtt

SEQ ID NO: 1931396 - DNA, 17 bp, Homo sapiens
agtggaggggtcagcag

SEQ ID NO: 1931397 - DNA, 23 bp, Homo sapiens
agtggcccctggcacctgggtgc

SEQ ID NO: 1931398 - DNA, 17 bp, Homo sapiens
agtggcctgagaagagt

SEQ ID NO: 1931399 - DNA, 21 bp, Homo sapiens
agtggcctgagaagagtcgag

SEQ ID NO: 1931400 - DNA, 17 bp, Homo sapiens
agtggcttaatagtaat

SEQ ID NO: 1931401 - DNA, 21 bp, Homo sapiens
agtgggacagggcatggccag

SEQ ID NO: 1931402 - DNA, 11 bp, Homo sapiens
agtgggagagg

SEQ ID NO: 1931403 - DNA, 13 bp, Homo sapiens
agtgggagaggaa

SEQ ID NO: 1931404 - DNA, 14 bp, Homo sapiens
agtgggagtgggag

SEQ ID NO: 1931405 - DNA, 17 bp, Homo sapiens
agtggggaggggcctgg

SEQ ID NO: 1931406 - DNA, 19 bp, Homo sapiens
agtggggaggggcctggcc

SEQ ID NO: 1931407 - DNA, 20 bp, Homo sapiens
agtggggaggggcctggcct

SEQ ID NO: 1931408 - DNA, 23 bp, Homo sapiens
agtggggaggggcctggcctggg

SEQ ID NO: 1931409 - DNA, 16 bp, Homo sapiens
agtgggttctccaaac

SEQ ID NO: 1931410 - DNA, 16 bp, Homo sapiens
agtgtataccacctgt

SEQ ID NO: 1931411 - DNA, 18 bp, Homo sapiens
agtgtataccacctgtac

SEQ ID NO: 1931412 - DNA, 21 bp, Homo sapiens
agtgtataccacctgtacata

SEQ ID NO: 1931413 - DNA, 13 bp, Homo sapiens
agtgtatctcgaa

SEQ ID NO: 1931414 - DNA, 20 bp, Homo sapiens
agtgtgacgggggttggggt

SEQ ID NO: 1931415 - DNA, 15 bp, Homo sapiens
agtgtgccaccctct

SEQ ID NO: 1931416 - DNA, 22 bp, Homo sapiens
agtgtgccaccctctgcagggc

SEQ ID NO: 1931417 - DNA, 19 bp, Homo sapiens
agtgtggaaaaaaaaagaa

SEQ ID NO: 1931418 - DNA, 15 bp, Homo sapiens
agtgtgttttggtat

SEQ ID NO: 1931419 - DNA, 20 bp, Homo sapiens
agtgtgttttggtatgcact

SEQ ID NO: 1931420 - DNA, 15 bp, Homo sapiens
agtgttaaatgtgat

SEQ ID NO: 1931421 - DNA, 21 bp, Homo sapiens
agtgtttgggtatattcattt

SEQ ID NO: 1931422 - DNA, 20 bp, Homo sapiens
agttacaaattgcttgaaag

SEQ ID NO: 1931423 - DNA, 23 bp, Homo sapiens
agttactatcatgtcaaacgtga

SEQ ID NO: 1931424 - DNA, 16 bp, Homo sapiens
agttcaatcaaacttt

SEQ ID NO: 1931425 - DNA, 19 bp, Homo sapiens
agttcaatcaaactttcag

SEQ ID NO: 1931426 - DNA, 15 bp, Homo sapiens
agttcatagtttctg

SEQ ID NO: 1931427 - DNA, 17 bp, Homo sapiens
agttcatagtttctgta

SEQ ID NO: 1931428 - DNA, 18 bp, Homo sapiens
agttcatagtttctgtaa

SEQ ID NO: 1931429 - DNA, 22 bp, Homo sapiens
agttccagataaaaacaatata

SEQ ID NO: 1931430 - DNA, 14 bp, Homo sapiens
agttccttatgtat

SEQ ID NO: 1931431 - DNA, 17 bp, Homo sapiens
agttctcatccacagag

SEQ ID NO: 1931432 - DNA, 22 bp, Homo sapiens
agttctcatccacagaggccag

SEQ ID NO: 1931433 - DNA, 13 bp, Homo sapiens
agttgaggggctt

SEQ ID NO: 1931434 - DNA, 21 bp, Homo sapiens
agttgaggggcttccctctgc

SEQ ID NO: 1931435 - DNA, 21 bp, Homo sapiens
agttgatcgcctttcccaggt

SEQ ID NO: 1931436 - DNA, 20 bp, Homo sapiens
agttgctcctacccctgtcc

SEQ ID NO: 1931437 - DNA, 21 bp, Homo sapiens
agttgctcctacccctgtcct

SEQ ID NO: 1931438 - DNA, 19 bp, Homo sapiens
agttgttagtgatttgcta

SEQ ID NO: 1931439 - DNA, 18 bp, Homo sapiens
agtttgattattcagtgt

SEQ ID NO: 1931440 - DNA, 13 bp, Homo sapiens
agtttttacagtg

SEQ ID NO: 1931441 - DNA, 14 bp, Homo sapiens
agtttttacagtgt

SEQ ID NO: 1931442 - DNA, 18 bp, Homo sapiens
agtttttttcaaagtcca

SEQ ID NO: 1931443 - DNA, 15 bp, Homo sapiens
ataaaaacaatatat

SEQ ID NO: 1931444 - DNA, 20 bp, Homo sapiens
ataaactaattttgtacgta

SEQ ID NO: 1931445 - DNA, 19 bp, Homo sapiens
ataaagtacgtgtttactt

SEQ ID NO: 1931446 - DNA, 18 bp, Homo sapiens
ataaagtgcctataaagg

SEQ ID NO: 1931447 - DNA, 13 bp, Homo sapiens
ataaagttattaa

SEQ ID NO: 1931448 - DNA, 16 bp, Homo sapiens
ataaatactaaatatg

SEQ ID NO: 1931449 - DNA, 16 bp, Homo sapiens
ataaatatctatttat

SEQ ID NO: 1931450 - DNA, 19 bp, Homo sapiens
ataaatggtgagaattaaa

SEQ ID NO: 1931451 - DNA, 14 bp, Homo sapiens
ataacaattcctct

SEQ ID NO: 1931452 - DNA, 19 bp, Homo sapiens
ataaccccaccctttacat

SEQ ID NO: 1931453 - DNA, 15 bp, Homo sapiens
ataactatgttgata

SEQ ID NO: 1931454 - DNA, 13 bp, Homo sapiens
ataataaaaatca

SEQ ID NO: 1931455 - DNA, 19 bp, Homo sapiens
ataataaaaccaaagaata

SEQ ID NO: 1931456 - DNA, 17 bp, Homo sapiens
ataatgacgtattgtga

SEQ ID NO: 1931457 - DNA, 13 bp, Homo sapiens
ataatgtgaaaat

SEQ ID NO: 1931458 - DNA, 16 bp, Homo sapiens
ataatgtgaaaatggt

SEQ ID NO: 1931459 - DNA, 14 bp, Homo sapiens
ataatgttgttatt

SEQ ID NO: 1931460 - DNA, 19 bp, Homo sapiens
ataatgttgttatttaaag

SEQ ID NO: 1931461 - DNA, 16 bp, Homo sapiens
ataattgtggagagga

SEQ ID NO: 1931462 - DNA, 20 bp, Homo sapiens
ataattgtggagaggagaga

SEQ ID NO: 1931463 - DNA, 14 bp, Homo sapiens
atacaccgggcctg

SEQ ID NO: 1931464 - DNA, 14 bp, Homo sapiens
atacagaactcttt

SEQ ID NO: 1931465 - DNA, 15 bp, Homo sapiens
atacagaactctttc

SEQ ID NO: 1931466 - DNA, 16 bp, Homo sapiens
atacagaactctttca

SEQ ID NO: 1931467 - DNA, 18 bp, Homo sapiens
atacagaactctttcaaa

SEQ ID NO: 1931468 - DNA, 15 bp, Homo sapiens
atacatggtagcagg

SEQ ID NO: 1931469 - DNA, 21 bp, Homo sapiens
atacattgtataggccatctg

SEQ ID NO: 1931470 - DNA, 19 bp, Homo sapiens
ataccaatgaaaaaatgta

SEQ ID NO: 1931471 - DNA, 15 bp, Homo sapiens
ataccacctgtacat

SEQ ID NO: 1931472 - DNA, 12 bp, Homo sapiens
atactattaaag

SEQ ID NO: 1931473 - DNA, 16 bp, Homo sapiens
atactgtctaagaata

SEQ ID NO: 1931474 - DNA, 15 bp, Homo sapiens
atagagcctgaggga

SEQ ID NO: 1931475 - DNA, 15 bp, Homo sapiens
atagaggtgagggaa

SEQ ID NO: 1931476 - DNA, 15 bp, Homo sapiens
atagataatagtaca

SEQ ID NO: 1931477 - DNA, 15 bp, Homo sapiens
atagatgagtcctgt

SEQ ID NO: 1931478 - DNA, 16 bp, Homo sapiens
atagcagacagtgttt

SEQ ID NO: 1931479 - DNA, 18 bp, Homo sapiens
ataggagcttccagatgg

SEQ ID NO: 1931480 - DNA, 17 bp, Homo sapiens
ataggccatctgtaaat

SEQ ID NO: 1931481 - DNA, 13 bp, Homo sapiens
atagtaaaaataa

SEQ ID NO: 1931482 - DNA, 23 bp, Homo sapiens
atagtgtataccacctgtacata

SEQ ID NO: 1931483 - DNA, 22 bp, Homo sapiens
atagttccagataaaaacaata

SEQ ID NO: 1931484 - DNA, 12 bp, Homo sapiens
atagtttctgta

SEQ ID NO: 1931485 - DNA, 19 bp, Homo sapiens
atataaatatcacaaagtt

SEQ ID NO: 1931486 - DNA, 16 bp, Homo sapiens
atataaatggtgagaa

SEQ ID NO: 1931487 - DNA, 18 bp, Homo sapiens
atataaatggtgagaatt

SEQ ID NO: 1931488 - DNA, 12 bp, Homo sapiens
atatattgcata

SEQ ID NO: 1931489 - DNA, 21 bp, Homo sapiens
atatatttaactatttagaga

SEQ ID NO: 1931490 - DNA, 13 bp, Homo sapiens
atatatttttaag

SEQ ID NO: 1931491 - DNA, 20 bp, Homo sapiens
atatcccagagaacaatcac

SEQ ID NO: 1931492 - DNA, 20 bp, Homo sapiens
atatccctatgtcccagccc

SEQ ID NO: 1931493 - DNA, 13 bp, Homo sapiens
atatctatttatc

SEQ ID NO: 1931494 - DNA, 18 bp, Homo sapiens
atatctgtgcaatggaat

SEQ ID NO: 1931495 - DNA, 22 bp, Homo sapiens
atatctgtgcaatggaatataa

SEQ ID NO: 1931496 - DNA, 18 bp, Homo sapiens
atatgattctcctctccc

SEQ ID NO: 1931497 - DNA, 11 bp, Homo sapiens
atatgcacttt

SEQ ID NO: 1931498 - DNA, 14 bp, Homo sapiens
atatgcatgtactt

SEQ ID NO: 1931499 - DNA, 21 bp, Homo sapiens
atatgtaaattataagtaact

SEQ ID NO: 1931500 - DNA, 14 bp, Homo sapiens
atatgtatataaaa

SEQ ID NO: 1931501 - DNA, 13 bp, Homo sapiens
atattacttttgt

SEQ ID NO: 1931502 - DNA, 17 bp, Homo sapiens
atattacttttgtaaat

SEQ ID NO: 1931503 - DNA, 12 bp, Homo sapiens
atattatatata

SEQ ID NO: 1931504 - DNA, 18 bp, Homo sapiens
atattcaatcttaacaaa

SEQ ID NO: 1931505 - DNA, 23 bp, Homo sapiens
atattcttatgtatgtgaaagtt

SEQ ID NO: 1931506 - DNA, 19 bp, Homo sapiens
atattgtcacaacactgaa

SEQ ID NO: 1931507 - DNA, 22 bp, Homo sapiens
atattgtcacctagcagatatg

SEQ ID NO: 1931508 - DNA, 13 bp, Homo sapiens
atatttaaaatag

SEQ ID NO: 1931509 - DNA, 13 bp, Homo sapiens
atatttgtaactt

SEQ ID NO: 1931510 - DNA, 17 bp, Homo sapiens
atattttagaaaatgtt

SEQ ID NO: 1931511 - DNA, 19 bp, Homo sapiens
atcaaaagattaacaacac

SEQ ID NO: 1931512 - DNA, 16 bp, Homo sapiens
atcaagcacagaagga

SEQ ID NO: 1931513 - DNA, 22 bp, Homo sapiens
atcaagttggcttctaatcaaa

SEQ ID NO: 1931514 - DNA, 20 bp, Homo sapiens
atcacaaagttgtttaacta

SEQ ID NO: 1931515 - DNA, 19 bp, Homo sapiens
atcacagattttttcttta

SEQ ID NO: 1931516 - DNA, 24 bp, Homo sapiens
atcacattcaggcatgcgaatgag

SEQ ID NO: 1931517 - DNA, 17 bp, Homo sapiens
atcactattcttaagca

SEQ ID NO: 1931518 - DNA, 13 bp, Homo sapiens
atcagctccttcc

SEQ ID NO: 1931519 - DNA, 16 bp, Homo sapiens
atcaggacccagagga

SEQ ID NO: 1931520 - DNA, 17 bp, Homo sapiens
atcagtattaagctaat

SEQ ID NO: 1931521 - DNA, 19 bp, Homo sapiens
atcagtcataactaaataa

SEQ ID NO: 1931522 - DNA, 16 bp, Homo sapiens
atcatataataaatgt

SEQ ID NO: 1931523 - DNA, 20 bp, Homo sapiens
atcatataataaatgtacat

SEQ ID NO: 1931524 - DNA, 22 bp, Homo sapiens
atcatcatagaggatgatgtaa

SEQ ID NO: 1931525 - DNA, 18 bp, Homo sapiens
atcatcatgtgtgtccac

SEQ ID NO: 1931526 - DNA, 14 bp, Homo sapiens
atcattctctgtct

SEQ ID NO: 1931527 - DNA, 24 bp, Homo sapiens
atcattctctgtctcatccatcat

SEQ ID NO: 1931528 - DNA, 14 bp, Homo sapiens
atcattttaattat

SEQ ID NO: 1931529 - DNA, 15 bp, Homo sapiens
atcattttaattatt

SEQ ID NO: 1931530 - DNA, 14 bp, Homo sapiens
atccaacatttcct

SEQ ID NO: 1931531 - DNA, 21 bp, Homo sapiens
atccagagagaagcaccccac

SEQ ID NO: 1931532 - DNA, 15 bp, Homo sapiens
atccagccattcctg

SEQ ID NO: 1931533 - DNA, 15 bp, Homo sapiens
atccagctatgttat

SEQ ID NO: 1931534 - DNA, 18 bp, Homo sapiens
atccatcatcatgtgtgt

SEQ ID NO: 1931535 - DNA, 15 bp, Homo sapiens
atcccaccaaccctc

SEQ ID NO: 1931536 - DNA, 16 bp, Homo sapiens
atcccacttgcccctg

SEQ ID NO: 1931537 - DNA, 15 bp, Homo sapiens
atcccagagaacaat

SEQ ID NO: 1931538 - DNA, 16 bp, Homo sapiens
atcccagagaacaatc

SEQ ID NO: 1931539 - DNA, 19 bp, Homo sapiens
atcccagagaacaatcact

SEQ ID NO: 1931540 - DNA, 18 bp, Homo sapiens
atccctatgtcccagccc

SEQ ID NO: 1931541 - DNA, 11 bp, Homo sapiens
atccctcatct

SEQ ID NO: 1931542 - DNA, 13 bp, Homo sapiens
atccctcatctgt

SEQ ID NO: 1931543 - DNA, 17 bp, Homo sapiens
atccctcatctgtccct

SEQ ID NO: 1931544 - DNA, 22 bp, Homo sapiens
atccctctacagagcttccctg

SEQ ID NO: 1931545 - DNA, 13 bp, Homo sapiens
atcccttggcccc

SEQ ID NO: 1931546 - DNA, 16 bp, Homo sapiens
atcccttggcccctct

SEQ ID NO: 1931547 - DNA, 17 bp, Homo sapiens
atcccttggcccctctc

SEQ ID NO: 1931548 - DNA, 19 bp, Homo sapiens
atcccttggcccctctctg

SEQ ID NO: 1931549 - DNA, 15 bp, Homo sapiens
atccgaaatcagcag

SEQ ID NO: 1931550 - DNA, 16 bp, Homo sapiens
atccgcctctgagcca

SEQ ID NO: 1931551 - DNA, 24 bp, Homo sapiens
atccggcatgagggctgagatgcg

SEQ ID NO: 1931552 - DNA, 12 bp, Homo sapiens
atcctaatgaat

SEQ ID NO: 1931553 - DNA, 13 bp, Homo sapiens
atcctaatgaatg

SEQ ID NO: 1931554 - DNA, 19 bp, Homo sapiens
atcctaatgaatgcataaa

SEQ ID NO: 1931555 - DNA, 16 bp, Homo sapiens
atcctagagattctta

SEQ ID NO: 1931556 - DNA, 23 bp, Homo sapiens
atcctagagattcttagctcttg

SEQ ID NO: 1931557 - DNA, 22 bp, Homo sapiens
atcctaggcatctgctgtaata

SEQ ID NO: 1931558 - DNA, 20 bp, Homo sapiens
atcctatgtttttgttcaaa

SEQ ID NO: 1931559 - DNA, 15 bp, Homo sapiens
atcctcaatccagct

SEQ ID NO: 1931560 - DNA, 18 bp, Homo sapiens
atcctctgagtgtgacca

SEQ ID NO: 1931561 - DNA, 21 bp, Homo sapiens
catatgtaccatgtacatgaa

SEQ ID NO: 1931562 - DNA, 22 bp, Homo sapiens
catattcacagtgaacataact

SEQ ID NO: 1931563 - DNA, 14 bp, Homo sapiens
catattccagcagt

SEQ ID NO: 1931564 - DNA, 17 bp, Homo sapiens
catcaaactcttagtta

SEQ ID NO: 1931565 - DNA, 23 bp, Homo sapiens
catcaagttattgacaaactctc

SEQ ID NO: 1931566 - DNA, 15 bp, Homo sapiens
catcactgctgtccc

SEQ ID NO: 1931567 - DNA, 19 bp, Homo sapiens
catcactgctgtccctcct

SEQ ID NO: 1931568 - DNA, 20 bp, Homo sapiens
catcactgctgtccctcctg

SEQ ID NO: 1931569 - DNA, 13 bp, Homo sapiens
catcagcagtgat

SEQ ID NO: 1931570 - DNA, 23 bp, Homo sapiens
catcagcagtgattgaagtatct

SEQ ID NO: 1931571 - DNA, 20 bp, Homo sapiens
catcatctcctgccttcctc

SEQ ID NO: 1931572 - DNA, 15 bp, Homo sapiens
catcattctctgtct

SEQ ID NO: 1931573 - DNA, 21 bp, Homo sapiens
catcattctctgtctcatcca

SEQ ID NO: 1931574 - DNA, 15 bp, Homo sapiens
catccaggtcctttc

SEQ ID NO: 1931575 - DNA, 17 bp, Homo sapiens
catccaggtcctttcct

SEQ ID NO: 1931576 - DNA, 22 bp, Homo sapiens
catccatttatttggcatctgt

SEQ ID NO: 1931577 - DNA, 15 bp, Homo sapiens
catccccctccttgc

SEQ ID NO: 1931578 - DNA, 13 bp, Homo sapiens
catcccttggccc

SEQ ID NO: 1931579 - DNA, 13 bp, Homo sapiens
catccgcctctga

SEQ ID NO: 1931580 - DNA, 20 bp, Homo sapiens
catccgcctctgagccagga

SEQ ID NO: 1931581 - DNA, 14 bp, Homo sapiens
catcctgtacaagt

SEQ ID NO: 1931582 - DNA, 15 bp, Homo sapiens
catctaacctcatct

SEQ ID NO: 1931583 - DNA, 14 bp, Homo sapiens
catctaataaaaaa

SEQ ID NO: 1931584 - DNA, 17 bp, Homo sapiens
catctattcccaaagaa

SEQ ID NO: 1931585 - DNA, 16 bp, Homo sapiens
catctcctgccttcct

SEQ ID NO: 1931586 - DNA, 19 bp, Homo sapiens
catctctggagtgtgtggg

SEQ ID NO: 1931587 - DNA, 19 bp, Homo sapiens
catctgtaaatatcccaga

SEQ ID NO: 1931588 - DNA, 20 bp, Homo sapiens
catctgtccctccgggacct

SEQ ID NO: 1931589 - DNA, 15 bp, Homo sapiens
catctgtggcctggg

SEQ ID NO: 1931590 - DNA, 16 bp, Homo sapiens
catctgtggcctgggg

SEQ ID NO: 1931591 - DNA, 14 bp, Homo sapiens
catcttcttcacca

SEQ ID NO: 1931592 - DNA, 12 bp, Homo sapiens
catctttccaaa

SEQ ID NO: 1931593 - DNA, 19 bp, Homo sapiens
catgagaccactgttatca

SEQ ID NO: 1931594 - DNA, 17 bp, Homo sapiens
catgagggctgagatgc

SEQ ID NO: 1931595 - DNA, 19 bp, Homo sapiens
catgatacttattcaaaaa

SEQ ID NO: 1931596 - DNA, 12 bp, Homo sapiens
catgatgtcctt

SEQ ID NO: 1931597 - DNA, 16 bp, Homo sapiens
catgattttggccact

SEQ ID NO: 1931598 - DNA, 23 bp, Homo sapiens
catgcactgttccccctgtgcag

SEQ ID NO: 1931599 - DNA, 15 bp, Homo sapiens
catgcccagcttgga

SEQ ID NO: 1931600 - DNA, 22 bp, Homo sapiens
catgcccagcttggagtgccac

SEQ ID NO: 1931601 - DNA, 17 bp, Homo sapiens
catgcgaatgagctggg

SEQ ID NO: 1931602 - DNA, 19 bp, Homo sapiens
catgctcttacccacacta

SEQ ID NO: 1931603 - DNA, 12 bp, Homo sapiens
catggccaggag

SEQ ID NO: 1931604 - DNA, 17 bp, Homo sapiens
catggccaggagtgggt

SEQ ID NO: 1931605 - DNA, 14 bp, Homo sapiens
catggcccagcctg

SEQ ID NO: 1931606 - DNA, 16 bp, Homo sapiens
catggcccagcctgga

SEQ ID NO: 1931607 - DNA, 19 bp, Homo sapiens
catggcccagcctggagcc

SEQ ID NO: 1931608 - DNA, 17 bp, Homo sapiens
catggccgcaacttccc

SEQ ID NO: 1931609 - DNA, 12 bp, Homo sapiens
catggcttgggc

SEQ ID NO: 1931610 - DNA, 13 bp, Homo sapiens
catgggagccggg

SEQ ID NO: 1931611 - DNA, 22 bp, Homo sapiens
catgggagccgggtctgcctct

SEQ ID NO: 1931612 - DNA, 22 bp, Homo sapiens
catggtagcagggtctttgtgt

SEQ ID NO: 1931613 - DNA, 18 bp, Homo sapiens
catggtgtgatcgtctga

SEQ ID NO: 1931614 - DNA, 19 bp, Homo sapiens
catgtactgagccttgtaa

SEQ ID NO: 1931615 - DNA, 23 bp, Homo sapiens
catgtactgagccttgtaattct

SEQ ID NO: 1931616 - DNA, 18 bp, Homo sapiens
catgtaggaagtaggaag

SEQ ID NO: 1931617 - DNA, 18 bp, Homo sapiens
caggtgaacgctcagcgc

SEQ ID NO: 1931618 - DNA, 15 bp, Homo sapiens
caggtgcacagacgt

SEQ ID NO: 1931619 - DNA, 17 bp, Homo sapiens
caggtgttttccttcac

SEQ ID NO: 1931620 - DNA, 19 bp, Homo sapiens
caggttgaggctaaaacaa

SEQ ID NO: 1931621 - DNA, 13 bp, Homo sapiens
cagtaaacaccat

SEQ ID NO: 1931622 - DNA, 14 bp, Homo sapiens
cagtaaatccacag

SEQ ID NO: 1931623 - DNA, 16 bp, Homo sapiens
cagtaaggcagctctg

SEQ ID NO: 1931624 - DNA, 14 bp, Homo sapiens
cagtaggagcccag

SEQ ID NO: 1931625 - DNA, 22 bp, Homo sapiens
cagtaggagcccagctctgaaa

SEQ ID NO: 1931626 - DNA, 23 bp, Homo sapiens
cagtataattgagttttcagtgg

SEQ ID NO: 1931627 - DNA, 18 bp, Homo sapiens
cagtattgccacctctgg

SEQ ID NO: 1931628 - DNA, 15 bp, Homo sapiens
cagtcaacctgggca

SEQ ID NO: 1931629 - DNA, 16 bp, Homo sapiens
cagtcaacctgggcaa

SEQ ID NO: 1931630 - DNA, 17 bp, Homo sapiens
cagtcaaggagtggctt

SEQ ID NO: 1931631 - DNA, 19 bp, Homo sapiens
cagtcaagttccgtctcct

SEQ ID NO: 1931632 - DNA, 13 bp, Homo sapiens
cagtcacactgct

SEQ ID NO: 1931633 - DNA, 16 bp, Homo sapiens
cagtcacactgctggg

SEQ ID NO: 1931634 - DNA, 17 bp, Homo sapiens
cagtcacactgctggga

SEQ ID NO: 1931635 - DNA, 14 bp, Homo sapiens
cagtcacccctgtc

SEQ ID NO: 1931636 - DNA, 18 bp, Homo sapiens
cagtcattctagagggat

SEQ ID NO: 1931637 - DNA, 13 bp, Homo sapiens
cagtccacaaaat

SEQ ID NO: 1931638 - DNA, 18 bp, Homo sapiens
cagtcttccatttgcaag

SEQ ID NO: 1931639 - DNA, 21 bp, Homo sapiens
cagtcttccatttgcaaggga

SEQ ID NO: 1931640 - DNA, 15 bp, Homo sapiens
cagtcttgagtgggc

SEQ ID NO: 1931641 - DNA, 17 bp, Homo sapiens
cagtcttgagtgggccc

SEQ ID NO: 1931642 - DNA, 23 bp, Homo sapiens
cagtcttgagtgggccccctctc

SEQ ID NO: 1931643 - DNA, 15 bp, Homo sapiens
cagtgaacataactg

SEQ ID NO: 1931644 - DNA, 18 bp, Homo sapiens
cagtgaagcccaggagga

SEQ ID NO: 1931645 - DNA, 14 bp, Homo sapiens
cagtgctccctcac

SEQ ID NO: 1931646 - DNA, 13 bp, Homo sapiens
cagtggagagggg

SEQ ID NO: 1931647 - DNA, 17 bp, Homo sapiens
cagtggagaggggactt

SEQ ID NO: 1931648 - DNA, 12 bp, Homo sapiens
cagtggcagcaa

SEQ ID NO: 1931649 - DNA, 17 bp, Homo sapiens
cagtgtgaggccagggc

SEQ ID NO: 1931650 - DNA, 18 bp, Homo sapiens
cagtgtgaggccagggca

SEQ ID NO: 1931651 - DNA, 16 bp, Homo sapiens
cagtgtgccaccctct

SEQ ID NO: 1931652 - DNA, 21 bp, Homo sapiens
cagtgtgccaccctctgcagg

SEQ ID NO: 1931653 - DNA, 14 bp, Homo sapiens
cagtgttaaatgtg

SEQ ID NO: 1931654 - DNA, 22 bp, Homo sapiens
cagtgttttctgggataagtaa

SEQ ID NO: 1931655 - DNA, 15 bp, Homo sapiens
cagttaaaaaaaatt

SEQ ID NO: 1931656 - DNA, 16 bp, Homo sapiens
cagttaaaaaaaattt

SEQ ID NO: 1931657 - DNA, 12 bp, Homo sapiens
cagttcaatcaa

SEQ ID NO: 1931658 - DNA, 15 bp, Homo sapiens
cagttgggtgtgaga

SEQ ID NO: 1931659 - DNA, 22 bp, Homo sapiens
cagtttgtccacacaagacagc

SEQ ID NO: 1931660 - DNA, 21 bp, Homo sapiens
cataaccccaccctttacatt

SEQ ID NO: 1931661 - DNA, 19 bp, Homo sapiens
cataagaaaactaagaaat

SEQ ID NO: 1931662 - DNA, 12 bp, Homo sapiens
cataagtttctg

SEQ ID NO: 1931663 - DNA, 18 bp, Homo sapiens
cataatgttacattatta

SEQ ID NO: 1931664 - DNA, 22 bp, Homo sapiens
catacattgtataggccatctg

SEQ ID NO: 1931665 - DNA, 23 bp, Homo sapiens
catacattgtataggccatctgt

SEQ ID NO: 1931666 - DNA, 14 bp, Homo sapiens
cataccaatgaaaa

SEQ ID NO: 1931667 - DNA, 23 bp, Homo sapiens
catacttcatcgcagtggactgt

SEQ ID NO: 1931668 - DNA, 15 bp, Homo sapiens
catagccaggaaact

SEQ ID NO: 1931669 - DNA, 15 bp, Homo sapiens
catagctgagctgga

SEQ ID NO: 1931670 - DNA, 16 bp, Homo sapiens
catagtaccaatcatt

SEQ ID NO: 1931671 - DNA, 22 bp, Homo sapiens
catagtaccaatcattttaatt

SEQ ID NO: 1931672 - DNA, 21 bp, Homo sapiens
catatattgttatttttgtct

SEQ ID NO: 1931673 - DNA, 16 bp, Homo sapiens
atcctgcaatttctcc

SEQ ID NO: 1931674 - DNA, 14 bp, Homo sapiens
atcctgcaccctct

SEQ ID NO: 1931675 - DNA, 18 bp, Homo sapiens
atcctgtcaatgtttgct

SEQ ID NO: 1931676 - DNA, 14 bp, Homo sapiens
atcctgtcctcagc

SEQ ID NO: 1931677 - DNA, 18 bp, Homo sapiens
atcctgtcctcagcttct

SEQ ID NO: 1931678 - DNA, 16 bp, Homo sapiens
atcggagcctcctctc

SEQ ID NO: 1931679 - DNA, 15 bp, Homo sapiens
atctaacctcatctt

SEQ ID NO: 1931680 - DNA, 23 bp, Homo sapiens
atctattgctggcaaagacagaa

SEQ ID NO: 1931681 - DNA, 18 bp, Homo sapiens
atctatttatctgtctga

SEQ ID NO: 1931682 - DNA, 17 bp, Homo sapiens
atctcagaacagtctga

SEQ ID NO: 1931683 - DNA, 20 bp, Homo sapiens
atctcattggacccttccat

SEQ ID NO: 1931684 - DNA, 14 bp, Homo sapiens
atctcctttgtcca

SEQ ID NO: 1931685 - DNA, 15 bp, Homo sapiens
atctgaagtgtctaa

SEQ ID NO: 1931686 - DNA, 21 bp, Homo sapiens
atctgctgacagatgttccat

SEQ ID NO: 1931687 - DNA, 23 bp, Homo sapiens
atctgctgtaataatattttaga

SEQ ID NO: 1931688 - DNA, 13 bp, Homo sapiens
atctgtaaatatc

SEQ ID NO: 1931689 - DNA, 19 bp, Homo sapiens
atctgtaaatatcccagag

SEQ ID NO: 1931690 - DNA, 22 bp, Homo sapiens
atctgtaacccttgaatttcta

SEQ ID NO: 1931691 - DNA, 18 bp, Homo sapiens
atctgtatgggtcattct

SEQ ID NO: 1931692 - DNA, 16 bp, Homo sapiens
atctgtggcctggggc

SEQ ID NO: 1931693 - DNA, 12 bp, Homo sapiens
atctgtgtcttg

SEQ ID NO: 1931694 - DNA, 14 bp, Homo sapiens
atctgtgtcttgtt

SEQ ID NO: 1931695 - DNA, 21 bp, Homo sapiens
atctgtttaaagtagattaga

SEQ ID NO: 1931696 - DNA, 17 bp, Homo sapiens
atcttaagataatattt

SEQ ID NO: 1931697 - DNA, 17 bp, Homo sapiens
ctcttcagaggccctcg

SEQ ID NO: 1931698 - DNA, 14 bp, Homo sapiens
ctcttcccccttcc

SEQ ID NO: 1931699 - DNA, 15 bp, Homo sapiens
ctcttcccccttccc

SEQ ID NO: 1931700 - DNA, 17 bp, Homo sapiens
ctcttcccccttcccct

SEQ ID NO: 1931701 - DNA, 16 bp, Homo sapiens
ctcttctatcctgcaa

SEQ ID NO: 1931702 - DNA, 14 bp, Homo sapiens
ctcttctccactgg

SEQ ID NO: 1931703 - DNA, 13 bp, Homo sapiens
ctcttctcctttc

SEQ ID NO: 1931704 - DNA, 21 bp, Homo sapiens
ctcttgtaatccgaatctctt

SEQ ID NO: 1931705 - DNA, 12 bp, Homo sapiens
ctctttcaaaac

SEQ ID NO: 1931706 - DNA, 13 bp, Homo sapiens
ctctttcctgtgc

SEQ ID NO: 1931707 - DNA, 10 bp, Homo sapiens
ctctttgaga

SEQ ID NO: 1931708 - DNA, 17 bp, Homo sapiens
ctctttggtgccagctg

SEQ ID NO: 1931709 - DNA, 16 bp, Homo sapiens
ctcttttccaaacaca

SEQ ID NO: 1931710 - DNA, 12 bp, Homo sapiens
ctcttttccctt

SEQ ID NO: 1931711 - DNA, 14 bp, Homo sapiens
ctgaaagctgcttc

SEQ ID NO: 1931712 - DNA, 17 bp, Homo sapiens
ctgaaatacctttgcct

SEQ ID NO: 1931713 - DNA, 21 bp, Homo sapiens
ctgaaggcaaatctcctttgt

SEQ ID NO: 1931714 - DNA, 13 bp, Homo sapiens
ctgaagtcactgc

SEQ ID NO: 1931715 - DNA, 15 bp, Homo sapiens
ctgaagtcactgcac

SEQ ID NO: 1931716 - DNA, 16 bp, Homo sapiens
ctgaagtcactgcaca

SEQ ID NO: 1931717 - DNA, 22 bp, Homo sapiens
ctgaagtcactgcacagtgcat

SEQ ID NO: 1931718 - DNA, 15 bp, Homo sapiens
ctgaatattggacat

SEQ ID NO: 1931719 - DNA, 19 bp, Homo sapiens
ctgaattcgagacaggcag

SEQ ID NO: 1931720 - DNA, 15 bp, Homo sapiens
ctgaattctgaactt

SEQ ID NO: 1931721 - DNA, 13 bp, Homo sapiens
ctgacaacttctg

SEQ ID NO: 1931722 - DNA, 22 bp, Homo sapiens
ctgaccgggcttcctccctcca

SEQ ID NO: 1931723 - DNA, 12 bp, Homo sapiens
ctgactcagggc

SEQ ID NO: 1931724 - DNA, 15 bp, Homo sapiens
ctgactcagggctcc

SEQ ID NO: 1931725 - DNA, 16 bp, Homo sapiens
ctgactcattctgaag

SEQ ID NO: 1931726 - DNA, 13 bp, Homo sapiens
ctgactgaaatta

SEQ ID NO: 1931727 - DNA, 12 bp, Homo sapiens
ctgactgggagt

SEQ ID NO: 1931728 - DNA, 18 bp, Homo sapiens
ctgagaaggccccagggc

SEQ ID NO: 1931729 - DNA, 20 bp, Homo sapiens
ctgagccaccgcgagggcct

SEQ ID NO: 1931730 - DNA, 12 bp, Homo sapiens
ctgagccctgcc

SEQ ID NO: 1931731 - DNA, 14 bp, Homo sapiens
ctgagcggccgcct

SEQ ID NO: 1931732 - DNA, 19 bp, Homo sapiens
ctgagcggccgcctgtcct

SEQ ID NO: 1931733 - DNA, 13 bp, Homo sapiens
ctgagctgaggca

SEQ ID NO: 1931734 - DNA, 22 bp, Homo sapiens
ctgagcttgattctaaagggga

SEQ ID NO: 1931735 - DNA, 23 bp, Homo sapiens
ctgagcttgattctaaaggggac

SEQ ID NO: 1931736 - DNA, 17 bp, Homo sapiens
ctgaggcagcagtgtga

SEQ ID NO: 1931737 - DNA, 23 bp, Homo sapiens
ctgaggcagcagtgtgaggccag

SEQ ID NO: 1931738 - DNA, 21 bp, Homo sapiens
ctgagggcagggttctagaag

SEQ ID NO: 1931739 - DNA, 16 bp, Homo sapiens
ctgagggcagtcgata

SEQ ID NO: 1931740 - DNA, 15 bp, Homo sapiens
ctgaggttaagggga

SEQ ID NO: 1931741 - DNA, 12 bp, Homo sapiens
ctgagtcctgtt

SEQ ID NO: 1931742 - DNA, 16 bp, Homo sapiens
ctgagtgttcaaacta

SEQ ID NO: 1931743 - DNA, 22 bp, Homo sapiens
ctgagtgttcaaactactgtac

SEQ ID NO: 1931744 - DNA, 15 bp, Homo sapiens
ctgagttctcatcca

SEQ ID NO: 1931745 - DNA, 16 bp, Homo sapiens
ctgagttgaggggctt

SEQ ID NO: 1931746 - DNA, 21 bp, Homo sapiens
ctgagttgaggggcttccctc

SEQ ID NO: 1931747 - DNA, 19 bp, Homo sapiens
ctgataaaaccatgtagaa

SEQ ID NO: 1931748 - DNA, 13 bp, Homo sapiens
ctgatacagcctt

SEQ ID NO: 1931749 - DNA, 13 bp, Homo sapiens
ctgatccctctac

SEQ ID NO: 1931750 - DNA, 21 bp, Homo sapiens
ctgatgaactcttaatcaaat

SEQ ID NO: 1931751 - DNA, 15 bp, Homo sapiens
ctgcaacagcctgtt

SEQ ID NO: 1931752 - DNA, 19 bp, Homo sapiens
ctgcaacttgtaaatgtgg

SEQ ID NO: 1931753 - DNA, 23 bp, Homo sapiens
ctgcaagtccatagctgagctgg

SEQ ID NO: 1931754 - DNA, 16 bp, Homo sapiens
ctgcaccctctgctat

SEQ ID NO: 1931755 - DNA, 15 bp, Homo sapiens
ctgcacctcattcca

SEQ ID NO: 1931756 - DNA, 17 bp, Homo sapiens
ctgcagaacagcttcat

SEQ ID NO: 1931757 - DNA, 17 bp, Homo sapiens
ctgcagagacagagagg

SEQ ID NO: 1931758 - DNA, 17 bp, Homo sapiens
ctgcagctttgaggctg

SEQ ID NO: 1931759 - DNA, 22 bp, Homo sapiens
ctgcagggaaaattatttgcat

SEQ ID NO: 1931760 - DNA, 14 bp, Homo sapiens
ctgcagggcagcct

SEQ ID NO: 1931761 - DNA, 15 bp, Homo sapiens
ctgcagggcagcctg

SEQ ID NO: 1931762 - DNA, 16 bp, Homo sapiens
ctgcagggcagcctgt

SEQ ID NO: 1931763 - DNA, 18 bp, Homo sapiens
ctgcagtcacccctgtct

SEQ ID NO: 1931764 - DNA, 18 bp, Homo sapiens
ctgcagtcctcggcagct

SEQ ID NO: 1931765 - DNA, 19 bp, Homo sapiens
ctgcagtcctcggcagctc

SEQ ID NO: 1931766 - DNA, 21 bp, Homo sapiens
ctgcagtcctcggcagctccg

SEQ ID NO: 1931767 - DNA, 17 bp, Homo sapiens
ctgcagttgtgaaagca

SEQ ID NO: 1931768 - DNA, 21 bp, Homo sapiens
ctgcatcccttggcccctctc

SEQ ID NO: 1931769 - DNA, 13 bp, Homo sapiens
ctgccacacttca

SEQ ID NO: 1931770 - DNA, 22 bp, Homo sapiens
ctgccacacttcaggctcttct

SEQ ID NO: 1931771 - DNA, 19 bp, Homo sapiens
ctgccaggctgcagggaca

SEQ ID NO: 1931772 - DNA, 23 bp, Homo sapiens
ctgccagggggtttgaggaccct

SEQ ID NO: 1931773 - DNA, 20 bp, Homo sapiens
ctgccatgattttggccact

SEQ ID NO: 1931774 - DNA, 20 bp, Homo sapiens
ctgccatggaggcacacagc

SEQ ID NO: 1931775 - DNA, 13 bp, Homo sapiens
ctgcccacctgcc

SEQ ID NO: 1931776 - DNA, 16 bp, Homo sapiens
ctgcccacctgccagg

SEQ ID NO: 1931777 - DNA, 18 bp, Homo sapiens
ctgcccacctgccaggct

SEQ ID NO: 1931778 - DNA, 17 bp, Homo sapiens
ctgcccacgtcccgggc

SEQ ID NO: 1931779 - DNA, 18 bp, Homo sapiens
ctgcccacgtcccgggca

SEQ ID NO: 1931780 - DNA, 22 bp, Homo sapiens
ctgcccacgtcccgggcactgt

SEQ ID NO: 1931781 - DNA, 13 bp, Homo sapiens
ctgcccccagctg

SEQ ID NO: 1931782 - DNA, 16 bp, Homo sapiens
ctgcccccagctgctc

SEQ ID NO: 1931783 - DNA, 24 bp, Homo sapiens
ctgcccccagctgctcctcgcagt

SEQ ID NO: 1931784 - DNA, 12 bp, Homo sapiens
ctgccccccttc

SEQ ID NO: 1931785 - DNA, 15 bp, Homo sapiens
ctgccccccttccca

SEQ ID NO: 1931786 - DNA, 22 bp, Homo sapiens
ctgccccccttcccacccctat

SEQ ID NO: 1931787 - DNA, 13 bp, Homo sapiens
ctgcccctccctt

SEQ ID NO: 1931788 - DNA, 18 bp, Homo sapiens
ctgccctcactccactcc

SEQ ID NO: 1931789 - DNA, 20 bp, Homo sapiens
ctgccctcactccactcccc

SEQ ID NO: 1931790 - DNA, 16 bp, Homo sapiens
ctgccctggtgctgcc

SEQ ID NO: 1931791 - DNA, 17 bp, Homo sapiens
ctgccctggtgctgcca

SEQ ID NO: 1931792 - DNA, 14 bp, Homo sapiens
ctgccgtgagagcc

SEQ ID NO: 1931793 - DNA, 22 bp, Homo sapiens
ctgccgtgagagcccaatcact

SEQ ID NO: 1931794 - DNA, 16 bp, Homo sapiens
ctgcctcttctgggag

SEQ ID NO: 1931795 - DNA, 23 bp, Homo sapiens
ctgcctgacatttggagtgttcc

SEQ ID NO: 1931796 - DNA, 16 bp, Homo sapiens
ctgcctgcctcatgct

SEQ ID NO: 1931797 - DNA, 13 bp, Homo sapiens
ctgccttcctcct

SEQ ID NO: 1931798 - DNA, 15 bp, Homo sapiens
ctgccttcctcctgg

SEQ ID NO: 1931799 - DNA, 13 bp, Homo sapiens
ctgccttctcttc

SEQ ID NO: 1931800 - DNA, 14 bp, Homo sapiens
ctgccttctcttct

SEQ ID NO: 1931801 - DNA, 16 bp, Homo sapiens
ctgccttctcttctat

SEQ ID NO: 1931802 - DNA, 15 bp, Homo sapiens
ctgcgccctccctcc

SEQ ID NO: 1931803 - DNA, 21 bp, Homo sapiens
ctgcgccctccctccctccac

SEQ ID NO: 1931804 - DNA, 21 bp, Homo sapiens
ctgcggaacaggagtgactct

SEQ ID NO: 1931805 - DNA, 14 bp, Homo sapiens
ctgcgtctcctgcc

SEQ ID NO: 1931806 - DNA, 19 bp, Homo sapiens
ctgcgtgtcacctgtgctt

SEQ ID NO: 1931807 - DNA, 15 bp, Homo sapiens
ctgctcacattccct

SEQ ID NO: 1931808 - DNA, 21 bp, Homo sapiens
ctgctcacattccctctcatc

SEQ ID NO: 1931809 - DNA, 17 bp, Homo sapiens
ctgctccacagaaaccc

SEQ ID NO: 1931810 - DNA, 12 bp, Homo sapiens
ctgctcctcgca

SEQ ID NO: 1931811 - DNA, 15 bp, Homo sapiens
ctgctctcccaggtg

SEQ ID NO: 1931812 - DNA, 17 bp, Homo sapiens
ctgctgccatgattttg

SEQ ID NO: 1931813 - DNA, 12 bp, Homo sapiens
ctgctggctgcc

SEQ ID NO: 1931814 - DNA, 14 bp, Homo sapiens
ctgctgtcagacct

SEQ ID NO: 1931815 - DNA, 20 bp, Homo sapiens
ctgctgtcagaccttcttcc

SEQ ID NO: 1931816 - DNA, 20 bp, Homo sapiens
ctgctgtccctcctgaggtc

SEQ ID NO: 1931817 - DNA, 20 bp, Homo sapiens
ctgcttctgtgcatttgtgt

SEQ ID NO: 1931818 - DNA, 12 bp, Homo sapiens
ctgcttgaggaa

SEQ ID NO: 1931819 - DNA, 16 bp, Homo sapiens
ctgcttgaggaaaaca

SEQ ID NO: 1931820 - DNA, 16 bp, Homo sapiens
ctgctttgggctgccc

SEQ ID NO: 1931821 - DNA, 18 bp, Homo sapiens
ctgctttgggctgccctg

SEQ ID NO: 1931822 - DNA, 20 bp, Homo sapiens
ctgctttgggctgccctggt

SEQ ID NO: 1931823 - DNA, 21 bp, Homo sapiens
ctgctttgggctgccctggtg

SEQ ID NO: 1931824 - DNA, 21 bp, Homo sapiens
cttaaggatggagccagctct

SEQ ID NO: 1931825 - DNA, 21 bp, Homo sapiens
cttacaaataaatccaagact

SEQ ID NO: 1931826 - DNA, 17 bp, Homo sapiens
cttacaatgtgcactga

SEQ ID NO: 1931827 - DNA, 21 bp, Homo sapiens
cttacattagcagtttgcttt

SEQ ID NO: 1931828 - DNA, 22 bp, Homo sapiens
cttacattagcagtttgctttg

SEQ ID NO: 1931829 - DNA, 22 bp, Homo sapiens
cttacccacttccctgcaaggt

SEQ ID NO: 1931830 - DNA, 19 bp, Homo sapiens
cttacctgggcattcttgt

SEQ ID NO: 1931831 - DNA, 20 bp, Homo sapiens
cttactacatgtgggagctt

SEQ ID NO: 1931832 - DNA, 14 bp, Homo sapiens
cttagacccagtca

SEQ ID NO: 1931833 - DNA, 14 bp, Homo sapiens
cttagatgttctaa

SEQ ID NO: 1931834 - DNA, 18 bp, Homo sapiens
cttagatgttctaagtct

SEQ ID NO: 1931835 - DNA, 19 bp, Homo sapiens
cttagggtacagcccaggc

SEQ ID NO: 1931836 - DNA, 20 bp, Homo sapiens
cttagggtacagcccaggcg

SEQ ID NO: 1931837 - DNA, 14 bp, Homo sapiens
cttagggtctgtcc

SEQ ID NO: 1931838 - DNA, 15 bp, Homo sapiens
cttataagcaacatg

SEQ ID NO: 1931839 - DNA, 20 bp, Homo sapiens
cttattagagtgtctttcca

SEQ ID NO: 1931840 - DNA, 16 bp, Homo sapiens
cttattgggagtagga

SEQ ID NO: 1931841 - DNA, 21 bp, Homo sapiens
cttcagactctctcctctctc

SEQ ID NO: 1931842 - DNA, 17 bp, Homo sapiens
cttcagctttggatgtg

SEQ ID NO: 1931843 - DNA, 14 bp, Homo sapiens
cttcaggctcttct

SEQ ID NO: 1931844 - DNA, 16 bp, Homo sapiens
cttcaggctcttctcc

SEQ ID NO: 1931845 - DNA, 15 bp, Homo sapiens
cttcataacaatttt

SEQ ID NO: 1931846 - DNA, 16 bp, Homo sapiens
cttcatcgcagtggac

SEQ ID NO: 1931847 - DNA, 18 bp, Homo sapiens
cttcatcgcagtggactg

SEQ ID NO: 1931848 - DNA, 20 bp, Homo sapiens
cttcattttctaattctctt

SEQ ID NO: 1931849 - DNA, 13 bp, Homo sapiens
cttcatttttcct

SEQ ID NO: 1931850 - DNA, 20 bp, Homo sapiens
cttccaaatcccctaagcag

SEQ ID NO: 1931851 - DNA, 14 bp, Homo sapiens
cttccacagcaaat

SEQ ID NO: 1931852 - DNA, 23 bp, Homo sapiens
cttccatcagcagtgattgaagt

SEQ ID NO: 1931853 - DNA, 19 bp, Homo sapiens
cttcccacggccactgcag

SEQ ID NO: 1931854 - DNA, 10 bp, Homo sapiens
cttccccact

SEQ ID NO: 1931855 - DNA, 13 bp, Homo sapiens
cttccccactccc

SEQ ID NO: 1931856 - DNA, 15 bp, Homo sapiens
cttcccccttcccct

SEQ ID NO: 1931857 - DNA, 15 bp, Homo sapiens
cttcccctgcgccct

SEQ ID NO: 1931858 - DNA, 19 bp, Homo sapiens
cttcccctgcgccctccct

SEQ ID NO: 1931859 - DNA, 20 bp, Homo sapiens
cttcccctgcgccctccctc

SEQ ID NO: 1931860 - DNA, 22 bp, Homo sapiens
cttcccctgcgccctccctccc

SEQ ID NO: 1931861 - DNA, 18 bp, Homo sapiens
cttcccgctcagccctcc

SEQ ID NO: 1931862 - DNA, 22 bp, Homo sapiens
cttccctagatggttccctttg

SEQ ID NO: 1931863 - DNA, 15 bp, Homo sapiens
cttccctctgctcca

SEQ ID NO: 1931864 - DNA, 20 bp, Homo sapiens
cttccctgactcattctgaa

SEQ ID NO: 1931865 - DNA, 22 bp, Homo sapiens
cttccctttgattttttgctgc

SEQ ID NO: 1931866 - DNA, 17 bp, Homo sapiens
cttcctccctccctgca

SEQ ID NO: 1931867 - DNA, 18 bp, Homo sapiens
cttcctccctccctgcag

SEQ ID NO: 1931868 - DNA, 13 bp, Homo sapiens
cttcctcctcctc

SEQ ID NO: 1931869 - DNA, 22 bp, Homo sapiens
cttcctcctgggccctctctgc

SEQ ID NO: 1931870 - DNA, 13 bp, Homo sapiens
cttcctctccact

SEQ ID NO: 1931871 - DNA, 14 bp, Homo sapiens
cttcctctccactg

SEQ ID NO: 1931872 - DNA, 16 bp, Homo sapiens
cttcctctccactgcc

SEQ ID NO: 1931873 - DNA, 18 bp, Homo sapiens
cttcctctcggctggaag

SEQ ID NO: 1931874 - DNA, 23 bp, Homo sapiens
cttcctctcggctggaagaacat

SEQ ID NO: 1931875 - DNA, 17 bp, Homo sapiens
cttcctggacagtgaga

SEQ ID NO: 1931876 - DNA, 14 bp, Homo sapiens
cttcctggagactg

SEQ ID NO: 1931877 - DNA, 21 bp, Homo sapiens
cttcgatacaccgggcctgga

SEQ ID NO: 1931878 - DNA, 17 bp, Homo sapiens
cttcgggcccttcccac

SEQ ID NO: 1931879 - DNA, 13 bp, Homo sapiens
cttctacttttaa

SEQ ID NO: 1931880 - DNA, 21 bp, Homo sapiens
cttctagacactgaaggcaaa

SEQ ID NO: 1931881 - DNA, 14 bp, Homo sapiens
cttctccactggat

SEQ ID NO: 1931882 - DNA, 17 bp, Homo sapiens
cttctccactggatgga

SEQ ID NO: 1931883 - DNA, 23 bp, Homo sapiens
cttctccagacaaaccagaagca

SEQ ID NO: 1931884 - DNA, 19 bp, Homo sapiens
cttctcccctccagacccc

SEQ ID NO: 1931885 - DNA, 17 bp, Homo sapiens
cttctcctttcacaacc

SEQ ID NO: 1931886 - DNA, 15 bp, Homo sapiens
cttctctctttgtcc

SEQ ID NO: 1931887 - DNA, 15 bp, Homo sapiens
cttctcttctatcct

SEQ ID NO: 1931888 - DNA, 19 bp, Homo sapiens
cttctgggacttgaaatca

SEQ ID NO: 1931889 - DNA, 20 bp, Homo sapiens
cttcttaatataactgcctt

SEQ ID NO: 1931890 - DNA, 14 bp, Homo sapiens
cttctttcatgtaa

SEQ ID NO: 1931891 - DNA, 17 bp, Homo sapiens
cttctttcatgtaagta

SEQ ID NO: 1931892 - DNA, 21 bp, Homo sapiens
cttgaattgtaactgttcttg

SEQ ID NO: 1931893 - DNA, 22 bp, Homo sapiens
cttgaattgtaactgttcttga

SEQ ID NO: 1931894 - DNA, 22 bp, Homo sapiens
cttgacgcgtggtcacaggacg

SEQ ID NO: 1931895 - DNA, 17 bp, Homo sapiens
cttgagactgttttgaa

SEQ ID NO: 1931896 - DNA, 18 bp, Homo sapiens
cttgagagcgctggcctc

SEQ ID NO: 1931897 - DNA, 21 bp, Homo sapiens
cttgagcaaggcaagaagtgg

SEQ ID NO: 1931898 - DNA, 13 bp, Homo sapiens
cttgagccagtaa

SEQ ID NO: 1931899 - DNA, 16 bp, Homo sapiens
cttgagtgggccccct

SEQ ID NO: 1931900 - DNA, 18 bp, Homo sapiens
cttgagtgggccccctct

SEQ ID NO: 1931901 - DNA, 13 bp, Homo sapiens
cttgattctaaag

SEQ ID NO: 1931902 - DNA, 16 bp, Homo sapiens
cttgattctaaagggg

SEQ ID NO: 1931903 - DNA, 15 bp, Homo sapiens
cttgcatttctttat

SEQ ID NO: 1931904 - DNA, 16 bp, Homo sapiens
cttgcatttctttatt

SEQ ID NO: 1931905 - DNA, 13 bp, Homo sapiens
cttgccgctggga

SEQ ID NO: 1931906 - DNA, 15 bp, Homo sapiens
cttgccgctgggaga

SEQ ID NO: 1931907 - DNA, 18 bp, Homo sapiens
cttggaacatttgggaga

SEQ ID NO: 1931908 - DNA, 13 bp, Homo sapiens
cttggagaggagg

SEQ ID NO: 1931909 - DNA, 20 bp, Homo sapiens
cttggagcgtttttgctggc

SEQ ID NO: 1931910 - DNA, 13 bp, Homo sapiens
cttggaggcaacc

SEQ ID NO: 1931911 - DNA, 20 bp, Homo sapiens
cttggagtgccacatggccg

SEQ ID NO: 1931912 - DNA, 20 bp, Homo sapiens
cttggagtgccacgtggccg

SEQ ID NO: 1931913 - DNA, 20 bp, Homo sapiens
cttggccaccaggactcctt

SEQ ID NO: 1931914 - DNA, 14 bp, Homo sapiens
cttggcccctctct

SEQ ID NO: 1931915 - DNA, 16 bp, Homo sapiens
cttggggtagagagga

SEQ ID NO: 1931916 - DNA, 19 bp, Homo sapiens
cttggggtagagaggacag

SEQ ID NO: 1931917 - DNA, 15 bp, Homo sapiens
cttggtgaggaggag

SEQ ID NO: 1931918 - DNA, 19 bp, Homo sapiens
cttggtgaggaggaggcag

SEQ ID NO: 1931919 - DNA, 15 bp, Homo sapiens
cttggttcctccagc

SEQ ID NO: 1931920 - DNA, 16 bp, Homo sapiens
cttggttcctccagca

SEQ ID NO: 1931921 - DNA, 22 bp, Homo sapiens
cttggttcctccagcaatgcct

SEQ ID NO: 1931922 - DNA, 16 bp, Homo sapiens
cttggttgaggaaaca

SEQ ID NO: 1931923 - DNA, 15 bp, Homo sapiens
cttgtccacattcta

SEQ ID NO: 1931924 - DNA, 15 bp, Homo sapiens
cttgtgcagtgttga

SEQ ID NO: 1931925 - DNA, 14 bp, Homo sapiens
cttgtgtctgttgc

SEQ ID NO: 1931926 - DNA, 22 bp, Homo sapiens
cttgtgttactaatttgtataa

SEQ ID NO: 1931927 - DNA, 18 bp, Homo sapiens
cttgttacggcagtcaca

SEQ ID NO: 1931928 - DNA, 12 bp, Homo sapiens
cttgtttcaatt

SEQ ID NO: 1931929 - DNA, 22 bp, Homo sapiens
cttgtttcaattccacctgcaa

SEQ ID NO: 1931930 - DNA, 19 bp, Homo sapiens
cttgttttttttttccact

SEQ ID NO: 1931931 - DNA, 14 bp, Homo sapiens
ctttaaataaaaat

SEQ ID NO: 1931932 - DNA, 20 bp, Homo sapiens
ctttaaataaaaataagtca

SEQ ID NO: 1931933 - DNA, 15 bp, Homo sapiens
ctttaacagtaatgt

SEQ ID NO: 1931934 - DNA, 17 bp, Homo sapiens
ctttaagcgaggcagaa

SEQ ID NO: 1931935 - DNA, 20 bp, Homo sapiens
ctttaagcgaggcagaatgg

SEQ ID NO: 1931936 - DNA, 18 bp, Homo sapiens
ctttacattttgtgcagt

SEQ ID NO: 1931937 - DNA, 19 bp, Homo sapiens
ctttacattttgtgcagtg

SEQ ID NO: 1931938 - DNA, 15 bp, Homo sapiens
ctttatattttctat

SEQ ID NO: 1931939 - DNA, 22 bp, Homo sapiens
ctttctgacaataaataatatt

SEQ ID NO: 1931940 - DNA, 21 bp, Homo sapiens
ctttgaaatatgcatgtactt

SEQ ID NO: 1931941 - DNA, 22 bp, Homo sapiens
ctttgacctcaatggaggtttg

SEQ ID NO: 1931942 - DNA, 21 bp, Homo sapiens
ctttgactcttttgccattaa

SEQ ID NO: 1931943 - DNA, 18 bp, Homo sapiens
ctttgcagacctgggact

SEQ ID NO: 1931944 - DNA, 19 bp, Homo sapiens
ctttgcagacctgggactt

SEQ ID NO: 1931945 - DNA, 20 bp, Homo sapiens
ctttgcagacctgggacttt

SEQ ID NO: 1931946 - DNA, 21 bp, Homo sapiens
ctttgcagacctgggacttta

SEQ ID NO: 1931947 - DNA, 16 bp, Homo sapiens
ctttgcatgttcttgt

SEQ ID NO: 1931948 - DNA, 13 bp, Homo sapiens
ctttgctgtttat

SEQ ID NO: 1931949 - DNA, 19 bp, Homo sapiens
ctttgggctgccctggtgc

SEQ ID NO: 1931950 - DNA, 21 bp, Homo sapiens
ctttgggtagtgccatggcca

SEQ ID NO: 1931951 - DNA, 21 bp, Homo sapiens
ctttgtaaaccggctggacca

SEQ ID NO: 1931952 - DNA, 14 bp, Homo sapiens
ctttgtaaggactt

SEQ ID NO: 1931953 - DNA, 13 bp, Homo sapiens
ctttgtgtgctgt

SEQ ID NO: 1931954 - DNA, 16 bp, Homo sapiens
ctttgtttttttttcc

SEQ ID NO: 1931955 - DNA, 21 bp, Homo sapiens
ctttgtttttttttcctgtcc

SEQ ID NO: 1931956 - DNA, 16 bp, Homo sapiens
cttttaatgatactgt

SEQ ID NO: 1931957 - DNA, 16 bp, Homo sapiens
cttttcaaacacacac

SEQ ID NO: 1931958 - DNA, 17 bp, Homo sapiens
cttttcaaacacacaca

SEQ ID NO: 1931959 - DNA, 22 bp, Homo sapiens
cttttcaggaggtactgtgagg

SEQ ID NO: 1931960 - DNA, 16 bp, Homo sapiens
cttttcgccgtggctg

SEQ ID NO: 1931961 - DNA, 18 bp, Homo sapiens
cttttctggaatgtaatc

SEQ ID NO: 1931962 - DNA, 16 bp, Homo sapiens
cttttgaatcaaagaa

SEQ ID NO: 1931963 - DNA, 15 bp, Homo sapiens
cttttggatttagag

SEQ ID NO: 1931964 - DNA, 14 bp, Homo sapiens
cttttgtaaatatt

SEQ ID NO: 1931965 - DNA, 15 bp, Homo sapiens
cttttgtaaatattc

SEQ ID NO: 1931966 - DNA, 16 bp, Homo sapiens
cttttgtaaatattct

SEQ ID NO: 1931967 - DNA, 11 bp, Homo sapiens
ctttttcaatg

SEQ ID NO: 1931968 - DNA, 18 bp, Homo sapiens
ctttttcttcctctcggc

SEQ ID NO: 1931969 - DNA, 13 bp, Homo sapiens
ctttttgctttcg

SEQ ID NO: 1931970 - DNA, 15 bp, Homo sapiens
gaaaaagaaattctg

SEQ ID NO: 1931971 - DNA, 18 bp, Homo sapiens
gaaaaccaagccgtggct

SEQ ID NO: 1931972 - DNA, 15 bp, Homo sapiens
gaaaatatttctatg

SEQ ID NO: 1931973 - DNA, 16 bp, Homo sapiens
gaaaatatttctatgt

SEQ ID NO: 1931974 - DNA, 21 bp, Homo sapiens
gaaaatatttctatgtaaatt

SEQ ID NO: 1931975 - DNA, 23 bp, Homo sapiens
gaaaatgctgtattagtcacaga

SEQ ID NO: 1931976 - DNA, 14 bp, Homo sapiens
gaaaatgtcttgtg

SEQ ID NO: 1931977 - DNA, 15 bp, Homo sapiens
gaaaattatttgcat

SEQ ID NO: 1931978 - DNA, 17 bp, Homo sapiens
gaaacaactctttgaga

SEQ ID NO: 1931979 - DNA, 20 bp, Homo sapiens
gaaagaaattgtttttctga

SEQ ID NO: 1931980 - DNA, 19 bp, Homo sapiens
gaaagctgcttctggggga

SEQ ID NO: 1931981 - DNA, 23 bp, Homo sapiens
gaaagctgcttctgggggatttc

SEQ ID NO: 1931982 - DNA, 14 bp, Homo sapiens
gaaaggatgcttct

SEQ ID NO: 1931983 - DNA, 20 bp, Homo sapiens
gaaaggcagagattgggggg

SEQ ID NO: 1931984 - DNA, 18 bp, Homo sapiens
gaaagggcagcccctccc

SEQ ID NO: 1931985 - DNA, 20 bp, Homo sapiens
gaaagggcagcccctcccca

SEQ ID NO: 1931986 - DNA, 18 bp, Homo sapiens
gaaagggtgtggcttgga

SEQ ID NO: 1931987 - DNA, 16 bp, Homo sapiens
gaacaccctatatttt

SEQ ID NO: 1931988 - DNA, 13 bp, Homo sapiens
gaacagaaatacc

SEQ ID NO: 1931989 - DNA, 19 bp, Homo sapiens
gaacaggagtgactctggc

SEQ ID NO: 1931990 - DNA, 22 bp, Homo sapiens
gaacaggagtgactctggctgc

SEQ ID NO: 1931991 - DNA, 15 bp, Homo sapiens
gaacatcaagatacc

SEQ ID NO: 1931992 - DNA, 19 bp, Homo sapiens
gaacattattaaatcagaa

SEQ ID NO: 1931993 - DNA, 18 bp, Homo sapiens
gaacatttgggagactga

SEQ ID NO: 1931994 - DNA, 20 bp, Homo sapiens
gaaccaggaggcctgggaga

SEQ ID NO: 1931995 - DNA, 15 bp, Homo sapiens
gaacccccctcccca

SEQ ID NO: 1931996 - DNA, 16 bp, Homo sapiens
gaactcaactttgaca

SEQ ID NO: 1931997 - DNA, 16 bp, Homo sapiens
gaactcctaaatcaag

SEQ ID NO: 1931998 - DNA, 12 bp, Homo sapiens
gaactctcagga

SEQ ID NO: 1931999 - DNA, 14 bp, Homo sapiens
gaactgcttgcatt

SEQ ID NO: 1932000 - DNA, 16 bp, Homo sapiens
gaactgcttgcatttc

SEQ ID NO: 1932001 - DNA, 12 bp, Homo sapiens
gaactggcccca

SEQ ID NO: 1932002 - DNA, 13 bp, Homo sapiens
gaactggccccag

SEQ ID NO: 1932003 - DNA, 16 bp, Homo sapiens
gaactggccccagctc

SEQ ID NO: 1932004 - DNA, 21 bp, Homo sapiens
gaagaattacaatttctttaa

SEQ ID NO: 1932005 - DNA, 22 bp, Homo sapiens
gaagacatggggaggaaggaca

SEQ ID NO: 1932006 - DNA, 19 bp, Homo sapiens
gaagagggagaaggagagg

SEQ ID NO: 1932007 - DNA, 14 bp, Homo sapiens
gaagattctttccc

SEQ ID NO: 1932008 - DNA, 15 bp, Homo sapiens
gaagcacaagaagtg

SEQ ID NO: 1932009 - DNA, 17 bp, Homo sapiens
gaagcacaagaagtggg

SEQ ID NO: 1932010 - DNA, 21 bp, Homo sapiens
gaagcacaagaagtgggagtg

SEQ ID NO: 1932011 - DNA, 13 bp, Homo sapiens
gaagcaccccacc

SEQ ID NO: 1932012 - DNA, 16 bp, Homo sapiens
gaagcaccccaccaca

SEQ ID NO: 1932013 - DNA, 16 bp, Homo sapiens
gaaggacaaggctaga

SEQ ID NO: 1932014 - DNA, 15 bp, Homo sapiens
gaaggcaaagcacga

SEQ ID NO: 1932015 - DNA, 17 bp, Homo sapiens
gaaggcctgcccccctt

SEQ ID NO: 1932016 - DNA, 16 bp, Homo sapiens
gaaggcttctctctgt

SEQ ID NO: 1932017 - DNA, 16 bp, Homo sapiens
gaagggggatgcaggc

SEQ ID NO: 1932018 - DNA, 18 bp, Homo sapiens
gaagtcttccatcagcag

SEQ ID NO: 1932019 - DNA, 20 bp, Homo sapiens
gaagtcttccatcagcagtg

SEQ ID NO: 1932020 - DNA, 17 bp, Homo sapiens
gaagtgggagtgggaga

SEQ ID NO: 1932021 - DNA, 21 bp, Homo sapiens
gaagtgggattcaggaatggg

SEQ ID NO: 1932022 - DNA, 12 bp, Homo sapiens
gaagttgttagt

SEQ ID NO: 1932023 - DNA, 21 bp, Homo sapiens
gaatataccccttagtgtttg

SEQ ID NO: 1932024 - DNA, 22 bp, Homo sapiens
gaatatgaacggtgagcattgt

SEQ ID NO: 1932025 - DNA, 18 bp, Homo sapiens
gaatatgattagtaaaga

SEQ ID NO: 1932026 - DNA, 19 bp, Homo sapiens
gaatatgattagtaaagaa

SEQ ID NO: 1932027 - DNA, 13 bp, Homo sapiens
gaatattgtccat

SEQ ID NO: 1932028 - DNA, 14 bp, Homo sapiens
gaatccaaagtgga

SEQ ID NO: 1932029 - DNA, 21 bp, Homo sapiens
gaatcggtgctgtcagccctg

SEQ ID NO: 1932030 - DNA, 16 bp, Homo sapiens
gaatcgtttcatgtaa

SEQ ID NO: 1932031 - DNA, 16 bp, Homo sapiens
gaatgagagagtgtgg

SEQ ID NO: 1932032 - DNA, 12 bp, Homo sapiens
gaatgagctggg

SEQ ID NO: 1932033 - DNA, 18 bp, Homo sapiens
gaatgcttctgacttcat

SEQ ID NO: 1932034 - DNA, 17 bp, Homo sapiens
gaatggggcttccatgg

SEQ ID NO: 1932035 - DNA, 19 bp, Homo sapiens
gaatggggtgggagccaca

SEQ ID NO: 1932036 - DNA, 17 bp, Homo sapiens
gaatggtaaccgagcca

SEQ ID NO: 1932037 - DNA, 20 bp, Homo sapiens
gaatggtaaccgagccagca

SEQ ID NO: 1932038 - DNA, 16 bp, Homo sapiens
gaatggtgcccttgga

SEQ ID NO: 1932039 - DNA, 20 bp, Homo sapiens
gaatggtgcccttggaggca

SEQ ID NO: 1932040 - DNA, 16 bp, Homo sapiens
gagccccctgtccttc

SEQ ID NO: 1932041 - DNA, 22 bp, Homo sapiens
gagcccctatcctgcaccctct

SEQ ID NO: 1932042 - DNA, 13 bp, Homo sapiens
gagccctgccctc

SEQ ID NO: 1932043 - DNA, 14 bp, Homo sapiens
gagccgcaggggcc

SEQ ID NO: 1932044 - DNA, 17 bp, Homo sapiens
gagccgggtctgcctct

SEQ ID NO: 1932045 - DNA, 15 bp, Homo sapiens
gagccgtggccgagg

SEQ ID NO: 1932046 - DNA, 13 bp, Homo sapiens
gagccgtggtcct

SEQ ID NO: 1932047 - DNA, 15 bp, Homo sapiens
gagcctgagggatct

SEQ ID NO: 1932048 - DNA, 21 bp, Homo sapiens
gagcgaggagatgctccttgg

SEQ ID NO: 1932049 - DNA, 17 bp, Homo sapiens
gagcgctggcctcttcc

SEQ ID NO: 1932050 - DNA, 19 bp, Homo sapiens
gagcggccgcctgtccttg

SEQ ID NO: 1932051 - DNA, 13 bp, Homo sapiens
gagctcaggagaa

SEQ ID NO: 1932052 - DNA, 18 bp, Homo sapiens
gagctcaggagaaggcct

SEQ ID NO: 1932053 - DNA, 16 bp, Homo sapiens
gagctgaggcagcagt

SEQ ID NO: 1932054 - DNA, 22 bp, Homo sapiens
gagctggaaaggatgcttctgc

SEQ ID NO: 1932055 - DNA, 18 bp, Homo sapiens
gagcttgattctaaaggg

SEQ ID NO: 1932056 - DNA, 20 bp, Homo sapiens
gaggaaaaccaagccgtggc

SEQ ID NO: 1932057 - DNA, 16 bp, Homo sapiens
gaggaagccacgtgct

SEQ ID NO: 1932058 - DNA, 15 bp, Homo sapiens
gaggaccctcccagg

SEQ ID NO: 1932059 - DNA, 16 bp, Homo sapiens
gaggaccctcccaggt

SEQ ID NO: 1932060 - DNA, 16 bp, Homo sapiens
gaggacgtgggcggca

SEQ ID NO: 1932061 - DNA, 18 bp, Homo sapiens
gaggacgtgggcggcaga

SEQ ID NO: 1932062 - DNA, 20 bp, Homo sapiens
gaggacgtgggcggcagaga

SEQ ID NO: 1932063 - DNA, 22 bp, Homo sapiens
gaggacgtgggcggcagagagg

SEQ ID NO: 1932064 - DNA, 23 bp, Homo sapiens
gaggactgttgacatccaagctt

SEQ ID NO: 1932065 - DNA, 22 bp, Homo sapiens
gaggagactagatttatgaata

SEQ ID NO: 1932066 - DNA, 19 bp, Homo sapiens
gaggagagaatgagagagt

SEQ ID NO: 1932067 - DNA, 17 bp, Homo sapiens
gaggagatgctccttgg

SEQ ID NO: 1932068 - DNA, 16 bp, Homo sapiens
gaggaggtgtggagtg

SEQ ID NO: 1932069 - DNA, 19 bp, Homo sapiens
gaggaggtgtggagtggag

SEQ ID NO: 1932070 - DNA, 20 bp, Homo sapiens
gaggaggtgtggagtggagg

SEQ ID NO: 1932071 - DNA, 16 bp, Homo sapiens
gaggattctatgaggc

SEQ ID NO: 1932072 - DNA, 20 bp, Homo sapiens
gaggcacacagctgcagaga

SEQ ID NO: 1932073 - DNA, 13 bp, Homo sapiens
gaggcagcagtgt

SEQ ID NO: 1932074 - DNA, 19 bp, Homo sapiens
gaggcaggggctgggcaga

SEQ ID NO: 1932075 - DNA, 16 bp, Homo sapiens
gaggcaggtcccgagc

SEQ ID NO: 1932076 - DNA, 22 bp, Homo sapiens
gaggcaggtcccgagccccctg

SEQ ID NO: 1932077 - DNA, 10 bp, Homo sapiens
gaggccacgg

SEQ ID NO: 1932078 - DNA, 16 bp, Homo sapiens
gaggccacgggggagg

SEQ ID NO: 1932079 - DNA, 19 bp, Homo sapiens
gaggccagggcagagtgag

SEQ ID NO: 1932080 - DNA, 17 bp, Homo sapiens
gaggccctcgctgccag

SEQ ID NO: 1932081 - DNA, 13 bp, Homo sapiens
gaggccgaggcag

SEQ ID NO: 1932082 - DNA, 15 bp, Homo sapiens
gaggccgaggcaggg

SEQ ID NO: 1932083 - DNA, 13 bp, Homo sapiens
gaggcctgggaga

SEQ ID NO: 1932084 - DNA, 17 bp, Homo sapiens
gaggcctgggagatgca

SEQ ID NO: 1932085 - DNA, 13 bp, Homo sapiens
gaggcctggtctg

SEQ ID NO: 1932086 - DNA, 17 bp, Homo sapiens
gaggcggtatccacctg

SEQ ID NO: 1932087 - DNA, 21 bp, Homo sapiens
gaggcgtgggatccagagaga

SEQ ID NO: 1932088 - DNA, 14 bp, Homo sapiens
gaggctccagaggg

SEQ ID NO: 1932089 - DNA, 17 bp, Homo sapiens
gaggctggcggggtctg

SEQ ID NO: 1932090 - DNA, 15 bp, Homo sapiens
gagggagaaggagag

SEQ ID NO: 1932091 - DNA, 19 bp, Homo sapiens
gagggagaaggagaggctc

SEQ ID NO: 1932092 - DNA, 21 bp, Homo sapiens
gagggcaaaccaggctgcagg

SEQ ID NO: 1932093 - DNA, 12 bp, Homo sapiens
gagggcactggt

SEQ ID NO: 1932094 - DNA, 14 bp, Homo sapiens
gagggcagcagggc

SEQ ID NO: 1932095 - DNA, 16 bp, Homo sapiens
gagggcagcagggcta

SEQ ID NO: 1932096 - DNA, 19 bp, Homo sapiens
gagggcagcagggctaccc

SEQ ID NO: 1932097 - DNA, 13 bp, Homo sapiens
gagggcgcctggg

SEQ ID NO: 1932098 - DNA, 14 bp, Homo sapiens
gagggcgcctgggt

SEQ ID NO: 1932099 - DNA, 21 bp, Homo sapiens
gagggcgcctgggtcctccca

SEQ ID NO: 1932100 - DNA, 22 bp, Homo sapiens
gagggcgcctgggtcctcccag

SEQ ID NO: 1932101 - DNA, 13 bp, Homo sapiens
gaggggcctggcc

SEQ ID NO: 1932102 - DNA, 15 bp, Homo sapiens
gaggggcctggcctg

SEQ ID NO: 1932103 - DNA, 21 bp, Homo sapiens
gaggggcttccctctgctcca

SEQ ID NO: 1932104 - DNA, 16 bp, Homo sapiens
gaggggtcagcagggg

SEQ ID NO: 1932105 - DNA, 13 bp, Homo sapiens
gagggtcagagag

SEQ ID NO: 1932106 - DNA, 16 bp, Homo sapiens
gagggtcaggaaggat

SEQ ID NO: 1932107 - DNA, 21 bp, Homo sapiens
gaggtgggggtctggcctagt

SEQ ID NO: 1932108 - DNA, 18 bp, Homo sapiens
gaggtgtggagtggaggg

SEQ ID NO: 1932109 - DNA, 19 bp, Homo sapiens
gaggtgtggagtggagggg

SEQ ID NO: 1932110 - DNA, 15 bp, Homo sapiens
gagtaaaatcacaga

SEQ ID NO: 1932111 - DNA, 19 bp, Homo sapiens
gagtagaaactgcagggaa

SEQ ID NO: 1932112 - DNA, 15 bp, Homo sapiens
gagtagacctgagat

SEQ ID NO: 1932113 - DNA, 20 bp, Homo sapiens
gagtattcattttgcaactt

SEQ ID NO: 1932114 - DNA, 19 bp, Homo sapiens
gagtattctatgtaaaaat

SEQ ID NO: 1932115 - DNA, 14 bp, Homo sapiens
gagtctcttctcca

SEQ ID NO: 1932116 - DNA, 16 bp, Homo sapiens
gagtctcttctccact

SEQ ID NO: 1932117 - DNA, 17 bp, Homo sapiens
gagtctcttctccactg

SEQ ID NO: 1932118 - DNA, 18 bp, Homo sapiens
gagtctcttctccactgg

SEQ ID NO: 1932119 - DNA, 20 bp, Homo sapiens
gagtctgaaggagaggagtg

SEQ ID NO: 1932120 - DNA, 18 bp, Homo sapiens
gagtgactctggctgcca

SEQ ID NO: 1932121 - DNA, 16 bp, Homo sapiens
gagtgcaacagtagca

SEQ ID NO: 1932122 - DNA, 17 bp, Homo sapiens
gagtgcagtcctgatca

SEQ ID NO: 1932123 - DNA, 23 bp, Homo sapiens
gagtgccacatggccgctgccca

SEQ ID NO: 1932124 - DNA, 15 bp, Homo sapiens
gagtgccacgtggcc

SEQ ID NO: 1932125 - DNA, 14 bp, Homo sapiens
gagtgcgctagagc

SEQ ID NO: 1932126 - DNA, 14 bp, Homo sapiens
gagtggcccctggc

SEQ ID NO: 1932127 - DNA, 11 bp, Homo sapiens
gagtgggagag

SEQ ID NO: 1932128 - DNA, 15 bp, Homo sapiens
gagtgggagaggaag

SEQ ID NO: 1932129 - DNA, 19 bp, Homo sapiens
gagtgtctttccacggagc

SEQ ID NO: 1932130 - DNA, 23 bp, Homo sapiens
gagtgttcaaactactgtacatt

SEQ ID NO: 1932131 - DNA, 22 bp, Homo sapiens
gataaaaacaatatatgtaaat

SEQ ID NO: 1932132 - DNA, 22 bp, Homo sapiens
gataagagtagaaactgcaggg

SEQ ID NO: 1932133 - DNA, 12 bp, Homo sapiens
gataatatttaa

SEQ ID NO: 1932134 - DNA, 22 bp, Homo sapiens
gataccagcgaggaggctccag

SEQ ID NO: 1932135 - DNA, 17 bp, Homo sapiens
gataggagcttccagat

SEQ ID NO: 1932136 - DNA, 19 bp, Homo sapiens
gatattttcaacgcagccc

SEQ ID NO: 1932137 - DNA, 16 bp, Homo sapiens
gatcagaccataatgt

SEQ ID NO: 1932138 - DNA, 20 bp, Homo sapiens
gatccaccgccacactggcc

SEQ ID NO: 1932139 - DNA, 14 bp, Homo sapiens
gatccagagagaag

SEQ ID NO: 1932140 - DNA, 18 bp, Homo sapiens
gatccctcatctgtccct

SEQ ID NO: 1932141 - DNA, 23 bp, Homo sapiens
gatcctaatgaatgcataaaatg

SEQ ID NO: 1932142 - DNA, 17 bp, Homo sapiens
gatcggagcctcctctc

SEQ ID NO: 1932143 - DNA, 18 bp, Homo sapiens
gatcgtctgactggtgtt

SEQ ID NO: 1932144 - DNA, 18 bp, Homo sapiens
gatctaaaaggaggacag

SEQ ID NO: 1932145 - DNA, 20 bp, Homo sapiens
gatctaaaaggaggacaggg

SEQ ID NO: 1932146 - DNA, 19 bp, Homo sapiens
gatctgaacagaaatacca

SEQ ID NO: 1932147 - DNA, 21 bp, Homo sapiens
gatctgctgacagatgttcca

SEQ ID NO: 1932148 - DNA, 19 bp, Homo sapiens
gatctggagtctgaaggag

SEQ ID NO: 1932149 - DNA, 22 bp, Homo sapiens
gatcttgagcaaggcaagaagt

SEQ ID NO: 1932150 - DNA, 16 bp, Homo sapiens
gatgacccctccccta

SEQ ID NO: 1932151 - DNA, 19 bp, Homo sapiens
gatgagaaacaacagaaac

SEQ ID NO: 1932152 - DNA, 15 bp, Homo sapiens
gatgcctgacacagg

SEQ ID NO: 1932153 - DNA, 16 bp, Homo sapiens
gatgctccttgggccc

SEQ ID NO: 1932154 - DNA, 23 bp, Homo sapiens
gatgctggtcaagccccctttga

SEQ ID NO: 1932155 - DNA, 20 bp, Homo sapiens
gatgcttctgctcacattcc

SEQ ID NO: 1932156 - DNA, 14 bp, Homo sapiens
gatgggagtaagag

SEQ ID NO: 1932157 - DNA, 19 bp, Homo sapiens
gatgggatggtggagggcc

SEQ ID NO: 1932158 - DNA, 17 bp, Homo sapiens
gatggggagcagctggg

SEQ ID NO: 1932159 - DNA, 23 bp, Homo sapiens
gatgggtctggtttgcagagctt

SEQ ID NO: 1932160 - DNA, 11 bp, Homo sapiens
gatgggtgggc

SEQ ID NO: 1932161 - DNA, 14 bp, Homo sapiens
gatggtggagggcc

SEQ ID NO: 1932162 - DNA, 13 bp, Homo sapiens
gatggttcccctg

SEQ ID NO: 1932163 - DNA, 21 bp, Homo sapiens
gatggttcccctgttcactct

SEQ ID NO: 1932164 - DNA, 13 bp, Homo sapiens
gatgtatgcccaa

SEQ ID NO: 1932165 - DNA, 22 bp, Homo sapiens
gatgtcaaccttgtgtgagtgt

SEQ ID NO: 1932166 - DNA, 12 bp, Homo sapiens
gatgttaaaaca

SEQ ID NO: 1932167 - DNA, 17 bp, Homo sapiens
gattacctcctgagaaa

SEQ ID NO: 1932168 - DNA, 14 bp, Homo sapiens
gattattcagtgtc

SEQ ID NO: 1932169 - DNA, 15 bp, Homo sapiens
gattcaggaatgggc

SEQ ID NO: 1932170 - DNA, 20 bp, Homo sapiens
gattcagtgttaaatgtgat

SEQ ID NO: 1932171 - DNA, 22 bp, Homo sapiens
gattccagagagtggctcctcc

SEQ ID NO: 1932172 - DNA, 16 bp, Homo sapiens
gcccacccctcttccc

SEQ ID NO: 1932173 - DNA, 21 bp, Homo sapiens
gcccacccctcttcccccttc

SEQ ID NO: 1932174 - DNA, 22 bp, Homo sapiens
gcccacccctcttcccccttcc

SEQ ID NO: 1932175 - DNA, 16 bp, Homo sapiens
gcccacgtcctgggtg

SEQ ID NO: 1932176 - DNA, 23 bp, Homo sapiens
gcccacgtcctgggtgctgtcat

SEQ ID NO: 1932177 - DNA, 13 bp, Homo sapiens
gcccagctctgaa

SEQ ID NO: 1932178 - DNA, 16 bp, Homo sapiens
gcccaggaggacctgg

SEQ ID NO: 1932179 - DNA, 14 bp, Homo sapiens
gccccccttcccac

SEQ ID NO: 1932180 - DNA, 21 bp, Homo sapiens
gccccctctcttaccccgtcc

SEQ ID NO: 1932181 - DNA, 12 bp, Homo sapiens
gcccctcccttc

SEQ ID NO: 1932182 - DNA, 15 bp, Homo sapiens
gcccctcccttcaac

SEQ ID NO: 1932183 - DNA, 19 bp, Homo sapiens
gcccctcctccagagcctg

SEQ ID NO: 1932184 - DNA, 17 bp, Homo sapiens
gcccctccttctcccct

SEQ ID NO: 1932185 - DNA, 21 bp, Homo sapiens
gcccctccttctcccctccag

SEQ ID NO: 1932186 - DNA, 17 bp, Homo sapiens
gcccgacagcctggcac

SEQ ID NO: 1932187 - DNA, 18 bp, Homo sapiens
gcccggaagttgctgtgc

SEQ ID NO: 1932188 - DNA, 22 bp, Homo sapiens
gcccggagatgcatctgtggcc

SEQ ID NO: 1932189 - DNA, 14 bp, Homo sapiens
gcccgggagccgca

SEQ ID NO: 1932190 - DNA, 18 bp, Homo sapiens
gccctcactccactcccc

SEQ ID NO: 1932191 - DNA, 19 bp, Homo sapiens
gccctcactccactcccct

SEQ ID NO: 1932192 - DNA, 23 bp, Homo sapiens
gccctcaggtcagggtgaggatg

SEQ ID NO: 1932193 - DNA, 12 bp, Homo sapiens
gccctcatcccg

SEQ ID NO: 1932194 - DNA, 10 bp, Homo sapiens
gccctccctc

SEQ ID NO: 1932195 - DNA, 11 bp, Homo sapiens
gccctccctcc

SEQ ID NO: 1932196 - DNA, 14 bp, Homo sapiens
gccctccctccctc

SEQ ID NO: 1932197 - DNA, 20 bp, Homo sapiens
gccctccctccctccacacc

SEQ ID NO: 1932198 - DNA, 15 bp, Homo sapiens
gccctccctgcccct

SEQ ID NO: 1932199 - DNA, 21 bp, Homo sapiens
gccctccctgcccctcccttc

SEQ ID NO: 1932200 - DNA, 13 bp, Homo sapiens
gccctctctgcag

SEQ ID NO: 1932201 - DNA, 10 bp, Homo sapiens
gccctctgcc

SEQ ID NO: 1932202 - DNA, 21 bp, Homo sapiens
gccctctgcccccagctgctc

SEQ ID NO: 1932203 - DNA, 19 bp, Homo sapiens
gccctgagctactgcttct

SEQ ID NO: 1932204 - DNA, 18 bp, Homo sapiens
gccctgcaaaaggactct

SEQ ID NO: 1932205 - DNA, 17 bp, Homo sapiens
gccctgccctcactcca

SEQ ID NO: 1932206 - DNA, 21 bp, Homo sapiens
gccctgccctcactccactcc

SEQ ID NO: 1932207 - DNA, 19 bp, Homo sapiens
gccctgctttgggctgccc

SEQ ID NO: 1932208 - DNA, 15 bp, Homo sapiens
gccctggtgctgcca

SEQ ID NO: 1932209 - DNA, 15 bp, Homo sapiens
gccctgttgtggggg

SEQ ID NO: 1932210 - DNA, 18 bp, Homo sapiens
gcccttcctctccactgc

SEQ ID NO: 1932211 - DNA, 19 bp, Homo sapiens
gcccttcctctccactgcc

SEQ ID NO: 1932212 - DNA, 18 bp, Homo sapiens
gccctttgagtgcagtcc

SEQ ID NO: 1932213 - DNA, 13 bp, Homo sapiens
gccgcctgtcctt

SEQ ID NO: 1932214 - DNA, 18 bp, Homo sapiens
gccgctgctgtgacaggc

SEQ ID NO: 1932215 - DNA, 16 bp, Homo sapiens
gccgctgggagagcca

SEQ ID NO: 1932216 - DNA, 21 bp, Homo sapiens
gccgctgggagagccaaggcc

SEQ ID NO: 1932217 - DNA, 19 bp, Homo sapiens
gccggcccacgtcctgggt

SEQ ID NO: 1932218 - DNA, 21 bp, Homo sapiens
gccgggggtgggggcctgctg

SEQ ID NO: 1932219 - DNA, 18 bp, Homo sapiens
gccgggtcgcctgccctg

SEQ ID NO: 1932220 - DNA, 14 bp, Homo sapiens
gccgtgccttcagc

SEQ ID NO: 1932221 - DNA, 17 bp, Homo sapiens
gccgtgccttcagctct

SEQ ID NO: 1932222 - DNA, 18 bp, Homo sapiens
gccgtggctgcggcaccc

SEQ ID NO: 1932223 - DNA, 19 bp, Homo sapiens
gccgtggcttcccgctcag

SEQ ID NO: 1932224 - DNA, 23 bp, Homo sapiens
gcctagtgaaggcttctctctgt

SEQ ID NO: 1932225 - DNA, 23 bp, Homo sapiens
gcctagtggggaggggcctggcc

SEQ ID NO: 1932226 - DNA, 19 bp, Homo sapiens
gcctatgccacctgcagcg

SEQ ID NO: 1932227 - DNA, 14 bp, Homo sapiens
gcctcccctgccag

SEQ ID NO: 1932228 - DNA, 15 bp, Homo sapiens
gcctcccctgccagg

SEQ ID NO: 1932229 - DNA, 18 bp, Homo sapiens
gcctcccctgccagggca

SEQ ID NO: 1932230 - DNA, 23 bp, Homo sapiens
gcctctacctgacactcccttgg

SEQ ID NO: 1932231 - DNA, 12 bp, Homo sapiens
gcctctgagcca

SEQ ID NO: 1932232 - DNA, 17 bp, Homo sapiens
gcctctgagccaggagc

SEQ ID NO: 1932233 - DNA, 18 bp, Homo sapiens
gcctcttgagagccccac

SEQ ID NO: 1932234 - DNA, 15 bp, Homo sapiens
gcctgcagaccctgc

SEQ ID NO: 1932235 - DNA, 18 bp, Homo sapiens
gcctgcagaccctgccag

SEQ ID NO: 1932236 - DNA, 15 bp, Homo sapiens
gcctgccccccttcc

SEQ ID NO: 1932237 - DNA, 18 bp, Homo sapiens
gcctgcctcatgctctct

SEQ ID NO: 1932238 - DNA, 18 bp, Homo sapiens
gcctggcaagtgggtgaa

SEQ ID NO: 1932239 - DNA, 15 bp, Homo sapiens
gcctggccccaagca

SEQ ID NO: 1932240 - DNA, 13 bp, Homo sapiens
gcctggcctggtc

SEQ ID NO: 1932241 - DNA, 15 bp, Homo sapiens
gcctggcctggtcca

SEQ ID NO: 1932242 - DNA, 17 bp, Homo sapiens
gcctgggagatgcagct

SEQ ID NO: 1932243 - DNA, 18 bp, Homo sapiens
gcctgggtcctcccagct

SEQ ID NO: 1932244 - DNA, 23 bp, Homo sapiens
gcctgggtggggcagggcctggc

SEQ ID NO: 1932245 - DNA, 18 bp, Homo sapiens
gcctgtccttggtggccg

SEQ ID NO: 1932246 - DNA, 17 bp, Homo sapiens
gcctgtgatcgtgtgtt

SEQ ID NO: 1932247 - DNA, 14 bp, Homo sapiens
gcctgtgggagaag

SEQ ID NO: 1932248 - DNA, 22 bp, Homo sapiens
gcctgtgggagaagggacagcg

SEQ ID NO: 1932249 - DNA, 17 bp, Homo sapiens
gcctgtttgggaggctg

SEQ ID NO: 1932250 - DNA, 12 bp, Homo sapiens
gccttaaaactt

SEQ ID NO: 1932251 - DNA, 16 bp, Homo sapiens
gccttcctcctgggcc

SEQ ID NO: 1932252 - DNA, 18 bp, Homo sapiens
gccttctcttctatcctg

SEQ ID NO: 1932253 - DNA, 16 bp, Homo sapiens
gcgaactctcaggact

SEQ ID NO: 1932254 - DNA, 17 bp, Homo sapiens
gcgaactctcaggacta

SEQ ID NO: 1932255 - DNA, 17 bp, Homo sapiens
gcgacacaggctgccgc

SEQ ID NO: 1932256 - DNA, 15 bp, Homo sapiens
gcgaggaggctccag

SEQ ID NO: 1932257 - DNA, 16 bp, Homo sapiens
gcgaggaggctccaga

SEQ ID NO: 1932258 - DNA, 18 bp, Homo sapiens
gcgaggaggctccagagg

SEQ ID NO: 1932259 - DNA, 19 bp, Homo sapiens
gcgaggctttaagcgaggc

SEQ ID NO: 1932260 - DNA, 23 bp, Homo sapiens
gcgattcaagtcgcggctgcagg

SEQ ID NO: 1932261 - DNA, 23 bp, Homo sapiens
gcgcaagcgacacaggctgccgc

SEQ ID NO: 1932262 - DNA, 11 bp, Homo sapiens
gcgcacacaca

SEQ ID NO: 1932263 - DNA, 18 bp, Homo sapiens
gcgcccagcctggcccca

SEQ ID NO: 1932264 - DNA, 12 bp, Homo sapiens
gcgccctccctc

SEQ ID NO: 1932265 - DNA, 13 bp, Homo sapiens
gcgccctccctcc

SEQ ID NO: 1932266 - DNA, 18 bp, Homo sapiens
gcgccctccctccctcca

SEQ ID NO: 1932267 - DNA, 14 bp, Homo sapiens
gcgcctgggtcctc

SEQ ID NO: 1932268 - DNA, 19 bp, Homo sapiens
gcgcctgggtcctcccagc

SEQ ID NO: 1932269 - DNA, 22 bp, Homo sapiens
gcgcctgggtcctcccagctga

SEQ ID NO: 1932270 - DNA, 14 bp, Homo sapiens
gcgcgcacacacac

SEQ ID NO: 1932271 - DNA, 17 bp, Homo sapiens
gcgcgcacacacactct

SEQ ID NO: 1932272 - DNA, 17 bp, Homo sapiens
gcgcttttgctggtcac

SEQ ID NO: 1932273 - DNA, 14 bp, Homo sapiens
gcggaaaccgggtg

SEQ ID NO: 1932274 - DNA, 21 bp, Homo sapiens
gcggcctgcagaccctgccag

SEQ ID NO: 1932275 - DNA, 16 bp, Homo sapiens
gcgggctgggcagctg

SEQ ID NO: 1932276 - DNA, 17 bp, Homo sapiens
gcggggtctgctcctgg

SEQ ID NO: 1932277 - DNA, 14 bp, Homo sapiens
gcgggtaaaaagag

SEQ ID NO: 1932278 - DNA, 17 bp, Homo sapiens
gcgggtaaaaagagaag

SEQ ID NO: 1932279 - DNA, 23 bp, Homo sapiens
gcggtcactgcccacctgccagg

SEQ ID NO: 1932280 - DNA, 14 bp, Homo sapiens
gcgtcctcctctgt

SEQ ID NO: 1932281 - DNA, 20 bp, Homo sapiens
gcgtctcctcgtcccgaggg

SEQ ID NO: 1932282 - DNA, 22 bp, Homo sapiens
gcgtctgagcggccgcctgtcc

SEQ ID NO: 1932283 - DNA, 18 bp, Homo sapiens
gcgtgaggatgggaagga

SEQ ID NO: 1932284 - DNA, 16 bp, Homo sapiens
gcgtgggatccagaga

SEQ ID NO: 1932285 - DNA, 17 bp, Homo sapiens
gctaaagcaatatgcat

SEQ ID NO: 1932286 - DNA, 19 bp, Homo sapiens
gctaaatcctttactgtta

SEQ ID NO: 1932287 - DNA, 16 bp, Homo sapiens
gctaatcagcattctc

SEQ ID NO: 1932288 - DNA, 22 bp, Homo sapiens
gctaatcagcattctcactcct

SEQ ID NO: 1932289 - DNA, 20 bp, Homo sapiens
gctaatgccaggccagtaaa

SEQ ID NO: 1932290 - DNA, 20 bp, Homo sapiens
gctacacagcagctgttcaa

SEQ ID NO: 1932291 - DNA, 14 bp, Homo sapiens
gctaccctgagctg

SEQ ID NO: 1932292 - DNA, 20 bp, Homo sapiens
gctaggttaataggaggaca

SEQ ID NO: 1932293 - DNA, 18 bp, Homo sapiens
gctagtctgtgcctcagt

SEQ ID NO: 1932294 - DNA, 19 bp, Homo sapiens
gctagtctgtgcctcagtg

SEQ ID NO: 1932295 - DNA, 18 bp, Homo sapiens
gctatggggagaaaagac

SEQ ID NO: 1932296 - DNA, 17 bp, Homo sapiens
gctcaaggcgtgaggat

SEQ ID NO: 1932297 - DNA, 15 bp, Homo sapiens
gctcacattccctct

SEQ ID NO: 1932298 - DNA, 23 bp, Homo sapiens
gctcacattccctctcatccagg

SEQ ID NO: 1932299 - DNA, 18 bp, Homo sapiens
gctcagccctccctgccc

SEQ ID NO: 1932300 - DNA, 19 bp, Homo sapiens
gctccagagtaggtgggtc

SEQ ID NO: 1932301 - DNA, 15 bp, Homo sapiens
gctcccacaggccct

SEQ ID NO: 1932302 - DNA, 15 bp, Homo sapiens
gctccccaatactct

SEQ ID NO: 1932303 - DNA, 21 bp, Homo sapiens
gctcctacccctgtcctgggg

SEQ ID NO: 1932304 - DNA, 14 bp, Homo sapiens
gctcctcccggtgc

SEQ ID NO: 1932305 - DNA, 18 bp, Homo sapiens
gctccttcagcagctaga

SEQ ID NO: 1932306 - DNA, 14 bp, Homo sapiens
gctccttcctggag

SEQ ID NO: 1932307 - DNA, 19 bp, Homo sapiens
gctccttgggccctttgag

SEQ ID NO: 1932308 - DNA, 14 bp, Homo sapiens
gctgaaaagtaaat

SEQ ID NO: 1932309 - DNA, 18 bp, Homo sapiens
gctgaagtctctttttct

SEQ ID NO: 1932310 - DNA, 21 bp, Homo sapiens
gctgactggccccagggactc

SEQ ID NO: 1932311 - DNA, 18 bp, Homo sapiens
gctgactgtactcctccc

SEQ ID NO: 1932312 - DNA, 21 bp, Homo sapiens
gctgagcccctccctcctgtg

SEQ ID NO: 1932313 - DNA, 23 bp, Homo sapiens
gctgaggcagcagtgtgaggcca

SEQ ID NO: 1932314 - DNA, 18 bp, Homo sapiens
gctgcagagacagagagg

SEQ ID NO: 1932315 - DNA, 17 bp, Homo sapiens
gctgcaggatccttgcc

SEQ ID NO: 1932316 - DNA, 18 bp, Homo sapiens
gctgcagttgtgaaagca

SEQ ID NO: 1932317 - DNA, 20 bp, Homo sapiens
gctgccaagataccttcatg

SEQ ID NO: 1932318 - DNA, 22 bp, Homo sapiens
gctgccacacttcaggctcttc

SEQ ID NO: 1932319 - DNA, 18 bp, Homo sapiens
gctgccagctctgtatca

SEQ ID NO: 1932320 - DNA, 17 bp, Homo sapiens
gctgcccacacacccca

SEQ ID NO: 1932321 - DNA, 19 bp, Homo sapiens
gctgcccacgtcccgggca

SEQ ID NO: 1932322 - DNA, 20 bp, Homo sapiens
gctgcccagcggctcttcct

SEQ ID NO: 1932323 - DNA, 18 bp, Homo sapiens
gctgccctggtgctgcca

SEQ ID NO: 1932324 - DNA, 14 bp, Homo sapiens
gctgccgctgctct

SEQ ID NO: 1932325 - DNA, 14 bp, Homo sapiens
gctgctctcccagg

SEQ ID NO: 1932326 - DNA, 21 bp, Homo sapiens
gctggaaaggatgcttctgct

SEQ ID NO: 1932327 - DNA, 14 bp, Homo sapiens
gctggaagaacatc

SEQ ID NO: 1932328 - DNA, 23 bp, Homo sapiens
gctggaccacgtctccctggccc

SEQ ID NO: 1932329 - DNA, 18 bp, Homo sapiens
gctggagaggaaaagcca

SEQ ID NO: 1932330 - DNA, 20 bp, Homo sapiens
gctggagaggaaaagccagt

SEQ ID NO: 1932331 - DNA, 22 bp, Homo sapiens
gctggatggggcggcctgcaga

SEQ ID NO: 1932332 - DNA, 15 bp, Homo sapiens
gctggcaaagacaga

SEQ ID NO: 1932333 - DNA, 12 bp, Homo sapiens
gctggcttgcac

SEQ ID NO: 1932334 - DNA, 10 bp, Homo sapiens
gctgggagag

SEQ ID NO: 1932335 - DNA, 13 bp, Homo sapiens
gctgggagagcca

SEQ ID NO: 1932336 - DNA, 23 bp, Homo sapiens
gctgggcactgggccggcagcct

SEQ ID NO: 1932337 - DNA, 13 bp, Homo sapiens
gctgggcagaggg

SEQ ID NO: 1932338 - DNA, 17 bp, Homo sapiens
gctgggcagaggggaga

SEQ ID NO: 1932339 - DNA, 12 bp, Homo sapiens
gctgggcagctg

SEQ ID NO: 1932340 - DNA, 13 bp, Homo sapiens
gctgggcagctgt

SEQ ID NO: 1932341 - DNA, 21 bp, Homo sapiens
gctgggcgcctctgtcctggc

SEQ ID NO: 1932342 - DNA, 21 bp, Homo sapiens
gctgggtttgggcagtggaga

SEQ ID NO: 1932343 - DNA, 22 bp, Homo sapiens
gctgtcagaccttcttccacag

SEQ ID NO: 1932344 - DNA, 18 bp, Homo sapiens
gctgtcagccctgctgtc

SEQ ID NO: 1932345 - DNA, 13 bp, Homo sapiens
gctgtcatctcag

SEQ ID NO: 1932346 - DNA, 19 bp, Homo sapiens
gctgtcatgcccagcttgg

SEQ ID NO: 1932347 - DNA, 14 bp, Homo sapiens
gctgtggcccctcc

SEQ ID NO: 1932348 - DNA, 18 bp, Homo sapiens
gctgtggcccctccttct

SEQ ID NO: 1932349 - DNA, 15 bp, Homo sapiens
gctgtgggtcagtgt

SEQ ID NO: 1932350 - DNA, 23 bp, Homo sapiens
gctgtggtgtgtccccctctgtc

SEQ ID NO: 1932351 - DNA, 13 bp, Homo sapiens
gctgttgttcaga

SEQ ID NO: 1932352 - DNA, 17 bp, Homo sapiens
gctgttgtttaaaataa

SEQ ID NO: 1932353 - DNA, 15 bp, Homo sapiens
gctgtttactaggga

SEQ ID NO: 1932354 - DNA, 14 bp, Homo sapiens
gcttacaatgtgca

SEQ ID NO: 1932355 - DNA, 22 bp, Homo sapiens
gcttcatgttcccaaaatcacc

SEQ ID NO: 1932356 - DNA, 21 bp, Homo sapiens
gcttccatggtggtttcagaa

SEQ ID NO: 1932357 - DNA, 16 bp, Homo sapiens
gcttcccgctcagccc

SEQ ID NO: 1932358 - DNA, 17 bp, Homo sapiens
gcttcccgctcagccct

SEQ ID NO: 1932359 - DNA, 15 bp, Homo sapiens
gcttccctagatggt

SEQ ID NO: 1932360 - DNA, 18 bp, Homo sapiens
gcttccctctgctccaca

SEQ ID NO: 1932361 - DNA, 14 bp, Homo sapiens
gcttccctgactca

SEQ ID NO: 1932362 - DNA, 18 bp, Homo sapiens
gcttcgggcccttcccac

SEQ ID NO: 1932363 - DNA, 20 bp, Homo sapiens
gcttcgggcccttcccacag

SEQ ID NO: 1932364 - DNA, 19 bp, Homo sapiens
gcttcttaatataactgcc

SEQ ID NO: 1932365 - DNA, 22 bp, Homo sapiens
gcttcttaatataactgcctta

SEQ ID NO: 1932366 - DNA, 21 bp, Homo sapiens
gcttggaacatttgggagact

SEQ ID NO: 1932367 - DNA, 14 bp, Homo sapiens
gcttggagcagagg

SEQ ID NO: 1932368 - DNA, 14 bp, Homo sapiens
gcttggggtagaga

SEQ ID NO: 1932369 - DNA, 18 bp, Homo sapiens
gcttgtagggtgaggcgt

SEQ ID NO: 1932370 - DNA, 16 bp, Homo sapiens
gctttcgaactgctag

SEQ ID NO: 1932371 - DNA, 21 bp, Homo sapiens
gctttggctcgggacttcaaa

SEQ ID NO: 1932372 - DNA, 15 bp, Homo sapiens
gctttgggctgccct

SEQ ID NO: 1932373 - DNA, 16 bp, Homo sapiens
gctttgggctgccctg

SEQ ID NO: 1932374 - DNA, 15 bp, Homo sapiens
gctttgtatgcactt

SEQ ID NO: 1932375 - DNA, 18 bp, Homo sapiens
gcttttcactgctggctg

SEQ ID NO: 1932376 - DNA, 15 bp, Homo sapiens
gcttttgctggtcac

SEQ ID NO: 1932377 - DNA, 22 bp, Homo sapiens
ggaaaaccaagccgtggcttcc

SEQ ID NO: 1932378 - DNA, 12 bp, Homo sapiens
ggaaaagccagt

SEQ ID NO: 1932379 - DNA, 20 bp, Homo sapiens
ggaaaattaatatcacagca

SEQ ID NO: 1932380 - DNA, 10 bp, Homo sapiens
ggaaaccaga

SEQ ID NO: 1932381 - DNA, 17 bp, Homo sapiens
ggaaatgtcaacaagta

SEQ ID NO: 1932382 - DNA, 23 bp, Homo sapiens
ggaactagactcccaagctggac

SEQ ID NO: 1932383 - DNA, 13 bp, Homo sapiens
ggaagaaatcaag

SEQ ID NO: 1932384 - DNA, 18 bp, Homo sapiens
ggaagccacgtgctggag

SEQ ID NO: 1932385 - DNA, 20 bp, Homo sapiens
ggaagccacgtgctggagag

SEQ ID NO: 1932386 - DNA, 12 bp, Homo sapiens
ggaagctgagcc

SEQ ID NO: 1932387 - DNA, 21 bp, Homo sapiens
ggaaggacacagtcaggggcc

SEQ ID NO: 1932388 - DNA, 14 bp, Homo sapiens
ggaaggaggtgcct

SEQ ID NO: 1932389 - DNA, 14 bp, Homo sapiens
ggaatataaatatc

SEQ ID NO: 1932390 - DNA, 24 bp, Homo sapiens
ggaatcatttctatttctcctcca

SEQ ID NO: 1932391 - DNA, 19 bp, Homo sapiens
ggaatcctgtcctcagctt

SEQ ID NO: 1932392 - DNA, 20 bp, Homo sapiens
ggaatggtaaccgagccagc

SEQ ID NO: 1932393 - DNA, 17 bp, Homo sapiens
ggacaagccaggccctc

SEQ ID NO: 1932394 - DNA, 14 bp, Homo sapiens
ggacaggaagcaca

SEQ ID NO: 1932395 - DNA, 15 bp, Homo sapiens
ggacagggcatggcc

SEQ ID NO: 1932396 - DNA, 22 bp, Homo sapiens
ggacagggcatggccaggtggc

SEQ ID NO: 1932397 - DNA, 19 bp, Homo sapiens
ggacatggtgtgccacagg

SEQ ID NO: 1932398 - DNA, 22 bp, Homo sapiens
ggacatggtgtgccacaggctg

SEQ ID NO: 1932399 - DNA, 14 bp, Homo sapiens
ggacatttctctaa

SEQ ID NO: 1932400 - DNA, 21 bp, Homo sapiens
ggacccagaggaaggggccag

SEQ ID NO: 1932401 - DNA, 22 bp, Homo sapiens
ggaccctcccaggtttcccact

SEQ ID NO: 1932402 - DNA, 20 bp, Homo sapiens
ggacgacccggggcgggctg

SEQ ID NO: 1932403 - DNA, 17 bp, Homo sapiens
ggactctcagtctctga

SEQ ID NO: 1932404 - DNA, 10 bp, Homo sapiens
ggacttcaaa

SEQ ID NO: 1932405 - DNA, 13 bp, Homo sapiens
ggacttgtgcctc

SEQ ID NO: 1932406 - DNA, 23 bp, Homo sapiens
ggacttgtgcctcttgggagacg

SEQ ID NO: 1932407 - DNA, 19 bp, Homo sapiens
ggacttttgcagcttcctt

SEQ ID NO: 1932408 - DNA, 23 bp, Homo sapiens
ggagaaggcctgccccccttccc

SEQ ID NO: 1932409 - DNA, 17 bp, Homo sapiens
ggagacaatctaaaaaa

SEQ ID NO: 1932410 - DNA, 23 bp, Homo sapiens
ggagacgtccacccgtttccaag

SEQ ID NO: 1932411 - DNA, 14 bp, Homo sapiens
ggagactgagcttg

SEQ ID NO: 1932412 - DNA, 15 bp, Homo sapiens
ggagactgagcttga

SEQ ID NO: 1932413 - DNA, 15 bp, Homo sapiens
ggagactgcccagct

SEQ ID NO: 1932414 - DNA, 13 bp, Homo sapiens
ggagactgggctg

SEQ ID NO: 1932415 - DNA, 19 bp, Homo sapiens
ggagagaatgagagagtgt

SEQ ID NO: 1932416 - DNA, 17 bp, Homo sapiens
ggagaggaaaagccagt

SEQ ID NO: 1932417 - DNA, 12 bp, Homo sapiens
ggagaggaagca

SEQ ID NO: 1932418 - DNA, 13 bp, Homo sapiens
ggagaggaagcac

SEQ ID NO: 1932419 - DNA, 19 bp, Homo sapiens
ggagaggctctgaaagctg

SEQ ID NO: 1932420 - DNA, 16 bp, Homo sapiens
ggagccactcctctga

SEQ ID NO: 1932421 - DNA, 14 bp, Homo sapiens
ggagccgcaggggc

SEQ ID NO: 1932422 - DNA, 18 bp, Homo sapiens
ggagccgggtctgcctct

SEQ ID NO: 1932423 - DNA, 20 bp, Homo sapiens
ggaggaaaaccaagccgtgg

SEQ ID NO: 1932424 - DNA, 22 bp, Homo sapiens
ggaggaaaaccaagccgtggct

SEQ ID NO: 1932425 - DNA, 13 bp, Homo sapiens
ggaggacagggag

SEQ ID NO: 1932426 - DNA, 18 bp, Homo sapiens
ggaggacctggggggggc

SEQ ID NO: 1932427 - DNA, 17 bp, Homo sapiens
ggaggcacacagctgca

SEQ ID NO: 1932428 - DNA, 13 bp, Homo sapiens
ggaggcagaacca

SEQ ID NO: 1932429 - DNA, 17 bp, Homo sapiens
ggaggccacgggggagg

SEQ ID NO: 1932430 - DNA, 21 bp, Homo sapiens
ggaggccgaggcaggggctgg

SEQ ID NO: 1932431 - DNA, 23 bp, Homo sapiens
ggaggccgaggcaggggctgggc

SEQ ID NO: 1932432 - DNA, 13 bp, Homo sapiens
ggaggcctgggag

SEQ ID NO: 1932433 - DNA, 20 bp, Homo sapiens
ggaggcctggtctggagccc

SEQ ID NO: 1932434 - DNA, 16 bp, Homo sapiens
ggaggctccagagggc

SEQ ID NO: 1932435 - DNA, 13 bp, Homo sapiens
ggagggcagcagg

SEQ ID NO: 1932436 - DNA, 16 bp, Homo sapiens
ggagggcagcagggct

SEQ ID NO: 1932437 - DNA, 14 bp, Homo sapiens
ggagggtcaggaag

SEQ ID NO: 1932438 - DNA, 16 bp, Homo sapiens
ggagggtcaggaagga

SEQ ID NO: 1932439 - DNA, 22 bp, Homo sapiens
ggaggtattcgtaaggatggga

SEQ ID NO: 1932440 - DNA, 16 bp, Homo sapiens
ggagtctgaaggagag

SEQ ID NO: 1932441 - DNA, 20 bp, Homo sapiens
ggagtgactctggctgccaa

SEQ ID NO: 1932442 - DNA, 20 bp, Homo sapiens
ggagtgccacgtggccgctg

SEQ ID NO: 1932443 - DNA, 14 bp, Homo sapiens
ggagtgggagagga

SEQ ID NO: 1932444 - DNA, 24 bp, Homo sapiens
ggagtgggagaggaagccacgtgc

SEQ ID NO: 1932445 - DNA, 18 bp, Homo sapiens
tcagccctccctgcccct

SEQ ID NO: 1932446 - DNA, 14 bp, Homo sapiens
tcagctccttcctg

SEQ ID NO: 1932447 - DNA, 13 bp, Homo sapiens
tcagcttcttaat

SEQ ID NO: 1932448 - DNA, 14 bp, Homo sapiens
tcagcttcttaata

SEQ ID NO: 1932449 - DNA, 18 bp, Homo sapiens
tcagctttggatgtggtt

SEQ ID NO: 1932450 - DNA, 16 bp, Homo sapiens
tcagcttttttttcag

SEQ ID NO: 1932451 - DNA, 22 bp, Homo sapiens
tcaggaatgggccaagccaggg

SEQ ID NO: 1932452 - DNA, 22 bp, Homo sapiens
tcaggactaccgttaccaagag

SEQ ID NO: 1932453 - DNA, 16 bp, Homo sapiens
tcaggctcttctcctt

SEQ ID NO: 1932454 - DNA, 15 bp, Homo sapiens
tcagggaggtcattt

SEQ ID NO: 1932455 - DNA, 14 bp, Homo sapiens
tcagggctcctggg

SEQ ID NO: 1932456 - DNA, 12 bp, Homo sapiens
tcagggggccag

SEQ ID NO: 1932457 - DNA, 13 bp, Homo sapiens
tcagggggccagg

SEQ ID NO: 1932458 - DNA, 17 bp, Homo sapiens
tcaggtcagagcccagg

SEQ ID NO: 1932459 - DNA, 21 bp, Homo sapiens
tcaggtgaaaaaggcaagcca

SEQ ID NO: 1932460 - DNA, 14 bp, Homo sapiens
tcagtgataaagcg

SEQ ID NO: 1932461 - DNA, 19 bp, Homo sapiens
tcagtgctccctcacatgt

SEQ ID NO: 1932462 - DNA, 15 bp, Homo sapiens
tcagtgcttcgcaga

SEQ ID NO: 1932463 - DNA, 22 bp, Homo sapiens
tcagtgtgccaccctctgcagg

SEQ ID NO: 1932464 - DNA, 21 bp, Homo sapiens
tcagtgttaaatgtgatgaat

SEQ ID NO: 1932465 - DNA, 14 bp, Homo sapiens
tcagttcaatcaaa

SEQ ID NO: 1932466 - DNA, 18 bp, Homo sapiens
tcagttcaatcaaacttt

SEQ ID NO: 1932467 - DNA, 21 bp, Homo sapiens
tcagtttgtccacacaagaca

SEQ ID NO: 1932468 - DNA, 19 bp, Homo sapiens
tcagttttatcattttcaa

SEQ ID NO: 1932469 - DNA, 20 bp, Homo sapiens
tcataagtatttcaaattgg

SEQ ID NO: 1932470 - DNA, 20 bp, Homo sapiens
tcatagaggatgatgtaatt

SEQ ID NO: 1932471 - DNA, 14 bp, Homo sapiens
tcatagtttctgta

SEQ ID NO: 1932472 - DNA, 15 bp, Homo sapiens
tcatataataaatgt

SEQ ID NO: 1932473 - DNA, 15 bp, Homo sapiens
tcatatattataaga

SEQ ID NO: 1932474 - DNA, 14 bp, Homo sapiens
tcatcattctctgt

SEQ ID NO: 1932475 - DNA, 22 bp, Homo sapiens
tcatcattctctgtctcatcca

SEQ ID NO: 1932476 - DNA, 15 bp, Homo sapiens
tcatccatcatcatg

SEQ ID NO: 1932477 - DNA, 23 bp, Homo sapiens
tcatcccgagcacctccacatcc

SEQ ID NO: 1932478 - DNA, 15 bp, Homo sapiens
tcatctcctgccttc

SEQ ID NO: 1932479 - DNA, 23 bp, Homo sapiens
tcatctcctgccttcctcctggg

SEQ ID NO: 1932480 - DNA, 19 bp, Homo sapiens
tcatgacatttctcaaagt

SEQ ID NO: 1932481 - DNA, 22 bp, Homo sapiens
tcatgcccagcttggagtgcca

SEQ ID NO: 1932482 - DNA, 22 bp, Homo sapiens
tcatggcagaaggcaaacccat

SEQ ID NO: 1932483 - DNA, 13 bp, Homo sapiens
tcatgtaaactgt

SEQ ID NO: 1932484 - DNA, 22 bp, Homo sapiens
tcatgtaagaatccaaagtgga

SEQ ID NO: 1932485 - DNA, 21 bp, Homo sapiens
tcattaattcaattaaaacca

SEQ ID NO: 1932486 - DNA, 19 bp, Homo sapiens
tcattctctgtctcatcca

SEQ ID NO: 1932487 - DNA, 18 bp, Homo sapiens
tcattctgaaggagcccc

SEQ ID NO: 1932488 - DNA, 12 bp, Homo sapiens
tcattggatgca

SEQ ID NO: 1932489 - DNA, 19 bp, Homo sapiens
tcatttagtttgattattc

SEQ ID NO: 1932490 - DNA, 13 bp, Homo sapiens
tcatttatctgga

SEQ ID NO: 1932491 - DNA, 21 bp, Homo sapiens
tcatttctatttctcctccat

SEQ ID NO: 1932492 - DNA, 14 bp, Homo sapiens
tcattttaattatt

SEQ ID NO: 1932493 - DNA, 15 bp, Homo sapiens
tcattttctgcattt

SEQ ID NO: 1932494 - DNA, 19 bp, Homo sapiens
tccaaactaccttccagtt

SEQ ID NO: 1932495 - DNA, 19 bp, Homo sapiens
tccaacatttcctcaggca

SEQ ID NO: 1932496 - DNA, 18 bp, Homo sapiens
tccaagatattttaaaat

SEQ ID NO: 1932497 - DNA, 22 bp, Homo sapiens
tccaagatattttaaaatctgt

SEQ ID NO: 1932498 - DNA, 14 bp, Homo sapiens
tccaagcctgggcc

SEQ ID NO: 1932499 - DNA, 16 bp, Homo sapiens
tccaagcctgggccac

SEQ ID NO: 1932500 - DNA, 22 bp, Homo sapiens
tccaagcctgggccactggcat

SEQ ID NO: 1932501 - DNA, 16 bp, Homo sapiens
tccaatcctatgtttt

SEQ ID NO: 1932502 - DNA, 18 bp, Homo sapiens
tccacacaagacagcaga

SEQ ID NO: 1932503 - DNA, 15 bp, Homo sapiens
tccacacctccaccc

SEQ ID NO: 1932504 - DNA, 20 bp, Homo sapiens
tccacagaaaccctgtttta

SEQ ID NO: 1932505 - DNA, 18 bp, Homo sapiens
tccacattctacttcagc

SEQ ID NO: 1932506 - DNA, 19 bp, Homo sapiens
tccacattctacttcagct

SEQ ID NO: 1932507 - DNA, 22 bp, Homo sapiens
tccacattctacttcagctttg

SEQ ID NO: 1932508 - DNA, 15 bp, Homo sapiens
tccacccctcaagcc

SEQ ID NO: 1932509 - DNA, 21 bp, Homo sapiens
tccacccgtttccaagcctgg

SEQ ID NO: 1932510 - DNA, 15 bp, Homo sapiens
tccacggagccactc

SEQ ID NO: 1932511 - DNA, 22 bp, Homo sapiens
tccacggagccactcctctgac

SEQ ID NO: 1932512 - DNA, 19 bp, Homo sapiens
tccacgttctgctcatcat

SEQ ID NO: 1932513 - DNA, 21 bp, Homo sapiens
tccacgttctgctcatcattc

SEQ ID NO: 1932514 - DNA, 16 bp, Homo sapiens
tccactcccctcatcc

SEQ ID NO: 1932515 - DNA, 19 bp, Homo sapiens
tccactcccctcatccact

SEQ ID NO: 1932516 - DNA, 12 bp, Homo sapiens
tccactcctccc

SEQ ID NO: 1932517 - DNA, 13 bp, Homo sapiens
tccactgccttcg

SEQ ID NO: 1932518 - DNA, 19 bp, Homo sapiens
tccactgtaaatttaatag

SEQ ID NO: 1932519 - DNA, 21 bp, Homo sapiens
tccacttagaaattgcatttc

SEQ ID NO: 1932520 - DNA, 19 bp, Homo sapiens
tccagacaaaccagaagca

SEQ ID NO: 1932521 - DNA, 16 bp, Homo sapiens
tccagacagggtgggg

SEQ ID NO: 1932522 - DNA, 15 bp, Homo sapiens
tccagacccctggct

SEQ ID NO: 1932523 - DNA, 17 bp, Homo sapiens
tccagacccctggcttt

SEQ ID NO: 1932524 - DNA, 18 bp, Homo sapiens
tccagacccctggctttt

SEQ ID NO: 1932525 - DNA, 13 bp, Homo sapiens
tccagagagaagc

SEQ ID NO: 1932526 - DNA, 15 bp, Homo sapiens
tccagagagtggctc

SEQ ID NO: 1932527 - DNA, 22 bp, Homo sapiens
tccagagagtggctcctcccgg

SEQ ID NO: 1932528 - DNA, 23 bp, Homo sapiens
tccagataaaaacaatatatgta

SEQ ID NO: 1932529 - DNA, 14 bp, Homo sapiens
tccagcaatgcctg

SEQ ID NO: 1932530 - DNA, 19 bp, Homo sapiens
tccagcaggtgttttcctt

SEQ ID NO: 1932531 - DNA, 22 bp, Homo sapiens
tccagcagtgaaacttgtgcta

SEQ ID NO: 1932532 - DNA, 21 bp, Homo sapiens
tccagccacccagccaggagg

SEQ ID NO: 1932533 - DNA, 14 bp, Homo sapiens
tccagccattcctg

SEQ ID NO: 1932534 - DNA, 14 bp, Homo sapiens
tccagcttgaggga

SEQ ID NO: 1932535 - DNA, 16 bp, Homo sapiens
tccaggcactgagata

SEQ ID NO: 1932536 - DNA, 20 bp, Homo sapiens
tccaggctgtctttcactga

SEQ ID NO: 1932537 - DNA, 15 bp, Homo sapiens
tccaggtcctttcct

SEQ ID NO: 1932538 - DNA, 19 bp, Homo sapiens
tccaggtcctttccttctc

SEQ ID NO: 1932539 - DNA, 20 bp, Homo sapiens
tccaggtcctttccttctcg

SEQ ID NO: 1932540 - DNA, 19 bp, Homo sapiens
tccagttaaaaaaaatttt

SEQ ID NO: 1932541 - DNA, 21 bp, Homo sapiens
tccagttaaaaaaaattttaa

SEQ ID NO: 1932542 - DNA, 12 bp, Homo sapiens
tccatcagaagg

SEQ ID NO: 1932543 - DNA, 13 bp, Homo sapiens
tccatcatcatgt

SEQ ID NO: 1932544 - DNA, 15 bp, Homo sapiens
tccatgaaaaacagc

SEQ ID NO: 1932545 - DNA, 23 bp, Homo sapiens
tccatgggcagagcccaagggaa

SEQ ID NO: 1932546 - DNA, 16 bp, Homo sapiens
tccattggatctcatt

SEQ ID NO: 1932547 - DNA, 17 bp, Homo sapiens
tcccaaaatcaccgtac

SEQ ID NO: 1932548 - DNA, 20 bp, Homo sapiens
tcccaactctggccttggtt

SEQ ID NO: 1932549 - DNA, 17 bp, Homo sapiens
tcccacaggacatttct

SEQ ID NO: 1932550 - DNA, 17 bp, Homo sapiens
tcccacaggcccttcct

SEQ ID NO: 1932551 - DNA, 21 bp, Homo sapiens
tcccacaggcccttcctctcc

SEQ ID NO: 1932552 - DNA, 22 bp, Homo sapiens
tcccagagaacaatcactattc

SEQ ID NO: 1932553 - DNA, 19 bp, Homo sapiens
tcccagcccctggtactcc

SEQ ID NO: 1932554 - DNA, 17 bp, Homo sapiens
tcccagctgaaatactg

SEQ ID NO: 1932555 - DNA, 11 bp, Homo sapiens
tcccagctgct

SEQ ID NO: 1932556 - DNA, 17 bp, Homo sapiens
tcccagctgctcctaga

SEQ ID NO: 1932557 - DNA, 16 bp, Homo sapiens
tcccaggcgccccttc

SEQ ID NO: 1932558 - DNA, 18 bp, Homo sapiens
tcccaggcgccccttccc

SEQ ID NO: 1932559 - DNA, 16 bp, Homo sapiens
tcccatcactgctgtc

SEQ ID NO: 1932560 - DNA, 17 bp, Homo sapiens
tcccatcactgctgtcc

SEQ ID NO: 1932561 - DNA, 22 bp, Homo sapiens
tcccatcccagctgaaatactg

SEQ ID NO: 1932562 - DNA, 19 bp, Homo sapiens
tcccatggatgtttcttct

SEQ ID NO: 1932563 - DNA, 22 bp, Homo sapiens
tcccattactcaaaatgcagga

SEQ ID NO: 1932564 - DNA, 17 bp, Homo sapiens
tccccactcccgtgatg

SEQ ID NO: 1932565 - DNA, 23 bp, Homo sapiens
tccccaggccgtggctgcccaca

SEQ ID NO: 1932566 - DNA, 20 bp, Homo sapiens
tccccatggtgcagtgaaga

SEQ ID NO: 1932567 - DNA, 13 bp, Homo sapiens
tcccccatgggct

SEQ ID NO: 1932568 - DNA, 21 bp, Homo sapiens
tcccccgcaatgtgcccccag

SEQ ID NO: 1932569 - DNA, 15 bp, Homo sapiens
tccccctctgtccag

SEQ ID NO: 1932570 - DNA, 11 bp, Homo sapiens
tcccccttccc

SEQ ID NO: 1932571 - DNA, 13 bp, Homo sapiens
tcccctccagacc

SEQ ID NO: 1932572 - DNA, 20 bp, Homo sapiens
tcccctgcgccctccctccc

SEQ ID NO: 1932573 - DNA, 19 bp, Homo sapiens
tcccgagccccctgtcctt

SEQ ID NO: 1932574 - DNA, 20 bp, Homo sapiens
tcccgagccccctgtccttc

SEQ ID NO: 1932575 - DNA, 13 bp, Homo sapiens
tcccgctcagccc

SEQ ID NO: 1932576 - DNA, 14 bp, Homo sapiens
tcccgctcagccct

SEQ ID NO: 1932577 - DNA, 22 bp, Homo sapiens
tctatgtaaattattgtaaact

SEQ ID NO: 1932578 - DNA, 23 bp, Homo sapiens
tctatgtaaattattgtaaactt

SEQ ID NO: 1932579 - DNA, 22 bp, Homo sapiens
tctattgctggcaaagacagaa

SEQ ID NO: 1932580 - DNA, 16 bp, Homo sapiens
tctatttatctgtctg

SEQ ID NO: 1932581 - DNA, 15 bp, Homo sapiens
tctatttctcctcca

SEQ ID NO: 1932582 - DNA, 14 bp, Homo sapiens
tctcaaactggggc

SEQ ID NO: 1932583 - DNA, 21 bp, Homo sapiens
tctcaaagtttttacagtgta

SEQ ID NO: 1932584 - DNA, 22 bp, Homo sapiens
tctcaaagtttttacagtgtat

SEQ ID NO: 1932585 - DNA, 17 bp, Homo sapiens
tctcaagagggcactgg

SEQ ID NO: 1932586 - DNA, 17 bp, Homo sapiens
tctcactcctacctggt

SEQ ID NO: 1932587 - DNA, 15 bp, Homo sapiens
tctcagtctctgagc

SEQ ID NO: 1932588 - DNA, 18 bp, Homo sapiens
tctcattaattcaattaa

SEQ ID NO: 1932589 - DNA, 16 bp, Homo sapiens
gttctcatccacagag

SEQ ID NO: 1932590 - DNA, 21 bp, Homo sapiens
gttctgaaggttggaactgct

SEQ ID NO: 1932591 - DNA, 17 bp, Homo sapiens
gttcttgttttgttata

SEQ ID NO: 1932592 - DNA, 15 bp, Homo sapiens
gttgaccccagagga

SEQ ID NO: 1932593 - DNA, 20 bp, Homo sapiens
gttgaggggcttccctctgc

SEQ ID NO: 1932594 - DNA, 21 bp, Homo sapiens
gttgaggggcttccctctgct

SEQ ID NO: 1932595 - DNA, 19 bp, Homo sapiens
gttgctgttgttcagaagt

SEQ ID NO: 1932596 - DNA, 15 bp, Homo sapiens
gttggaactgctgcc

SEQ ID NO: 1932597 - DNA, 19 bp, Homo sapiens
gttggaggcctggtctgga

SEQ ID NO: 1932598 - DNA, 15 bp, Homo sapiens
gttgtagctaattag

SEQ ID NO: 1932599 - DNA, 19 bp, Homo sapiens
gttgtctgaagtcactgca

SEQ ID NO: 1932600 - DNA, 21 bp, Homo sapiens
gttgtggagagtgcaacagta

SEQ ID NO: 1932601 - DNA, 20 bp, Homo sapiens
gtttaaaataaaagtaccta

SEQ ID NO: 1932602 - DNA, 18 bp, Homo sapiens
gtttaccctccctgtccc

SEQ ID NO: 1932603 - DNA, 21 bp, Homo sapiens
gtttataattgttatacattt

SEQ ID NO: 1932604 - DNA, 13 bp, Homo sapiens
gtttcagaaaggg

SEQ ID NO: 1932605 - DNA, 18 bp, Homo sapiens
gtttgaggaccctcccag

SEQ ID NO: 1932606 - DNA, 21 bp, Homo sapiens
gtttgcaactggtatatattt

SEQ ID NO: 1932607 - DNA, 18 bp, Homo sapiens
gtttgggcagtggagagg

SEQ ID NO: 1932608 - DNA, 21 bp, Homo sapiens
gttttaacctcaggttccaaa

SEQ ID NO: 1932609 - DNA, 17 bp, Homo sapiens
gttttacttttcacagt

SEQ ID NO: 1932610 - DNA, 21 bp, Homo sapiens
gttttcaccatctttctaatc

SEQ ID NO: 1932611 - DNA, 22 bp, Homo sapiens
gttttcagtcaagttccgtctc

SEQ ID NO: 1932612 - DNA, 13 bp, Homo sapiens
gtttttacagtgt

SEQ ID NO: 1932613 - DNA, 16 bp, Homo sapiens
gtttttatattacttt

SEQ ID NO: 1932614 - DNA, 18 bp, Homo sapiens
gtttttatattacttttg

SEQ ID NO: 1932615 - DNA, 15 bp, Homo sapiens
gtttttgttcaaagc

SEQ ID NO: 1932616 - DNA, 15 bp, Homo sapiens
taaaaataagtcatt

SEQ ID NO: 1932617 - DNA, 14 bp, Homo sapiens
taaaacaaattaaa

SEQ ID NO: 1932618 - DNA, 21 bp, Homo sapiens
taaaaccatgtagaaaatttg

SEQ ID NO: 1932619 - DNA, 17 bp, Homo sapiens
taaaagaagaaactatt

SEQ ID NO: 1932620 - DNA, 21 bp, Homo sapiens
taaaaggaggacagggaggga

SEQ ID NO: 1932621 - DNA, 22 bp, Homo sapiens
taaaataaaagtacctattgaa

SEQ ID NO: 1932622 - DNA, 15 bp, Homo sapiens
taaaatcctcaatcc

SEQ ID NO: 1932623 - DNA, 17 bp, Homo sapiens
taaaatctattttgtct

SEQ ID NO: 1932624 - DNA, 21 bp, Homo sapiens
taaaatgtgcagtattttcag

SEQ ID NO: 1932625 - DNA, 16 bp, Homo sapiens
taaaattaaagctgaa

SEQ ID NO: 1932626 - DNA, 19 bp, Homo sapiens
taaaattaaagctgaaaac

SEQ ID NO: 1932627 - DNA, 13 bp, Homo sapiens
taaaattacagaa

SEQ ID NO: 1932628 - DNA, 14 bp, Homo sapiens
taaaattacagaag

SEQ ID NO: 1932629 - DNA, 15 bp, Homo sapiens
taaacaccatgaaga

SEQ ID NO: 1932630 - DNA, 19 bp, Homo sapiens
taaaccaaacggaactctt

SEQ ID NO: 1932631 - DNA, 21 bp, Homo sapiens
taaaccaaacggaactcttca

SEQ ID NO: 1932632 - DNA, 15 bp, Homo sapiens
taaactataggtaat

SEQ ID NO: 1932633 - DNA, 17 bp, Homo sapiens
taaagaaaggcagagat

SEQ ID NO: 1932634 - DNA, 20 bp, Homo sapiens
taaagaggagcctttccaga

SEQ ID NO: 1932635 - DNA, 15 bp, Homo sapiens
taaagcaatatgcat

SEQ ID NO: 1932636 - DNA, 20 bp, Homo sapiens
taaaggaaacacgtttagaa

SEQ ID NO: 1932637 - DNA, 21 bp, Homo sapiens
taaaggggacagatcttgagc

SEQ ID NO: 1932638 - DNA, 19 bp, Homo sapiens
taaagtcttctttcatgta

SEQ ID NO: 1932639 - DNA, 19 bp, Homo sapiens
taaataaaaataagtcatt

SEQ ID NO: 1932640 - DNA, 21 bp, Homo sapiens
taaataagaaacaactctttg

SEQ ID NO: 1932641 - DNA, 22 bp, Homo sapiens
taaataagaaacaactctttga

SEQ ID NO: 1932642 - DNA, 16 bp, Homo sapiens
taaatagatgagtcct

SEQ ID NO: 1932643 - DNA, 12 bp, Homo sapiens
taaatatcacaa

SEQ ID NO: 1932644 - DNA, 16 bp, Homo sapiens
taaatatcccagagaa

SEQ ID NO: 1932645 - DNA, 15 bp, Homo sapiens
taaatcagaatcttt

SEQ ID NO: 1932646 - DNA, 22 bp, Homo sapiens
taaatcgcattaatgaaatacc

SEQ ID NO: 1932647 - DNA, 23 bp, Homo sapiens
taaatggtgagaattaaaataaa

SEQ ID NO: 1932648 - DNA, 18 bp, Homo sapiens
taaatgttatagctgcat

SEQ ID NO: 1932649 - DNA, 13 bp, Homo sapiens
taaattattgtaa

SEQ ID NO: 1932650 - DNA, 16 bp, Homo sapiens
taaattattgtaaact

SEQ ID NO: 1932651 - DNA, 13 bp, Homo sapiens
taaattgccttct

SEQ ID NO: 1932652 - DNA, 16 bp, Homo sapiens
taacaactatgatttg

SEQ ID NO: 1932653 - DNA, 21 bp, Homo sapiens
taacaactatgatttggaaaa

SEQ ID NO: 1932654 - DNA, 14 bp, Homo sapiens
taacatataatgtt

SEQ ID NO: 1932655 - DNA, 23 bp, Homo sapiens
taacatataatgttgttatttaa

SEQ ID NO: 1932656 - DNA, 11 bp, Homo sapiens
taacatctgaa

SEQ ID NO: 1932657 - DNA, 12 bp, Homo sapiens
taacatttaagc

SEQ ID NO: 1932658 - DNA, 18 bp, Homo sapiens
taacccatatctgtgcaa

SEQ ID NO: 1932659 - DNA, 16 bp, Homo sapiens
taacccttgaatttct

SEQ ID NO: 1932660 - DNA, 18 bp, Homo sapiens
taacctcatcttcttcac

SEQ ID NO: 1932661 - DNA, 18 bp, Homo sapiens
taactaagcacattatgt

SEQ ID NO: 1932662 - DNA, 16 bp, Homo sapiens
taactatgttgataaa

SEQ ID NO: 1932663 - DNA, 16 bp, Homo sapiens
taactatttagagaat

SEQ ID NO: 1932664 - DNA, 13 bp, Homo sapiens
taactttgcatgt

SEQ ID NO: 1932665 - DNA, 14 bp, Homo sapiens
taactttgcatgtt

SEQ ID NO: 1932666 - DNA, 21 bp, Homo sapiens
taagaaacaactctttgagaa

SEQ ID NO: 1932667 - DNA, 16 bp, Homo sapiens
taagagaatccacata

SEQ ID NO: 1932668 - DNA, 21 bp, Homo sapiens
taagagtagaaactgcaggga

SEQ ID NO: 1932669 - DNA, 12 bp, Homo sapiens
taagatgaaatt

SEQ ID NO: 1932670 - DNA, 16 bp, Homo sapiens
taagatgaaattgcca

SEQ ID NO: 1932671 - DNA, 14 bp, Homo sapiens
taagattccagaga

SEQ ID NO: 1932672 - DNA, 20 bp, Homo sapiens
taagcactttgaaaatattt

SEQ ID NO: 1932673 - DNA, 18 bp, Homo sapiens
taaggcagctctgtcgtg

SEQ ID NO: 1932674 - DNA, 24 bp, Homo sapiens
taagtggctgtgattaattattga

SEQ ID NO: 1932675 - DNA, 23 bp, Homo sapiens
taatacccccgtcggaatggtaa

SEQ ID NO: 1932676 - DNA, 15 bp, Homo sapiens
taatacttaaaaata

SEQ ID NO: 1932677 - DNA, 20 bp, Homo sapiens
taatacttaaaaatatgtga

SEQ ID NO: 1932678 - DNA, 13 bp, Homo sapiens
taatatttaaaat

SEQ ID NO: 1932679 - DNA, 18 bp, Homo sapiens
taatattttagaaaatgt

SEQ ID NO: 1932680 - DNA, 19 bp, Homo sapiens
taatattttagaaaatgtt

SEQ ID NO: 1932681 - DNA, 17 bp, Homo sapiens
taatcaatacccttggc

SEQ ID NO: 1932682 - DNA, 22 bp, Homo sapiens
taatcaatacccttggcactga

SEQ ID NO: 1932683 - DNA, 19 bp, Homo sapiens
taatcagggaggtcatttt

SEQ ID NO: 1932684 - DNA, 15 bp, Homo sapiens
taatcatataataaa

SEQ ID NO: 1932685 - DNA, 20 bp, Homo sapiens
taatcatataataaatgtac

SEQ ID NO: 1932686 - DNA, 16 bp, Homo sapiens
taatcttgaattgtaa

SEQ ID NO: 1932687 - DNA, 22 bp, Homo sapiens
taatgaagaaagtggaaaacaa

SEQ ID NO: 1932688 - DNA, 16 bp, Homo sapiens
taatgatactgtctaa

SEQ ID NO: 1932689 - DNA, 22 bp, Homo sapiens
taatgatactgtctaagaataa

SEQ ID NO: 1932690 - DNA, 24 bp, Homo sapiens
taatgatactgtctaagaataatg

SEQ ID NO: 1932691 - DNA, 16 bp, Homo sapiens
taatgcattaactttt

SEQ ID NO: 1932692 - DNA, 16 bp, Homo sapiens
taatggtcctgttatg

SEQ ID NO: 1932693 - DNA, 12 bp, Homo sapiens
taattaaaatgt

SEQ ID NO: 1932694 - DNA, 12 bp, Homo sapiens
taattagagcag

SEQ ID NO: 1932695 - DNA, 14 bp, Homo sapiens
taattgtggagagg

SEQ ID NO: 1932696 - DNA, 12 bp, Homo sapiens
taattgttatac

SEQ ID NO: 1932697 - DNA, 14 bp, Homo sapiens
tacaaggcaacata

SEQ ID NO: 1932698 - DNA, 20 bp, Homo sapiens
tacaagtgctcagttccaat

SEQ ID NO: 1932699 - DNA, 16 bp, Homo sapiens
tacaatgtgcactgaa

SEQ ID NO: 1932700 - DNA, 21 bp, Homo sapiens
tacaatttctttaaatcattt

SEQ ID NO: 1932701 - DNA, 17 bp, Homo sapiens
tacaccgggcctggaga

SEQ ID NO: 1932702 - DNA, 16 bp, Homo sapiens
tacagacccacagagt

SEQ ID NO: 1932703 - DNA, 23 bp, Homo sapiens
tatctcgaagtcttccatcagca

SEQ ID NO: 1932704 - DNA, 24 bp, Homo sapiens
tatctgtacctgcccccactcagc

SEQ ID NO: 1932705 - DNA, 14 bp, Homo sapiens
tatctgtctgagcc

SEQ ID NO: 1932706 - DNA, 17 bp, Homo sapiens
tatctgtctgagccctg

SEQ ID NO: 1932707 - DNA, 17 bp, Homo sapiens
tatctgtgcaatggaat

SEQ ID NO: 1932708 - DNA, 15 bp, Homo sapiens
tatgaatgatatctt

SEQ ID NO: 1932709 - DNA, 16 bp, Homo sapiens
tatgattagtaaagaa

SEQ ID NO: 1932710 - DNA, 14 bp, Homo sapiens
tatgattctcctct

SEQ ID NO: 1932711 - DNA, 15 bp, Homo sapiens
tatgattctcctctc

SEQ ID NO: 1932712 - DNA, 16 bp, Homo sapiens
tatgcacctataaata

SEQ ID NO: 1932713 - DNA, 18 bp, Homo sapiens
tatgcacctataaatact

SEQ ID NO: 1932714 - DNA, 20 bp, Homo sapiens
tatgcacttataattttcct

SEQ ID NO: 1932715 - DNA, 16 bp, Homo sapiens
tatgcctctgtattta

SEQ ID NO: 1932716 - DNA, 13 bp, Homo sapiens
tatgctaatcagg

SEQ ID NO: 1932717 - DNA, 16 bp, Homo sapiens
tatggaaagggtgtgg

SEQ ID NO: 1932718 - DNA, 22 bp, Homo sapiens
tatggggagaaaagacatgaat

SEQ ID NO: 1932719 - DNA, 15 bp, Homo sapiens
tatgtaaattattgt

SEQ ID NO: 1932720 - DNA, 16 bp, Homo sapiens
tatgtaaattattgta

SEQ ID NO: 1932721 - DNA, 12 bp, Homo sapiens
tatgtaacatgt

SEQ ID NO: 1932722 - DNA, 16 bp, Homo sapiens
tatgtaccatgtacat

SEQ ID NO: 1932723 - DNA, 12 bp, Homo sapiens
tatgtatttata

SEQ ID NO: 1932724 - DNA, 14 bp, Homo sapiens
tatgtcccagcccc

SEQ ID NO: 1932725 - DNA, 12 bp, Homo sapiens
tatgtctgtgat

SEQ ID NO: 1932726 - DNA, 14 bp, Homo sapiens
tatgtgagcatgaa

SEQ ID NO: 1932727 - DNA, 17 bp, Homo sapiens
tatgtgagcatgaaact

SEQ ID NO: 1932728 - DNA, 16 bp, Homo sapiens
tatgttttaatatcct

SEQ ID NO: 1932729 - DNA, 17 bp, Homo sapiens
tatgttttaatatccta

SEQ ID NO: 1932730 - DNA, 15 bp, Homo sapiens
tattacttttctgca

SEQ ID NO: 1932731 - DNA, 14 bp, Homo sapiens
tattacttttgtaa

SEQ ID NO: 1932732 - DNA, 18 bp, Homo sapiens
tattacttttgtaaatat

SEQ ID NO: 1932733 - DNA, 18 bp, Homo sapiens
tattagagtgtctttcca

SEQ ID NO: 1932734 - DNA, 18 bp, Homo sapiens
tattattggcttgcactt

SEQ ID NO: 1932735 - DNA, 21 bp, Homo sapiens
tattccctagaaacttccaaa

SEQ ID NO: 1932736 - DNA, 16 bp, Homo sapiens
tattccctgaattgtt

SEQ ID NO: 1932737 - DNA, 12 bp, Homo sapiens
tattctctgagc

SEQ ID NO: 1932738 - DNA, 19 bp, Homo sapiens
tattctctgagctgtgcag

SEQ ID NO: 1932739 - DNA, 18 bp, Homo sapiens
tattcttaagcactttga

SEQ ID NO: 1932740 - DNA, 15 bp, Homo sapiens
tattgacaaactctc

SEQ ID NO: 1932741 - DNA, 14 bp, Homo sapiens
tattggtgtgaatg

SEQ ID NO: 1932742 - DNA, 18 bp, Homo sapiens
tattgtctgacttctcag

SEQ ID NO: 1932743 - DNA, 23 bp, Homo sapiens
tatttaaaagaaagcctcagaga

SEQ ID NO: 1932744 - DNA, 12 bp, Homo sapiens
tatttaaaatag

SEQ ID NO: 1932745 - DNA, 16 bp, Homo sapiens
tatttaactatttaga

SEQ ID NO: 1932746 - DNA, 19 bp, Homo sapiens
tatttatctgtctgagccc

SEQ ID NO: 1932747 - DNA, 20 bp, Homo sapiens
tatttatgcctctgtattta

SEQ ID NO: 1932748 - DNA, 18 bp, Homo sapiens
tatttcaaattggagctt

SEQ ID NO: 1932749 - DNA, 16 bp, Homo sapiens
tatttctatgtaaatt

SEQ ID NO: 1932750 - DNA, 19 bp, Homo sapiens
tatttctatgtaaattatt

SEQ ID NO: 1932751 - DNA, 20 bp, Homo sapiens
tatttgaaaacactgctgtt

SEQ ID NO: 1932752 - DNA, 18 bp, Homo sapiens
tattttaaaatctgtcac

SEQ ID NO: 1932753 - DNA, 19 bp, Homo sapiens
tattttattgcctttagaa

SEQ ID NO: 1932754 - DNA, 19 bp, Homo sapiens
tattttcaacgcagccctg

SEQ ID NO: 1932755 - DNA, 13 bp, Homo sapiens
tattttcaccatt

SEQ ID NO: 1932756 - DNA, 19 bp, Homo sapiens
tattttctatatttgtaac

SEQ ID NO: 1932757 - DNA, 12 bp, Homo sapiens
tattttttaatt

SEQ ID NO: 1932758 - DNA, 16 bp, Homo sapiens
tatttttttgttgctg

SEQ ID NO: 1932759 - DNA, 13 bp, Homo sapiens
tcaaacacacaca

SEQ ID NO: 1932760 - DNA, 19 bp, Homo sapiens
tcaaactggggcctccctg

SEQ ID NO: 1932761 - DNA, 12 bp, Homo sapiens
tcaaactttcag

SEQ ID NO: 1932762 - DNA, 17 bp, Homo sapiens
tcaaagaaccaggaggc

SEQ ID NO: 1932763 - DNA, 20 bp, Homo sapiens
tcaaagaacccccctcccca

SEQ ID NO: 1932764 - DNA, 17 bp, Homo sapiens
tcaaagacattctgaca

SEQ ID NO: 1932765 - DNA, 16 bp, Homo sapiens
tcaaagcaaggaaact

SEQ ID NO: 1932766 - DNA, 14 bp, Homo sapiens
tcaaatcttaagag

SEQ ID NO: 1932767 - DNA, 20 bp, Homo sapiens
tcaaccttgtgtgagtgtga

SEQ ID NO: 1932768 - DNA, 20 bp, Homo sapiens
tcaagaagacggattatcta

SEQ ID NO: 1932769 - DNA, 23 bp, Homo sapiens
tcaagaagacggattatctagag

SEQ ID NO: 1932770 - DNA, 20 bp, Homo sapiens
tcaagagggcactggtggcc

SEQ ID NO: 1932771 - DNA, 21 bp, Homo sapiens
tcaagagggcactggtggccc

SEQ ID NO: 1932772 - DNA, 21 bp, Homo sapiens
tcaagattcccggctggactt

SEQ ID NO: 1932773 - DNA, 16 bp, Homo sapiens
tcaagcagattggaga

SEQ ID NO: 1932774 - DNA, 14 bp, Homo sapiens
tcaagccaggagac

SEQ ID NO: 1932775 - DNA, 18 bp, Homo sapiens
tcaagccaggagaccctg

SEQ ID NO: 1932776 - DNA, 17 bp, Homo sapiens
tcaagggactgggggtg

SEQ ID NO: 1932777 - DNA, 17 bp, Homo sapiens
tcaagtgcaatccatgt

SEQ ID NO: 1932778 - DNA, 21 bp, Homo sapiens
tcaagttattgacaaactctc

SEQ ID NO: 1932779 - DNA, 23 bp, Homo sapiens
tcaataaatagatgagtcctgtt

SEQ ID NO: 1932780 - DNA, 19 bp, Homo sapiens
tcaatcaaactttcagctt

SEQ ID NO: 1932781 - DNA, 14 bp, Homo sapiens
tcaatcctgtcaat

SEQ ID NO: 1932782 - DNA, 16 bp, Homo sapiens
tcaattgcatctccca

SEQ ID NO: 1932783 - DNA, 17 bp, Homo sapiens
tcaattgcatctcccag

SEQ ID NO: 1932784 - DNA, 18 bp, Homo sapiens
tcaattgcatctcccaga

SEQ ID NO: 1932785 - DNA, 22 bp, Homo sapiens
tcacaaagtgagaaattatgaa

SEQ ID NO: 1932786 - DNA, 14 bp, Homo sapiens
tcacaaccttctgt

SEQ ID NO: 1932787 - DNA, 12 bp, Homo sapiens
tcacactgctgg

SEQ ID NO: 1932788 - DNA, 13 bp, Homo sapiens
tcacactgctggg

SEQ ID NO: 1932789 - DNA, 18 bp, Homo sapiens
tcacagaggcagtggcag

SEQ ID NO: 1932790 - DNA, 19 bp, Homo sapiens
tcacagattttttctttaa

SEQ ID NO: 1932791 - DNA, 22 bp, Homo sapiens
tcacaggacgatttcactgaca

SEQ ID NO: 1932792 - DNA, 21 bp, Homo sapiens
tcacatgtcagtaccttcaaa

SEQ ID NO: 1932793 - DNA, 13 bp, Homo sapiens
tcacattccctct

SEQ ID NO: 1932794 - DNA, 14 bp, Homo sapiens
tcacattccctctc

SEQ ID NO: 1932795 - DNA, 16 bp, Homo sapiens
tcaccagactttggct

SEQ ID NO: 1932796 - DNA, 20 bp, Homo sapiens
tcaccatctttctaatcttt

SEQ ID NO: 1932797 - DNA, 22 bp, Homo sapiens
tcaccatttgattatgtagcaa

SEQ ID NO: 1932798 - DNA, 23 bp, Homo sapiens
tcaccatttggcaatgccatcat

SEQ ID NO: 1932799 - DNA, 16 bp, Homo sapiens
tcacccccttctccat

SEQ ID NO: 1932800 - DNA, 18 bp, Homo sapiens
tcacccccttctccatcc

SEQ ID NO: 1932801 - DNA, 22 bp, Homo sapiens
tcacccccttctccatccacat

SEQ ID NO: 1932802 - DNA, 19 bp, Homo sapiens
tcaccgtgggctccctgac

SEQ ID NO: 1932803 - DNA, 20 bp, Homo sapiens
tcacctgaattcgagacagg

SEQ ID NO: 1932804 - DNA, 20 bp, Homo sapiens
tcacctgtgcttcgggccct

SEQ ID NO: 1932805 - DNA, 21 bp, Homo sapiens
tcacctgtgcttcgggccctt

SEQ ID NO: 1932806 - DNA, 12 bp, Homo sapiens
tcacggacagga

SEQ ID NO: 1932807 - DNA, 14 bp, Homo sapiens
tcacggacaggaag

SEQ ID NO: 1932808 - DNA, 16 bp, Homo sapiens
tcactattcttaagca

SEQ ID NO: 1932809 - DNA, 13 bp, Homo sapiens
tcactccactccc

SEQ ID NO: 1932810 - DNA, 14 bp, Homo sapiens
tcactccactcccc

SEQ ID NO: 1932811 - DNA, 17 bp, Homo sapiens
tcactccactcccctca

SEQ ID NO: 1932812 - DNA, 19 bp, Homo sapiens
tcactctacttagcatgtc

SEQ ID NO: 1932813 - DNA, 23 bp, Homo sapiens
tcactgagaaggccccagggcag

SEQ ID NO: 1932814 - DNA, 17 bp, Homo sapiens
tcactgcccacctgcca

SEQ ID NO: 1932815 - DNA, 18 bp, Homo sapiens
tcactgcccacctgccag

SEQ ID NO: 1932816 - DNA, 20 bp, Homo sapiens
tcactgcccacctgccaggc

SEQ ID NO: 1932817 - DNA, 17 bp, Homo sapiens
tcactgctggctgcctt

SEQ ID NO: 1932818 - DNA, 16 bp, Homo sapiens
tcactgctgtccctcc

SEQ ID NO: 1932819 - DNA, 22 bp, Homo sapiens
tcactggcgacacgtagcagct

SEQ ID NO: 1932820 - DNA, 14 bp, Homo sapiens
tcacttcctagggt

SEQ ID NO: 1932821 - DNA, 13 bp, Homo sapiens
tcacttgtgtttg

SEQ ID NO: 1932822 - DNA, 15 bp, Homo sapiens
tcacttgtgtttgta

SEQ ID NO: 1932823 - DNA, 21 bp, Homo sapiens
tcagaaagggcagcccctccc

SEQ ID NO: 1932824 - DNA, 22 bp, Homo sapiens
tcagaaagggcagcccctcccc

SEQ ID NO: 1932825 - DNA, 19 bp, Homo sapiens
tcagaagttgttagtgatt

SEQ ID NO: 1932826 - DNA, 23 bp, Homo sapiens
tcagaccataatgttacattatt

SEQ ID NO: 1932827 - DNA, 14 bp, Homo sapiens
tcagactctctcct

SEQ ID NO: 1932828 - DNA, 15 bp, Homo sapiens
tcagactctctcctc

SEQ ID NO: 1932829 - DNA, 16 bp, Homo sapiens
tcagactctctcctct

SEQ ID NO: 1932830 - DNA, 21 bp, Homo sapiens
tcagagccacccctaaagaga

SEQ ID NO: 1932831 - DNA, 21 bp, Homo sapiens
tcagaggccctcgctgccagc

SEQ ID NO: 1932832 - DNA, 22 bp, Homo sapiens
tcagagtggccaatccctgtgt

SEQ ID NO: 1932833 - DNA, 14 bp, Homo sapiens
tcagcaggaagcaa

SEQ ID NO: 1932834 - DNA, 23 bp, Homo sapiens
tcagcaggggggttgggttccag

SEQ ID NO: 1932835 - DNA, 23 bp, Homo sapiens
tcagcagtgattgaagtatctgt

SEQ ID NO: 1932836 - DNA, 23 bp, Homo sapiens
tcagcattctcactcctacctgg

SEQ ID NO: 1932837 - DNA, 19 bp, Homo sapiens
tcagccctagggtggagag

SEQ ID NO: 1932838 - DNA, 14 bp, Homo sapiens
tcagccctccctgc

SEQ ID NO: 1932839 - DNA, 20 bp, Homo sapiens
gtgatcagaccataatgtta

SEQ ID NO: 1932840 - DNA, 15 bp, Homo sapiens
gtgatctgaacagaa

SEQ ID NO: 1932841 - DNA, 14 bp, Homo sapiens
gtgatgaatactgt

SEQ ID NO: 1932842 - DNA, 20 bp, Homo sapiens
gtgattcacagtgtgaatct

SEQ ID NO: 1932843 - DNA, 15 bp, Homo sapiens
gtgcaaagaaaagaa

SEQ ID NO: 1932844 - DNA, 22 bp, Homo sapiens
gtgcacagacgtccctccacgt

SEQ ID NO: 1932845 - DNA, 14 bp, Homo sapiens
gtgcactgaatcgt

SEQ ID NO: 1932846 - DNA, 23 bp, Homo sapiens
gtgcactgaatcgtttcatgtaa

SEQ ID NO: 1932847 - DNA, 19 bp, Homo sapiens
gtgcagcccgccatggccg

SEQ ID NO: 1932848 - DNA, 18 bp, Homo sapiens
gtgcagccgctgagcgag

SEQ ID NO: 1932849 - DNA, 16 bp, Homo sapiens
gtgcagtcctgatcag

SEQ ID NO: 1932850 - DNA, 14 bp, Homo sapiens
gtgcatctcagccc

SEQ ID NO: 1932851 - DNA, 19 bp, Homo sapiens
gtgcatttgtgtctgcctg

SEQ ID NO: 1932852 - DNA, 18 bp, Homo sapiens
gtgccaaccacctctggc

SEQ ID NO: 1932853 - DNA, 22 bp, Homo sapiens
gtgccaaccacctctggccctg

SEQ ID NO: 1932854 - DNA, 23 bp, Homo sapiens
gtgccaaccacctctggccctgt

SEQ ID NO: 1932855 - DNA, 19 bp, Homo sapiens
gtgccacaggctgcaagct

SEQ ID NO: 1932856 - DNA, 14 bp, Homo sapiens
gtgccaccctctgc

SEQ ID NO: 1932857 - DNA, 15 bp, Homo sapiens
gtgccaccctctgca

SEQ ID NO: 1932858 - DNA, 19 bp, Homo sapiens
gtgccaccctctgcagggc

SEQ ID NO: 1932859 - DNA, 21 bp, Homo sapiens
gtgccaccctctgcagggcag

SEQ ID NO: 1932860 - DNA, 22 bp, Homo sapiens
gtgccaccctctgcagggcagc

SEQ ID NO: 1932861 - DNA, 17 bp, Homo sapiens
gtgccacgtggccgctg

SEQ ID NO: 1932862 - DNA, 13 bp, Homo sapiens
gtgccaggactct

SEQ ID NO: 1932863 - DNA, 14 bp, Homo sapiens
gtgcctatagaaaa

SEQ ID NO: 1932864 - DNA, 15 bp, Homo sapiens
gtgcctcttgggaga

SEQ ID NO: 1932865 - DNA, 21 bp, Homo sapiens
gtgcctcttgggagacgtcca

SEQ ID NO: 1932866 - DNA, 19 bp, Homo sapiens
gtgcgctagagcattctgg

SEQ ID NO: 1932867 - DNA, 23 bp, Homo sapiens
gtgctaaaaaattaaaccaagca

SEQ ID NO: 1932868 - DNA, 18 bp, Homo sapiens
gtgctgttgtctgccgtg

SEQ ID NO: 1932869 - DNA, 16 bp, Homo sapiens
gtggaaaaagaaattc

SEQ ID NO: 1932870 - DNA, 17 bp, Homo sapiens
gtggaaaaagaaattct

SEQ ID NO: 1932871 - DNA, 18 bp, Homo sapiens
gtggagccacaggcagac

SEQ ID NO: 1932872 - DNA, 12 bp, Homo sapiens
gtggagtggagg

SEQ ID NO: 1932873 - DNA, 16 bp, Homo sapiens
gtggcacttcgtggat

SEQ ID NO: 1932874 - DNA, 17 bp, Homo sapiens
gtggcattcctttcttt

SEQ ID NO: 1932875 - DNA, 12 bp, Homo sapiens
gtggcccctcct

SEQ ID NO: 1932876 - DNA, 18 bp, Homo sapiens
gtggcccctccttctccc

SEQ ID NO: 1932877 - DNA, 13 bp, Homo sapiens
gtggccgctgccc

SEQ ID NO: 1932878 - DNA, 15 bp, Homo sapiens
gtggccgctgcccac

SEQ ID NO: 1932879 - DNA, 14 bp, Homo sapiens
gtggcctgagaaga

SEQ ID NO: 1932880 - DNA, 15 bp, Homo sapiens
gtggcctgagaagag

SEQ ID NO: 1932881 - DNA, 16 bp, Homo sapiens
gtggctgcccacacac

SEQ ID NO: 1932882 - DNA, 18 bp, Homo sapiens
gtggctgcggcacccttg

SEQ ID NO: 1932883 - DNA, 13 bp, Homo sapiens
gtggctgtgatta

SEQ ID NO: 1932884 - DNA, 20 bp, Homo sapiens
gtggcttactacatgtggga

SEQ ID NO: 1932885 - DNA, 20 bp, Homo sapiens
gtggcttcccgctcagccct

SEQ ID NO: 1932886 - DNA, 21 bp, Homo sapiens
gtggcttcccgctcagccctc

SEQ ID NO: 1932887 - DNA, 16 bp, Homo sapiens
gtggcttcggcctgct

SEQ ID NO: 1932888 - DNA, 10 bp, Homo sapiens
gtgggagagg

SEQ ID NO: 1932889 - DNA, 16 bp, Homo sapiens
gtgggagaggaagcca

SEQ ID NO: 1932890 - DNA, 21 bp, Homo sapiens
gtgggagaggagaggctgctg

SEQ ID NO: 1932891 - DNA, 14 bp, Homo sapiens
gtgggagccacagg

SEQ ID NO: 1932892 - DNA, 18 bp, Homo sapiens
gtgggagtgggagaggaa

SEQ ID NO: 1932893 - DNA, 19 bp, Homo sapiens
gtgggagtgggagaggaag

SEQ ID NO: 1932894 - DNA, 13 bp, Homo sapiens
gtgggatccagag

SEQ ID NO: 1932895 - DNA, 17 bp, Homo sapiens
gtgggatccagagagaa

SEQ ID NO: 1932896 - DNA, 17 bp, Homo sapiens
gtgggctccagagtagg

SEQ ID NO: 1932897 - DNA, 14 bp, Homo sapiens
gtggggagggtggg

SEQ ID NO: 1932898 - DNA, 15 bp, Homo sapiens
gtggggagggtgggc

SEQ ID NO: 1932899 - DNA, 23 bp, Homo sapiens
gtggggcagcacagagagggggc

SEQ ID NO: 1932900 - DNA, 21 bp, Homo sapiens
gtgggggagaatggctctggc

SEQ ID NO: 1932901 - DNA, 18 bp, Homo sapiens
gtgggggcctgctgtggg

SEQ ID NO: 1932902 - DNA, 14 bp, Homo sapiens
gtgggggtctggga

SEQ ID NO: 1932903 - DNA, 21 bp, Homo sapiens
gtgggggtgtcacagaggcag

SEQ ID NO: 1932904 - DNA, 18 bp, Homo sapiens
gtggggttttcacttcct

SEQ ID NO: 1932905 - DNA, 19 bp, Homo sapiens
gtgggtcagtgtgccaccc

SEQ ID NO: 1932906 - DNA, 20 bp, Homo sapiens
gtgggtccctgcgtctcctg

SEQ ID NO: 1932907 - DNA, 21 bp, Homo sapiens
gtgggtcttggattggtacca

SEQ ID NO: 1932908 - DNA, 16 bp, Homo sapiens
gtggtcttggagagga

SEQ ID NO: 1932909 - DNA, 15 bp, Homo sapiens
gtgtataccacctgt

SEQ ID NO: 1932910 - DNA, 19 bp, Homo sapiens
gtgtataccacctgtacat

SEQ ID NO: 1932911 - DNA, 20 bp, Homo sapiens
gtgtataccacctgtacata

SEQ ID NO: 1932912 - DNA, 21 bp, Homo sapiens
gtgtctaatgcattaactttt

SEQ ID NO: 1932913 - DNA, 19 bp, Homo sapiens
gtgtctcactctttcttct

SEQ ID NO: 1932914 - DNA, 17 bp, Homo sapiens
gtgtcttttatatttga

SEQ ID NO: 1932915 - DNA, 14 bp, Homo sapiens
gtgtgaatgctgta

SEQ ID NO: 1932916 - DNA, 17 bp, Homo sapiens
gtgtgaatgctgtacct

SEQ ID NO: 1932917 - DNA, 14 bp, Homo sapiens
gtgtgagggcaaac

SEQ ID NO: 1932918 - DNA, 16 bp, Homo sapiens
gtgtgcaccagggttg

SEQ ID NO: 1932919 - DNA, 15 bp, Homo sapiens
gtgtgccacaggctg

SEQ ID NO: 1932920 - DNA, 22 bp, Homo sapiens
gtgtgccaccctctgcagggca

SEQ ID NO: 1932921 - DNA, 12 bp, Homo sapiens
gtgtggagtgga

SEQ ID NO: 1932922 - DNA, 19 bp, Homo sapiens
gtgtggagtggaggggtca

SEQ ID NO: 1932923 - DNA, 13 bp, Homo sapiens
gtgtggccctgca

SEQ ID NO: 1932924 - DNA, 13 bp, Homo sapiens
gtgtggcttggaa

SEQ ID NO: 1932925 - DNA, 13 bp, Homo sapiens
gtgtggggagggt

SEQ ID NO: 1932926 - DNA, 17 bp, Homo sapiens
gtgtggggagggtgggc

SEQ ID NO: 1932927 - DNA, 17 bp, Homo sapiens
gtgtgtaagctgactgg

SEQ ID NO: 1932928 - DNA, 16 bp, Homo sapiens
gtgtgtccccctctgt

SEQ ID NO: 1932929 - DNA, 15 bp, Homo sapiens
gtgtgtttcaggaca

SEQ ID NO: 1932930 - DNA, 14 bp, Homo sapiens
gtgtgttttggtat

SEQ ID NO: 1932931 - DNA, 16 bp, Homo sapiens
gtgttagggaagggcc

SEQ ID NO: 1932932 - DNA, 22 bp, Homo sapiens
gtgttagggaagggcctgccac

SEQ ID NO: 1932933 - DNA, 22 bp, Homo sapiens
gtgttccccttccactgagggc

SEQ ID NO: 1932934 - DNA, 23 bp, Homo sapiens
gtgttcgtggagccacaggcaga

SEQ ID NO: 1932935 - DNA, 23 bp, Homo sapiens
gtgttgtagctaattaggaagct

SEQ ID NO: 1932936 - DNA, 18 bp, Homo sapiens
gtgtttataattgttata

SEQ ID NO: 1932937 - DNA, 17 bp, Homo sapiens
gtgtttcaggacagctg

SEQ ID NO: 1932938 - DNA, 19 bp, Homo sapiens
gtgtttcaggacagctgct

SEQ ID NO: 1932939 - DNA, 13 bp, Homo sapiens
gtgtttgtgtgct

SEQ ID NO: 1932940 - DNA, 14 bp, Homo sapiens
gtgttttattcact

SEQ ID NO: 1932941 - DNA, 15 bp, Homo sapiens
gttaaagctgccggc

SEQ ID NO: 1932942 - DNA, 10 bp, Homo sapiens
gttacctaat

SEQ ID NO: 1932943 - DNA, 21 bp, Homo sapiens
gttactaagatgaaattgcca

SEQ ID NO: 1932944 - DNA, 12 bp, Homo sapiens
gttagtcatttg

SEQ ID NO: 1932945 - DNA, 17 bp, Homo sapiens
gttagtgatttgctatc

SEQ ID NO: 1932946 - DNA, 15 bp, Homo sapiens
ggggacactgaacct

SEQ ID NO: 1932947 - DNA, 16 bp, Homo sapiens
ggggacttggatagga

SEQ ID NO: 1932948 - DNA, 18 bp, Homo sapiens
ggggagactgggctgagg

SEQ ID NO: 1932949 - DNA, 19 bp, Homo sapiens
ggggaggccgaggcagggg

SEQ ID NO: 1932950 - DNA, 19 bp, Homo sapiens
ggggatttcaagggactgg

SEQ ID NO: 1932951 - DNA, 22 bp, Homo sapiens
ggggcaagagctcaggagaagg

SEQ ID NO: 1932952 - DNA, 16 bp, Homo sapiens
ggggcagaccagagag

SEQ ID NO: 1932953 - DNA, 16 bp, Homo sapiens
ggggcagggcctggcc

SEQ ID NO: 1932954 - DNA, 12 bp, Homo sapiens
ggggccagaggc

SEQ ID NO: 1932955 - DNA, 12 bp, Homo sapiens
ggggcctggcct

SEQ ID NO: 1932956 - DNA, 13 bp, Homo sapiens
ggggcctggcctg

SEQ ID NO: 1932957 - DNA, 13 bp, Homo sapiens
ggggcgggaggcc

SEQ ID NO: 1932958 - DNA, 13 bp, Homo sapiens
ggggctgggcaga

SEQ ID NO: 1932959 - DNA, 14 bp, Homo sapiens
ggggctgggcagag

SEQ ID NO: 1932960 - DNA, 13 bp, Homo sapiens
ggggcttggaagg

SEQ ID NO: 1932961 - DNA, 21 bp, Homo sapiens
gggggcaagagctcaggagaa

SEQ ID NO: 1932962 - DNA, 22 bp, Homo sapiens
gggggcaagagctcaggagaag

SEQ ID NO: 1932963 - DNA, 21 bp, Homo sapiens
gggggcagaccagagagctca

SEQ ID NO: 1932964 - DNA, 17 bp, Homo sapiens
gggggccacctccccag

SEQ ID NO: 1932965 - DNA, 21 bp, Homo sapiens
gggggcctgagttgaggggct

SEQ ID NO: 1932966 - DNA, 15 bp, Homo sapiens
ggggtagagaggaca

SEQ ID NO: 1932967 - DNA, 14 bp, Homo sapiens
ggggtctgggaggc

SEQ ID NO: 1932968 - DNA, 15 bp, Homo sapiens
ggggtgggagaggtc

SEQ ID NO: 1932969 - DNA, 19 bp, Homo sapiens
ggggtggggcttggaaggg

SEQ ID NO: 1932970 - DNA, 18 bp, Homo sapiens
ggggttgggttccagaca

SEQ ID NO: 1932971 - DNA, 14 bp, Homo sapiens
gggtaaaaagagaa

SEQ ID NO: 1932972 - DNA, 22 bp, Homo sapiens
gggtactcagtcagcccagtgg

SEQ ID NO: 1932973 - DNA, 15 bp, Homo sapiens
gggtagagaggacag

SEQ ID NO: 1932974 - DNA, 19 bp, Homo sapiens
gggtcagacgcctgaggaa

SEQ ID NO: 1932975 - DNA, 13 bp, Homo sapiens
gggtcaggaagga

SEQ ID NO: 1932976 - DNA, 19 bp, Homo sapiens
gggtcaggaaggatgagca

SEQ ID NO: 1932977 - DNA, 17 bp, Homo sapiens
gggtcaggccacggcag

SEQ ID NO: 1932978 - DNA, 12 bp, Homo sapiens
gggtccatgggc

SEQ ID NO: 1932979 - DNA, 23 bp, Homo sapiens
gggtccctgcgtctcctgcccac

SEQ ID NO: 1932980 - DNA, 18 bp, Homo sapiens
gggtctccaggaggagac

SEQ ID NO: 1932981 - DNA, 15 bp, Homo sapiens
gggtctgggaggcag

SEQ ID NO: 1932982 - DNA, 19 bp, Homo sapiens
gggtcttagggtacagccc

SEQ ID NO: 1932983 - DNA, 23 bp, Homo sapiens
gggtcttagggtacagcccaggc

SEQ ID NO: 1932984 - DNA, 20 bp, Homo sapiens
gggtcttcagggggccaggt

SEQ ID NO: 1932985 - DNA, 18 bp, Homo sapiens
gggtgccaaccacctctg

SEQ ID NO: 1932986 - DNA, 23 bp, Homo sapiens
gggtggatttgggttggaagtga

SEQ ID NO: 1932987 - DNA, 22 bp, Homo sapiens
gggtgggcatcaaagatgagaa

SEQ ID NO: 1932988 - DNA, 17 bp, Homo sapiens
gggtggggcttggaagg

SEQ ID NO: 1932989 - DNA, 17 bp, Homo sapiens
gggtgtcacagaggcag

SEQ ID NO: 1932990 - DNA, 12 bp, Homo sapiens
gggtgtggcttg

SEQ ID NO: 1932991 - DNA, 23 bp, Homo sapiens
gggttccagacagagtggatctg

SEQ ID NO: 1932992 - DNA, 14 bp, Homo sapiens
gggttccagacagg

SEQ ID NO: 1932993 - DNA, 15 bp, Homo sapiens
ggtaaaaagagaagg

SEQ ID NO: 1932994 - DNA, 19 bp, Homo sapiens
ggtactcccccagccctca

SEQ ID NO: 1932995 - DNA, 12 bp, Homo sapiens
ggtagagaggac

SEQ ID NO: 1932996 - DNA, 20 bp, Homo sapiens
ggtagtgccatggccaggag

SEQ ID NO: 1932997 - DNA, 22 bp, Homo sapiens
ggtatatatttaggatttgtgt

SEQ ID NO: 1932998 - DNA, 22 bp, Homo sapiens
ggtcaagttcatagtttctgta

SEQ ID NO: 1932999 - DNA, 21 bp, Homo sapiens
ggtcactgcccacctgccagg

SEQ ID NO: 1933000 - DNA, 16 bp, Homo sapiens
ggtcaggccacggcag

SEQ ID NO: 1933001 - DNA, 21 bp, Homo sapiens
ggtcccgagccccctgtcctt

SEQ ID NO: 1933002 - DNA, 12 bp, Homo sapiens
ggtcctcccagc

SEQ ID NO: 1933003 - DNA, 13 bp, Homo sapiens
ggtcctgttatgt

SEQ ID NO: 1933004 - DNA, 16 bp, Homo sapiens
ggtcctttccttctcg

SEQ ID NO: 1933005 - DNA, 20 bp, Homo sapiens
ggtctaaacaaataataccc

SEQ ID NO: 1933006 - DNA, 11 bp, Homo sapiens
ggtctccaccc

SEQ ID NO: 1933007 - DNA, 15 bp, Homo sapiens
ggtctccacccctca

SEQ ID NO: 1933008 - DNA, 17 bp, Homo sapiens
ggtctccacccctcaag

SEQ ID NO: 1933009 - DNA, 18 bp, Homo sapiens
ggtctccacccctcaagc

SEQ ID NO: 1933010 - DNA, 13 bp, Homo sapiens
ggtctgctcctgg

SEQ ID NO: 1933011 - DNA, 15 bp, Homo sapiens
ggtctggagccccta

SEQ ID NO: 1933012 - DNA, 16 bp, Homo sapiens
ggtctgggaggcaggt

SEQ ID NO: 1933013 - DNA, 20 bp, Homo sapiens
ggtcttagggtacagcccag

SEQ ID NO: 1933014 - DNA, 22 bp, Homo sapiens
ggtcttagggtacagcccaggc

SEQ ID NO: 1933015 - DNA, 19 bp, Homo sapiens
ggtcttcagggggccaggt

SEQ ID NO: 1933016 - DNA, 14 bp, Homo sapiens
ggtcttggagagga

SEQ ID NO: 1933017 - DNA, 16 bp, Homo sapiens
ggtcttggagaggagg

SEQ ID NO: 1933018 - DNA, 22 bp, Homo sapiens
ggtcttggattggtaccagagc

SEQ ID NO: 1933019 - DNA, 20 bp, Homo sapiens
ggtctttgaaatatgcatgt

SEQ ID NO: 1933020 - DNA, 16 bp, Homo sapiens
ggtgagaattaaaata

SEQ ID NO: 1933021 - DNA, 18 bp, Homo sapiens
ggtgaggcgtgggatcca

SEQ ID NO: 1933022 - DNA, 16 bp, Homo sapiens
ggtgatgttttacttt

SEQ ID NO: 1933023 - DNA, 15 bp, Homo sapiens
ggtgattttcctgtg

SEQ ID NO: 1933024 - DNA, 19 bp, Homo sapiens
ggtgcacctgccccaggct

SEQ ID NO: 1933025 - DNA, 23 bp, Homo sapiens
ggtgctacacccttttccagctg

SEQ ID NO: 1933026 - DNA, 13 bp, Homo sapiens
ggtggagggccac

SEQ ID NO: 1933027 - DNA, 20 bp, Homo sapiens
ggtggccactccagacccct

SEQ ID NO: 1933028 - DNA, 21 bp, Homo sapiens
ggtggccactccagacccctg

SEQ ID NO: 1933029 - DNA, 22 bp, Homo sapiens
ggtggccactccagacccctgg

SEQ ID NO: 1933030 - DNA, 23 bp, Homo sapiens
ggtggccactccagacccctggc

SEQ ID NO: 1933031 - DNA, 16 bp, Homo sapiens
ggtggcccgacagcct

SEQ ID NO: 1933032 - DNA, 17 bp, Homo sapiens
ggtggcccgacagcctg

SEQ ID NO: 1933033 - DNA, 18 bp, Homo sapiens
ggtggcccgacagcctgg

SEQ ID NO: 1933034 - DNA, 20 bp, Homo sapiens
ggtggcccgacagcctggca

SEQ ID NO: 1933035 - DNA, 23 bp, Homo sapiens
ggtggcttcggcctgcttcccgg

SEQ ID NO: 1933036 - DNA, 18 bp, Homo sapiens
ggtgggctccagagtagg

SEQ ID NO: 1933037 - DNA, 15 bp, Homo sapiens
ggtggggctgcatcc

SEQ ID NO: 1933038 - DNA, 17 bp, Homo sapiens
ggagtgggctctctgga

SEQ ID NO: 1933039 - DNA, 18 bp, Homo sapiens
ggagtgggtttccctgcg

SEQ ID NO: 1933040 - DNA, 19 bp, Homo sapiens
ggagtgtgtgggggtctgg

SEQ ID NO: 1933041 - DNA, 12 bp, Homo sapiens
ggagtgttcccc

SEQ ID NO: 1933042 - DNA, 20 bp, Homo sapiens
ggagttgatcgcctttccca

SEQ ID NO: 1933043 - DNA, 12 bp, Homo sapiens
ggagttgctcct

SEQ ID NO: 1933044 - DNA, 24 bp, Homo sapiens
ggagttgctcctacccctgtcctg

SEQ ID NO: 1933045 - DNA, 21 bp, Homo sapiens
ggagttggaagtgtgtgatct

SEQ ID NO: 1933046 - DNA, 13 bp, Homo sapiens
ggatccagagaga

SEQ ID NO: 1933047 - DNA, 15 bp, Homo sapiens
ggatccagagagaag

SEQ ID NO: 1933048 - DNA, 18 bp, Homo sapiens
ggatccagccattcctga

SEQ ID NO: 1933049 - DNA, 23 bp, Homo sapiens
ggatgagaatttgagtgctctga

SEQ ID NO: 1933050 - DNA, 13 bp, Homo sapiens
ggatgtttcttct

SEQ ID NO: 1933051 - DNA, 18 bp, Homo sapiens
ggatgtttcttctttgac

SEQ ID NO: 1933052 - DNA, 18 bp, Homo sapiens
ggattggtaccagagcct

SEQ ID NO: 1933053 - DNA, 16 bp, Homo sapiens
ggatttcaagggactg

SEQ ID NO: 1933054 - DNA, 13 bp, Homo sapiens
ggattttgtggct

SEQ ID NO: 1933055 - DNA, 22 bp, Homo sapiens
ggcaaacactttggccacagcc

SEQ ID NO: 1933056 - DNA, 16 bp, Homo sapiens
ggcaaaccaggctgca

SEQ ID NO: 1933057 - DNA, 17 bp, Homo sapiens
ggcaaaccaggctgcag

SEQ ID NO: 1933058 - DNA, 16 bp, Homo sapiens
ggcaaagacagaagcc

SEQ ID NO: 1933059 - DNA, 18 bp, Homo sapiens
ggcaacagggcttctctt

SEQ ID NO: 1933060 - DNA, 20 bp, Homo sapiens
ggcaaccacaggcagcattt

SEQ ID NO: 1933061 - DNA, 18 bp, Homo sapiens
ggcaacttgggaactaga

SEQ ID NO: 1933062 - DNA, 18 bp, Homo sapiens
ggcaagagctcaggagaa

SEQ ID NO: 1933063 - DNA, 21 bp, Homo sapiens
ggcaagagctcaggagaaggc

SEQ ID NO: 1933064 - DNA, 16 bp, Homo sapiens
ggcacagggcagtggg

SEQ ID NO: 1933065 - DNA, 13 bp, Homo sapiens
ggcaccagcagca

SEQ ID NO: 1933066 - DNA, 14 bp, Homo sapiens
ggcactggaaaaca

SEQ ID NO: 1933067 - DNA, 15 bp, Homo sapiens
ggcactgggccggca

SEQ ID NO: 1933068 - DNA, 22 bp, Homo sapiens
ggcactgggccggcagcctggt

SEQ ID NO: 1933069 - DNA, 17 bp, Homo sapiens
ggcagaaggcaaaccca

SEQ ID NO: 1933070 - DNA, 15 bp, Homo sapiens
ggcagaggggagagg

SEQ ID NO: 1933071 - DNA, 16 bp, Homo sapiens
ggcagaggggagagga

SEQ ID NO: 1933072 - DNA, 18 bp, Homo sapiens
ggcagaggggagaggaag

SEQ ID NO: 1933073 - DNA, 21 bp, Homo sapiens
ggcagcaacaaaggatttgaa

SEQ ID NO: 1933074 - DNA, 18 bp, Homo sapiens
ggcagcagggctaccctg

SEQ ID NO: 1933075 - DNA, 19 bp, Homo sapiens
ggcagcagtgtgaggccag

SEQ ID NO: 1933076 - DNA, 20 bp, Homo sapiens
ggcagcagtgtgaggccagg

SEQ ID NO: 1933077 - DNA, 22 bp, Homo sapiens
ggcagcagtgtgaggccagggc

SEQ ID NO: 1933078 - DNA, 13 bp, Homo sapiens
ggcagcccctccc

SEQ ID NO: 1933079 - DNA, 15 bp, Homo sapiens
ggcagcccctcccca

SEQ ID NO: 1933080 - DNA, 18 bp, Homo sapiens
ggcagcctgtgggagaag

SEQ ID NO: 1933081 - DNA, 20 bp, Homo sapiens
ggcagctgaaaagtaaattg

SEQ ID NO: 1933082 - DNA, 19 bp, Homo sapiens
ggcaggacactgcagaaca

SEQ ID NO: 1933083 - DNA, 14 bp, Homo sapiens
ggcaggagggtggc

SEQ ID NO: 1933084 - DNA, 18 bp, Homo sapiens
ggcaggggctgggcagag

SEQ ID NO: 1933085 - DNA, 19 bp, Homo sapiens
ggcaggggttccagcttcc

SEQ ID NO: 1933086 - DNA, 11 bp, Homo sapiens
ggcagtggaga

SEQ ID NO: 1933087 - DNA, 13 bp, Homo sapiens
ggcagtggcagca

SEQ ID NO: 1933088 - DNA, 21 bp, Homo sapiens
ggcagtgggacagggcatggc

SEQ ID NO: 1933089 - DNA, 19 bp, Homo sapiens
ggcagtgttcttgggggtg

SEQ ID NO: 1933090 - DNA, 18 bp, Homo sapiens
ggcatcaaagatgagaag

SEQ ID NO: 1933091 - DNA, 17 bp, Homo sapiens
ggcatgcgaatgagctg

SEQ ID NO: 1933092 - DNA, 20 bp, Homo sapiens
ggcatggcccagcctggagc

SEQ ID NO: 1933093 - DNA, 21 bp, Homo sapiens
ggccaaaggagggtcaggaag

SEQ ID NO: 1933094 - DNA, 12 bp, Homo sapiens
ggccaaatatgc

SEQ ID NO: 1933095 - DNA, 21 bp, Homo sapiens
ggccaagccagggttccagac

SEQ ID NO: 1933096 - DNA, 18 bp, Homo sapiens
ggccacatccaacatttc

SEQ ID NO: 1933097 - DNA, 19 bp, Homo sapiens
ggccacatgggaggctcac

SEQ ID NO: 1933098 - DNA, 20 bp, Homo sapiens
ggccacctccaaggactcta

SEQ ID NO: 1933099 - DNA, 14 bp, Homo sapiens
ggccacgggggagg

SEQ ID NO: 1933100 - DNA, 17 bp, Homo sapiens
ggccactgcagtcaccc

SEQ ID NO: 1933101 - DNA, 21 bp, Homo sapiens
ggccactgcagtcacccctgt

SEQ ID NO: 1933102 - DNA, 22 bp, Homo sapiens
ggccaggcatggcccagcctgg

SEQ ID NO: 1933103 - DNA, 20 bp, Homo sapiens
ggccatctgtaaatatccca

SEQ ID NO: 1933104 - DNA, 22 bp, Homo sapiens
ggccatctgtaaatatcccaga

SEQ ID NO: 1933105 - DNA, 13 bp, Homo sapiens
ggcccagcctgga

SEQ ID NO: 1933106 - DNA, 11 bp, Homo sapiens
ggccccagctc

SEQ ID NO: 1933107 - DNA, 16 bp, Homo sapiens
ggcccccgccctctgc

SEQ ID NO: 1933108 - DNA, 18 bp, Homo sapiens
ggcccccgccctctgccc

SEQ ID NO: 1933109 - DNA, 14 bp, Homo sapiens
ggcccctcctccag

SEQ ID NO: 1933110 - DNA, 15 bp, Homo sapiens
ggcccctcctccaga

SEQ ID NO: 1933111 - DNA, 20 bp, Homo sapiens
ggcccctcctccagagcctg

SEQ ID NO: 1933112 - DNA, 11 bp, Homo sapiens
ggcccctctct

SEQ ID NO: 1933113 - DNA, 16 bp, Homo sapiens
ggccctcgctgccagc

SEQ ID NO: 1933114 - DNA, 19 bp, Homo sapiens
ggccctcgctgccagctct

SEQ ID NO: 1933115 - DNA, 21 bp, Homo sapiens
ggccctcgctgccagctctgt

SEQ ID NO: 1933116 - DNA, 15 bp, Homo sapiens
ggccctgttgtgggg

SEQ ID NO: 1933117 - DNA, 19 bp, Homo sapiens
ggcccttcccacaggacat

SEQ ID NO: 1933118 - DNA, 22 bp, Homo sapiens
ggcccttcctctccactgcctt

SEQ ID NO: 1933119 - DNA, 20 bp, Homo sapiens
ggccggcccacgtcctgggt

SEQ ID NO: 1933120 - DNA, 23 bp, Homo sapiens
ggccgggggtgggggcctgctgt

SEQ ID NO: 1933121 - DNA, 13 bp, Homo sapiens
ggccgtggctgcc

SEQ ID NO: 1933122 - DNA, 19 bp, Homo sapiens
ggcctatgccacctgcagc

SEQ ID NO: 1933123 - DNA, 19 bp, Homo sapiens
ggcctgcagaccctgccag

SEQ ID NO: 1933124 - DNA, 21 bp, Homo sapiens
ggcctgcagaccctgccaggg

SEQ ID NO: 1933125 - DNA, 21 bp, Homo sapiens
ggcctgccccccttcccaccc

SEQ ID NO: 1933126 - DNA, 22 bp, Homo sapiens
ggcctgccccccttcccacccc

SEQ ID NO: 1933127 - DNA, 15 bp, Homo sapiens
ggcctggcagccgtg

SEQ ID NO: 1933128 - DNA, 18 bp, Homo sapiens
ggcctgggagatgcagct

SEQ ID NO: 1933129 - DNA, 18 bp, Homo sapiens
ggcgcctgggtcctccca

SEQ ID NO: 1933130 - DNA, 15 bp, Homo sapiens
ggcgctgagggcagg

SEQ ID NO: 1933131 - DNA, 14 bp, Homo sapiens
ggcggcctgcagac

SEQ ID NO: 1933132 - DNA, 15 bp, Homo sapiens
ggcgggctgatgtct

SEQ ID NO: 1933133 - DNA, 17 bp, Homo sapiens
ggcgtgggatccagaga

SEQ ID NO: 1933134 - DNA, 22 bp, Homo sapiens
ggcgtgggatccagagagaagc

SEQ ID NO: 1933135 - DNA, 24 bp, Homo sapiens
ggctaaccagttctctttgtaagg

SEQ ID NO: 1933136 - DNA, 16 bp, Homo sapiens
ggctaatcaataccct

SEQ ID NO: 1933137 - DNA, 15 bp, Homo sapiens
ggctagatcatgaag

SEQ ID NO: 1933138 - DNA, 15 bp, Homo sapiens
ggctagtctgtgcct

SEQ ID NO: 1933139 - DNA, 13 bp, Homo sapiens
ggctcaggctgcc

SEQ ID NO: 1933140 - DNA, 13 bp, Homo sapiens
ggctccagagggc

SEQ ID NO: 1933141 - DNA, 19 bp, Homo sapiens
ggctcccgctttggggagc

SEQ ID NO: 1933142 - DNA, 18 bp, Homo sapiens
ggctccctgactgggagt

SEQ ID NO: 1933143 - DNA, 21 bp, Homo sapiens
ggctccctgtaacctcttcag

SEQ ID NO: 1933144 - DNA, 14 bp, Homo sapiens
ggctcggcctcttg

SEQ ID NO: 1933145 - DNA, 15 bp, Homo sapiens
ggctctctggacctg

SEQ ID NO: 1933146 - DNA, 21 bp, Homo sapiens
ggctctgaaagctgcttctgg

SEQ ID NO: 1933147 - DNA, 20 bp, Homo sapiens
ggctctgtattctgcaacag

SEQ ID NO: 1933148 - DNA, 14 bp, Homo sapiens
ggctcttctccttt

SEQ ID NO: 1933149 - DNA, 15 bp, Homo sapiens
ggctcttctcctttc

SEQ ID NO: 1933150 - DNA, 23 bp, Homo sapiens
ggctcttctcctttcacaacctt

SEQ ID NO: 1933151 - DNA, 16 bp, Homo sapiens
ggctgagggagcctgg

SEQ ID NO: 1933152 - DNA, 20 bp, Homo sapiens
ggctgatgtcttcttggggg

SEQ ID NO: 1933153 - DNA, 16 bp, Homo sapiens
ggctgcaagctgcagg

SEQ ID NO: 1933154 - DNA, 17 bp, Homo sapiens
ggctgcaagctgcaggg

SEQ ID NO: 1933155 - DNA, 13 bp, Homo sapiens
ggctgcccagcgg

SEQ ID NO: 1933156 - DNA, 19 bp, Homo sapiens
ggctgccctggtgctgcca

SEQ ID NO: 1933157 - DNA, 22 bp, Homo sapiens
ggctgccctggtgctgccacac

SEQ ID NO: 1933158 - DNA, 20 bp, Homo sapiens
ggctgccgctgctctcccag

SEQ ID NO: 1933159 - DNA, 12 bp, Homo sapiens
ggctgctgtcac

SEQ ID NO: 1933160 - DNA, 20 bp, Homo sapiens
ggctggagaggaaaagccag

SEQ ID NO: 1933161 - DNA, 17 bp, Homo sapiens
ggctgttttaacggcct

SEQ ID NO: 1933162 - DNA, 15 bp, Homo sapiens
ggcttccatggtggt

SEQ ID NO: 1933163 - DNA, 21 bp, Homo sapiens
ggcttcccgctcagccctccc

SEQ ID NO: 1933164 - DNA, 11 bp, Homo sapiens
ggcttgctgcc

SEQ ID NO: 1933165 - DNA, 14 bp, Homo sapiens
ggctttgggtagtg

SEQ ID NO: 1933166 - DNA, 20 bp, Homo sapiens
ggctttgggtagtgccatgg

SEQ ID NO: 1933167 - DNA, 13 bp, Homo sapiens
ggcttttcactgc

SEQ ID NO: 1933168 - DNA, 14 bp, Homo sapiens
ggcttttcactgct

SEQ ID NO: 1933169 - DNA, 18 bp, Homo sapiens
ggcttttgaatcaaagaa

SEQ ID NO: 1933170 - DNA, 17 bp, Homo sapiens
gggaaaattatttgcat

SEQ ID NO: 1933171 - DNA, 18 bp, Homo sapiens
gggaaaattatttgcata

SEQ ID NO: 1933172 - DNA, 22 bp, Homo sapiens
gggaattttcattggatgcagt

SEQ ID NO: 1933173 - DNA, 21 bp, Homo sapiens
gggacgcctgggggtgccagg

SEQ ID NO: 1933174 - DNA, 20 bp, Homo sapiens
gtacaagtgctcagttccaa

SEQ ID NO: 1933175 - DNA, 23 bp, Homo sapiens
gtacaagtgctcagttccaatgt

SEQ ID NO: 1933176 - DNA, 14 bp, Homo sapiens
gtacatacattgta

SEQ ID NO: 1933177 - DNA, 16 bp, Homo sapiens
gtacatacattgtata

SEQ ID NO: 1933178 - DNA, 15 bp, Homo sapiens
gtaccagggctctgt

SEQ ID NO: 1933179 - DNA, 21 bp, Homo sapiens
gtacctgcccccactcagcat

SEQ ID NO: 1933180 - DNA, 22 bp, Homo sapiens
gtacctttctgacaataaataa

SEQ ID NO: 1933181 - DNA, 21 bp, Homo sapiens
gtactcagtcagcccagtggg

SEQ ID NO: 1933182 - DNA, 15 bp, Homo sapiens
gtactcccccagccc

SEQ ID NO: 1933183 - DNA, 17 bp, Homo sapiens
gtactcccccagccctc

SEQ ID NO: 1933184 - DNA, 19 bp, Homo sapiens
gtactttcattccctttca

SEQ ID NO: 1933185 - DNA, 15 bp, Homo sapiens
gtagaaactgcaggg

SEQ ID NO: 1933186 - DNA, 13 bp, Homo sapiens
gtagaaggagaca

SEQ ID NO: 1933187 - DNA, 11 bp, Homo sapiens
gtagagaggac

SEQ ID NO: 1933188 - DNA, 21 bp, Homo sapiens
gtagcagggtctttgtgtgct

SEQ ID NO: 1933189 - DNA, 15 bp, Homo sapiens
gtaggaagtaggaag

SEQ ID NO: 1933190 - DNA, 22 bp, Homo sapiens
gtagggtaattagtaacatgtg

SEQ ID NO: 1933191 - DNA, 21 bp, Homo sapiens
gtagggtcaggccacggcagc

SEQ ID NO: 1933192 - DNA, 22 bp, Homo sapiens
gtagggtcaggccacggcagcc

SEQ ID NO: 1933193 - DNA, 17 bp, Homo sapiens
gtagggtgaggcgtggg

SEQ ID NO: 1933194 - DNA, 18 bp, Homo sapiens
gtagtagggtcaggccac

SEQ ID NO: 1933195 - DNA, 16 bp, Homo sapiens
gtagtgccatggccag

SEQ ID NO: 1933196 - DNA, 14 bp, Homo sapiens
gtataccacctgta

SEQ ID NO: 1933197 - DNA, 18 bp, Homo sapiens
gtatagttttacactcta

SEQ ID NO: 1933198 - DNA, 16 bp, Homo sapiens
gtatattcatttcaaa

SEQ ID NO: 1933199 - DNA, 23 bp, Homo sapiens
gtatctgtacctgcccccactca

SEQ ID NO: 1933200 - DNA, 17 bp, Homo sapiens
gtatgaatgatatcttt

SEQ ID NO: 1933201 - DNA, 17 bp, Homo sapiens
gtattcattttgcaact

SEQ ID NO: 1933202 - DNA, 22 bp, Homo sapiens
gtattcgtgcagcatatgagga

SEQ ID NO: 1933203 - DNA, 11 bp, Homo sapiens
gtattctctga

SEQ ID NO: 1933204 - DNA, 13 bp, Homo sapiens
gtatttataaata

SEQ ID NO: 1933205 - DNA, 13 bp, Homo sapiens
gtcaaaaaccaga

SEQ ID NO: 1933206 - DNA, 15 bp, Homo sapiens
gtcaaacgtgaaaat

SEQ ID NO: 1933207 - DNA, 17 bp, Homo sapiens
gtcaaacgtgaaaatgc

SEQ ID NO: 1933208 - DNA, 19 bp, Homo sapiens
gtcaaatatatttaactat

SEQ ID NO: 1933209 - DNA, 21 bp, Homo sapiens
gtcaacaagtatgaataaaga

SEQ ID NO: 1933210 - DNA, 19 bp, Homo sapiens
gtcaacctgggcaaagcct

SEQ ID NO: 1933211 - DNA, 21 bp, Homo sapiens
gtcaagttcatagtttctgta

SEQ ID NO: 1933212 - DNA, 22 bp, Homo sapiens
gtcaataattgtggagaggaga

SEQ ID NO: 1933213 - DNA, 12 bp, Homo sapiens
gtcacagaggca

SEQ ID NO: 1933214 - DNA, 15 bp, Homo sapiens
gtcacagaggcagtg

SEQ ID NO: 1933215 - DNA, 19 bp, Homo sapiens
gtcacagaggcagtggcag

SEQ ID NO: 1933216 - DNA, 22 bp, Homo sapiens
gtcacaggacgatttcactgac

SEQ ID NO: 1933217 - DNA, 18 bp, Homo sapiens
gtcacagggcctggggag

SEQ ID NO: 1933218 - DNA, 15 bp, Homo sapiens
gtcactgcccacctg

SEQ ID NO: 1933219 - DNA, 18 bp, Homo sapiens
gtcactgcccacctgcca

SEQ ID NO: 1933220 - DNA, 17 bp, Homo sapiens
gtcagagaggagtcaga

SEQ ID NO: 1933221 - DNA, 19 bp, Homo sapiens
gtcagagaggagtcagaga

SEQ ID NO: 1933222 - DNA, 21 bp, Homo sapiens
gtcagagaggagtcagagaga

SEQ ID NO: 1933223 - DNA, 14 bp, Homo sapiens
gtcagagcccagga

SEQ ID NO: 1933224 - DNA, 13 bp, Homo sapiens
gtcagcaggaagc

SEQ ID NO: 1933225 - DNA, 13 bp, Homo sapiens
gtcagccctaggg

SEQ ID NO: 1933226 - DNA, 15 bp, Homo sapiens
gtcaggggccgggca

SEQ ID NO: 1933227 - DNA, 19 bp, Homo sapiens
gtcagtgaagcccaggagg

SEQ ID NO: 1933228 - DNA, 21 bp, Homo sapiens
gtcagtgaagcccaggaggac

SEQ ID NO: 1933229 - DNA, 16 bp, Homo sapiens
gtcataccaatgaaaa

SEQ ID NO: 1933230 - DNA, 16 bp, Homo sapiens
gtcatgacatttctca

SEQ ID NO: 1933231 - DNA, 18 bp, Homo sapiens
gtccaacgtggggcagca

SEQ ID NO: 1933232 - DNA, 17 bp, Homo sapiens
gtccaatcctatgtttt

SEQ ID NO: 1933233 - DNA, 12 bp, Homo sapiens
gtccacattcta

SEQ ID NO: 1933234 - DNA, 20 bp, Homo sapiens
gtccacattctacttcagct

SEQ ID NO: 1933235 - DNA, 16 bp, Homo sapiens
gtccacgactgtctcc

SEQ ID NO: 1933236 - DNA, 20 bp, Homo sapiens
gtccatgaaaaacagcagag

SEQ ID NO: 1933237 - DNA, 23 bp, Homo sapiens
gtccatgggcagagcccaaggga

SEQ ID NO: 1933238 - DNA, 13 bp, Homo sapiens
gtccccctctgtc

SEQ ID NO: 1933239 - DNA, 19 bp, Homo sapiens
gtccccctctgtccaggca

SEQ ID NO: 1933240 - DNA, 15 bp, Homo sapiens
gtcccgagccccctg

SEQ ID NO: 1933241 - DNA, 22 bp, Homo sapiens
gtcccgggtactcagtcagccc

SEQ ID NO: 1933242 - DNA, 19 bp, Homo sapiens
gtccctccacgttcacccc

SEQ ID NO: 1933243 - DNA, 14 bp, Homo sapiens
gtcctcattcttct

SEQ ID NO: 1933244 - DNA, 12 bp, Homo sapiens
gtcctcctctgt

SEQ ID NO: 1933245 - DNA, 14 bp, Homo sapiens
gtcctcctctgtga

SEQ ID NO: 1933246 - DNA, 17 bp, Homo sapiens
gtcctgatcagagccgt

SEQ ID NO: 1933247 - DNA, 17 bp, Homo sapiens
gtcctggcccgggagcc

SEQ ID NO: 1933248 - DNA, 15 bp, Homo sapiens
gtcctggggctgggt

SEQ ID NO: 1933249 - DNA, 19 bp, Homo sapiens
gtccttcccacggccactg

SEQ ID NO: 1933250 - DNA, 18 bp, Homo sapiens
gtccttctctcacctcct

SEQ ID NO: 1933251 - DNA, 19 bp, Homo sapiens
gtccttctctcacctccta

SEQ ID NO: 1933252 - DNA, 22 bp, Homo sapiens
gtccttggtggccgggggtggg

SEQ ID NO: 1933253 - DNA, 14 bp, Homo sapiens
gtcctttccttctc

SEQ ID NO: 1933254 - DNA, 14 bp, Homo sapiens
gtcgatagagctgt

SEQ ID NO: 1933255 - DNA, 12 bp, Homo sapiens
gtcggaatggta

SEQ ID NO: 1933256 - DNA, 17 bp, Homo sapiens
gtctcaagagggcactg

SEQ ID NO: 1933257 - DNA, 22 bp, Homo sapiens
gtctcaagagggcactggtggc

SEQ ID NO: 1933258 - DNA, 14 bp, Homo sapiens
gtctccacccctca

SEQ ID NO: 1933259 - DNA, 15 bp, Homo sapiens
gtctccctggcccca

SEQ ID NO: 1933260 - DNA, 17 bp, Homo sapiens
gtctcctctccagccct

SEQ ID NO: 1933261 - DNA, 13 bp, Homo sapiens
gtctcctgcccac

SEQ ID NO: 1933262 - DNA, 14 bp, Homo sapiens
gtctcttctccact

SEQ ID NO: 1933263 - DNA, 16 bp, Homo sapiens
gtctctttttcttcct

SEQ ID NO: 1933264 - DNA, 14 bp, Homo sapiens
gtctgaaggagagg

SEQ ID NO: 1933265 - DNA, 16 bp, Homo sapiens
gtctgaagtcactgca

SEQ ID NO: 1933266 - DNA, 17 bp, Homo sapiens
gtctgaagtcactgcac

SEQ ID NO: 1933267 - DNA, 24 bp, Homo sapiens
gtctgagccctgccctcactccac

SEQ ID NO: 1933268 - DNA, 19 bp, Homo sapiens
gtctgagcggccgcctgtc

SEQ ID NO: 1933269 - DNA, 20 bp, Homo sapiens
gtctgcctgcctcatgctct

SEQ ID NO: 1933270 - DNA, 17 bp, Homo sapiens
gtctgcgccgctgtgct

SEQ ID NO: 1933271 - DNA, 14 bp, Homo sapiens
gtctgctcctggga

SEQ ID NO: 1933272 - DNA, 24 bp, Homo sapiens
gtctggagcccctatcctgcaccc

SEQ ID NO: 1933273 - DNA, 14 bp, Homo sapiens
gtctggctgtggcc

SEQ ID NO: 1933274 - DNA, 20 bp, Homo sapiens
tcttgttttgttatataaaa

SEQ ID NO: 1933275 - DNA, 21 bp, Homo sapiens
tcttgttttttttttccactt

SEQ ID NO: 1933276 - DNA, 23 bp, Homo sapiens
tctttaaagaggagcctttccag

SEQ ID NO: 1933277 - DNA, 19 bp, Homo sapiens
tctttatttctgtctcata

SEQ ID NO: 1933278 - DNA, 20 bp, Homo sapiens
tctttcaaaaccttttgaaa

SEQ ID NO: 1933279 - DNA, 21 bp, Homo sapiens
tctttcaaaaccttttgaaat

SEQ ID NO: 1933280 - DNA, 20 bp, Homo sapiens
tctttccattggatctcatt

SEQ ID NO: 1933281 - DNA, 19 bp, Homo sapiens
tctttgaaatatgcatgta

SEQ ID NO: 1933282 - DNA, 21 bp, Homo sapiens
tctttgaaatatgcatgtact

SEQ ID NO: 1933283 - DNA, 22 bp, Homo sapiens
tctttgaaatatgcatgtactt

SEQ ID NO: 1933284 - DNA, 14 bp, Homo sapiens
tctttgacctcaat

SEQ ID NO: 1933285 - DNA, 18 bp, Homo sapiens
tctttgactataacaaaa

SEQ ID NO: 1933286 - DNA, 17 bp, Homo sapiens
tctttgagtcaagtcaa

SEQ ID NO: 1933287 - DNA, 14 bp, Homo sapiens
tctttgtgtgctgt

SEQ ID NO: 1933288 - DNA, 13 bp, Homo sapiens
tcttttcatctca

SEQ ID NO: 1933289 - DNA, 18 bp, Homo sapiens
tgaaaaaatgtatatgca

SEQ ID NO: 1933290 - DNA, 17 bp, Homo sapiens
tgaaaagacatcaagca

SEQ ID NO: 1933291 - DNA, 18 bp, Homo sapiens
tgaaaagacatcaagcac

SEQ ID NO: 1933292 - DNA, 16 bp, Homo sapiens
tgaaaatgtcttgtgt

SEQ ID NO: 1933293 - DNA, 20 bp, Homo sapiens
ttggtgtgttcgtggagcca

SEQ ID NO: 1933294 - DNA, 20 bp, Homo sapiens
ttgtaaactttttcaatggt

SEQ ID NO: 1933295 - DNA, 13 bp, Homo sapiens
ttgtaactttgca

SEQ ID NO: 1933296 - DNA, 15 bp, Homo sapiens
ttgtaactttgcatg

SEQ ID NO: 1933297 - DNA, 14 bp, Homo sapiens
ttgtaaggtactga

SEQ ID NO: 1933298 - DNA, 17 bp, Homo sapiens
ttgtaattctaaatgaa

SEQ ID NO: 1933299 - DNA, 15 bp, Homo sapiens
ttgtagggtgaggcg

SEQ ID NO: 1933300 - DNA, 18 bp, Homo sapiens
ttgtataggccatctgta

SEQ ID NO: 1933301 - DNA, 22 bp, Homo sapiens
ttgtataggccatctgtaaata

SEQ ID NO: 1933302 - DNA, 14 bp, Homo sapiens
ttgtatataaatgg

SEQ ID NO: 1933303 - DNA, 16 bp, Homo sapiens
ttgtattctctgagct

SEQ ID NO: 1933304 - DNA, 22 bp, Homo sapiens
ttgtattctctgagctgtgcag

SEQ ID NO: 1933305 - DNA, 16 bp, Homo sapiens
ttgtcacaacactgaa

SEQ ID NO: 1933306 - DNA, 16 bp, Homo sapiens
ttgtcactcggctttg

SEQ ID NO: 1933307 - DNA, 13 bp, Homo sapiens
ttgtccacacaag

SEQ ID NO: 1933308 - DNA, 14 bp, Homo sapiens
ttgtccacattcta

SEQ ID NO: 1933309 - DNA, 21 bp, Homo sapiens
ttgtccacattctacttcagc

SEQ ID NO: 1933310 - DNA, 13 bp, Homo sapiens
ttgtccattgtcc

SEQ ID NO: 1933311 - DNA, 17 bp, Homo sapiens
ttgtcccggataggcta

SEQ ID NO: 1933312 - DNA, 18 bp, Homo sapiens
ttgtctgaagtcactgca

SEQ ID NO: 1933313 - DNA, 20 bp, Homo sapiens
ttgtctgccgtgagagccca

SEQ ID NO: 1933314 - DNA, 20 bp, Homo sapiens
ttgtctggctgtggcccctc

SEQ ID NO: 1933315 - DNA, 17 bp, Homo sapiens
ttgtgcctcttgggaga

SEQ ID NO: 1933316 - DNA, 18 bp, Homo sapiens
ttgtgcctcttgggagac

SEQ ID NO: 1933317 - DNA, 19 bp, Homo sapiens
ttgtggatactattaaagt

SEQ ID NO: 1933318 - DNA, 15 bp, Homo sapiens
ttgtgtctgcctgcc

SEQ ID NO: 1933319 - DNA, 12 bp, Homo sapiens
ttgtgtctgttg

SEQ ID NO: 1933320 - DNA, 22 bp, Homo sapiens
ttgtgtgagggcaaaccaggct

SEQ ID NO: 1933321 - DNA, 18 bp, Homo sapiens
ttgtgtgctgttgtttaa

SEQ ID NO: 1933322 - DNA, 19 bp, Homo sapiens
ttgtgttactaatttgtat

SEQ ID NO: 1933323 - DNA, 23 bp, Homo sapiens
ttgttaatatatataatacttaa

SEQ ID NO: 1933324 - DNA, 17 bp, Homo sapiens
ttgttaggggtggggga

SEQ ID NO: 1933325 - DNA, 17 bp, Homo sapiens
ttgttagtgatttgcta

SEQ ID NO: 1933326 - DNA, 20 bp, Homo sapiens
ttgttcaaagaacccccctc

SEQ ID NO: 1933327 - DNA, 19 bp, Homo sapiens
ttgtttaaaataaaagtac

SEQ ID NO: 1933328 - DNA, 16 bp, Homo sapiens
ttgtttgatgtgtatg

SEQ ID NO: 1933329 - DNA, 15 bp, Homo sapiens
tttaaaaattcactt

SEQ ID NO: 1933330 - DNA, 22 bp, Homo sapiens
tttaaaaattcacttctatata

SEQ ID NO: 1933331 - DNA, 16 bp, Homo sapiens
tttaaaataaaagtac

SEQ ID NO: 1933332 - DNA, 21 bp, Homo sapiens
tttaaataaaaataagtcatt

SEQ ID NO: 1933333 - DNA, 14 bp, Homo sapiens
tttaactgccttgt

SEQ ID NO: 1933334 - DNA, 14 bp, Homo sapiens
tttaagataattat

SEQ ID NO: 1933335 - DNA, 20 bp, Homo sapiens
tttaagcccatcaattatag

SEQ ID NO: 1933336 - DNA, 21 bp, Homo sapiens
tttaatgatactgtctaagaa

SEQ ID NO: 1933337 - DNA, 23 bp, Homo sapiens
tttaattattattcttcataaca

SEQ ID NO: 1933338 - DNA, 18 bp, Homo sapiens
tttacatgaattgcattt

SEQ ID NO: 1933339 - DNA, 17 bp, Homo sapiens
tttacattttgtgcagt

SEQ ID NO: 1933340 - DNA, 13 bp, Homo sapiens
tttaccctccctg

SEQ ID NO: 1933341 - DNA, 11 bp, Homo sapiens
tttagaaatga

SEQ ID NO: 1933342 - DNA, 17 bp, Homo sapiens
tttagagatattttcca

SEQ ID NO: 1933343 - DNA, 13 bp, Homo sapiens
tttaggtgtcttt

SEQ ID NO: 1933344 - DNA, 19 bp, Homo sapiens
tttatattacttttgtaaa

SEQ ID NO: 1933345 - DNA, 15 bp, Homo sapiens
tttatattttctata

SEQ ID NO: 1933346 - DNA, 20 bp, Homo sapiens
tttatccagatgaactgaga

SEQ ID NO: 1933347 - DNA, 15 bp, Homo sapiens
tttatccttaagaat

SEQ ID NO: 1933348 - DNA, 18 bp, Homo sapiens
tttattaacatatattgt

SEQ ID NO: 1933349 - DNA, 12 bp, Homo sapiens
tttatttttcat

SEQ ID NO: 1933350 - DNA, 18 bp, Homo sapiens
tttcaaaaccttttgaaa

SEQ ID NO: 1933351 - DNA, 23 bp, Homo sapiens
tttcaatggttgggacaatggca

SEQ ID NO: 1933352 - DNA, 18 bp, Homo sapiens
tttcaattgcatctccca

SEQ ID NO: 1933353 - DNA, 19 bp, Homo sapiens
tttcactgaagtgaataca

SEQ ID NO: 1933354 - DNA, 21 bp, Homo sapiens
tttcactgaagtgaatacatg

SEQ ID NO: 1933355 - DNA, 14 bp, Homo sapiens
tttcactgctggct

SEQ ID NO: 1933356 - DNA, 24 bp, Homo sapiens
tttcactgctggctgccttagaac

SEQ ID NO: 1933357 - DNA, 22 bp, Homo sapiens
tttcagaaagggcagcccctcc

SEQ ID NO: 1933358 - DNA, 21 bp, Homo sapiens
tttcaggacagctgcttctgt

SEQ ID NO: 1933359 - DNA, 21 bp, Homo sapiens
tttcagtggggcagtcattat

SEQ ID NO: 1933360 - DNA, 14 bp, Homo sapiens
tttcataagtattt

SEQ ID NO: 1933361 - DNA, 17 bp, Homo sapiens
tttcataagtatttcaa

SEQ ID NO: 1933362 - DNA, 18 bp, Homo sapiens
tttcataagtatttcaaa

SEQ ID NO: 1933363 - DNA, 22 bp, Homo sapiens
tttcatctcattaattcaatta

SEQ ID NO: 1933364 - DNA, 19 bp, Homo sapiens
tttcatctttccaaattga

SEQ ID NO: 1933365 - DNA, 23 bp, Homo sapiens
tttcatgatttgcaactttagaa

SEQ ID NO: 1933366 - DNA, 12 bp, Homo sapiens
tttcatgtaagt

SEQ ID NO: 1933367 - DNA, 15 bp, Homo sapiens
tttcattggatgcag

SEQ ID NO: 1933368 - DNA, 14 bp, Homo sapiens
tttcatttcaactg

SEQ ID NO: 1933369 - DNA, 23 bp, Homo sapiens
tttccaagcctgggccactggca

SEQ ID NO: 1933370 - DNA, 21 bp, Homo sapiens
tttccagaactaccaaaatga

SEQ ID NO: 1933371 - DNA, 20 bp, Homo sapiens
tttccagccgtgttgtagct

SEQ ID NO: 1933372 - DNA, 20 bp, Homo sapiens
tttcccgtataataaaacca

SEQ ID NO: 1933373 - DNA, 15 bp, Homo sapiens
tttccctgcatccct

SEQ ID NO: 1933374 - DNA, 18 bp, Homo sapiens
tttcccttgtgtgagggc

SEQ ID NO: 1933375 - DNA, 21 bp, Homo sapiens
tttcctaataaagttctgtac

SEQ ID NO: 1933376 - DNA, 24 bp, Homo sapiens
tttcctaataaagttctgtactca

SEQ ID NO: 1933377 - DNA, 20 bp, Homo sapiens
tttcctctaattaaaatgtg

SEQ ID NO: 1933378 - DNA, 13 bp, Homo sapiens
tttccttctcgtc

SEQ ID NO: 1933379 - DNA, 20 bp, Homo sapiens
tttccttctcgtcttcctct

SEQ ID NO: 1933380 - DNA, 18 bp, Homo sapiens
tttctactttgaagtcat

SEQ ID NO: 1933381 - DNA, 15 bp, Homo sapiens
tttctatatttgtaa

SEQ ID NO: 1933382 - DNA, 17 bp, Homo sapiens
tttctatatttgtaact

SEQ ID NO: 1933383 - DNA, 15 bp, Homo sapiens
tttctatgtaaatta

SEQ ID NO: 1933384 - DNA, 21 bp, Homo sapiens
tttctatgtaaattattgtaa

SEQ ID NO: 1933385 - DNA, 22 bp, Homo sapiens
tttctatgtaaattattgtaaa

SEQ ID NO: 1933386 - DNA, 17 bp, Homo sapiens
tttctatttctcctcca

SEQ ID NO: 1933387 - DNA, 14 bp, Homo sapiens
tttctcaaagtttt

SEQ ID NO: 1933388 - DNA, 22 bp, Homo sapiens
tttctcaaagtttttacagtgt

SEQ ID NO: 1933389 - DNA, 12 bp, Homo sapiens
tttctctgtaaa

SEQ ID NO: 1933390 - DNA, 23 bp, Homo sapiens
tttctgatctgatgcaagcaaga

SEQ ID NO: 1933391 - DNA, 16 bp, Homo sapiens
tttctgggataagtaa

SEQ ID NO: 1933392 - DNA, 17 bp, Homo sapiens
tttctttaaataaaaat

SEQ ID NO: 1933393 - DNA, 15 bp, Homo sapiens
tttctttaaatcatt

SEQ ID NO: 1933394 - DNA, 15 bp, Homo sapiens
tttctttatttctgt

SEQ ID NO: 1933395 - DNA, 15 bp, Homo sapiens
tttctttccttaaaa

SEQ ID NO: 1933396 - DNA, 17 bp, Homo sapiens
tttgaatcaaagaatag

SEQ ID NO: 1933397 - DNA, 21 bp, Homo sapiens
tttgagaaacaacaatttcta

SEQ ID NO: 1933398 - DNA, 17 bp, Homo sapiens
tttgaggaccctcccag

SEQ ID NO: 1933399 - DNA, 13 bp, Homo sapiens
tttgatgtgtatg

SEQ ID NO: 1933400 - DNA, 21 bp, Homo sapiens
tttgcaagggaaaagtctctt

SEQ ID NO: 1933401 - DNA, 16 bp, Homo sapiens
tttgcataacaattcc

SEQ ID NO: 1933402 - DNA, 12 bp, Homo sapiens
tttgcatgttct

SEQ ID NO: 1933403 - DNA, 22 bp, Homo sapiens
tttgcatgttcttgttttgtta

SEQ ID NO: 1933404 - DNA, 15 bp, Homo sapiens
tttgccagtgggaac

SEQ ID NO: 1933405 - DNA, 20 bp, Homo sapiens
tttggtaaaatacttcttga

SEQ ID NO: 1933406 - DNA, 16 bp, Homo sapiens
tttgtatgcactttgt

SEQ ID NO: 1933407 - DNA, 16 bp, Homo sapiens
tttgtattctctgagc

SEQ ID NO: 1933408 - DNA, 16 bp, Homo sapiens
tttgtctggctgtggc

SEQ ID NO: 1933409 - DNA, 13 bp, Homo sapiens
tttgtgagtattc

SEQ ID NO: 1933410 - DNA, 15 bp, Homo sapiens
tttgtgtctgcctgc

SEQ ID NO: 1933411 - DNA, 13 bp, Homo sapiens
tttgttaatatat

SEQ ID NO: 1933412 - DNA, 22 bp, Homo sapiens
tttgttaatatatataatactt

SEQ ID NO: 1933413 - DNA, 15 bp, Homo sapiens
tttgttattttgcaa

SEQ ID NO: 1933414 - DNA, 12 bp, Homo sapiens
tttgttttgcac

SEQ ID NO: 1933415 - DNA, 13 bp, Homo sapiens
ttttaaaacccag

SEQ ID NO: 1933416 - DNA, 12 bp, Homo sapiens
ttttaatatcct

SEQ ID NO: 1933417 - DNA, 17 bp, Homo sapiens
ttttaattattattctt

SEQ ID NO: 1933418 - DNA, 22 bp, Homo sapiens
ttttaccattttgcgatgtgtt

SEQ ID NO: 1933419 - DNA, 15 bp, Homo sapiens
ttttagaaaatgttt

SEQ ID NO: 1933420 - DNA, 20 bp, Homo sapiens
ttttatattacttttgtaaa

SEQ ID NO: 1933421 - DNA, 21 bp, Homo sapiens
ttttatattacttttgtaaat

SEQ ID NO: 1933422 - DNA, 19 bp, Homo sapiens
ttttatcattttcaaaatg

SEQ ID NO: 1933423 - DNA, 18 bp, Homo sapiens
ttttatgttttattagca

SEQ ID NO: 1933424 - DNA, 20 bp, Homo sapiens
ttttattagcattttcaaga

SEQ ID NO: 1933425 - DNA, 23 bp, Homo sapiens
ccacctctggccaaatatgcact

SEQ ID NO: 1933426 - DNA, 18 bp, Homo sapiens
ccacctctggccctgttg

SEQ ID NO: 1933427 - DNA, 16 bp, Homo sapiens
ccacctgcagcccttt

SEQ ID NO: 1933428 - DNA, 18 bp, Homo sapiens
ccacctgccaggctgcag

SEQ ID NO: 1933429 - DNA, 21 bp, Homo sapiens
ccacctgccaggctgcaggga

SEQ ID NO: 1933430 - DNA, 21 bp, Homo sapiens
ccaccttgcactattggactt

SEQ ID NO: 1933431 - DNA, 17 bp, Homo sapiens
ccacggccactgcagtc

SEQ ID NO: 1933432 - DNA, 13 bp, Homo sapiens
ccacgggggaggc

SEQ ID NO: 1933433 - DNA, 16 bp, Homo sapiens
ccacgtgctggagagt

SEQ ID NO: 1933434 - DNA, 19 bp, Homo sapiens
ccactccagacccctggct

SEQ ID NO: 1933435 - DNA, 13 bp, Homo sapiens
ccactcccctcat

SEQ ID NO: 1933436 - DNA, 11 bp, Homo sapiens
ccactcctccc

SEQ ID NO: 1933437 - DNA, 14 bp, Homo sapiens
ccactcctctgact

SEQ ID NO: 1933438 - DNA, 20 bp, Homo sapiens
ccactcctctgactcagggc

SEQ ID NO: 1933439 - DNA, 13 bp, Homo sapiens
ccactgagggcag

SEQ ID NO: 1933440 - DNA, 20 bp, Homo sapiens
ccactgcagtcacccctgtc

SEQ ID NO: 1933441 - DNA, 22 bp, Homo sapiens
ccactgcagtcacccctgtctg

SEQ ID NO: 1933442 - DNA, 23 bp, Homo sapiens
ccactgcagtcacccctgtctgc

SEQ ID NO: 1933443 - DNA, 21 bp, Homo sapiens
ccactgccttcgatacaccgg

SEQ ID NO: 1933444 - DNA, 14 bp, Homo sapiens
ccactggcatctct

SEQ ID NO: 1933445 - DNA, 13 bp, Homo sapiens
ccacttaaaatgt

SEQ ID NO: 1933446 - DNA, 21 bp, Homo sapiens
ccacttagaaattgcatttcc

SEQ ID NO: 1933447 - DNA, 13 bp, Homo sapiens
ccacttatttcta

SEQ ID NO: 1933448 - DNA, 14 bp, Homo sapiens
ccacttatttctaa

SEQ ID NO: 1933449 - DNA, 17 bp, Homo sapiens
ccacttcaagtgaccac

SEQ ID NO: 1933450 - DNA, 18 bp, Homo sapiens
ccactttgcagacctggg

SEQ ID NO: 1933451 - DNA, 19 bp, Homo sapiens
ccagacagagtggatctgg

SEQ ID NO: 1933452 - DNA, 17 bp, Homo sapiens
ccagacagggtggggct

SEQ ID NO: 1933453 - DNA, 20 bp, Homo sapiens
ccagacccctaccctttccc

SEQ ID NO: 1933454 - DNA, 15 bp, Homo sapiens
ccagacccctggctt

SEQ ID NO: 1933455 - DNA, 20 bp, Homo sapiens
ccagacgcggaaaccgggtg

SEQ ID NO: 1933456 - DNA, 15 bp, Homo sapiens
ccagagcctgggcgc

SEQ ID NO: 1933457 - DNA, 23 bp, Homo sapiens
ccagatgaactgagaaggtcaga

SEQ ID NO: 1933458 - DNA, 18 bp, Homo sapiens
ccagatgccttctccaga

SEQ ID NO: 1933459 - DNA, 15 bp, Homo sapiens
ccagcactgcttgag

SEQ ID NO: 1933460 - DNA, 12 bp, Homo sapiens
ccagcagcagaa

SEQ ID NO: 1933461 - DNA, 16 bp, Homo sapiens
ccagccacccagccag

SEQ ID NO: 1933462 - DNA, 14 bp, Homo sapiens
ccagccaggagggg

SEQ ID NO: 1933463 - DNA, 13 bp, Homo sapiens
ccagccattcctg

SEQ ID NO: 1933464 - DNA, 13 bp, Homo sapiens
ccagcccagcctg

SEQ ID NO: 1933465 - DNA, 18 bp, Homo sapiens
ccagcctggccccaagca

SEQ ID NO: 1933466 - DNA, 13 bp, Homo sapiens
ccagcgtcctcct

SEQ ID NO: 1933467 - DNA, 17 bp, Homo sapiens
ccagcgtcctcctctgt

SEQ ID NO: 1933468 - DNA, 21 bp, Homo sapiens
ccagctgaaatactgaggggt

SEQ ID NO: 1933469 - DNA, 17 bp, Homo sapiens
ccagctgctcctcgcag

SEQ ID NO: 1933470 - DNA, 20 bp, Homo sapiens
ccagctgctcctcgcagttc

SEQ ID NO: 1933471 - DNA, 14 bp, Homo sapiens
aaaaaccagaatta

SEQ ID NO: 1933472 - DNA, 16 bp, Homo sapiens
aaaaatgtatatgcac

SEQ ID NO: 1933473 - DNA, 20 bp, Homo sapiens
aaaacaatatatgtaaatta

SEQ ID NO: 1933474 - DNA, 17 bp, Homo sapiens
aaaacacctaagtgact

SEQ ID NO: 1933475 - DNA, 13 bp, Homo sapiens
aaaacactgtgca

SEQ ID NO: 1933476 - DNA, 19 bp, Homo sapiens
aaaaccaagccgtggcttc

SEQ ID NO: 1933477 - DNA, 13 bp, Homo sapiens
aaaaccagaatta

SEQ ID NO: 1933478 - DNA, 18 bp, Homo sapiens
aaaacgggttactaagat

SEQ ID NO: 1933479 - DNA, 20 bp, Homo sapiens
aaaacgggttactaagatga

SEQ ID NO: 1933480 - DNA, 21 bp, Homo sapiens
aaaacgggttactaagatgaa

SEQ ID NO: 1933481 - DNA, 18 bp, Homo sapiens
aaaacggttaaaactgtc

SEQ ID NO: 1933482 - DNA, 12 bp, Homo sapiens
aaaagagaaggc

SEQ ID NO: 1933483 - DNA, 16 bp, Homo sapiens
aaaagcaactccatca

SEQ ID NO: 1933484 - DNA, 23 bp, Homo sapiens
aaaagggggctattccctggaga

SEQ ID NO: 1933485 - DNA, 12 bp, Homo sapiens
aaaataaaagta

SEQ ID NO: 1933486 - DNA, 23 bp, Homo sapiens
aaaatagcaacctttttatctcc

SEQ ID NO: 1933487 - DNA, 20 bp, Homo sapiens
aaaatatttctatgtaaatt

SEQ ID NO: 1933488 - DNA, 21 bp, Homo sapiens
aaaatcacagattttttcttt

SEQ ID NO: 1933489 - DNA, 22 bp, Homo sapiens
aaaatcatgcttataagcaaca

SEQ ID NO: 1933490 - DNA, 21 bp, Homo sapiens
aaaatctggggaggacaaagg

SEQ ID NO: 1933491 - DNA, 20 bp, Homo sapiens
aaaatctgtcacgtagaact

SEQ ID NO: 1933492 - DNA, 15 bp, Homo sapiens
aaaattaatatcaca

SEQ ID NO: 1933493 - DNA, 21 bp, Homo sapiens
aaaattacagaagaagctcct

SEQ ID NO: 1933494 - DNA, 20 bp, Homo sapiens
aaaattattccctgaattgt

SEQ ID NO: 1933495 - DNA, 13 bp, Homo sapiens
aaaattgtgatca

SEQ ID NO: 1933496 - DNA, 19 bp, Homo sapiens
aaacaaaaattaaaatcct

SEQ ID NO: 1933497 - DNA, 11 bp, Homo sapiens
aaacacacaca

SEQ ID NO: 1933498 - DNA, 19 bp, Homo sapiens
aaacacctaagtgactacc

SEQ ID NO: 1933499 - DNA, 22 bp, Homo sapiens
aaacacctaagtgactaccact

SEQ ID NO: 1933500 - DNA, 15 bp, Homo sapiens
aaacacgtttagaaa

SEQ ID NO: 1933501 - DNA, 20 bp, Homo sapiens
aaacagtaactaagcacatt

SEQ ID NO: 1933502 - DNA, 12 bp, Homo sapiens
aaaccagaagca

SEQ ID NO: 1933503 - DNA, 22 bp, Homo sapiens
aaaccagaatgattttgacata

SEQ ID NO: 1933504 - DNA, 18 bp, Homo sapiens
acgggggttggggtgggg

SEQ ID NO: 1933505 - DNA, 17 bp, Homo sapiens
acgtattgtgaaatttg

SEQ ID NO: 1933506 - DNA, 18 bp, Homo sapiens
acgtccacccgtttccaa

SEQ ID NO: 1933507 - DNA, 22 bp, Homo sapiens
acgtccctccacgttcacccct

SEQ ID NO: 1933508 - DNA, 12 bp, Homo sapiens
acgtcctgggtg

SEQ ID NO: 1933509 - DNA, 19 bp, Homo sapiens
acgtcctgggtgctgtcat

SEQ ID NO: 1933510 - DNA, 13 bp, Homo sapiens
acgtgctggagag

SEQ ID NO: 1933511 - DNA, 17 bp, Homo sapiens
acgtggccgctgcccac

SEQ ID NO: 1933512 - DNA, 20 bp, Homo sapiens
acgtggccgctgctgtgaca

SEQ ID NO: 1933513 - DNA, 22 bp, Homo sapiens
acgtggccgctgctgtgacagg

SEQ ID NO: 1933514 - DNA, 19 bp, Homo sapiens
acgtggggcagcacagaga

SEQ ID NO: 1933515 - DNA, 13 bp, Homo sapiens
acgttcacccctc

SEQ ID NO: 1933516 - DNA, 14 bp, Homo sapiens
acgttcacccctcc

SEQ ID NO: 1933517 - DNA, 17 bp, Homo sapiens
actaagcacattatgtt

SEQ ID NO: 1933518 - DNA, 19 bp, Homo sapiens
actaatgccctatcttagt

SEQ ID NO: 1933519 - DNA, 22 bp, Homo sapiens
actacagccaaattgcagaaga

SEQ ID NO: 1933520 - DNA, 17 bp, Homo sapiens
actactcagggaatgaa

SEQ ID NO: 1933521 - DNA, 16 bp, Homo sapiens
actagaatattcctta

SEQ ID NO: 1933522 - DNA, 16 bp, Homo sapiens
actagggatccctcat

SEQ ID NO: 1933523 - DNA, 13 bp, Homo sapiens
actatcttttcat

SEQ ID NO: 1933524 - DNA, 16 bp, Homo sapiens
actatcttttcatctc

SEQ ID NO: 1933525 - DNA, 15 bp, Homo sapiens
actatgatttggaaa

SEQ ID NO: 1933526 - DNA, 19 bp, Homo sapiens
actatgcacctataaatac

SEQ ID NO: 1933527 - DNA, 14 bp, Homo sapiens
actatgtaacatgt

SEQ ID NO: 1933528 - DNA, 19 bp, Homo sapiens
actatgtccatgaaaaaca

SEQ ID NO: 1933529 - DNA, 14 bp, Homo sapiens
actattgtagagtg

SEQ ID NO: 1933530 - DNA, 17 bp, Homo sapiens
actatttttttgttgct

SEQ ID NO: 1933531 - DNA, 15 bp, Homo sapiens
actcaaaatgcagga

SEQ ID NO: 1933532 - DNA, 15 bp, Homo sapiens
actcattctgaagga

SEQ ID NO: 1933533 - DNA, 19 bp, Homo sapiens
actccagggttaaagaaag

SEQ ID NO: 1933534 - DNA, 20 bp, Homo sapiens
actccagggttaaagaaagg

SEQ ID NO: 1933535 - DNA, 15 bp, Homo sapiens
actcccaagctggac

SEQ ID NO: 1933536 - DNA, 13 bp, Homo sapiens
actcccccagccc

SEQ ID NO: 1933537 - DNA, 14 bp, Homo sapiens
actcccccagccct

SEQ ID NO: 1933538 - DNA, 18 bp, Homo sapiens
actcccccagccctcagt

SEQ ID NO: 1933539 - DNA, 12 bp, Homo sapiens
actcctcccagg

SEQ ID NO: 1933540 - DNA, 14 bp, Homo sapiens
actcctctgactca

SEQ ID NO: 1933541 - DNA, 20 bp, Homo sapiens
actcctctgactcagggctc

SEQ ID NO: 1933542 - DNA, 17 bp, Homo sapiens
actccttgttctgctct

SEQ ID NO: 1933543 - DNA, 20 bp, Homo sapiens
actctacttagcatgtccct

SEQ ID NO: 1933544 - DNA, 21 bp, Homo sapiens
actctacttagcatgtcccta

SEQ ID NO: 1933545 - DNA, 22 bp, Homo sapiens
actctcaggaccaaagctttca

SEQ ID NO: 1933546 - DNA, 13 bp, Homo sapiens
actctcagtctct

SEQ ID NO: 1933547 - DNA, 16 bp, Homo sapiens
actctcagtctctgag

SEQ ID NO: 1933548 - DNA, 17 bp, Homo sapiens
actctcagtctctgagc

SEQ ID NO: 1933549 - DNA, 18 bp, Homo sapiens
actctcagtctctgagca

SEQ ID NO: 1933550 - DNA, 17 bp, Homo sapiens
actctctccatcagaag

SEQ ID NO: 1933551 - DNA, 22 bp, Homo sapiens
actctctcctctctctccctcc

SEQ ID NO: 1933552 - DNA, 16 bp, Homo sapiens
actctctttcttccac

SEQ ID NO: 1933553 - DNA, 14 bp, Homo sapiens
actctgaccgggct

SEQ ID NO: 1933554 - DNA, 11 bp, Homo sapiens
actctggcctt

SEQ ID NO: 1933555 - DNA, 22 bp, Homo sapiens
actctggccttggttcctccag

SEQ ID NO: 1933556 - DNA, 15 bp, Homo sapiens
actcttagttactca

SEQ ID NO: 1933557 - DNA, 16 bp, Homo sapiens
actctttgagaaacaa

SEQ ID NO: 1933558 - DNA, 14 bp, Homo sapiens
actctttgtaagag

SEQ ID NO: 1933559 - DNA, 14 bp, Homo sapiens
actgaagtgaatac

SEQ ID NO: 1933560 - DNA, 16 bp, Homo sapiens
actgcacagtgcatct

SEQ ID NO: 1933561 - DNA, 12 bp, Homo sapiens
actgcagaacag

SEQ ID NO: 1933562 - DNA, 10 bp, Homo sapiens
actgcaggga

SEQ ID NO: 1933563 - DNA, 20 bp, Homo sapiens
actgcagtcacccctgtctg

SEQ ID NO: 1933564 - DNA, 18 bp, Homo sapiens
actgccatggaggcacac

SEQ ID NO: 1933565 - DNA, 21 bp, Homo sapiens
actgccatggaggcacacagc

SEQ ID NO: 1933566 - DNA, 18 bp, Homo sapiens
actgcccacctgccaggc

SEQ ID NO: 1933567 - DNA, 17 bp, Homo sapiens
actgcctatacccctca

SEQ ID NO: 1933568 - DNA, 19 bp, Homo sapiens
actgcttgcatttctttat

SEQ ID NO: 1933569 - DNA, 17 bp, Homo sapiens
actggaaaacatagagt

SEQ ID NO: 1933570 - DNA, 20 bp, Homo sapiens
actggaaaacatagagtaga

SEQ ID NO: 1933571 - DNA, 19 bp, Homo sapiens
actggcccacccctcttcc

SEQ ID NO: 1933572 - DNA, 15 bp, Homo sapiens
actggccccagctcc

SEQ ID NO: 1933573 - DNA, 22 bp, Homo sapiens
actggccggcccacgtcctggg

SEQ ID NO: 1933574 - DNA, 23 bp, Homo sapiens
actggccggcccacgtcctgggt

SEQ ID NO: 1933575 - DNA, 17 bp, Homo sapiens
actgggctgagggagcc

SEQ ID NO: 1933576 - DNA, 18 bp, Homo sapiens
actggttaaatcaattct

SEQ ID NO: 1933577 - DNA, 16 bp, Homo sapiens
actgtaaatttaatag

SEQ ID NO: 1933578 - DNA, 13 bp, Homo sapiens
actgtactcctcc

SEQ ID NO: 1933579 - DNA, 15 bp, Homo sapiens
actgtcatgcccagc

SEQ ID NO: 1933580 - DNA, 14 bp, Homo sapiens
actgtctaagaata

SEQ ID NO: 1933581 - DNA, 18 bp, Homo sapiens
actgtgcaccaagcagga

SEQ ID NO: 1933582 - DNA, 18 bp, Homo sapiens
actgtgggtccctgcgtc

SEQ ID NO: 1933583 - DNA, 18 bp, Homo sapiens
actgttgtttgatgtgta

SEQ ID NO: 1933584 - DNA, 21 bp, Homo sapiens
actgttgtttgatgtgtatgt

SEQ ID NO: 1933585 - DNA, 21 bp, Homo sapiens
actgtttgccttctactttta

SEQ ID NO: 1933586 - DNA, 15 bp, Homo sapiens
acttaaaaatatgtg

SEQ ID NO: 1933587 - DNA, 15 bp, Homo sapiens
acttagacccagtca

SEQ ID NO: 1933588 - DNA, 19 bp, Homo sapiens
acttattcaaaaaaatcct

SEQ ID NO: 1933589 - DNA, 14 bp, Homo sapiens
acttatttctaaat

SEQ ID NO: 1933590 - DNA, 19 bp, Homo sapiens
acttcaaaatcagtgatgg

SEQ ID NO: 1933591 - DNA, 14 bp, Homo sapiens
acttcaggctcttc

SEQ ID NO: 1933592 - DNA, 17 bp, Homo sapiens
acttcatagatttcctt

SEQ ID NO: 1933593 - DNA, 21 bp, Homo sapiens
acttccaaatcccctaagcag

SEQ ID NO: 1933594 - DNA, 14 bp, Homo sapiens
acttcctcctcctc

SEQ ID NO: 1933595 - DNA, 16 bp, Homo sapiens
acttctatatatacaa

SEQ ID NO: 1933596 - DNA, 20 bp, Homo sapiens
acttgggagacctgtaatca

SEQ ID NO: 1933597 - DNA, 19 bp, Homo sapiens
acttggtgaggaggaggca

SEQ ID NO: 1933598 - DNA, 13 bp, Homo sapiens
acttgttttcccc

SEQ ID NO: 1933599 - DNA, 11 bp, Homo sapiens
actttaataat

SEQ ID NO: 1933600 - DNA, 22 bp, Homo sapiens
actttaataataaaaatcatgc

SEQ ID NO: 1933601 - DNA, 15 bp, Homo sapiens
actttagaaagaaat

SEQ ID NO: 1933602 - DNA, 16 bp, Homo sapiens
actttagaaagaaatt

SEQ ID NO: 1933603 - DNA, 20 bp, Homo sapiens
actttcattccctttcatga

SEQ ID NO: 1933604 - DNA, 15 bp, Homo sapiens
actttccctagaaag

SEQ ID NO: 1933605 - DNA, 19 bp, Homo sapiens
actttccctagaaagccat

SEQ ID NO: 1933606 - DNA, 18 bp, Homo sapiens
actttgtgagtattctat

SEQ ID NO: 1933607 - DNA, 15 bp, Homo sapiens
acttttgccctttga

SEQ ID NO: 1933608 - DNA, 12 bp, Homo sapiens
acttttgtaaat

SEQ ID NO: 1933609 - DNA, 13 bp, Homo sapiens
acttttgtaaata

SEQ ID NO: 1933610 - DNA, 20 bp, Homo sapiens
agaaaacggttaaaactgtc

SEQ ID NO: 1933611 - DNA, 18 bp, Homo sapiens
agaaacaacaatttctac

SEQ ID NO: 1933612 - DNA, 17 bp, Homo sapiens
agaaacaactctttgag

SEQ ID NO: 1933613 - DNA, 23 bp, Homo sapiens
agaaagcagacagcaagggcttg

SEQ ID NO: 1933614 - DNA, 21 bp, Homo sapiens
agaaagccaaatcaaaatatg

SEQ ID NO: 1933615 - DNA, 17 bp, Homo sapiens
agaaagggcagcccctc

SEQ ID NO: 1933616 - DNA, 18 bp, Homo sapiens
agaaagggcagcccctcc

SEQ ID NO: 1933617 - DNA, 19 bp, Homo sapiens
agaaagtggaaaacaagga

SEQ ID NO: 1933618 - DNA, 15 bp, Homo sapiens
agaaatagcaagaga

SEQ ID NO: 1933619 - DNA, 21 bp, Homo sapiens
agaaatgatttcaaaatgata

SEQ ID NO: 1933620 - DNA, 17 bp, Homo sapiens
agaaattgcatttcctg

SEQ ID NO: 1933621 - DNA, 20 bp, Homo sapiens
agaaattgcatttcctgaca

SEQ ID NO: 1933622 - DNA, 14 bp, Homo sapiens
agaacaatcactat

SEQ ID NO: 1933623 - DNA, 19 bp, Homo sapiens
agaacaatcactattctta

SEQ ID NO: 1933624 - DNA, 13 bp, Homo sapiens
agaacatcaagat

SEQ ID NO: 1933625 - DNA, 16 bp, Homo sapiens
agaaccaacgggtctg

SEQ ID NO: 1933626 - DNA, 19 bp, Homo sapiens
agaaccaacgggtctgtgg

SEQ ID NO: 1933627 - DNA, 17 bp, Homo sapiens
agaaccaggcaacttgg

SEQ ID NO: 1933628 - DNA, 16 bp, Homo sapiens
agaactaccaaaatga

SEQ ID NO: 1933629 - DNA, 22 bp, Homo sapiens
agaactcgcaatccgagccagc

SEQ ID NO: 1933630 - DNA, 14 bp, Homo sapiens
agaactctttcaaa

SEQ ID NO: 1933631 - DNA, 19 bp, Homo sapiens
agaactgcttgcatttctt

SEQ ID NO: 1933632 - DNA, 20 bp, Homo sapiens
agaactgcttgcatttcttt

SEQ ID NO: 1933633 - DNA, 19 bp, Homo sapiens
agaaggaggaattttagaa

SEQ ID NO: 1933634 - DNA, 21 bp, Homo sapiens
agaaggcaagctggcaggagg

SEQ ID NO: 1933635 - DNA, 15 bp, Homo sapiens
agaaggcctgccccc

SEQ ID NO: 1933636 - DNA, 16 bp, Homo sapiens
agaaggcctgcccccc

SEQ ID NO: 1933637 - DNA, 12 bp, Homo sapiens
agtatgggctac

SEQ ID NO: 1933638 - DNA, 16 bp, Homo sapiens
agtattgccacctctg

SEQ ID NO: 1933639 - DNA, 14 bp, Homo sapiens
agtcaacctgggca

SEQ ID NO: 1933640 - DNA, 16 bp, Homo sapiens
agtcaaggagtggctt

SEQ ID NO: 1933641 - DNA, 14 bp, Homo sapiens
agtcagcagaactg

SEQ ID NO: 1933642 - DNA, 16 bp, Homo sapiens
agtcagcccagtggga

SEQ ID NO: 1933643 - DNA, 22 bp, Homo sapiens
agtcagctccgagtggctcccg

SEQ ID NO: 1933644 - DNA, 17 bp, Homo sapiens
agtcataccaatgaaaa

SEQ ID NO: 1933645 - DNA, 16 bp, Homo sapiens
agtcatgagctgagca

SEQ ID NO: 1933646 - DNA, 19 bp, Homo sapiens
agtcatttgctgagcatgt

SEQ ID NO: 1933647 - DNA, 22 bp, Homo sapiens
agtcatttgctgagcatgtact

SEQ ID NO: 1933648 - DNA, 19 bp, Homo sapiens
agtcattttaataactaaa

SEQ ID NO: 1933649 - DNA, 18 bp, Homo sapiens
agtccaacgtggggcagc

SEQ ID NO: 1933650 - DNA, 19 bp, Homo sapiens
agtccaacgtggggcagca

SEQ ID NO: 1933651 - DNA, 20 bp, Homo sapiens
agtccaacgtggggcagcac

SEQ ID NO: 1933652 - DNA, 18 bp, Homo sapiens
agtccatagctgagctgg

SEQ ID NO: 1933653 - DNA, 19 bp, Homo sapiens
agtcccagggagctctgca

SEQ ID NO: 1933654 - DNA, 16 bp, Homo sapiens
agtctcttctccactg

SEQ ID NO: 1933655 - DNA, 15 bp, Homo sapiens
agtctgaaggagagg

SEQ ID NO: 1933656 - DNA, 16 bp, Homo sapiens
agtctgtgcctcagtg

SEQ ID NO: 1933657 - DNA, 23 bp, Homo sapiens
agtcttcaagcagattggagaaa

SEQ ID NO: 1933658 - DNA, 16 bp, Homo sapiens
agtcttccatttgcaa

SEQ ID NO: 1933659 - DNA, 17 bp, Homo sapiens
agtcttgagtgggcccc

SEQ ID NO: 1933660 - DNA, 17 bp, Homo sapiens
agtgaatgattcagtgt

SEQ ID NO: 1933661 - DNA, 23 bp, Homo sapiens
agtgactaccacttatttctaaa

SEQ ID NO: 1933662 - DNA, 18 bp, Homo sapiens
agtgactctggctgccaa

SEQ ID NO: 1933663 - DNA, 16 bp, Homo sapiens
agtgagagcagggctg

SEQ ID NO: 1933664 - DNA, 22 bp, Homo sapiens
agtgagggtcagagaggagtca

SEQ ID NO: 1933665 - DNA, 15 bp, Homo sapiens
agtgagttggggcga

SEQ ID NO: 1933666 - DNA, 15 bp, Homo sapiens
agtgatatggcttgt

SEQ ID NO: 1933667 - DNA, 19 bp, Homo sapiens
agtgatttgctatcatata

SEQ ID NO: 1933668 - DNA, 16 bp, Homo sapiens
agtgcagtcctgatca

SEQ ID NO: 1933669 - DNA, 15 bp, Homo sapiens
agtgcatctcagccc

SEQ ID NO: 1933670 - DNA, 16 bp, Homo sapiens
agtgcatctcagccca

SEQ ID NO: 1933671 - DNA, 13 bp, Homo sapiens
agtgccatatatt

SEQ ID NO: 1933672 - DNA, 18 bp, Homo sapiens
agtgccatggccaggagt

SEQ ID NO: 1933673 - DNA, 13 bp, Homo sapiens
agtgcctgtgatc

SEQ ID NO: 1933674 - DNA, 14 bp, Homo sapiens
agtgctccctcaca

SEQ ID NO: 1933675 - DNA, 16 bp, Homo sapiens
agtgctctgatccctc

SEQ ID NO: 1933676 - DNA, 17 bp, Homo sapiens
agtgctctgatccctct

SEQ ID NO: 1933677 - DNA, 14 bp, Homo sapiens
agtggactgtgtcc

SEQ ID NO: 1933678 - DNA, 14 bp, Homo sapiens
agtggagaggggac

SEQ ID NO: 1933679 - DNA, 16 bp, Homo sapiens
agtggcctgagaagag

SEQ ID NO: 1933680 - DNA, 13 bp, Homo sapiens
agtggctcctccc

SEQ ID NO: 1933681 - DNA, 14 bp, Homo sapiens
agtgggagaggaag

SEQ ID NO: 1933682 - DNA, 17 bp, Homo sapiens
agtgggagaggaagcca

SEQ ID NO: 1933683 - DNA, 15 bp, Homo sapiens
agtgggagtgggaga

SEQ ID NO: 1933684 - DNA, 19 bp, Homo sapiens
agtgggagtgggagaggaa

SEQ ID NO: 1933685 - DNA, 18 bp, Homo sapiens
agtggggaggggcctggc

SEQ ID NO: 1933686 - DNA, 22 bp, Homo sapiens
agtgtataccacctgtacatac

SEQ ID NO: 1933687 - DNA, 23 bp, Homo sapiens
agtgtatctcgaagtcttccatc

SEQ ID NO: 1933688 - DNA, 20 bp, Homo sapiens
agtgtgccaccctctgcagg

SEQ ID NO: 1933689 - DNA, 15 bp, Homo sapiens
agtgttagggaaggg

SEQ ID NO: 1933690 - DNA, 18 bp, Homo sapiens
agtgttagggaagggcct

SEQ ID NO: 1933691 - DNA, 23 bp, Homo sapiens
agtgttagggaagggcctgccac

SEQ ID NO: 1933692 - DNA, 16 bp, Homo sapiens
agtgttatcagtcata

SEQ ID NO: 1933693 - DNA, 23 bp, Homo sapiens
agtgttatcagtcataactaaat

SEQ ID NO: 1933694 - DNA, 10 bp, Homo sapiens
agttaaaatc

SEQ ID NO: 1933695 - DNA, 20 bp, Homo sapiens
agttaatgtactttcattcc

SEQ ID NO: 1933696 - DNA, 17 bp, Homo sapiens
agttattgacaaactct

SEQ ID NO: 1933697 - DNA, 18 bp, Homo sapiens
agttcatatgtaccatgt

SEQ ID NO: 1933698 - DNA, 15 bp, Homo sapiens
agttccaatgtgccc

SEQ ID NO: 1933699 - DNA, 13 bp, Homo sapiens
agttccgtctcct

SEQ ID NO: 1933700 - DNA, 14 bp, Homo sapiens
agttccgtctcctc

SEQ ID NO: 1933701 - DNA, 19 bp, Homo sapiens
agttccgtctcctctccag

SEQ ID NO: 1933702 - DNA, 22 bp, Homo sapiens
agttccgtctcctctccagccc

SEQ ID NO: 1933703 - DNA, 12 bp, Homo sapiens
agttctcatcca

SEQ ID NO: 1933704 - DNA, 12 bp, Homo sapiens
agttctgaaggt

SEQ ID NO: 1933705 - DNA, 23 bp, Homo sapiens
agttctgtactcaaatgtagcca

SEQ ID NO: 1933706 - DNA, 15 bp, Homo sapiens
agttgctgtgcccca

SEQ ID NO: 1933707 - DNA, 13 bp, Homo sapiens
agttggcttctaa

SEQ ID NO: 1933708 - DNA, 15 bp, Homo sapiens
agtttcactgactta

SEQ ID NO: 1933709 - DNA, 17 bp, Homo sapiens
agtttgattattcagtg

SEQ ID NO: 1933710 - DNA, 23 bp, Homo sapiens
agtttgattattcagtgtcactg

SEQ ID NO: 1933711 - DNA, 20 bp, Homo sapiens
agtttggttcttcaaatctt

SEQ ID NO: 1933712 - DNA, 22 bp, Homo sapiens
agttttaacctcaggttccaaa

SEQ ID NO: 1933713 - DNA, 12 bp, Homo sapiens
agttttatcatt

SEQ ID NO: 1933714 - DNA, 12 bp, Homo sapiens
agttttcagtgg

SEQ ID NO: 1933715 - DNA, 16 bp, Homo sapiens
agtttttacagtgtat

SEQ ID NO: 1933716 - DNA, 18 bp, Homo sapiens
ataaaaacaatatatgta

SEQ ID NO: 1933717 - DNA, 13 bp, Homo sapiens
ataaaaccaaaga

SEQ ID NO: 1933718 - DNA, 15 bp, Homo sapiens
ataaatatctattta

SEQ ID NO: 1933719 - DNA, 22 bp, Homo sapiens
ataaatatctatttatctgtct

SEQ ID NO: 1933720 - DNA, 22 bp, Homo sapiens
ataaatggtgagaattaaaata

SEQ ID NO: 1933721 - DNA, 15 bp, Homo sapiens
ataacaattcctcta

SEQ ID NO: 1933722 - DNA, 14 bp, Homo sapiens
ataactaaataaag

SEQ ID NO: 1933723 - DNA, 13 bp, Homo sapiens
ataactgtaacat

SEQ ID NO: 1933724 - DNA, 20 bp, Homo sapiens
ataacttgtgttactaattt

SEQ ID NO: 1933725 - DNA, 15 bp, Homo sapiens
ataagatttttaggt

SEQ ID NO: 1933726 - DNA, 23 bp, Homo sapiens
ataagtaacttgtcaaggaatgt

SEQ ID NO: 1933727 - DNA, 14 bp, Homo sapiens
ataagtcattttaa

SEQ ID NO: 1933728 - DNA, 19 bp, Homo sapiens
ataagtcattttaataact

SEQ ID NO: 1933729 - DNA, 11 bp, Homo sapiens
ataataaaacc

SEQ ID NO: 1933730 - DNA, 14 bp, Homo sapiens
ataataaaaccaaa

SEQ ID NO: 1933731 - DNA, 18 bp, Homo sapiens
ataatgaagaatggccat

SEQ ID NO: 1933732 - DNA, 19 bp, Homo sapiens
ataatgacgtattgtgaaa

SEQ ID NO: 1933733 - DNA, 15 bp, Homo sapiens
ataattgtggagagg

SEQ ID NO: 1933734 - DNA, 21 bp, Homo sapiens
ataattgtggagaggagagaa

SEQ ID NO: 1933735 - DNA, 17 bp, Homo sapiens
ataattttttagttaaa

SEQ ID NO: 1933736 - DNA, 17 bp, Homo sapiens
atacacgaggtatgagg

SEQ ID NO: 1933737 - DNA, 18 bp, Homo sapiens
atacagccttacaataca

SEQ ID NO: 1933738 - DNA, 20 bp, Homo sapiens
atacagtcttccatttgcaa

SEQ ID NO: 1933739 - DNA, 16 bp, Homo sapiens
atacatggtagcaggg

SEQ ID NO: 1933740 - DNA, 17 bp, Homo sapiens
atacattgtataggcca

SEQ ID NO: 1933741 - DNA, 19 bp, Homo sapiens
ataccaaaattatttcaga

SEQ ID NO: 1933742 - DNA, 21 bp, Homo sapiens
ataccaatgaaaaaatgtata

SEQ ID NO: 1933743 - DNA, 16 bp, Homo sapiens
ataccacctgtacata

SEQ ID NO: 1933744 - DNA, 23 bp, Homo sapiens
ataccacctgtacatacattgta

SEQ ID NO: 1933745 - DNA, 21 bp, Homo sapiens
atacccccgtcggaatggtaa

SEQ ID NO: 1933746 - DNA, 18 bp, Homo sapiens
ataccctaggtctccacc

SEQ ID NO: 1933747 - DNA, 13 bp, Homo sapiens
atacctttgcctg

SEQ ID NO: 1933748 - DNA, 20 bp, Homo sapiens
atactaaatatgaaatttta

SEQ ID NO: 1933749 - DNA, 14 bp, Homo sapiens
atactatatttatg

SEQ ID NO: 1933750 - DNA, 14 bp, Homo sapiens
atactattaaagta

SEQ ID NO: 1933751 - DNA, 19 bp, Homo sapiens
atactgtattttgtattgt

SEQ ID NO: 1933752 - DNA, 14 bp, Homo sapiens
atactgtctaagaa

SEQ ID NO: 1933753 - DNA, 16 bp, Homo sapiens
atacttaaaaatatgt

SEQ ID NO: 1933754 - DNA, 19 bp, Homo sapiens
atacttaaaaatatgtgag

SEQ ID NO: 1933755 - DNA, 21 bp, Homo sapiens
atacttaaaaatatgtgagca

SEQ ID NO: 1933756 - DNA, 22 bp, Homo sapiens
atagaaagccaaatcaaaatat

SEQ ID NO: 1933757 - DNA, 14 bp, Homo sapiens
atagagctgtatta

SEQ ID NO: 1933758 - DNA, 18 bp, Homo sapiens
atagaggatgatgtaatt

SEQ ID NO: 1933759 - DNA, 14 bp, Homo sapiens
atagagtgttatca

SEQ ID NO: 1933760 - DNA, 18 bp, Homo sapiens
atagctatttagagatat

SEQ ID NO: 1933761 - DNA, 17 bp, Homo sapiens
atagctgagctggaaag

SEQ ID NO: 1933762 - DNA, 15 bp, Homo sapiens
ataggagcttccaga

SEQ ID NO: 1933763 - DNA, 16 bp, Homo sapiens
ataggagcttccagat

SEQ ID NO: 1933764 - DNA, 13 bp, Homo sapiens
ataggaggacaga

SEQ ID NO: 1933765 - DNA, 13 bp, Homo sapiens
ataggccatctgt

SEQ ID NO: 1933766 - DNA, 17 bp, Homo sapiens
ataggtaattaaggcag

SEQ ID NO: 1933767 - DNA, 18 bp, Homo sapiens
ataggttgtaaatgtgtt

SEQ ID NO: 1933768 - DNA, 17 bp, Homo sapiens
atagtaccaatcatttt

SEQ ID NO: 1933769 - DNA, 18 bp, Homo sapiens
atagtatgcagctaaaaa

SEQ ID NO: 1933770 - DNA, 14 bp, Homo sapiens
cagggaagaaatca

SEQ ID NO: 1933771 - DNA, 15 bp, Homo sapiens
cagggacagttgggt

SEQ ID NO: 1933772 - DNA, 19 bp, Homo sapiens
cagggaccagcccagcctg

SEQ ID NO: 1933773 - DNA, 21 bp, Homo sapiens
cagggaccagcccagcctgca

SEQ ID NO: 1933774 - DNA, 16 bp, Homo sapiens
cagggaggtcattttg

SEQ ID NO: 1933775 - DNA, 19 bp, Homo sapiens
cagggcagcctgtgggaga

SEQ ID NO: 1933776 - DNA, 20 bp, Homo sapiens
cagggcagcctgtgggagaa

SEQ ID NO: 1933777 - DNA, 18 bp, Homo sapiens
cagggcagcggtcttctc

SEQ ID NO: 1933778 - DNA, 20 bp, Homo sapiens
cagggccccaggcattgcca

SEQ ID NO: 1933779 - DNA, 22 bp, Homo sapiens
cagggctaccctgagctgaggc

SEQ ID NO: 1933780 - DNA, 24 bp, Homo sapiens
cagggctaccctgagctgaggcag

SEQ ID NO: 1933781 - DNA, 14 bp, Homo sapiens
cagggctgggcgcc

SEQ ID NO: 1933782 - DNA, 17 bp, Homo sapiens
cagggctgggcgcctct

SEQ ID NO: 1933783 - DNA, 22 bp, Homo sapiens
caggggacactgaaccttgttg

SEQ ID NO: 1933784 - DNA, 13 bp, Homo sapiens
cagggggccaggt

SEQ ID NO: 1933785 - DNA, 16 bp, Homo sapiens
cagggggccaggtgca

SEQ ID NO: 1933786 - DNA, 19 bp, Homo sapiens
cagggggccaggtgcacag

SEQ ID NO: 1933787 - DNA, 15 bp, Homo sapiens
cagggggtttgagga

SEQ ID NO: 1933788 - DNA, 18 bp, Homo sapiens
cagggtctttgtgtgctg

SEQ ID NO: 1933789 - DNA, 16 bp, Homo sapiens
cagggtggggcttaga

SEQ ID NO: 1933790 - DNA, 20 bp, Homo sapiens
cagggttccagacagggtgg

SEQ ID NO: 1933791 - DNA, 23 bp, Homo sapiens
cagggttccagacagggtggggc

SEQ ID NO: 1933792 - DNA, 21 bp, Homo sapiens
cagggttctagaaggggcgag

SEQ ID NO: 1933793 - DNA, 19 bp, Homo sapiens
cagggttgaccccagagga

SEQ ID NO: 1933794 - DNA, 20 bp, Homo sapiens
cagggttgaccccagaggat

SEQ ID NO: 1933795 - DNA, 16 bp, Homo sapiens
caggtcagggtgagga

SEQ ID NO: 1933796 - DNA, 22 bp, Homo sapiens
caggtcccgagccccctgtcct

SEQ ID NO: 1933797 - DNA, 12 bp, Homo sapiens
caggtctttgaa

SEQ ID NO: 1933798 - DNA, 19 bp, Homo sapiens
caggtctttgaaatatgca

SEQ ID NO: 1933799 - DNA, 23 bp, Homo sapiens
caggtgcacagacgtccctccac

SEQ ID NO: 1933800 - DNA, 22 bp, Homo sapiens
caggtggggagactgggctgag

SEQ ID NO: 1933801 - DNA, 20 bp, Homo sapiens
caggtggggttttcacttcc

SEQ ID NO: 1933802 - DNA, 22 bp, Homo sapiens
caggtggggttttcacttccta

SEQ ID NO: 1933803 - DNA, 15 bp, Homo sapiens
caggttcacccagcg

SEQ ID NO: 1933804 - DNA, 23 bp, Homo sapiens
caggttgtctgaagtcactgcac

SEQ ID NO: 1933805 - DNA, 17 bp, Homo sapiens
cagtaaatccacagtga

SEQ ID NO: 1933806 - DNA, 16 bp, Homo sapiens
cagtaactaagcacat

SEQ ID NO: 1933807 - DNA, 18 bp, Homo sapiens
cagtacagctatttctca

SEQ ID NO: 1933808 - DNA, 12 bp, Homo sapiens
cagtaggagccc

SEQ ID NO: 1933809 - DNA, 15 bp, Homo sapiens
cagtaggagcccagc

SEQ ID NO: 1933810 - DNA, 21 bp, Homo sapiens
cagtaggagcccagctctgaa

SEQ ID NO: 1933811 - DNA, 15 bp, Homo sapiens
cagtcaaggagtggc

SEQ ID NO: 1933812 - DNA, 20 bp, Homo sapiens
cagtcacactgctgggaagt

SEQ ID NO: 1933813 - DNA, 15 bp, Homo sapiens
cagtcagcccagtgg

SEQ ID NO: 1933814 - DNA, 16 bp, Homo sapiens
cagtcagcccagtggg

SEQ ID NO: 1933815 - DNA, 16 bp, Homo sapiens
cagtccacgccgggtc

SEQ ID NO: 1933816 - DNA, 22 bp, Homo sapiens
cagtcctgatcagagccgtggt

SEQ ID NO: 1933817 - DNA, 16 bp, Homo sapiens
cagtcgatagagctgt

SEQ ID NO: 1933818 - DNA, 14 bp, Homo sapiens
cagtctctgagcag

SEQ ID NO: 1933819 - DNA, 18 bp, Homo sapiens
cagtcttgagtgggcccc

SEQ ID NO: 1933820 - DNA, 20 bp, Homo sapiens
cagtcttgagtgggccccct

SEQ ID NO: 1933821 - DNA, 14 bp, Homo sapiens
cagtgaacataact

SEQ ID NO: 1933822 - DNA, 17 bp, Homo sapiens
cagtgaacataactgta

SEQ ID NO: 1933823 - DNA, 20 bp, Homo sapiens
cagtgaatgattcagtgtta

SEQ ID NO: 1933824 - DNA, 13 bp, Homo sapiens
cagtgacttattt

SEQ ID NO: 1933825 - DNA, 17 bp, Homo sapiens
cagtgacttatttgtag

SEQ ID NO: 1933826 - DNA, 16 bp, Homo sapiens
cagtgcatctcagccc

SEQ ID NO: 1933827 - DNA, 14 bp, Homo sapiens
cagtggagagggga

SEQ ID NO: 1933828 - DNA, 21 bp, Homo sapiens
cagtggagaggggacttggat

SEQ ID NO: 1933829 - DNA, 23 bp, Homo sapiens
cagtgggatcttacccacttccc

SEQ ID NO: 1933830 - DNA, 15 bp, Homo sapiens
cagtggggcagtcat

SEQ ID NO: 1933831 - DNA, 15 bp, Homo sapiens
cagtgtatctcgaag

SEQ ID NO: 1933832 - DNA, 22 bp, Homo sapiens
cagtgtcaaatatatttaacta

SEQ ID NO: 1933833 - DNA, 19 bp, Homo sapiens
cagtgtgaggccagggcag

SEQ ID NO: 1933834 - DNA, 14 bp, Homo sapiens
cagtgtgccaccct

SEQ ID NO: 1933835 - DNA, 15 bp, Homo sapiens
cagtgtgccaccctc

SEQ ID NO: 1933836 - DNA, 19 bp, Homo sapiens
cagtgttaaatgtgatgaa

SEQ ID NO: 1933837 - DNA, 14 bp, Homo sapiens
cagttcaatcaaac

SEQ ID NO: 1933838 - DNA, 16 bp, Homo sapiens
cagttccaatgtgccc

SEQ ID NO: 1933839 - DNA, 14 bp, Homo sapiens
cagttgtatagttt

SEQ ID NO: 1933840 - DNA, 17 bp, Homo sapiens
cagtttaggacccaagg

SEQ ID NO: 1933841 - DNA, 21 bp, Homo sapiens
cagtttgctttgtatgcactt

SEQ ID NO: 1933842 - DNA, 17 bp, Homo sapiens
cagtttgtccacacaag

SEQ ID NO: 1933843 - DNA, 13 bp, Homo sapiens
cataaaagaagaa

SEQ ID NO: 1933844 - DNA, 15 bp, Homo sapiens
cataacaattcctct

SEQ ID NO: 1933845 - DNA, 16 bp, Homo sapiens
cataacaattcctcta

SEQ ID NO: 1933846 - DNA, 17 bp, Homo sapiens
cataacaattcctctac

SEQ ID NO: 1933847 - DNA, 17 bp, Homo sapiens
cataatgttacattatt

SEQ ID NO: 1933848 - DNA, 15 bp, Homo sapiens
cataattgtcaaaaa

SEQ ID NO: 1933849 - DNA, 17 bp, Homo sapiens
catacattgtataggcc

SEQ ID NO: 1933850 - DNA, 21 bp, Homo sapiens
catacattgtataggccatct

SEQ ID NO: 1933851 - DNA, 17 bp, Homo sapiens
catagaggtgagggaag

SEQ ID NO: 1933852 - DNA, 21 bp, Homo sapiens
catagaggtgagggaagcctg

SEQ ID NO: 1933853 - DNA, 14 bp, Homo sapiens
catagtttctgtaa

SEQ ID NO: 1933854 - DNA, 21 bp, Homo sapiens
catatctgtgcaatggaatat

SEQ ID NO: 1933855 - DNA, 13 bp, Homo sapiens
catatgaggatgc

SEQ ID NO: 1933856 - DNA, 13 bp, Homo sapiens
catcaacaaaaat

SEQ ID NO: 1933857 - DNA, 18 bp, Homo sapiens
catcaagcacagaaggag

SEQ ID NO: 1933858 - DNA, 21 bp, Homo sapiens
catcaagttattgacaaactc

SEQ ID NO: 1933859 - DNA, 16 bp, Homo sapiens
catcaattctctatca

SEQ ID NO: 1933860 - DNA, 17 bp, Homo sapiens
catcactgctgtccctc

SEQ ID NO: 1933861 - DNA, 13 bp, Homo sapiens
catcagcagcttg

SEQ ID NO: 1933862 - DNA, 14 bp, Homo sapiens
catcagcagtgatt

SEQ ID NO: 1933863 - DNA, 22 bp, Homo sapiens
catcatagaggatgatgtaatt

SEQ ID NO: 1933864 - DNA, 21 bp, Homo sapiens
catcatctcctgccttcctcc

SEQ ID NO: 1933865 - DNA, 19 bp, Homo sapiens
catcatgagccgttgctaa

SEQ ID NO: 1933866 - DNA, 22 bp, Homo sapiens
catcattctctgtctcatccat

SEQ ID NO: 1933867 - DNA, 16 bp, Homo sapiens
catccaggtcctttcc

SEQ ID NO: 1933868 - DNA, 11 bp, Homo sapiens
catccccctcc

SEQ ID NO: 1933869 - DNA, 13 bp, Homo sapiens
catccccctcctt

SEQ ID NO: 1933870 - DNA, 20 bp, Homo sapiens
catccccctccttgccgctg

SEQ ID NO: 1933871 - DNA, 20 bp, Homo sapiens
catcccttggcccctctctg

SEQ ID NO: 1933872 - DNA, 15 bp, Homo sapiens
catccgcctctgagc

SEQ ID NO: 1933873 - DNA, 18 bp, Homo sapiens
catccgcctctgagccag

SEQ ID NO: 1933874 - DNA, 22 bp, Homo sapiens
catccgcctctgagccaggagc

SEQ ID NO: 1933875 - DNA, 22 bp, Homo sapiens
catccggcatgagggctgagat

SEQ ID NO: 1933876 - DNA, 23 bp, Homo sapiens
catccggcatgagggctgagatg

SEQ ID NO: 1933877 - DNA, 21 bp, Homo sapiens
catcctccacgttctgctcat

SEQ ID NO: 1933878 - DNA, 14 bp, Homo sapiens
catctattcccaaa

SEQ ID NO: 1933879 - DNA, 17 bp, Homo sapiens
catctcactttaataat

SEQ ID NO: 1933880 - DNA, 22 bp, Homo sapiens
catctcctgccttcctcctggg

SEQ ID NO: 1933881 - DNA, 13 bp, Homo sapiens
catctctggagtg

SEQ ID NO: 1933882 - DNA, 15 bp, Homo sapiens
catctgctgtaataa

SEQ ID NO: 1933883 - DNA, 15 bp, Homo sapiens
catctgtaaatatcc

SEQ ID NO: 1933884 - DNA, 21 bp, Homo sapiens
catctgtaaatatcccagaga

SEQ ID NO: 1933885 - DNA, 17 bp, Homo sapiens
catctgtccctccggga

SEQ ID NO: 1933886 - DNA, 19 bp, Homo sapiens
catcttagtatttgcatat

SEQ ID NO: 1933887 - DNA, 16 bp, Homo sapiens
catgaaaaacagcaga

SEQ ID NO: 1933888 - DNA, 15 bp, Homo sapiens
catgaattaagaact

SEQ ID NO: 1933889 - DNA, 14 bp, Homo sapiens
catgacatttctca

SEQ ID NO: 1933890 - DNA, 16 bp, Homo sapiens
catgacatttctcaaa

SEQ ID NO: 1933891 - DNA, 17 bp, Homo sapiens
catgagaccactgttat

SEQ ID NO: 1933892 - DNA, 20 bp, Homo sapiens
catgagatctaggtgaggat

SEQ ID NO: 1933893 - DNA, 12 bp, Homo sapiens
catgagctctgt

SEQ ID NO: 1933894 - DNA, 14 bp, Homo sapiens
catgagctctgtgt

SEQ ID NO: 1933895 - DNA, 14 bp, Homo sapiens
catgagggctgaga

SEQ ID NO: 1933896 - DNA, 16 bp, Homo sapiens
catgagggctgagatg

SEQ ID NO: 1933897 - DNA, 18 bp, Homo sapiens
catgatgtccttgttatt

SEQ ID NO: 1933898 - DNA, 13 bp, Homo sapiens
catgatttgcaac

SEQ ID NO: 1933899 - DNA, 21 bp, Homo sapiens
catgatttgcaactttagaaa

SEQ ID NO: 1933900 - DNA, 23 bp, Homo sapiens
catgatttgcaactttagaaaga

SEQ ID NO: 1933901 - DNA, 17 bp, Homo sapiens
catgcagataacagctg

SEQ ID NO: 1933902 - DNA, 17 bp, Homo sapiens
cccgagccccctgtcct

SEQ ID NO: 1933903 - DNA, 13 bp, Homo sapiens
cccgccctctgcc

SEQ ID NO: 1933904 - DNA, 20 bp, Homo sapiens
cccggcccccgccctctgcc

SEQ ID NO: 1933905 - DNA, 18 bp, Homo sapiens
cccgggcactgtcatgcc

SEQ ID NO: 1933906 - DNA, 18 bp, Homo sapiens
cccggtgcccaagaatag

SEQ ID NO: 1933907 - DNA, 12 bp, Homo sapiens
cccgtttccaag

SEQ ID NO: 1933908 - DNA, 12 bp, Homo sapiens
ccctaatgcctg

SEQ ID NO: 1933909 - DNA, 21 bp, Homo sapiens
ccctaccgagtctcttctcca

SEQ ID NO: 1933910 - DNA, 17 bp, Homo sapiens
ccctagaaacttccaaa

SEQ ID NO: 1933911 - DNA, 19 bp, Homo sapiens
ccctagatggttccctttg

SEQ ID NO: 1933912 - DNA, 14 bp, Homo sapiens
ccctatcctgcacc

SEQ ID NO: 1933913 - DNA, 14 bp, Homo sapiens
ccctatgtcccagc

SEQ ID NO: 1933914 - DNA, 24 bp, Homo sapiens
ccctatgtcccagcccctggtact

SEQ ID NO: 1933915 - DNA, 17 bp, Homo sapiens
ccctattggtaaagaat

SEQ ID NO: 1933916 - DNA, 23 bp, Homo sapiens
ccctcaagccaggagaccctgtc

SEQ ID NO: 1933917 - DNA, 13 bp, Homo sapiens
ccctcactccact

SEQ ID NO: 1933918 - DNA, 16 bp, Homo sapiens
ccctcactccactccc

SEQ ID NO: 1933919 - DNA, 13 bp, Homo sapiens
ccctccacacctc

SEQ ID NO: 1933920 - DNA, 17 bp, Homo sapiens
ccctccacacctccacc

SEQ ID NO: 1933921 - DNA, 18 bp, Homo sapiens
ccctccacgttcacccct

SEQ ID NO: 1933922 - DNA, 10 bp, Homo sapiens
ccctccagac

SEQ ID NO: 1933923 - DNA, 11 bp, Homo sapiens
ccctccagacc

SEQ ID NO: 1933924 - DNA, 17 bp, Homo sapiens
ccctccagacccctacc

SEQ ID NO: 1933925 - DNA, 19 bp, Homo sapiens
ccctccagacccctaccct

SEQ ID NO: 1933926 - DNA, 21 bp, Homo sapiens
ccctccatgtagaagagggag

SEQ ID NO: 1933927 - DNA, 10 bp, Homo sapiens
ccctcccagg

SEQ ID NO: 1933928 - DNA, 14 bp, Homo sapiens
ccctccccaaggaa

SEQ ID NO: 1933929 - DNA, 16 bp, Homo sapiens
ccctccccaaggaaga

SEQ ID NO: 1933930 - DNA, 21 bp, Homo sapiens
ccctcccctaatgcctgcgga

SEQ ID NO: 1933931 - DNA, 12 bp, Homo sapiens
ccctccctccac

SEQ ID NO: 1933932 - DNA, 13 bp, Homo sapiens
ccctccctccaca

SEQ ID NO: 1933933 - DNA, 15 bp, Homo sapiens
ccctccctccacacc

SEQ ID NO: 1933934 - DNA, 11 bp, Homo sapiens
ccctccctccc

SEQ ID NO: 1933935 - DNA, 16 bp, Homo sapiens
ccctccctccctccac

SEQ ID NO: 1933936 - DNA, 15 bp, Homo sapiens
ccctccctcgcatcc

SEQ ID NO: 1933937 - DNA, 14 bp, Homo sapiens
ccctccctgcccct

SEQ ID NO: 1933938 - DNA, 13 bp, Homo sapiens
ccctccctgtccc

SEQ ID NO: 1933939 - DNA, 17 bp, Homo sapiens
ccctccttctcccctcc

SEQ ID NO: 1933940 - DNA, 20 bp, Homo sapiens
ccctccttctcccctccaga

SEQ ID NO: 1933941 - DNA, 12 bp, Homo sapiens
ccctccttgccg

SEQ ID NO: 1933942 - DNA, 19 bp, Homo sapiens
ccctccttgccgctgggag

SEQ ID NO: 1933943 - DNA, 22 bp, Homo sapiens
ccctccttgccgctgggagagc

SEQ ID NO: 1933944 - DNA, 16 bp, Homo sapiens
ccctctctgctctgcg

SEQ ID NO: 1933945 - DNA, 14 bp, Homo sapiens
ccctctctttgagt

SEQ ID NO: 1933946 - DNA, 15 bp, Homo sapiens
ccctctgcagggcag

SEQ ID NO: 1933947 - DNA, 14 bp, Homo sapiens
ccctctgcccccag

SEQ ID NO: 1933948 - DNA, 13 bp, Homo sapiens
ccctcttccccct

SEQ ID NO: 1933949 - DNA, 13 bp, Homo sapiens
ccctctttcctgt

SEQ ID NO: 1933950 - DNA, 15 bp, Homo sapiens
ccctgactcattctg

SEQ ID NO: 1933951 - DNA, 13 bp, Homo sapiens
ccctgactgggag

SEQ ID NO: 1933952 - DNA, 14 bp, Homo sapiens
ccctgagctgaggc

SEQ ID NO: 1933953 - DNA, 16 bp, Homo sapiens
ccctgcatcccttggc

SEQ ID NO: 1933954 - DNA, 19 bp, Homo sapiens
ccctgcccctcccttcaac

SEQ ID NO: 1933955 - DNA, 13 bp, Homo sapiens
ccctgcgccctcc

SEQ ID NO: 1933956 - DNA, 22 bp, Homo sapiens
ccctgcgccctccctccctcca

SEQ ID NO: 1933957 - DNA, 19 bp, Homo sapiens
ccctgctttgggctgccct

SEQ ID NO: 1933958 - DNA, 13 bp, Homo sapiens
ccctggccccagt

SEQ ID NO: 1933959 - DNA, 17 bp, Homo sapiens
ccctggctcccacaggc

SEQ ID NO: 1933960 - DNA, 19 bp, Homo sapiens
ccctggctcccacaggccc

SEQ ID NO: 1933961 - DNA, 20 bp, Homo sapiens
ccctggctcccacaggccct

SEQ ID NO: 1933962 - DNA, 18 bp, Homo sapiens
ccctggcttttcactgct

SEQ ID NO: 1933963 - DNA, 16 bp, Homo sapiens
ccctggtgctgccaca

SEQ ID NO: 1933964 - DNA, 12 bp, Homo sapiens
ccctgtcccctg

SEQ ID NO: 1933965 - DNA, 14 bp, Homo sapiens
ccctgtcccctgag

SEQ ID NO: 1933966 - DNA, 23 bp, Homo sapiens
ccctgtccttcccacggccactg

SEQ ID NO: 1933967 - DNA, 13 bp, Homo sapiens
ccctgtctgcagg

SEQ ID NO: 1933968 - DNA, 15 bp, Homo sapiens
ccctgtctgcaggcc

SEQ ID NO: 1933969 - DNA, 20 bp, Homo sapiens
ccctgtgtgtcgttcccttg

SEQ ID NO: 1933970 - DNA, 14 bp, Homo sapiens
cccttcaaccattc

SEQ ID NO: 1933971 - DNA, 18 bp, Homo sapiens
cccttcaaccattcccca

SEQ ID NO: 1933972 - DNA, 14 bp, Homo sapiens
cccttcccacagga

SEQ ID NO: 1933973 - DNA, 15 bp, Homo sapiens
cccttccccactccc

SEQ ID NO: 1933974 - DNA, 17 bp, Homo sapiens
cccttcccctgcgccct

SEQ ID NO: 1933975 - DNA, 18 bp, Homo sapiens
cccttcccctgcgccctc

SEQ ID NO: 1933976 - DNA, 17 bp, Homo sapiens
cccttcctctccactgc

SEQ ID NO: 1933977 - DNA, 22 bp, Homo sapiens
cccttcggtattgttcaaagaa

SEQ ID NO: 1933978 - DNA, 23 bp, Homo sapiens
cccttctccatccacatgggagc

SEQ ID NO: 1933979 - DNA, 20 bp, Homo sapiens
ccctttacattttgtgcagt

SEQ ID NO: 1933980 - DNA, 18 bp, Homo sapiens
ccctttcccaaacccttc

SEQ ID NO: 1933981 - DNA, 14 bp, Homo sapiens
ccctttccctgcat

SEQ ID NO: 1933982 - DNA, 21 bp, Homo sapiens
ccctttgttgctgtctggctt

SEQ ID NO: 1933983 - DNA, 23 bp, Homo sapiens
ccgaatctctttttgctttcgaa

SEQ ID NO: 1933984 - DNA, 14 bp, Homo sapiens
ccgagccagctctg

SEQ ID NO: 1933985 - DNA, 14 bp, Homo sapiens
ccgagccccctgtc

SEQ ID NO: 1933986 - DNA, 15 bp, Homo sapiens
ccgaggcaggggctg

SEQ ID NO: 1933987 - DNA, 20 bp, Homo sapiens
ccgaggcaggggctgggcag

SEQ ID NO: 1933988 - DNA, 22 bp, Homo sapiens
ccgaggcaggggctgggcagag

SEQ ID NO: 1933989 - DNA, 16 bp, Homo sapiens
ccgagggcgcctgggt

SEQ ID NO: 1933990 - DNA, 18 bp, Homo sapiens
ccgagtctcttctccact

SEQ ID NO: 1933991 - DNA, 22 bp, Homo sapiens
ccgagtctcttctccactggat

SEQ ID NO: 1933992 - DNA, 16 bp, Homo sapiens
ccgcctctgagccagg

SEQ ID NO: 1933993 - DNA, 11 bp, Homo sapiens
ccgcctgtcct

SEQ ID NO: 1933994 - DNA, 11 bp, Homo sapiens
ccgctcagccc

SEQ ID NO: 1933995 - DNA, 13 bp, Homo sapiens
ccgctcagccctc

SEQ ID NO: 1933996 - DNA, 23 bp, Homo sapiens
ccgctgagcgaggagatgctcct

SEQ ID NO: 1933997 - DNA, 13 bp, Homo sapiens
ccgctgggagagc

SEQ ID NO: 1933998 - DNA, 19 bp, Homo sapiens
ccgctgggagagccaaggc

SEQ ID NO: 1933999 - DNA, 20 bp, Homo sapiens
ccgctgggagagccaaggcc

SEQ ID NO: 1934000 - DNA, 23 bp, Homo sapiens
ccgctgggagagccaaggcctat

SEQ ID NO: 1934001 - DNA, 19 bp, Homo sapiens
ccgctgtgctgttgtctgc

SEQ ID NO: 1934002 - DNA, 18 bp, Homo sapiens
ccgcttggagcagagggg

SEQ ID NO: 1934003 - DNA, 19 bp, Homo sapiens
ccggaatcctgtcctcagc

SEQ ID NO: 1934004 - DNA, 22 bp, Homo sapiens
ccggaatcctgtcctcagcttc

SEQ ID NO: 1934005 - DNA, 14 bp, Homo sapiens
ccggaggggcctgg

SEQ ID NO: 1934006 - DNA, 14 bp, Homo sapiens
ccggcagcctggtt

SEQ ID NO: 1934007 - DNA, 20 bp, Homo sapiens
ccggcccacgtcctgggtgc

SEQ ID NO: 1934008 - DNA, 19 bp, Homo sapiens
ccggctcggcctcttgaga

SEQ ID NO: 1934009 - DNA, 19 bp, Homo sapiens
ccggctggaccacgtctcc

SEQ ID NO: 1934010 - DNA, 13 bp, Homo sapiens
ccggctggacttt

SEQ ID NO: 1934011 - DNA, 15 bp, Homo sapiens
ccggctggacttttg

SEQ ID NO: 1934012 - DNA, 20 bp, Homo sapiens
ccgggggtgggggcctgctg

SEQ ID NO: 1934013 - DNA, 13 bp, Homo sapiens
ccgtccctttccc

SEQ ID NO: 1934014 - DNA, 13 bp, Homo sapiens
ccgtctcctctcc

SEQ ID NO: 1934015 - DNA, 21 bp, Homo sapiens
ccgtggcttcccgctcagccc

SEQ ID NO: 1934016 - DNA, 23 bp, Homo sapiens
ccgtggcttcccgctcagccctc

SEQ ID NO: 1934017 - DNA, 21 bp, Homo sapiens
ccgtgggagaggagaggctgc

SEQ ID NO: 1934018 - DNA, 19 bp, Homo sapiens
ccgttagggaaatccaact

SEQ ID NO: 1934019 - DNA, 23 bp, Homo sapiens
ccgttagggaaatccaactccag

SEQ ID NO: 1934020 - DNA, 19 bp, Homo sapiens
cctaaaagttttaacctca

SEQ ID NO: 1934021 - DNA, 19 bp, Homo sapiens
cctaaagtagacttcattt

SEQ ID NO: 1934022 - DNA, 17 bp, Homo sapiens
cctaatcgccctgagct

SEQ ID NO: 1934023 - DNA, 14 bp, Homo sapiens
cctaattagagcag

SEQ ID NO: 1934024 - DNA, 23 bp, Homo sapiens
cctaattagagcagatgacccct

SEQ ID NO: 1934025 - DNA, 19 bp, Homo sapiens
cctaccgagtctcttctcc

SEQ ID NO: 1934026 - DNA, 20 bp, Homo sapiens
cctaccgagtctcttctcca

SEQ ID NO: 1934027 - DNA, 22 bp, Homo sapiens
cctaccgagtctcttctccact

SEQ ID NO: 1934028 - DNA, 15 bp, Homo sapiens
cctacgaggagtgtt

SEQ ID NO: 1934029 - DNA, 14 bp, Homo sapiens
cctacttcctcctc

SEQ ID NO: 1934030 - DNA, 20 bp, Homo sapiens
cctagaaagccatattccag

SEQ ID NO: 1934031 - DNA, 21 bp, Homo sapiens
cctagaggggacaagccaggc

SEQ ID NO: 1934032 - DNA, 15 bp, Homo sapiens
cctagatggttccct

SEQ ID NO: 1934033 - DNA, 15 bp, Homo sapiens
cctaggtctccaccc

SEQ ID NO: 1934034 - DNA, 19 bp, Homo sapiens
cctaggtctccacccctca

SEQ ID NO: 1934035 - DNA, 16 bp, Homo sapiens
ctcagtcagcccagtg

SEQ ID NO: 1934036 - DNA, 18 bp, Homo sapiens
ctcagtgagatcagtcag

SEQ ID NO: 1934037 - DNA, 17 bp, Homo sapiens
ctcagttttatcatttt

SEQ ID NO: 1934038 - DNA, 15 bp, Homo sapiens
ctcataattgtcaaa

SEQ ID NO: 1934039 - DNA, 13 bp, Homo sapiens
ctcatcattctct

SEQ ID NO: 1934040 - DNA, 15 bp, Homo sapiens
ctcatcattctctgt

SEQ ID NO: 1934041 - DNA, 13 bp, Homo sapiens
ctcatccacagag

SEQ ID NO: 1934042 - DNA, 17 bp, Homo sapiens
ctcatccacagaggcca

SEQ ID NO: 1934043 - DNA, 20 bp, Homo sapiens
ctcatccacagaggccaggc

SEQ ID NO: 1934044 - DNA, 19 bp, Homo sapiens
ctcatccaggtcctttcct

SEQ ID NO: 1934045 - DNA, 24 bp, Homo sapiens
ctcatcctttttaaatgagacttg

SEQ ID NO: 1934046 - DNA, 17 bp, Homo sapiens
ctcatctgtccctccgg

SEQ ID NO: 1934047 - DNA, 13 bp, Homo sapiens
ctcatggcttggg

SEQ ID NO: 1934048 - DNA, 20 bp, Homo sapiens
ctcatggcttgggctggagt

SEQ ID NO: 1934049 - DNA, 23 bp, Homo sapiens
ctcattaattcaattaaaaccat

SEQ ID NO: 1934050 - DNA, 18 bp, Homo sapiens
ctcattaccgtctgtgat

SEQ ID NO: 1934051 - DNA, 14 bp, Homo sapiens
ctccaaggactcta

SEQ ID NO: 1934052 - DNA, 14 bp, Homo sapiens
ctccacccctcaag

SEQ ID NO: 1934053 - DNA, 22 bp, Homo sapiens
ctccacccctcaagccaggaga

SEQ ID NO: 1934054 - DNA, 16 bp, Homo sapiens
ctccacgttcacccct

SEQ ID NO: 1934055 - DNA, 18 bp, Homo sapiens
ctccacgttcacccctcc

SEQ ID NO: 1934056 - DNA, 14 bp, Homo sapiens
ctccactcctccca

SEQ ID NO: 1934057 - DNA, 16 bp, Homo sapiens
ctccactgccttcgat

SEQ ID NO: 1934058 - DNA, 14 bp, Homo sapiens
ctccactggatgga

SEQ ID NO: 1934059 - DNA, 22 bp, Homo sapiens
ctccagacccctaccctttccc

SEQ ID NO: 1934060 - DNA, 23 bp, Homo sapiens
ctccagacccctaccctttccca

SEQ ID NO: 1934061 - DNA, 17 bp, Homo sapiens
ctccagacccctggctt

SEQ ID NO: 1934062 - DNA, 20 bp, Homo sapiens
ctccagacccctggcttttc

SEQ ID NO: 1934063 - DNA, 21 bp, Homo sapiens
ctccagacccctggcttttca

SEQ ID NO: 1934064 - DNA, 13 bp, Homo sapiens
ctccagagggcac

SEQ ID NO: 1934065 - DNA, 20 bp, Homo sapiens
ctccagagtaggtgggtctt

SEQ ID NO: 1934066 - DNA, 18 bp, Homo sapiens
ctccagccacccagccag

SEQ ID NO: 1934067 - DNA, 17 bp, Homo sapiens
ctccaggctgtctttca

SEQ ID NO: 1934068 - DNA, 20 bp, Homo sapiens
ctccatccacatgggagccg

SEQ ID NO: 1934069 - DNA, 20 bp, Homo sapiens
ctccattcccatcactgctg

SEQ ID NO: 1934070 - DNA, 21 bp, Homo sapiens
ctcccacaggcccttcctctc

SEQ ID NO: 1934071 - DNA, 16 bp, Homo sapiens
ctcccagctgacggca

SEQ ID NO: 1934072 - DNA, 17 bp, Homo sapiens
ctcccaggcgccccttc

SEQ ID NO: 1934073 - DNA, 12 bp, Homo sapiens
ctcccccagccc

SEQ ID NO: 1934074 - DNA, 13 bp, Homo sapiens
ctcccccagccct

SEQ ID NO: 1934075 - DNA, 16 bp, Homo sapiens
ctcccctaatgcctgc

SEQ ID NO: 1934076 - DNA, 11 bp, Homo sapiens
ctcccctccag

SEQ ID NO: 1934077 - DNA, 13 bp, Homo sapiens
ctcccctccagac

SEQ ID NO: 1934078 - DNA, 15 bp, Homo sapiens
ctcccctgccagggc

SEQ ID NO: 1934079 - DNA, 16 bp, Homo sapiens
ctcccctgccagggca

SEQ ID NO: 1934080 - DNA, 16 bp, Homo sapiens
ctcccgaatcctgagg

SEQ ID NO: 1934081 - DNA, 15 bp, Homo sapiens
ctcccggtgcccaag

SEQ ID NO: 1934082 - DNA, 21 bp, Homo sapiens
ctcccggtgcccaagaataga

SEQ ID NO: 1934083 - DNA, 10 bp, Homo sapiens
ctccctccac

SEQ ID NO: 1934084 - DNA, 20 bp, Homo sapiens
ctccctccacacctccaccc

SEQ ID NO: 1934085 - DNA, 16 bp, Homo sapiens
ctccctccactcctcc

SEQ ID NO: 1934086 - DNA, 17 bp, Homo sapiens
ctccctccactcctccc

SEQ ID NO: 1934087 - DNA, 15 bp, Homo sapiens
ctccctccctgcagg

SEQ ID NO: 1934088 - DNA, 13 bp, Homo sapiens
ctccctcgcatcc

SEQ ID NO: 1934089 - DNA, 11 bp, Homo sapiens
ctccctgcagg

SEQ ID NO: 1934090 - DNA, 12 bp, Homo sapiens
ctccctgcaggg

SEQ ID NO: 1934091 - DNA, 20 bp, Homo sapiens
ctccctgcccctcccttcaa

SEQ ID NO: 1934092 - DNA, 21 bp, Homo sapiens
ctccctgcccctcccttcaac

SEQ ID NO: 1934093 - DNA, 18 bp, Homo sapiens
ctccctggccccagtgac

SEQ ID NO: 1934094 - DNA, 13 bp, Homo sapiens
ctccctgtcccct

SEQ ID NO: 1934095 - DNA, 12 bp, Homo sapiens
ctcccttcaacc

SEQ ID NO: 1934096 - DNA, 18 bp, Homo sapiens
ctcccttcaaccattccc

SEQ ID NO: 1934097 - DNA, 20 bp, Homo sapiens
ctcccttcaaccattcccca

SEQ ID NO: 1934098 - DNA, 14 bp, Homo sapiens
ctcccttgggctcc

SEQ ID NO: 1934099 - DNA, 16 bp, Homo sapiens
ctccggaaggacacag

SEQ ID NO: 1934100 - DNA, 16 bp, Homo sapiens
ctccggatgacacaaa

SEQ ID NO: 1934101 - DNA, 13 bp, Homo sapiens
ctccgtatttcag

SEQ ID NO: 1934102 - DNA, 13 bp, Homo sapiens
ctcctacctggta

SEQ ID NO: 1934103 - DNA, 14 bp, Homo sapiens
ctcctcccggtgcc

SEQ ID NO: 1934104 - DNA, 15 bp, Homo sapiens
ctcctctctctccct

SEQ ID NO: 1934105 - DNA, 13 bp, Homo sapiens
ctcctctgtgacc

SEQ ID NO: 1934106 - DNA, 23 bp, Homo sapiens
ctcctctgtgaccaatgtcttga

SEQ ID NO: 1934107 - DNA, 18 bp, Homo sapiens
ctcctgaggtctggattg

SEQ ID NO: 1934108 - DNA, 18 bp, Homo sapiens
ctcctgccttcctcctgg

SEQ ID NO: 1934109 - DNA, 23 bp, Homo sapiens
ctcctgggaatggggtgggagcc

SEQ ID NO: 1934110 - DNA, 22 bp, Homo sapiens
ctccttagaaaagactgacctt

SEQ ID NO: 1934111 - DNA, 18 bp, Homo sapiens
ctccttctcccctccaga

SEQ ID NO: 1934112 - DNA, 16 bp, Homo sapiens
ctccttgccgctggga

SEQ ID NO: 1934113 - DNA, 17 bp, Homo sapiens
ctccttgccgctgggag

SEQ ID NO: 1934114 - DNA, 13 bp, Homo sapiens
ctccttgggccct

SEQ ID NO: 1934115 - DNA, 16 bp, Homo sapiens
ctccttgggccctttg

SEQ ID NO: 1934116 - DNA, 19 bp, Homo sapiens
ctccttgggccctttgagt

SEQ ID NO: 1934117 - DNA, 18 bp, Homo sapiens
ctcgcatccgcctctgag

SEQ ID NO: 1934118 - DNA, 16 bp, Homo sapiens
ctcgctggactctcag

SEQ ID NO: 1934119 - DNA, 17 bp, Homo sapiens
ctcggctggaagaacat

SEQ ID NO: 1934120 - DNA, 19 bp, Homo sapiens
ctcgtcccgagggcgcctg

SEQ ID NO: 1934121 - DNA, 22 bp, Homo sapiens
ctcgtcccgagggcgcctgggt

SEQ ID NO: 1934122 - DNA, 20 bp, Homo sapiens
ctcgttgactggctgtgtgt

SEQ ID NO: 1934123 - DNA, 22 bp, Homo sapiens
ctctacctgacactcccttggg

SEQ ID NO: 1934124 - DNA, 20 bp, Homo sapiens
ctctacttagcatgtcccta

SEQ ID NO: 1934125 - DNA, 18 bp, Homo sapiens
ctctcacctacttcctcc

SEQ ID NO: 1934126 - DNA, 15 bp, Homo sapiens
ctctcagtctctgag

SEQ ID NO: 1934127 - DNA, 18 bp, Homo sapiens
ctctcagtctctgagcag

SEQ ID NO: 1934128 - DNA, 19 bp, Homo sapiens
ctctcatccaggtcctttc

SEQ ID NO: 1934129 - DNA, 22 bp, Homo sapiens
ctctcatccaggtcctttcctt

SEQ ID NO: 1934130 - DNA, 12 bp, Homo sapiens
ctctccactgcc

SEQ ID NO: 1934131 - DNA, 14 bp, Homo sapiens
ctctccactgcctt

SEQ ID NO: 1934132 - DNA, 13 bp, Homo sapiens
ctctccagcccta

SEQ ID NO: 1934133 - DNA, 20 bp, Homo sapiens
ctctcccacacaagcagtct

SEQ ID NO: 1934134 - DNA, 12 bp, Homo sapiens
ctctccctccac

SEQ ID NO: 1934135 - DNA, 20 bp, Homo sapiens
ctctccctccactcctccca

SEQ ID NO: 1934136 - DNA, 17 bp, Homo sapiens
ctctcctctctctccct

SEQ ID NO: 1934137 - DNA, 20 bp, Homo sapiens
ctctcctctctctccctcca

SEQ ID NO: 1934138 - DNA, 12 bp, Homo sapiens
ctctctccctcc

SEQ ID NO: 1934139 - DNA, 14 bp, Homo sapiens
ctctctccctccac

SEQ ID NO: 1934140 - DNA, 13 bp, Homo sapiens
ctctctcctctct

SEQ ID NO: 1934141 - DNA, 15 bp, Homo sapiens
ctctctctccctcca

SEQ ID NO: 1934142 - DNA, 12 bp, Homo sapiens
ctctctgctctg

SEQ ID NO: 1934143 - DNA, 20 bp, Homo sapiens
ctctctgtttaccctccctg

SEQ ID NO: 1934144 - DNA, 16 bp, Homo sapiens
ctctctttcttccact

SEQ ID NO: 1934145 - DNA, 17 bp, Homo sapiens
ctctgaaagctgcttct

SEQ ID NO: 1934146 - DNA, 16 bp, Homo sapiens
ctctgactcagggctc

SEQ ID NO: 1934147 - DNA, 17 bp, Homo sapiens
ctctgactcagggctcc

SEQ ID NO: 1934148 - DNA, 13 bp, Homo sapiens
ctctgagcagtga

SEQ ID NO: 1934149 - DNA, 23 bp, Homo sapiens
ctctgagccaccgcgagggcctg

SEQ ID NO: 1934150 - DNA, 12 bp, Homo sapiens
ctctgagtgtga

SEQ ID NO: 1934151 - DNA, 12 bp, Homo sapiens
ctctgatccctc

SEQ ID NO: 1934152 - DNA, 13 bp, Homo sapiens
ctctgcagggcag

SEQ ID NO: 1934153 - DNA, 14 bp, Homo sapiens
ctctgcattctagt

SEQ ID NO: 1934154 - DNA, 18 bp, Homo sapiens
ctctgcctgaacactgct

SEQ ID NO: 1934155 - DNA, 22 bp, Homo sapiens
ctctgcgtgtcacctgtgcttc

SEQ ID NO: 1934156 - DNA, 20 bp, Homo sapiens
ctctgctatgtctgtgatgt

SEQ ID NO: 1934157 - DNA, 13 bp, Homo sapiens
ctctgctctgcgt

SEQ ID NO: 1934158 - DNA, 17 bp, Homo sapiens
ctctggacctgaccaga

SEQ ID NO: 1934159 - DNA, 22 bp, Homo sapiens
ctctggccaaatatgcactttc

SEQ ID NO: 1934160 - DNA, 11 bp, Homo sapiens
ctctggccctg

SEQ ID NO: 1934161 - DNA, 13 bp, Homo sapiens
ctctggctgccaa

SEQ ID NO: 1934162 - DNA, 16 bp, Homo sapiens
ctctggctgccaagat

SEQ ID NO: 1934163 - DNA, 18 bp, Homo sapiens
ctctgtccaatctgcaag

SEQ ID NO: 1934164 - DNA, 15 bp, Homo sapiens
ctctgtctcatccat

SEQ ID NO: 1934165 - DNA, 20 bp, Homo sapiens
ctctgtttaccctccctgtc

SEQ ID NO: 1934166 - DNA, 21 bp, Homo sapiens
ctcttaccccgtccctttccc

SEQ ID NO: 1934167 - DNA, 16 bp, Homo sapiens
ctcttcccccttcccc

SEQ ID NO: 1934168 - DNA, 19 bp, Homo sapiens
ctcttcccccttcccctgc

SEQ ID NO: 1934169 - DNA, 23 bp, Homo sapiens
ctttgggtagtgccatggccagg

SEQ ID NO: 1934170 - DNA, 16 bp, Homo sapiens
ctttgtaaggacttgt

SEQ ID NO: 1934171 - DNA, 20 bp, Homo sapiens
ctttgtaaggacttgtgcct

SEQ ID NO: 1934172 - DNA, 12 bp, Homo sapiens
ctttgtatgcac

SEQ ID NO: 1934173 - DNA, 17 bp, Homo sapiens
ctttgtcttgatcctca

SEQ ID NO: 1934174 - DNA, 19 bp, Homo sapiens
cttttaatgatactgtcta

SEQ ID NO: 1934175 - DNA, 24 bp, Homo sapiens
cttttaatgatactgtctaagaat

SEQ ID NO: 1934176 - DNA, 20 bp, Homo sapiens
cttttcactgctggctgcct

SEQ ID NO: 1934177 - DNA, 15 bp, Homo sapiens
cttttctgcaatgtt

SEQ ID NO: 1934178 - DNA, 17 bp, Homo sapiens
cttttgacaaaggcaag

SEQ ID NO: 1934179 - DNA, 13 bp, Homo sapiens
cttttgcagcttc

SEQ ID NO: 1934180 - DNA, 18 bp, Homo sapiens
cttttgcagcttccttcc

SEQ ID NO: 1934181 - DNA, 11 bp, Homo sapiens
cttttgtaaat

SEQ ID NO: 1934182 - DNA, 23 bp, Homo sapiens
ctttttcaatggttgggacaatg

SEQ ID NO: 1934183 - DNA, 21 bp, Homo sapiens
cttttttcttccccctccatg

SEQ ID NO: 1934184 - DNA, 13 bp, Homo sapiens
gaaaaaaaaagaa

SEQ ID NO: 1934185 - DNA, 19 bp, Homo sapiens
gaaaaaaaaagaataatga

SEQ ID NO: 1934186 - DNA, 17 bp, Homo sapiens
gaaaaacagcagagtaa

SEQ ID NO: 1934187 - DNA, 22 bp, Homo sapiens
gaaaaacagcagagtaaaatta

SEQ ID NO: 1934188 - DNA, 14 bp, Homo sapiens
gaaaaagaaattct

SEQ ID NO: 1934189 - DNA, 18 bp, Homo sapiens
gaaaacagtaactaagca

SEQ ID NO: 1934190 - DNA, 21 bp, Homo sapiens
gaaaaccaagccgtggcttcc

SEQ ID NO: 1934191 - DNA, 20 bp, Homo sapiens
gaaaacccgacaacatttct

SEQ ID NO: 1934192 - DNA, 22 bp, Homo sapiens
gaaaacccgacaacatttctgc

SEQ ID NO: 1934193 - DNA, 12 bp, Homo sapiens
gaaaagactgac

SEQ ID NO: 1934194 - DNA, 23 bp, Homo sapiens
gaaaataaatcaatgctataact

SEQ ID NO: 1934195 - DNA, 14 bp, Homo sapiens
gaaaatggaacatt

SEQ ID NO: 1934196 - DNA, 18 bp, Homo sapiens
gaaaatggtccaggagaa

SEQ ID NO: 1934197 - DNA, 16 bp, Homo sapiens
gaaaattatttgcata

SEQ ID NO: 1934198 - DNA, 20 bp, Homo sapiens
gaaacaactctttgagaaac

SEQ ID NO: 1934199 - DNA, 22 bp, Homo sapiens
gaaacactgggcttctagaacc

SEQ ID NO: 1934200 - DNA, 17 bp, Homo sapiens
gaaacccttgaaaagac

SEQ ID NO: 1934201 - DNA, 24 bp, Homo sapiens
gaaactatgcacctataaatacta

SEQ ID NO: 1934202 - DNA, 20 bp, Homo sapiens
gaaactcctggatccctttc

SEQ ID NO: 1934203 - DNA, 15 bp, Homo sapiens
gaaactgcagggaaa

SEQ ID NO: 1934204 - DNA, 18 bp, Homo sapiens
gaaagaagtggggacaga

SEQ ID NO: 1934205 - DNA, 15 bp, Homo sapiens
gaaagccatattcca

SEQ ID NO: 1934206 - DNA, 15 bp, Homo sapiens
gaaagggcagcccct

SEQ ID NO: 1934207 - DNA, 17 bp, Homo sapiens
gaaagttacaaattgct

SEQ ID NO: 1934208 - DNA, 18 bp, Homo sapiens
gaaatatgcacaatagca

SEQ ID NO: 1934209 - DNA, 13 bp, Homo sapiens
gaaatatgcatgt

SEQ ID NO: 1934210 - DNA, 14 bp, Homo sapiens
gaaatatgcatgta

SEQ ID NO: 1934211 - DNA, 15 bp, Homo sapiens
gaaatattccctaga

SEQ ID NO: 1934212 - DNA, 21 bp, Homo sapiens
gaacaatgtgctatgtgaaga

SEQ ID NO: 1934213 - DNA, 19 bp, Homo sapiens
gaacacctgacaacttctg

SEQ ID NO: 1934214 - DNA, 23 bp, Homo sapiens
gaacatgaaaacagaaaacggtt

SEQ ID NO: 1934215 - DNA, 15 bp, Homo sapiens
gaaccaacactaaca

SEQ ID NO: 1934216 - DNA, 16 bp, Homo sapiens
gaacccccctccccaa

SEQ ID NO: 1934217 - DNA, 21 bp, Homo sapiens
gaacccccctccccaaggaag

SEQ ID NO: 1934218 - DNA, 15 bp, Homo sapiens
gaactaccaaaatga

SEQ ID NO: 1934219 - DNA, 15 bp, Homo sapiens
gaactcctaaatcaa

SEQ ID NO: 1934220 - DNA, 22 bp, Homo sapiens
gaactgctagtcaagtgcgtcc

SEQ ID NO: 1934221 - DNA, 21 bp, Homo sapiens
gaactgctgccatgattttgg

SEQ ID NO: 1934222 - DNA, 18 bp, Homo sapiens
gaactgcttgcatttctt

SEQ ID NO: 1934223 - DNA, 14 bp, Homo sapiens
gaactggccccagc

SEQ ID NO: 1934224 - DNA, 20 bp, Homo sapiens
gaactgttgtttgatgtgta

SEQ ID NO: 1934225 - DNA, 18 bp, Homo sapiens
gaagaagctcctgaatcc

SEQ ID NO: 1934226 - DNA, 22 bp, Homo sapiens
gaagaattacaatttctttaaa

SEQ ID NO: 1934227 - DNA, 23 bp, Homo sapiens
gaagacatgaacgttttctcttc

SEQ ID NO: 1934228 - DNA, 15 bp, Homo sapiens
gaagagggagaagga

SEQ ID NO: 1934229 - DNA, 16 bp, Homo sapiens
gaagcaacagaaaaaa

SEQ ID NO: 1934230 - DNA, 16 bp, Homo sapiens
gaagcaacgaagggaa

SEQ ID NO: 1934231 - DNA, 19 bp, Homo sapiens
gaagcacaagaagtgggag

SEQ ID NO: 1934232 - DNA, 14 bp, Homo sapiens
gaagcacagcaggt

SEQ ID NO: 1934233 - DNA, 23 bp, Homo sapiens
gaagcttcttaaatgagaaggaa

SEQ ID NO: 1934234 - DNA, 17 bp, Homo sapiens
gaaggagaggagtgcgc

SEQ ID NO: 1934235 - DNA, 18 bp, Homo sapiens
gaaggaggaggaggaggt

SEQ ID NO: 1934236 - DNA, 14 bp, Homo sapiens
gaaggatgagcatt

SEQ ID NO: 1934237 - DNA, 16 bp, Homo sapiens
gaaggatgagcattta

SEQ ID NO: 1934238 - DNA, 17 bp, Homo sapiens
gaaggcaagctggcagg

SEQ ID NO: 1934239 - DNA, 18 bp, Homo sapiens
gaaggcaagctggcagga

SEQ ID NO: 1934240 - DNA, 16 bp, Homo sapiens
gaaggccccagggcag

SEQ ID NO: 1934241 - DNA, 15 bp, Homo sapiens
gaaggcctgcccccc

SEQ ID NO: 1934242 - DNA, 19 bp, Homo sapiens
gaaggcctgccccccttcc

SEQ ID NO: 1934243 - DNA, 20 bp, Homo sapiens
gaagggcgctgagggcaggg

SEQ ID NO: 1934244 - DNA, 16 bp, Homo sapiens
gaaggggccagaggct

SEQ ID NO: 1934245 - DNA, 15 bp, Homo sapiens
gaagtcaaagcaagg

SEQ ID NO: 1934246 - DNA, 19 bp, Homo sapiens
gaagtcatagataatagta

SEQ ID NO: 1934247 - DNA, 18 bp, Homo sapiens
gaagtcccaccagggacc

SEQ ID NO: 1934248 - DNA, 17 bp, Homo sapiens
gaagtctctttttcttc

SEQ ID NO: 1934249 - DNA, 16 bp, Homo sapiens
gaagtcttccatcagc

SEQ ID NO: 1934250 - DNA, 19 bp, Homo sapiens
gaagtcttccatcagcagt

SEQ ID NO: 1934251 - DNA, 21 bp, Homo sapiens
gaagtcttccatcagcagtga

SEQ ID NO: 1934252 - DNA, 23 bp, Homo sapiens
gaagtgaatacatggtagcaggg

SEQ ID NO: 1934253 - DNA, 17 bp, Homo sapiens
gaagtggaaaaagaaat

SEQ ID NO: 1934254 - DNA, 19 bp, Homo sapiens
gaagtggaaaaagaaattc

SEQ ID NO: 1934255 - DNA, 15 bp, Homo sapiens
gaagtggcctgagaa

SEQ ID NO: 1934256 - DNA, 21 bp, Homo sapiens
gaagtgggagtgggagaggaa

SEQ ID NO: 1934257 - DNA, 23 bp, Homo sapiens
gaagtgggagtgggagaggaagc

SEQ ID NO: 1934258 - DNA, 22 bp, Homo sapiens
gaagtgggattcaggaatgggc

SEQ ID NO: 1934259 - DNA, 18 bp, Homo sapiens
gaagttactgttatagag

SEQ ID NO: 1934260 - DNA, 22 bp, Homo sapiens
gaataatgacgtattgtgaaat

SEQ ID NO: 1934261 - DNA, 15 bp, Homo sapiens
gaatagatgctgact

SEQ ID NO: 1934262 - DNA, 13 bp, Homo sapiens
gaatgagagagtg

SEQ ID NO: 1934263 - DNA, 14 bp, Homo sapiens
gaatgagctgggcc

SEQ ID NO: 1934264 - DNA, 14 bp, Homo sapiens
gaatgcataaaatg

SEQ ID NO: 1934265 - DNA, 22 bp, Homo sapiens
gaatggggtgggagccacaggg

SEQ ID NO: 1934266 - DNA, 19 bp, Homo sapiens
gaatgtaatcaatgtttct

SEQ ID NO: 1934267 - DNA, 17 bp, Homo sapiens
gaatgttatcagtatta

SEQ ID NO: 1934268 - DNA, 15 bp, Homo sapiens
gaatgtttgaattac

SEQ ID NO: 1934269 - DNA, 12 bp, Homo sapiens
gaattaagaact

SEQ ID NO: 1934270 - DNA, 22 bp, Homo sapiens
gaattcgagacaggcagaatca

SEQ ID NO: 1934271 - DNA, 23 bp, Homo sapiens
gacaaaaatataaagttattaat

SEQ ID NO: 1934272 - DNA, 14 bp, Homo sapiens
gacaaaggtgattt

SEQ ID NO: 1934273 - DNA, 18 bp, Homo sapiens
gacaagccaggccctctc

SEQ ID NO: 1934274 - DNA, 12 bp, Homo sapiens
gacaataaataa

SEQ ID NO: 1934275 - DNA, 12 bp, Homo sapiens
gacacaggctgc

SEQ ID NO: 1934276 - DNA, 14 bp, Homo sapiens
gacacaggctgccg

SEQ ID NO: 1934277 - DNA, 16 bp, Homo sapiens
gacacaggctgccgct

SEQ ID NO: 1934278 - DNA, 16 bp, Homo sapiens
gacacaggggacactg

SEQ ID NO: 1934279 - DNA, 21 bp, Homo sapiens
gacacaggggacactgaacct

SEQ ID NO: 1934280 - DNA, 14 bp, Homo sapiens
gacaccaccaacag

SEQ ID NO: 1934281 - DNA, 12 bp, Homo sapiens
gacaccttccca

SEQ ID NO: 1934282 - DNA, 15 bp, Homo sapiens
gacactcccttgggc

SEQ ID NO: 1934283 - DNA, 21 bp, Homo sapiens
gacactcccttgggctccctg

SEQ ID NO: 1934284 - DNA, 13 bp, Homo sapiens
gacactgaaggca

SEQ ID NO: 1934285 - DNA, 15 bp, Homo sapiens
gacactgaaggcaaa

SEQ ID NO: 1934286 - DNA, 19 bp, Homo sapiens
gacactgaaggcaaatctc

SEQ ID NO: 1934287 - DNA, 21 bp, Homo sapiens
gacacttttcatgtgtgattt

SEQ ID NO: 1934288 - DNA, 19 bp, Homo sapiens
gacagagaggacgtgggcg

SEQ ID NO: 1934289 - DNA, 18 bp, Homo sapiens
gacagagtggatctggag

SEQ ID NO: 1934290 - DNA, 21 bp, Homo sapiens
gacagagtggatctggagtct

SEQ ID NO: 1934291 - DNA, 21 bp, Homo sapiens
gacagatctctgctttggaaa

SEQ ID NO: 1934292 - DNA, 13 bp, Homo sapiens
gacagcaagggct

SEQ ID NO: 1934293 - DNA, 11 bp, Homo sapiens
gacagcctggc

SEQ ID NO: 1934294 - DNA, 12 bp, Homo sapiens
gacagcctggca

SEQ ID NO: 1934295 - DNA, 13 bp, Homo sapiens
gacagcctggcac

SEQ ID NO: 1934296 - DNA, 19 bp, Homo sapiens
gacagcgggtaaaaagaga

SEQ ID NO: 1934297 - DNA, 15 bp, Homo sapiens
gacagggcatggcca

SEQ ID NO: 1934298 - DNA, 22 bp, Homo sapiens
gacagggcatggccaggtggcc

SEQ ID NO: 1934299 - DNA, 18 bp, Homo sapiens
gacagtattgccacctct

SEQ ID NO: 1934300 - DNA, 13 bp, Homo sapiens
gacatattcattt

SEQ ID NO: 1934301 - DNA, 16 bp, Homo sapiens
gacatccaagcttcct

SEQ ID NO: 1934302 - DNA, 16 bp, Homo sapiens
gacatcttagtatttg

SEQ ID NO: 1934303 - DNA, 15 bp, Homo sapiens
gacatgcgggctggg

SEQ ID NO: 1934304 - DNA, 18 bp, Homo sapiens
gacatgcgggctgggcag

SEQ ID NO: 1934305 - DNA, 22 bp, Homo sapiens
gacatgcgggctgggcagctgt

SEQ ID NO: 1934306 - DNA, 13 bp, Homo sapiens
gacatttctctaa

SEQ ID NO: 1934307 - DNA, 22 bp, Homo sapiens
gaccacgtctccctggccccag

SEQ ID NO: 1934308 - DNA, 17 bp, Homo sapiens
gaccagcccagcctgca

SEQ ID NO: 1934309 - DNA, 15 bp, Homo sapiens
gaccataatgttaca

SEQ ID NO: 1934310 - DNA, 20 bp, Homo sapiens
gaccccaccctgtctgcagg

SEQ ID NO: 1934311 - DNA, 12 bp, Homo sapiens
gaccccagagga

SEQ ID NO: 1934312 - DNA, 12 bp, Homo sapiens
gacccctaccct

SEQ ID NO: 1934313 - DNA, 15 bp, Homo sapiens
gacccctaccctttc

SEQ ID NO: 1934314 - DNA, 18 bp, Homo sapiens
gacccctaccctttccca

SEQ ID NO: 1934315 - DNA, 20 bp, Homo sapiens
gacccggaggggcctggcag

SEQ ID NO: 1934316 - DNA, 21 bp, Homo sapiens
gacccggcccccgccctctgc

SEQ ID NO: 1934317 - DNA, 22 bp, Homo sapiens
gacccggcccccgccctctgcc

SEQ ID NO: 1934318 - DNA, 13 bp, Homo sapiens
gaccctgccaggg

SEQ ID NO: 1934319 - DNA, 22 bp, Homo sapiens
gaccctgtgatgcctgacacag

SEQ ID NO: 1934320 - DNA, 18 bp, Homo sapiens
gaccgtttttatattact

SEQ ID NO: 1934321 - DNA, 20 bp, Homo sapiens
gacctcagttttatcatttt

SEQ ID NO: 1934322 - DNA, 17 bp, Homo sapiens
gacctcctaacaagtag

SEQ ID NO: 1934323 - DNA, 12 bp, Homo sapiens
gacctgtaatca

SEQ ID NO: 1934324 - DNA, 20 bp, Homo sapiens
gacgactgttttcccaacac

SEQ ID NO: 1934325 - DNA, 21 bp, Homo sapiens
gacgcctgggggtgccaggac

SEQ ID NO: 1934326 - DNA, 17 bp, Homo sapiens
gacggattatctagaga

SEQ ID NO: 1934327 - DNA, 12 bp, Homo sapiens
gacgtccctcca

SEQ ID NO: 1934328 - DNA, 18 bp, Homo sapiens
gactacagtcaggaaagg

SEQ ID NO: 1934329 - DNA, 13 bp, Homo sapiens
gactactctgcct

SEQ ID NO: 1934330 - DNA, 13 bp, Homo sapiens
gactcagggctcc

SEQ ID NO: 1934331 - DNA, 19 bp, Homo sapiens
gactcagggctcctgggtt

SEQ ID NO: 1934332 - DNA, 16 bp, Homo sapiens
gactcattctgaagga

SEQ ID NO: 1934333 - DNA, 18 bp, Homo sapiens
gactctcagtctctgagc

SEQ ID NO: 1934334 - DNA, 20 bp, Homo sapiens
gactctcagtctctgagcag

SEQ ID NO: 1934335 - DNA, 16 bp, Homo sapiens
gactctggctgccaag

SEQ ID NO: 1934336 - DNA, 14 bp, Homo sapiens
gactggcccacccc

SEQ ID NO: 1934337 - DNA, 21 bp, Homo sapiens
gactggcccacccctcttccc

SEQ ID NO: 1934338 - DNA, 16 bp, Homo sapiens
gactgggctgagggag

SEQ ID NO: 1934339 - DNA, 22 bp, Homo sapiens
gactgggggtgccaaccacctc

SEQ ID NO: 1934340 - DNA, 21 bp, Homo sapiens
gactgtctcaagagggcactg

SEQ ID NO: 1934341 - DNA, 18 bp, Homo sapiens
gactgtctccatggccct

SEQ ID NO: 1934342 - DNA, 22 bp, Homo sapiens
gacttcagactctctcctctct

SEQ ID NO: 1934343 - DNA, 21 bp, Homo sapiens
gacttcatagatttccttccc

SEQ ID NO: 1934344 - DNA, 16 bp, Homo sapiens
gacttcatttttccta

SEQ ID NO: 1934345 - DNA, 14 bp, Homo sapiens
gacttgtgcctctt

SEQ ID NO: 1934346 - DNA, 15 bp, Homo sapiens
gacttgtgcctcttg

SEQ ID NO: 1934347 - DNA, 13 bp, Homo sapiens
gagaaaagacatg

SEQ ID NO: 1934348 - DNA, 22 bp, Homo sapiens
gagaaggacccggaggggcctg

SEQ ID NO: 1934349 - DNA, 23 bp, Homo sapiens
gagaaggacccggaggggcctgg

SEQ ID NO: 1934350 - DNA, 12 bp, Homo sapiens
gagaaggagagg

SEQ ID NO: 1934351 - DNA, 18 bp, Homo sapiens
gagaaggagaggctctga

SEQ ID NO: 1934352 - DNA, 12 bp, Homo sapiens
gagaaggcctgc

SEQ ID NO: 1934353 - DNA, 18 bp, Homo sapiens
gagaaggcctgcccccct

SEQ ID NO: 1934354 - DNA, 21 bp, Homo sapiens
gagaaggcctgccccccttcc

SEQ ID NO: 1934355 - DNA, 22 bp, Homo sapiens
gagaaggcctgccccccttccc

SEQ ID NO: 1934356 - DNA, 19 bp, Homo sapiens
gagaatgagagagtgtgga

SEQ ID NO: 1934357 - DNA, 14 bp, Homo sapiens
gagacagagctggt

SEQ ID NO: 1934358 - DNA, 18 bp, Homo sapiens
gagacccagccctcatcc

SEQ ID NO: 1934359 - DNA, 17 bp, Homo sapiens
gagaccccagagtaggg

SEQ ID NO: 1934360 - DNA, 14 bp, Homo sapiens
gagaccttctctta

SEQ ID NO: 1934361 - DNA, 20 bp, Homo sapiens
gagactgggctgagggagcc

SEQ ID NO: 1934362 - DNA, 13 bp, Homo sapiens
gagagcagggctg

SEQ ID NO: 1934363 - DNA, 20 bp, Homo sapiens
gagagccaaggcctatgcca

SEQ ID NO: 1934364 - DNA, 22 bp, Homo sapiens
gagagccaaggcctatgccacc

SEQ ID NO: 1934365 - DNA, 14 bp, Homo sapiens
gagagcgctggcct

SEQ ID NO: 1934366 - DNA, 19 bp, Homo sapiens
gagagctcaagtttcagag

SEQ ID NO: 1934367 - DNA, 19 bp, Homo sapiens
gagaggaagccacgtgctg

SEQ ID NO: 1934368 - DNA, 21 bp, Homo sapiens
gagaggaagccacgtgctgga

SEQ ID NO: 1934369 - DNA, 16 bp, Homo sapiens
gagaggacgtgggcgg

SEQ ID NO: 1934370 - DNA, 17 bp, Homo sapiens
gagaggacgtgggcggc

SEQ ID NO: 1934371 - DNA, 17 bp, Homo sapiens
gagaggtcttttttaaa

SEQ ID NO: 1934372 - DNA, 14 bp, Homo sapiens
gagatgcagctgga

SEQ ID NO: 1934373 - DNA, 15 bp, Homo sapiens
gagattacctcctga

SEQ ID NO: 1934374 - DNA, 21 bp, Homo sapiens
gagattcttagctcttgggat

SEQ ID NO: 1934375 - DNA, 19 bp, Homo sapiens
gagcacctccacatcctcc

SEQ ID NO: 1934376 - DNA, 16 bp, Homo sapiens
gagcagctgggcactg

SEQ ID NO: 1934377 - DNA, 19 bp, Homo sapiens
gagcagggctgggcgcctc

SEQ ID NO: 1934378 - DNA, 15 bp, Homo sapiens
gagcatacccagtgt

SEQ ID NO: 1934379 - DNA, 20 bp, Homo sapiens
gagcatggccgcaacttccc

SEQ ID NO: 1934380 - DNA, 22 bp, Homo sapiens
gagcatggccgcaacttcccag

SEQ ID NO: 1934381 - DNA, 16 bp, Homo sapiens
gagcattctggggtgg

SEQ ID NO: 1934382 - DNA, 13 bp, Homo sapiens
gagccaaggccta

SEQ ID NO: 1934383 - DNA, 14 bp, Homo sapiens
gagccacagggacg

SEQ ID NO: 1934384 - DNA, 13 bp, Homo sapiens
gagccaggagcct

SEQ ID NO: 1934385 - DNA, 22 bp, Homo sapiens
gagccccacccctgaactggcc

SEQ ID NO: 1934386 - DNA, 17 bp, Homo sapiens
gagccccattcctggga

SEQ ID NO: 1934387 - DNA, 14 bp, Homo sapiens
gagccccctgtcct

SEQ ID NO: 1934388 - DNA, 15 bp, Homo sapiens
gagccccctgtcctt

SEQ ID NO: 1934389 - DNA, 12 bp, Homo sapiens
gagccctgccct

SEQ ID NO: 1934390 - DNA, 19 bp, Homo sapiens
gagccctgccctcactcca

SEQ ID NO: 1934391 - DNA, 20 bp, Homo sapiens
gagccgggtctgcctcttct

SEQ ID NO: 1934392 - DNA, 17 bp, Homo sapiens
gagccgtggtcctttgg

SEQ ID NO: 1934393 - DNA, 17 bp, Homo sapiens
gagccgttgctaatgcc

SEQ ID NO: 1934394 - DNA, 16 bp, Homo sapiens
gagcctatggaaaggg

SEQ ID NO: 1934395 - DNA, 10 bp, Homo sapiens
gagcctgagg

SEQ ID NO: 1934396 - DNA, 12 bp, Homo sapiens
gagcctgaggga

SEQ ID NO: 1934397 - DNA, 16 bp, Homo sapiens
gagccttttattaaca

SEQ ID NO: 1934398 - DNA, 18 bp, Homo sapiens
gagcgaggagatgctcct

SEQ ID NO: 1934399 - DNA, 16 bp, Homo sapiens
gagctcaggagaaggc

SEQ ID NO: 1934400 - DNA, 18 bp, Homo sapiens
gagctggttgggaagaca

SEQ ID NO: 1934401 - DNA, 18 bp, Homo sapiens
gagctgtattaagccact

SEQ ID NO: 1934402 - DNA, 13 bp, Homo sapiens
gagcttccctgac

SEQ ID NO: 1934403 - DNA, 22 bp, Homo sapiens
gagcttgattctaaaggggaca

SEQ ID NO: 1934404 - DNA, 23 bp, Homo sapiens
gaggaagccacgtgctggagagt

SEQ ID NO: 1934405 - DNA, 15 bp, Homo sapiens
gaggaagggcccccg

SEQ ID NO: 1934406 - DNA, 19 bp, Homo sapiens
gaggaaggggccagaggct

SEQ ID NO: 1934407 - DNA, 13 bp, Homo sapiens
gaggacagggagg

SEQ ID NO: 1934408 - DNA, 14 bp, Homo sapiens
gaggacagggaggg

SEQ ID NO: 1934409 - DNA, 13 bp, Homo sapiens
gaggaccctccca

SEQ ID NO: 1934410 - DNA, 14 bp, Homo sapiens
gaggacctgggggg

SEQ ID NO: 1934411 - DNA, 21 bp, Homo sapiens
gaggagcctttccagaactac

SEQ ID NO: 1934412 - DNA, 14 bp, Homo sapiens
gaggaggaggaggt

SEQ ID NO: 1934413 - DNA, 18 bp, Homo sapiens
gaggaggctccagagggc

SEQ ID NO: 1934414 - DNA, 19 bp, Homo sapiens
gaggatgggaaggagggag

SEQ ID NO: 1934415 - DNA, 17 bp, Homo sapiens
gaggattctatgaggca

SEQ ID NO: 1934416 - DNA, 16 bp, Homo sapiens
gaggcagaatggtggg

SEQ ID NO: 1934417 - DNA, 15 bp, Homo sapiens
gaggcaggggctggg

SEQ ID NO: 1934418 - DNA, 20 bp, Homo sapiens
gaggcaggggctgggcagag

SEQ ID NO: 1934419 - DNA, 13 bp, Homo sapiens
gaggcagtggcag

SEQ ID NO: 1934420 - DNA, 16 bp, Homo sapiens
gaggcagtggcagcaa

SEQ ID NO: 1934421 - DNA, 15 bp, Homo sapiens
gaggccagggcagag

SEQ ID NO: 1934422 - DNA, 14 bp, Homo sapiens
gaggccgaggcagg

SEQ ID NO: 1934423 - DNA, 16 bp, Homo sapiens
gaggccgaggcagggg

SEQ ID NO: 1934424 - DNA, 22 bp, Homo sapiens
gaggcctgggagatgcagctgg

SEQ ID NO: 1934425 - DNA, 12 bp, Homo sapiens
gaggcctggtct

SEQ ID NO: 1934426 - DNA, 18 bp, Homo sapiens
gaggctaaaacaaatctc

SEQ ID NO: 1934427 - DNA, 15 bp, Homo sapiens
gagggacgcctgggg

SEQ ID NO: 1934428 - DNA, 12 bp, Homo sapiens
gagggagaagga

SEQ ID NO: 1934429 - DNA, 22 bp, Homo sapiens
gagggagaaggagaggctctga

SEQ ID NO: 1934430 - DNA, 12 bp, Homo sapiens
gagggcaaacca

SEQ ID NO: 1934431 - DNA, 16 bp, Homo sapiens
gagggcactggtggcc

SEQ ID NO: 1934432 - DNA, 18 bp, Homo sapiens
gagggcactggtggcccg

SEQ ID NO: 1934433 - DNA, 16 bp, Homo sapiens
gagggccacatgggag

SEQ ID NO: 1934434 - DNA, 15 bp, Homo sapiens
gctgacttgcagacg

SEQ ID NO: 1934435 - DNA, 13 bp, Homo sapiens
gctgaggcagcag

SEQ ID NO: 1934436 - DNA, 22 bp, Homo sapiens
gctgagggcagggttctagaag

SEQ ID NO: 1934437 - DNA, 17 bp, Homo sapiens
gctgcaagctgcaggga

SEQ ID NO: 1934438 - DNA, 17 bp, Homo sapiens
gctgccacacttcaggc

SEQ ID NO: 1934439 - DNA, 23 bp, Homo sapiens
gctgccacacttcaggctcttct

SEQ ID NO: 1934440 - DNA, 17 bp, Homo sapiens
gctgccagctctgtatc

SEQ ID NO: 1934441 - DNA, 18 bp, Homo sapiens
gctgccccatcagtgctc

SEQ ID NO: 1934442 - DNA, 12 bp, Homo sapiens
gctgccctggtg

SEQ ID NO: 1934443 - DNA, 15 bp, Homo sapiens
gctgccctggtgctg

SEQ ID NO: 1934444 - DNA, 20 bp, Homo sapiens
gctgccctggtgctgccaca

SEQ ID NO: 1934445 - DNA, 22 bp, Homo sapiens
gctgccctggtgctgccacact

SEQ ID NO: 1934446 - DNA, 14 bp, Homo sapiens
gctgctcctcgcag

SEQ ID NO: 1934447 - DNA, 20 bp, Homo sapiens
gctgctcctcgcagttcggt

SEQ ID NO: 1934448 - DNA, 12 bp, Homo sapiens
gctgcttctgtg

SEQ ID NO: 1934449 - DNA, 22 bp, Homo sapiens
gctggactctcagtctctgagc

SEQ ID NO: 1934450 - DNA, 13 bp, Homo sapiens
gctggagagtaga

SEQ ID NO: 1934451 - DNA, 14 bp, Homo sapiens
gctggagtgggctc

SEQ ID NO: 1934452 - DNA, 20 bp, Homo sapiens
gctggatgagaatttgagtg

SEQ ID NO: 1934453 - DNA, 18 bp, Homo sapiens
gctggcagcgctcctgga

SEQ ID NO: 1934454 - DNA, 19 bp, Homo sapiens
gctggccctggctcccaca

SEQ ID NO: 1934455 - DNA, 13 bp, Homo sapiens
gctggcctcttcc

SEQ ID NO: 1934456 - DNA, 14 bp, Homo sapiens
gctggcggggtctg

SEQ ID NO: 1934457 - DNA, 11 bp, Homo sapiens
gctggctgcct

SEQ ID NO: 1934458 - DNA, 14 bp, Homo sapiens
gctggctgccttag

SEQ ID NO: 1934459 - DNA, 11 bp, Homo sapiens
gctgggagagc

SEQ ID NO: 1934460 - DNA, 12 bp, Homo sapiens
gctgggagagcc

SEQ ID NO: 1934461 - DNA, 14 bp, Homo sapiens
gctgggcagctgtt

SEQ ID NO: 1934462 - DNA, 15 bp, Homo sapiens
gctggtcactgccat

SEQ ID NO: 1934463 - DNA, 17 bp, Homo sapiens
gctgtattaagccactt

SEQ ID NO: 1934464 - DNA, 14 bp, Homo sapiens
gctgtcatgcccag

SEQ ID NO: 1934465 - DNA, 21 bp, Homo sapiens
gctgtccctcctgaggtctgg

SEQ ID NO: 1934466 - DNA, 19 bp, Homo sapiens
gctgtggattttgtggctt

SEQ ID NO: 1934467 - DNA, 15 bp, Homo sapiens
gctgtggcccctcct

SEQ ID NO: 1934468 - DNA, 23 bp, Homo sapiens
gctgtggcccctccttctcccct

SEQ ID NO: 1934469 - DNA, 23 bp, Homo sapiens
gctgtgggtcagtgtgccaccct

SEQ ID NO: 1934470 - DNA, 20 bp, Homo sapiens
gctgttgtctgccgtgagag

SEQ ID NO: 1934471 - DNA, 22 bp, Homo sapiens
gctgttgtctgccgtgagagcc

SEQ ID NO: 1934472 - DNA, 21 bp, Homo sapiens
gctgttgttcagaagttgtta

SEQ ID NO: 1934473 - DNA, 13 bp, Homo sapiens
gctgttgtttaaa

SEQ ID NO: 1934474 - DNA, 16 bp, Homo sapiens
gctgttgtttaaaata

SEQ ID NO: 1934475 - DNA, 19 bp, Homo sapiens
gcttcaatctacgatgtta

SEQ ID NO: 1934476 - DNA, 23 bp, Homo sapiens
gcttccatggtggtttcagaaag

SEQ ID NO: 1934477 - DNA, 15 bp, Homo sapiens
gcttcccgctcagcc

SEQ ID NO: 1934478 - DNA, 13 bp, Homo sapiens
gcttccctctgct

SEQ ID NO: 1934479 - DNA, 23 bp, Homo sapiens
gcttccctttcactgaagtgaat

SEQ ID NO: 1934480 - DNA, 23 bp, Homo sapiens
gcttcctttgtttttttttcctg

SEQ ID NO: 1934481 - DNA, 14 bp, Homo sapiens
gcttcggcctgctt

SEQ ID NO: 1934482 - DNA, 16 bp, Homo sapiens
gcttctctctgtggga

SEQ ID NO: 1934483 - DNA, 20 bp, Homo sapiens
gcttgattctaaaggggaca

SEQ ID NO: 1934484 - DNA, 21 bp, Homo sapiens
gcttgattctaaaggggacag

SEQ ID NO: 1934485 - DNA, 15 bp, Homo sapiens
gcttgggctccattc

SEQ ID NO: 1934486 - DNA, 15 bp, Homo sapiens
gcttgtagggtgagg

SEQ ID NO: 1934487 - DNA, 13 bp, Homo sapiens
gcttgtgtacttg

SEQ ID NO: 1934488 - DNA, 15 bp, Homo sapiens
gctttcatgtaaact

SEQ ID NO: 1934489 - DNA, 20 bp, Homo sapiens
gctttcatgtaaactgtgca

SEQ ID NO: 1934490 - DNA, 21 bp, Homo sapiens
gctttcatgtaaactgtgcac

SEQ ID NO: 1934491 - DNA, 19 bp, Homo sapiens
gctttgggctgccctggtg

SEQ ID NO: 1934492 - DNA, 23 bp, Homo sapiens
gctttgttttgcacactttgcca

SEQ ID NO: 1934493 - DNA, 13 bp, Homo sapiens
gcttttcactgct

SEQ ID NO: 1934494 - DNA, 14 bp, Homo sapiens
gcttttcactgctg

SEQ ID NO: 1934495 - DNA, 22 bp, Homo sapiens
gcttttcactgctggctgcctt

SEQ ID NO: 1934496 - DNA, 23 bp, Homo sapiens
gcttttcactgctggctgcctta

SEQ ID NO: 1934497 - DNA, 15 bp, Homo sapiens
ggaaaaagaaattct

SEQ ID NO: 1934498 - DNA, 21 bp, Homo sapiens
ggaaaaccaagccgtggcttc

SEQ ID NO: 1934499 - DNA, 22 bp, Homo sapiens
ggaacaggagtgactctggctg

SEQ ID NO: 1934500 - DNA, 23 bp, Homo sapiens
ggaaccagtaggttgaggacagg

SEQ ID NO: 1934501 - DNA, 24 bp, Homo sapiens
ggaacccttacagtaggagcccag

SEQ ID NO: 1934502 - DNA, 12 bp, Homo sapiens
ggaactgctgcc

SEQ ID NO: 1934503 - DNA, 22 bp, Homo sapiens
ggaagcacaagaagtgggagtg

SEQ ID NO: 1934504 - DNA, 15 bp, Homo sapiens
ggaagcacagcaggt

SEQ ID NO: 1934505 - DNA, 15 bp, Homo sapiens
ggaagccacgtgctg

SEQ ID NO: 1934506 - DNA, 15 bp, Homo sapiens
ggaaggacacagtca

SEQ ID NO: 1934507 - DNA, 13 bp, Homo sapiens
ggaaggagggagg

SEQ ID NO: 1934508 - DNA, 15 bp, Homo sapiens
ggaaggggccagagg

SEQ ID NO: 1934509 - DNA, 21 bp, Homo sapiens
ggaagtgagggtcagagagga

SEQ ID NO: 1934510 - DNA, 14 bp, Homo sapiens
ggaatcctgtcctc

SEQ ID NO: 1934511 - DNA, 19 bp, Homo sapiens
ggaattttcattggatgca

SEQ ID NO: 1934512 - DNA, 23 bp, Homo sapiens
ggacaaagaaatagcaagagatg

SEQ ID NO: 1934513 - DNA, 22 bp, Homo sapiens
ggacaaggctagatcatgaaga

SEQ ID NO: 1934514 - DNA, 19 bp, Homo sapiens
ggacactgaaccttgttga

SEQ ID NO: 1934515 - DNA, 20 bp, Homo sapiens
ggacagaaccaacgggtctg

SEQ ID NO: 1934516 - DNA, 19 bp, Homo sapiens
ggacaggaagcacagcagg

SEQ ID NO: 1934517 - DNA, 18 bp, Homo sapiens
ggaccagcccagcctgca

SEQ ID NO: 1934518 - DNA, 19 bp, Homo sapiens
ggaccagtcaacctgggca

SEQ ID NO: 1934519 - DNA, 17 bp, Homo sapiens
ggacctggtgctgcctc

SEQ ID NO: 1934520 - DNA, 18 bp, Homo sapiens
ggactctcagtctctgag

SEQ ID NO: 1934521 - DNA, 23 bp, Homo sapiens
ggactgttgacatccaagcttcc

SEQ ID NO: 1934522 - DNA, 20 bp, Homo sapiens
ggacttttgcagcttccttc

SEQ ID NO: 1934523 - DNA, 18 bp, Homo sapiens
ggagaaggagaggctctg

SEQ ID NO: 1934524 - DNA, 18 bp, Homo sapiens
ggagaaggcctgcccccc

SEQ ID NO: 1934525 - DNA, 22 bp, Homo sapiens
ggagaaggcctgccccccttcc

SEQ ID NO: 1934526 - DNA, 14 bp, Homo sapiens
ggagaagggacagc

SEQ ID NO: 1934527 - DNA, 22 bp, Homo sapiens
ggagactagatttatgaataca

SEQ ID NO: 1934528 - DNA, 22 bp, Homo sapiens
ggagactgctgagtcaacccaa

SEQ ID NO: 1934529 - DNA, 17 bp, Homo sapiens
ggagactgggctgaggg

SEQ ID NO: 1934530 - DNA, 23 bp, Homo sapiens
ggagactgggctgagggagcctg

SEQ ID NO: 1934531 - DNA, 16 bp, Homo sapiens
ggagactgtctcaaga

SEQ ID NO: 1934532 - DNA, 21 bp, Homo sapiens
ggagagaatgagagagtgtgg

SEQ ID NO: 1934533 - DNA, 14 bp, Homo sapiens
ggagagagactcca

SEQ ID NO: 1934534 - DNA, 16 bp, Homo sapiens
ggagagagagttctca

SEQ ID NO: 1934535 - DNA, 22 bp, Homo sapiens
ggagagccaccaagagggacgc

SEQ ID NO: 1934536 - DNA, 11 bp, Homo sapiens
ggagaggaagc

SEQ ID NO: 1934537 - DNA, 13 bp, Homo sapiens
ggagaggaagcca

SEQ ID NO: 1934538 - DNA, 20 bp, Homo sapiens
ggagaggaagccacgtgctg

SEQ ID NO: 1934539 - DNA, 11 bp, Homo sapiens
ggagaggtctt

SEQ ID NO: 1934540 - DNA, 12 bp, Homo sapiens
ggagcagctggg

SEQ ID NO: 1934541 - DNA, 16 bp, Homo sapiens
ggagccaatggagact

SEQ ID NO: 1934542 - DNA, 21 bp, Homo sapiens
ggagccactcctctgactcag

SEQ ID NO: 1934543 - DNA, 16 bp, Homo sapiens
ggagcccagctctgaa

SEQ ID NO: 1934544 - DNA, 16 bp, Homo sapiens
ggagccccattcctgg

SEQ ID NO: 1934545 - DNA, 17 bp, Homo sapiens
ggagccccattcctggg

SEQ ID NO: 1934546 - DNA, 21 bp, Homo sapiens
ggaggaaaaccaagccgtggc

SEQ ID NO: 1934547 - DNA, 11 bp, Homo sapiens
ggaggacagaa

SEQ ID NO: 1934548 - DNA, 23 bp, Homo sapiens
ggaggaggtttaggtcaagaaga

SEQ ID NO: 1934549 - DNA, 14 bp, Homo sapiens
ggaggcagaaccag

SEQ ID NO: 1934550 - DNA, 19 bp, Homo sapiens
ggaggcaggtcccgagccc

SEQ ID NO: 1934551 - DNA, 16 bp, Homo sapiens
ggaggccacgggggag

SEQ ID NO: 1934552 - DNA, 14 bp, Homo sapiens
ggaggccgaggcag

SEQ ID NO: 1934553 - DNA, 14 bp, Homo sapiens
ggaggcctggtctg

SEQ ID NO: 1934554 - DNA, 16 bp, Homo sapiens
ggaggcctggtctgga

SEQ ID NO: 1934555 - DNA, 15 bp, Homo sapiens
ggagggcagcagggc

SEQ ID NO: 1934556 - DNA, 23 bp, Homo sapiens
ggagggccacatgggaggctcac

SEQ ID NO: 1934557 - DNA, 20 bp, Homo sapiens
ggagggtggcacttcgtgga

SEQ ID NO: 1934558 - DNA, 17 bp, Homo sapiens
ggaggtgtggagtggag

SEQ ID NO: 1934559 - DNA, 20 bp, Homo sapiens
ggaggtttaggtcaagaaga

SEQ ID NO: 1934560 - DNA, 14 bp, Homo sapiens
ggagtgactctggc

SEQ ID NO: 1934561 - DNA, 23 bp, Homo sapiens
ggagtgggctctctggacctgac

SEQ ID NO: 1934562 - DNA, 21 bp, Homo sapiens
ggagtgtgtgggggtctggga

SEQ ID NO: 1934563 - DNA, 20 bp, Homo sapiens
ggagtgttccccttccactg

SEQ ID NO: 1934564 - DNA, 12 bp, Homo sapiens
ggatccagagag

SEQ ID NO: 1934565 - DNA, 13 bp, Homo sapiens
ggatccctcatct

SEQ ID NO: 1934566 - DNA, 18 bp, Homo sapiens
gtctgagccctgccctca

SEQ ID NO: 1934567 - DNA, 16 bp, Homo sapiens
gtctgagcggccgcct

SEQ ID NO: 1934568 - DNA, 17 bp, Homo sapiens
gtctgagcggccgcctg

SEQ ID NO: 1934569 - DNA, 21 bp, Homo sapiens
gtctgagcggccgcctgtcct

SEQ ID NO: 1934570 - DNA, 15 bp, Homo sapiens
gtctgccgtgagagc

SEQ ID NO: 1934571 - DNA, 16 bp, Homo sapiens
gtctgccgtgagagcc

SEQ ID NO: 1934572 - DNA, 11 bp, Homo sapiens
gtctgcctctt

SEQ ID NO: 1934573 - DNA, 17 bp, Homo sapiens
gtctgcctgcctcatgc

SEQ ID NO: 1934574 - DNA, 14 bp, Homo sapiens
gtctgcgccgctgt

SEQ ID NO: 1934575 - DNA, 18 bp, Homo sapiens
gtctgcgccgctgtgctg

SEQ ID NO: 1934576 - DNA, 15 bp, Homo sapiens
gtctgctcctgggaa

SEQ ID NO: 1934577 - DNA, 15 bp, Homo sapiens
gtctggctgtggccc

SEQ ID NO: 1934578 - DNA, 16 bp, Homo sapiens
gtctggctgtggcccc

SEQ ID NO: 1934579 - DNA, 18 bp, Homo sapiens
gtctggctgtggcccctc

SEQ ID NO: 1934580 - DNA, 19 bp, Homo sapiens
gtctggctgtggcccctcc

SEQ ID NO: 1934581 - DNA, 21 bp, Homo sapiens
gtctggctgtggcccctcctt

SEQ ID NO: 1934582 - DNA, 22 bp, Homo sapiens
gtctggctgtggcccctccttc

SEQ ID NO: 1934583 - DNA, 20 bp, Homo sapiens
gtctgtgatgtcagtagtgc

SEQ ID NO: 1934584 - DNA, 14 bp, Homo sapiens
gtctgtgattgcca

SEQ ID NO: 1934585 - DNA, 21 bp, Homo sapiens
gtctgttccccatggccactt

SEQ ID NO: 1934586 - DNA, 22 bp, Homo sapiens
gtcttagggtacagcccaggcg

SEQ ID NO: 1934587 - DNA, 14 bp, Homo sapiens
gtcttccatcagca

SEQ ID NO: 1934588 - DNA, 17 bp, Homo sapiens
gtcttcctctctctcac

SEQ ID NO: 1934589 - DNA, 20 bp, Homo sapiens
gtcttgagagcgctggcctc

SEQ ID NO: 1934590 - DNA, 13 bp, Homo sapiens
gtcttgagtgggc

SEQ ID NO: 1934591 - DNA, 15 bp, Homo sapiens
gtgaaatttgttaat

SEQ ID NO: 1934592 - DNA, 17 bp, Homo sapiens
gtgaaatttgttaatat

SEQ ID NO: 1934593 - DNA, 20 bp, Homo sapiens
gtgaaatttgttaatatata

SEQ ID NO: 1934594 - DNA, 18 bp, Homo sapiens
gtgaacataactgtaaca

SEQ ID NO: 1934595 - DNA, 21 bp, Homo sapiens
gtgaagcccaggaggacctgg

SEQ ID NO: 1934596 - DNA, 17 bp, Homo sapiens
gtgaaggcttctctctg

SEQ ID NO: 1934597 - DNA, 22 bp, Homo sapiens
gtgaaggcttctctctgtggga

SEQ ID NO: 1934598 - DNA, 23 bp, Homo sapiens
gtgacaggcagtgttcttggggg

SEQ ID NO: 1934599 - DNA, 15 bp, Homo sapiens
gtgacccagtcagag

SEQ ID NO: 1934600 - DNA, 19 bp, Homo sapiens
gtgacgggggttggggtgg

SEQ ID NO: 1934601 - DNA, 19 bp, Homo sapiens
gtgactaccacttatttct

SEQ ID NO: 1934602 - DNA, 16 bp, Homo sapiens
gtgactctggctgcca

SEQ ID NO: 1934603 - DNA, 18 bp, Homo sapiens
gtgactctggctgccaag

SEQ ID NO: 1934604 - DNA, 20 bp, Homo sapiens
gtgacttcagactctctcct

SEQ ID NO: 1934605 - DNA, 15 bp, Homo sapiens
gtgagaactactcag

SEQ ID NO: 1934606 - DNA, 13 bp, Homo sapiens
gtgagatcagtca

SEQ ID NO: 1934607 - DNA, 22 bp, Homo sapiens
gtgaggaggaggcagaaccagc

SEQ ID NO: 1934608 - DNA, 23 bp, Homo sapiens
gtgagggcaaaccaggctgcagg

SEQ ID NO: 1934609 - DNA, 11 bp, Homo sapiens
gtgatgggagt

SEQ ID NO: 1934610 - DNA, 14 bp, Homo sapiens
gtgatggttcccct

SEQ ID NO: 1934611 - DNA, 22 bp, Homo sapiens
gtgatggttcccctgttcactc

SEQ ID NO: 1934612 - DNA, 23 bp, Homo sapiens
gtgatggttcccctgttcactct

SEQ ID NO: 1934613 - DNA, 14 bp, Homo sapiens
gtgcaccgtgcagc

SEQ ID NO: 1934614 - DNA, 17 bp, Homo sapiens
gtgcacctgccccaggc

SEQ ID NO: 1934615 - DNA, 18 bp, Homo sapiens
gtgcacctgccccaggct

SEQ ID NO: 1934616 - DNA, 21 bp, Homo sapiens
gtgcacctgccccaggctcag

SEQ ID NO: 1934617 - DNA, 15 bp, Homo sapiens
gtgcagcatatgagg

SEQ ID NO: 1934618 - DNA, 17 bp, Homo sapiens
gtgcagccgctgagcga

SEQ ID NO: 1934619 - DNA, 15 bp, Homo sapiens
gtgcatctcagccca

SEQ ID NO: 1934620 - DNA, 18 bp, Homo sapiens
gtgcatgcagcatctaag

SEQ ID NO: 1934621 - DNA, 23 bp, Homo sapiens
gtgcatttgtgtctgcctgcctc

SEQ ID NO: 1934622 - DNA, 20 bp, Homo sapiens
gtgccacatggccgctgccc

SEQ ID NO: 1934623 - DNA, 22 bp, Homo sapiens
gtgccacatggccgctgcccac

SEQ ID NO: 1934624 - DNA, 16 bp, Homo sapiens
gtgccaccctctgcag

SEQ ID NO: 1934625 - DNA, 17 bp, Homo sapiens
gtgccaccctctgcagg

SEQ ID NO: 1934626 - DNA, 18 bp, Homo sapiens
gtgccaccctctgcaggg

SEQ ID NO: 1934627 - DNA, 13 bp, Homo sapiens
gtgccaggaccag

SEQ ID NO: 1934628 - DNA, 16 bp, Homo sapiens
gtgccaggaccagtca

SEQ ID NO: 1934629 - DNA, 19 bp, Homo sapiens
gtgccaggactctctttct

SEQ ID NO: 1934630 - DNA, 14 bp, Homo sapiens
gtgccatccctgag

SEQ ID NO: 1934631 - DNA, 16 bp, Homo sapiens
gtgccatccctgagag

SEQ ID NO: 1934632 - DNA, 18 bp, Homo sapiens
gtgccatggccaggagtg

SEQ ID NO: 1934633 - DNA, 17 bp, Homo sapiens
gtgccccatcagcagct

SEQ ID NO: 1934634 - DNA, 16 bp, Homo sapiens
gtgcctcttgggagac

SEQ ID NO: 1934635 - DNA, 15 bp, Homo sapiens
gtgcgtccacgagct

SEQ ID NO: 1934636 - DNA, 11 bp, Homo sapiens
gtgctgcctct

SEQ ID NO: 1934637 - DNA, 19 bp, Homo sapiens
gtgctgcctctacctgaca

SEQ ID NO: 1934638 - DNA, 12 bp, Homo sapiens
gtgctggagagt

SEQ ID NO: 1934639 - DNA, 17 bp, Homo sapiens
gtgctgtcatgcccagc

SEQ ID NO: 1934640 - DNA, 21 bp, Homo sapiens
gtgctgtcatgcccagcttgg

SEQ ID NO: 1934641 - DNA, 19 bp, Homo sapiens
gtgctgttgtttaaaataa

SEQ ID NO: 1934642 - DNA, 14 bp, Homo sapiens
gtggaaaaagaaat

SEQ ID NO: 1934643 - DNA, 14 bp, Homo sapiens
gtggagaggagaga

SEQ ID NO: 1934644 - DNA, 18 bp, Homo sapiens
gtggagaggagagaatga

SEQ ID NO: 1934645 - DNA, 20 bp, Homo sapiens
gtggagccacaggcagacga

SEQ ID NO: 1934646 - DNA, 12 bp, Homo sapiens
gtggagggccac

SEQ ID NO: 1934647 - DNA, 17 bp, Homo sapiens
gtggcaggacactgcag

SEQ ID NO: 1934648 - DNA, 17 bp, Homo sapiens
gtggcccgacagcctgg

SEQ ID NO: 1934649 - DNA, 19 bp, Homo sapiens
gtggcccgacagcctggca

SEQ ID NO: 1934650 - DNA, 18 bp, Homo sapiens
gtggcttggaacatttgg

SEQ ID NO: 1934651 - DNA, 13 bp, Homo sapiens
gtgggagaaggga

SEQ ID NO: 1934652 - DNA, 17 bp, Homo sapiens
gtgggagaggaagccac

SEQ ID NO: 1934653 - DNA, 21 bp, Homo sapiens
gtgggcaggggttccagcttc

SEQ ID NO: 1934654 - DNA, 13 bp, Homo sapiens
gtgggctccagag

SEQ ID NO: 1934655 - DNA, 13 bp, Homo sapiens
gtgggctccctga

SEQ ID NO: 1934656 - DNA, 14 bp, Homo sapiens
gtgggctccctgac

SEQ ID NO: 1934657 - DNA, 14 bp, Homo sapiens
gtgggggcctgctg

SEQ ID NO: 1934658 - DNA, 16 bp, Homo sapiens
gtgggggtctgggagg

SEQ ID NO: 1934659 - DNA, 20 bp, Homo sapiens
gtgggggtctgggaggcagg

SEQ ID NO: 1934660 - DNA, 19 bp, Homo sapiens
gtggggttttcacttccta

SEQ ID NO: 1934661 - DNA, 22 bp, Homo sapiens
gtgggtccatgggcagagccca

SEQ ID NO: 1934662 - DNA, 15 bp, Homo sapiens
gtggtcttggagagg

SEQ ID NO: 1934663 - DNA, 18 bp, Homo sapiens
gtggtcttggagaggagg

SEQ ID NO: 1934664 - DNA, 20 bp, Homo sapiens
gtggtcttggagaggaggtg

SEQ ID NO: 1934665 - DNA, 23 bp, Homo sapiens
gtggtgtgtccccctctgtccag

SEQ ID NO: 1934666 - DNA, 13 bp, Homo sapiens
gtggttggaggcc

SEQ ID NO: 1934667 - DNA, 15 bp, Homo sapiens
gtggttggaggcctg

SEQ ID NO: 1934668 - DNA, 22 bp, Homo sapiens
gtggttggaggcctggtctgga

SEQ ID NO: 1934669 - DNA, 19 bp, Homo sapiens
gtgtatgtgtttataattg

SEQ ID NO: 1934670 - DNA, 14 bp, Homo sapiens
gtgtcacagaggca

SEQ ID NO: 1934671 - DNA, 15 bp, Homo sapiens
gtgtcacagaggcag

SEQ ID NO: 1934672 - DNA, 14 bp, Homo sapiens
gtgtcacctgtgct

SEQ ID NO: 1934673 - DNA, 18 bp, Homo sapiens
gtgtcgtaacagcaggag

SEQ ID NO: 1934674 - DNA, 15 bp, Homo sapiens
gtgtctaatgcatta

SEQ ID NO: 1934675 - DNA, 15 bp, Homo sapiens
gtgtcttttaatgat

SEQ ID NO: 1934676 - DNA, 22 bp, Homo sapiens
gtgtcttttaatgatactgtct

SEQ ID NO: 1934677 - DNA, 14 bp, Homo sapiens
gtgtgaggccaggg

SEQ ID NO: 1934678 - DNA, 20 bp, Homo sapiens
gtgtgagggcaaaccaggct

SEQ ID NO: 1934679 - DNA, 14 bp, Homo sapiens
gtgtgatcgtctga

SEQ ID NO: 1934680 - DNA, 17 bp, Homo sapiens
gtgtgccacaggctgca

SEQ ID NO: 1934681 - DNA, 18 bp, Homo sapiens
gtgtgccaccctctgcag

SEQ ID NO: 1934682 - DNA, 20 bp, Homo sapiens
gtgtgccaccctctgcaggg

SEQ ID NO: 1934683 - DNA, 23 bp, Homo sapiens
gtgtgccaccctctgcagggcag

SEQ ID NO: 1934684 - DNA, 14 bp, Homo sapiens
gtgtgctgttgttt

SEQ ID NO: 1934685 - DNA, 13 bp, Homo sapiens
gtgtggagtggag

SEQ ID NO: 1934686 - DNA, 23 bp, Homo sapiens
gtgtggcttggaacatttgggag

SEQ ID NO: 1934687 - DNA, 16 bp, Homo sapiens
gtgtggggagggtggg

SEQ ID NO: 1934688 - DNA, 17 bp, Homo sapiens
gtgtgggggtctgggag

SEQ ID NO: 1934689 - DNA, 15 bp, Homo sapiens
gtgtgtaagctgact

SEQ ID NO: 1934690 - DNA, 20 bp, Homo sapiens
gtgtgtttcaggacagctgc

SEQ ID NO: 1934691 - DNA, 18 bp, Homo sapiens
gtgttccccttccactga

SEQ ID NO: 1934692 - DNA, 16 bp, Homo sapiens
gtgttcgtggagccac

SEQ ID NO: 1934693 - DNA, 15 bp, Homo sapiens
gtgttcttgggggtg

SEQ ID NO: 1934694 - DNA, 13 bp, Homo sapiens
gtgttgcagaagg

SEQ ID NO: 1934695 - DNA, 17 bp, Homo sapiens
gttaacatctgaagtgt

SEQ ID NO: 1934696 - DNA, 20 bp, Homo sapiens
gttaaggggatctaaaagga

SEQ ID NO: 1934697 - DNA, 19 bp, Homo sapiens
gttaatcacttaacctgct

SEQ ID NO: 1934698 - DNA, 16 bp, Homo sapiens
gttaccgagtatctgt

SEQ ID NO: 1934699 - DNA, 13 bp, Homo sapiens
ttatattttctat

SEQ ID NO: 1934700 - DNA, 15 bp, Homo sapiens
ttatattttctatat

SEQ ID NO: 1934701 - DNA, 21 bp, Homo sapiens
ttatcagtcataactaaataa

SEQ ID NO: 1934702 - DNA, 14 bp, Homo sapiens
ttatgtcattgtgt

SEQ ID NO: 1934703 - DNA, 15 bp, Homo sapiens
ttattaaatcggcaa

SEQ ID NO: 1934704 - DNA, 21 bp, Homo sapiens
ttattagagattacctcctga

SEQ ID NO: 1934705 - DNA, 22 bp, Homo sapiens
ttattagcattttcaagaagac

SEQ ID NO: 1934706 - DNA, 14 bp, Homo sapiens
ttattgtaaacttt

SEQ ID NO: 1934707 - DNA, 12 bp, Homo sapiens
ttatttctaaat

SEQ ID NO: 1934708 - DNA, 13 bp, Homo sapiens
ttatttctaaatc

SEQ ID NO: 1934709 - DNA, 12 bp, Homo sapiens
ttatttctgtct

SEQ ID NO: 1934710 - DNA, 21 bp, Homo sapiens
ttatttctgtctcataattgt

SEQ ID NO: 1934711 - DNA, 20 bp, Homo sapiens
ttatttgaaaacactgctgt

SEQ ID NO: 1934712 - DNA, 17 bp, Homo sapiens
ttatttgaataacaagg

SEQ ID NO: 1934713 - DNA, 16 bp, Homo sapiens
ttattttttaattatt

SEQ ID NO: 1934714 - DNA, 16 bp, Homo sapiens
ttcaaaatggagggaa

SEQ ID NO: 1934715 - DNA, 13 bp, Homo sapiens
ttcaaacacacac

SEQ ID NO: 1934716 - DNA, 16 bp, Homo sapiens
ttcaaacacacacaca

SEQ ID NO: 1934717 - DNA, 17 bp, Homo sapiens
ttcaaccattccccatg

SEQ ID NO: 1934718 - DNA, 16 bp, Homo sapiens
ttcaaccattgaaggg

SEQ ID NO: 1934719 - DNA, 13 bp, Homo sapiens
ttcaacgcagccc

SEQ ID NO: 1934720 - DNA, 14 bp, Homo sapiens
ttcaacgcagccct

SEQ ID NO: 1934721 - DNA, 14 bp, Homo sapiens
ttcaagtgcaatcc

SEQ ID NO: 1934722 - DNA, 16 bp, Homo sapiens
ttcaagtgcaatccat

SEQ ID NO: 1934723 - DNA, 17 bp, Homo sapiens
ttcaatggttgggacaa

SEQ ID NO: 1934724 - DNA, 19 bp, Homo sapiens
ttcaattgcatctcccaga

SEQ ID NO: 1934725 - DNA, 17 bp, Homo sapiens
ttcacaacacaatcaaa

SEQ ID NO: 1934726 - DNA, 20 bp, Homo sapiens
ttcacaacacaatcaaaaga

SEQ ID NO: 1934727 - DNA, 18 bp, Homo sapiens
ttcacatctaacctcatc

SEQ ID NO: 1934728 - DNA, 19 bp, Homo sapiens
ttcacatctaacctcatct

SEQ ID NO: 1934729 - DNA, 24 bp, Homo sapiens
ttcaccatttggcaatgccatcat

SEQ ID NO: 1934730 - DNA, 20 bp, Homo sapiens
ttcacggacaggaagcacag

SEQ ID NO: 1934731 - DNA, 21 bp, Homo sapiens
ttcactgaagtgaatacatgg

SEQ ID NO: 1934732 - DNA, 19 bp, Homo sapiens
ttcagaaagggcagcccct

SEQ ID NO: 1934733 - DNA, 20 bp, Homo sapiens
ttcagaaagggcagcccctc

SEQ ID NO: 1934734 - DNA, 18 bp, Homo sapiens
ttcagctcacacatgaga

SEQ ID NO: 1934735 - DNA, 13 bp, Homo sapiens
ttcagctttggat

SEQ ID NO: 1934736 - DNA, 23 bp, Homo sapiens
ttcagcttttttttcagccattc

SEQ ID NO: 1934737 - DNA, 22 bp, Homo sapiens
ttcagggggccaggtgcacaga

SEQ ID NO: 1934738 - DNA, 16 bp, Homo sapiens
ttcagtaaacaccatg

SEQ ID NO: 1934739 - DNA, 14 bp, Homo sapiens
ttcagtggggcagt

SEQ ID NO: 1934740 - DNA, 22 bp, Homo sapiens
ttcagtgttaaatgtgatgaat

SEQ ID NO: 1934741 - DNA, 18 bp, Homo sapiens
ttcatagtttctgtaatt

SEQ ID NO: 1934742 - DNA, 16 bp, Homo sapiens
ttcatcaccagacttt

SEQ ID NO: 1934743 - DNA, 15 bp, Homo sapiens
ttcatctcattaatt

SEQ ID NO: 1934744 - DNA, 15 bp, Homo sapiens
ttcatctttccaaat

SEQ ID NO: 1934745 - DNA, 17 bp, Homo sapiens
ttcatgatttcatttca

SEQ ID NO: 1934746 - DNA, 23 bp, Homo sapiens
ttcatgatttcatttcaactgtt

SEQ ID NO: 1934747 - DNA, 14 bp, Homo sapiens
ttcatgatttgcaa

SEQ ID NO: 1934748 - DNA, 22 bp, Homo sapiens
ttcatgatttgcaactttagaa

SEQ ID NO: 1934749 - DNA, 17 bp, Homo sapiens
ttcatgtaaactgtgca

SEQ ID NO: 1934750 - DNA, 21 bp, Homo sapiens
ttcattccctttcatgatttg

SEQ ID NO: 1934751 - DNA, 15 bp, Homo sapiens
ttcatttttcctaac

SEQ ID NO: 1934752 - DNA, 15 bp, Homo sapiens
ttccaaattgatggg

SEQ ID NO: 1934753 - DNA, 19 bp, Homo sapiens
ttccaagcctgggccactg

SEQ ID NO: 1934754 - DNA, 21 bp, Homo sapiens
ttccaagcctgggccactggc

SEQ ID NO: 1934755 - DNA, 18 bp, Homo sapiens
ttccaatgtgcccagtca

SEQ ID NO: 1934756 - DNA, 21 bp, Homo sapiens
ttccaatgtgcccagtcatga

SEQ ID NO: 1934757 - DNA, 22 bp, Homo sapiens
ttccacctttatgttttaatat

SEQ ID NO: 1934758 - DNA, 15 bp, Homo sapiens
ttccacggagccact

SEQ ID NO: 1934759 - DNA, 16 bp, Homo sapiens
ttccactaccctccct

SEQ ID NO: 1934760 - DNA, 10 bp, Homo sapiens
ttccagacag

SEQ ID NO: 1934761 - DNA, 17 bp, Homo sapiens
ttccagacagagtggat

SEQ ID NO: 1934762 - DNA, 20 bp, Homo sapiens
ttccagacagggtggggctt

SEQ ID NO: 1934763 - DNA, 18 bp, Homo sapiens
ttccagagagtggctcct

SEQ ID NO: 1934764 - DNA, 21 bp, Homo sapiens
ttccagagagtggctcctccc

SEQ ID NO: 1934765 - DNA, 16 bp, Homo sapiens
ttccagcagtgaaact

SEQ ID NO: 1934766 - DNA, 12 bp, Homo sapiens
ttccagcttccc

SEQ ID NO: 1934767 - DNA, 15 bp, Homo sapiens
ttccagcttgaggga

SEQ ID NO: 1934768 - DNA, 22 bp, Homo sapiens
ttccatcctgtacaagtgctca

SEQ ID NO: 1934769 - DNA, 13 bp, Homo sapiens
ttccatttgcaag

SEQ ID NO: 1934770 - DNA, 12 bp, Homo sapiens
ttcccaggtgct

SEQ ID NO: 1934771 - DNA, 11 bp, Homo sapiens
ttccccatggg

SEQ ID NO: 1934772 - DNA, 15 bp, Homo sapiens
ttcccccactgatca

SEQ ID NO: 1934773 - DNA, 14 bp, Homo sapiens
ttccccctccatgt

SEQ ID NO: 1934774 - DNA, 16 bp, Homo sapiens
ttcccctgcgccctcc

SEQ ID NO: 1934775 - DNA, 20 bp, Homo sapiens
ttcccctgcgccctccctcc

SEQ ID NO: 1934776 - DNA, 17 bp, Homo sapiens
ttcccctgttcactcta

SEQ ID NO: 1934777 - DNA, 14 bp, Homo sapiens
ttccccttccactg

SEQ ID NO: 1934778 - DNA, 21 bp, Homo sapiens
ttccccttccactgagggcag

SEQ ID NO: 1934779 - DNA, 21 bp, Homo sapiens
ttcccgctcagccctccctgc

SEQ ID NO: 1934780 - DNA, 14 bp, Homo sapiens
ttcccggctggact

SEQ ID NO: 1934781 - DNA, 22 bp, Homo sapiens
ttccctagaaacttccaaatcc

SEQ ID NO: 1934782 - DNA, 18 bp, Homo sapiens
ttccctagaaagccatat

SEQ ID NO: 1934783 - DNA, 23 bp, Homo sapiens
ttccctagaaagccatattccag

SEQ ID NO: 1934784 - DNA, 14 bp, Homo sapiens
ttccctctcatcca

SEQ ID NO: 1934785 - DNA, 11 bp, Homo sapiens
ttccctctgct

SEQ ID NO: 1934786 - DNA, 14 bp, Homo sapiens
ttccctgcatccct

SEQ ID NO: 1934787 - DNA, 23 bp, Homo sapiens
ttccctgcatcccttggcccctc

SEQ ID NO: 1934788 - DNA, 14 bp, Homo sapiens
ttccctttgttgct

SEQ ID NO: 1934789 - DNA, 19 bp, Homo sapiens
ttccgcttggagcagaggg

SEQ ID NO: 1934790 - DNA, 15 bp, Homo sapiens
ttcctaataaagttc

SEQ ID NO: 1934791 - DNA, 19 bp, Homo sapiens
ttcctatacgcagcgtgct

SEQ ID NO: 1934792 - DNA, 19 bp, Homo sapiens
ttcctccctccctgcaggg

SEQ ID NO: 1934793 - DNA, 24 bp, Homo sapiens
ttcctcctcctcctcctgttcctg

SEQ ID NO: 1934794 - DNA, 14 bp, Homo sapiens
ttcctcctgggccc

SEQ ID NO: 1934795 - DNA, 15 bp, Homo sapiens
ttcctcctgggccct

SEQ ID NO: 1934796 - DNA, 23 bp, Homo sapiens
ttcctcctgggccctctctgctc

SEQ ID NO: 1934797 - DNA, 15 bp, Homo sapiens
ttcctctaattaaaa

SEQ ID NO: 1934798 - DNA, 12 bp, Homo sapiens
ttcctctccact

SEQ ID NO: 1934799 - DNA, 16 bp, Homo sapiens
ttcctctccactgcct

SEQ ID NO: 1934800 - DNA, 13 bp, Homo sapiens
ttcctgccttctc

SEQ ID NO: 1934801 - DNA, 15 bp, Homo sapiens
ttcctgccttctctt

SEQ ID NO: 1934802 - DNA, 16 bp, Homo sapiens
ttcctggacagtgaga

SEQ ID NO: 1934803 - DNA, 17 bp, Homo sapiens
ttcctgggaaatattcc

SEQ ID NO: 1934804 - DNA, 14 bp, Homo sapiens
ttcctgtgccagga

SEQ ID NO: 1934805 - DNA, 22 bp, Homo sapiens
ttccttctcgtcttcctctctc

SEQ ID NO: 1934806 - DNA, 17 bp, Homo sapiens
ttccttctgatctgaga

SEQ ID NO: 1934807 - DNA, 19 bp, Homo sapiens
ttcgagacaggcagaatca

SEQ ID NO: 1934808 - DNA, 12 bp, Homo sapiens
ttcggtgcttcc

SEQ ID NO: 1934809 - DNA, 13 bp, Homo sapiens
ttcggtgcttccc

SEQ ID NO: 1934810 - DNA, 18 bp, Homo sapiens
ttcgtggagccacaggca

SEQ ID NO: 1934811 - DNA, 21 bp, Homo sapiens
ttctagaaggggcgaggcttt

SEQ ID NO: 1934812 - DNA, 16 bp, Homo sapiens
ttctagacactgaagg

SEQ ID NO: 1934813 - DNA, 15 bp, Homo sapiens
ttctaggttctaaaa

SEQ ID NO: 1934814 - DNA, 12 bp, Homo sapiens
ttctatgtaaat

SEQ ID NO: 1934815 - DNA, 15 bp, Homo sapiens
ttctatgtaaattat

SEQ ID NO: 1934816 - DNA, 22 bp, Homo sapiens
ttctatgtaaattattgtaaac

SEQ ID NO: 1934817 - DNA, 14 bp, Homo sapiens
ttctcaagcactga

SEQ ID NO: 1934818 - DNA, 20 bp, Homo sapiens
ttctccatccacatgggagc

SEQ ID NO: 1934819 - DNA, 15 bp, Homo sapiens
ttctcccctccagac

SEQ ID NO: 1934820 - DNA, 18 bp, Homo sapiens
ttctcctttcacaacctt

SEQ ID NO: 1934821 - DNA, 22 bp, Homo sapiens
ttctcctttcacaaccttctgt

SEQ ID NO: 1934822 - DNA, 21 bp, Homo sapiens
ttctcgtcttcctctctctca

SEQ ID NO: 1934823 - DNA, 22 bp, Homo sapiens
ttctctcccacacaagcagtct

SEQ ID NO: 1934824 - DNA, 12 bp, Homo sapiens
ttctctctttgt

SEQ ID NO: 1934825 - DNA, 17 bp, Homo sapiens
ttctctgagctgtgcag

SEQ ID NO: 1934826 - DNA, 17 bp, Homo sapiens
ttctctgtctcatccat

SEQ ID NO: 1934827 - DNA, 17 bp, Homo sapiens
ttctcttctatcctgca

SEQ ID NO: 1934828 - DNA, 21 bp, Homo sapiens
ttctcttttcaaacacacaca

SEQ ID NO: 1934829 - DNA, 18 bp, Homo sapiens
ttctgacaataaataata

SEQ ID NO: 1934830 - DNA, 15 bp, Homo sapiens
ttctgcaacagcctg

SEQ ID NO: 1934831 - DNA, 17 bp, Homo sapiens
ttctgccaggtttgtta

SEQ ID NO: 1934832 - DNA, 18 bp, Homo sapiens
aagggcagcccctcccca

SEQ ID NO: 1934833 - DNA, 22 bp, Homo sapiens
aagggcccccggctcggcctct

SEQ ID NO: 1934834 - DNA, 18 bp, Homo sapiens
aagggcgctgagggcagg

SEQ ID NO: 1934835 - DNA, 18 bp, Homo sapiens
aagggctttgttttgcac

SEQ ID NO: 1934836 - DNA, 21 bp, Homo sapiens
aagggggctattccctggaga

SEQ ID NO: 1934837 - DNA, 17 bp, Homo sapiens
aaggtcagattagggcg

SEQ ID NO: 1934838 - DNA, 21 bp, Homo sapiens
aaggtgattttcctgtgtcca

SEQ ID NO: 1934839 - DNA, 21 bp, Homo sapiens
aaggtgcacctgccccaggct

SEQ ID NO: 1934840 - DNA, 21 bp, Homo sapiens
aaggtggtcttggagaggagg

SEQ ID NO: 1934841 - DNA, 23 bp, Homo sapiens
aaggtggtcttggagaggaggtg

SEQ ID NO: 1934842 - DNA, 18 bp, Homo sapiens
aaggtgtcagaataataa

SEQ ID NO: 1934843 - DNA, 13 bp, Homo sapiens
aagtacgtgttta

SEQ ID NO: 1934844 - DNA, 18 bp, Homo sapiens
aagtagcaaacagggctt

SEQ ID NO: 1934845 - DNA, 17 bp, Homo sapiens
aagtattttcataagta

SEQ ID NO: 1934846 - DNA, 13 bp, Homo sapiens
aagtccaactaca

SEQ ID NO: 1934847 - DNA, 19 bp, Homo sapiens
aagtccatagctgagctgg

SEQ ID NO: 1934848 - DNA, 16 bp, Homo sapiens
aagtctctttttcttc

SEQ ID NO: 1934849 - DNA, 18 bp, Homo sapiens
aagtctctttttcttcct

SEQ ID NO: 1934850 - DNA, 14 bp, Homo sapiens
aagtcttctttcat

SEQ ID NO: 1934851 - DNA, 22 bp, Homo sapiens
aagtgactaccacttatttcta

SEQ ID NO: 1934852 - DNA, 18 bp, Homo sapiens
aagtgagggtcagagagg

SEQ ID NO: 1934853 - DNA, 17 bp, Homo sapiens
aagtgctcagttccaat

SEQ ID NO: 1934854 - DNA, 19 bp, Homo sapiens
aagtggaaaaagaaattct

SEQ ID NO: 1934855 - DNA, 18 bp, Homo sapiens
aagtggcctgagaagagt

SEQ ID NO: 1934856 - DNA, 21 bp, Homo sapiens
aagtggcctgagaagagtcga

SEQ ID NO: 1934857 - DNA, 15 bp, Homo sapiens
aagtggggtgttgaa

SEQ ID NO: 1934858 - DNA, 21 bp, Homo sapiens
aagtgtctaatgcattaactt

SEQ ID NO: 1934859 - DNA, 23 bp, Homo sapiens
aagttaagaatgttcttatgttg

SEQ ID NO: 1934860 - DNA, 19 bp, Homo sapiens
aagttcatagtttctgtaa

SEQ ID NO: 1934861 - DNA, 19 bp, Homo sapiens
aagttctgtactcaaatgt

SEQ ID NO: 1934862 - DNA, 16 bp, Homo sapiens
aagttgctgtgcccca

SEQ ID NO: 1934863 - DNA, 16 bp, Homo sapiens
aagtttgatttcatta

SEQ ID NO: 1934864 - DNA, 14 bp, Homo sapiens
aataaactccttaa

SEQ ID NO: 1934865 - DNA, 15 bp, Homo sapiens
aataaatccaagact

SEQ ID NO: 1934866 - DNA, 21 bp, Homo sapiens
aataatgacgtattgtgaaat

SEQ ID NO: 1934867 - DNA, 23 bp, Homo sapiens
aatacaatagtatgcagctaaaa

SEQ ID NO: 1934868 - DNA, 20 bp, Homo sapiens
aataccaaaattatttcaga

SEQ ID NO: 1934869 - DNA, 22 bp, Homo sapiens
aataccagagcacagattcaag

SEQ ID NO: 1934870 - DNA, 17 bp, Homo sapiens
aatactaaatatgaaat

SEQ ID NO: 1934871 - DNA, 14 bp, Homo sapiens
aatagagcctgagg

SEQ ID NO: 1934872 - DNA, 17 bp, Homo sapiens
aatagatgagtcctgtt

SEQ ID NO: 1934873 - DNA, 17 bp, Homo sapiens
aatataaatatcacaaa

SEQ ID NO: 1934874 - DNA, 22 bp, Homo sapiens
aatataactgccttaaaacttt

SEQ ID NO: 1934875 - DNA, 20 bp, Homo sapiens
aatatatataatacttaaaa

SEQ ID NO: 1934876 - DNA, 14 bp, Homo sapiens
aatatatttaacta

SEQ ID NO: 1934877 - DNA, 16 bp, Homo sapiens
aatatatttaactatt

SEQ ID NO: 1934878 - DNA, 17 bp, Homo sapiens
aatatatttaactattt

SEQ ID NO: 1934879 - DNA, 22 bp, Homo sapiens
aatatatttaactatttagaga

SEQ ID NO: 1934880 - DNA, 15 bp, Homo sapiens
aatatatttaagata

SEQ ID NO: 1934881 - DNA, 20 bp, Homo sapiens
aatatatttaagataattat

SEQ ID NO: 1934882 - DNA, 23 bp, Homo sapiens
aatatctatttatctgtctgagc

SEQ ID NO: 1934883 - DNA, 13 bp, Homo sapiens
aatatgcactttc

SEQ ID NO: 1934884 - DNA, 19 bp, Homo sapiens
aatatgcactttccctaga

SEQ ID NO: 1934885 - DNA, 18 bp, Homo sapiens
aatatgtgagcatgaaac

SEQ ID NO: 1934886 - DNA, 23 bp, Homo sapiens
aatattcttgtccacattctact

SEQ ID NO: 1934887 - DNA, 24 bp, Homo sapiens
aatatttaaaaaaaaacattcaaa

SEQ ID NO: 1934888 - DNA, 19 bp, Homo sapiens
aatattttagaaaatgttt

SEQ ID NO: 1934889 - DNA, 14 bp, Homo sapiens
aatcaaactttcag

SEQ ID NO: 1934890 - DNA, 15 bp, Homo sapiens
aatcaaactttcagc

SEQ ID NO: 1934891 - DNA, 16 bp, Homo sapiens
aatcaatacccttggc

SEQ ID NO: 1934892 - DNA, 13 bp, Homo sapiens
aatcactattctt

SEQ ID NO: 1934893 - DNA, 18 bp, Homo sapiens
aatcagaatctttaaaga

SEQ ID NO: 1934894 - DNA, 16 bp, Homo sapiens
aatcagagtggccaat

SEQ ID NO: 1934895 - DNA, 23 bp, Homo sapiens
aatcagagtggccaatccctgtg

SEQ ID NO: 1934896 - DNA, 19 bp, Homo sapiens
aatcagcattctcactcct

SEQ ID NO: 1934897 - DNA, 21 bp, Homo sapiens
aatcatataataaatgtacat

SEQ ID NO: 1934898 - DNA, 18 bp, Homo sapiens
aatcatttatctggattt

SEQ ID NO: 1934899 - DNA, 12 bp, Homo sapiens
aatcatttctat

SEQ ID NO: 1934900 - DNA, 20 bp, Homo sapiens
aatcatttctatttctcctc

SEQ ID NO: 1934901 - DNA, 15 bp, Homo sapiens
aatcattttaattat

SEQ ID NO: 1934902 - DNA, 16 bp, Homo sapiens
aatcattttaattatt

SEQ ID NO: 1934903 - DNA, 17 bp, Homo sapiens
aatcattttaattatta

SEQ ID NO: 1934904 - DNA, 22 bp, Homo sapiens
aatccaagatattttaaaatct

SEQ ID NO: 1934905 - DNA, 16 bp, Homo sapiens
aatccatgtatctgta

SEQ ID NO: 1934906 - DNA, 13 bp, Homo sapiens
aatccctttcagt

SEQ ID NO: 1934907 - DNA, 15 bp, Homo sapiens
aatcctgtcctcagc

SEQ ID NO: 1934908 - DNA, 18 bp, Homo sapiens
aatcctgtcctcagcttc

SEQ ID NO: 1934909 - DNA, 16 bp, Homo sapiens
aatctacgatgttaaa

SEQ ID NO: 1934910 - DNA, 23 bp, Homo sapiens
aatctggacttatttttggactt

SEQ ID NO: 1934911 - DNA, 14 bp, Homo sapiens
aatgaaaaaatgta

SEQ ID NO: 1934912 - DNA, 11 bp, Homo sapiens
aatgaagaaag

SEQ ID NO: 1934913 - DNA, 20 bp, Homo sapiens
aatgacgtattgtgaaattt

SEQ ID NO: 1934914 - DNA, 10 bp, Homo sapiens
aatgagagag

SEQ ID NO: 1934915 - DNA, 17 bp, Homo sapiens
aatgagagagtgtggaa

SEQ ID NO: 1934916 - DNA, 14 bp, Homo sapiens
aatgagtaaaatca

SEQ ID NO: 1934917 - DNA, 21 bp, Homo sapiens
aatgattcagtgttaaatgtg

SEQ ID NO: 1934918 - DNA, 16 bp, Homo sapiens
aatgatttcaaaatga

SEQ ID NO: 1934919 - DNA, 16 bp, Homo sapiens
aatgcataaaatgtta

SEQ ID NO: 1934920 - DNA, 15 bp, Homo sapiens
aatgccatcatctcc

SEQ ID NO: 1934921 - DNA, 22 bp, Homo sapiens
aatgctgtattagtcacagaga

SEQ ID NO: 1934922 - DNA, 16 bp, Homo sapiens
aatggaatataaatat

SEQ ID NO: 1934923 - DNA, 18 bp, Homo sapiens
aatggaatataaatatca

SEQ ID NO: 1934924 - DNA, 18 bp, Homo sapiens
aatggaccacagtgactt

SEQ ID NO: 1934925 - DNA, 22 bp, Homo sapiens
aatggctgggtttgggcagtgg

SEQ ID NO: 1934926 - DNA, 18 bp, Homo sapiens
aatggtgggctccagagt

SEQ ID NO: 1934927 - DNA, 22 bp, Homo sapiens
aatggttgggacaatggcaata

SEQ ID NO: 1934928 - DNA, 20 bp, Homo sapiens
aatgtcttgatgcatgcact

SEQ ID NO: 1934929 - DNA, 10 bp, Homo sapiens
aatgtgcagt

SEQ ID NO: 1934930 - DNA, 13 bp, Homo sapiens
aatgtgcccccag

SEQ ID NO: 1934931 - DNA, 15 bp, Homo sapiens
aatgttacattatta

SEQ ID NO: 1934932 - DNA, 16 bp, Homo sapiens
aatgttacattattat

SEQ ID NO: 1934933 - DNA, 18 bp, Homo sapiens
aatgttgaatgtttgaat

SEQ ID NO: 1934934 - DNA, 13 bp, Homo sapiens
aatgttgaccttt

SEQ ID NO: 1934935 - DNA, 15 bp, Homo sapiens
aatgttgttatttaa

SEQ ID NO: 1934936 - DNA, 21 bp, Homo sapiens
aatgtttaatatctgactgaa

SEQ ID NO: 1934937 - DNA, 20 bp, Homo sapiens
aatgtttacactctttgtaa

SEQ ID NO: 1934938 - DNA, 22 bp, Homo sapiens
aatgtttgctttacgtattttg

SEQ ID NO: 1934939 - DNA, 13 bp, Homo sapiens
aatgtttggaatt

SEQ ID NO: 1934940 - DNA, 14 bp, Homo sapiens
aatgtttggaattt

SEQ ID NO: 1934941 - DNA, 17 bp, Homo sapiens
aatgtttggaatttaag

SEQ ID NO: 1934942 - DNA, 16 bp, Homo sapiens
aattaaaatgtgcagt

SEQ ID NO: 1934943 - DNA, 20 bp, Homo sapiens
aattaaaatgtgcagtattt

SEQ ID NO: 1934944 - DNA, 17 bp, Homo sapiens
aattaaggcagctgaaa

SEQ ID NO: 1934945 - DNA, 12 bp, Homo sapiens
aattacagaaga

SEQ ID NO: 1934946 - DNA, 21 bp, Homo sapiens
aattacagggaagaaatcaag

SEQ ID NO: 1934947 - DNA, 21 bp, Homo sapiens
aattaccttgagccagtaatt

SEQ ID NO: 1934948 - DNA, 12 bp, Homo sapiens
aattagagcaga

SEQ ID NO: 1934949 - DNA, 22 bp, Homo sapiens
aattaggaagcttgatttgctt

SEQ ID NO: 1934950 - DNA, 21 bp, Homo sapiens
aattattattcttcataacaa

SEQ ID NO: 1934951 - DNA, 22 bp, Homo sapiens
aattattatttatatatgtatt

SEQ ID NO: 1934952 - DNA, 16 bp, Homo sapiens
aattattgtaaacttt

SEQ ID NO: 1934953 - DNA, 12 bp, Homo sapiens
aattatttcaga

SEQ ID NO: 1934954 - DNA, 13 bp, Homo sapiens
aattatttcagaa

SEQ ID NO: 1934955 - DNA, 18 bp, Homo sapiens
aattcaattaaaaccatt

SEQ ID NO: 1934956 - DNA, 22 bp, Homo sapiens
aattcacatctaacctcatctt

SEQ ID NO: 1934957 - DNA, 21 bp, Homo sapiens
aattcgagacaggcagaatca

SEQ ID NO: 1934958 - DNA, 19 bp, Homo sapiens
aattctcttttcaaacaca

SEQ ID NO: 1934959 - DNA, 21 bp, Homo sapiens
aattctcttttcaaacacaca

SEQ ID NO: 1934960 - DNA, 17 bp, Homo sapiens
aattgagttttcagtgg

SEQ ID NO: 1934961 - DNA, 21 bp, Homo sapiens
aattgatgggtgggctagtaa

SEQ ID NO: 1934962 - DNA, 16 bp, Homo sapiens
aattggttaatcactt

SEQ ID NO: 1934963 - DNA, 16 bp, Homo sapiens
aattgtcccttaaaca

SEQ ID NO: 1934964 - DNA, 18 bp, Homo sapiens
aattgtggagaggagaga

SEQ ID NO: 1934965 - DNA, 21 bp, Homo sapiens
aatttaatagataaagtgcct

SEQ ID NO: 1934966 - DNA, 18 bp, Homo sapiens
aatttcatctttccaaat

SEQ ID NO: 1934967 - DNA, 16 bp, Homo sapiens
aatttctactttgaag

SEQ ID NO: 1934968 - DNA, 21 bp, Homo sapiens
aatttctagacagtattgcca

SEQ ID NO: 1934969 - DNA, 13 bp, Homo sapiens
aatttgagtgctc

SEQ ID NO: 1934970 - DNA, 20 bp, Homo sapiens
aatttgagttggatcatcta

SEQ ID NO: 1934971 - DNA, 14 bp, Homo sapiens
aatttgttaatata

SEQ ID NO: 1934972 - DNA, 20 bp, Homo sapiens
aattttcctctaattaaaat

SEQ ID NO: 1934973 - DNA, 13 bp, Homo sapiens
aattttgtacgta

SEQ ID NO: 1934974 - DNA, 22 bp, Homo sapiens
acaaaataaccaatcctggaca

SEQ ID NO: 1934975 - DNA, 14 bp, Homo sapiens
acaaaggacaaaaa

SEQ ID NO: 1934976 - DNA, 11 bp, Homo sapiens
acaaaggcaag

SEQ ID NO: 1934977 - DNA, 14 bp, Homo sapiens
acaaattaaaaaca

SEQ ID NO: 1934978 - DNA, 18 bp, Homo sapiens
acaaattaaaaacaccta

SEQ ID NO: 1934979 - DNA, 18 bp, Homo sapiens
acaaattgcttgaaagaa

SEQ ID NO: 1934980 - DNA, 18 bp, Homo sapiens
acaactatgatttggaaa

SEQ ID NO: 1934981 - DNA, 12 bp, Homo sapiens
acaactccagcc

SEQ ID NO: 1934982 - DNA, 22 bp, Homo sapiens
acaactccagccacccagccag

SEQ ID NO: 1934983 - DNA, 20 bp, Homo sapiens
acaagacagcagagccatct

SEQ ID NO: 1934984 - DNA, 15 bp, Homo sapiens
acaaggaaaacagta

SEQ ID NO: 1934985 - DNA, 23 bp, Homo sapiens
acaagtatgaataaagacaccta

SEQ ID NO: 1934986 - DNA, 14 bp, Homo sapiens
acaagtgctcagtt

SEQ ID NO: 1934987 - DNA, 17 bp, Homo sapiens
acaagtgctcagttcca

SEQ ID NO: 1934988 - DNA, 13 bp, Homo sapiens
acaataaataata

SEQ ID NO: 1934989 - DNA, 20 bp, Homo sapiens
acaatcactattcttaagca

SEQ ID NO: 1934990 - DNA, 17 bp, Homo sapiens
acaatgagtaaaatcac

SEQ ID NO: 1934991 - DNA, 22 bp, Homo sapiens
acacaagacagcagagccatct

SEQ ID NO: 1934992 - DNA, 19 bp, Homo sapiens
acacagctgcagagacaga

SEQ ID NO: 1934993 - DNA, 13 bp, Homo sapiens
acacaggctgccg

SEQ ID NO: 1934994 - DNA, 14 bp, Homo sapiens
acacaggctgccgc

SEQ ID NO: 1934995 - DNA, 23 bp, Homo sapiens
acacagtctcacccagactccag

SEQ ID NO: 1934996 - DNA, 20 bp, Homo sapiens
acaccatgaagatgccattg

SEQ ID NO: 1934997 - DNA, 14 bp, Homo sapiens
acaccgggcctgga

SEQ ID NO: 1934998 - DNA, 22 bp, Homo sapiens
acacctaagtgactaccactta

SEQ ID NO: 1934999 - DNA, 16 bp, Homo sapiens
acacctgacaacttct

SEQ ID NO: 1935000 - DNA, 12 bp, Homo sapiens
acactctttgta

SEQ ID NO: 1935001 - DNA, 23 bp, Homo sapiens
acactgattacttttgggagggg

SEQ ID NO: 1935002 - DNA, 19 bp, Homo sapiens
acactgccagaagtgtgtt

SEQ ID NO: 1935003 - DNA, 15 bp, Homo sapiens
acactgcgaactctc

SEQ ID NO: 1935004 - DNA, 16 bp, Homo sapiens
acactgcgaactctca

SEQ ID NO: 1935005 - DNA, 12 bp, Homo sapiens
acactgctggga

SEQ ID NO: 1935006 - DNA, 23 bp, Homo sapiens
acactggctttgggtagtgccat

SEQ ID NO: 1935007 - DNA, 21 bp, Homo sapiens
acactgtgcacatctgtgtct

SEQ ID NO: 1935008 - DNA, 15 bp, Homo sapiens
acacttcaggctctt

SEQ ID NO: 1935009 - DNA, 22 bp, Homo sapiens
acacttcaggctcttctccttt

SEQ ID NO: 1935010 - DNA, 17 bp, Homo sapiens
acagaaatatgattgat

SEQ ID NO: 1935011 - DNA, 20 bp, Homo sapiens
acagaactctttcaaaacct

SEQ ID NO: 1935012 - DNA, 21 bp, Homo sapiens
acagagctggttgggaagaca

SEQ ID NO: 1935013 - DNA, 15 bp, Homo sapiens
acagaggcagtggca

SEQ ID NO: 1935014 - DNA, 17 bp, Homo sapiens
acagaggcagtggcagc

SEQ ID NO: 1935015 - DNA, 18 bp, Homo sapiens
acagaggcagtggcagca

SEQ ID NO: 1935016 - DNA, 14 bp, Homo sapiens
acagatcttgagca

SEQ ID NO: 1935017 - DNA, 17 bp, Homo sapiens
acagatcttgagcaagg

SEQ ID NO: 1935018 - DNA, 16 bp, Homo sapiens
acagatgggcaaatta

SEQ ID NO: 1935019 - DNA, 22 bp, Homo sapiens
acagattttttctttaaataaa

SEQ ID NO: 1935020 - DNA, 22 bp, Homo sapiens
acagcaaataaccattggttaa

SEQ ID NO: 1935021 - DNA, 15 bp, Homo sapiens
acagcagagccatct

SEQ ID NO: 1935022 - DNA, 23 bp, Homo sapiens
acagcagagtaaaattacagaag

SEQ ID NO: 1935023 - DNA, 16 bp, Homo sapiens
acagcaggagcatggc

SEQ ID NO: 1935024 - DNA, 19 bp, Homo sapiens
acagccaaattgcagaaga

SEQ ID NO: 1935025 - DNA, 22 bp, Homo sapiens
acagccaaattgcagaagaaac

SEQ ID NO: 1935026 - DNA, 20 bp, Homo sapiens
acagccagtaaggcagctct

SEQ ID NO: 1935027 - DNA, 12 bp, Homo sapiens
acagcccaggcg

SEQ ID NO: 1935028 - DNA, 18 bp, Homo sapiens
acagcctcccctgccagg

SEQ ID NO: 1935029 - DNA, 11 bp, Homo sapiens
acagcctggca

SEQ ID NO: 1935030 - DNA, 14 bp, Homo sapiens
acagcctggcacag

SEQ ID NO: 1935031 - DNA, 22 bp, Homo sapiens
acagcctgtttgggaggctgga

SEQ ID NO: 1935032 - DNA, 17 bp, Homo sapiens
acagcgggtaaaaagag

SEQ ID NO: 1935033 - DNA, 22 bp, Homo sapiens
acagctaatcagcattctcact

SEQ ID NO: 1935034 - DNA, 23 bp, Homo sapiens
acagctaggttaataggaggaca

SEQ ID NO: 1935035 - DNA, 13 bp, Homo sapiens
acagctgcttctg

SEQ ID NO: 1935036 - DNA, 13 bp, Homo sapiens
acaggcccttcct

SEQ ID NO: 1935037 - DNA, 15 bp, Homo sapiens
acaggcccttcctct

SEQ ID NO: 1935038 - DNA, 22 bp, Homo sapiens
acaggcccttcctctccactgc

SEQ ID NO: 1935039 - DNA, 22 bp, Homo sapiens
acaggctgccgctgctctccca

SEQ ID NO: 1935040 - DNA, 14 bp, Homo sapiens
acagggcttctctt

SEQ ID NO: 1935041 - DNA, 16 bp, Homo sapiens
acaggttgaggctaaa

SEQ ID NO: 1935042 - DNA, 22 bp, Homo sapiens
acaggttgaggctaaaacaaat

SEQ ID NO: 1935043 - DNA, 17 bp, Homo sapiens
acagtaactaagcacat

SEQ ID NO: 1935044 - DNA, 17 bp, Homo sapiens
acagtcagcaacatgat

SEQ ID NO: 1935045 - DNA, 14 bp, Homo sapiens
acagtcttccattt

SEQ ID NO: 1935046 - DNA, 19 bp, Homo sapiens
acagtcttccatttgcaag

SEQ ID NO: 1935047 - DNA, 17 bp, Homo sapiens
acagtgcatctcagccc

SEQ ID NO: 1935048 - DNA, 15 bp, Homo sapiens
acagttcatatgtac

SEQ ID NO: 1935049 - DNA, 19 bp, Homo sapiens
acatacaggagagctgcag

SEQ ID NO: 1935050 - DNA, 11 bp, Homo sapiens
acatcaagata

SEQ ID NO: 1935051 - DNA, 16 bp, Homo sapiens
acatctaacctcatct

SEQ ID NO: 1935052 - DNA, 15 bp, Homo sapiens
acatctgaagtgtct

SEQ ID NO: 1935053 - DNA, 16 bp, Homo sapiens
acatgaagaagctaaa

SEQ ID NO: 1935054 - DNA, 19 bp, Homo sapiens
acatgcgggctgggcagct

SEQ ID NO: 1935055 - DNA, 21 bp, Homo sapiens
acatgcgggctgggcagctgt

SEQ ID NO: 1935056 - DNA, 11 bp, Homo sapiens
acatggccaca

SEQ ID NO: 1935057 - DNA, 20 bp, Homo sapiens
acatgggagccgggtctgcc

SEQ ID NO: 1935058 - DNA, 18 bp, Homo sapiens
acatggtagcagggtctt

SEQ ID NO: 1935059 - DNA, 18 bp, Homo sapiens
acatggtgggtccatggg

SEQ ID NO: 1935060 - DNA, 17 bp, Homo sapiens
acatgtaggaagtagga

SEQ ID NO: 1935061 - DNA, 21 bp, Homo sapiens
acatgtcagtaccttcaaact

SEQ ID NO: 1935062 - DNA, 18 bp, Homo sapiens
acattattaaatcagaat

SEQ ID NO: 1935063 - DNA, 17 bp, Homo sapiens
acattccctctcatcca

SEQ ID NO: 1935064 - DNA, 15 bp, Homo sapiens
acattgtataggcca

SEQ ID NO: 1935065 - DNA, 21 bp, Homo sapiens
acattgtataggccatctgta

SEQ ID NO: 1935066 - DNA, 22 bp, Homo sapiens
acattgtataggccatctgtaa

SEQ ID NO: 1935067 - DNA, 22 bp, Homo sapiens
acatttgggagactgagcttga

SEQ ID NO: 1935068 - DNA, 17 bp, Homo sapiens
accaaaattatttcaga

SEQ ID NO: 1935069 - DNA, 12 bp, Homo sapiens
accaaattctga

SEQ ID NO: 1935070 - DNA, 13 bp, Homo sapiens
accaagcaggaaa

SEQ ID NO: 1935071 - DNA, 15 bp, Homo sapiens
accaagccgtggctt

SEQ ID NO: 1935072 - DNA, 12 bp, Homo sapiens
accaatgtcttg

SEQ ID NO: 1935073 - DNA, 13 bp, Homo sapiens
accacctgtacat

SEQ ID NO: 1935074 - DNA, 14 bp, Homo sapiens
accacgtctccctg

SEQ ID NO: 1935075 - DNA, 15 bp, Homo sapiens
accactatcttttgt

SEQ ID NO: 1935076 - DNA, 21 bp, Homo sapiens
accagactttggctcccgctt

SEQ ID NO: 1935077 - DNA, 19 bp, Homo sapiens
accagattctttgtggata

SEQ ID NO: 1935078 - DNA, 23 bp, Homo sapiens
accaggcgagagacttgtggcct

SEQ ID NO: 1935079 - DNA, 12 bp, Homo sapiens
accaggctgcag

SEQ ID NO: 1935080 - DNA, 23 bp, Homo sapiens
accagtaggttgaggacaggaga

SEQ ID NO: 1935081 - DNA, 13 bp, Homo sapiens
accataatgttac

SEQ ID NO: 1935082 - DNA, 21 bp, Homo sapiens
accattaacaggtctttgaaa

SEQ ID NO: 1935083 - DNA, 15 bp, Homo sapiens
accattccccatggg

SEQ ID NO: 1935084 - DNA, 23 bp, Homo sapiens
acccaaggtggtcttggagagga

SEQ ID NO: 1935085 - DNA, 23 bp, Homo sapiens
acccacagagtgccatccctgag

SEQ ID NO: 1935086 - DNA, 19 bp, Homo sapiens
acccacttccctgcaaggt

SEQ ID NO: 1935087 - DNA, 16 bp, Homo sapiens
acccagtctgttcccc

SEQ ID NO: 1935088 - DNA, 18 bp, Homo sapiens
acccagtgtctaccttca

SEQ ID NO: 1935089 - DNA, 18 bp, Homo sapiens
acccatatctgtgcaatg

SEQ ID NO: 1935090 - DNA, 15 bp, Homo sapiens
acccatcaacaaaaa

SEQ ID NO: 1935091 - DNA, 23 bp, Homo sapiens
accccaccacacacacccttccc

SEQ ID NO: 1935092 - DNA, 17 bp, Homo sapiens
accccaccctgtctgca

SEQ ID NO: 1935093 - DNA, 18 bp, Homo sapiens
accccaccctgtctgcag

SEQ ID NO: 1935094 - DNA, 20 bp, Homo sapiens
accccaccctgtctgcaggc

SEQ ID NO: 1935095 - DNA, 19 bp, Homo sapiens
acccccacctccctgcagc

SEQ ID NO: 1935096 - DNA, 18 bp, Homo sapiens
acccccttctccatccac

SEQ ID NO: 1935097 - DNA, 16 bp, Homo sapiens
acccctcaagccagga

SEQ ID NO: 1935098 - DNA, 12 bp, Homo sapiens
acccctggcttt

SEQ ID NO: 1935099 - DNA, 18 bp, Homo sapiens
acccggaggggcctggca

SEQ ID NO: 1935100 - DNA, 20 bp, Homo sapiens
acccggcccccgccctctgc

SEQ ID NO: 1935101 - DNA, 19 bp, Homo sapiens
acccgtcctggggtggttg

SEQ ID NO: 1935102 - DNA, 16 bp, Homo sapiens
acccgtttccaagcct

SEQ ID NO: 1935103 - DNA, 17 bp, Homo sapiens
acttcgtggatgacctc

SEQ ID NO: 1935104 - DNA, 21 bp, Homo sapiens
acttggataggagcttccaga

SEQ ID NO: 1935105 - DNA, 22 bp, Homo sapiens
acttggataggagcttccagat

SEQ ID NO: 1935106 - DNA, 15 bp, Homo sapiens
acttgggtcttccct

SEQ ID NO: 1935107 - DNA, 15 bp, Homo sapiens
acttggtgaggagga

SEQ ID NO: 1935108 - DNA, 18 bp, Homo sapiens
acttggtgaggaggaggc

SEQ ID NO: 1935109 - DNA, 22 bp, Homo sapiens
acttgtacgctcacttgcccca

SEQ ID NO: 1935110 - DNA, 18 bp, Homo sapiens
actttatattttctatat

SEQ ID NO: 1935111 - DNA, 20 bp, Homo sapiens
actttatattttctatattt

SEQ ID NO: 1935112 - DNA, 22 bp, Homo sapiens
actttcaggccacatggctaaa

SEQ ID NO: 1935113 - DNA, 20 bp, Homo sapiens
actttcttttcgccgtggct

SEQ ID NO: 1935114 - DNA, 21 bp, Homo sapiens
actttcttttcgccgtggctg

SEQ ID NO: 1935115 - DNA, 14 bp, Homo sapiens
actttgaaaatatt

SEQ ID NO: 1935116 - DNA, 15 bp, Homo sapiens
actttgaaaatattt

SEQ ID NO: 1935117 - DNA, 12 bp, Homo sapiens
actttgcatgtt

SEQ ID NO: 1935118 - DNA, 15 bp, Homo sapiens
actttgcatgttctt

SEQ ID NO: 1935119 - DNA, 12 bp, Homo sapiens
acttttgacaaa

SEQ ID NO: 1935120 - DNA, 16 bp, Homo sapiens
acttttgcagcttcct

SEQ ID NO: 1935121 - DNA, 15 bp, Homo sapiens
acttttgtaaatatt

SEQ ID NO: 1935122 - DNA, 15 bp, Homo sapiens
actttttcaatggtt

SEQ ID NO: 1935123 - DNA, 15 bp, Homo sapiens
agaaaagaactgctt

SEQ ID NO: 1935124 - DNA, 15 bp, Homo sapiens
agaaaagactgacct

SEQ ID NO: 1935125 - DNA, 16 bp, Homo sapiens
agaaaatggaacatta

SEQ ID NO: 1935126 - DNA, 19 bp, Homo sapiens
agaaactcctggatccctt

SEQ ID NO: 1935127 - DNA, 16 bp, Homo sapiens
agaaactgagtcctgt

SEQ ID NO: 1935128 - DNA, 11 bp, Homo sapiens
agaaagaaatt

SEQ ID NO: 1935129 - DNA, 15 bp, Homo sapiens
agaaagcagccaaac

SEQ ID NO: 1935130 - DNA, 17 bp, Homo sapiens
agaaagcatctattccc

SEQ ID NO: 1935131 - DNA, 16 bp, Homo sapiens
agaaagccatattcca

SEQ ID NO: 1935132 - DNA, 24 bp, Homo sapiens
agaaagccatattccagcagtgaa

SEQ ID NO: 1935133 - DNA, 19 bp, Homo sapiens
agaaagggcagcccctccc

SEQ ID NO: 1935134 - DNA, 18 bp, Homo sapiens
agaaataccaaaattatt

SEQ ID NO: 1935135 - DNA, 23 bp, Homo sapiens
agaaataccaaaattatttcaga

SEQ ID NO: 1935136 - DNA, 13 bp, Homo sapiens
agaaattatgaaa

SEQ ID NO: 1935137 - DNA, 22 bp, Homo sapiens
agaacaaatatgattctcctct

SEQ ID NO: 1935138 - DNA, 18 bp, Homo sapiens
agaacaatcactattctt

SEQ ID NO: 1935139 - DNA, 15 bp, Homo sapiens
agaacaatgtgctat

SEQ ID NO: 1935140 - DNA, 20 bp, Homo sapiens
agaacacctgacaacttctg

SEQ ID NO: 1935141 - DNA, 19 bp, Homo sapiens
agaacagtctgaaatacct

SEQ ID NO: 1935142 - DNA, 20 bp, Homo sapiens
agaacagtctgaaatacctt

SEQ ID NO: 1935143 - DNA, 17 bp, Homo sapiens
agaaccaacgggtctgt

SEQ ID NO: 1935144 - DNA, 15 bp, Homo sapiens
agaacccccctcccc

SEQ ID NO: 1935145 - DNA, 22 bp, Homo sapiens
agaacccccctccccaaggaag

SEQ ID NO: 1935146 - DNA, 19 bp, Homo sapiens
agaactactcagggaatga

SEQ ID NO: 1935147 - DNA, 22 bp, Homo sapiens
agaactgcttgcatttctttat

SEQ ID NO: 1935148 - DNA, 18 bp, Homo sapiens
agaacttggatgtacctg

SEQ ID NO: 1935149 - DNA, 19 bp, Homo sapiens
agaagaaactcctggatcc

SEQ ID NO: 1935150 - DNA, 14 bp, Homo sapiens
agaagagaaagtac

SEQ ID NO: 1935151 - DNA, 20 bp, Homo sapiens
agaagagcatccggcatgag

SEQ ID NO: 1935152 - DNA, 14 bp, Homo sapiens
agaaggagacagag

SEQ ID NO: 1935153 - DNA, 13 bp, Homo sapiens
agaaggagaggct

SEQ ID NO: 1935154 - DNA, 13 bp, Homo sapiens
agaaggaggaatt

SEQ ID NO: 1935155 - DNA, 18 bp, Homo sapiens
agaaggcaagctggcagg

SEQ ID NO: 1935156 - DNA, 16 bp, Homo sapiens
agaaggccccagggca

SEQ ID NO: 1935157 - DNA, 19 bp, Homo sapiens
agaaggcctgccccccttc

SEQ ID NO: 1935158 - DNA, 18 bp, Homo sapiens
agaaggtttcagaaagaa

SEQ ID NO: 1935159 - DNA, 13 bp, Homo sapiens
agaagtgggagtg

SEQ ID NO: 1935160 - DNA, 19 bp, Homo sapiens
agaagtgggagtgggagag

SEQ ID NO: 1935161 - DNA, 21 bp, Homo sapiens
agaagtgggagtgggagagga

SEQ ID NO: 1935162 - DNA, 22 bp, Homo sapiens
agaagttgttagtgatttgcta

SEQ ID NO: 1935163 - DNA, 13 bp, Homo sapiens
agaataaatgggt

SEQ ID NO: 1935164 - DNA, 20 bp, Homo sapiens
agaataatgacgtattgtga

SEQ ID NO: 1935165 - DNA, 17 bp, Homo sapiens
agaatagggagacaatc

SEQ ID NO: 1935166 - DNA, 14 bp, Homo sapiens
agaatccacataaa

SEQ ID NO: 1935167 - DNA, 17 bp, Homo sapiens
agaatgagagagtgtgg

SEQ ID NO: 1935168 - DNA, 13 bp, Homo sapiens
agaatggctctgg

SEQ ID NO: 1935169 - DNA, 20 bp, Homo sapiens
agaatggtgggctccagagt

SEQ ID NO: 1935170 - DNA, 12 bp, Homo sapiens
agaattaaaata

SEQ ID NO: 1935171 - DNA, 17 bp, Homo sapiens
agacaatctaaaaaata

SEQ ID NO: 1935172 - DNA, 16 bp, Homo sapiens
agacaccttcccagct

SEQ ID NO: 1935173 - DNA, 19 bp, Homo sapiens
agacaccttcccagctgct

SEQ ID NO: 1935174 - DNA, 21 bp, Homo sapiens
agacagagctggttgggaaga

SEQ ID NO: 1935175 - DNA, 16 bp, Homo sapiens
agacagagtggatctg

SEQ ID NO: 1935176 - DNA, 18 bp, Homo sapiens
agacagagtggatctgga

SEQ ID NO: 1935177 - DNA, 21 bp, Homo sapiens
agacaggcagaatcagtagct

SEQ ID NO: 1935178 - DNA, 13 bp, Homo sapiens
agacagggtgggg

SEQ ID NO: 1935179 - DNA, 19 bp, Homo sapiens
agacagggtggggcttaga

SEQ ID NO: 1935180 - DNA, 23 bp, Homo sapiens
agacagggtggggcttagaatgg

SEQ ID NO: 1935181 - DNA, 15 bp, Homo sapiens
agacagtattgccac

SEQ ID NO: 1935182 - DNA, 18 bp, Homo sapiens
agacagtattgccacctc

SEQ ID NO: 1935183 - DNA, 19 bp, Homo sapiens
agacatccccctccttgcc

SEQ ID NO: 1935184 - DNA, 11 bp, Homo sapiens
agcccagcctg

SEQ ID NO: 1935185 - DNA, 21 bp, Homo sapiens
agcccctatcctgcaccctct

SEQ ID NO: 1935186 - DNA, 22 bp, Homo sapiens
agcccctccccatggtgcagtg

SEQ ID NO: 1935187 - DNA, 12 bp, Homo sapiens
agccctccctgc

SEQ ID NO: 1935188 - DNA, 15 bp, Homo sapiens
agccctccctgcccc

SEQ ID NO: 1935189 - DNA, 16 bp, Homo sapiens
agccctccctgcccct

SEQ ID NO: 1935190 - DNA, 22 bp, Homo sapiens
agccctccctgcccctcccttc

SEQ ID NO: 1935191 - DNA, 23 bp, Homo sapiens
agccctccctgcccctcccttca

SEQ ID NO: 1935192 - DNA, 11 bp, Homo sapiens
agccctgccct

SEQ ID NO: 1935193 - DNA, 18 bp, Homo sapiens
agccctgccctcactcca

SEQ ID NO: 1935194 - DNA, 19 bp, Homo sapiens
agccctgccctcactccac

SEQ ID NO: 1935195 - DNA, 22 bp, Homo sapiens
agccctgccctcactccactcc

SEQ ID NO: 1935196 - DNA, 20 bp, Homo sapiens
agccctgctttgggctgccc

SEQ ID NO: 1935197 - DNA, 21 bp, Homo sapiens
agccctgctttgggctgccct

SEQ ID NO: 1935198 - DNA, 19 bp, Homo sapiens
agccgctgagcgaggagat

SEQ ID NO: 1935199 - DNA, 13 bp, Homo sapiens
agccgtggcttcc

SEQ ID NO: 1935200 - DNA, 21 bp, Homo sapiens
agcctcaagtcttatttcctc

SEQ ID NO: 1935201 - DNA, 17 bp, Homo sapiens
agcctggccccatggtc

SEQ ID NO: 1935202 - DNA, 17 bp, Homo sapiens
agcctgggccactggca

SEQ ID NO: 1935203 - DNA, 18 bp, Homo sapiens
agcctgggccactggcat

SEQ ID NO: 1935204 - DNA, 19 bp, Homo sapiens
agcctgggccactggcatc

SEQ ID NO: 1935205 - DNA, 22 bp, Homo sapiens
agcctgggccactggcatctct

SEQ ID NO: 1935206 - DNA, 23 bp, Homo sapiens
agcctgggccactggcatctctg

SEQ ID NO: 1935207 - DNA, 16 bp, Homo sapiens
agcctggttccctctt

SEQ ID NO: 1935208 - DNA, 19 bp, Homo sapiens
agcctggttccctctttcc

SEQ ID NO: 1935209 - DNA, 20 bp, Homo sapiens
agcctggttccctctttcct

SEQ ID NO: 1935210 - DNA, 14 bp, Homo sapiens
agcctgtgggagaa

SEQ ID NO: 1935211 - DNA, 17 bp, Homo sapiens
agcctgtgggagaaggg

SEQ ID NO: 1935212 - DNA, 16 bp, Homo sapiens
agccttgtaattctaa

SEQ ID NO: 1935213 - DNA, 14 bp, Homo sapiens
agcctttccagaac

SEQ ID NO: 1935214 - DNA, 16 bp, Homo sapiens
agcgacacaggctgcc

SEQ ID NO: 1935215 - DNA, 18 bp, Homo sapiens
agcgacacaggctgccgc

SEQ ID NO: 1935216 - DNA, 19 bp, Homo sapiens
agcgacacaggctgccgct

SEQ ID NO: 1935217 - DNA, 20 bp, Homo sapiens
agcgaggagatgctccttgg

SEQ ID NO: 1935218 - DNA, 13 bp, Homo sapiens
agcgcacttccca

SEQ ID NO: 1935219 - DNA, 18 bp, Homo sapiens
agcgccctctacctccta

SEQ ID NO: 1935220 - DNA, 13 bp, Homo sapiens
agcgctggcctct

SEQ ID NO: 1935221 - DNA, 14 bp, Homo sapiens
agcggccgcctgtc

SEQ ID NO: 1935222 - DNA, 16 bp, Homo sapiens
agcggccgcctgtcct

SEQ ID NO: 1935223 - DNA, 17 bp, Homo sapiens
agcggccgcctgtcctt

SEQ ID NO: 1935224 - DNA, 16 bp, Homo sapiens
agctaatcagcattct

SEQ ID NO: 1935225 - DNA, 21 bp, Homo sapiens
agctaatcagcattctcactc

SEQ ID NO: 1935226 - DNA, 22 bp, Homo sapiens
agctatttctcatcaattctct

SEQ ID NO: 1935227 - DNA, 12 bp, Homo sapiens
agctcaggagaa

SEQ ID NO: 1935228 - DNA, 21 bp, Homo sapiens
agctccgagtggctcccgtgt

SEQ ID NO: 1935229 - DNA, 19 bp, Homo sapiens
agctctgaaaccagtgtta

SEQ ID NO: 1935230 - DNA, 16 bp, Homo sapiens
agctctttggtgccag

SEQ ID NO: 1935231 - DNA, 22 bp, Homo sapiens
agctggagagagagttctcaca

SEQ ID NO: 1935232 - DNA, 23 bp, Homo sapiens
agctggatggggcggcctgcaga

SEQ ID NO: 1935233 - DNA, 21 bp, Homo sapiens
agctggcaggagggtggcact

SEQ ID NO: 1935234 - DNA, 16 bp, Homo sapiens
agctgggttggaaaac

SEQ ID NO: 1935235 - DNA, 10 bp, Homo sapiens
agctgtgcag

SEQ ID NO: 1935236 - DNA, 18 bp, Homo sapiens
agctgtgcaggtggggag

SEQ ID NO: 1935237 - DNA, 19 bp, Homo sapiens
agctgtgcaggtggggaga

SEQ ID NO: 1935238 - DNA, 19 bp, Homo sapiens
agctgttcaacaagagtaa

SEQ ID NO: 1935239 - DNA, 15 bp, Homo sapiens
agcttagactaaggc

SEQ ID NO: 1935240 - DNA, 11 bp, Homo sapiens
agcttccagat

SEQ ID NO: 1935241 - DNA, 22 bp, Homo sapiens
agctttcatgtaaactgtgcac

SEQ ID NO: 1935242 - DNA, 15 bp, Homo sapiens
agctttgaggctggc

SEQ ID NO: 1935243 - DNA, 16 bp, Homo sapiens
agcttttaaaccctat

SEQ ID NO: 1935244 - DNA, 19 bp, Homo sapiens
aggaaaaccaagccgtggc

SEQ ID NO: 1935245 - DNA, 21 bp, Homo sapiens
aggaaaaccaagccgtggctt

SEQ ID NO: 1935246 - DNA, 23 bp, Homo sapiens
aggaaaaccaagccgtggcttcc

SEQ ID NO: 1935247 - DNA, 22 bp, Homo sapiens
aggaagccacgtgctggagagt

SEQ ID NO: 1935248 - DNA, 17 bp, Homo sapiens
aggaaggatgagcattt

SEQ ID NO: 1935249 - DNA, 23 bp, Homo sapiens
acccgtttccaagcctgggccac

SEQ ID NO: 1935250 - DNA, 16 bp, Homo sapiens
accctaaatcttgact

SEQ ID NO: 1935251 - DNA, 15 bp, Homo sapiens
accctaacccggagg

SEQ ID NO: 1935252 - DNA, 23 bp, Homo sapiens
accctaggtctccacccctcaag

SEQ ID NO: 1935253 - DNA, 23 bp, Homo sapiens
accctatattttgcatagtacca

SEQ ID NO: 1935254 - DNA, 18 bp, Homo sapiens
accctcagagccacccct

SEQ ID NO: 1935255 - DNA, 12 bp, Homo sapiens
accctcccaggt

SEQ ID NO: 1935256 - DNA, 22 bp, Homo sapiens
accctcccaggtttcccactgc

SEQ ID NO: 1935257 - DNA, 12 bp, Homo sapiens
accctctctgtc

SEQ ID NO: 1935258 - DNA, 13 bp, Homo sapiens
accctctgcaggg

SEQ ID NO: 1935259 - DNA, 14 bp, Homo sapiens
accctctgcagggc

SEQ ID NO: 1935260 - DNA, 20 bp, Homo sapiens
accctctgctatgtctgtga

SEQ ID NO: 1935261 - DNA, 17 bp, Homo sapiens
accctgagctgaggcag

SEQ ID NO: 1935262 - DNA, 23 bp, Homo sapiens
accctgagctgaggcagcagtgt

SEQ ID NO: 1935263 - DNA, 12 bp, Homo sapiens
accctgccaggg

SEQ ID NO: 1935264 - DNA, 11 bp, Homo sapiens
accctggaagc

SEQ ID NO: 1935265 - DNA, 13 bp, Homo sapiens
acccttacagtag

SEQ ID NO: 1935266 - DNA, 20 bp, Homo sapiens
acccttgaatttctagacag

SEQ ID NO: 1935267 - DNA, 18 bp, Homo sapiens
acccttggcactgatggg

SEQ ID NO: 1935268 - DNA, 22 bp, Homo sapiens
accctttacattttgtgcagtg

SEQ ID NO: 1935269 - DNA, 12 bp, Homo sapiens
acccttttccag

SEQ ID NO: 1935270 - DNA, 16 bp, Homo sapiens
accgagccagcagctg

SEQ ID NO: 1935271 - DNA, 17 bp, Homo sapiens
accgagtctcttctcca

SEQ ID NO: 1935272 - DNA, 21 bp, Homo sapiens
accgagtctcttctccactgg

SEQ ID NO: 1935273 - DNA, 14 bp, Homo sapiens
accgcgagggcctg

SEQ ID NO: 1935274 - DNA, 16 bp, Homo sapiens
accgcgagggcctgcg

SEQ ID NO: 1935275 - DNA, 18 bp, Homo sapiens
accggcaatttccggcca

SEQ ID NO: 1935276 - DNA, 18 bp, Homo sapiens
accgggtggcagcgccca

SEQ ID NO: 1935277 - DNA, 19 bp, Homo sapiens
accgggtggcagcgcccag

SEQ ID NO: 1935278 - DNA, 16 bp, Homo sapiens
accgtgggctccctga

SEQ ID NO: 1935279 - DNA, 14 bp, Homo sapiens
acctataaatacta

SEQ ID NO: 1935280 - DNA, 22 bp, Homo sapiens
acctataaatactaaatatgaa

SEQ ID NO: 1935281 - DNA, 16 bp, Homo sapiens
acctcaggttccaaat

SEQ ID NO: 1935282 - DNA, 10 bp, Homo sapiens
acctccaccc

SEQ ID NO: 1935283 - DNA, 14 bp, Homo sapiens
acctccacccgtcc

SEQ ID NO: 1935284 - DNA, 13 bp, Homo sapiens
acctccccaggcc

SEQ ID NO: 1935285 - DNA, 15 bp, Homo sapiens
acctccctgcagctt

SEQ ID NO: 1935286 - DNA, 13 bp, Homo sapiens
acctcctgagaaa

SEQ ID NO: 1935287 - DNA, 20 bp, Homo sapiens
acctcggctgtgtggggagg

SEQ ID NO: 1935288 - DNA, 17 bp, Homo sapiens
acctctggccctgttgt

SEQ ID NO: 1935289 - DNA, 15 bp, Homo sapiens
acctcttcagaggcc

SEQ ID NO: 1935290 - DNA, 16 bp, Homo sapiens
acctctttccaaaggc

SEQ ID NO: 1935291 - DNA, 19 bp, Homo sapiens
acctgaaaacactgtgcac

SEQ ID NO: 1935292 - DNA, 19 bp, Homo sapiens
acctgacactcccttgggc

SEQ ID NO: 1935293 - DNA, 16 bp, Homo sapiens
acctgccaggctgcag

SEQ ID NO: 1935294 - DNA, 18 bp, Homo sapiens
acctgccaggctgcaggg

SEQ ID NO: 1935295 - DNA, 13 bp, Homo sapiens
acctgccccaggc

SEQ ID NO: 1935296 - DNA, 16 bp, Homo sapiens
acctgcccccaatcca

SEQ ID NO: 1935297 - DNA, 14 bp, Homo sapiens
acctgggtgctctg

SEQ ID NO: 1935298 - DNA, 12 bp, Homo sapiens
accttcccagct

SEQ ID NO: 1935299 - DNA, 17 bp, Homo sapiens
accttcccagctgctcc

SEQ ID NO: 1935300 - DNA, 16 bp, Homo sapiens
acctttatgttttaat

SEQ ID NO: 1935301 - DNA, 14 bp, Homo sapiens
acgaggtatgaggt

SEQ ID NO: 1935302 - DNA, 22 bp, Homo sapiens
acgatgttaaaacaaattaaaa

SEQ ID NO: 1935303 - DNA, 19 bp, Homo sapiens
acgcacgtgggtcttcagg

SEQ ID NO: 1935304 - DNA, 16 bp, Homo sapiens
acgcagaagagaaagt

SEQ ID NO: 1935305 - DNA, 20 bp, Homo sapiens
acgcagaagagaaagtacaa

SEQ ID NO: 1935306 - DNA, 22 bp, Homo sapiens
acgcagccctgctttgggctgc

SEQ ID NO: 1935307 - DNA, 16 bp, Homo sapiens
acgcccgactctctcc

SEQ ID NO: 1935308 - DNA, 18 bp, Homo sapiens
acgccgggtcgcctgccc

SEQ ID NO: 1935309 - DNA, 13 bp, Homo sapiens
acgcctgaggaac

SEQ ID NO: 1935310 - DNA, 14 bp, Homo sapiens
acggaagtggcctg

SEQ ID NO: 1935311 - DNA, 20 bp, Homo sapiens
acggagccactcctctgact

SEQ ID NO: 1935312 - DNA, 19 bp, Homo sapiens
acgtccacccgtttccaag

SEQ ID NO: 1935313 - DNA, 18 bp, Homo sapiens
acgtgtttacttggtgag

SEQ ID NO: 1935314 - DNA, 15 bp, Homo sapiens
acgttaccaggcagg

SEQ ID NO: 1935315 - DNA, 16 bp, Homo sapiens
acgttcacccctccac

SEQ ID NO: 1935316 - DNA, 14 bp, Homo sapiens
acgtttagaaatga

SEQ ID NO: 1935317 - DNA, 19 bp, Homo sapiens
acgtttagaaatgatttca

SEQ ID NO: 1935318 - DNA, 22 bp, Homo sapiens
acgtttagaaatgatttcaaaa

SEQ ID NO: 1935319 - DNA, 15 bp, Homo sapiens
actaacatataatgt

SEQ ID NO: 1935320 - DNA, 17 bp, Homo sapiens
actaagatgaaattgcc

SEQ ID NO: 1935321 - DNA, 21 bp, Homo sapiens
actacagccaaattgcagaag

SEQ ID NO: 1935322 - DNA, 13 bp, Homo sapiens
actacgcagaaga

SEQ ID NO: 1935323 - DNA, 13 bp, Homo sapiens
actactctgcctg

SEQ ID NO: 1935324 - DNA, 12 bp, Homo sapiens
actactgtacat

SEQ ID NO: 1935325 - DNA, 13 bp, Homo sapiens
actactgtacatt

SEQ ID NO: 1935326 - DNA, 19 bp, Homo sapiens
actagactcccaagctgga

SEQ ID NO: 1935327 - DNA, 20 bp, Homo sapiens
actaggtgcccagtcttgag

SEQ ID NO: 1935328 - DNA, 18 bp, Homo sapiens
actatgcacctataaata

SEQ ID NO: 1935329 - DNA, 13 bp, Homo sapiens
actattaaagtaa

SEQ ID NO: 1935330 - DNA, 19 bp, Homo sapiens
actattcttaagcactttg

SEQ ID NO: 1935331 - DNA, 18 bp, Homo sapiens
actcagtcagcccagtgg

SEQ ID NO: 1935332 - DNA, 23 bp, Homo sapiens
actcattcagggatagcactgag

SEQ ID NO: 1935333 - DNA, 19 bp, Homo sapiens
actcattctgaaggagccc

SEQ ID NO: 1935334 - DNA, 15 bp, Homo sapiens
actccagacccctgg

SEQ ID NO: 1935335 - DNA, 18 bp, Homo sapiens
actccagacccctggctt

SEQ ID NO: 1935336 - DNA, 21 bp, Homo sapiens
actccagacccctggcttttc

SEQ ID NO: 1935337 - DNA, 16 bp, Homo sapiens
actcccccagccctca

SEQ ID NO: 1935338 - DNA, 18 bp, Homo sapiens
actcctggatccctttca

SEQ ID NO: 1935339 - DNA, 19 bp, Homo sapiens
actccttaaccacctagtc

SEQ ID NO: 1935340 - DNA, 15 bp, Homo sapiens
aggaagtaggaagta

SEQ ID NO: 1935341 - DNA, 21 bp, Homo sapiens
aggaatgggccaagccagggt

SEQ ID NO: 1935342 - DNA, 14 bp, Homo sapiens
aggacaaggctaga

SEQ ID NO: 1935343 - DNA, 17 bp, Homo sapiens
aggacagggagggaaca

SEQ ID NO: 1935344 - DNA, 17 bp, Homo sapiens
aggacagtaaactcact

SEQ ID NO: 1935345 - DNA, 18 bp, Homo sapiens
aggacagtttaggaccca

SEQ ID NO: 1935346 - DNA, 14 bp, Homo sapiens
aggacatttctcta

SEQ ID NO: 1935347 - DNA, 21 bp, Homo sapiens
aggacccaaggtggtcttgga

SEQ ID NO: 1935348 - DNA, 15 bp, Homo sapiens
aggacccagaggaag

SEQ ID NO: 1935349 - DNA, 17 bp, Homo sapiens
aggacccggaggggcct

SEQ ID NO: 1935350 - DNA, 22 bp, Homo sapiens
aggacccggaggggcctggcag

SEQ ID NO: 1935351 - DNA, 20 bp, Homo sapiens
aggacgtgggcggcagagag

SEQ ID NO: 1935352 - DNA, 12 bp, Homo sapiens
aggactctcagg

SEQ ID NO: 1935353 - DNA, 15 bp, Homo sapiens
aggactctctttctt

SEQ ID NO: 1935354 - DNA, 13 bp, Homo sapiens
aggacttgtgcct

SEQ ID NO: 1935355 - DNA, 14 bp, Homo sapiens
aggagaaggcctgc

SEQ ID NO: 1935356 - DNA, 22 bp, Homo sapiens
aggagaaggcctgccccccttc

SEQ ID NO: 1935357 - DNA, 14 bp, Homo sapiens
aggagaccctgtct

SEQ ID NO: 1935358 - DNA, 13 bp, Homo sapiens
aggagaggagtgc

SEQ ID NO: 1935359 - DNA, 18 bp, Homo sapiens
aggagatgctccttgggc

SEQ ID NO: 1935360 - DNA, 14 bp, Homo sapiens
aggagcctcctgac

SEQ ID NO: 1935361 - DNA, 13 bp, Homo sapiens
aggagcttccaga

SEQ ID NO: 1935362 - DNA, 11 bp, Homo sapiens
aggaggacagg

SEQ ID NO: 1935363 - DNA, 16 bp, Homo sapiens
aggaggcagaaccagc

SEQ ID NO: 1935364 - DNA, 15 bp, Homo sapiens
aggaggcctgggaga

SEQ ID NO: 1935365 - DNA, 16 bp, Homo sapiens
aggaggctccagaggg

SEQ ID NO: 1935366 - DNA, 18 bp, Homo sapiens
aggaggctccagagggca

SEQ ID NO: 1935367 - DNA, 19 bp, Homo sapiens
aggaggctccagagggcac

SEQ ID NO: 1935368 - DNA, 17 bp, Homo sapiens
aggagggtcaggaagga

SEQ ID NO: 1935369 - DNA, 20 bp, Homo sapiens
aggaggtgtggagtggaggg

SEQ ID NO: 1935370 - DNA, 21 bp, Homo sapiens
aggaggtgtggagtggagggg

SEQ ID NO: 1935371 - DNA, 22 bp, Homo sapiens
aggagtgactctggctgccaag

SEQ ID NO: 1935372 - DNA, 23 bp, Homo sapiens
aggagtgactctggctgccaaga

SEQ ID NO: 1935373 - DNA, 13 bp, Homo sapiens
aggagttgctcct

SEQ ID NO: 1935374 - DNA, 18 bp, Homo sapiens
aggatgcagagtcagcag

SEQ ID NO: 1935375 - DNA, 19 bp, Homo sapiens
aggatgcagagtcagcaga

SEQ ID NO: 1935376 - DNA, 22 bp, Homo sapiens
aggatgggtctggtttgcagag

SEQ ID NO: 1935377 - DNA, 13 bp, Homo sapiens
aggattctatgag

SEQ ID NO: 1935378 - DNA, 12 bp, Homo sapiens
aggatttgtgtt

SEQ ID NO: 1935379 - DNA, 20 bp, Homo sapiens
aggatttgtgttttacagta

SEQ ID NO: 1935380 - DNA, 22 bp, Homo sapiens
aggcaaacccatcaacaaaaat

SEQ ID NO: 1935381 - DNA, 16 bp, Homo sapiens
aggcaacttgggaact

SEQ ID NO: 1935382 - DNA, 13 bp, Homo sapiens
aggcaagaagtgg

SEQ ID NO: 1935383 - DNA, 15 bp, Homo sapiens
aggcaagccacagaa

SEQ ID NO: 1935384 - DNA, 16 bp, Homo sapiens
aggcaagccacagaaa

SEQ ID NO: 1935385 - DNA, 15 bp, Homo sapiens
aggcaagctggcagg

SEQ ID NO: 1935386 - DNA, 15 bp, Homo sapiens
aggcagaatggtggg

SEQ ID NO: 1935387 - DNA, 21 bp, Homo sapiens
aggcagaatggtgggctccag

SEQ ID NO: 1935388 - DNA, 23 bp, Homo sapiens
aggcagaatggtgggctccagag

SEQ ID NO: 1935389 - DNA, 19 bp, Homo sapiens
aggcagcagtgtgaggcca

SEQ ID NO: 1935390 - DNA, 20 bp, Homo sapiens
aggcagcagtgtgaggccag

SEQ ID NO: 1935391 - DNA, 23 bp, Homo sapiens
aggcagcagtgtgaggccagggc

SEQ ID NO: 1935392 - DNA, 14 bp, Homo sapiens
aggcagtggcagca

SEQ ID NO: 1935393 - DNA, 15 bp, Homo sapiens
aggcagtggcagcaa

SEQ ID NO: 1935394 - DNA, 19 bp, Homo sapiens
aggcatggatgaataaatg

SEQ ID NO: 1935395 - DNA, 16 bp, Homo sapiens
aggcattgccaagggc

SEQ ID NO: 1935396 - DNA, 18 bp, Homo sapiens
aggcattgccaagggctt

SEQ ID NO: 1935397 - DNA, 16 bp, Homo sapiens
aggccacccccacctc

SEQ ID NO: 1935398 - DNA, 13 bp, Homo sapiens
aggccacggcagc

SEQ ID NO: 1935399 - DNA, 15 bp, Homo sapiens
aggccacgggggagg

SEQ ID NO: 1935400 - DNA, 23 bp, Homo sapiens
aggccaggcatggcccagcctgg

SEQ ID NO: 1935401 - DNA, 15 bp, Homo sapiens
aggccatctgtaaat

SEQ ID NO: 1935402 - DNA, 16 bp, Homo sapiens
aggccatctgtaaata

SEQ ID NO: 1935403 - DNA, 21 bp, Homo sapiens
aggccatctgtaaatatccca

SEQ ID NO: 1935404 - DNA, 15 bp, Homo sapiens
aggcccggagatgca

SEQ ID NO: 1935405 - DNA, 22 bp, Homo sapiens
aggccctcgctgccagctctgt

SEQ ID NO: 1935406 - DNA, 16 bp, Homo sapiens
aggccctctctgcagt

SEQ ID NO: 1935407 - DNA, 18 bp, Homo sapiens
aggccctctctgcagtcc

SEQ ID NO: 1935408 - DNA, 19 bp, Homo sapiens
aggcccttcctctccactg

SEQ ID NO: 1935409 - DNA, 22 bp, Homo sapiens
aggcccttcctctccactgcct

SEQ ID NO: 1935410 - DNA, 19 bp, Homo sapiens
aggccgaggcaggggctgg

SEQ ID NO: 1935411 - DNA, 20 bp, Homo sapiens
aggccgtggctgcccacaca

SEQ ID NO: 1935412 - DNA, 17 bp, Homo sapiens
aggcctgccccccttcc

SEQ ID NO: 1935413 - DNA, 19 bp, Homo sapiens
aggcctgccccccttccca

SEQ ID NO: 1935414 - DNA, 19 bp, Homo sapiens
aggcctgggagatgcagct

SEQ ID NO: 1935415 - DNA, 22 bp, Homo sapiens
aggcctgtgtgtaagctgactg

SEQ ID NO: 1935416 - DNA, 13 bp, Homo sapiens
aggcgtgggatcc

SEQ ID NO: 1935417 - DNA, 17 bp, Homo sapiens
aggcgtgggatccagag

SEQ ID NO: 1935418 - DNA, 14 bp, Homo sapiens
aggctcaggctgcc

SEQ ID NO: 1935419 - DNA, 15 bp, Homo sapiens
aggctcaggctgccc

SEQ ID NO: 1935420 - DNA, 16 bp, Homo sapiens
aggctccagagggcac

SEQ ID NO: 1935421 - DNA, 20 bp, Homo sapiens
aggctctgaaagctgcttct

SEQ ID NO: 1935422 - DNA, 18 bp, Homo sapiens
aggctgccgctgctctcc

SEQ ID NO: 1935423 - DNA, 14 bp, Homo sapiens
aggctggcggggtc

SEQ ID NO: 1935424 - DNA, 18 bp, Homo sapiens
aggctggcggggtctgct

SEQ ID NO: 1935425 - DNA, 16 bp, Homo sapiens
agggaaatccaactcc

SEQ ID NO: 1935426 - DNA, 12 bp, Homo sapiens
agggaagaaatc

SEQ ID NO: 1935427 - DNA, 14 bp, Homo sapiens
agggaagggcctgc

SEQ ID NO: 1935428 - DNA, 16 bp, Homo sapiens
agggaagggcctgcca

SEQ ID NO: 1935429 - DNA, 18 bp, Homo sapiens
agggaagggcctgccaca

SEQ ID NO: 1935430 - DNA, 22 bp, Homo sapiens
agggacgacccggggcgggctg

SEQ ID NO: 1935431 - DNA, 18 bp, Homo sapiens
agggacgcctgggggtgc

SEQ ID NO: 1935432 - DNA, 14 bp, Homo sapiens
agggactgggggtg

SEQ ID NO: 1935433 - DNA, 16 bp, Homo sapiens
agggagaaggagaggc

SEQ ID NO: 1935434 - DNA, 14 bp, Homo sapiens
agggagcctggccc

SEQ ID NO: 1935435 - DNA, 19 bp, Homo sapiens
agggatccctcatctgtcc

SEQ ID NO: 1935436 - DNA, 15 bp, Homo sapiens
agggatggggagcag

SEQ ID NO: 1935437 - DNA, 15 bp, Homo sapiens
agggcaaaccaggct

SEQ ID NO: 1935438 - DNA, 18 bp, Homo sapiens
agggcaaaccaggctgca

SEQ ID NO: 1935439 - DNA, 19 bp, Homo sapiens
agggcaaaccaggctgcag

SEQ ID NO: 1935440 - DNA, 16 bp, Homo sapiens
agggcagcctgtggga

SEQ ID NO: 1935441 - DNA, 17 bp, Homo sapiens
agggcagcctgtgggag

SEQ ID NO: 1935442 - DNA, 20 bp, Homo sapiens
agggcagcctgtgggagaag

SEQ ID NO: 1935443 - DNA, 17 bp, Homo sapiens
agggcagggccccaggc

SEQ ID NO: 1935444 - DNA, 18 bp, Homo sapiens
agggcagggttctagaag

SEQ ID NO: 1935445 - DNA, 19 bp, Homo sapiens
agggcagggttctagaagg

SEQ ID NO: 1935446 - DNA, 21 bp, Homo sapiens
agggccacatgggaggctcac

SEQ ID NO: 1935447 - DNA, 12 bp, Homo sapiens
agggcgcctggg

SEQ ID NO: 1935448 - DNA, 20 bp, Homo sapiens
agggcgcctgggtcctccca

SEQ ID NO: 1935449 - DNA, 22 bp, Homo sapiens
agggctaccctgagctgaggca

SEQ ID NO: 1935450 - DNA, 12 bp, Homo sapiens
agggctcctggg

SEQ ID NO: 1935451 - DNA, 13 bp, Homo sapiens
agggcttctcttt

SEQ ID NO: 1935452 - DNA, 18 bp, Homo sapiens
agggctttgttttgcaca

SEQ ID NO: 1935453 - DNA, 16 bp, Homo sapiens
aggggacactgaacct

SEQ ID NO: 1935454 - DNA, 15 bp, Homo sapiens
aggggacagatcttg

SEQ ID NO: 1935455 - DNA, 17 bp, Homo sapiens
aggggagaggaagcaca

SEQ ID NO: 1935456 - DNA, 16 bp, Homo sapiens
aggggatctaaaagga

SEQ ID NO: 1935457 - DNA, 23 bp, Homo sapiens
aggggatctaaaaggaggacagg

SEQ ID NO: 1935458 - DNA, 12 bp, Homo sapiens
aggggccagagg

SEQ ID NO: 1935459 - DNA, 12 bp, Homo sapiens
aggggcctggca

SEQ ID NO: 1935460 - DNA, 19 bp, Homo sapiens
aggggcttccctctgctcc

SEQ ID NO: 1935461 - DNA, 10 bp, Homo sapiens
agggggccac

SEQ ID NO: 1935462 - DNA, 19 bp, Homo sapiens
aggggggttgggttccaga

SEQ ID NO: 1935463 - DNA, 18 bp, Homo sapiens
aggggtctccaggaggag

SEQ ID NO: 1935464 - DNA, 14 bp, Homo sapiens
agggtacagcccag

SEQ ID NO: 1935465 - DNA, 16 bp, Homo sapiens
agggtagggggcctga

SEQ ID NO: 1935466 - DNA, 22 bp, Homo sapiens
agggtagtttaattttaaaata

SEQ ID NO: 1935467 - DNA, 16 bp, Homo sapiens
agggtctgtcccgggt

SEQ ID NO: 1935468 - DNA, 18 bp, Homo sapiens
agggtctttgtgtgctgt

SEQ ID NO: 1935469 - DNA, 13 bp, Homo sapiens
agggtgaggcgtg

SEQ ID NO: 1935470 - DNA, 14 bp, Homo sapiens
agggtgaggcgtgg

SEQ ID NO: 1935471 - DNA, 23 bp, Homo sapiens
agggtgaggcgtgggatccagag

SEQ ID NO: 1935472 - DNA, 12 bp, Homo sapiens
agggtgggcgtg

SEQ ID NO: 1935473 - DNA, 14 bp, Homo sapiens
agggtgtggcttgg

SEQ ID NO: 1935474 - DNA, 15 bp, Homo sapiens
agggttaaagaaagg

SEQ ID NO: 1935475 - DNA, 19 bp, Homo sapiens
agggttaaagaaaggcaga

SEQ ID NO: 1935476 - DNA, 12 bp, Homo sapiens
agggttccagac

SEQ ID NO: 1935477 - DNA, 14 bp, Homo sapiens
agggttccagacag

SEQ ID NO: 1935478 - DNA, 22 bp, Homo sapiens
atacttcagctcacacatgaga

SEQ ID NO: 1935479 - DNA, 16 bp, Homo sapiens
atacttttgccctttg

SEQ ID NO: 1935480 - DNA, 13 bp, Homo sapiens
atagagctgtatt

SEQ ID NO: 1935481 - DNA, 22 bp, Homo sapiens
atagaggtgagggaagcctgaa

SEQ ID NO: 1935482 - DNA, 23 bp, Homo sapiens
atagataaagtgcctataaagga

SEQ ID NO: 1935483 - DNA, 15 bp, Homo sapiens
atagcactgagcaaa

SEQ ID NO: 1935484 - DNA, 14 bp, Homo sapiens
atagctgagctgga

SEQ ID NO: 1935485 - DNA, 20 bp, Homo sapiens
ataggagcttccagatgggt

SEQ ID NO: 1935486 - DNA, 14 bp, Homo sapiens
atagtaaaaataaa

SEQ ID NO: 1935487 - DNA, 23 bp, Homo sapiens
atagtacatgtcaccttaggtag

SEQ ID NO: 1935488 - DNA, 20 bp, Homo sapiens
atagtgatgtaatcttgaat

SEQ ID NO: 1935489 - DNA, 22 bp, Homo sapiens
atagtgtataccacctgtacat

SEQ ID NO: 1935490 - DNA, 23 bp, Homo sapiens
atagttccagataaaaacaatat

SEQ ID NO: 1935491 - DNA, 13 bp, Homo sapiens
atagtttctgtaa

SEQ ID NO: 1935492 - DNA, 14 bp, Homo sapiens
atagtttctgtaat

SEQ ID NO: 1935493 - DNA, 19 bp, Homo sapiens
atagtttctgtaattggct

SEQ ID NO: 1935494 - DNA, 23 bp, Homo sapiens
atagttttacactctagtgccat

SEQ ID NO: 1935495 - DNA, 20 bp, Homo sapiens
atataactgccttaaaactt

SEQ ID NO: 1935496 - DNA, 17 bp, Homo sapiens
atataatacttaaaaat

SEQ ID NO: 1935497 - DNA, 14 bp, Homo sapiens
atatatattgcata

SEQ ID NO: 1935498 - DNA, 12 bp, Homo sapiens
atatatgtattt

SEQ ID NO: 1935499 - DNA, 22 bp, Homo sapiens
atatcacaaagttgtttaacta

SEQ ID NO: 1935500 - DNA, 19 bp, Homo sapiens
atatctatttatctgtctg

SEQ ID NO: 1935501 - DNA, 20 bp, Homo sapiens
atatctatttatctgtctga

SEQ ID NO: 1935502 - DNA, 23 bp, Homo sapiens
atatctatttatctgtctgagcc

SEQ ID NO: 1935503 - DNA, 21 bp, Homo sapiens
atatctgtgcaatggaatata

SEQ ID NO: 1935504 - DNA, 17 bp, Homo sapiens
atatctttgacctcaat

SEQ ID NO: 1935505 - DNA, 21 bp, Homo sapiens
atatgattagtaaagaaatga

SEQ ID NO: 1935506 - DNA, 16 bp, Homo sapiens
atatgattctcctctc

SEQ ID NO: 1935507 - DNA, 22 bp, Homo sapiens
atatgattctcctctcccaaat

SEQ ID NO: 1935508 - DNA, 15 bp, Homo sapiens
atatgcacaatagca

SEQ ID NO: 1935509 - DNA, 14 bp, Homo sapiens
atatgcacttataa

SEQ ID NO: 1935510 - DNA, 19 bp, Homo sapiens
atatgcactttccctagaa

SEQ ID NO: 1935511 - DNA, 17 bp, Homo sapiens
atatggcttgtagggtg

SEQ ID NO: 1935512 - DNA, 16 bp, Homo sapiens
atatgtatataaaata

SEQ ID NO: 1935513 - DNA, 19 bp, Homo sapiens
atatgtggcattcctttct

SEQ ID NO: 1935514 - DNA, 20 bp, Homo sapiens
atatgtggcattcctttctt

SEQ ID NO: 1935515 - DNA, 22 bp, Homo sapiens
atatgtggcattcctttcttta

SEQ ID NO: 1935516 - DNA, 14 bp, Homo sapiens
atatgttgatgaaa

SEQ ID NO: 1935517 - DNA, 16 bp, Homo sapiens
atattacttttgtaaa

SEQ ID NO: 1935518 - DNA, 23 bp, Homo sapiens
atattacttttgtaaatattctt

SEQ ID NO: 1935519 - DNA, 11 bp, Homo sapiens
atattatatat

SEQ ID NO: 1935520 - DNA, 20 bp, Homo sapiens
atattccagcagtgaaactt

SEQ ID NO: 1935521 - DNA, 14 bp, Homo sapiens
atattcttatgtat

SEQ ID NO: 1935522 - DNA, 15 bp, Homo sapiens
atattcttgtccaca

SEQ ID NO: 1935523 - DNA, 20 bp, Homo sapiens
atattcttgtccacattcta

SEQ ID NO: 1935524 - DNA, 15 bp, Homo sapiens
atatttaaaagaaag

SEQ ID NO: 1935525 - DNA, 21 bp, Homo sapiens
atatttacatgaattgcattt

SEQ ID NO: 1935526 - DNA, 19 bp, Homo sapiens
atatttaggatttgtgttt

SEQ ID NO: 1935527 - DNA, 16 bp, Homo sapiens
atatttctatgtaaat

SEQ ID NO: 1935528 - DNA, 18 bp, Homo sapiens
atatttgtaactttgcat

SEQ ID NO: 1935529 - DNA, 20 bp, Homo sapiens
atatttgtaactttgcatgt

SEQ ID NO: 1935530 - DNA, 21 bp, Homo sapiens
atatttgtaactttgcatgtt

SEQ ID NO: 1935531 - DNA, 22 bp, Homo sapiens
atatttgtaactttgcatgttc

SEQ ID NO: 1935532 - DNA, 22 bp, Homo sapiens
atcaagatcaaagaaccaggag

SEQ ID NO: 1935533 - DNA, 13 bp, Homo sapiens
atcaagcccttta

SEQ ID NO: 1935534 - DNA, 12 bp, Homo sapiens
atcaagcttgtg

SEQ ID NO: 1935535 - DNA, 15 bp, Homo sapiens
atcaatacccttggc

SEQ ID NO: 1935536 - DNA, 19 bp, Homo sapiens
atcaattctgatacagcct

SEQ ID NO: 1935537 - DNA, 21 bp, Homo sapiens
atcaattctgatacagcctta

SEQ ID NO: 1935538 - DNA, 19 bp, Homo sapiens
atcaccgtgggctccctga

SEQ ID NO: 1935539 - DNA, 21 bp, Homo sapiens
atcactattcttaagcacttt

SEQ ID NO: 1935540 - DNA, 22 bp, Homo sapiens
atcactattcttaagcactttg

SEQ ID NO: 1935541 - DNA, 18 bp, Homo sapiens
atcactgctgtccctcct

SEQ ID NO: 1935542 - DNA, 17 bp, Homo sapiens
atcagaatctttaaaga

SEQ ID NO: 1935543 - DNA, 11 bp, Homo sapiens
atcagcagtga

SEQ ID NO: 1935544 - DNA, 12 bp, Homo sapiens
atcagcagtgat

SEQ ID NO: 1935545 - DNA, 18 bp, Homo sapiens
atcaggacccagaggaag

SEQ ID NO: 1935546 - DNA, 17 bp, Homo sapiens
atcaggtcagagcccag

SEQ ID NO: 1935547 - DNA, 15 bp, Homo sapiens
atcagtgctccctca

SEQ ID NO: 1935548 - DNA, 20 bp, Homo sapiens
atcatctcctgccttcctcc

SEQ ID NO: 1935549 - DNA, 12 bp, Homo sapiens
atcattctctgt

SEQ ID NO: 1935550 - DNA, 20 bp, Homo sapiens
atccagagagaagcacccca

SEQ ID NO: 1935551 - DNA, 12 bp, Homo sapiens
atcccccagcct

SEQ ID NO: 1935552 - DNA, 14 bp, Homo sapiens
atcccgagcacctc

SEQ ID NO: 1935553 - DNA, 17 bp, Homo sapiens
atcccgagcacctccac

SEQ ID NO: 1935554 - DNA, 19 bp, Homo sapiens
atcccgagcacctccacat

SEQ ID NO: 1935555 - DNA, 20 bp, Homo sapiens
atccctatgtcccagcccct

SEQ ID NO: 1935556 - DNA, 20 bp, Homo sapiens
atccctgtgtgtcgttccct

SEQ ID NO: 1935557 - DNA, 14 bp, Homo sapiens
atcccttggcccct

SEQ ID NO: 1935558 - DNA, 15 bp, Homo sapiens
atcccttggcccctc

SEQ ID NO: 1935559 - DNA, 14 bp, Homo sapiens
atccgcctctgagc

SEQ ID NO: 1935560 - DNA, 21 bp, Homo sapiens
atccgtctttggcctcctcca

SEQ ID NO: 1935561 - DNA, 19 bp, Homo sapiens
atcctccacgttctgctca

SEQ ID NO: 1935562 - DNA, 15 bp, Homo sapiens
atcctgcaccctctg

SEQ ID NO: 1935563 - DNA, 21 bp, Homo sapiens
atcctgccttttaccttcagt

SEQ ID NO: 1935564 - DNA, 22 bp, Homo sapiens
atcctggacatgaagattcttt

SEQ ID NO: 1935565 - DNA, 22 bp, Homo sapiens
atcctggttggtgttgcagaag

SEQ ID NO: 1935566 - DNA, 17 bp, Homo sapiens
atcctgtacaagtgctc

SEQ ID NO: 1935567 - DNA, 17 bp, Homo sapiens
atcgcattaatgaaata

SEQ ID NO: 1935568 - DNA, 12 bp, Homo sapiens
atcgcctttccc

SEQ ID NO: 1935569 - DNA, 21 bp, Homo sapiens
atcggtgctgtcagccctgct

SEQ ID NO: 1935570 - DNA, 10 bp, Homo sapiens
cattgtgttt

SEQ ID NO: 1935571 - DNA, 14 bp, Homo sapiens
cattgtgtttgtgt

SEQ ID NO: 1935572 - DNA, 14 bp, Homo sapiens
catttacctggaaa

SEQ ID NO: 1935573 - DNA, 15 bp, Homo sapiens
catttcaactgtttg

SEQ ID NO: 1935574 - DNA, 13 bp, Homo sapiens
catttcctgacag

SEQ ID NO: 1935575 - DNA, 20 bp, Homo sapiens
catttcctgacagaaggact

SEQ ID NO: 1935576 - DNA, 12 bp, Homo sapiens
catttcttccca

SEQ ID NO: 1935577 - DNA, 16 bp, Homo sapiens
catttctttatttctg

SEQ ID NO: 1935578 - DNA, 22 bp, Homo sapiens
catttctttatttctgtctcat

SEQ ID NO: 1935579 - DNA, 20 bp, Homo sapiens
catttggctccactgtaaat

SEQ ID NO: 1935580 - DNA, 15 bp, Homo sapiens
cattttaagaaaacc

SEQ ID NO: 1935581 - DNA, 20 bp, Homo sapiens
cattttaataactaaaccag

SEQ ID NO: 1935582 - DNA, 17 bp, Homo sapiens
cattttaattattattc

SEQ ID NO: 1935583 - DNA, 17 bp, Homo sapiens
cattttgtgcagtgatt

SEQ ID NO: 1935584 - DNA, 13 bp, Homo sapiens
catttttcctaac

SEQ ID NO: 1935585 - DNA, 18 bp, Homo sapiens
catttttgaatacaggca

SEQ ID NO: 1935586 - DNA, 20 bp, Homo sapiens
catttttgaatacaggcata

SEQ ID NO: 1935587 - DNA, 17 bp, Homo sapiens
ccaaaatgaagacacgc

SEQ ID NO: 1935588 - DNA, 16 bp, Homo sapiens
ccaaaattatttcaga

SEQ ID NO: 1935589 - DNA, 14 bp, Homo sapiens
ccaaacacaggcaa

SEQ ID NO: 1935590 - DNA, 19 bp, Homo sapiens
ccaaacggaactcttcatc

SEQ ID NO: 1935591 - DNA, 16 bp, Homo sapiens
ccaaagctttcatgta

SEQ ID NO: 1935592 - DNA, 13 bp, Homo sapiens
ccaaatatgcact

SEQ ID NO: 1935593 - DNA, 16 bp, Homo sapiens
ccaaatatgcactttc

SEQ ID NO: 1935594 - DNA, 20 bp, Homo sapiens
ccaaatatgcactttcccta

SEQ ID NO: 1935595 - DNA, 22 bp, Homo sapiens
ccaaatatgcactttccctaga

SEQ ID NO: 1935596 - DNA, 23 bp, Homo sapiens
ccaaatatgcactttccctagaa

SEQ ID NO: 1935597 - DNA, 15 bp, Homo sapiens
ccaaatcccctaagc

SEQ ID NO: 1935598 - DNA, 15 bp, Homo sapiens
ccaaccacctctggc

SEQ ID NO: 1935599 - DNA, 18 bp, Homo sapiens
ccaaccacctctggccct

SEQ ID NO: 1935600 - DNA, 23 bp, Homo sapiens
ccaaccacctctggccctgttgt

SEQ ID NO: 1935601 - DNA, 14 bp, Homo sapiens
ccaaccctcagagc

SEQ ID NO: 1935602 - DNA, 15 bp, Homo sapiens
ccaaccctcagagcc

SEQ ID NO: 1935603 - DNA, 15 bp, Homo sapiens
ccaacgtggggcagc

SEQ ID NO: 1935604 - DNA, 16 bp, Homo sapiens
ccaacgtggggcagca

SEQ ID NO: 1935605 - DNA, 17 bp, Homo sapiens
ccaactctggccttggt

SEQ ID NO: 1935606 - DNA, 20 bp, Homo sapiens
ccaagaatagatgctgactg

SEQ ID NO: 1935607 - DNA, 18 bp, Homo sapiens
ccaagcaggaaatgaaaa

SEQ ID NO: 1935608 - DNA, 17 bp, Homo sapiens
ccaagccgtggcttccc

SEQ ID NO: 1935609 - DNA, 17 bp, Homo sapiens
ccaagcttcctttgttt

SEQ ID NO: 1935610 - DNA, 15 bp, Homo sapiens
agggttccagacagg

SEQ ID NO: 1935611 - DNA, 20 bp, Homo sapiens
agggttccagacagggtggg

SEQ ID NO: 1935612 - DNA, 14 bp, Homo sapiens
agggttctagaagg

SEQ ID NO: 1935613 - DNA, 21 bp, Homo sapiens
aggtcaagttcatagtttctg

SEQ ID NO: 1935614 - DNA, 16 bp, Homo sapiens
aggtcagagcccagga

SEQ ID NO: 1935615 - DNA, 22 bp, Homo sapiens
aggtcccgagccccctgtcctt

SEQ ID NO: 1935616 - DNA, 16 bp, Homo sapiens
aggtcctttccttctc

SEQ ID NO: 1935617 - DNA, 20 bp, Homo sapiens
aggtgattttcctgtgtcca

SEQ ID NO: 1935618 - DNA, 20 bp, Homo sapiens
aggtgcacctgccccaggct

SEQ ID NO: 1935619 - DNA, 21 bp, Homo sapiens
aggtgcacctgccccaggctc

SEQ ID NO: 1935620 - DNA, 16 bp, Homo sapiens
aggtgcccagtcttga

SEQ ID NO: 1935621 - DNA, 20 bp, Homo sapiens
aggtgctacacccttttcca

SEQ ID NO: 1935622 - DNA, 14 bp, Homo sapiens
aggtggccactcca

SEQ ID NO: 1935623 - DNA, 19 bp, Homo sapiens
aggtggggagactgggctg

SEQ ID NO: 1935624 - DNA, 14 bp, Homo sapiens
aggtgggtcttgga

SEQ ID NO: 1935625 - DNA, 15 bp, Homo sapiens
aggtgggtcttggat

SEQ ID NO: 1935626 - DNA, 17 bp, Homo sapiens
aggtggtcttggagagg

SEQ ID NO: 1935627 - DNA, 14 bp, Homo sapiens
aggtgtggagtgga

SEQ ID NO: 1935628 - DNA, 13 bp, Homo sapiens
aggtgtttctctg

SEQ ID NO: 1935629 - DNA, 19 bp, Homo sapiens
aggttaaggggatctaaaa

SEQ ID NO: 1935630 - DNA, 15 bp, Homo sapiens
aggttcacccagcgc

SEQ ID NO: 1935631 - DNA, 23 bp, Homo sapiens
aggttccgcttggagcagagggg

SEQ ID NO: 1935632 - DNA, 14 bp, Homo sapiens
aggttgaggctaaa

SEQ ID NO: 1935633 - DNA, 17 bp, Homo sapiens
aggttggaactgctgcc

SEQ ID NO: 1935634 - DNA, 22 bp, Homo sapiens
aggttggagatgacagaaatat

SEQ ID NO: 1935635 - DNA, 15 bp, Homo sapiens
agtaaaattacagaa

SEQ ID NO: 1935636 - DNA, 16 bp, Homo sapiens
agtaaaattacagaag

SEQ ID NO: 1935637 - DNA, 17 bp, Homo sapiens
agtaaaattacagaaga

SEQ ID NO: 1935638 - DNA, 13 bp, Homo sapiens
agtaaagaaatga

SEQ ID NO: 1935639 - DNA, 13 bp, Homo sapiens
agtaaattgcctt

SEQ ID NO: 1935640 - DNA, 21 bp, Homo sapiens
agtaactaagcacattatgtt

SEQ ID NO: 1935641 - DNA, 18 bp, Homo sapiens
agtaacttgtcaaggaat

SEQ ID NO: 1935642 - DNA, 18 bp, Homo sapiens
agtacaaccactatcttt

SEQ ID NO: 1935643 - DNA, 21 bp, Homo sapiens
agtacaggtaaggtgagggaa

SEQ ID NO: 1935644 - DNA, 23 bp, Homo sapiens
agtacaggtaaggtgagggaata

SEQ ID NO: 1935645 - DNA, 13 bp, Homo sapiens
agtagggtcaggc

SEQ ID NO: 1935646 - DNA, 16 bp, Homo sapiens
agtagggttgccagtc

SEQ ID NO: 1935647 - DNA, 16 bp, Homo sapiens
agtaggtgggtcttgg

SEQ ID NO: 1935648 - DNA, 20 bp, Homo sapiens
agtaggtgggtcttggattg

SEQ ID NO: 1935649 - DNA, 13 bp, Homo sapiens
agtagtcatttca

SEQ ID NO: 1935650 - DNA, 14 bp, Homo sapiens
agtagtgcctgtga

SEQ ID NO: 1935651 - DNA, 16 bp, Homo sapiens
agtagtgcctgtgatc

SEQ ID NO: 1935652 - DNA, 19 bp, Homo sapiens
agtagtgcctgtgatcgtg

SEQ ID NO: 1935653 - DNA, 12 bp, Homo sapiens
agtatctgtaac

SEQ ID NO: 1935654 - DNA, 15 bp, Homo sapiens
agtatctgtaaccct

SEQ ID NO: 1935655 - DNA, 19 bp, Homo sapiens
agtatctgtaacccttgaa

SEQ ID NO: 1935656 - DNA, 14 bp, Homo sapiens
agtatctgtacctg

SEQ ID NO: 1935657 - DNA, 11 bp, Homo sapiens
agtatgggcta

SEQ ID NO: 1935658 - DNA, 18 bp, Homo sapiens
agtattgccacctctggc

SEQ ID NO: 1935659 - DNA, 16 bp, Homo sapiens
agtatttcaaattgga

SEQ ID NO: 1935660 - DNA, 13 bp, Homo sapiens
agtcaaagacatt

SEQ ID NO: 1935661 - DNA, 19 bp, Homo sapiens
agtcaagaaaaacattatt

SEQ ID NO: 1935662 - DNA, 14 bp, Homo sapiens
agtcaagtcaaata

SEQ ID NO: 1935663 - DNA, 23 bp, Homo sapiens
atcgtctctccctccctttgaaa

SEQ ID NO: 1935664 - DNA, 16 bp, Homo sapiens
atctaaaaaatatctt

SEQ ID NO: 1935665 - DNA, 16 bp, Homo sapiens
atctagagaataatca

SEQ ID NO: 1935666 - DNA, 17 bp, Homo sapiens
atctatataaatcgcat

SEQ ID NO: 1935667 - DNA, 17 bp, Homo sapiens
atctcactttaataata

SEQ ID NO: 1935668 - DNA, 14 bp, Homo sapiens
atctcattggaccc

SEQ ID NO: 1935669 - DNA, 20 bp, Homo sapiens
atctcccagataatgtgaaa

SEQ ID NO: 1935670 - DNA, 16 bp, Homo sapiens
atctcctgccttcctc

SEQ ID NO: 1935671 - DNA, 17 bp, Homo sapiens
atctcgaagtcttccat

SEQ ID NO: 1935672 - DNA, 16 bp, Homo sapiens
atctctgctttggaaa

SEQ ID NO: 1935673 - DNA, 19 bp, Homo sapiens
atctctttttgctttcgaa

SEQ ID NO: 1935674 - DNA, 18 bp, Homo sapiens
atctgatgcaagcaagaa

SEQ ID NO: 1935675 - DNA, 13 bp, Homo sapiens
atctgctgtaata

SEQ ID NO: 1935676 - DNA, 22 bp, Homo sapiens
atctggagtctgaaggagagga

SEQ ID NO: 1935677 - DNA, 19 bp, Homo sapiens
atctgtaacccttgaattt

SEQ ID NO: 1935678 - DNA, 23 bp, Homo sapiens
atctgtaacccttgaatttctag

SEQ ID NO: 1935679 - DNA, 17 bp, Homo sapiens
atctgtctgagccctgc

SEQ ID NO: 1935680 - DNA, 21 bp, Homo sapiens
atctgtctgagccctgccctc

SEQ ID NO: 1935681 - DNA, 18 bp, Homo sapiens
atctgtgcaatggaatat

SEQ ID NO: 1935682 - DNA, 13 bp, Homo sapiens
atctgtgtcttgt

SEQ ID NO: 1935683 - DNA, 18 bp, Homo sapiens
atcttaagagaatccaca

SEQ ID NO: 1935684 - DNA, 20 bp, Homo sapiens
atcttaagagaatccacata

SEQ ID NO: 1935685 - DNA, 20 bp, Homo sapiens
atcttaagataatatttaaa

SEQ ID NO: 1935686 - DNA, 17 bp, Homo sapiens
atcttgactacagtcag

SEQ ID NO: 1935687 - DNA, 17 bp, Homo sapiens
atcttgagcaaggcaag

SEQ ID NO: 1935688 - DNA, 15 bp, Homo sapiens
atctttgacctcaat

SEQ ID NO: 1935689 - DNA, 18 bp, Homo sapiens
atctttttaggccacctc

SEQ ID NO: 1935690 - DNA, 13 bp, Homo sapiens
atgaaaaatagca

SEQ ID NO: 1935691 - DNA, 16 bp, Homo sapiens
atgaaaatgtcttgtg

SEQ ID NO: 1935692 - DNA, 11 bp, Homo sapiens
atgaaattgcc

SEQ ID NO: 1935693 - DNA, 23 bp, Homo sapiens
atgaaattgccaaaaaaatttat

SEQ ID NO: 1935694 - DNA, 16 bp, Homo sapiens
atgaacggtgagcatt

SEQ ID NO: 1935695 - DNA, 16 bp, Homo sapiens
atgaactcttaatcaa

SEQ ID NO: 1935696 - DNA, 22 bp, Homo sapiens
atgaatgtttacactctttgta

SEQ ID NO: 1935697 - DNA, 20 bp, Homo sapiens
atgacagaaatatgattgat

SEQ ID NO: 1935698 - DNA, 15 bp, Homo sapiens
atgacatttctcaaa

SEQ ID NO: 1935699 - DNA, 11 bp, Homo sapiens
atgacccctcc

SEQ ID NO: 1935700 - DNA, 23 bp, Homo sapiens
atgacccggcccccgccctctgc

SEQ ID NO: 1935701 - DNA, 17 bp, Homo sapiens
atgacgtattgtgaaat

SEQ ID NO: 1935702 - DNA, 15 bp, Homo sapiens
atgagaaacaacaga

SEQ ID NO: 1935703 - DNA, 15 bp, Homo sapiens
atgagctgggccctg

SEQ ID NO: 1935704 - DNA, 14 bp, Homo sapiens
atgagtctcactag

SEQ ID NO: 1935705 - DNA, 15 bp, Homo sapiens
atgatactgtctaag

SEQ ID NO: 1935706 - DNA, 12 bp, Homo sapiens
atgatttgcaac

SEQ ID NO: 1935707 - DNA, 15 bp, Homo sapiens
atgatttgcaacttt

SEQ ID NO: 1935708 - DNA, 16 bp, Homo sapiens
atgatttgcaacttta

SEQ ID NO: 1935709 - DNA, 22 bp, Homo sapiens
atgatttgcaactttagaaaga

SEQ ID NO: 1935710 - DNA, 16 bp, Homo sapiens
atgcacctataaatac

SEQ ID NO: 1935711 - DNA, 21 bp, Homo sapiens
atgcactgttccccctgtgca

SEQ ID NO: 1935712 - DNA, 19 bp, Homo sapiens
atgcacttataattttcct

SEQ ID NO: 1935713 - DNA, 17 bp, Homo sapiens
atgcactttccctagaa

SEQ ID NO: 1935714 - DNA, 23 bp, Homo sapiens
atgcagaccccaccctgtctgca

SEQ ID NO: 1935715 - DNA, 14 bp, Homo sapiens
atgcatacgtaaaa

SEQ ID NO: 1935716 - DNA, 17 bp, Homo sapiens
atgcatgcactgttccc

SEQ ID NO: 1935717 - DNA, 15 bp, Homo sapiens
atgccacctgcagcg

SEQ ID NO: 1935718 - DNA, 15 bp, Homo sapiens
atgccatcatctcct

SEQ ID NO: 1935719 - DNA, 21 bp, Homo sapiens
atgcccagcttggagtgccac

SEQ ID NO: 1935720 - DNA, 19 bp, Homo sapiens
atgccctatcttagtagag

SEQ ID NO: 1935721 - DNA, 15 bp, Homo sapiens
atgcctcctctgtcc

SEQ ID NO: 1935722 - DNA, 15 bp, Homo sapiens
atgcctgcctgaaca

SEQ ID NO: 1935723 - DNA, 15 bp, Homo sapiens
atgccttctccagac

SEQ ID NO: 1935724 - DNA, 15 bp, Homo sapiens
atgcgaatgagctgg

SEQ ID NO: 1935725 - DNA, 19 bp, Homo sapiens
atgctgactgtactcctcc

SEQ ID NO: 1935726 - DNA, 21 bp, Homo sapiens
atgctgactgtactcctccca

SEQ ID NO: 1935727 - DNA, 16 bp, Homo sapiens
atgcttataagcaaca

SEQ ID NO: 1935728 - DNA, 17 bp, Homo sapiens
atgcttctgacttcata

SEQ ID NO: 1935729 - DNA, 13 bp, Homo sapiens
atgcttctgctca

SEQ ID NO: 1935730 - DNA, 21 bp, Homo sapiens
atgcttctgctcacattccct

SEQ ID NO: 1935731 - DNA, 17 bp, Homo sapiens
atggaaacgcacaaccc

SEQ ID NO: 1935732 - DNA, 18 bp, Homo sapiens
atggaccacagtgactta

SEQ ID NO: 1935733 - DNA, 21 bp, Homo sapiens
atggagccagctctgcattat

SEQ ID NO: 1935734 - DNA, 16 bp, Homo sapiens
atggagggaataatac

SEQ ID NO: 1935735 - DNA, 13 bp, Homo sapiens
atggcagaaggca

SEQ ID NO: 1935736 - DNA, 21 bp, Homo sapiens
atggcagaaggcaaacccatc

SEQ ID NO: 1935737 - DNA, 13 bp, Homo sapiens
atggccaggagtg

SEQ ID NO: 1935738 - DNA, 22 bp, Homo sapiens
atggccaggtggccactccaga

SEQ ID NO: 1935739 - DNA, 14 bp, Homo sapiens
atggcccagcctgg

SEQ ID NO: 1935740 - DNA, 17 bp, Homo sapiens
atggcccagcctggagc

SEQ ID NO: 1935741 - DNA, 13 bp, Homo sapiens
atggctctggcta

SEQ ID NO: 1935742 - DNA, 16 bp, Homo sapiens
atggctgggtttgggc

SEQ ID NO: 1935743 - DNA, 20 bp, Homo sapiens
atggcttgggctggagtggg

SEQ ID NO: 1935744 - DNA, 15 bp, Homo sapiens
atgggcactggaaaa

SEQ ID NO: 1935745 - DNA, 16 bp, Homo sapiens
atgggccaagccaggg

SEQ ID NO: 1935746 - DNA, 15 bp, Homo sapiens
atgggtaacactgat

SEQ ID NO: 1935747 - DNA, 18 bp, Homo sapiens
atggtcagtgtgcaaaga

SEQ ID NO: 1935748 - DNA, 16 bp, Homo sapiens
atggtccaggagaagg

SEQ ID NO: 1935749 - DNA, 18 bp, Homo sapiens
atggtcctgttatgtcat

SEQ ID NO: 1935750 - DNA, 19 bp, Homo sapiens
atggtgagaattaaaataa

SEQ ID NO: 1935751 - DNA, 17 bp, Homo sapiens
atggtgcagtgaagaaa

SEQ ID NO: 1935752 - DNA, 14 bp, Homo sapiens
atggtgcccttgga

SEQ ID NO: 1935753 - DNA, 15 bp, Homo sapiens
atggtgggctccaga

SEQ ID NO: 1935754 - DNA, 16 bp, Homo sapiens
atggtgggctccagag

SEQ ID NO: 1935755 - DNA, 19 bp, Homo sapiens
atggtggtttcagaaaggg

SEQ ID NO: 1935756 - DNA, 19 bp, Homo sapiens
atggttcccctgttcactc

SEQ ID NO: 1935757 - DNA, 20 bp, Homo sapiens
atggttcccctgttcactct

SEQ ID NO: 1935758 - DNA, 22 bp, Homo sapiens
atggttgggacaatggcaatag

SEQ ID NO: 1935759 - DNA, 15 bp, Homo sapiens
atgtaaattataagt

SEQ ID NO: 1935760 - DNA, 18 bp, Homo sapiens
atgtaaattattgtaaac

SEQ ID NO: 1935761 - DNA, 20 bp, Homo sapiens
atgtaagaatccaaagtgga

SEQ ID NO: 1935762 - DNA, 16 bp, Homo sapiens
atgtaatcaatgtttc

SEQ ID NO: 1935763 - DNA, 18 bp, Homo sapiens
atgtactgagccttgtaa

SEQ ID NO: 1935764 - DNA, 20 bp, Homo sapiens
atgtactttatattttctat

SEQ ID NO: 1935765 - DNA, 22 bp, Homo sapiens
atgtactttatattttctatat

SEQ ID NO: 1935766 - DNA, 12 bp, Homo sapiens
atgtagaagagg

SEQ ID NO: 1935767 - DNA, 18 bp, Homo sapiens
atgtagaagagggagaag

SEQ ID NO: 1935768 - DNA, 13 bp, Homo sapiens
atgtatataaaat

SEQ ID NO: 1935769 - DNA, 19 bp, Homo sapiens
atgtatatttaaaagaaag

SEQ ID NO: 1935770 - DNA, 18 bp, Homo sapiens
atgtattacttttctgca

SEQ ID NO: 1935771 - DNA, 17 bp, Homo sapiens
atgtcagtaccttcaaa

SEQ ID NO: 1935772 - DNA, 13 bp, Homo sapiens
atgtcattgtgtt

SEQ ID NO: 1935773 - DNA, 24 bp, Homo sapiens
atgtccctaccgagtctcttctcc

SEQ ID NO: 1935774 - DNA, 19 bp, Homo sapiens
atgtcgtagttactctcag

SEQ ID NO: 1935775 - DNA, 11 bp, Homo sapiens
atgtctgtgat

SEQ ID NO: 1935776 - DNA, 22 bp, Homo sapiens
atgtcttcttgggggcagacca

SEQ ID NO: 1935777 - DNA, 23 bp, Homo sapiens
atgtcttgatgcatgcactgttc

SEQ ID NO: 1935778 - DNA, 21 bp, Homo sapiens
atgtgaaaatggtccaggaga

SEQ ID NO: 1935779 - DNA, 19 bp, Homo sapiens
atgtgacatgcgggctggg

SEQ ID NO: 1935780 - DNA, 22 bp, Homo sapiens
atgtggccaagggctccagggc

SEQ ID NO: 1935781 - DNA, 14 bp, Homo sapiens
atgtgtatgtgttt

SEQ ID NO: 1935782 - DNA, 22 bp, Homo sapiens
atgtgtgtccacgactgtctcc

SEQ ID NO: 1935783 - DNA, 20 bp, Homo sapiens
atgtgtttataattgttata

SEQ ID NO: 1935784 - DNA, 18 bp, Homo sapiens
atgttaaaacaaattaaa

SEQ ID NO: 1935785 - DNA, 23 bp, Homo sapiens
atgttaattaaagtaaaattatt

SEQ ID NO: 1935786 - DNA, 14 bp, Homo sapiens
atgttacattatta

SEQ ID NO: 1935787 - DNA, 17 bp, Homo sapiens
atgttattttttaatta

SEQ ID NO: 1935788 - DNA, 20 bp, Homo sapiens
atgttcacttttgacaaagg

SEQ ID NO: 1935789 - DNA, 18 bp, Homo sapiens
atgttctaagtctttcca

SEQ ID NO: 1935790 - DNA, 12 bp, Homo sapiens
atgttgttattt

SEQ ID NO: 1935791 - DNA, 17 bp, Homo sapiens
atgttgttatttaaaga

SEQ ID NO: 1935792 - DNA, 16 bp, Homo sapiens
atgtttacactctttg

SEQ ID NO: 1935793 - DNA, 22 bp, Homo sapiens
atgtttacactctttgtaagag

SEQ ID NO: 1935794 - DNA, 19 bp, Homo sapiens
atgtttgcaactggtatat

SEQ ID NO: 1935795 - DNA, 15 bp, Homo sapiens
atgttttaatatcct

SEQ ID NO: 1935796 - DNA, 19 bp, Homo sapiens
atgtttttgttcaaagcca

SEQ ID NO: 1935797 - DNA, 21 bp, Homo sapiens
attaaaaacacctaagtgact

SEQ ID NO: 1935798 - DNA, 15 bp, Homo sapiens
attaaaatgtgcagt

SEQ ID NO: 1935799 - DNA, 19 bp, Homo sapiens
cccaccacacacacccttc

SEQ ID NO: 1935800 - DNA, 18 bp, Homo sapiens
cccacccctcttccccct

SEQ ID NO: 1935801 - DNA, 22 bp, Homo sapiens
cccacccctcttcccccttccc

SEQ ID NO: 1935802 - DNA, 13 bp, Homo sapiens
cccacctgccagg

SEQ ID NO: 1935803 - DNA, 12 bp, Homo sapiens
cccacggccact

SEQ ID NO: 1935804 - DNA, 15 bp, Homo sapiens
cccacggccactgca

SEQ ID NO: 1935805 - DNA, 18 bp, Homo sapiens
cccacgtcccgggcactg

SEQ ID NO: 1935806 - DNA, 15 bp, Homo sapiens
cccacgtcctgggtg

SEQ ID NO: 1935807 - DNA, 13 bp, Homo sapiens
cccactcagcatt

SEQ ID NO: 1935808 - DNA, 22 bp, Homo sapiens
cccactcagcatttcggtgctt

SEQ ID NO: 1935809 - DNA, 21 bp, Homo sapiens
cccagagaacaatcactattc

SEQ ID NO: 1935810 - DNA, 22 bp, Homo sapiens
cccagagaacaatcactattct

SEQ ID NO: 1935811 - DNA, 21 bp, Homo sapiens
cccagaggaaggggccagagg

SEQ ID NO: 1935812 - DNA, 17 bp, Homo sapiens
cccagccaggaggggct

SEQ ID NO: 1935813 - DNA, 10 bp, Homo sapiens
cccagcctgg

SEQ ID NO: 1935814 - DNA, 16 bp, Homo sapiens
cccagctcctcttcct

SEQ ID NO: 1935815 - DNA, 17 bp, Homo sapiens
cccagctcctcttcctg

SEQ ID NO: 1935816 - DNA, 17 bp, Homo sapiens
cccagctgctcctcgca

SEQ ID NO: 1935817 - DNA, 15 bp, Homo sapiens
cccaggccgtggctg

SEQ ID NO: 1935818 - DNA, 12 bp, Homo sapiens
cccagggcagcg

SEQ ID NO: 1935819 - DNA, 16 bp, Homo sapiens
cccagtcttgagtggg

SEQ ID NO: 1935820 - DNA, 17 bp, Homo sapiens
cccagtcttgagtgggc

SEQ ID NO: 1935821 - DNA, 22 bp, Homo sapiens
cccatcagtgctccctcacatg

SEQ ID NO: 1935822 - DNA, 23 bp, Homo sapiens
cccatcagtgctccctcacatgt

SEQ ID NO: 1935823 - DNA, 13 bp, Homo sapiens
ccccaaggaagaa

SEQ ID NO: 1935824 - DNA, 18 bp, Homo sapiens
ccccacccctgaactggc

SEQ ID NO: 1935825 - DNA, 21 bp, Homo sapiens
ccccaccctgtctgcaggcca

SEQ ID NO: 1935826 - DNA, 14 bp, Homo sapiens
ccccatcagtgctc

SEQ ID NO: 1935827 - DNA, 13 bp, Homo sapiens
ccccatgggctgc

SEQ ID NO: 1935828 - DNA, 19 bp, Homo sapiens
ccccatggtcagccctagg

SEQ ID NO: 1935829 - DNA, 23 bp, Homo sapiens
ccccattcctgggaaatattccc

SEQ ID NO: 1935830 - DNA, 15 bp, Homo sapiens
cccccgccctctgcc

SEQ ID NO: 1935831 - DNA, 22 bp, Homo sapiens
cccccggctcggcctcttgaga

SEQ ID NO: 1935832 - DNA, 13 bp, Homo sapiens
cccccttcccctg

SEQ ID NO: 1935833 - DNA, 19 bp, Homo sapiens
cccccttcccctgcgccct

SEQ ID NO: 1935834 - DNA, 13 bp, Homo sapiens
ccccgccctctgc

SEQ ID NO: 1935835 - DNA, 15 bp, Homo sapiens
ccccgtccctttccc

SEQ ID NO: 1935836 - DNA, 14 bp, Homo sapiens
cccctaccctttcc

SEQ ID NO: 1935837 - DNA, 16 bp, Homo sapiens
cccctataccctaggt

SEQ ID NO: 1935838 - DNA, 13 bp, Homo sapiens
cccctatcctgca

SEQ ID NO: 1935839 - DNA, 21 bp, Homo sapiens
cccctcaagccaggagaccct

SEQ ID NO: 1935840 - DNA, 11 bp, Homo sapiens
cccctccagac

SEQ ID NO: 1935841 - DNA, 13 bp, Homo sapiens
cccctccttctcc

SEQ ID NO: 1935842 - DNA, 20 bp, Homo sapiens
cccctctcttaccccgtccc

SEQ ID NO: 1935843 - DNA, 21 bp, Homo sapiens
cccctgaactggccccagctc

SEQ ID NO: 1935844 - DNA, 23 bp, Homo sapiens
cccctgaactggccccagctcct

SEQ ID NO: 1935845 - DNA, 14 bp, Homo sapiens
cccctgccagggca

SEQ ID NO: 1935846 - DNA, 23 bp, Homo sapiens
cccctgccagggcagggccccag

SEQ ID NO: 1935847 - DNA, 14 bp, Homo sapiens
cccctgcgccctcc

SEQ ID NO: 1935848 - DNA, 23 bp, Homo sapiens
cccctgcgccctccctccctcca

SEQ ID NO: 1935849 - DNA, 20 bp, Homo sapiens
cccctggcttttcactgctg

SEQ ID NO: 1935850 - DNA, 23 bp, Homo sapiens
cccctggtactcccccagccctc

SEQ ID NO: 1935851 - DNA, 11 bp, Homo sapiens
cccctgtgcag

SEQ ID NO: 1935852 - DNA, 15 bp, Homo sapiens
cccctgttcactcta

SEQ ID NO: 1935853 - DNA, 16 bp, Homo sapiens
ccccttcatcctctga

SEQ ID NO: 1935854 - DNA, 14 bp, Homo sapiens
ccccttcccacccc

SEQ ID NO: 1935855 - DNA, 12 bp, Homo sapiens
cccgactctctc

SEQ ID NO: 1935856 - DNA, 15 bp, Homo sapiens
cccgagccccctgtc

SEQ ID NO: 1935857 - DNA, 22 bp, Homo sapiens
cccgcaatgtgcccccagacgc

SEQ ID NO: 1935858 - DNA, 13 bp, Homo sapiens
cccgctcagccct

SEQ ID NO: 1935859 - DNA, 17 bp, Homo sapiens
cccggaggggcctggca

SEQ ID NO: 1935860 - DNA, 19 bp, Homo sapiens
cccgggtactcagtcagcc

SEQ ID NO: 1935861 - DNA, 21 bp, Homo sapiens
cccgggtactcagtcagccca

SEQ ID NO: 1935862 - DNA, 23 bp, Homo sapiens
cccgggtactcagtcagcccagt

SEQ ID NO: 1935863 - DNA, 16 bp, Homo sapiens
cccgtccctttccctg

SEQ ID NO: 1935864 - DNA, 16 bp, Homo sapiens
cccgtcggaatggtaa

SEQ ID NO: 1935865 - DNA, 20 bp, Homo sapiens
ccctagaaagccatattcca

SEQ ID NO: 1935866 - DNA, 16 bp, Homo sapiens
ccctaggtctccaccc

SEQ ID NO: 1935867 - DNA, 21 bp, Homo sapiens
ccctaggtctccacccctcaa

SEQ ID NO: 1935868 - DNA, 15 bp, Homo sapiens
ccctatcctgcaccc

SEQ ID NO: 1935869 - DNA, 16 bp, Homo sapiens
ccctatcctgcaccct

SEQ ID NO: 1935870 - DNA, 18 bp, Homo sapiens
ccctatcctgcaccctct

SEQ ID NO: 1935871 - DNA, 14 bp, Homo sapiens
ccctcactccactc

SEQ ID NO: 1935872 - DNA, 17 bp, Homo sapiens
ccctcactccactcccc

SEQ ID NO: 1935873 - DNA, 13 bp, Homo sapiens
ccctcatctgtcc

SEQ ID NO: 1935874 - DNA, 18 bp, Homo sapiens
ccctccacacctccaccc

SEQ ID NO: 1935875 - DNA, 13 bp, Homo sapiens
ccctccactcctc

SEQ ID NO: 1935876 - DNA, 19 bp, Homo sapiens
ccctccactcctcccaact

SEQ ID NO: 1935877 - DNA, 16 bp, Homo sapiens
ccctccagacccctac

SEQ ID NO: 1935878 - DNA, 14 bp, Homo sapiens
ccctccctccacac

SEQ ID NO: 1935879 - DNA, 15 bp, Homo sapiens
ccctccctccctcca

SEQ ID NO: 1935880 - DNA, 16 bp, Homo sapiens
ccctccctcctgtgtt

SEQ ID NO: 1935881 - DNA, 12 bp, Homo sapiens
ccctccctgcag

SEQ ID NO: 1935882 - DNA, 11 bp, Homo sapiens
ccctccctgtc

SEQ ID NO: 1935883 - DNA, 12 bp, Homo sapiens
ccctccctgtcc

SEQ ID NO: 1935884 - DNA, 19 bp, Homo sapiens
ccctcctccagagcctggg

SEQ ID NO: 1935885 - DNA, 19 bp, Homo sapiens
ccctccttctcccctccag

SEQ ID NO: 1935886 - DNA, 21 bp, Homo sapiens
ccctccttctcccctccagac

SEQ ID NO: 1935887 - DNA, 14 bp, Homo sapiens
ccctcgctgccagc

SEQ ID NO: 1935888 - DNA, 20 bp, Homo sapiens
ccctcggtgcagaaactacc

SEQ ID NO: 1935889 - DNA, 15 bp, Homo sapiens
ccctctacagagctt

SEQ ID NO: 1935890 - DNA, 21 bp, Homo sapiens
ccctctcatccaggtcctttc

SEQ ID NO: 1935891 - DNA, 12 bp, Homo sapiens
ccctctctgcag

SEQ ID NO: 1935892 - DNA, 13 bp, Homo sapiens
ccctctctgcagt

SEQ ID NO: 1935893 - DNA, 14 bp, Homo sapiens
ccctctctgctctg

SEQ ID NO: 1935894 - DNA, 18 bp, Homo sapiens
ccctctctgtttaccctc

SEQ ID NO: 1935895 - DNA, 18 bp, Homo sapiens
ccctctgcccccagctgc

SEQ ID NO: 1935896 - DNA, 19 bp, Homo sapiens
ccctctgctatgtctgtga

SEQ ID NO: 1935897 - DNA, 12 bp, Homo sapiens
ccctcttccccc

SEQ ID NO: 1935898 - DNA, 14 bp, Homo sapiens
ccctcttccccctt

SEQ ID NO: 1935899 - DNA, 18 bp, Homo sapiens
ccctgaactggccccagc

SEQ ID NO: 1935900 - DNA, 17 bp, Homo sapiens
ccctgaattgtttgata

SEQ ID NO: 1935901 - DNA, 19 bp, Homo sapiens
ccctgactcattctgaagg

SEQ ID NO: 1935902 - DNA, 19 bp, Homo sapiens
ccctgagctgaggcagcag

SEQ ID NO: 1935903 - DNA, 21 bp, Homo sapiens
ccctgagctgaggcagcagtg

SEQ ID NO: 1935904 - DNA, 20 bp, Homo sapiens
ccctgcaaaaggactctcag

SEQ ID NO: 1935905 - DNA, 17 bp, Homo sapiens
ccctgcacctcattcca

SEQ ID NO: 1935906 - DNA, 18 bp, Homo sapiens
ccctgcacctcattccaa

SEQ ID NO: 1935907 - DNA, 19 bp, Homo sapiens
ccctgcacctcattccaac

SEQ ID NO: 1935908 - DNA, 17 bp, Homo sapiens
ccctgccctcactccac

SEQ ID NO: 1935909 - DNA, 16 bp, Homo sapiens
ccctgcgtctcctgcc

SEQ ID NO: 1935910 - DNA, 17 bp, Homo sapiens
ccctgctttgggctgcc

SEQ ID NO: 1935911 - DNA, 20 bp, Homo sapiens
ccctgctttgggctgccctg

SEQ ID NO: 1935912 - DNA, 18 bp, Homo sapiens
ccctggcacctgggtgct

SEQ ID NO: 1935913 - DNA, 15 bp, Homo sapiens
ccctggccccagtga

SEQ ID NO: 1935914 - DNA, 17 bp, Homo sapiens
ccctggcttttcactgc

SEQ ID NO: 1935915 - DNA, 22 bp, Homo sapiens
ccctggcttttcactgctggct

SEQ ID NO: 1935916 - DNA, 13 bp, Homo sapiens
ccctggtgctgcc

SEQ ID NO: 1935917 - DNA, 17 bp, Homo sapiens
ccctggtgctgccacac

SEQ ID NO: 1935918 - DNA, 21 bp, Homo sapiens
ccctggtgctgccacacttca

SEQ ID NO: 1935919 - DNA, 12 bp, Homo sapiens
ccctgtcctggg

SEQ ID NO: 1935920 - DNA, 18 bp, Homo sapiens
ccctgtccttcccacggc

SEQ ID NO: 1935921 - DNA, 23 bp, Homo sapiens
ccctgtctttgctgtttatatat

SEQ ID NO: 1935922 - DNA, 22 bp, Homo sapiens
ccctgttcactctacttagcat

SEQ ID NO: 1935923 - DNA, 16 bp, Homo sapiens
cccttccactgagggc

SEQ ID NO: 1935924 - DNA, 12 bp, Homo sapiens
cccttccccact

SEQ ID NO: 1935925 - DNA, 16 bp, Homo sapiens
cccttccccactcccg

SEQ ID NO: 1935926 - DNA, 13 bp, Homo sapiens
cccttcctctcca

SEQ ID NO: 1935927 - DNA, 13 bp, Homo sapiens
cccttggcccctc

SEQ ID NO: 1935928 - DNA, 18 bp, Homo sapiens
ccctttcactgaagtgaa

SEQ ID NO: 1935929 - DNA, 12 bp, Homo sapiens
ccctttccctgc

SEQ ID NO: 1935930 - DNA, 13 bp, Homo sapiens
ccctttccctgca

SEQ ID NO: 1935931 - DNA, 15 bp, Homo sapiens
ccctttccctgcatc

SEQ ID NO: 1935932 - DNA, 15 bp, Homo sapiens
ccctttgttgctgtc

SEQ ID NO: 1935933 - DNA, 12 bp, Homo sapiens
ccgacagcctgg

SEQ ID NO: 1935934 - DNA, 15 bp, Homo sapiens
ccgacagcctggcac

SEQ ID NO: 1935935 - DNA, 15 bp, Homo sapiens
ccgagccccctgtcc

SEQ ID NO: 1935936 - DNA, 18 bp, Homo sapiens
ccgagccccctgtccttc

SEQ ID NO: 1935937 - DNA, 14 bp, Homo sapiens
cctccacccgtcct

SEQ ID NO: 1935938 - DNA, 18 bp, Homo sapiens
cctccacgttctgctcat

SEQ ID NO: 1935939 - DNA, 13 bp, Homo sapiens
cctccagacccct

SEQ ID NO: 1935940 - DNA, 22 bp, Homo sapiens
cctccagacccctaccctttcc

SEQ ID NO: 1935941 - DNA, 17 bp, Homo sapiens
cctccagcaatgcctgc

SEQ ID NO: 1935942 - DNA, 13 bp, Homo sapiens
cctcccctgccag

SEQ ID NO: 1935943 - DNA, 14 bp, Homo sapiens
cctccctccctgca

SEQ ID NO: 1935944 - DNA, 12 bp, Homo sapiens
cctccctgcagc

SEQ ID NO: 1935945 - DNA, 18 bp, Homo sapiens
cctccgggacctggtgct

SEQ ID NO: 1935946 - DNA, 16 bp, Homo sapiens
cctccgtatttcagac

SEQ ID NO: 1935947 - DNA, 21 bp, Homo sapiens
cctcctccagagcctgggcgc

SEQ ID NO: 1935948 - DNA, 16 bp, Homo sapiens
cctcctcctcctcctg

SEQ ID NO: 1935949 - DNA, 13 bp, Homo sapiens
cctcctgaccctg

SEQ ID NO: 1935950 - DNA, 17 bp, Homo sapiens
cctcctgttcctgcctt

SEQ ID NO: 1935951 - DNA, 15 bp, Homo sapiens
cctccttagaaaaga

SEQ ID NO: 1935952 - DNA, 13 bp, Homo sapiens
cctccttctcccc

SEQ ID NO: 1935953 - DNA, 14 bp, Homo sapiens
cctccttctcccct

SEQ ID NO: 1935954 - DNA, 13 bp, Homo sapiens
cctcgctgccagc

SEQ ID NO: 1935955 - DNA, 14 bp, Homo sapiens
cctcggctgtgtgg

SEQ ID NO: 1935956 - DNA, 15 bp, Homo sapiens
cctcggctgtgtggg

SEQ ID NO: 1935957 - DNA, 19 bp, Homo sapiens
cctcggctgtgtggggagg

SEQ ID NO: 1935958 - DNA, 22 bp, Homo sapiens
cctcgtcccgagggcgcctggg

SEQ ID NO: 1935959 - DNA, 15 bp, Homo sapiens
cctctaattaaaatg

SEQ ID NO: 1935960 - DNA, 21 bp, Homo sapiens
cctctacagagcttccctgac

SEQ ID NO: 1935961 - DNA, 20 bp, Homo sapiens
cctctcatccaggtcctttc

SEQ ID NO: 1935962 - DNA, 23 bp, Homo sapiens
cctctcatccaggtcctttcctt

SEQ ID NO: 1935963 - DNA, 13 bp, Homo sapiens
cctctccactgcc

SEQ ID NO: 1935964 - DNA, 19 bp, Homo sapiens
cctctccactgccttcgat

SEQ ID NO: 1935965 - DNA, 22 bp, Homo sapiens
cctctcccaaataaactcctta

SEQ ID NO: 1935966 - DNA, 20 bp, Homo sapiens
cctctctctcacctacttcc

SEQ ID NO: 1935967 - DNA, 14 bp, Homo sapiens
cctctctctccctc

SEQ ID NO: 1935968 - DNA, 12 bp, Homo sapiens
cctctgactcag

SEQ ID NO: 1935969 - DNA, 21 bp, Homo sapiens
cctctgagccaggagcctcct

SEQ ID NO: 1935970 - DNA, 14 bp, Homo sapiens
cctctgcagggcag

SEQ ID NO: 1935971 - DNA, 17 bp, Homo sapiens
cctctgcagggcagcct

SEQ ID NO: 1935972 - DNA, 20 bp, Homo sapiens
cctctgcagggcagcctgtg

SEQ ID NO: 1935973 - DNA, 21 bp, Homo sapiens
cctctgcccccagctgctcct

SEQ ID NO: 1935974 - DNA, 18 bp, Homo sapiens
cctctggccaaatatgca

SEQ ID NO: 1935975 - DNA, 15 bp, Homo sapiens
cctctgtccaggcac

SEQ ID NO: 1935976 - DNA, 20 bp, Homo sapiens
cctctgtccaggcactgaga

SEQ ID NO: 1935977 - DNA, 21 bp, Homo sapiens
cctctgtccaggcactgagat

SEQ ID NO: 1935978 - DNA, 21 bp, Homo sapiens
cctctgtgaccaatgtcttga

SEQ ID NO: 1935979 - DNA, 21 bp, Homo sapiens
cctcttgagagccccacccct

SEQ ID NO: 1935980 - DNA, 14 bp, Homo sapiens
cctgaactggcccc

SEQ ID NO: 1935981 - DNA, 13 bp, Homo sapiens
cctgaatcccttt

SEQ ID NO: 1935982 - DNA, 23 bp, Homo sapiens
cctgaattgtttgatattgtcac

SEQ ID NO: 1935983 - DNA, 13 bp, Homo sapiens
cctgactcattct

SEQ ID NO: 1935984 - DNA, 15 bp, Homo sapiens
cctgagctgaggcag

SEQ ID NO: 1935985 - DNA, 18 bp, Homo sapiens
cctgaggaacccttacag

SEQ ID NO: 1935986 - DNA, 17 bp, Homo sapiens
cctgaggggatatccct

SEQ ID NO: 1935987 - DNA, 16 bp, Homo sapiens
cctgcaaggtgcacct

SEQ ID NO: 1935988 - DNA, 14 bp, Homo sapiens
cctgcaccctctgc

SEQ ID NO: 1935989 - DNA, 17 bp, Homo sapiens
cctgcaccctctgctat

SEQ ID NO: 1935990 - DNA, 16 bp, Homo sapiens
cctgcatcccttggcc

SEQ ID NO: 1935991 - DNA, 22 bp, Homo sapiens
cctgcatcccttggcccctctc

SEQ ID NO: 1935992 - DNA, 23 bp, Homo sapiens
cctgcatcccttggcccctctct

SEQ ID NO: 1935993 - DNA, 17 bp, Homo sapiens
cctgccagggcagggcc

SEQ ID NO: 1935994 - DNA, 19 bp, Homo sapiens
cctgccagggcagggcccc

SEQ ID NO: 1935995 - DNA, 15 bp, Homo sapiens
cctgccccaggctca

SEQ ID NO: 1935996 - DNA, 15 bp, Homo sapiens
cctgcccccaatcca

SEQ ID NO: 1935997 - DNA, 14 bp, Homo sapiens
cctgccccccttcc

SEQ ID NO: 1935998 - DNA, 15 bp, Homo sapiens
cctgccccccttccc

SEQ ID NO: 1935999 - DNA, 22 bp, Homo sapiens
cctgccccccttcccaccccta

SEQ ID NO: 1936000 - DNA, 15 bp, Homo sapiens
cctgcccctcccttc

SEQ ID NO: 1936001 - DNA, 12 bp, Homo sapiens
cctgccctcact

SEQ ID NO: 1936002 - DNA, 23 bp, Homo sapiens
cctgcctctctcatggcttgggc

SEQ ID NO: 1936003 - DNA, 14 bp, Homo sapiens
cctgcgccctccct

SEQ ID NO: 1936004 - DNA, 21 bp, Homo sapiens
cctgcgccctccctccctcca

SEQ ID NO: 1936005 - DNA, 14 bp, Homo sapiens
cctgcgtctcctgc

SEQ ID NO: 1936006 - DNA, 15 bp, Homo sapiens
cctgctgtgggtcag

SEQ ID NO: 1936007 - DNA, 18 bp, Homo sapiens
cctgctttgggctgccct

SEQ ID NO: 1936008 - DNA, 22 bp, Homo sapiens
cctgctttgggctgccctggtg

SEQ ID NO: 1936009 - DNA, 23 bp, Homo sapiens
cctggacatgaagattctttccc

SEQ ID NO: 1936010 - DNA, 24 bp, Homo sapiens
cctggacatgaagattctttccca

SEQ ID NO: 1936011 - DNA, 10 bp, Homo sapiens
ctaattaaaa

SEQ ID NO: 1936012 - DNA, 11 bp, Homo sapiens
ctaattaaaat

SEQ ID NO: 1936013 - DNA, 12 bp, Homo sapiens
ctaattaaaatg

SEQ ID NO: 1936014 - DNA, 18 bp, Homo sapiens
ctaattaaaatgtgcagt

SEQ ID NO: 1936015 - DNA, 22 bp, Homo sapiens
ctaattaaaatgtgcagtattt

SEQ ID NO: 1936016 - DNA, 14 bp, Homo sapiens
ctaattagagcaga

SEQ ID NO: 1936017 - DNA, 19 bp, Homo sapiens
ctacaagctaaaattagat

SEQ ID NO: 1936018 - DNA, 19 bp, Homo sapiens
ctacacagcagctgttcaa

SEQ ID NO: 1936019 - DNA, 16 bp, Homo sapiens
ctacacccttttccag

SEQ ID NO: 1936020 - DNA, 18 bp, Homo sapiens
ctacacccttttccagct

SEQ ID NO: 1936021 - DNA, 17 bp, Homo sapiens
ctacagagcttccctga

SEQ ID NO: 1936022 - DNA, 18 bp, Homo sapiens
ctacagccaaattgcaga

SEQ ID NO: 1936023 - DNA, 21 bp, Homo sapiens
ctacagctaatcagcattctc

SEQ ID NO: 1936024 - DNA, 14 bp, Homo sapiens
ctacagtcaggaaa

SEQ ID NO: 1936025 - DNA, 15 bp, Homo sapiens
ctacagtcaggaaag

SEQ ID NO: 1936026 - DNA, 18 bp, Homo sapiens
ctacagtcaggaaaggaa

SEQ ID NO: 1936027 - DNA, 17 bp, Homo sapiens
ctacatgtgggagcttt

SEQ ID NO: 1936028 - DNA, 14 bp, Homo sapiens
ctaccaaaatgaag

SEQ ID NO: 1936029 - DNA, 13 bp, Homo sapiens
ctaccctccctcg

SEQ ID NO: 1936030 - DNA, 15 bp, Homo sapiens
ctaccctttcccaaa

SEQ ID NO: 1936031 - DNA, 19 bp, Homo sapiens
ctaccctttcccaaaccct

SEQ ID NO: 1936032 - DNA, 21 bp, Homo sapiens
ctaccttggttcccccactga

SEQ ID NO: 1936033 - DNA, 14 bp, Homo sapiens
ctacgcagaagaga

SEQ ID NO: 1936034 - DNA, 12 bp, Homo sapiens
ctactgtacatt

SEQ ID NO: 1936035 - DNA, 17 bp, Homo sapiens
ctacttagcatgtccct

SEQ ID NO: 1936036 - DNA, 12 bp, Homo sapiens
ctacttcagctt

SEQ ID NO: 1936037 - DNA, 18 bp, Homo sapiens
ctagaaagccatattcca

SEQ ID NO: 1936038 - DNA, 19 bp, Homo sapiens
ctagaaagccatattccag

SEQ ID NO: 1936039 - DNA, 14 bp, Homo sapiens
ctagaaggggcgag

SEQ ID NO: 1936040 - DNA, 12 bp, Homo sapiens
ctagacagtatt

SEQ ID NO: 1936041 - DNA, 15 bp, Homo sapiens
ctagacagtattgcc

SEQ ID NO: 1936042 - DNA, 17 bp, Homo sapiens
ctagacagtattgccac

SEQ ID NO: 1936043 - DNA, 20 bp, Homo sapiens
ctagagattcttagctcttg

SEQ ID NO: 1936044 - DNA, 17 bp, Homo sapiens
ctagagggatccaccgc

SEQ ID NO: 1936045 - DNA, 20 bp, Homo sapiens
ctagatggttccctttgttg

SEQ ID NO: 1936046 - DNA, 13 bp, Homo sapiens
ctagatttatgaa

SEQ ID NO: 1936047 - DNA, 16 bp, Homo sapiens
ctagggccaagcccag

SEQ ID NO: 1936048 - DNA, 13 bp, Homo sapiens
ctaggtctccacc

SEQ ID NO: 1936049 - DNA, 15 bp, Homo sapiens
ctaggtctccacccc

SEQ ID NO: 1936050 - DNA, 19 bp, Homo sapiens
ctaggtctccacccctcaa

SEQ ID NO: 1936051 - DNA, 17 bp, Homo sapiens
ctaggttaataggagga

SEQ ID NO: 1936052 - DNA, 22 bp, Homo sapiens
ctataccctaggtctccacccc

SEQ ID NO: 1936053 - DNA, 19 bp, Homo sapiens
ctatacgcagcgtgcttta

SEQ ID NO: 1936054 - DNA, 19 bp, Homo sapiens
ctatatttgtaactttgca

SEQ ID NO: 1936055 - DNA, 23 bp, Homo sapiens
ctatatttgtaactttgcatgtt

SEQ ID NO: 1936056 - DNA, 15 bp, Homo sapiens
ctatcctgcaccctc

SEQ ID NO: 1936057 - DNA, 16 bp, Homo sapiens
ctatcctgcaccctct

SEQ ID NO: 1936058 - DNA, 17 bp, Homo sapiens
ctatcctgcaccctctg

SEQ ID NO: 1936059 - DNA, 18 bp, Homo sapiens
ctatcctgcaccctctgc

SEQ ID NO: 1936060 - DNA, 21 bp, Homo sapiens
ctatcctgcaccctctgctat

SEQ ID NO: 1936061 - DNA, 15 bp, Homo sapiens
ctatgatttggaaaa

SEQ ID NO: 1936062 - DNA, 21 bp, Homo sapiens
ctatggggagaaaagacatga

SEQ ID NO: 1936063 - DNA, 14 bp, Homo sapiens
ctatgtaaattatt

SEQ ID NO: 1936064 - DNA, 15 bp, Homo sapiens
ctatgtaaattattg

SEQ ID NO: 1936065 - DNA, 17 bp, Homo sapiens
ctatgtaaattattgta

SEQ ID NO: 1936066 - DNA, 18 bp, Homo sapiens
ctatgtaaattattgtaa

SEQ ID NO: 1936067 - DNA, 20 bp, Homo sapiens
ctatgtccatgaaaaacagc

SEQ ID NO: 1936068 - DNA, 19 bp, Homo sapiens
ctatgtcccagcccctggt

SEQ ID NO: 1936069 - DNA, 22 bp, Homo sapiens
ctatgtttttgttcaaagccag

SEQ ID NO: 1936070 - DNA, 21 bp, Homo sapiens
ctattaaagtaacatttaagc

SEQ ID NO: 1936071 - DNA, 15 bp, Homo sapiens
ctattcccaaagaac

SEQ ID NO: 1936072 - DNA, 15 bp, Homo sapiens
ctattccctggagac

SEQ ID NO: 1936073 - DNA, 11 bp, Homo sapiens
ctattggtaaa

SEQ ID NO: 1936074 - DNA, 18 bp, Homo sapiens
ctatttagagaatgattt

SEQ ID NO: 1936075 - DNA, 16 bp, Homo sapiens
ctattttttaaaaatt

SEQ ID NO: 1936076 - DNA, 17 bp, Homo sapiens
ctatttttttgttgctg

SEQ ID NO: 1936077 - DNA, 18 bp, Homo sapiens
ctcaaagtttttacagtg

SEQ ID NO: 1936078 - DNA, 19 bp, Homo sapiens
ctcaagagggcactggtgg

SEQ ID NO: 1936079 - DNA, 21 bp, Homo sapiens
ctcaagagggcactggtggcc

SEQ ID NO: 1936080 - DNA, 16 bp, Homo sapiens
ctcaagcactgacact

SEQ ID NO: 1936081 - DNA, 16 bp, Homo sapiens
ctcaagccaggagacc

SEQ ID NO: 1936082 - DNA, 23 bp, Homo sapiens
ctcaagccaggagaccctgtctt

SEQ ID NO: 1936083 - DNA, 15 bp, Homo sapiens
ctcaaggcgtgagga

SEQ ID NO: 1936084 - DNA, 18 bp, Homo sapiens
ctcaagttagcatttcaa

SEQ ID NO: 1936085 - DNA, 20 bp, Homo sapiens
ctcacaggttcacccagcgc

SEQ ID NO: 1936086 - DNA, 21 bp, Homo sapiens
ctcacaggttcacccagcgcc

SEQ ID NO: 1936087 - DNA, 15 bp, Homo sapiens
ctcacattccctctc

SEQ ID NO: 1936088 - DNA, 20 bp, Homo sapiens
ctcacattccctctcatcca

SEQ ID NO: 1936089 - DNA, 16 bp, Homo sapiens
ctcacctacttcctcc

SEQ ID NO: 1936090 - DNA, 17 bp, Homo sapiens
ctcacctgaattcgaga

SEQ ID NO: 1936091 - DNA, 15 bp, Homo sapiens
ctcactccactcccc

SEQ ID NO: 1936092 - DNA, 18 bp, Homo sapiens
ctcactccactcccctca

SEQ ID NO: 1936093 - DNA, 13 bp, Homo sapiens
ctcactcctacct

SEQ ID NO: 1936094 - DNA, 19 bp, Homo sapiens
ctcactcctacctggtaat

SEQ ID NO: 1936095 - DNA, 19 bp, Homo sapiens
ctcagcccacatagtgatg

SEQ ID NO: 1936096 - DNA, 21 bp, Homo sapiens
ctcagcccacatagtgatggt

SEQ ID NO: 1936097 - DNA, 22 bp, Homo sapiens
ctcagcctccggatgacacaaa

SEQ ID NO: 1936098 - DNA, 22 bp, Homo sapiens
ctcaggaccaaagctttcatgt

SEQ ID NO: 1936099 - DNA, 17 bp, Homo sapiens
ctcagggctcctgggtt

SEQ ID NO: 1936100 - DNA, 14 bp, Homo sapiens
ctcagtcagcccag

SEQ ID NO: 1936101 - DNA, 17 bp, Homo sapiens
ctcagtcagcccagtgg

SEQ ID NO: 1936102 - DNA, 13 bp, Homo sapiens
ctcataattgtca

SEQ ID NO: 1936103 - DNA, 19 bp, Homo sapiens
ctcatcattctctgtctca

SEQ ID NO: 1936104 - DNA, 22 bp, Homo sapiens
ctcatcattctctgtctcatcc

SEQ ID NO: 1936105 - DNA, 18 bp, Homo sapiens
ctcatccacagaggccag

SEQ ID NO: 1936106 - DNA, 19 bp, Homo sapiens
ctcatccactaggtgccca

SEQ ID NO: 1936107 - DNA, 18 bp, Homo sapiens
ctcatccaggtcctttcc

SEQ ID NO: 1936108 - DNA, 17 bp, Homo sapiens
ctcatcttcttcaccat

SEQ ID NO: 1936109 - DNA, 17 bp, Homo sapiens
ctcattggacccttcca

SEQ ID NO: 1936110 - DNA, 18 bp, Homo sapiens
ctcattggacccttccat

SEQ ID NO: 1936111 - DNA, 15 bp, Homo sapiens
ctccacacctccacc

SEQ ID NO: 1936112 - DNA, 17 bp, Homo sapiens
ctccacagaaaccctgt

SEQ ID NO: 1936113 - DNA, 18 bp, Homo sapiens
ctccacagaaaccctgtt

SEQ ID NO: 1936114 - DNA, 13 bp, Homo sapiens
ctccacatcctcc

SEQ ID NO: 1936115 - DNA, 12 bp, Homo sapiens
ctccacccctca

SEQ ID NO: 1936116 - DNA, 20 bp, Homo sapiens
ctccacccgtcctggggtgg

SEQ ID NO: 1936117 - DNA, 18 bp, Homo sapiens
ctccacgcttagggtctg

SEQ ID NO: 1936118 - DNA, 20 bp, Homo sapiens
ctccacgttcacccctccac

SEQ ID NO: 1936119 - DNA, 15 bp, Homo sapiens
ctccacgttctgctc

SEQ ID NO: 1936120 - DNA, 17 bp, Homo sapiens
ctccacgttctgctcat

SEQ ID NO: 1936121 - DNA, 18 bp, Homo sapiens
ctccacgttctgctcatc

SEQ ID NO: 1936122 - DNA, 15 bp, Homo sapiens
ctccactcccctcat

SEQ ID NO: 1936123 - DNA, 17 bp, Homo sapiens
ctccactcccctcatcc

SEQ ID NO: 1936124 - DNA, 11 bp, Homo sapiens
ctccactgcct

SEQ ID NO: 1936125 - DNA, 13 bp, Homo sapiens
ctccactgccttc

SEQ ID NO: 1936126 - DNA, 14 bp, Homo sapiens
ctccactgccttcg

SEQ ID NO: 1936127 - DNA, 15 bp, Homo sapiens
ctccactgccttcga

SEQ ID NO: 1936128 - DNA, 16 bp, Homo sapiens
ctccactggatggagg

SEQ ID NO: 1936129 - DNA, 20 bp, Homo sapiens
ctccagacccctaccctttc

SEQ ID NO: 1936130 - DNA, 21 bp, Homo sapiens
ctccagacccctaccctttcc

SEQ ID NO: 1936131 - DNA, 18 bp, Homo sapiens
ctccagacccctggcttt

SEQ ID NO: 1936132 - DNA, 19 bp, Homo sapiens
ctccagacccctggctttt

SEQ ID NO: 1936133 - DNA, 15 bp, Homo sapiens
ctccagagcctgggc

SEQ ID NO: 1936134 - DNA, 15 bp, Homo sapiens
ctccagagtaggtgg

SEQ ID NO: 1936135 - DNA, 16 bp, Homo sapiens
ctccatgtagaagagg

SEQ ID NO: 1936136 - DNA, 19 bp, Homo sapiens
ctccatgtagaagagggag

SEQ ID NO: 1936137 - DNA, 18 bp, Homo sapiens
ctcccaaataaactcctt

SEQ ID NO: 1936138 - DNA, 19 bp, Homo sapiens
ctcccaaataaactcctta

SEQ ID NO: 1936139 - DNA, 20 bp, Homo sapiens
ctcccaaataaactccttaa

SEQ ID NO: 1936140 - DNA, 16 bp, Homo sapiens
ctcccaactctggcct

SEQ ID NO: 1936141 - DNA, 15 bp, Homo sapiens
ctcccacaggccctt

SEQ ID NO: 1936142 - DNA, 16 bp, Homo sapiens
ctcccacaggcccttc

SEQ ID NO: 1936143 - DNA, 19 bp, Homo sapiens
ctcccaggcgccccttccc

SEQ ID NO: 1936144 - DNA, 14 bp, Homo sapiens
ctcccctccagacc

SEQ ID NO: 1936145 - DNA, 15 bp, Homo sapiens
ctcccctccagaccc

SEQ ID NO: 1936146 - DNA, 16 bp, Homo sapiens
ctcccctccagacccc

SEQ ID NO: 1936147 - DNA, 15 bp, Homo sapiens
ctcccgaatcctgag

SEQ ID NO: 1936148 - DNA, 18 bp, Homo sapiens
ctccctccacacctccac

SEQ ID NO: 1936149 - DNA, 13 bp, Homo sapiens
ctccctccactcc

SEQ ID NO: 1936150 - DNA, 13 bp, Homo sapiens
ctccctccctcca

SEQ ID NO: 1936151 - DNA, 14 bp, Homo sapiens
ctccctccctccac

SEQ ID NO: 1936152 - DNA, 15 bp, Homo sapiens
ctccctccctccaca

SEQ ID NO: 1936153 - DNA, 16 bp, Homo sapiens
ctccctccctgcaggg

SEQ ID NO: 1936154 - DNA, 14 bp, Homo sapiens
ctccctcctgtgtt

SEQ ID NO: 1936155 - DNA, 21 bp, Homo sapiens
ctccctcgcatccgcctctga

SEQ ID NO: 1936156 - DNA, 13 bp, Homo sapiens
ctccctgcagctt

SEQ ID NO: 1936157 - DNA, 14 bp, Homo sapiens
ctccctgcccctcc

SEQ ID NO: 1936158 - DNA, 16 bp, Homo sapiens
ctccctggccccagtg

SEQ ID NO: 1936159 - DNA, 14 bp, Homo sapiens
ctccctgtcccctg

SEQ ID NO: 1936160 - DNA, 19 bp, Homo sapiens
ctcccttcaaccattcccc

SEQ ID NO: 1936161 - DNA, 19 bp, Homo sapiens
ctcctacccctgtcctggg

SEQ ID NO: 1936162 - DNA, 19 bp, Homo sapiens
ctcctccagagcctgggcg

SEQ ID NO: 1936163 - DNA, 13 bp, Homo sapiens
ctcctcccaactc

SEQ ID NO: 1936164 - DNA, 23 bp, Homo sapiens
ctcctcccaggcgccccttcccc

SEQ ID NO: 1936165 - DNA, 21 bp, Homo sapiens
ctcctcgtcccgagggcgcct

SEQ ID NO: 1936166 - DNA, 13 bp, Homo sapiens
ctcctctcccaaa

SEQ ID NO: 1936167 - DNA, 18 bp, Homo sapiens
ctcctctctctccctcca

SEQ ID NO: 1936168 - DNA, 20 bp, Homo sapiens
ctcctctctctccctccact

SEQ ID NO: 1936169 - DNA, 22 bp, Homo sapiens
ctcctctctctccctccactcc

SEQ ID NO: 1936170 - DNA, 13 bp, Homo sapiens
ctcctctgactca

SEQ ID NO: 1936171 - DNA, 18 bp, Homo sapiens
ctcctctgactcagggct

SEQ ID NO: 1936172 - DNA, 20 bp, Homo sapiens
ctcctctgactcagggctcc

SEQ ID NO: 1936173 - DNA, 22 bp, Homo sapiens
ctcctctgtgaccaatgtcttg

SEQ ID NO: 1936174 - DNA, 23 bp, Homo sapiens
ctcctgaatccctttcagtttgt

SEQ ID NO: 1936175 - DNA, 20 bp, Homo sapiens
ctcctgagaaaaaaggttcc

SEQ ID NO: 1936176 - DNA, 13 bp, Homo sapiens
ctcctgaggtctg

SEQ ID NO: 1936177 - DNA, 15 bp, Homo sapiens
ctcctgcccactctg

SEQ ID NO: 1936178 - DNA, 19 bp, Homo sapiens
ctcctgggccctctctgct

SEQ ID NO: 1936179 - DNA, 22 bp, Homo sapiens
ctcctgggttttgtattctctg

SEQ ID NO: 1936180 - DNA, 19 bp, Homo sapiens
ctcctgttcctgccttctc

SEQ ID NO: 1936181 - DNA, 21 bp, Homo sapiens
ctcctgttcctgccttctctt

SEQ ID NO: 1936182 - DNA, 18 bp, Homo sapiens
ctccttaaccacctagtc

SEQ ID NO: 1936183 - DNA, 14 bp, Homo sapiens
ctccttcctggaga

SEQ ID NO: 1936184 - DNA, 13 bp, Homo sapiens
ctccttctcccct

SEQ ID NO: 1936185 - DNA, 14 bp, Homo sapiens
ctccttctcccctc

SEQ ID NO: 1936186 - DNA, 16 bp, Homo sapiens
ctccttctcccctcca

SEQ ID NO: 1936187 - DNA, 19 bp, Homo sapiens
ctccttctcccctccagac

SEQ ID NO: 1936188 - DNA, 16 bp, Homo sapiens
ctcctttcacaacctt

SEQ ID NO: 1936189 - DNA, 20 bp, Homo sapiens
ctcctttcacaaccttctgt

SEQ ID NO: 1936190 - DNA, 15 bp, Homo sapiens
ctcgaagtcttccat

SEQ ID NO: 1936191 - DNA, 19 bp, Homo sapiens
ctcgcatccgcctctgagc

SEQ ID NO: 1936192 - DNA, 12 bp, Homo sapiens
ctcgctgccagc

SEQ ID NO: 1936193 - DNA, 19 bp, Homo sapiens
ctcgctgccagctctgtat

SEQ ID NO: 1936194 - DNA, 15 bp, Homo sapiens
ctcgctggactctca

SEQ ID NO: 1936195 - DNA, 13 bp, Homo sapiens
ctcggctggaaga

SEQ ID NO: 1936196 - DNA, 18 bp, Homo sapiens
ctcggctggaagaacatc

SEQ ID NO: 1936197 - DNA, 21 bp, Homo sapiens
ctcggctggaagaacatcaag

SEQ ID NO: 1936198 - DNA, 22 bp, Homo sapiens
ctcggctttggctcgggacttc

SEQ ID NO: 1936199 - DNA, 23 bp, Homo sapiens
ctcgtcccgagggcgcctgggtc

SEQ ID NO: 1936200 - DNA, 13 bp, Homo sapiens
ctcgtcttcctct

SEQ ID NO: 1936201 - DNA, 19 bp, Homo sapiens
ctcgtcttcctctctctca

SEQ ID NO: 1936202 - DNA, 20 bp, Homo sapiens
ctctaattaaaatgtgcagt

SEQ ID NO: 1936203 - DNA, 21 bp, Homo sapiens
ctctacagctaatcagcattc

SEQ ID NO: 1936204 - DNA, 21 bp, Homo sapiens
ctctactaacaatcagctcct

SEQ ID NO: 1936205 - DNA, 19 bp, Homo sapiens
ctctcacctacttcctcct

SEQ ID NO: 1936206 - DNA, 12 bp, Homo sapiens
ctctcacctcct

SEQ ID NO: 1936207 - DNA, 14 bp, Homo sapiens
ctctcagtctctga

SEQ ID NO: 1936208 - DNA, 11 bp, Homo sapiens
ctctccactgc

SEQ ID NO: 1936209 - DNA, 16 bp, Homo sapiens
ctctccactgccttcg

SEQ ID NO: 1936210 - DNA, 16 bp, Homo sapiens
ctctcctctctctccc

SEQ ID NO: 1936211 - DNA, 18 bp, Homo sapiens
ctctcctctctctccctc

SEQ ID NO: 1936212 - DNA, 13 bp, Homo sapiens
ctctctccctcca

SEQ ID NO: 1936213 - DNA, 19 bp, Homo sapiens
ctctctccctccactcctc

SEQ ID NO: 1936214 - DNA, 14 bp, Homo sapiens
ctctctctccctcc

SEQ ID NO: 1936215 - DNA, 16 bp, Homo sapiens
ctctctctccctccac

SEQ ID NO: 1936216 - DNA, 13 bp, Homo sapiens
ctctctgcagtcc

SEQ ID NO: 1936217 - DNA, 23 bp, Homo sapiens
ctctctgcagtcctcggcagctc

SEQ ID NO: 1936218 - DNA, 14 bp, Homo sapiens
ctctctgctctgcg

SEQ ID NO: 1936219 - DNA, 13 bp, Homo sapiens
ctctctggacctg

SEQ ID NO: 1936220 - DNA, 12 bp, Homo sapiens
ctctctgtttac

SEQ ID NO: 1936221 - DNA, 21 bp, Homo sapiens
ctctctgtttaccctccctgt

SEQ ID NO: 1936222 - DNA, 22 bp, Homo sapiens
ctctctgtttaccctccctgtc

SEQ ID NO: 1936223 - DNA, 16 bp, Homo sapiens
ctctcttaccccgtcc

SEQ ID NO: 1936224 - DNA, 20 bp, Homo sapiens
ctctcttaccccgtcccttt

SEQ ID NO: 1936225 - DNA, 18 bp, Homo sapiens
ctctgaaagctgcttctg

SEQ ID NO: 1936226 - DNA, 14 bp, Homo sapiens
ctctgactcagggc

SEQ ID NO: 1936227 - DNA, 21 bp, Homo sapiens
ctctgactcagggctcctggg

SEQ ID NO: 1936228 - DNA, 13 bp, Homo sapiens
ctctgagccagga

SEQ ID NO: 1936229 - DNA, 20 bp, Homo sapiens
ctctgagccaggagcctcct

SEQ ID NO: 1936230 - DNA, 21 bp, Homo sapiens
ctctgagccaggagcctcctg

SEQ ID NO: 1936231 - DNA, 23 bp, Homo sapiens
ctctgcagggcagcctgtgggag

SEQ ID NO: 1936232 - DNA, 20 bp, Homo sapiens
ctctgcagtcctcggcagct

SEQ ID NO: 1936233 - DNA, 21 bp, Homo sapiens
ctctgcagtcctcggcagctc

SEQ ID NO: 1936234 - DNA, 21 bp, Homo sapiens
ctctgcccccagctgctcctc

SEQ ID NO: 1936235 - DNA, 18 bp, Homo sapiens
ctctggagtgtgtggggg

SEQ ID NO: 1936236 - DNA, 17 bp, Homo sapiens
ctctggccaaatatgca

SEQ ID NO: 1936237 - DNA, 20 bp, Homo sapiens
ctctggccaaatatgcactt

SEQ ID NO: 1936238 - DNA, 20 bp, Homo sapiens
ctctggccttggttcctcca

SEQ ID NO: 1936239 - DNA, 21 bp, Homo sapiens
ctctggccttggttcctccag

SEQ ID NO: 1936240 - DNA, 18 bp, Homo sapiens
ctggctcccacaggccct

SEQ ID NO: 1936241 - DNA, 15 bp, Homo sapiens
ctggctggagaggaa

SEQ ID NO: 1936242 - DNA, 14 bp, Homo sapiens
ctggctgtggcccc

SEQ ID NO: 1936243 - DNA, 15 bp, Homo sapiens
ctggctgtggcccct

SEQ ID NO: 1936244 - DNA, 17 bp, Homo sapiens
ctggctgtggcccctcc

SEQ ID NO: 1936245 - DNA, 16 bp, Homo sapiens
ctggcttttcactgct

SEQ ID NO: 1936246 - DNA, 23 bp, Homo sapiens
ctgggaatggggtgggagccaca

SEQ ID NO: 1936247 - DNA, 14 bp, Homo sapiens
ctgggagagccaag

SEQ ID NO: 1936248 - DNA, 16 bp, Homo sapiens
ctgggagatgcagctg

SEQ ID NO: 1936249 - DNA, 23 bp, Homo sapiens
cttcccgctcagccctccctgcc

SEQ ID NO: 1936250 - DNA, 14 bp, Homo sapiens
cttccctgcaaggt

SEQ ID NO: 1936251 - DNA, 21 bp, Homo sapiens
cttccctgcaaggtgcacctg

SEQ ID NO: 1936252 - DNA, 22 bp, Homo sapiens
cttccctgtatgattccttgat

SEQ ID NO: 1936253 - DNA, 20 bp, Homo sapiens
cttcctccctccctgcaggg

SEQ ID NO: 1936254 - DNA, 19 bp, Homo sapiens
cttcctcctcctcctcctg

SEQ ID NO: 1936255 - DNA, 22 bp, Homo sapiens
cttcctttgtttttttttcctg

SEQ ID NO: 1936256 - DNA, 16 bp, Homo sapiens
cttcgtggatgacctc

SEQ ID NO: 1936257 - DNA, 14 bp, Homo sapiens
cttctaacacctct

SEQ ID NO: 1936258 - DNA, 13 bp, Homo sapiens
cttctagaaccag

SEQ ID NO: 1936259 - DNA, 16 bp, Homo sapiens
cttctaggttctaaaa

SEQ ID NO: 1936260 - DNA, 16 bp, Homo sapiens
cttctatatatacaat

SEQ ID NO: 1936261 - DNA, 17 bp, Homo sapiens
cttctcaagcactgaca

SEQ ID NO: 1936262 - DNA, 15 bp, Homo sapiens
cttctccactggatg

SEQ ID NO: 1936263 - DNA, 17 bp, Homo sapiens
cttctccagacaaacca

SEQ ID NO: 1936264 - DNA, 14 bp, Homo sapiens
cttctccatccaca

SEQ ID NO: 1936265 - DNA, 16 bp, Homo sapiens
cttctccatccacatg

SEQ ID NO: 1936266 - DNA, 14 bp, Homo sapiens
cttctcccctccag

SEQ ID NO: 1936267 - DNA, 16 bp, Homo sapiens
cttctcccctccagac

SEQ ID NO: 1936268 - DNA, 22 bp, Homo sapiens
cttctcctttcacaaccttctg

SEQ ID NO: 1936269 - DNA, 14 bp, Homo sapiens
cttctcgtcttcct

SEQ ID NO: 1936270 - DNA, 15 bp, Homo sapiens
cttctcgtcttcctc

SEQ ID NO: 1936271 - DNA, 16 bp, Homo sapiens
cttctcgtcttcctct

SEQ ID NO: 1936272 - DNA, 18 bp, Homo sapiens
cttctctcacctcctaaa

SEQ ID NO: 1936273 - DNA, 21 bp, Homo sapiens
cttctctcccacacaagcagt

SEQ ID NO: 1936274 - DNA, 21 bp, Homo sapiens
cttctgctcacattccctctc

SEQ ID NO: 1936275 - DNA, 16 bp, Homo sapiens
cttctgggacttgaaa

SEQ ID NO: 1936276 - DNA, 22 bp, Homo sapiens
cttctgggagggcagcagggct

SEQ ID NO: 1936277 - DNA, 23 bp, Homo sapiens
cttctgtgcatttgtgtctgcct

SEQ ID NO: 1936278 - DNA, 13 bp, Homo sapiens
cttctgtggctca

SEQ ID NO: 1936279 - DNA, 16 bp, Homo sapiens
cttcttaaatgagaag

SEQ ID NO: 1936280 - DNA, 13 bp, Homo sapiens
cttcttcaccatt

SEQ ID NO: 1936281 - DNA, 18 bp, Homo sapiens
cttcttgggggcagacca

SEQ ID NO: 1936282 - DNA, 19 bp, Homo sapiens
cttcttgggggcagaccag

SEQ ID NO: 1936283 - DNA, 12 bp, Homo sapiens
cttgacctccta

SEQ ID NO: 1936284 - DNA, 20 bp, Homo sapiens
cttgacgcgtggtcacagga

SEQ ID NO: 1936285 - DNA, 13 bp, Homo sapiens
cttgagagcccca

SEQ ID NO: 1936286 - DNA, 17 bp, Homo sapiens
cttgagagcgctggcct

SEQ ID NO: 1936287 - DNA, 19 bp, Homo sapiens
cttgagagcgctggcctct

SEQ ID NO: 1936288 - DNA, 18 bp, Homo sapiens
cttgagcaaggcaagaag

SEQ ID NO: 1936289 - DNA, 22 bp, Homo sapiens
cttgagcaaggcaagaagtggg

SEQ ID NO: 1936290 - DNA, 22 bp, Homo sapiens
cttgagcaataaacgctgactt

SEQ ID NO: 1936291 - DNA, 21 bp, Homo sapiens
cttgcatttctttatttctgt

SEQ ID NO: 1936292 - DNA, 22 bp, Homo sapiens
cttgcatttctttatttctgtc

SEQ ID NO: 1936293 - DNA, 22 bp, Homo sapiens
cttgccccagatgcctcctctg

SEQ ID NO: 1936294 - DNA, 14 bp, Homo sapiens
cttgccgctgggag

SEQ ID NO: 1936295 - DNA, 18 bp, Homo sapiens
cttgccgctgggagagcc

SEQ ID NO: 1936296 - DNA, 21 bp, Homo sapiens
cttgccttattagagtgtctt

SEQ ID NO: 1936297 - DNA, 21 bp, Homo sapiens
cttggagaggaggtgtggagt

SEQ ID NO: 1936298 - DNA, 17 bp, Homo sapiens
cttggaggcaacctccc

SEQ ID NO: 1936299 - DNA, 22 bp, Homo sapiens
cttggctgtagaaggagacaga

SEQ ID NO: 1936300 - DNA, 22 bp, Homo sapiens
cttgggctccattcccatcact

SEQ ID NO: 1936301 - DNA, 13 bp, Homo sapiens
cttgggctccctg

SEQ ID NO: 1936302 - DNA, 21 bp, Homo sapiens
cttgggctccctgtaacctct

SEQ ID NO: 1936303 - DNA, 16 bp, Homo sapiens
cttgggggcagaccag

SEQ ID NO: 1936304 - DNA, 17 bp, Homo sapiens
cttggggtagagaggac

SEQ ID NO: 1936305 - DNA, 16 bp, Homo sapiens
cttggttcccccactg

SEQ ID NO: 1936306 - DNA, 14 bp, Homo sapiens
cttggttgaggaaa

SEQ ID NO: 1936307 - DNA, 15 bp, Homo sapiens
cttggttgaggaaac

SEQ ID NO: 1936308 - DNA, 15 bp, Homo sapiens
cttgtaattctaaat

SEQ ID NO: 1936309 - DNA, 19 bp, Homo sapiens
cttgtgcctcttgggagac

SEQ ID NO: 1936310 - DNA, 14 bp, Homo sapiens
cttgtggcctggga

SEQ ID NO: 1936311 - DNA, 12 bp, Homo sapiens
cttgtgtctgtt

SEQ ID NO: 1936312 - DNA, 12 bp, Homo sapiens
cttgtgtgaggg

SEQ ID NO: 1936313 - DNA, 15 bp, Homo sapiens
cttgtgtgagtgtga

SEQ ID NO: 1936314 - DNA, 13 bp, Homo sapiens
cttgtgtttgtat

SEQ ID NO: 1936315 - DNA, 19 bp, Homo sapiens
cttgtgtttgtatataaat

SEQ ID NO: 1936316 - DNA, 19 bp, Homo sapiens
cttgttttgttatataaaa

SEQ ID NO: 1936317 - DNA, 20 bp, Homo sapiens
cttgttttgttatataaaaa

SEQ ID NO: 1936318 - DNA, 20 bp, Homo sapiens
cttgttttttttttccactt

SEQ ID NO: 1936319 - DNA, 13 bp, Homo sapiens
ctttaaataaaaa

SEQ ID NO: 1936320 - DNA, 21 bp, Homo sapiens
ctttaaatcatttatctggat

SEQ ID NO: 1936321 - DNA, 21 bp, Homo sapiens
ctttagaaactgagtcctgtt

SEQ ID NO: 1936322 - DNA, 22 bp, Homo sapiens
ctttatattttctatatttgta

SEQ ID NO: 1936323 - DNA, 19 bp, Homo sapiens
ctttcaaaaccttttgaaa

SEQ ID NO: 1936324 - DNA, 13 bp, Homo sapiens
ctttcactgaagt

SEQ ID NO: 1936325 - DNA, 19 bp, Homo sapiens
ctttcactgaagtgaatac

SEQ ID NO: 1936326 - DNA, 17 bp, Homo sapiens
ctttcatgtaaactgtg

SEQ ID NO: 1936327 - DNA, 19 bp, Homo sapiens
ctttcatgtaaactgtgca

SEQ ID NO: 1936328 - DNA, 13 bp, Homo sapiens
ctttccagaacta

SEQ ID NO: 1936329 - DNA, 19 bp, Homo sapiens
ctttccttctgatctgaga

SEQ ID NO: 1936330 - DNA, 21 bp, Homo sapiens
ctttctgacaataaataatat

SEQ ID NO: 1936331 - DNA, 21 bp, Homo sapiens
ctttcttccactaccctccct

SEQ ID NO: 1936332 - DNA, 21 bp, Homo sapiens
ctttgaaaatatttctatgta

SEQ ID NO: 1936333 - DNA, 18 bp, Homo sapiens
ctttgaaatatgcatgta

SEQ ID NO: 1936334 - DNA, 22 bp, Homo sapiens
ctttgaaatatgcatgtacttt

SEQ ID NO: 1936335 - DNA, 20 bp, Homo sapiens
ctttgactataacaaaatct

SEQ ID NO: 1936336 - DNA, 16 bp, Homo sapiens
ctttgagcttaagaat

SEQ ID NO: 1936337 - DNA, 20 bp, Homo sapiens
ctttgattaaagactccagt

SEQ ID NO: 1936338 - DNA, 13 bp, Homo sapiens
ctttgcatgttct

SEQ ID NO: 1936339 - DNA, 18 bp, Homo sapiens
ctttgcatgttcttgttt

SEQ ID NO: 1936340 - DNA, 14 bp, Homo sapiens
ctttgctcccagtt

SEQ ID NO: 1936341 - DNA, 18 bp, Homo sapiens
ctttgctcccagtttctt

SEQ ID NO: 1936342 - DNA, 21 bp, Homo sapiens
ctttggcacaccctctctgtc

SEQ ID NO: 1936343 - DNA, 22 bp, Homo sapiens
ctttgtgagtattctatgtaaa

SEQ ID NO: 1936344 - DNA, 15 bp, Homo sapiens
ctttgtgtgctgtgg

SEQ ID NO: 1936345 - DNA, 19 bp, Homo sapiens
ctttgttttgcacactttg

SEQ ID NO: 1936346 - DNA, 12 bp, Homo sapiens
cttttcactgct

SEQ ID NO: 1936347 - DNA, 17 bp, Homo sapiens
cttttcactgctggctg

SEQ ID NO: 1936348 - DNA, 18 bp, Homo sapiens
cttttcatctcattaatt

SEQ ID NO: 1936349 - DNA, 19 bp, Homo sapiens
cttttctggaatgtaatca

SEQ ID NO: 1936350 - DNA, 12 bp, Homo sapiens
cttttgtaaata

SEQ ID NO: 1936351 - DNA, 17 bp, Homo sapiens
cttttgtaaatattctt

SEQ ID NO: 1936352 - DNA, 18 bp, Homo sapiens
cttttgtaaatattcttg

SEQ ID NO: 1936353 - DNA, 11 bp, Homo sapiens
cttttgttcta

SEQ ID NO: 1936354 - DNA, 12 bp, Homo sapiens
ctttttcaatgg

SEQ ID NO: 1936355 - DNA, 21 bp, Homo sapiens
ctttttcaatggttgggacaa

SEQ ID NO: 1936356 - DNA, 18 bp, Homo sapiens
gaaaaagaaattctgtta

SEQ ID NO: 1936357 - DNA, 12 bp, Homo sapiens
gaaaacaaggaa

SEQ ID NO: 1936358 - DNA, 19 bp, Homo sapiens
gaaaacccgacaacatttc

SEQ ID NO: 1936359 - DNA, 17 bp, Homo sapiens
gaaaacggttaaaactg

SEQ ID NO: 1936360 - DNA, 22 bp, Homo sapiens
gaaaagaactgcttgcatttct

SEQ ID NO: 1936361 - DNA, 12 bp, Homo sapiens
gaaaatatgcat

SEQ ID NO: 1936362 - DNA, 16 bp, Homo sapiens
gaaaatgtttggaatt

SEQ ID NO: 1936363 - DNA, 13 bp, Homo sapiens
gaaaattaatatc

SEQ ID NO: 1936364 - DNA, 14 bp, Homo sapiens
gaaaattaatatca

SEQ ID NO: 1936365 - DNA, 17 bp, Homo sapiens
gaaaatttgttattttg

SEQ ID NO: 1936366 - DNA, 21 bp, Homo sapiens
gaaaatttgttattttgcaac

SEQ ID NO: 1936367 - DNA, 14 bp, Homo sapiens
gaaacaacagaaac

SEQ ID NO: 1936368 - DNA, 16 bp, Homo sapiens
gaaactgagtcctgtt

SEQ ID NO: 1936369 - DNA, 17 bp, Homo sapiens
gaaaggatgcttctgct

SEQ ID NO: 1936370 - DNA, 17 bp, Homo sapiens
gaaagggcagcccctcc

SEQ ID NO: 1936371 - DNA, 23 bp, Homo sapiens
gaaagtatcaccaaaaaatctat

SEQ ID NO: 1936372 - DNA, 21 bp, Homo sapiens
gaaagtgatatcccccagcct

SEQ ID NO: 1936373 - DNA, 23 bp, Homo sapiens
gaaataattttttagttaaaatc

SEQ ID NO: 1936374 - DNA, 19 bp, Homo sapiens
gaaatacctttgcctggat

SEQ ID NO: 1936375 - DNA, 17 bp, Homo sapiens
gaaatatgcacaatagc

SEQ ID NO: 1936376 - DNA, 17 bp, Homo sapiens
gaaatatgcatgtactt

SEQ ID NO: 1936377 - DNA, 18 bp, Homo sapiens
gaaatatgcatgtacttt

SEQ ID NO: 1936378 - DNA, 12 bp, Homo sapiens
gaaatgaatata

SEQ ID NO: 1936379 - DNA, 22 bp, Homo sapiens
gaaatgttattttttaattatt

SEQ ID NO: 1936380 - DNA, 19 bp, Homo sapiens
gaaattgcatttcctgaca

SEQ ID NO: 1936381 - DNA, 13 bp, Homo sapiens
gaaatttgttaat

SEQ ID NO: 1936382 - DNA, 17 bp, Homo sapiens
gaaatttgttaatatat

SEQ ID NO: 1936383 - DNA, 24 bp, Homo sapiens
gaacaaatatgattctcctctccc

SEQ ID NO: 1936384 - DNA, 14 bp, Homo sapiens
gaacaatcactatt

SEQ ID NO: 1936385 - DNA, 17 bp, Homo sapiens
ctgaaagctgcttctgg

SEQ ID NO: 1936386 - DNA, 18 bp, Homo sapiens
ctgaaagtatcaccaaaa

SEQ ID NO: 1936387 - DNA, 14 bp, Homo sapiens
ctgaagcaacactg

SEQ ID NO: 1936388 - DNA, 23 bp, Homo sapiens
ctgaaggcaaatctcctttgtcc

SEQ ID NO: 1936389 - DNA, 21 bp, Homo sapiens
ctgaaggttggaactgctgcc

SEQ ID NO: 1936390 - DNA, 16 bp, Homo sapiens
ctgaagtctctttttc

SEQ ID NO: 1936391 - DNA, 17 bp, Homo sapiens
ctgaagtgaatacatgg

SEQ ID NO: 1936392 - DNA, 21 bp, Homo sapiens
ctgaatatgaacggtgagcat

SEQ ID NO: 1936393 - DNA, 15 bp, Homo sapiens
ctgaatccctttcag

SEQ ID NO: 1936394 - DNA, 14 bp, Homo sapiens
ctgacacaggggac

SEQ ID NO: 1936395 - DNA, 17 bp, Homo sapiens
ctgacactcccttgggc

SEQ ID NO: 1936396 - DNA, 21 bp, Homo sapiens
ctgacatttggagtgttcccc

SEQ ID NO: 1936397 - DNA, 14 bp, Homo sapiens
ctgactcagggctc

SEQ ID NO: 1936398 - DNA, 22 bp, Homo sapiens
ctgactggccccagggactctt

SEQ ID NO: 1936399 - DNA, 16 bp, Homo sapiens
ctgagaaggccccagg

SEQ ID NO: 1936400 - DNA, 21 bp, Homo sapiens
ctgagatgcgcaaagagtgtg

SEQ ID NO: 1936401 - DNA, 21 bp, Homo sapiens
ctgagccaccgcgagggcctg

SEQ ID NO: 1936402 - DNA, 14 bp, Homo sapiens
ctgagccctgccct

SEQ ID NO: 1936403 - DNA, 15 bp, Homo sapiens
ctgagccttgtaatt

SEQ ID NO: 1936404 - DNA, 21 bp, Homo sapiens
ctgagccttgtaattctaaat

SEQ ID NO: 1936405 - DNA, 17 bp, Homo sapiens
ctgagcggccgcctgtc

SEQ ID NO: 1936406 - DNA, 23 bp, Homo sapiens
ctgagctactgcttctaacacct

SEQ ID NO: 1936407 - DNA, 23 bp, Homo sapiens
ctgagctggaaaggatgcttctg

SEQ ID NO: 1936408 - DNA, 15 bp, Homo sapiens
ctgagctgtgcaggt

SEQ ID NO: 1936409 - DNA, 21 bp, Homo sapiens
ctgagcttgattctaaagggg

SEQ ID NO: 1936410 - DNA, 22 bp, Homo sapiens
ctgaggaacccttacagtagga

SEQ ID NO: 1936411 - DNA, 22 bp, Homo sapiens
ctgaggcagcagtgtgaggcca

SEQ ID NO: 1936412 - DNA, 15 bp, Homo sapiens
ctgaggtctggattg

SEQ ID NO: 1936413 - DNA, 20 bp, Homo sapiens
ctgagttgaggggcttccct

SEQ ID NO: 1936414 - DNA, 20 bp, Homo sapiens
ctgatattggtgtgaatgct

SEQ ID NO: 1936415 - DNA, 15 bp, Homo sapiens
ctgatccctctacag

SEQ ID NO: 1936416 - DNA, 20 bp, Homo sapiens
ctgatctgatgcaagcaaga

SEQ ID NO: 1936417 - DNA, 14 bp, Homo sapiens
ctgatgggcactgg

SEQ ID NO: 1936418 - DNA, 16 bp, Homo sapiens
ctgatttgttccttct

SEQ ID NO: 1936419 - DNA, 17 bp, Homo sapiens
ctgcaaaaggactctca

SEQ ID NO: 1936420 - DNA, 18 bp, Homo sapiens
ctgcaaaaggactctcag

SEQ ID NO: 1936421 - DNA, 14 bp, Homo sapiens
ctgcaagctgcagg

SEQ ID NO: 1936422 - DNA, 18 bp, Homo sapiens
ctgcaaggtgcacctgcc

SEQ ID NO: 1936423 - DNA, 21 bp, Homo sapiens
ctgcacagtgcatctcagccc

SEQ ID NO: 1936424 - DNA, 22 bp, Homo sapiens
ctgcacagtgcatctcagccca

SEQ ID NO: 1936425 - DNA, 23 bp, Homo sapiens
ctgcaccctctgctatgtctgtg

SEQ ID NO: 1936426 - DNA, 12 bp, Homo sapiens
ctgcagaccctg

SEQ ID NO: 1936427 - DNA, 23 bp, Homo sapiens
ctgcagggaaaattatttgcata

SEQ ID NO: 1936428 - DNA, 12 bp, Homo sapiens
ctgcagggcagc

SEQ ID NO: 1936429 - DNA, 13 bp, Homo sapiens
ctgcagggcagcc

SEQ ID NO: 1936430 - DNA, 17 bp, Homo sapiens
ctgcagggcagcctgtg

SEQ ID NO: 1936431 - DNA, 16 bp, Homo sapiens
ctgcagtcacccctgt

SEQ ID NO: 1936432 - DNA, 19 bp, Homo sapiens
ctgcagtcacccctgtctg

SEQ ID NO: 1936433 - DNA, 20 bp, Homo sapiens
ctgcagtcacccctgtctgc

SEQ ID NO: 1936434 - DNA, 20 bp, Homo sapiens
ctgcagtcctcggcagctcc

SEQ ID NO: 1936435 - DNA, 18 bp, Homo sapiens
ctgcatcccttggcccct

SEQ ID NO: 1936436 - DNA, 13 bp, Homo sapiens
ctgccagaagtgt

SEQ ID NO: 1936437 - DNA, 17 bp, Homo sapiens
ctgccagctctgtatca

SEQ ID NO: 1936438 - DNA, 11 bp, Homo sapiens
ctgccagggca

SEQ ID NO: 1936439 - DNA, 13 bp, Homo sapiens
ctgccagggcagg

SEQ ID NO: 1936440 - DNA, 19 bp, Homo sapiens
ctgccatgattttggccac

SEQ ID NO: 1936441 - DNA, 17 bp, Homo sapiens
ctgccatggaggcacac

SEQ ID NO: 1936442 - DNA, 15 bp, Homo sapiens
ctgcccacctgccag

SEQ ID NO: 1936443 - DNA, 22 bp, Homo sapiens
ctgccccaggctcaggctgccc

SEQ ID NO: 1936444 - DNA, 14 bp, Homo sapiens
ctgcccctcccttc

SEQ ID NO: 1936445 - DNA, 16 bp, Homo sapiens
ctgccctcactccact

SEQ ID NO: 1936446 - DNA, 19 bp, Homo sapiens
ctgccctcactccactccc

SEQ ID NO: 1936447 - DNA, 15 bp, Homo sapiens
ctgccctggtgctgc

SEQ ID NO: 1936448 - DNA, 23 bp, Homo sapiens
ctgccctggtgctgccacacttc

SEQ ID NO: 1936449 - DNA, 19 bp, Homo sapiens
ctgccgctgctctcccagg

SEQ ID NO: 1936450 - DNA, 17 bp, Homo sapiens
ctgcctctctcatggct

SEQ ID NO: 1936451 - DNA, 23 bp, Homo sapiens
ctgcctctctcatggcttgggct

SEQ ID NO: 1936452 - DNA, 19 bp, Homo sapiens
ctgcctgaacactgcttct

SEQ ID NO: 1936453 - DNA, 20 bp, Homo sapiens
ctgcctgacatttggagtgt

SEQ ID NO: 1936454 - DNA, 16 bp, Homo sapiens
ctgcgacaccaccaac

SEQ ID NO: 1936455 - DNA, 14 bp, Homo sapiens
ctgcgccctccctc

SEQ ID NO: 1936456 - DNA, 20 bp, Homo sapiens
ctgcgccctccctccctcca

SEQ ID NO: 1936457 - DNA, 23 bp, Homo sapiens
ctgcgccctccctccctccacac

SEQ ID NO: 1936458 - DNA, 15 bp, Homo sapiens
ctgcgccgctgtgct

SEQ ID NO: 1936459 - DNA, 15 bp, Homo sapiens
ctgctatgtctgtga

SEQ ID NO: 1936460 - DNA, 13 bp, Homo sapiens
ctgctcacattcc

SEQ ID NO: 1936461 - DNA, 19 bp, Homo sapiens
ctgctcacattccctctca

SEQ ID NO: 1936462 - DNA, 16 bp, Homo sapiens
ctgctcatcattctct

SEQ ID NO: 1936463 - DNA, 17 bp, Homo sapiens
ctgctcatcattctctg

SEQ ID NO: 1936464 - DNA, 18 bp, Homo sapiens
ctgctcatcattctctgt

SEQ ID NO: 1936465 - DNA, 22 bp, Homo sapiens
ctgctcatcattctctgtctca

SEQ ID NO: 1936466 - DNA, 20 bp, Homo sapiens
ctgctccacagaaaccctgt

SEQ ID NO: 1936467 - DNA, 13 bp, Homo sapiens
ctgctcctcgcag

SEQ ID NO: 1936468 - DNA, 14 bp, Homo sapiens
ctgctcctcgcagt

SEQ ID NO: 1936469 - DNA, 21 bp, Homo sapiens
ctgctctgcgtgtcacctgtg

SEQ ID NO: 1936470 - DNA, 15 bp, Homo sapiens
ctgctggctgcctta

SEQ ID NO: 1936471 - DNA, 20 bp, Homo sapiens
ctgctgtaataatattttag

SEQ ID NO: 1936472 - DNA, 12 bp, Homo sapiens
ctgcttgcattt

SEQ ID NO: 1936473 - DNA, 13 bp, Homo sapiens
ctgctttggaaat

SEQ ID NO: 1936474 - DNA, 17 bp, Homo sapiens
ctgctttgggctgccct

SEQ ID NO: 1936475 - DNA, 19 bp, Homo sapiens
ctgctttgggctgccctgg

SEQ ID NO: 1936476 - DNA, 23 bp, Homo sapiens
ctgctttgggctgccctggtgct

SEQ ID NO: 1936477 - DNA, 23 bp, Homo sapiens
ctggactctcagtctctgagcag

SEQ ID NO: 1936478 - DNA, 17 bp, Homo sapiens
ctggacttttgcagctt

SEQ ID NO: 1936479 - DNA, 18 bp, Homo sapiens
ctggacttttgcagcttc

SEQ ID NO: 1936480 - DNA, 19 bp, Homo sapiens
ctggacttttgcagcttcc

SEQ ID NO: 1936481 - DNA, 19 bp, Homo sapiens
ctggagaggaaaagccagt

SEQ ID NO: 1936482 - DNA, 19 bp, Homo sapiens
ctggagcatgagctctgtg

SEQ ID NO: 1936483 - DNA, 22 bp, Homo sapiens
ctggagtgggctctctggacct

SEQ ID NO: 1936484 - DNA, 20 bp, Homo sapiens
ctggatccctttcactatgt

SEQ ID NO: 1936485 - DNA, 13 bp, Homo sapiens
ctggcagccgtgc

SEQ ID NO: 1936486 - DNA, 14 bp, Homo sapiens
ctggccaaatatgc

SEQ ID NO: 1936487 - DNA, 17 bp, Homo sapiens
ctggccaaatatgcact

SEQ ID NO: 1936488 - DNA, 13 bp, Homo sapiens
ctggccccagctc

SEQ ID NO: 1936489 - DNA, 22 bp, Homo sapiens
ctggccccagctcctcttcctg

SEQ ID NO: 1936490 - DNA, 14 bp, Homo sapiens
ctggccctgttgtg

SEQ ID NO: 1936491 - DNA, 19 bp, Homo sapiens
ctggccggcccacgtcctg

SEQ ID NO: 1936492 - DNA, 20 bp, Homo sapiens
ctggccggcccacgtcctgg

SEQ ID NO: 1936493 - DNA, 22 bp, Homo sapiens
ctggcctagtggggaggggcct

SEQ ID NO: 1936494 - DNA, 12 bp, Homo sapiens
ctggcctcttcc

SEQ ID NO: 1936495 - DNA, 22 bp, Homo sapiens
ctggcctcttcctccctccctg

SEQ ID NO: 1936496 - DNA, 17 bp, Homo sapiens
ctggccttggttcctcc

SEQ ID NO: 1936497 - DNA, 21 bp, Homo sapiens
ctggccttggttcctccagca

SEQ ID NO: 1936498 - DNA, 15 bp, Homo sapiens
ctggctcccacaggc

SEQ ID NO: 1936499 - DNA, 18 bp, Homo sapiens
gaacaatcactattctta

SEQ ID NO: 1936500 - DNA, 17 bp, Homo sapiens
gaacaggagtgactctg

SEQ ID NO: 1936501 - DNA, 20 bp, Homo sapiens
gaacaggagtgactctggct

SEQ ID NO: 1936502 - DNA, 22 bp, Homo sapiens
gaacattattaaatcagaatct

SEQ ID NO: 1936503 - DNA, 21 bp, Homo sapiens
gaaccaacgggtctgtgggac

SEQ ID NO: 1936504 - DNA, 23 bp, Homo sapiens
gaaccagctctttggtgccagct

SEQ ID NO: 1936505 - DNA, 18 bp, Homo sapiens
gaaccaggaggcctggga

SEQ ID NO: 1936506 - DNA, 13 bp, Homo sapiens
gaacccccctccc

SEQ ID NO: 1936507 - DNA, 16 bp, Homo sapiens
gaacgctcagcgctgg

SEQ ID NO: 1936508 - DNA, 19 bp, Homo sapiens
gaactaccttggttccccc

SEQ ID NO: 1936509 - DNA, 20 bp, Homo sapiens
gaactaccttggttccccca

SEQ ID NO: 1936510 - DNA, 15 bp, Homo sapiens
gaactcaactttgac

SEQ ID NO: 1936511 - DNA, 13 bp, Homo sapiens
gaactcttaatca

SEQ ID NO: 1936512 - DNA, 12 bp, Homo sapiens
gaactgctgcca

SEQ ID NO: 1936513 - DNA, 19 bp, Homo sapiens
gaactgcttgcatttcttt

SEQ ID NO: 1936514 - DNA, 15 bp, Homo sapiens
gaactggccccagct

SEQ ID NO: 1936515 - DNA, 22 bp, Homo sapiens
gaacttgctgctgagtgcacca

SEQ ID NO: 1936516 - DNA, 15 bp, Homo sapiens
gaagaaactcctgga

SEQ ID NO: 1936517 - DNA, 15 bp, Homo sapiens
gaagaaagtggaaaa

SEQ ID NO: 1936518 - DNA, 10 bp, Homo sapiens
gaagaacatc

SEQ ID NO: 1936519 - DNA, 14 bp, Homo sapiens
gaagaacatcaaga

SEQ ID NO: 1936520 - DNA, 14 bp, Homo sapiens
gaagaagctcctga

SEQ ID NO: 1936521 - DNA, 13 bp, Homo sapiens
gaagaatggccat

SEQ ID NO: 1936522 - DNA, 12 bp, Homo sapiens
gaagagggagaa

SEQ ID NO: 1936523 - DNA, 13 bp, Homo sapiens
gaagagggagaag

SEQ ID NO: 1936524 - DNA, 14 bp, Homo sapiens
gaagagggagaagg

SEQ ID NO: 1936525 - DNA, 23 bp, Homo sapiens
gaagagtaagtcaacctgcctga

SEQ ID NO: 1936526 - DNA, 20 bp, Homo sapiens
gaagcacaagaagtgggagt

SEQ ID NO: 1936527 - DNA, 17 bp, Homo sapiens
gaagccacgtgctggag

SEQ ID NO: 1936528 - DNA, 19 bp, Homo sapiens
gaagccacgtgctggagag

SEQ ID NO: 1936529 - DNA, 14 bp, Homo sapiens
gaagcccaggagga

SEQ ID NO: 1936530 - DNA, 20 bp, Homo sapiens
gaagcccaggaggacctggg

SEQ ID NO: 1936531 - DNA, 16 bp, Homo sapiens
gaagcttgatttgctt

SEQ ID NO: 1936532 - DNA, 23 bp, Homo sapiens
gaaggacccggaggggcctggca

SEQ ID NO: 1936533 - DNA, 18 bp, Homo sapiens
gaaggagacagagctggt

SEQ ID NO: 1936534 - DNA, 13 bp, Homo sapiens
gaaggagaggagt

SEQ ID NO: 1936535 - DNA, 16 bp, Homo sapiens
gaaggagaggagtgcg

SEQ ID NO: 1936536 - DNA, 12 bp, Homo sapiens
gaaggagaggct

SEQ ID NO: 1936537 - DNA, 13 bp, Homo sapiens
gaaggagaggctc

SEQ ID NO: 1936538 - DNA, 21 bp, Homo sapiens
gaaggagccccattcctggga

SEQ ID NO: 1936539 - DNA, 22 bp, Homo sapiens
gaaggagccccattcctgggaa

SEQ ID NO: 1936540 - DNA, 15 bp, Homo sapiens
gaaggaggaggagga

SEQ ID NO: 1936541 - DNA, 14 bp, Homo sapiens
gaaggcaaatctcc

SEQ ID NO: 1936542 - DNA, 15 bp, Homo sapiens
gaaggcaagctggca

SEQ ID NO: 1936543 - DNA, 11 bp, Homo sapiens
gaaggccccag

SEQ ID NO: 1936544 - DNA, 13 bp, Homo sapiens
gaaggccccaggg

SEQ ID NO: 1936545 - DNA, 18 bp, Homo sapiens
gaaggcctgccccccttc

SEQ ID NO: 1936546 - DNA, 15 bp, Homo sapiens
gaagggcccccggct

SEQ ID NO: 1936547 - DNA, 17 bp, Homo sapiens
gaaggggccagaggctc

SEQ ID NO: 1936548 - DNA, 16 bp, Homo sapiens
gaagtatctgtacctg

SEQ ID NO: 1936549 - DNA, 15 bp, Homo sapiens
gaagtcactgcacag

SEQ ID NO: 1936550 - DNA, 18 bp, Homo sapiens
gaagtcataccaatgaaa

SEQ ID NO: 1936551 - DNA, 15 bp, Homo sapiens
gaagtcccaccaggg

SEQ ID NO: 1936552 - DNA, 23 bp, Homo sapiens
gaagtcttccatcagcagtgatt

SEQ ID NO: 1936553 - DNA, 16 bp, Homo sapiens
gaagtgggagtgggag

SEQ ID NO: 1936554 - DNA, 19 bp, Homo sapiens
gaagtgggattcaggaatg

SEQ ID NO: 1936555 - DNA, 20 bp, Homo sapiens
gaagtgggattcaggaatgg

SEQ ID NO: 1936556 - DNA, 13 bp, Homo sapiens
gaagtgtgttttg

SEQ ID NO: 1936557 - DNA, 19 bp, Homo sapiens
gaatacatggtagcagggt

SEQ ID NO: 1936558 - DNA, 19 bp, Homo sapiens
gaatacttaatatgtggga

SEQ ID NO: 1936559 - DNA, 14 bp, Homo sapiens
gaatataaatatca

SEQ ID NO: 1936560 - DNA, 22 bp, Homo sapiens
gaatcccatggatgtttcttct

SEQ ID NO: 1936561 - DNA, 20 bp, Homo sapiens
gaatccctttcagtttgtcc

SEQ ID NO: 1936562 - DNA, 15 bp, Homo sapiens
gaatcggtgctgtca

SEQ ID NO: 1936563 - DNA, 17 bp, Homo sapiens
gaatgaaggtgtcagaa

SEQ ID NO: 1936564 - DNA, 12 bp, Homo sapiens
gaatgagagagt

SEQ ID NO: 1936565 - DNA, 15 bp, Homo sapiens
gaatgagctgggccc

SEQ ID NO: 1936566 - DNA, 15 bp, Homo sapiens
gaatgattcagtgtt

SEQ ID NO: 1936567 - DNA, 21 bp, Homo sapiens
gaatgcttctgacttcataga

SEQ ID NO: 1936568 - DNA, 14 bp, Homo sapiens
gaatggctctggct

SEQ ID NO: 1936569 - DNA, 23 bp, Homo sapiens
gaatgggccaagccagggttcca

SEQ ID NO: 1936570 - DNA, 18 bp, Homo sapiens
gaatggtaaccgagccag

SEQ ID NO: 1936571 - DNA, 15 bp, Homo sapiens
gaatggtgggctcca

SEQ ID NO: 1936572 - DNA, 18 bp, Homo sapiens
gaatggtgggctccagag

SEQ ID NO: 1936573 - DNA, 19 bp, Homo sapiens
gaatggtgggctccagagt

SEQ ID NO: 1936574 - DNA, 13 bp, Homo sapiens
gaatgtaatcaat

SEQ ID NO: 1936575 - DNA, 18 bp, Homo sapiens
gaatgtaatcaatgtttc

SEQ ID NO: 1936576 - DNA, 15 bp, Homo sapiens
gaattaaaataaaac

SEQ ID NO: 1936577 - DNA, 15 bp, Homo sapiens
gaattacaatttctt

SEQ ID NO: 1936578 - DNA, 20 bp, Homo sapiens
gaattacagggaagaaatca

SEQ ID NO: 1936579 - DNA, 19 bp, Homo sapiens
gaattcttggttgaggaaa

SEQ ID NO: 1936580 - DNA, 16 bp, Homo sapiens
gaatttaataatctgt

SEQ ID NO: 1936581 - DNA, 16 bp, Homo sapiens
gaatttctagacagta

SEQ ID NO: 1936582 - DNA, 20 bp, Homo sapiens
gaatttctagacagtattgc

SEQ ID NO: 1936583 - DNA, 19 bp, Homo sapiens
gacaaggtgtttctctgta

SEQ ID NO: 1936584 - DNA, 18 bp, Homo sapiens
gacacaaataccagagca

SEQ ID NO: 1936585 - DNA, 16 bp, Homo sapiens
gacaccaccaacaggc

SEQ ID NO: 1936586 - DNA, 18 bp, Homo sapiens
gacacgcccgactctctc

SEQ ID NO: 1936587 - DNA, 18 bp, Homo sapiens
gacagaaccaacgggtct

SEQ ID NO: 1936588 - DNA, 12 bp, Homo sapiens
gacagagtggat

SEQ ID NO: 1936589 - DNA, 13 bp, Homo sapiens
gacagagtggatc

SEQ ID NO: 1936590 - DNA, 17 bp, Homo sapiens
gacagagtggatctgga

SEQ ID NO: 1936591 - DNA, 19 bp, Homo sapiens
gacagatctctgctttgga

SEQ ID NO: 1936592 - DNA, 23 bp, Homo sapiens
gacagatctctgctttggaaatc

SEQ ID NO: 1936593 - DNA, 13 bp, Homo sapiens
gacagatcttgag

SEQ ID NO: 1936594 - DNA, 18 bp, Homo sapiens
gacagatcttgagcaagg

SEQ ID NO: 1936595 - DNA, 23 bp, Homo sapiens
gacagatgttccatcctgtacaa

SEQ ID NO: 1936596 - DNA, 19 bp, Homo sapiens
gacagcctggcacagggca

SEQ ID NO: 1936597 - DNA, 22 bp, Homo sapiens
gacagcgggtaaaaagagaagg

SEQ ID NO: 1936598 - DNA, 18 bp, Homo sapiens
gacagctgcttctgtgca

SEQ ID NO: 1936599 - DNA, 14 bp, Homo sapiens
gacagggcatggcc

SEQ ID NO: 1936600 - DNA, 20 bp, Homo sapiens
gacagggcatggccaggtgg

SEQ ID NO: 1936601 - DNA, 17 bp, Homo sapiens
gacagttgggtgtgaga

SEQ ID NO: 1936602 - DNA, 19 bp, Homo sapiens
gacatcaagcacagaagga

SEQ ID NO: 1936603 - DNA, 15 bp, Homo sapiens
gacatccaagcttcc

SEQ ID NO: 1936604 - DNA, 19 bp, Homo sapiens
gacatgaacgttttctctt

SEQ ID NO: 1936605 - DNA, 14 bp, Homo sapiens
gacatgaatatgat

SEQ ID NO: 1936606 - DNA, 21 bp, Homo sapiens
gacatgcgggctgggcagctg

SEQ ID NO: 1936607 - DNA, 16 bp, Homo sapiens
gacatggggaggaagg

SEQ ID NO: 1936608 - DNA, 23 bp, Homo sapiens
gaccacgtctccctggccccagt

SEQ ID NO: 1936609 - DNA, 23 bp, Homo sapiens
gaccaggcatcctccacaatagc

SEQ ID NO: 1936610 - DNA, 17 bp, Homo sapiens
gaccagtcaacctgggc

SEQ ID NO: 1936611 - DNA, 18 bp, Homo sapiens
gaccccaccctgtctgca

SEQ ID NO: 1936612 - DNA, 22 bp, Homo sapiens
gacccctggcttttcactgctg

SEQ ID NO: 1936613 - DNA, 12 bp, Homo sapiens
gaccctcccagg

SEQ ID NO: 1936614 - DNA, 22 bp, Homo sapiens
gagtgatatggcttgtagggtg

SEQ ID NO: 1936615 - DNA, 18 bp, Homo sapiens
gagtgcagtcctgatcag

SEQ ID NO: 1936616 - DNA, 22 bp, Homo sapiens
gagtgcagtcctgatcagagcc

SEQ ID NO: 1936617 - DNA, 18 bp, Homo sapiens
gagtgccacgtggccgct

SEQ ID NO: 1936618 - DNA, 10 bp, Homo sapiens
gagtgccatc

SEQ ID NO: 1936619 - DNA, 16 bp, Homo sapiens
gagtgccatccctgag

SEQ ID NO: 1936620 - DNA, 19 bp, Homo sapiens
gagtggaggggtcagcagg

SEQ ID NO: 1936621 - DNA, 13 bp, Homo sapiens
gagtggctcccgt

SEQ ID NO: 1936622 - DNA, 13 bp, Homo sapiens
gagtggctcctcc

SEQ ID NO: 1936623 - DNA, 15 bp, Homo sapiens
gagtggctcctcccg

SEQ ID NO: 1936624 - DNA, 14 bp, Homo sapiens
gagtgggagaggaa

SEQ ID NO: 1936625 - DNA, 23 bp, Homo sapiens
gagtgggctctctggacctgacc

SEQ ID NO: 1936626 - DNA, 22 bp, Homo sapiens
gagtgtgacgggggttggggtg

SEQ ID NO: 1936627 - DNA, 21 bp, Homo sapiens
gagtgtgtgggggtctgggag

SEQ ID NO: 1936628 - DNA, 22 bp, Homo sapiens
gagtgtgtgggggtctgggagg

SEQ ID NO: 1936629 - DNA, 21 bp, Homo sapiens
gagtgttcaaactactgtaca

SEQ ID NO: 1936630 - DNA, 19 bp, Homo sapiens
gagtgttcccaatgctttg

SEQ ID NO: 1936631 - DNA, 21 bp, Homo sapiens
gagttgaggggcttccctctg

SEQ ID NO: 1936632 - DNA, 22 bp, Homo sapiens
gagttgaggggcttccctctgc

SEQ ID NO: 1936633 - DNA, 14 bp, Homo sapiens
gataatatttaaaa

SEQ ID NO: 1936634 - DNA, 14 bp, Homo sapiens
gataattataatat

SEQ ID NO: 1936635 - DNA, 18 bp, Homo sapiens
gataattctagctttgag

SEQ ID NO: 1936636 - DNA, 23 bp, Homo sapiens
gatactattaaagtaacatttaa

SEQ ID NO: 1936637 - DNA, 16 bp, Homo sapiens
gataggagcttccaga

SEQ ID NO: 1936638 - DNA, 22 bp, Homo sapiens
gatatgtattacttttctgcaa

SEQ ID NO: 1936639 - DNA, 23 bp, Homo sapiens
gatattttcaacgcagccctgct

SEQ ID NO: 1936640 - DNA, 16 bp, Homo sapiens
gatcagagccgtggtc

SEQ ID NO: 1936641 - DNA, 23 bp, Homo sapiens
gatcagagccgtggtcctttggg

SEQ ID NO: 1936642 - DNA, 19 bp, Homo sapiens
gatctaaaaggaggacagg

SEQ ID NO: 1936643 - DNA, 13 bp, Homo sapiens
gcagcttgacgcg

SEQ ID NO: 1936644 - DNA, 23 bp, Homo sapiens
gcaggaaatgaaaatgtcttgtg

SEQ ID NO: 1936645 - DNA, 18 bp, Homo sapiens
gcaggaagcaacgaaggg

SEQ ID NO: 1936646 - DNA, 14 bp, Homo sapiens
gcaggacactgcag

SEQ ID NO: 1936647 - DNA, 13 bp, Homo sapiens
gcaggacgactgt

SEQ ID NO: 1936648 - DNA, 16 bp, Homo sapiens
gcaggagggtggcact

SEQ ID NO: 1936649 - DNA, 20 bp, Homo sapiens
gcaggcaagacaccttccca

SEQ ID NO: 1936650 - DNA, 21 bp, Homo sapiens
gcaggcaagacaccttcccag

SEQ ID NO: 1936651 - DNA, 15 bp, Homo sapiens
gcagggacagttggg

SEQ ID NO: 1936652 - DNA, 16 bp, Homo sapiens
gcagggcagcctgtgg

SEQ ID NO: 1936653 - DNA, 17 bp, Homo sapiens
gcagggcctggcctggt

SEQ ID NO: 1936654 - DNA, 20 bp, Homo sapiens
gcagggctaccctgagctga

SEQ ID NO: 1936655 - DNA, 16 bp, Homo sapiens
gcagggctgggcgcct

SEQ ID NO: 1936656 - DNA, 20 bp, Homo sapiens
gcaggggcccctcctccaga

SEQ ID NO: 1936657 - DNA, 22 bp, Homo sapiens
gcaggggggttgggttccagac

SEQ ID NO: 1936658 - DNA, 23 bp, Homo sapiens
gcaggggggttgggttccagaca

SEQ ID NO: 1936659 - DNA, 18 bp, Homo sapiens
gcagggtctttgtgtgct

SEQ ID NO: 1936660 - DNA, 22 bp, Homo sapiens
gcaggtggggttttcacttcct

SEQ ID NO: 1936661 - DNA, 20 bp, Homo sapiens
gcagtcacactgctgggaag

SEQ ID NO: 1936662 - DNA, 18 bp, Homo sapiens
gcagtcctcggcagctcc

SEQ ID NO: 1936663 - DNA, 16 bp, Homo sapiens
gcagtggactgtgtcc

SEQ ID NO: 1936664 - DNA, 14 bp, Homo sapiens
gcagtggagagggg

SEQ ID NO: 1936665 - DNA, 14 bp, Homo sapiens
gcagtggcagcaac

SEQ ID NO: 1936666 - DNA, 15 bp, Homo sapiens
gcagtgtgaggccag

SEQ ID NO: 1936667 - DNA, 14 bp, Homo sapiens
gcagttaacatctg

SEQ ID NO: 1936668 - DNA, 20 bp, Homo sapiens
gcagttaacatctgaagtgt

SEQ ID NO: 1936669 - DNA, 23 bp, Homo sapiens
gcatacccagtgtctaccttcat

SEQ ID NO: 1936670 - DNA, 13 bp, Homo sapiens
gcatcccttggcc

SEQ ID NO: 1936671 - DNA, 18 bp, Homo sapiens
gcatcccttggcccctct

SEQ ID NO: 1936672 - DNA, 13 bp, Homo sapiens
gcatctcccagat

SEQ ID NO: 1936673 - DNA, 19 bp, Homo sapiens
gcatgaaactatgcaccta

SEQ ID NO: 1936674 - DNA, 17 bp, Homo sapiens
gcatgcactgttccccc

SEQ ID NO: 1936675 - DNA, 17 bp, Homo sapiens
gcatgcgaatgagctgg

SEQ ID NO: 1936676 - DNA, 19 bp, Homo sapiens
gcatgcgaatgagctgggc

SEQ ID NO: 1936677 - DNA, 21 bp, Homo sapiens
gcatgctcttacccacactac

SEQ ID NO: 1936678 - DNA, 13 bp, Homo sapiens
gcatggccaggtg

SEQ ID NO: 1936679 - DNA, 14 bp, Homo sapiens
gcatggcccagcct

SEQ ID NO: 1936680 - DNA, 23 bp, Homo sapiens
gcatgtactttatattttctata

SEQ ID NO: 1936681 - DNA, 14 bp, Homo sapiens
gcattaacttttgt

SEQ ID NO: 1936682 - DNA, 13 bp, Homo sapiens
gcattcctttctt

SEQ ID NO: 1936683 - DNA, 19 bp, Homo sapiens
gcatttctttatttctgtc

SEQ ID NO: 1936684 - DNA, 17 bp, Homo sapiens
gccaaacctttcctgta

SEQ ID NO: 1936685 - DNA, 19 bp, Homo sapiens
gccaaggcctatgccacct

SEQ ID NO: 1936686 - DNA, 22 bp, Homo sapiens
gccaaggcctatgccacctgca

SEQ ID NO: 1936687 - DNA, 16 bp, Homo sapiens
gccaagggctttgttt

SEQ ID NO: 1936688 - DNA, 16 bp, Homo sapiens
gccaatggagactgtc

SEQ ID NO: 1936689 - DNA, 13 bp, Homo sapiens
gccaattcctata

SEQ ID NO: 1936690 - DNA, 14 bp, Homo sapiens
gccacactggccgg

SEQ ID NO: 1936691 - DNA, 21 bp, Homo sapiens
gccacactggccggcccacgt

SEQ ID NO: 1936692 - DNA, 20 bp, Homo sapiens
gccacacttcaggctcttct

SEQ ID NO: 1936693 - DNA, 16 bp, Homo sapiens
gccacagcctcccctg

SEQ ID NO: 1936694 - DNA, 12 bp, Homo sapiens
gccacaggctgc

SEQ ID NO: 1936695 - DNA, 18 bp, Homo sapiens
gccacatggccgctgccc

SEQ ID NO: 1936696 - DNA, 19 bp, Homo sapiens
gccacatggccgctgccca

SEQ ID NO: 1936697 - DNA, 22 bp, Homo sapiens
gccacatggccgctgcccacgt

SEQ ID NO: 1936698 - DNA, 14 bp, Homo sapiens
gccaccaagaggga

SEQ ID NO: 1936699 - DNA, 20 bp, Homo sapiens
gccaccctctgcagggcagc

SEQ ID NO: 1936700 - DNA, 17 bp, Homo sapiens
gccacctccccaggccg

SEQ ID NO: 1936701 - DNA, 22 bp, Homo sapiens
gccacctctggccaaatatgca

SEQ ID NO: 1936702 - DNA, 14 bp, Homo sapiens
gccacggcagccta

SEQ ID NO: 1936703 - DNA, 11 bp, Homo sapiens
gccacggggga

SEQ ID NO: 1936704 - DNA, 21 bp, Homo sapiens
gccacgggggaggccgaggca

SEQ ID NO: 1936705 - DNA, 22 bp, Homo sapiens
gccacgggggaggccgaggcag

SEQ ID NO: 1936706 - DNA, 16 bp, Homo sapiens
gccactccagacccct

SEQ ID NO: 1936707 - DNA, 18 bp, Homo sapiens
gccactccagacccctgg

SEQ ID NO: 1936708 - DNA, 21 bp, Homo sapiens
gccactccagacccctggctt

SEQ ID NO: 1936709 - DNA, 12 bp, Homo sapiens
gccactgcagtc

SEQ ID NO: 1936710 - DNA, 24 bp, Homo sapiens
gccactgcagtcacccctgtctgc

SEQ ID NO: 1936711 - DNA, 16 bp, Homo sapiens
gccactggcatctctg

SEQ ID NO: 1936712 - DNA, 18 bp, Homo sapiens
gccactttgcagacctgg

SEQ ID NO: 1936713 - DNA, 21 bp, Homo sapiens
gccagcagctgaagtctcttt

SEQ ID NO: 1936714 - DNA, 22 bp, Homo sapiens
gccagcgtcctcctctgtgacc

SEQ ID NO: 1936715 - DNA, 13 bp, Homo sapiens
gccagctctgtat

SEQ ID NO: 1936716 - DNA, 22 bp, Homo sapiens
gccaggaccagtcaacctgggc

SEQ ID NO: 1936717 - DNA, 21 bp, Homo sapiens
gccaggagcctcctgaccctg

SEQ ID NO: 1936718 - DNA, 21 bp, Homo sapiens
gccaggcatggcccagcctgg

SEQ ID NO: 1936719 - DNA, 13 bp, Homo sapiens
gccaggccctctc

SEQ ID NO: 1936720 - DNA, 16 bp, Homo sapiens
gccaggccctctctgc

SEQ ID NO: 1936721 - DNA, 19 bp, Homo sapiens
gccaggccctctctgcagt

SEQ ID NO: 1936722 - DNA, 15 bp, Homo sapiens
gccagggcagagtga

SEQ ID NO: 1936723 - DNA, 16 bp, Homo sapiens
gccagggcagagtgag

SEQ ID NO: 1936724 - DNA, 21 bp, Homo sapiens
gccagggcagagtgagaccca

SEQ ID NO: 1936725 - DNA, 16 bp, Homo sapiens
gccagggttccagaca

SEQ ID NO: 1936726 - DNA, 18 bp, Homo sapiens
gccaggtggccactccag

SEQ ID NO: 1936727 - DNA, 19 bp, Homo sapiens
gccagtaaggcagctctgt

SEQ ID NO: 1936728 - DNA, 20 bp, Homo sapiens
gccagtaaggcagctctgtc

SEQ ID NO: 1936729 - DNA, 17 bp, Homo sapiens
gccatctgtaaatatcc

SEQ ID NO: 1936730 - DNA, 17 bp, Homo sapiens
gccatgattttggccac

SEQ ID NO: 1936731 - DNA, 21 bp, Homo sapiens
gccatgattttggccactttg

SEQ ID NO: 1936732 - DNA, 18 bp, Homo sapiens
gccatggaggcacacagc

SEQ ID NO: 1936733 - DNA, 16 bp, Homo sapiens
gccatttcttcccaag

SEQ ID NO: 1936734 - DNA, 18 bp, Homo sapiens
gccattttgtctggctgt

SEQ ID NO: 1936735 - DNA, 20 bp, Homo sapiens
gccattttgtctggctgtgg

SEQ ID NO: 1936736 - DNA, 22 bp, Homo sapiens
gcccaagaatagatgctgactg

SEQ ID NO: 1936737 - DNA, 13 bp, Homo sapiens
gcccacacacccc

SEQ ID NO: 1936738 - DNA, 19 bp, Homo sapiens
gcccacccctcttccccct

SEQ ID NO: 1936739 - DNA, 17 bp, Homo sapiens
gcccacctgccaggctg

SEQ ID NO: 1936740 - DNA, 23 bp, Homo sapiens
gcccacctgccaggctgcaggga

SEQ ID NO: 1936741 - DNA, 22 bp, Homo sapiens
gcccacgtcctgggtgctgtca

SEQ ID NO: 1936742 - DNA, 14 bp, Homo sapiens
gcccactctgaccg

SEQ ID NO: 1936743 - DNA, 16 bp, Homo sapiens
gcccagcctggagccg

SEQ ID NO: 1936744 - DNA, 13 bp, Homo sapiens
gcccagcggctct

SEQ ID NO: 1936745 - DNA, 17 bp, Homo sapiens
gcccagcttggagtgcc

SEQ ID NO: 1936746 - DNA, 23 bp, Homo sapiens
gcccagtcatgacatttctcaaa

SEQ ID NO: 1936747 - DNA, 18 bp, Homo sapiens
gcccagtcttgagtgggc

SEQ ID NO: 1936748 - DNA, 23 bp, Homo sapiens
gcccagtcttgagtgggccccct

SEQ ID NO: 1936749 - DNA, 17 bp, Homo sapiens
gcccatcaattatagaa

SEQ ID NO: 1936750 - DNA, 21 bp, Homo sapiens
gccccagatgcctcctctgtc

SEQ ID NO: 1936751 - DNA, 17 bp, Homo sapiens
gccccaggctcaggctg

SEQ ID NO: 1936752 - DNA, 16 bp, Homo sapiens
gccccatcagcagctt

SEQ ID NO: 1936753 - DNA, 14 bp, Homo sapiens
gccccatcagtgct

SEQ ID NO: 1936754 - DNA, 12 bp, Homo sapiens
gccccattcctg

SEQ ID NO: 1936755 - DNA, 15 bp, Homo sapiens
gcccccactcagcat

SEQ ID NO: 1936756 - DNA, 11 bp, Homo sapiens
gccccctctct

SEQ ID NO: 1936757 - DNA, 13 bp, Homo sapiens
gccccctgtcctt

SEQ ID NO: 1936758 - DNA, 15 bp, Homo sapiens
gcccctatcctgcac

SEQ ID NO: 1936759 - DNA, 16 bp, Homo sapiens
gcccctatcctgcacc

SEQ ID NO: 1936760 - DNA, 19 bp, Homo sapiens
gcccctatcctgcaccctc

SEQ ID NO: 1936761 - DNA, 22 bp, Homo sapiens
gcccctatcctgcaccctctgc

SEQ ID NO: 1936762 - DNA, 13 bp, Homo sapiens
gcccctccccatg

SEQ ID NO: 1936763 - DNA, 17 bp, Homo sapiens
gcccctccccatggtgc

SEQ ID NO: 1936764 - DNA, 17 bp, Homo sapiens
gcccctccctcctgtgt

SEQ ID NO: 1936765 - DNA, 18 bp, Homo sapiens
gcccctcctccagagcct

SEQ ID NO: 1936766 - DNA, 21 bp, Homo sapiens
gcctcttcctccctccctgca

SEQ ID NO: 1936767 - DNA, 18 bp, Homo sapiens
gcctcttctgggagggca

SEQ ID NO: 1936768 - DNA, 16 bp, Homo sapiens
gcctcttgggagacgt

SEQ ID NO: 1936769 - DNA, 20 bp, Homo sapiens
gcctgacacaggggacactg

SEQ ID NO: 1936770 - DNA, 13 bp, Homo sapiens
gcctgagaagagt

SEQ ID NO: 1936771 - DNA, 10 bp, Homo sapiens
gcctgaggga

SEQ ID NO: 1936772 - DNA, 16 bp, Homo sapiens
gcctgatttgttcctt

SEQ ID NO: 1936773 - DNA, 19 bp, Homo sapiens
gcctgcagaccctgccagg

SEQ ID NO: 1936774 - DNA, 20 bp, Homo sapiens
gcctgcagaccctgccaggg

SEQ ID NO: 1936775 - DNA, 12 bp, Homo sapiens
gcctgcccccct

SEQ ID NO: 1936776 - DNA, 14 bp, Homo sapiens
gcctgccccccttc

SEQ ID NO: 1936777 - DNA, 21 bp, Homo sapiens
gcctgccccccttcccacccc

SEQ ID NO: 1936778 - DNA, 18 bp, Homo sapiens
gcctggcacagggcagtg

SEQ ID NO: 1936779 - DNA, 19 bp, Homo sapiens
gcctggcacagggcagtgg

SEQ ID NO: 1936780 - DNA, 20 bp, Homo sapiens
gcctggcagccgtgccttca

SEQ ID NO: 1936781 - DNA, 13 bp, Homo sapiens
gcctggcctgggt

SEQ ID NO: 1936782 - DNA, 16 bp, Homo sapiens
gcctgggagatgcagc

SEQ ID NO: 1936783 - DNA, 15 bp, Homo sapiens
gcctgggccactggc

SEQ ID NO: 1936784 - DNA, 19 bp, Homo sapiens
gcctgggccactggcatct

SEQ ID NO: 1936785 - DNA, 17 bp, Homo sapiens
gcctgggggtgccagga

SEQ ID NO: 1936786 - DNA, 21 bp, Homo sapiens
gcctgggggtgccaggaccag

SEQ ID NO: 1936787 - DNA, 16 bp, Homo sapiens
gcctgggtcctcccag

SEQ ID NO: 1936788 - DNA, 17 bp, Homo sapiens
gcctgggtcctcccagc

SEQ ID NO: 1936789 - DNA, 21 bp, Homo sapiens
gcctgggtggggcagggcctg

SEQ ID NO: 1936790 - DNA, 14 bp, Homo sapiens
gcctggttccctct

SEQ ID NO: 1936791 - DNA, 15 bp, Homo sapiens
gcctggttccctctt

SEQ ID NO: 1936792 - DNA, 17 bp, Homo sapiens
gcctggttccctctttc

SEQ ID NO: 1936793 - DNA, 21 bp, Homo sapiens
gcctggttccctctttcctgt

SEQ ID NO: 1936794 - DNA, 15 bp, Homo sapiens
gcctgtgggagaagg

SEQ ID NO: 1936795 - DNA, 19 bp, Homo sapiens
gcctgtttgggaggctgga

SEQ ID NO: 1936796 - DNA, 13 bp, Homo sapiens
gccttaaaacttt

SEQ ID NO: 1936797 - DNA, 13 bp, Homo sapiens
gccttcagctcta

SEQ ID NO: 1936798 - DNA, 16 bp, Homo sapiens
gccttcagctctacag

SEQ ID NO: 1936799 - DNA, 17 bp, Homo sapiens
gccttcctcctgggccc

SEQ ID NO: 1936800 - DNA, 22 bp, Homo sapiens
gccttcctcctgggccctctct

SEQ ID NO: 1936801 - DNA, 18 bp, Homo sapiens
gccttcgatacaccgggc

SEQ ID NO: 1936802 - DNA, 21 bp, Homo sapiens
gccttctcttctatcctgcaa

SEQ ID NO: 1936803 - DNA, 17 bp, Homo sapiens
gccttggttcctccagc

SEQ ID NO: 1936804 - DNA, 17 bp, Homo sapiens
gccttgtaattctaaat

SEQ ID NO: 1936805 - DNA, 19 bp, Homo sapiens
gcctttagaaactgagtcc

SEQ ID NO: 1936806 - DNA, 15 bp, Homo sapiens
gcgacacaggctgcc

SEQ ID NO: 1936807 - DNA, 18 bp, Homo sapiens
gcgactgtgaaactggaa

SEQ ID NO: 1936808 - DNA, 17 bp, Homo sapiens
gcgagggcctgcgttca

SEQ ID NO: 1936809 - DNA, 10 bp, Homo sapiens
gcgatgtgtt

SEQ ID NO: 1936810 - DNA, 22 bp, Homo sapiens
gcgcaagcgacacaggctgccg

SEQ ID NO: 1936811 - DNA, 14 bp, Homo sapiens
gcgccctccctccc

SEQ ID NO: 1936812 - DNA, 16 bp, Homo sapiens
gcgccctccctccctc

SEQ ID NO: 1936813 - DNA, 18 bp, Homo sapiens
gcgcctgggtcctcccag

SEQ ID NO: 1936814 - DNA, 15 bp, Homo sapiens
gcgcgcgcacacaca

SEQ ID NO: 1936815 - DNA, 19 bp, Homo sapiens
gcgctggcagcgctcctgg

SEQ ID NO: 1936816 - DNA, 20 bp, Homo sapiens
gcggaaaccgggtggcagcg

SEQ ID NO: 1936817 - DNA, 15 bp, Homo sapiens
gcggccgcctgtcct

SEQ ID NO: 1936818 - DNA, 14 bp, Homo sapiens
gcggctcttcctgg

SEQ ID NO: 1936819 - DNA, 12 bp, Homo sapiens
gcgggaggccac

SEQ ID NO: 1936820 - DNA, 19 bp, Homo sapiens
gcgggtaaaaagagaaggc

SEQ ID NO: 1936821 - DNA, 23 bp, Homo sapiens
gcggtcaataattgtggagagga

SEQ ID NO: 1936822 - DNA, 24 bp, Homo sapiens
gcgtgacttcagactctctcctct

SEQ ID NO: 1936823 - DNA, 19 bp, Homo sapiens
gcgtggcctccgtgaccca

SEQ ID NO: 1936824 - DNA, 11 bp, Homo sapiens
gcgttctcagc

SEQ ID NO: 1936825 - DNA, 18 bp, Homo sapiens
gctaaccagttctctttg

SEQ ID NO: 1936826 - DNA, 17 bp, Homo sapiens
gctaatcaatacccttg

SEQ ID NO: 1936827 - DNA, 17 bp, Homo sapiens
gctaatcagcattctca

SEQ ID NO: 1936828 - DNA, 16 bp, Homo sapiens
gctaattaggaagctt

SEQ ID NO: 1936829 - DNA, 17 bp, Homo sapiens
gctacacccttttccag

SEQ ID NO: 1936830 - DNA, 19 bp, Homo sapiens
gctacacccttttccagct

SEQ ID NO: 1936831 - DNA, 16 bp, Homo sapiens
gctaccctgagctgag

SEQ ID NO: 1936832 - DNA, 15 bp, Homo sapiens
gctagagcattctgg

SEQ ID NO: 1936833 - DNA, 18 bp, Homo sapiens
gctaggttaataggagga

SEQ ID NO: 1936834 - DNA, 22 bp, Homo sapiens
gctaggttaataggaggacaga

SEQ ID NO: 1936835 - DNA, 13 bp, Homo sapiens
gctagtctgtgcc

SEQ ID NO: 1936836 - DNA, 16 bp, Homo sapiens
gctagtctgtgcctca

SEQ ID NO: 1936837 - DNA, 14 bp, Homo sapiens
gctatgtctgtgat

SEQ ID NO: 1936838 - DNA, 15 bp, Homo sapiens
gctattccctggaga

SEQ ID NO: 1936839 - DNA, 18 bp, Homo sapiens
gctcaagtttcagagtca

SEQ ID NO: 1936840 - DNA, 14 bp, Homo sapiens
gctcacacatgaga

SEQ ID NO: 1936841 - DNA, 19 bp, Homo sapiens
gctgtattagtcacagaga

SEQ ID NO: 1936842 - DNA, 19 bp, Homo sapiens
gctgtcagaccttcttcca

SEQ ID NO: 1936843 - DNA, 21 bp, Homo sapiens
gctgtcatgcccagcttggag

SEQ ID NO: 1936844 - DNA, 15 bp, Homo sapiens
gctgtccctcctgag

SEQ ID NO: 1936845 - DNA, 22 bp, Homo sapiens
gctgtgccccatcagcagcttg

SEQ ID NO: 1936846 - DNA, 21 bp, Homo sapiens
gctgtggattttgtggcttca

SEQ ID NO: 1936847 - DNA, 21 bp, Homo sapiens
gctgtggcccctccttctccc

SEQ ID NO: 1936848 - DNA, 19 bp, Homo sapiens
gctgtgggtcagtgtgcca

SEQ ID NO: 1936849 - DNA, 21 bp, Homo sapiens
gctgttctttaaatgcgttcc

SEQ ID NO: 1936850 - DNA, 13 bp, Homo sapiens
gcttagaatgggg

SEQ ID NO: 1936851 - DNA, 16 bp, Homo sapiens
gcttagaatggggctt

SEQ ID NO: 1936852 - DNA, 20 bp, Homo sapiens
gcttcacggacaggaagcac

SEQ ID NO: 1936853 - DNA, 23 bp, Homo sapiens
gcttcacggacaggaagcacagc

SEQ ID NO: 1936854 - DNA, 17 bp, Homo sapiens
gcttcatggcagaaggc

SEQ ID NO: 1936855 - DNA, 18 bp, Homo sapiens
gcttcccgctcagccctc

SEQ ID NO: 1936856 - DNA, 23 bp, Homo sapiens
gcttcccgctcagccctccctgc

SEQ ID NO: 1936857 - DNA, 19 bp, Homo sapiens
gcttcccgggatgcgcctg

SEQ ID NO: 1936858 - DNA, 16 bp, Homo sapiens
gcttccctctgctcca

SEQ ID NO: 1936859 - DNA, 14 bp, Homo sapiens
gcttcttaaatgag

SEQ ID NO: 1936860 - DNA, 21 bp, Homo sapiens
gcttcttaatataactgcctt

SEQ ID NO: 1936861 - DNA, 20 bp, Homo sapiens
gcttgaaagaaaatatgcat

SEQ ID NO: 1936862 - DNA, 23 bp, Homo sapiens
gcttgacgcgtggtcacaggacg

SEQ ID NO: 1936863 - DNA, 19 bp, Homo sapiens
gcttgattctaaaggggac

SEQ ID NO: 1936864 - DNA, 16 bp, Homo sapiens
gcttggagcagagggg

SEQ ID NO: 1936865 - DNA, 18 bp, Homo sapiens
gcttggagcagaggggct

SEQ ID NO: 1936866 - DNA, 14 bp, Homo sapiens
gcttggagtgccac

SEQ ID NO: 1936867 - DNA, 20 bp, Homo sapiens
gcttggggtagagaggacag

SEQ ID NO: 1936868 - DNA, 19 bp, Homo sapiens
gcttgtagggtgaggcgtg

SEQ ID NO: 1936869 - DNA, 12 bp, Homo sapiens
gctttcatgtaa

SEQ ID NO: 1936870 - DNA, 16 bp, Homo sapiens
gctttgaggctggcgg

SEQ ID NO: 1936871 - DNA, 14 bp, Homo sapiens
gctttgggctgccc

SEQ ID NO: 1936872 - DNA, 18 bp, Homo sapiens
gctttgggctgccctggt

SEQ ID NO: 1936873 - DNA, 19 bp, Homo sapiens
gctttggggagcgcctcgc

SEQ ID NO: 1936874 - DNA, 20 bp, Homo sapiens
gctttgggtagtgccatggc

SEQ ID NO: 1936875 - DNA, 17 bp, Homo sapiens
gctttgtccatgatgtc

SEQ ID NO: 1936876 - DNA, 19 bp, Homo sapiens
gcttttgctggtcactgcc

SEQ ID NO: 1936877 - DNA, 21 bp, Homo sapiens
gcttttgctggtcactgccat

SEQ ID NO: 1936878 - DNA, 12 bp, Homo sapiens
ggaaaattattt

SEQ ID NO: 1936879 - DNA, 17 bp, Homo sapiens
ggaaacacgtttagaaa

SEQ ID NO: 1936880 - DNA, 18 bp, Homo sapiens
ggaaaccgggtggcagcg

SEQ ID NO: 1936881 - DNA, 18 bp, Homo sapiens
ggaaagggtgtggcttgg

SEQ ID NO: 1936882 - DNA, 16 bp, Homo sapiens
ggaacagacctcggct

SEQ ID NO: 1936883 - DNA, 22 bp, Homo sapiens
ggaagacatggggaggaaggac

SEQ ID NO: 1936884 - DNA, 21 bp, Homo sapiens
ggaagcacaagaagtgggagt

SEQ ID NO: 1936885 - DNA, 23 bp, Homo sapiens
ggaagccacgtgctggagagtag

SEQ ID NO: 1936886 - DNA, 17 bp, Homo sapiens
ggaaggctgagaggaga

SEQ ID NO: 1936887 - DNA, 16 bp, Homo sapiens
ggaagtaggaagtaaa

SEQ ID NO: 1936888 - DNA, 17 bp, Homo sapiens
ggaagttgctgtgcccc

SEQ ID NO: 1936889 - DNA, 20 bp, Homo sapiens
ggaatggggtgggagccaca

SEQ ID NO: 1936890 - DNA, 22 bp, Homo sapiens
ggaatggtaaccgagccagcag

SEQ ID NO: 1936891 - DNA, 15 bp, Homo sapiens
ggacaagccaggccc

SEQ ID NO: 1936892 - DNA, 12 bp, Homo sapiens
ggacaggaagca

SEQ ID NO: 1936893 - DNA, 13 bp, Homo sapiens
ggacaggaagcac

SEQ ID NO: 1936894 - DNA, 21 bp, Homo sapiens
ggacagggagggaacagacct

SEQ ID NO: 1936895 - DNA, 20 bp, Homo sapiens
ggacagtgagagcagggctg

SEQ ID NO: 1936896 - DNA, 14 bp, Homo sapiens
ggacatattcattt

SEQ ID NO: 1936897 - DNA, 22 bp, Homo sapiens
ggaccacgtctccctggcccca

SEQ ID NO: 1936898 - DNA, 14 bp, Homo sapiens
ggaccctcccaggt

SEQ ID NO: 1936899 - DNA, 13 bp, Homo sapiens
ggacggaagtggc

SEQ ID NO: 1936900 - DNA, 19 bp, Homo sapiens
ggactccttgttctgctct

SEQ ID NO: 1936901 - DNA, 13 bp, Homo sapiens
ggactctctttct

SEQ ID NO: 1936902 - DNA, 18 bp, Homo sapiens
ggactggcccacccctct

SEQ ID NO: 1936903 - DNA, 24 bp, Homo sapiens
ggacttatttttggacttagtgca

SEQ ID NO: 1936904 - DNA, 23 bp, Homo sapiens
ggactttcttttcgccgtggctg

SEQ ID NO: 1936905 - DNA, 19 bp, Homo sapiens
ggagaaacccttgaaaaga

SEQ ID NO: 1936906 - DNA, 13 bp, Homo sapiens
ggagaaggagagg

SEQ ID NO: 1936907 - DNA, 18 bp, Homo sapiens
ggggtctgggaggcaggt

SEQ ID NO: 1936908 - DNA, 16 bp, Homo sapiens
ggggtgggagccacag

SEQ ID NO: 1936909 - DNA, 22 bp, Homo sapiens
ggggtgggggagaatggctctg

SEQ ID NO: 1936910 - DNA, 18 bp, Homo sapiens
ggggtggttggaggcctg

SEQ ID NO: 1936911 - DNA, 19 bp, Homo sapiens
ggggtgtcacagaggcagt

SEQ ID NO: 1936912 - DNA, 18 bp, Homo sapiens
gggtaaaaagagaaggca

SEQ ID NO: 1936913 - DNA, 21 bp, Homo sapiens
gggtaaaaagagaaggcaagc

SEQ ID NO: 1936914 - DNA, 14 bp, Homo sapiens
gggtagtgccatgg

SEQ ID NO: 1936915 - DNA, 13 bp, Homo sapiens
gggtatattcatt

SEQ ID NO: 1936916 - DNA, 20 bp, Homo sapiens
gggtcagcaggggggttggg

SEQ ID NO: 1936917 - DNA, 15 bp, Homo sapiens
gggtcaggccacggc

SEQ ID NO: 1936918 - DNA, 22 bp, Homo sapiens
gggtccctgcgtctcctgccca

SEQ ID NO: 1936919 - DNA, 15 bp, Homo sapiens
gggtcctcccagctg

SEQ ID NO: 1936920 - DNA, 17 bp, Homo sapiens
gggtctgggaggcaggt

SEQ ID NO: 1936921 - DNA, 15 bp, Homo sapiens
gggtgaggcgtggga

SEQ ID NO: 1936922 - DNA, 22 bp, Homo sapiens
gggtgaggcgtgggatccagag

SEQ ID NO: 1936923 - DNA, 21 bp, Homo sapiens
gggtgctctggctggagagga

SEQ ID NO: 1936924 - DNA, 21 bp, Homo sapiens
gggtgctgtcatgcccagctt

SEQ ID NO: 1936925 - DNA, 22 bp, Homo sapiens
gggtggcagcgcccagcctggc

SEQ ID NO: 1936926 - DNA, 14 bp, Homo sapiens
gggtggggcttgga

SEQ ID NO: 1936927 - DNA, 19 bp, Homo sapiens
gggtgtcacagaggcagtg

SEQ ID NO: 1936928 - DNA, 14 bp, Homo sapiens
gggtgtggcttgga

SEQ ID NO: 1936929 - DNA, 20 bp, Homo sapiens
gggttaaagaaaggcagaga

SEQ ID NO: 1936930 - DNA, 13 bp, Homo sapiens
gggttccagacag

SEQ ID NO: 1936931 - DNA, 16 bp, Homo sapiens
gggttccagacagagt

SEQ ID NO: 1936932 - DNA, 20 bp, Homo sapiens
gggttccagacagagtggat

SEQ ID NO: 1936933 - DNA, 16 bp, Homo sapiens
gggttccagcttccct

SEQ ID NO: 1936934 - DNA, 16 bp, Homo sapiens
gggttgccagtcctgc

SEQ ID NO: 1936935 - DNA, 17 bp, Homo sapiens
gggttgccagtcctgca

SEQ ID NO: 1936936 - DNA, 15 bp, Homo sapiens
gggttgggttccaga

SEQ ID NO: 1936937 - DNA, 21 bp, Homo sapiens
gggtttgaggaccctcccagg

SEQ ID NO: 1936938 - DNA, 20 bp, Homo sapiens
gggttttcacttcctagggt

SEQ ID NO: 1936939 - DNA, 18 bp, Homo sapiens
gggttttgtattctctga

SEQ ID NO: 1936940 - DNA, 18 bp, Homo sapiens
gggttttgttaggggtgg

SEQ ID NO: 1936941 - DNA, 15 bp, Homo sapiens
ggtacagcccaggcg

SEQ ID NO: 1936942 - DNA, 19 bp, Homo sapiens
ggtaccagagcctatggaa

SEQ ID NO: 1936943 - DNA, 19 bp, Homo sapiens
ggtagtgccatggccagga

SEQ ID NO: 1936944 - DNA, 22 bp, Homo sapiens
ggtatgcactggttccttaagt

SEQ ID NO: 1936945 - DNA, 13 bp, Homo sapiens
ggtcactgcccac

SEQ ID NO: 1936946 - DNA, 20 bp, Homo sapiens
ggtcagattagggcggggag

SEQ ID NO: 1936947 - DNA, 14 bp, Homo sapiens
ggtcagtgtgcaaa

SEQ ID NO: 1936948 - DNA, 14 bp, Homo sapiens
ggtccatgggcaga

SEQ ID NO: 1936949 - DNA, 17 bp, Homo sapiens
ggtccatgggcagagcc

SEQ ID NO: 1936950 - DNA, 13 bp, Homo sapiens
ggtcctcccagct

SEQ ID NO: 1936951 - DNA, 21 bp, Homo sapiens
ggtcctttccttctcgtcttc

SEQ ID NO: 1936952 - DNA, 15 bp, Homo sapiens
ggtcctttggggtga

SEQ ID NO: 1936953 - DNA, 18 bp, Homo sapiens
ggtctatttctcccttca

SEQ ID NO: 1936954 - DNA, 12 bp, Homo sapiens
ggtctccacccc

SEQ ID NO: 1936955 - DNA, 23 bp, Homo sapiens
ggtctgcctcttctgggagggca

SEQ ID NO: 1936956 - DNA, 15 bp, Homo sapiens
ggtctggcctagtgg

SEQ ID NO: 1936957 - DNA, 16 bp, Homo sapiens
ggtctgtgggactggc

SEQ ID NO: 1936958 - DNA, 23 bp, Homo sapiens
ggtcttagggtacagcccaggcg

SEQ ID NO: 1936959 - DNA, 13 bp, Homo sapiens
ggtcttctccatc

SEQ ID NO: 1936960 - DNA, 15 bp, Homo sapiens
ggtctttgtgtgctg

SEQ ID NO: 1936961 - DNA, 13 bp, Homo sapiens
ggtgaggaggagg

SEQ ID NO: 1936962 - DNA, 16 bp, Homo sapiens
ggtgaggaggaggcag

SEQ ID NO: 1936963 - DNA, 23 bp, Homo sapiens
ggtgaggtgggggtctggcctag

SEQ ID NO: 1936964 - DNA, 20 bp, Homo sapiens
ggtgcacagacgtccctcca

SEQ ID NO: 1936965 - DNA, 12 bp, Homo sapiens
ggtgccagctgt

SEQ ID NO: 1936966 - DNA, 19 bp, Homo sapiens
ggtgctgtcatgcccagct

SEQ ID NO: 1936967 - DNA, 19 bp, Homo sapiens
ggtggcccgacagcctggc

SEQ ID NO: 1936968 - DNA, 16 bp, Homo sapiens
ggtggcttcggcctgc

SEQ ID NO: 1936969 - DNA, 19 bp, Homo sapiens
ggtgggagccacagggacg

SEQ ID NO: 1936970 - DNA, 14 bp, Homo sapiens
ggtgggctccagag

SEQ ID NO: 1936971 - DNA, 12 bp, Homo sapiens
ggtggggcggga

SEQ ID NO: 1936972 - DNA, 15 bp, Homo sapiens
ggtggggcttggaag

SEQ ID NO: 1936973 - DNA, 22 bp, Homo sapiens
ggtggggcttggaagggcgctg

SEQ ID NO: 1936974 - DNA, 14 bp, Homo sapiens
ggtgggtccatggg

SEQ ID NO: 1936975 - DNA, 20 bp, Homo sapiens
ggtgggtccatgggcagagc

SEQ ID NO: 1936976 - DNA, 16 bp, Homo sapiens
ggtggtcttggagagg

SEQ ID NO: 1936977 - DNA, 18 bp, Homo sapiens
ggtggtcttggagaggag

SEQ ID NO: 1936978 - DNA, 20 bp, Homo sapiens
ggtggtcttggagaggaggt

SEQ ID NO: 1936979 - DNA, 15 bp, Homo sapiens
ggtggttggaggcct

SEQ ID NO: 1936980 - DNA, 17 bp, Homo sapiens
ggtggttggaggcctgg

SEQ ID NO: 1936981 - DNA, 17 bp, Homo sapiens
ggtggtttcagaaaggg

SEQ ID NO: 1936982 - DNA, 18 bp, Homo sapiens
ggtggtttcagaaagggc

SEQ ID NO: 1936983 - DNA, 20 bp, Homo sapiens
ggtgtctcactctttcttct

SEQ ID NO: 1936984 - DNA, 24 bp, Homo sapiens
ggtgtcttttaatgatactgtcta

SEQ ID NO: 1936985 - DNA, 19 bp, Homo sapiens
ggtgtgaatgctgtacctt

SEQ ID NO: 1936986 - DNA, 15 bp, Homo sapiens
ggtgtgatcgtctga

SEQ ID NO: 1936987 - DNA, 17 bp, Homo sapiens
ggtgtgcaccagggttg

SEQ ID NO: 1936988 - DNA, 23 bp, Homo sapiens
ggtgtgtccccctctgtccaggc

SEQ ID NO: 1936989 - DNA, 21 bp, Homo sapiens
ggtgtgttcgtggagccacag

SEQ ID NO: 1936990 - DNA, 21 bp, Homo sapiens
ggtgtgtttcaggacagctgc

SEQ ID NO: 1936991 - DNA, 14 bp, Homo sapiens
ggtgtttctctgta

SEQ ID NO: 1936992 - DNA, 19 bp, Homo sapiens
ggttaaagaaaggcagaga

SEQ ID NO: 1936993 - DNA, 13 bp, Homo sapiens
ggttaataagttt

SEQ ID NO: 1936994 - DNA, 17 bp, Homo sapiens
ggttactaagatgaaat

SEQ ID NO: 1936995 - DNA, 13 bp, Homo sapiens
ggttccagacaga

SEQ ID NO: 1936996 - DNA, 17 bp, Homo sapiens
ggttccagacagagtgg

SEQ ID NO: 1936997 - DNA, 16 bp, Homo sapiens
gtactcccccagccct

SEQ ID NO: 1936998 - DNA, 14 bp, Homo sapiens
gtactcctcccagg

SEQ ID NO: 1936999 - DNA, 17 bp, Homo sapiens
gtactgagttctcatcc

SEQ ID NO: 1937000 - DNA, 21 bp, Homo sapiens
gtacttgaccgtttttatatt

SEQ ID NO: 1937001 - DNA, 19 bp, Homo sapiens
gtactttatattttctata

SEQ ID NO: 1937002 - DNA, 19 bp, Homo sapiens
gtagaaactgcagggaaaa

SEQ ID NO: 1937003 - DNA, 15 bp, Homo sapiens
gtagaagagggagaa

SEQ ID NO: 1937004 - DNA, 15 bp, Homo sapiens
gtagaaggagacaga

SEQ ID NO: 1937005 - DNA, 19 bp, Homo sapiens
gtagggttgccagtcctgc

SEQ ID NO: 1937006 - DNA, 19 bp, Homo sapiens
gtagtgccatggccaggag

SEQ ID NO: 1937007 - DNA, 13 bp, Homo sapiens
gtataccacctgt

SEQ ID NO: 1937008 - DNA, 21 bp, Homo sapiens
gtataccacctgtacatacat

SEQ ID NO: 1937009 - DNA, 15 bp, Homo sapiens
gtataggccatctgt

SEQ ID NO: 1937010 - DNA, 11 bp, Homo sapiens
gtatataaatg

SEQ ID NO: 1937011 - DNA, 21 bp, Homo sapiens
gtatcaggacccagaggaagg

SEQ ID NO: 1937012 - DNA, 18 bp, Homo sapiens
gtatctcgaagtcttcca

SEQ ID NO: 1937013 - DNA, 19 bp, Homo sapiens
gtattctctgagctgtgca

SEQ ID NO: 1937014 - DNA, 20 bp, Homo sapiens
gtattgtctgacttctcagg

SEQ ID NO: 1937015 - DNA, 17 bp, Homo sapiens
gtcaaccttgtgtgagt

SEQ ID NO: 1937016 - DNA, 19 bp, Homo sapiens
gtcaataattgtggagagg

SEQ ID NO: 1937017 - DNA, 14 bp, Homo sapiens
gtcacagaggcagt

SEQ ID NO: 1937018 - DNA, 13 bp, Homo sapiens
gtcacccctgtct

SEQ ID NO: 1937019 - DNA, 13 bp, Homo sapiens
gtcacctgtgctt

SEQ ID NO: 1937020 - DNA, 20 bp, Homo sapiens
gtcactgcacagtgcatctc

SEQ ID NO: 1937021 - DNA, 23 bp, Homo sapiens
gtcactgcacagtgcatctcagc

SEQ ID NO: 1937022 - DNA, 16 bp, Homo sapiens
gtcactgccatggagg

SEQ ID NO: 1937023 - DNA, 20 bp, Homo sapiens
gtcactgccatggaggcaca

SEQ ID NO: 1937024 - DNA, 13 bp, Homo sapiens
gtcagcccagtgg

SEQ ID NO: 1937025 - DNA, 22 bp, Homo sapiens
gtcagccctagggtggagagcc

SEQ ID NO: 1937026 - DNA, 17 bp, Homo sapiens
gtcaggaaggatgagca

SEQ ID NO: 1937027 - DNA, 12 bp, Homo sapiens
gtcaggccacgg

SEQ ID NO: 1937028 - DNA, 18 bp, Homo sapiens
gtcatgacatttctcaaa

SEQ ID NO: 1937029 - DNA, 15 bp, Homo sapiens
gtcatgcccagcttg

SEQ ID NO: 1937030 - DNA, 22 bp, Homo sapiens
gtcatgcccagcttggagtgcc

SEQ ID NO: 1937031 - DNA, 21 bp, Homo sapiens
gtcatttgctgagcatgtact

SEQ ID NO: 1937032 - DNA, 12 bp, Homo sapiens
gtccaatcctat

SEQ ID NO: 1937033 - DNA, 22 bp, Homo sapiens
gtccacgccgggtcgcctgccc

SEQ ID NO: 1937034 - DNA, 15 bp, Homo sapiens
gtccaggcactgaga

SEQ ID NO: 1937035 - DNA, 16 bp, Homo sapiens
gtccatgatgtccttg

SEQ ID NO: 1937036 - DNA, 16 bp, Homo sapiens
gtccattgtccaatcc

SEQ ID NO: 1937037 - DNA, 21 bp, Homo sapiens
gtccccctctgtccaggcact

SEQ ID NO: 1937038 - DNA, 22 bp, Homo sapiens
gtccctaccgagtctcttctcc

SEQ ID NO: 1937039 - DNA, 20 bp, Homo sapiens
gtccctccacgttcacccct

SEQ ID NO: 1937040 - DNA, 15 bp, Homo sapiens
gtccctttccctgca

SEQ ID NO: 1937041 - DNA, 23 bp, Homo sapiens
gtcctggcccgggagccgcaggg

SEQ ID NO: 1937042 - DNA, 12 bp, Homo sapiens
gtcctggggtgg

SEQ ID NO: 1937043 - DNA, 13 bp, Homo sapiens
gtcctggggtggt

SEQ ID NO: 1937044 - DNA, 19 bp, Homo sapiens
gtcctgttatgtcattgtg

SEQ ID NO: 1937045 - DNA, 22 bp, Homo sapiens
gtccttcccacggccactgcag

SEQ ID NO: 1937046 - DNA, 13 bp, Homo sapiens
gtcgcggctgcag

SEQ ID NO: 1937047 - DNA, 20 bp, Homo sapiens
gtctcaagagggcactggtg

SEQ ID NO: 1937048 - DNA, 15 bp, Homo sapiens
gtctcactctttctt

SEQ ID NO: 1937049 - DNA, 13 bp, Homo sapiens
gtctccacccctc

SEQ ID NO: 1937050 - DNA, 15 bp, Homo sapiens
gtctccacccctcaa

SEQ ID NO: 1937051 - DNA, 17 bp, Homo sapiens
gtctccacccctcaagc

SEQ ID NO: 1937052 - DNA, 14 bp, Homo sapiens
gtctccatggccct

SEQ ID NO: 1937053 - DNA, 20 bp, Homo sapiens
gtctccctacttagacccag

SEQ ID NO: 1937054 - DNA, 19 bp, Homo sapiens
gtctcctcgtcccgagggc

SEQ ID NO: 1937055 - DNA, 16 bp, Homo sapiens
gtctcctctccagccc

SEQ ID NO: 1937056 - DNA, 23 bp, Homo sapiens
gtctcctgcccactctgaccggg

SEQ ID NO: 1937057 - DNA, 15 bp, Homo sapiens
gtctcttctccactg

SEQ ID NO: 1937058 - DNA, 19 bp, Homo sapiens
gtctgaaatacctttgcct

SEQ ID NO: 1937059 - DNA, 22 bp, Homo sapiens
gtctgaaggagaggagtgcgct

SEQ ID NO: 1937060 - DNA, 10 bp, Homo sapiens
gtctgagccc

SEQ ID NO: 1937061 - DNA, 16 bp, Homo sapiens
gtctgagccctgccct

SEQ ID NO: 1937062 - DNA, 22 bp, Homo sapiens
gtctgagcggccgcctgtcctt

SEQ ID NO: 1937063 - DNA, 15 bp, Homo sapiens
gtctgatattggtgt

SEQ ID NO: 1937064 - DNA, 15 bp, Homo sapiens
gtctggagcccctat

SEQ ID NO: 1937065 - DNA, 22 bp, Homo sapiens
gtctggagcccctatcctgcac

SEQ ID NO: 1937066 - DNA, 13 bp, Homo sapiens
gtctgggaggcag

SEQ ID NO: 1937067 - DNA, 15 bp, Homo sapiens
gtctgggaggcaggt

SEQ ID NO: 1937068 - DNA, 18 bp, Homo sapiens
gtctgtgggactggccca

SEQ ID NO: 1937069 - DNA, 14 bp, Homo sapiens
gtcttatttcctca

SEQ ID NO: 1937070 - DNA, 15 bp, Homo sapiens
gtcttccatcagcag

SEQ ID NO: 1937071 - DNA, 19 bp, Homo sapiens
gtcttgagtgggccccctc

SEQ ID NO: 1937072 - DNA, 22 bp, Homo sapiens
gtcttgctatggggagaaaaga

SEQ ID NO: 1937073 - DNA, 14 bp, Homo sapiens
gtcttggagaggag

SEQ ID NO: 1937074 - DNA, 20 bp, Homo sapiens
gtctttgaaatatgcatgta

SEQ ID NO: 1937075 - DNA, 16 bp, Homo sapiens
gtctttgctgtttata

SEQ ID NO: 1937076 - DNA, 18 bp, Homo sapiens
gtctttgctgtttatata

SEQ ID NO: 1937077 - DNA, 16 bp, Homo sapiens
gtctttgtgtgctgtg

SEQ ID NO: 1937078 - DNA, 15 bp, Homo sapiens
gtgaagcccaggagg

SEQ ID NO: 1937079 - DNA, 18 bp, Homo sapiens
gtgaatacatggtagcag

SEQ ID NO: 1937080 - DNA, 16 bp, Homo sapiens
gtgacatgcgggctgg

SEQ ID NO: 1937081 - DNA, 20 bp, Homo sapiens
gtgacatgcgggctgggcag

SEQ ID NO: 1937082 - DNA, 22 bp, Homo sapiens
gtgacatgcgggctgggcagct

SEQ ID NO: 1937083 - DNA, 15 bp, Homo sapiens
gtgaccaatgtcttg

SEQ ID NO: 1937084 - DNA, 18 bp, Homo sapiens
gtgaccgggggaagctga

SEQ ID NO: 1937085 - DNA, 21 bp, Homo sapiens
gtgacgggggttggggtgggg

SEQ ID NO: 1937086 - DNA, 14 bp, Homo sapiens
gtgagatcagtcag

SEQ ID NO: 1937087 - DNA, 22 bp, Homo sapiens
gtgagcatgaaactatgcacct

SEQ ID NO: 1937088 - DNA, 22 bp, Homo sapiens
gtgagcattgtggctgtcagca

SEQ ID NO: 1937089 - DNA, 19 bp, Homo sapiens
gtgaggatgggaaggaggg

SEQ ID NO: 1937090 - DNA, 17 bp, Homo sapiens
gtgaggccagggcagag

SEQ ID NO: 1937091 - DNA, 13 bp, Homo sapiens
gtgaggcgtggga

SEQ ID NO: 1937092 - DNA, 19 bp, Homo sapiens
gtgaggcgtgggatccaga

SEQ ID NO: 1937093 - DNA, 16 bp, Homo sapiens
gtggccgggggtgggg

SEQ ID NO: 1937094 - DNA, 15 bp, Homo sapiens
gtggctgtcagcagg

SEQ ID NO: 1937095 - DNA, 18 bp, Homo sapiens
gtggcttcccgctcagcc

SEQ ID NO: 1937096 - DNA, 19 bp, Homo sapiens
gtggcttcccgctcagccc

SEQ ID NO: 1937097 - DNA, 18 bp, Homo sapiens
gtgggactggcccacccc

SEQ ID NO: 1937098 - DNA, 21 bp, Homo sapiens
gtgggactggcccacccctct

SEQ ID NO: 1937099 - DNA, 15 bp, Homo sapiens
gtgggagaagggaca

SEQ ID NO: 1937100 - DNA, 17 bp, Homo sapiens
gtgggagaagggacagc

SEQ ID NO: 1937101 - DNA, 14 bp, Homo sapiens
gtgggagaggaagc

SEQ ID NO: 1937102 - DNA, 12 bp, Homo sapiens
gtgggagtggga

SEQ ID NO: 1937103 - DNA, 14 bp, Homo sapiens
gtgggatccagaga

SEQ ID NO: 1937104 - DNA, 15 bp, Homo sapiens
gtgggatccagagag

SEQ ID NO: 1937105 - DNA, 23 bp, Homo sapiens
gtgggatcttacccacttccctg

SEQ ID NO: 1937106 - DNA, 17 bp, Homo sapiens
gtgggattcaggaatgg

SEQ ID NO: 1937107 - DNA, 13 bp, Homo sapiens
gtgggcggcagag

SEQ ID NO: 1937108 - DNA, 14 bp, Homo sapiens
gtgggctccagagt

SEQ ID NO: 1937109 - DNA, 15 bp, Homo sapiens
gtgggctccctgact

SEQ ID NO: 1937110 - DNA, 24 bp, Homo sapiens
gtgggctctctggacctgaccaga

SEQ ID NO: 1937111 - DNA, 22 bp, Homo sapiens
gtgggctggtgacccagtcaga

SEQ ID NO: 1937112 - DNA, 12 bp, Homo sapiens
gtggggcagcac

SEQ ID NO: 1937113 - DNA, 14 bp, Homo sapiens
gtggggcagcacag

SEQ ID NO: 1937114 - DNA, 18 bp, Homo sapiens
gtggggcttagaatgggg

SEQ ID NO: 1937115 - DNA, 24 bp, Homo sapiens
gtggggcttagaatggggcttcca

SEQ ID NO: 1937116 - DNA, 15 bp, Homo sapiens
gtgggggcctgctgt

SEQ ID NO: 1937117 - DNA, 21 bp, Homo sapiens
gtgggggtctgggaggcaggt

SEQ ID NO: 1937118 - DNA, 22 bp, Homo sapiens
gtgggggtgtcacagaggcagt

SEQ ID NO: 1937119 - DNA, 13 bp, Homo sapiens
gtgggtcttcagg

SEQ ID NO: 1937120 - DNA, 17 bp, Homo sapiens
gtgggtcttcagggggc

SEQ ID NO: 1937121 - DNA, 21 bp, Homo sapiens
gtgggtcttcagggggccagg

SEQ ID NO: 1937122 - DNA, 14 bp, Homo sapiens
gtggtccttaggct

SEQ ID NO: 1937123 - DNA, 13 bp, Homo sapiens
gtggtctatttct

SEQ ID NO: 1937124 - DNA, 17 bp, Homo sapiens
gtggtcttggagaggag

SEQ ID NO: 1937125 - DNA, 19 bp, Homo sapiens
gtggtggcttcggcctgct

SEQ ID NO: 1937126 - DNA, 16 bp, Homo sapiens
gtgtataccacctgta

SEQ ID NO: 1937127 - DNA, 20 bp, Homo sapiens
gtgtatctcgaagtcttcca

SEQ ID NO: 1937128 - DNA, 13 bp, Homo sapiens
gtgtatgtgttta

SEQ ID NO: 1937129 - DNA, 22 bp, Homo sapiens
gtgtatgtgtttataattgtta

SEQ ID NO: 1937130 - DNA, 16 bp, Homo sapiens
gtgtcacagaggcagt

SEQ ID NO: 1937131 - DNA, 16 bp, Homo sapiens
gtgtctcactctttct

SEQ ID NO: 1937132 - DNA, 20 bp, Homo sapiens
gtgtcttttaatgatactgt

SEQ ID NO: 1937133 - DNA, 17 bp, Homo sapiens
gtgtgaggccagggcag

SEQ ID NO: 1937134 - DNA, 17 bp, Homo sapiens
gtgtgccaccctctgca

SEQ ID NO: 1937135 - DNA, 14 bp, Homo sapiens
gtgtggagtggagg

SEQ ID NO: 1937136 - DNA, 17 bp, Homo sapiens
gtgtggagtggaggggt

SEQ ID NO: 1937137 - DNA, 19 bp, Homo sapiens
gtgtgtccacgactgtctc

SEQ ID NO: 1937138 - DNA, 17 bp, Homo sapiens
gtgtgtccccctctgtc

SEQ ID NO: 1937139 - DNA, 15 bp, Homo sapiens
gtgtgtttctgatct

SEQ ID NO: 1937140 - DNA, 21 bp, Homo sapiens
gtgttaaatgtgatgaatact

SEQ ID NO: 1937141 - DNA, 16 bp, Homo sapiens
gtgttacctgaaaaca

SEQ ID NO: 1937142 - DNA, 23 bp, Homo sapiens
gtgttagggaagggcctgccaca

SEQ ID NO: 1937143 - DNA, 18 bp, Homo sapiens
gtgttcccaatgctttgt

SEQ ID NO: 1937144 - DNA, 14 bp, Homo sapiens
gtgtttgtatataa

SEQ ID NO: 1937145 - DNA, 20 bp, Homo sapiens
gttaaaacaaattaaaaaca

SEQ ID NO: 1937146 - DNA, 22 bp, Homo sapiens
gttaagttgatggtgatgaaat

SEQ ID NO: 1937147 - DNA, 16 bp, Homo sapiens
gttaataggaggacag

SEQ ID NO: 1937148 - DNA, 20 bp, Homo sapiens
gttaatcacttaacctgctt

SEQ ID NO: 1937149 - DNA, 22 bp, Homo sapiens
gttaattaaagtaaaattattc

SEQ ID NO: 1937150 - DNA, 15 bp, Homo sapiens
gttaccgagtatctg

SEQ ID NO: 1937151 - DNA, 18 bp, Homo sapiens
gttaccgagtatctgtaa

SEQ ID NO: 1937152 - DNA, 22 bp, Homo sapiens
gttacctgaaaacactgtgcac

SEQ ID NO: 1937153 - DNA, 22 bp, Homo sapiens
gttactaagatgaaattgccaa

SEQ ID NO: 1937154 - DNA, 13 bp, Homo sapiens
gttaggggtgggg

SEQ ID NO: 1937155 - DNA, 16 bp, Homo sapiens
gttaggggtgggggag

SEQ ID NO: 1937156 - DNA, 22 bp, Homo sapiens
gttagtcatttgctgagcatgt

SEQ ID NO: 1937157 - DNA, 12 bp, Homo sapiens
gttatataaaaa

SEQ ID NO: 1937158 - DNA, 19 bp, Homo sapiens
gttatattgaaaaaataga

SEQ ID NO: 1937159 - DNA, 15 bp, Homo sapiens
gttatgtcattgtgt

SEQ ID NO: 1937160 - DNA, 23 bp, Homo sapiens
gttattattggcttgcactttgt

SEQ ID NO: 1937161 - DNA, 16 bp, Homo sapiens
gttattgacaaactct

SEQ ID NO: 1937162 - DNA, 13 bp, Homo sapiens
gttattttgcaac

SEQ ID NO: 1937163 - DNA, 16 bp, Homo sapiens
gttattttttaattat

SEQ ID NO: 1937164 - DNA, 18 bp, Homo sapiens
gttcaaactactgtacat

SEQ ID NO: 1937165 - DNA, 19 bp, Homo sapiens
gttcaaactactgtacatt

SEQ ID NO: 1937166 - DNA, 13 bp, Homo sapiens
gttcaaagccagc

SEQ ID NO: 1937167 - DNA, 12 bp, Homo sapiens
gttcacccctcc

SEQ ID NO: 1937168 - DNA, 24 bp, Homo sapiens
gttcactctacttagcatgtccct

SEQ ID NO: 1937169 - DNA, 16 bp, Homo sapiens
gttcacttttgacaaa

SEQ ID NO: 1937170 - DNA, 16 bp, Homo sapiens
gttcatagtttctgta

SEQ ID NO: 1937171 - DNA, 20 bp, Homo sapiens
gttcatagtttctgtaattg

SEQ ID NO: 1937172 - DNA, 22 bp, Homo sapiens
gttcatatgtaccatgtacatg

SEQ ID NO: 1937173 - DNA, 11 bp, Homo sapiens
gttccagacag

SEQ ID NO: 1937174 - DNA, 19 bp, Homo sapiens
gttccagacagagtggatc

SEQ ID NO: 1937175 - DNA, 17 bp, Homo sapiens
gttcccctgttcactct

SEQ ID NO: 1937176 - DNA, 15 bp, Homo sapiens
gttccctctttcctg

SEQ ID NO: 1937177 - DNA, 11 bp, Homo sapiens
gttcctccagc

SEQ ID NO: 1937178 - DNA, 9 bp, Homo sapiens
gttcctgcc

SEQ ID NO: 1937179 - DNA, 14 bp, Homo sapiens
gttcctgccttctc

SEQ ID NO: 1937180 - DNA, 18 bp, Homo sapiens
gttcctgccttctcttct

SEQ ID NO: 1937181 - DNA, 19 bp, Homo sapiens
gttctaaaaattgtgatca

SEQ ID NO: 1937182 - DNA, 21 bp, Homo sapiens
gttctcatccacagaggccag

SEQ ID NO: 1937183 - DNA, 14 bp, Homo sapiens
gttgaccccagagg

SEQ ID NO: 1937184 - DNA, 22 bp, Homo sapiens
gttgacctttgaggtctaaaca

SEQ ID NO: 1937185 - DNA, 16 bp, Homo sapiens
gttgccattttgtctg

SEQ ID NO: 1937186 - DNA, 20 bp, Homo sapiens
gttgctcctacccctgtcct

SEQ ID NO: 1937187 - DNA, 21 bp, Homo sapiens
gttgctgtgccccatcagcag

SEQ ID NO: 1937188 - DNA, 16 bp, Homo sapiens
gttggaactgctgcca

SEQ ID NO: 1937189 - DNA, 18 bp, Homo sapiens
gttggaactgctgccatg

SEQ ID NO: 1937190 - DNA, 14 bp, Homo sapiens
gttgggaagacatg

SEQ ID NO: 1937191 - DNA, 12 bp, Homo sapiens
gttggggtgggg

SEQ ID NO: 1937192 - DNA, 14 bp, Homo sapiens
gttgggttccagac

SEQ ID NO: 1937193 - DNA, 16 bp, Homo sapiens
gttgggttccagacag

SEQ ID NO: 1937194 - DNA, 15 bp, Homo sapiens
gttggtgttgcagaa

SEQ ID NO: 1937195 - DNA, 16 bp, Homo sapiens
gttgttcagaagttgt

SEQ ID NO: 1937196 - DNA, 20 bp, Homo sapiens
gtttaatatctgactgaaat

SEQ ID NO: 1937197 - DNA, 16 bp, Homo sapiens
gtttacactctttgta

SEQ ID NO: 1937198 - DNA, 13 bp, Homo sapiens
gtttaccctccct

SEQ ID NO: 1937199 - DNA, 17 bp, Homo sapiens
gtttaccctccctgtcc

SEQ ID NO: 1937200 - DNA, 22 bp, Homo sapiens
gtttcaattccacctgcaatca

SEQ ID NO: 1937201 - DNA, 16 bp, Homo sapiens
gtttcaattgcatctc

SEQ ID NO: 1937202 - DNA, 21 bp, Homo sapiens
gtttcagaaagggcagcccct

SEQ ID NO: 1937203 - DNA, 13 bp, Homo sapiens
gtttcaggacagc

SEQ ID NO: 1937204 - DNA, 17 bp, Homo sapiens
gtttccaagcctgggcc

SEQ ID NO: 1937205 - DNA, 21 bp, Homo sapiens
gtttccaagcctgggccactg

SEQ ID NO: 1937206 - DNA, 23 bp, Homo sapiens
gtttccaagcctgggccactggc

SEQ ID NO: 1937207 - DNA, 23 bp, Homo sapiens
gtttctgtaattggcttttgaat

SEQ ID NO: 1937208 - DNA, 24 bp, Homo sapiens
gtttgaattacagggaagaaatca

SEQ ID NO: 1937209 - DNA, 15 bp, Homo sapiens
gtttgatttcattaa

SEQ ID NO: 1937210 - DNA, 20 bp, Homo sapiens
gtttgcaactggtatatatt

SEQ ID NO: 1937211 - DNA, 15 bp, Homo sapiens
gtttggaatttaaga

SEQ ID NO: 1937212 - DNA, 22 bp, Homo sapiens
gtttgggaatggtgcccttgga

SEQ ID NO: 1937213 - DNA, 18 bp, Homo sapiens
gtttgtccacacaagaca

SEQ ID NO: 1937214 - DNA, 20 bp, Homo sapiens
gttttattgagttctgaagg

SEQ ID NO: 1937215 - DNA, 18 bp, Homo sapiens
gtttttggtttttaaaac

SEQ ID NO: 1937216 - DNA, 20 bp, Homo sapiens
gtttttttttcctgtccttc

SEQ ID NO: 1937217 - DNA, 15 bp, Homo sapiens
taaaaacacctaagt

SEQ ID NO: 1937218 - DNA, 14 bp, Homo sapiens
taaaaatatgtgag

SEQ ID NO: 1937219 - DNA, 16 bp, Homo sapiens
taaaaatatgtgagca

SEQ ID NO: 1937220 - DNA, 17 bp, Homo sapiens
taaaaattgtgatcaga

SEQ ID NO: 1937221 - DNA, 18 bp, Homo sapiens
taaaaccaaagaatagtt

SEQ ID NO: 1937222 - DNA, 13 bp, Homo sapiens
taaaactttaatc

SEQ ID NO: 1937223 - DNA, 20 bp, Homo sapiens
taaaaggaggacagggaggg

SEQ ID NO: 1937224 - DNA, 17 bp, Homo sapiens
taaaagttttaacctca

SEQ ID NO: 1937225 - DNA, 18 bp, Homo sapiens
tacagtcttccatttgca

SEQ ID NO: 1937226 - DNA, 14 bp, Homo sapiens
tacatacattgtat

SEQ ID NO: 1937227 - DNA, 16 bp, Homo sapiens
tacatgacatttattt

SEQ ID NO: 1937228 - DNA, 14 bp, Homo sapiens
tacatggtagcagg

SEQ ID NO: 1937229 - DNA, 21 bp, Homo sapiens
tacatttggctccactgtaaa

SEQ ID NO: 1937230 - DNA, 15 bp, Homo sapiens
tacattttgtgcagt

SEQ ID NO: 1937231 - DNA, 16 bp, Homo sapiens
tacattttgtgcagtg

SEQ ID NO: 1937232 - DNA, 17 bp, Homo sapiens
tacattttgtgcagtga

SEQ ID NO: 1937233 - DNA, 18 bp, Homo sapiens
taccaaaattatttcaga

SEQ ID NO: 1937234 - DNA, 23 bp, Homo sapiens
taccaaaattatttcagaaatgt

SEQ ID NO: 1937235 - DNA, 15 bp, Homo sapiens
taccaatcattttaa

SEQ ID NO: 1937236 - DNA, 19 bp, Homo sapiens
taccaatcattttaattat

SEQ ID NO: 1937237 - DNA, 22 bp, Homo sapiens
taccaatcattttaattattat

SEQ ID NO: 1937238 - DNA, 15 bp, Homo sapiens
taccaatgaaaaaat

SEQ ID NO: 1937239 - DNA, 17 bp, Homo sapiens
taccaatgaaaaaatgt

SEQ ID NO: 1937240 - DNA, 13 bp, Homo sapiens
taccacctgtaca

SEQ ID NO: 1937241 - DNA, 15 bp, Homo sapiens
taccacttatttcta

SEQ ID NO: 1937242 - DNA, 16 bp, Homo sapiens
taccacttatttctaa

SEQ ID NO: 1937243 - DNA, 18 bp, Homo sapiens
taccagagcacagattca

SEQ ID NO: 1937244 - DNA, 15 bp, Homo sapiens
taccagcgaggaggc

SEQ ID NO: 1937245 - DNA, 18 bp, Homo sapiens
taccaggggttccccagg

SEQ ID NO: 1937246 - DNA, 20 bp, Homo sapiens
taccattttgcgatgtgttt

SEQ ID NO: 1937247 - DNA, 13 bp, Homo sapiens
tatctgaggtcac

SEQ ID NO: 1937248 - DNA, 15 bp, Homo sapiens
tatctgtctgagccc

SEQ ID NO: 1937249 - DNA, 18 bp, Homo sapiens
tatgaacggtgagcattg

SEQ ID NO: 1937250 - DNA, 18 bp, Homo sapiens
tatgaataaagacaccta

SEQ ID NO: 1937251 - DNA, 16 bp, Homo sapiens
tatgaatgatatcttt

SEQ ID NO: 1937252 - DNA, 22 bp, Homo sapiens
tatgaggcaaccacaggcagca

SEQ ID NO: 1937253 - DNA, 16 bp, Homo sapiens
tatgattctcctctcc

SEQ ID NO: 1937254 - DNA, 18 bp, Homo sapiens
tatgatttggaaaataaa

SEQ ID NO: 1937255 - DNA, 19 bp, Homo sapiens
tatgcacttataattttcc

SEQ ID NO: 1937256 - DNA, 17 bp, Homo sapiens
tatgcatctaataaaaa

SEQ ID NO: 1937257 - DNA, 21 bp, Homo sapiens
tatgcatttaaatacagtctt

SEQ ID NO: 1937258 - DNA, 22 bp, Homo sapiens
tatgcatttaaatacagtcttc

SEQ ID NO: 1937259 - DNA, 15 bp, Homo sapiens
tatgccacctgcagc

SEQ ID NO: 1937260 - DNA, 23 bp, Homo sapiens
tatggaaagggtgtggcttggaa

SEQ ID NO: 1937261 - DNA, 18 bp, Homo sapiens
tatggcttgtagggtgag

SEQ ID NO: 1937262 - DNA, 17 bp, Homo sapiens
tatgtaaattataagta

SEQ ID NO: 1937263 - DNA, 12 bp, Homo sapiens
tatgtatataaa

SEQ ID NO: 1937264 - DNA, 18 bp, Homo sapiens
tatgtgagcatgaaacta

SEQ ID NO: 1937265 - DNA, 22 bp, Homo sapiens
tatgtgagcatgaaactatgca

SEQ ID NO: 1937266 - DNA, 14 bp, Homo sapiens
tatgttgataaaag

SEQ ID NO: 1937267 - DNA, 21 bp, Homo sapiens
tattaaatcagaatctttaaa

SEQ ID NO: 1937268 - DNA, 17 bp, Homo sapiens
tattacttttctgcaat

SEQ ID NO: 1937269 - DNA, 15 bp, Homo sapiens
tattacttttgtaaa

SEQ ID NO: 1937270 - DNA, 17 bp, Homo sapiens
tattacttttgtaaata

SEQ ID NO: 1937271 - DNA, 18 bp, Homo sapiens
tattagcattttcaagaa

SEQ ID NO: 1937272 - DNA, 15 bp, Homo sapiens
tattatcaacaatag

SEQ ID NO: 1937273 - DNA, 12 bp, Homo sapiens
tattcaatctta

SEQ ID NO: 1937274 - DNA, 22 bp, Homo sapiens
tattcacagtgaacataactgt

SEQ ID NO: 1937275 - DNA, 15 bp, Homo sapiens
tattcacttgtgttt

SEQ ID NO: 1937276 - DNA, 21 bp, Homo sapiens
tattcacttgtgtttgtatat

SEQ ID NO: 1937277 - DNA, 18 bp, Homo sapiens
tattctatgtaaaaatat

SEQ ID NO: 1937278 - DNA, 15 bp, Homo sapiens
tattcttaagcactt

SEQ ID NO: 1937279 - DNA, 19 bp, Homo sapiens
tattcttgtccacattcta

SEQ ID NO: 1937280 - DNA, 23 bp, Homo sapiens
tattgggagtaggagttgctcct

SEQ ID NO: 1937281 - DNA, 18 bp, Homo sapiens
tattgtaaactttttcaa

SEQ ID NO: 1937282 - DNA, 17 bp, Homo sapiens
tattgtccattgtccaa

SEQ ID NO: 1937283 - DNA, 12 bp, Homo sapiens
tattgtttcaat

SEQ ID NO: 1937284 - DNA, 18 bp, Homo sapiens
tattgtttcaattgcatc

SEQ ID NO: 1937285 - DNA, 11 bp, Homo sapiens
tatttaaaata

SEQ ID NO: 1937286 - DNA, 15 bp, Homo sapiens
tatttaaaatagttc

SEQ ID NO: 1937287 - DNA, 21 bp, Homo sapiens
tatttacatgaattgcatttt

SEQ ID NO: 1937288 - DNA, 16 bp, Homo sapiens
tatttataaatatatt

SEQ ID NO: 1937289 - DNA, 17 bp, Homo sapiens
tatttataaatatattt

SEQ ID NO: 1937290 - DNA, 17 bp, Homo sapiens
tatttatctgtctgagc

SEQ ID NO: 1937291 - DNA, 15 bp, Homo sapiens
tatttctatgtaaat

SEQ ID NO: 1937292 - DNA, 23 bp, Homo sapiens
tatttctgtctcataattgtcaa

SEQ ID NO: 1937293 - DNA, 21 bp, Homo sapiens
tatttgcataacaattcctct

SEQ ID NO: 1937294 - DNA, 20 bp, Homo sapiens
tattttctatatttgtaact

SEQ ID NO: 1937295 - DNA, 19 bp, Homo sapiens
tattttggggaactgttgt

SEQ ID NO: 1937296 - DNA, 13 bp, Homo sapiens
tatttttggactt

SEQ ID NO: 1937297 - DNA, 12 bp, Homo sapiens
tattttttaaag

SEQ ID NO: 1937298 - DNA, 15 bp, Homo sapiens
tattttttaattatt

SEQ ID NO: 1937299 - DNA, 15 bp, Homo sapiens
tatttttttgttgct

SEQ ID NO: 1937300 - DNA, 18 bp, Homo sapiens
tatttttttgttgctgtt

SEQ ID NO: 1937301 - DNA, 16 bp, Homo sapiens
tcaaaaacatggccac

SEQ ID NO: 1937302 - DNA, 15 bp, Homo sapiens
tcaaaaccttttgaa

SEQ ID NO: 1937303 - DNA, 15 bp, Homo sapiens
tcaaacgtgaaaatg

SEQ ID NO: 1937304 - DNA, 16 bp, Homo sapiens
tcaaacgtgaaaatgc

SEQ ID NO: 1937305 - DNA, 17 bp, Homo sapiens
tcaaagaacccccctcc

SEQ ID NO: 1937306 - DNA, 15 bp, Homo sapiens
tcaaagcaaggaaac

SEQ ID NO: 1937307 - DNA, 20 bp, Homo sapiens
tcaaagcaaggaaactatgt

SEQ ID NO: 1937308 - DNA, 20 bp, Homo sapiens
tcaaagtccaactacagcca

SEQ ID NO: 1937309 - DNA, 18 bp, Homo sapiens
tcaacaaaaattgtccct

SEQ ID NO: 1937310 - DNA, 15 bp, Homo sapiens
tcaaccattccccat

SEQ ID NO: 1937311 - DNA, 18 bp, Homo sapiens
tcaaccattccccatggg

SEQ ID NO: 1937312 - DNA, 22 bp, Homo sapiens
tcaaccattgaagggggatgca

SEQ ID NO: 1937313 - DNA, 14 bp, Homo sapiens
tcaacgcagccctg

SEQ ID NO: 1937314 - DNA, 22 bp, Homo sapiens
tcaagattcccggctggacttt

SEQ ID NO: 1937315 - DNA, 17 bp, Homo sapiens
tcaagcagattggagaa

SEQ ID NO: 1937316 - DNA, 13 bp, Homo sapiens
tcaagccaggaga

SEQ ID NO: 1937317 - DNA, 19 bp, Homo sapiens
tcaagccaggagaccctgt

SEQ ID NO: 1937318 - DNA, 11 bp, Homo sapiens
tcaagcttgtg

SEQ ID NO: 1937319 - DNA, 14 bp, Homo sapiens
tcaagcttgtgtac

SEQ ID NO: 1937320 - DNA, 17 bp, Homo sapiens
tcaagcttgtgtacttg

SEQ ID NO: 1937321 - DNA, 15 bp, Homo sapiens
tcaaggaatgttatc

SEQ ID NO: 1937322 - DNA, 20 bp, Homo sapiens
tcaagggactgggggtgcca

SEQ ID NO: 1937323 - DNA, 21 bp, Homo sapiens
tcaagttccgtctcctctcca

SEQ ID NO: 1937324 - DNA, 16 bp, Homo sapiens
tcaagtttttttcaaa

SEQ ID NO: 1937325 - DNA, 18 bp, Homo sapiens
tcaatacccttggcactg

SEQ ID NO: 1937326 - DNA, 20 bp, Homo sapiens
tcaatacccttggcactgat

SEQ ID NO: 1937327 - DNA, 21 bp, Homo sapiens
tcaatggttgggacaatggca

SEQ ID NO: 1937328 - DNA, 18 bp, Homo sapiens
tcaatgtttcttctaggt

SEQ ID NO: 1937329 - DNA, 19 bp, Homo sapiens
tcacaaagttgtttaacta

SEQ ID NO: 1937330 - DNA, 16 bp, Homo sapiens
tcacaacacaatcaaa

SEQ ID NO: 1937331 - DNA, 16 bp, Homo sapiens
tcacactgctgggaag

SEQ ID NO: 1937332 - DNA, 21 bp, Homo sapiens
tcacagaacccttggagccaa

SEQ ID NO: 1937333 - DNA, 23 bp, Homo sapiens
tcacagatgtgtgattcacagtg

SEQ ID NO: 1937334 - DNA, 15 bp, Homo sapiens
tcacagattttttct

SEQ ID NO: 1937335 - DNA, 12 bp, Homo sapiens
tcacagcataac

SEQ ID NO: 1937336 - DNA, 13 bp, Homo sapiens
tcacatttaatat

SEQ ID NO: 1937337 - DNA, 16 bp, Homo sapiens
tcaccatctttctaat

SEQ ID NO: 1937338 - DNA, 17 bp, Homo sapiens
tcacccctccacccttg

SEQ ID NO: 1937339 - DNA, 15 bp, Homo sapiens
tcaccgtgggctccc

SEQ ID NO: 1937340 - DNA, 12 bp, Homo sapiens
tcacctcctaat

SEQ ID NO: 1937341 - DNA, 21 bp, Homo sapiens
tcactattcttaagcactttg

SEQ ID NO: 1937342 - DNA, 22 bp, Homo sapiens
tcactattcttaagcactttga

SEQ ID NO: 1937343 - DNA, 15 bp, Homo sapiens
tcactcctacctggt

SEQ ID NO: 1937344 - DNA, 22 bp, Homo sapiens
tcactgacactgcgaactctca

SEQ ID NO: 1937345 - DNA, 18 bp, Homo sapiens
tcactgagaaggccccag

SEQ ID NO: 1937346 - DNA, 19 bp, Homo sapiens
tcactgagaaggccccagg

SEQ ID NO: 1937347 - DNA, 24 bp, Homo sapiens
tcactgagaaggccccagggcagc

SEQ ID NO: 1937348 - DNA, 22 bp, Homo sapiens
tcactgcacagtgcatctcagc

SEQ ID NO: 1937349 - DNA, 21 bp, Homo sapiens
tcactgcccacctgccaggct

SEQ ID NO: 1937350 - DNA, 18 bp, Homo sapiens
tcactgctggctgcctta

SEQ ID NO: 1937351 - DNA, 20 bp, Homo sapiens
tcactggcgacacgtagcag

SEQ ID NO: 1937352 - DNA, 16 bp, Homo sapiens
tcacttgtgtttgtat

SEQ ID NO: 1937353 - DNA, 18 bp, Homo sapiens
tcacttgtgtttgtatat

SEQ ID NO: 1937354 - DNA, 23 bp, Homo sapiens
tcacttgtgtttgtatataaatg

SEQ ID NO: 1937355 - DNA, 16 bp, Homo sapiens
tcactttaataataaa

SEQ ID NO: 1937356 - DNA, 18 bp, Homo sapiens
tcacttttgacaaaggca

SEQ ID NO: 1937357 - DNA, 18 bp, Homo sapiens
tcagaaagcatctattcc

SEQ ID NO: 1937358 - DNA, 21 bp, Homo sapiens
tcagaaagcatctattcccaa

SEQ ID NO: 1937359 - DNA, 23 bp, Homo sapiens
tcagaaagggcagcccctcccca

SEQ ID NO: 1937360 - DNA, 16 bp, Homo sapiens
tcagaacagtctgaaa

SEQ ID NO: 1937361 - DNA, 17 bp, Homo sapiens
tcagagaggagtcagag

SEQ ID NO: 1937362 - DNA, 12 bp, Homo sapiens
tcagagcccagg

SEQ ID NO: 1937363 - DNA, 18 bp, Homo sapiens
tcagattagggcggggag

SEQ ID NO: 1937364 - DNA, 18 bp, Homo sapiens
tcagcagtgattgaagta

SEQ ID NO: 1937365 - DNA, 20 bp, Homo sapiens
tcagcattctcactcctacc

SEQ ID NO: 1937366 - DNA, 14 bp, Homo sapiens
tcagccattcacaa

SEQ ID NO: 1937367 - DNA, 23 bp, Homo sapiens
tcagccctagggtggagagccac

SEQ ID NO: 1937368 - DNA, 16 bp, Homo sapiens
tcagccctccctgccc

SEQ ID NO: 1937369 - DNA, 17 bp, Homo sapiens
tcagccctccctgcccc

SEQ ID NO: 1937370 - DNA, 19 bp, Homo sapiens
tcagccctccctgcccctc

SEQ ID NO: 1937371 - DNA, 15 bp, Homo sapiens
tcagccctgctgtca

SEQ ID NO: 1937372 - DNA, 22 bp, Homo sapiens
tcagcctccggatgacacaaat

SEQ ID NO: 1937373 - DNA, 15 bp, Homo sapiens
tcaggaaaggaatca

SEQ ID NO: 1937374 - DNA, 17 bp, Homo sapiens
tcaggaaggatgagcat

SEQ ID NO: 1937375 - DNA, 20 bp, Homo sapiens
tcaggaaggatgagcattta

SEQ ID NO: 1937376 - DNA, 12 bp, Homo sapiens
tcaggaatgggc

SEQ ID NO: 1937377 - DNA, 15 bp, Homo sapiens
tcaggacccagagga

SEQ ID NO: 1937378 - DNA, 19 bp, Homo sapiens
tcaggacccagaggaaggg

SEQ ID NO: 1937379 - DNA, 23 bp, Homo sapiens
tcagggatagcactgagcaaagc

SEQ ID NO: 1937380 - DNA, 15 bp, Homo sapiens
tcaggtcagagccca

SEQ ID NO: 1937381 - DNA, 20 bp, Homo sapiens
tcaggtcagagcccaggaat

SEQ ID NO: 1937382 - DNA, 18 bp, Homo sapiens
tcaggtcagggtgaggat

SEQ ID NO: 1937383 - DNA, 23 bp, Homo sapiens
tctcccagataatgtgaaaatgg

SEQ ID NO: 1937384 - DNA, 19 bp, Homo sapiens
tctcccctccagaccccta

SEQ ID NO: 1937385 - DNA, 17 bp, Homo sapiens
tctcccgaatcctgagg

SEQ ID NO: 1937386 - DNA, 21 bp, Homo sapiens
tctccctacttagacccagtc

SEQ ID NO: 1937387 - DNA, 11 bp, Homo sapiens
tctccctccac

SEQ ID NO: 1937388 - DNA, 14 bp, Homo sapiens
tctccctccactcc

SEQ ID NO: 1937389 - DNA, 15 bp, Homo sapiens
tctccctccactcct

SEQ ID NO: 1937390 - DNA, 16 bp, Homo sapiens
tctccctccactcctc

SEQ ID NO: 1937391 - DNA, 20 bp, Homo sapiens
tctccctccactcctcccaa

SEQ ID NO: 1937392 - DNA, 15 bp, Homo sapiens
tctccctggccccag

SEQ ID NO: 1937393 - DNA, 22 bp, Homo sapiens
tctcctaaaataaacatgaagc

SEQ ID NO: 1937394 - DNA, 14 bp, Homo sapiens
tctcctctccagcc

SEQ ID NO: 1937395 - DNA, 16 bp, Homo sapiens
tctcctctctctccct

SEQ ID NO: 1937396 - DNA, 19 bp, Homo sapiens
tctcctctctctccctcca

SEQ ID NO: 1937397 - DNA, 15 bp, Homo sapiens
tctcgaagtcttcca

SEQ ID NO: 1937398 - DNA, 21 bp, Homo sapiens
tctcgaagtcttccatcagca

SEQ ID NO: 1937399 - DNA, 21 bp, Homo sapiens
tctcggctggaagaacatcaa

SEQ ID NO: 1937400 - DNA, 16 bp, Homo sapiens
tctctcacctacttcc

SEQ ID NO: 1937401 - DNA, 12 bp, Homo sapiens
tctctccctcca

SEQ ID NO: 1937402 - DNA, 16 bp, Homo sapiens
tctctccctccactcc

SEQ ID NO: 1937403 - DNA, 20 bp, Homo sapiens
tctctccctccactcctccc

SEQ ID NO: 1937404 - DNA, 21 bp, Homo sapiens
tctctccctccactcctccca

SEQ ID NO: 1937405 - DNA, 13 bp, Homo sapiens
tctctctccctcc

SEQ ID NO: 1937406 - DNA, 16 bp, Homo sapiens
tctctctccctccact

SEQ ID NO: 1937407 - DNA, 18 bp, Homo sapiens
tctctgctctgcgtgtca

SEQ ID NO: 1937408 - DNA, 22 bp, Homo sapiens
tctctgctctgcgtgtcacctg

SEQ ID NO: 1937409 - DNA, 13 bp, Homo sapiens
tctctggacctga

SEQ ID NO: 1937410 - DNA, 14 bp, Homo sapiens
tctctggagtgtgt

SEQ ID NO: 1937411 - DNA, 18 bp, Homo sapiens
tctctgtaaaatgaactg

SEQ ID NO: 1937412 - DNA, 14 bp, Homo sapiens
tctctgtctcatcc

SEQ ID NO: 1937413 - DNA, 15 bp, Homo sapiens
tctctgtctcatcca

SEQ ID NO: 1937414 - DNA, 16 bp, Homo sapiens
tctctgtctcatccat

SEQ ID NO: 1937415 - DNA, 23 bp, Homo sapiens
tctctgtctcatccatcatcatg

SEQ ID NO: 1937416 - DNA, 17 bp, Homo sapiens
tctctgtttaccctccc

SEQ ID NO: 1937417 - DNA, 15 bp, Homo sapiens
tctcttctccactgg

SEQ ID NO: 1937418 - DNA, 16 bp, Homo sapiens
tctcttctccactgga

SEQ ID NO: 1937419 - DNA, 21 bp, Homo sapiens
tctctttcttccactaccctc

SEQ ID NO: 1937420 - DNA, 19 bp, Homo sapiens
tctcttttcaaacacacac

SEQ ID NO: 1937421 - DNA, 15 bp, Homo sapiens
tctgaaaccagtgtt

SEQ ID NO: 1937422 - DNA, 15 bp, Homo sapiens
tctgaaagctgcttc

SEQ ID NO: 1937423 - DNA, 16 bp, Homo sapiens
tctgaaagctgcttct

SEQ ID NO: 1937424 - DNA, 13 bp, Homo sapiens
tctgaaggagagg

SEQ ID NO: 1937425 - DNA, 14 bp, Homo sapiens
tctgaaggagagga

SEQ ID NO: 1937426 - DNA, 15 bp, Homo sapiens
tctgaaggagaggag

SEQ ID NO: 1937427 - DNA, 15 bp, Homo sapiens
tctgaagtcactgca

SEQ ID NO: 1937428 - DNA, 15 bp, Homo sapiens
tctgacttctcagga

SEQ ID NO: 1937429 - DNA, 18 bp, Homo sapiens
tctgacttctcaggaaga

SEQ ID NO: 1937430 - DNA, 21 bp, Homo sapiens
tctgagccaccgcgagggcct

SEQ ID NO: 1937431 - DNA, 15 bp, Homo sapiens
tctgagccaggagcc

SEQ ID NO: 1937432 - DNA, 15 bp, Homo sapiens
tctgagcggccgcct

SEQ ID NO: 1937433 - DNA, 20 bp, Homo sapiens
tctgagcggccgcctgtcct

SEQ ID NO: 1937434 - DNA, 16 bp, Homo sapiens
tctgagtattcatttt

SEQ ID NO: 1937435 - DNA, 21 bp, Homo sapiens
tctgatattggtgtgaatgct

SEQ ID NO: 1937436 - DNA, 21 bp, Homo sapiens
tctgatccctctacagagctt

SEQ ID NO: 1937437 - DNA, 14 bp, Homo sapiens
tctgcaacagcctg

SEQ ID NO: 1937438 - DNA, 15 bp, Homo sapiens
tctgcaacagcctgt

SEQ ID NO: 1937439 - DNA, 16 bp, Homo sapiens
tctgcaacagcctgtt

SEQ ID NO: 1937440 - DNA, 15 bp, Homo sapiens
tctgcagggcagcct

SEQ ID NO: 1937441 - DNA, 16 bp, Homo sapiens
tctgcagggcagcctg

SEQ ID NO: 1937442 - DNA, 17 bp, Homo sapiens
tctgcagggcagcctgt

SEQ ID NO: 1937443 - DNA, 16 bp, Homo sapiens
tctgcattctagtact

SEQ ID NO: 1937444 - DNA, 14 bp, Homo sapiens
tctgcctcttctgg

SEQ ID NO: 1937445 - DNA, 16 bp, Homo sapiens
tctgcgccgctgtgct

SEQ ID NO: 1937446 - DNA, 22 bp, Homo sapiens
tctgcgccgctgtgctgttgtc

SEQ ID NO: 1937447 - DNA, 22 bp, Homo sapiens
tctgctaagctcaaggcgtgag

SEQ ID NO: 1937448 - DNA, 21 bp, Homo sapiens
tctgctcacattccctctcat

SEQ ID NO: 1937449 - DNA, 22 bp, Homo sapiens
tctgctcacattccctctcatc

SEQ ID NO: 1937450 - DNA, 23 bp, Homo sapiens
tctgctcacattccctctcatcc

SEQ ID NO: 1937451 - DNA, 14 bp, Homo sapiens
tctgctcatcattc

SEQ ID NO: 1937452 - DNA, 18 bp, Homo sapiens
tctgctcatcattctctg

SEQ ID NO: 1937453 - DNA, 13 bp, Homo sapiens
tctgctcctggga

SEQ ID NO: 1937454 - DNA, 21 bp, Homo sapiens
tctgctgtaataatattttag

SEQ ID NO: 1937455 - DNA, 13 bp, Homo sapiens
tctggacctgacc

SEQ ID NO: 1937456 - DNA, 16 bp, Homo sapiens
tctggagcccctatcc

SEQ ID NO: 1937457 - DNA, 21 bp, Homo sapiens
tctggagtctgaaggagagga

SEQ ID NO: 1937458 - DNA, 14 bp, Homo sapiens
tctggccaaatatg

SEQ ID NO: 1937459 - DNA, 13 bp, Homo sapiens
tctggccctgttg

SEQ ID NO: 1937460 - DNA, 20 bp, Homo sapiens
tctggccttggttcctccag

SEQ ID NO: 1937461 - DNA, 22 bp, Homo sapiens
tctggccttggttcctccagca

SEQ ID NO: 1937462 - DNA, 15 bp, Homo sapiens
tctggctggagagga

SEQ ID NO: 1937463 - DNA, 15 bp, Homo sapiens
tctggctgtggcccc

SEQ ID NO: 1937464 - DNA, 13 bp, Homo sapiens
tctgggaggcagg

SEQ ID NO: 1937465 - DNA, 13 bp, Homo sapiens
tctgggagggcag

SEQ ID NO: 1937466 - DNA, 19 bp, Homo sapiens
tctgggagggcagcagggc

SEQ ID NO: 1937467 - DNA, 18 bp, Homo sapiens
tctgggccaagtcaaaga

SEQ ID NO: 1937468 - DNA, 19 bp, Homo sapiens
tctggggtggggcttggaa

SEQ ID NO: 1937469 - DNA, 20 bp, Homo sapiens
tctggggtggggcttggaag

SEQ ID NO: 1937470 - DNA, 23 bp, Homo sapiens
tctgtaaatatcccagagaacaa

SEQ ID NO: 1937471 - DNA, 13 bp, Homo sapiens
tctgtaacccttg

SEQ ID NO: 1937472 - DNA, 20 bp, Homo sapiens
tctgtaacccttgaatttct

SEQ ID NO: 1937473 - DNA, 20 bp, Homo sapiens
tctgtagggtaattagtaac

SEQ ID NO: 1937474 - DNA, 22 bp, Homo sapiens
tctgtattctgcaacagcctgt

SEQ ID NO: 1937475 - DNA, 13 bp, Homo sapiens
tctgtcccgggta

SEQ ID NO: 1937476 - DNA, 17 bp, Homo sapiens
tctgtctcatccatcat

SEQ ID NO: 1937477 - DNA, 11 bp, Homo sapiens
tctgtctgagc

SEQ ID NO: 1937478 - DNA, 22 bp, Homo sapiens
tctgtctgagccctgccctcac

SEQ ID NO: 1937479 - DNA, 23 bp, Homo sapiens
tctgtgatgtcagtagtgcctgt

SEQ ID NO: 1937480 - DNA, 16 bp, Homo sapiens
tctgtgcaatggaata

SEQ ID NO: 1937481 - DNA, 15 bp, Homo sapiens
tctgtggcctggggc

SEQ ID NO: 1937482 - DNA, 16 bp, Homo sapiens
tctgttaatgttaatt

SEQ ID NO: 1937483 - DNA, 17 bp, Homo sapiens
tctgtttaaagtagatt

SEQ ID NO: 1937484 - DNA, 24 bp, Homo sapiens
tctgtttaccctccctgtcccctg

SEQ ID NO: 1937485 - DNA, 21 bp, Homo sapiens
tcttaagagaatccacataaa

SEQ ID NO: 1937486 - DNA, 12 bp, Homo sapiens
tcttaagcactt

SEQ ID NO: 1937487 - DNA, 16 bp, Homo sapiens
tcttaagcactttgaa

SEQ ID NO: 1937488 - DNA, 14 bp, Homo sapiens
tcttacccacacta

SEQ ID NO: 1937489 - DNA, 21 bp, Homo sapiens
tcttagggtacagcccaggcg

SEQ ID NO: 1937490 - DNA, 16 bp, Homo sapiens
tcttatttaaattttc

SEQ ID NO: 1937491 - DNA, 20 bp, Homo sapiens
tcttcaaatcttaagagaat

SEQ ID NO: 1937492 - DNA, 13 bp, Homo sapiens
tcttccacagcaa

SEQ ID NO: 1937493 - DNA, 19 bp, Homo sapiens
tcttccacagcaaatgaga

SEQ ID NO: 1937494 - DNA, 14 bp, Homo sapiens
tcttcccaaggcca

SEQ ID NO: 1937495 - DNA, 12 bp, Homo sapiens
tcttcccccttc

SEQ ID NO: 1937496 - DNA, 14 bp, Homo sapiens
tcttcccccttccc

SEQ ID NO: 1937497 - DNA, 23 bp, Homo sapiens
tcttcccccttcccctgcgccct

SEQ ID NO: 1937498 - DNA, 24 bp, Homo sapiens
tcttcccccttcccctgcgccctc

SEQ ID NO: 1937499 - DNA, 14 bp, Homo sapiens
tcttctcctttcac

SEQ ID NO: 1937500 - DNA, 14 bp, Homo sapiens
tcttctctctttgt

SEQ ID NO: 1937501 - DNA, 13 bp, Homo sapiens
tcttcttcaccat

SEQ ID NO: 1937502 - DNA, 15 bp, Homo sapiens
tcttcttcaccattt

SEQ ID NO: 1937503 - DNA, 13 bp, Homo sapiens
tcttcttctcaag

SEQ ID NO: 1937504 - DNA, 15 bp, Homo sapiens
tcttctttcatgtaa

SEQ ID NO: 1937505 - DNA, 22 bp, Homo sapiens
tcttctttcatgtaagtagcaa

SEQ ID NO: 1937506 - DNA, 13 bp, Homo sapiens
tcttgaatttaat

SEQ ID NO: 1937507 - DNA, 21 bp, Homo sapiens
tcttgaatttaataatctgta

SEQ ID NO: 1937508 - DNA, 14 bp, Homo sapiens
tcttgagagcccca

SEQ ID NO: 1937509 - DNA, 18 bp, Homo sapiens
tcttgagagcgctggcct

SEQ ID NO: 1937510 - DNA, 14 bp, Homo sapiens
tcttgagatctgct

SEQ ID NO: 1937511 - DNA, 15 bp, Homo sapiens
tcttgagtgggcccc

SEQ ID NO: 1937512 - DNA, 18 bp, Homo sapiens
tcttgagtgggccccctc

SEQ ID NO: 1937513 - DNA, 12 bp, Homo sapiens
tcttggagagga

SEQ ID NO: 1937514 - DNA, 21 bp, Homo sapiens
tcttggattggtaccagagcc

SEQ ID NO: 1937515 - DNA, 14 bp, Homo sapiens
tcttgtttcaattc

SEQ ID NO: 1937516 - DNA, 19 bp, Homo sapiens
tcttgttttgttatataaa

SEQ ID NO: 1937517 - DNA, 18 bp, Homo sapiens
tcttgttttttttttcca

SEQ ID NO: 1937518 - DNA, 16 bp, Homo sapiens
tctttaaataaaaata

SEQ ID NO: 1937519 - DNA, 11 bp, Homo sapiens
tctttcaaaac

SEQ ID NO: 1937520 - DNA, 21 bp, Homo sapiens
tctttcatgtaagtagcaaac

SEQ ID NO: 1937521 - DNA, 22 bp, Homo sapiens
tctttccacggagccactcctc

SEQ ID NO: 1937522 - DNA, 15 bp, Homo sapiens
tctttcctgtgccag

SEQ ID NO: 1937523 - DNA, 22 bp, Homo sapiens
tctttcttccactaccctccct

SEQ ID NO: 1937524 - DNA, 17 bp, Homo sapiens
tctttgaaatatgcatg

SEQ ID NO: 1937525 - DNA, 18 bp, Homo sapiens
tctttgaaatatgcatgt

SEQ ID NO: 1937526 - DNA, 19 bp, Homo sapiens
tctttgctgtttatatata

SEQ ID NO: 1937527 - DNA, 21 bp, Homo sapiens
tctttgtcccggataggctaa

SEQ ID NO: 1937528 - DNA, 24 bp, Homo sapiens
tctttgtcccggataggctaatca

SEQ ID NO: 1937529 - DNA, 13 bp, Homo sapiens
tctttgtgtgctg

SEQ ID NO: 1937530 - DNA, 15 bp, Homo sapiens
tcttttaatgatact

SEQ ID NO: 1937531 - DNA, 21 bp, Homo sapiens
tcttttaatgatactgtctaa

SEQ ID NO: 1937532 - DNA, 18 bp, Homo sapiens
tgaaaacactgtgcacat

SEQ ID NO: 1937533 - DNA, 18 bp, Homo sapiens
tgaaaacagaaaacggtt

SEQ ID NO: 1937534 - DNA, 16 bp, Homo sapiens
aactactgtacatttt

SEQ ID NO: 1937535 - DNA, 16 bp, Homo sapiens
aactatgatttggaaa

SEQ ID NO: 1937536 - DNA, 21 bp, Homo sapiens
aactatgatttggaaaataaa

SEQ ID NO: 1937537 - DNA, 16 bp, Homo sapiens
aactctgcattctagt

SEQ ID NO: 1937538 - DNA, 23 bp, Homo sapiens
aactctggccttggttcctccag

SEQ ID NO: 1937539 - DNA, 21 bp, Homo sapiens
aactcttcatcttaaactaca

SEQ ID NO: 1937540 - DNA, 14 bp, Homo sapiens
aactctttgagaaa

SEQ ID NO: 1937541 - DNA, 13 bp, Homo sapiens
aactgagtcctgt

SEQ ID NO: 1937542 - DNA, 15 bp, Homo sapiens
aactgagtcctgttc

SEQ ID NO: 1937543 - DNA, 17 bp, Homo sapiens
aactgccttaaaacttt

SEQ ID NO: 1937544 - DNA, 20 bp, Homo sapiens
aactgcttgcatttctttat

SEQ ID NO: 1937545 - DNA, 19 bp, Homo sapiens
aactgttgtttgatgtgta

SEQ ID NO: 1937546 - DNA, 22 bp, Homo sapiens
aactgttgtttgatgtgtatgt

SEQ ID NO: 1937547 - DNA, 19 bp, Homo sapiens
aacttacctgggcattctt

SEQ ID NO: 1937548 - DNA, 13 bp, Homo sapiens
aacttcccaggcc

SEQ ID NO: 1937549 - DNA, 15 bp, Homo sapiens
aacttgtgctatagt

SEQ ID NO: 1937550 - DNA, 15 bp, Homo sapiens
aacttgtgttactaa

SEQ ID NO: 1937551 - DNA, 11 bp, Homo sapiens
aactttagaaa

SEQ ID NO: 1937552 - DNA, 17 bp, Homo sapiens
aactttagaaagaaatt

SEQ ID NO: 1937553 - DNA, 13 bp, Homo sapiens
aactttgcatgtt

SEQ ID NO: 1937554 - DNA, 16 bp, Homo sapiens
aactttgcatgttctt

SEQ ID NO: 1937555 - DNA, 21 bp, Homo sapiens
aactttgcatgttcttgtttt

SEQ ID NO: 1937556 - DNA, 22 bp, Homo sapiens
aactttgcatgttcttgttttg

SEQ ID NO: 1937557 - DNA, 13 bp, Homo sapiens
aagaaaggcagag

SEQ ID NO: 1937558 - DNA, 19 bp, Homo sapiens
aagaacaccctatattttg

SEQ ID NO: 1937559 - DNA, 21 bp, Homo sapiens
aagaacaccctatattttgca

SEQ ID NO: 1937560 - DNA, 14 bp, Homo sapiens
aagaacccccctcc

SEQ ID NO: 1937561 - DNA, 22 bp, Homo sapiens
aagaagaaactattttttaaaa

SEQ ID NO: 1937562 - DNA, 17 bp, Homo sapiens
aagaattccatctatat

SEQ ID NO: 1937563 - DNA, 12 bp, Homo sapiens
aagacagaagcc

SEQ ID NO: 1937564 - DNA, 15 bp, Homo sapiens
aagacatgaatatga

SEQ ID NO: 1937565 - DNA, 19 bp, Homo sapiens
aagacatggggaggaagga

SEQ ID NO: 1937566 - DNA, 16 bp, Homo sapiens
aagacttttctttcct

SEQ ID NO: 1937567 - DNA, 17 bp, Homo sapiens
aagagactactctgcct

SEQ ID NO: 1937568 - DNA, 21 bp, Homo sapiens
aagagctcaggagaaggcctg

SEQ ID NO: 1937569 - DNA, 17 bp, Homo sapiens
aagaggagcctttccag

SEQ ID NO: 1937570 - DNA, 13 bp, Homo sapiens
aagagtagaaact

SEQ ID NO: 1937571 - DNA, 12 bp, Homo sapiens
aagataattata

SEQ ID NO: 1937572 - DNA, 20 bp, Homo sapiens
aagatcgtgaacataactga

SEQ ID NO: 1937573 - DNA, 13 bp, Homo sapiens
aagatgaaattgc

SEQ ID NO: 1937574 - DNA, 14 bp, Homo sapiens
aagattaacaacac

SEQ ID NO: 1937575 - DNA, 20 bp, Homo sapiens
aagcaacatgaattaagaac

SEQ ID NO: 1937576 - DNA, 19 bp, Homo sapiens
aagcacagaaggaggagga

SEQ ID NO: 1937577 - DNA, 22 bp, Homo sapiens
aagcactttgaaaatatttcta

SEQ ID NO: 1937578 - DNA, 21 bp, Homo sapiens
aagcagaccactgataaaacc

SEQ ID NO: 1937579 - DNA, 13 bp, Homo sapiens
aagcattcacaac

SEQ ID NO: 1937580 - DNA, 17 bp, Homo sapiens
aagccacgtgctggaga

SEQ ID NO: 1937581 - DNA, 17 bp, Homo sapiens
aagccagcgtcctcctc

SEQ ID NO: 1937582 - DNA, 11 bp, Homo sapiens
aagccaggaga

SEQ ID NO: 1937583 - DNA, 12 bp, Homo sapiens
aagccaggagac

SEQ ID NO: 1937584 - DNA, 15 bp, Homo sapiens
aagccaggccctctc

SEQ ID NO: 1937585 - DNA, 19 bp, Homo sapiens
aagccaggccctctctgca

SEQ ID NO: 1937586 - DNA, 13 bp, Homo sapiens
aatattgtccatt

SEQ ID NO: 1937587 - DNA, 13 bp, Homo sapiens
aatatttaaaata

SEQ ID NO: 1937588 - DNA, 22 bp, Homo sapiens
aatattttagaaaatgtttgga

SEQ ID NO: 1937589 - DNA, 22 bp, Homo sapiens
aatcaaaagattaacaacactg

SEQ ID NO: 1937590 - DNA, 13 bp, Homo sapiens
aatcaacttgtca

SEQ ID NO: 1937591 - DNA, 18 bp, Homo sapiens
aatcaacttgtcacaaag

SEQ ID NO: 1937592 - DNA, 22 bp, Homo sapiens
aatcaagttaatgtactttcat

SEQ ID NO: 1937593 - DNA, 21 bp, Homo sapiens
aatcaattctgatacagcctt

SEQ ID NO: 1937594 - DNA, 23 bp, Homo sapiens
aatcacagattttttctttaaat

SEQ ID NO: 1937595 - DNA, 11 bp, Homo sapiens
aatcacattca

SEQ ID NO: 1937596 - DNA, 17 bp, Homo sapiens
aatcacattcaggcatg

SEQ ID NO: 1937597 - DNA, 23 bp, Homo sapiens
aatcactattcttaagcactttg

SEQ ID NO: 1937598 - DNA, 20 bp, Homo sapiens
aatcagctccttcctggaga

SEQ ID NO: 1937599 - DNA, 17 bp, Homo sapiens
aatcagtgatgggagta

SEQ ID NO: 1937600 - DNA, 19 bp, Homo sapiens
aatcatttctatttctcct

SEQ ID NO: 1937601 - DNA, 20 bp, Homo sapiens
aatcattttaattattattc

SEQ ID NO: 1937602 - DNA, 15 bp, Homo sapiens
aatccctttcagttt

SEQ ID NO: 1937603 - DNA, 15 bp, Homo sapiens
aatcctagagattct

SEQ ID NO: 1937604 - DNA, 12 bp, Homo sapiens
aatcctgtcaat

SEQ ID NO: 1937605 - DNA, 21 bp, Homo sapiens
aatcctgtcctcagcttctta

SEQ ID NO: 1937606 - DNA, 20 bp, Homo sapiens
aatctctttttgctttcgaa

SEQ ID NO: 1937607 - DNA, 22 bp, Homo sapiens
aatctgtcacgtagaacttgga

SEQ ID NO: 1937608 - DNA, 20 bp, Homo sapiens
aatcttaagagaatccacat

SEQ ID NO: 1937609 - DNA, 16 bp, Homo sapiens
aatgaaaatgtcttgt

SEQ ID NO: 1937610 - DNA, 23 bp, Homo sapiens
aatgaatgtttacactctttgta

SEQ ID NO: 1937611 - DNA, 17 bp, Homo sapiens
aatgagaaggaatttga

SEQ ID NO: 1937612 - DNA, 18 bp, Homo sapiens
aatgagacttgttttccc

SEQ ID NO: 1937613 - DNA, 16 bp, Homo sapiens
aatgagagagtgtgga

SEQ ID NO: 1937614 - DNA, 14 bp, Homo sapiens
aatgagctgggccc

SEQ ID NO: 1937615 - DNA, 15 bp, Homo sapiens
aatgatactgtctaa

SEQ ID NO: 1937616 - DNA, 20 bp, Homo sapiens
aatgatactgtctaagaata

SEQ ID NO: 1937617 - DNA, 12 bp, Homo sapiens
aatgatatcttt

SEQ ID NO: 1937618 - DNA, 14 bp, Homo sapiens
aatgattcagtgtt

SEQ ID NO: 1937619 - DNA, 13 bp, Homo sapiens
aatgcataaaatg

SEQ ID NO: 1937620 - DNA, 12 bp, Homo sapiens
aatgctgtacct

SEQ ID NO: 1937621 - DNA, 21 bp, Homo sapiens
aatgcttctgacttcatagat

SEQ ID NO: 1937622 - DNA, 14 bp, Homo sapiens
aatggtccaggaga

SEQ ID NO: 1937623 - DNA, 19 bp, Homo sapiens
aatggtccaggagaaggcc

SEQ ID NO: 1937624 - DNA, 15 bp, Homo sapiens
aatggtcctgttatg

SEQ ID NO: 1937625 - DNA, 15 bp, Homo sapiens
aatggtgcccttgga

SEQ ID NO: 1937626 - DNA, 16 bp, Homo sapiens
aatggtgggctccaga

SEQ ID NO: 1937627 - DNA, 15 bp, Homo sapiens
aatgtactttcattc

SEQ ID NO: 1937628 - DNA, 22 bp, Homo sapiens
aatgtgaaaatggtccaggaga

SEQ ID NO: 1937629 - DNA, 12 bp, Homo sapiens
aatgtgatgaat

SEQ ID NO: 1937630 - DNA, 16 bp, Homo sapiens
aatgtgatgaatactg

SEQ ID NO: 1937631 - DNA, 20 bp, Homo sapiens
aatgtgatgaatactgtatt

SEQ ID NO: 1937632 - DNA, 11 bp, Homo sapiens
aatgtgcagta

SEQ ID NO: 1937633 - DNA, 16 bp, Homo sapiens
aatgtgcccagtcatg

SEQ ID NO: 1937634 - DNA, 21 bp, Homo sapiens
aatgtgcccagtcatgacatt

SEQ ID NO: 1937635 - DNA, 21 bp, Homo sapiens
aatgttgacctttgaggtcta

SEQ ID NO: 1937636 - DNA, 23 bp, Homo sapiens
aatgttggctagtctgtgcctca

SEQ ID NO: 1937637 - DNA, 15 bp, Homo sapiens
aatgtttggaattta

SEQ ID NO: 1937638 - DNA, 10 bp, Homo sapiens
aattaaaatg

SEQ ID NO: 1937639 - DNA, 23 bp, Homo sapiens
aattacaatttctttaaatcatt

SEQ ID NO: 1937640 - DNA, 14 bp, Homo sapiens
aattacagaagaag

SEQ ID NO: 1937641 - DNA, 20 bp, Homo sapiens
aattacagaagaagctcctg

SEQ ID NO: 1937642 - DNA, 17 bp, Homo sapiens
aattacagggaagaaat

SEQ ID NO: 1937643 - DNA, 18 bp, Homo sapiens
aattacagggaagaaatc

SEQ ID NO: 1937644 - DNA, 22 bp, Homo sapiens
aattaggtcaagttcatagttt

SEQ ID NO: 1937645 - DNA, 17 bp, Homo sapiens
aattagtaacatgtgtt

SEQ ID NO: 1937646 - DNA, 16 bp, Homo sapiens
aattataatatactat

SEQ ID NO: 1937647 - DNA, 22 bp, Homo sapiens
aattatagtgatgtaatcttga

SEQ ID NO: 1937648 - DNA, 13 bp, Homo sapiens
aattattatttat

SEQ ID NO: 1937649 - DNA, 16 bp, Homo sapiens
aattattccctgaatt

SEQ ID NO: 1937650 - DNA, 20 bp, Homo sapiens
aattattccctgaattgttt

SEQ ID NO: 1937651 - DNA, 22 bp, Homo sapiens
aattattccctgaattgtttga

SEQ ID NO: 1937652 - DNA, 14 bp, Homo sapiens
aattattgtaaact

SEQ ID NO: 1937653 - DNA, 21 bp, Homo sapiens
aattattgtaaactttttcaa

SEQ ID NO: 1937654 - DNA, 12 bp, Homo sapiens
aattatttgcat

SEQ ID NO: 1937655 - DNA, 17 bp, Homo sapiens
aattcaattaaaaccat

SEQ ID NO: 1937656 - DNA, 22 bp, Homo sapiens
aattcctatacgcagcgtgctt

SEQ ID NO: 1937657 - DNA, 14 bp, Homo sapiens
aattcgagacaggc

SEQ ID NO: 1937658 - DNA, 22 bp, Homo sapiens
aattcgagacaggcagaatcag

SEQ ID NO: 1937659 - DNA, 19 bp, Homo sapiens
aattctaaatgaatgttta

SEQ ID NO: 1937660 - DNA, 22 bp, Homo sapiens
aattctagctttgagcttaaga

SEQ ID NO: 1937661 - DNA, 19 bp, Homo sapiens
aattcttggttgaggaaac

SEQ ID NO: 1937662 - DNA, 20 bp, Homo sapiens
aattcttggttgaggaaaca

SEQ ID NO: 1937663 - DNA, 17 bp, Homo sapiens
aattgcttgaaagaaaa

SEQ ID NO: 1937664 - DNA, 22 bp, Homo sapiens
aattgcttgaaagaaaatatgc

SEQ ID NO: 1937665 - DNA, 11 bp, Homo sapiens
aattgtccctt

SEQ ID NO: 1937666 - DNA, 17 bp, Homo sapiens
aatttaagaaataactt

SEQ ID NO: 1937667 - DNA, 17 bp, Homo sapiens
aatttcatctttccaaa

SEQ ID NO: 1937668 - DNA, 22 bp, Homo sapiens
aatttctagacagtattgccac

SEQ ID NO: 1937669 - DNA, 16 bp, Homo sapiens
aatttgtataacccat

SEQ ID NO: 1937670 - DNA, 16 bp, Homo sapiens
aatttgttaatatata

SEQ ID NO: 1937671 - DNA, 16 bp, Homo sapiens
aattttaatgaagaaa

SEQ ID NO: 1937672 - DNA, 19 bp, Homo sapiens
aattttcctaataaagttc

SEQ ID NO: 1937673 - DNA, 14 bp, Homo sapiens
acaaaaattaaaat

SEQ ID NO: 1937674 - DNA, 16 bp, Homo sapiens
acaaagtgagaaatta

SEQ ID NO: 1937675 - DNA, 15 bp, Homo sapiens
acaaataccagagca

SEQ ID NO: 1937676 - DNA, 20 bp, Homo sapiens
acaaatatgattctcctctc

SEQ ID NO: 1937677 - DNA, 23 bp, Homo sapiens
acaaatgttgacctttgaggtct

SEQ ID NO: 1937678 - DNA, 18 bp, Homo sapiens
acaaccttctgtggctca

SEQ ID NO: 1937679 - DNA, 13 bp, Homo sapiens
acaactccagcca

SEQ ID NO: 1937680 - DNA, 20 bp, Homo sapiens
acaagaagccacagacctag

SEQ ID NO: 1937681 - DNA, 22 bp, Homo sapiens
acaagaagtgggagtgggagag

SEQ ID NO: 1937682 - DNA, 14 bp, Homo sapiens
acaagctaaaatta

SEQ ID NO: 1937683 - DNA, 14 bp, Homo sapiens
acaatcactattct

SEQ ID NO: 1937684 - DNA, 16 bp, Homo sapiens
acaatcactattctta

SEQ ID NO: 1937685 - DNA, 23 bp, Homo sapiens
acaatcactattcttaagcactt

SEQ ID NO: 1937686 - DNA, 20 bp, Homo sapiens
acaatctaaaaaatatctta

SEQ ID NO: 1937687 - DNA, 15 bp, Homo sapiens
acaatgagtaaaatc

SEQ ID NO: 1937688 - DNA, 14 bp, Homo sapiens
acaatgtgcactga

SEQ ID NO: 1937689 - DNA, 18 bp, Homo sapiens
acacaaataccagagcac

SEQ ID NO: 1937690 - DNA, 15 bp, Homo sapiens
acacaagacagcaga

SEQ ID NO: 1937691 - DNA, 12 bp, Homo sapiens
acacaatcaaaa

SEQ ID NO: 1937692 - DNA, 14 bp, Homo sapiens
acacacacacacac

SEQ ID NO: 1937693 - DNA, 14 bp, Homo sapiens
acacacacccttcc

SEQ ID NO: 1937694 - DNA, 15 bp, Homo sapiens
acacacacccttccc

SEQ ID NO: 1937695 - DNA, 11 bp, Homo sapiens
acacacactct

SEQ ID NO: 1937696 - DNA, 17 bp, Homo sapiens
acacattcaataagcat

SEQ ID NO: 1937697 - DNA, 21 bp, Homo sapiens
acacattttaattttcctcta

SEQ ID NO: 1937698 - DNA, 14 bp, Homo sapiens
acaccaccaacagg

SEQ ID NO: 1937699 - DNA, 14 bp, Homo sapiens
acaccctctctgtc

SEQ ID NO: 1937700 - DNA, 12 bp, Homo sapiens
acacctccaccc

SEQ ID NO: 1937701 - DNA, 17 bp, Homo sapiens
acacctgacaacttctg

SEQ ID NO: 1937702 - DNA, 19 bp, Homo sapiens
acacgcccgactctctcca

SEQ ID NO: 1937703 - DNA, 20 bp, Homo sapiens
acacgcccgactctctccat

SEQ ID NO: 1937704 - DNA, 14 bp, Homo sapiens
acactcccttgggc

SEQ ID NO: 1937705 - DNA, 14 bp, Homo sapiens
acactgaaggcaaa

SEQ ID NO: 1937706 - DNA, 21 bp, Homo sapiens
acactgccagaagtgtgtttt

SEQ ID NO: 1937707 - DNA, 20 bp, Homo sapiens
acactgtgcacatctgtgtc

SEQ ID NO: 1937708 - DNA, 17 bp, Homo sapiens
acacttacacccttttg

SEQ ID NO: 1937709 - DNA, 20 bp, Homo sapiens
acacttttcatgtgtgattt

SEQ ID NO: 1937710 - DNA, 21 bp, Homo sapiens
acagaagcctcactgcaagca

SEQ ID NO: 1937711 - DNA, 16 bp, Homo sapiens
acagacgtccctccac

SEQ ID NO: 1937712 - DNA, 16 bp, Homo sapiens
acagaggcagtggcag

SEQ ID NO: 1937713 - DNA, 13 bp, Homo sapiens
acagaggccaggc

SEQ ID NO: 1937714 - DNA, 19 bp, Homo sapiens
acagagtgccatccctgag

SEQ ID NO: 1937715 - DNA, 15 bp, Homo sapiens
acagagtggatctgg

SEQ ID NO: 1937716 - DNA, 14 bp, Homo sapiens
acagatgttccatc

SEQ ID NO: 1937717 - DNA, 23 bp, Homo sapiens
acagattttttctttaaataaaa

SEQ ID NO: 1937718 - DNA, 13 bp, Homo sapiens
acagcagcagctc

SEQ ID NO: 1937719 - DNA, 15 bp, Homo sapiens
acagccaaattgcag

SEQ ID NO: 1937720 - DNA, 22 bp, Homo sapiens
acagcccaggcggtcactgccc

SEQ ID NO: 1937721 - DNA, 21 bp, Homo sapiens
acagccccaaacaagcgccac

SEQ ID NO: 1937722 - DNA, 15 bp, Homo sapiens
acagcctcccctgcc

SEQ ID NO: 1937723 - DNA, 11 bp, Homo sapiens
aaaaaaaagaa

SEQ ID NO: 1937724 - DNA, 18 bp, Homo sapiens
aaaaaagaataatgaccc

SEQ ID NO: 1937725 - DNA, 23 bp, Homo sapiens
aaaaacaatatatgtaaattata

SEQ ID NO: 1937726 - DNA, 16 bp, Homo sapiens
aaaaaggcaagccaca

SEQ ID NO: 1937727 - DNA, 17 bp, Homo sapiens
aaaaattaaaccaagca

SEQ ID NO: 1937728 - DNA, 20 bp, Homo sapiens
aaaaattaaaccaagcagct

SEQ ID NO: 1937729 - DNA, 12 bp, Homo sapiens
aaaacaaatctc

SEQ ID NO: 1937730 - DNA, 22 bp, Homo sapiens
aaaacagtaactaagcacatta

SEQ ID NO: 1937731 - DNA, 23 bp, Homo sapiens
aaaacagtaactaagcacattat

SEQ ID NO: 1937732 - DNA, 16 bp, Homo sapiens
aaaacggttaaaactg

SEQ ID NO: 1937733 - DNA, 13 bp, Homo sapiens
aaaacttccacta

SEQ ID NO: 1937734 - DNA, 13 bp, Homo sapiens
aaaagaaattctg

SEQ ID NO: 1937735 - DNA, 16 bp, Homo sapiens
aaaagaagaaactatt

SEQ ID NO: 1937736 - DNA, 15 bp, Homo sapiens
aaaagactgaccttg

SEQ ID NO: 1937737 - DNA, 22 bp, Homo sapiens
aaaataaaagtacctattgaac

SEQ ID NO: 1937738 - DNA, 18 bp, Homo sapiens
aaaatatgtgagcatgaa

SEQ ID NO: 1937739 - DNA, 12 bp, Homo sapiens
aaaatatttcta

SEQ ID NO: 1937740 - DNA, 17 bp, Homo sapiens
aaaatcatgcttataag

SEQ ID NO: 1937741 - DNA, 23 bp, Homo sapiens
aaaatgctgtattagtcacagag

SEQ ID NO: 1937742 - DNA, 14 bp, Homo sapiens
aaaatggaacatta

SEQ ID NO: 1937743 - DNA, 23 bp, Homo sapiens
aaaattattccctgaattgtttg

SEQ ID NO: 1937744 - DNA, 13 bp, Homo sapiens
aaaattatttgca

SEQ ID NO: 1937745 - DNA, 14 bp, Homo sapiens
aaaattatttgcat

SEQ ID NO: 1937746 - DNA, 18 bp, Homo sapiens
aaaatttgttattttgca

SEQ ID NO: 1937747 - DNA, 16 bp, Homo sapiens
aaacaaagggtgggca

SEQ ID NO: 1937748 - DNA, 13 bp, Homo sapiens
aaacaacagaaac

SEQ ID NO: 1937749 - DNA, 15 bp, Homo sapiens
aaacagggctttact

SEQ ID NO: 1937750 - DNA, 19 bp, Homo sapiens
aaacatgaccctaaatctt

SEQ ID NO: 1937751 - DNA, 14 bp, Homo sapiens
aaaccaagcagctt

SEQ ID NO: 1937752 - DNA, 14 bp, Homo sapiens
aaaccaagccgtgg

SEQ ID NO: 1937753 - DNA, 16 bp, Homo sapiens
aaaccctattggtaaa

SEQ ID NO: 1937754 - DNA, 16 bp, Homo sapiens
aaacccttgaaaagac

SEQ ID NO: 1937755 - DNA, 15 bp, Homo sapiens
aaacggttaaaactg

SEQ ID NO: 1937756 - DNA, 17 bp, Homo sapiens
aaactactgtacatttt

SEQ ID NO: 1937757 - DNA, 14 bp, Homo sapiens
aaactataggtaat

SEQ ID NO: 1937758 - DNA, 15 bp, Homo sapiens
aaactttttcaatgg

SEQ ID NO: 1937759 - DNA, 17 bp, Homo sapiens
aaagaaagcctcagaga

SEQ ID NO: 1937760 - DNA, 14 bp, Homo sapiens
aaagaaattctgtt

SEQ ID NO: 1937761 - DNA, 17 bp, Homo sapiens
aaagaacccccctcccc

SEQ ID NO: 1937762 - DNA, 20 bp, Homo sapiens
aaagaagagtaaaatggctg

SEQ ID NO: 1937763 - DNA, 20 bp, Homo sapiens
aaagaaggtttcagaaagaa

SEQ ID NO: 1937764 - DNA, 13 bp, Homo sapiens
aaagacagaagcc

SEQ ID NO: 1937765 - DNA, 14 bp, Homo sapiens
aaagacatcaagca

SEQ ID NO: 1937766 - DNA, 15 bp, Homo sapiens
aaagacatgaatatg

SEQ ID NO: 1937767 - DNA, 14 bp, Homo sapiens
aaagcaaggaaact

SEQ ID NO: 1937768 - DNA, 19 bp, Homo sapiens
aaagcacgaaatgttattt

SEQ ID NO: 1937769 - DNA, 13 bp, Homo sapiens
aaagccatattcc

SEQ ID NO: 1937770 - DNA, 19 bp, Homo sapiens
aaagccatattccagcagt

SEQ ID NO: 1937771 - DNA, 22 bp, Homo sapiens
aaagccatattccagcagtgaa

SEQ ID NO: 1937772 - DNA, 19 bp, Homo sapiens
acttttgtaaatattcttg

SEQ ID NO: 1937773 - DNA, 13 bp, Homo sapiens
acttttttctcta

SEQ ID NO: 1937774 - DNA, 14 bp, Homo sapiens
agaaacaacagaaa

SEQ ID NO: 1937775 - DNA, 19 bp, Homo sapiens
agaaactattttttaaaaa

SEQ ID NO: 1937776 - DNA, 22 bp, Homo sapiens
agaaactcctggatccctttca

SEQ ID NO: 1937777 - DNA, 15 bp, Homo sapiens
agaaactgagtcctg

SEQ ID NO: 1937778 - DNA, 20 bp, Homo sapiens
agaaactgagtcctgttctt

SEQ ID NO: 1937779 - DNA, 21 bp, Homo sapiens
agaaagaaattgtttttctga

SEQ ID NO: 1937780 - DNA, 14 bp, Homo sapiens
agaaagcatctatt

SEQ ID NO: 1937781 - DNA, 19 bp, Homo sapiens
agaaagccatattccagca

SEQ ID NO: 1937782 - DNA, 22 bp, Homo sapiens
agaaagccatattccagcagtg

SEQ ID NO: 1937783 - DNA, 15 bp, Homo sapiens
agaaagcctcagaga

SEQ ID NO: 1937784 - DNA, 20 bp, Homo sapiens
agaaagggcagcccctcccc

SEQ ID NO: 1937785 - DNA, 20 bp, Homo sapiens
agaaagtggaaaacaaggaa

SEQ ID NO: 1937786 - DNA, 12 bp, Homo sapiens
agaaattctgtt

SEQ ID NO: 1937787 - DNA, 16 bp, Homo sapiens
agaaattgtttttctg

SEQ ID NO: 1937788 - DNA, 13 bp, Homo sapiens
agaacaatcacta

SEQ ID NO: 1937789 - DNA, 21 bp, Homo sapiens
agaacacctgacaacttctga

SEQ ID NO: 1937790 - DNA, 18 bp, Homo sapiens
agaaccaggaggcctggg

SEQ ID NO: 1937791 - DNA, 20 bp, Homo sapiens
agaaccaggcaacttgggaa

SEQ ID NO: 1937792 - DNA, 13 bp, Homo sapiens
agaacccccctcc

SEQ ID NO: 1937793 - DNA, 16 bp, Homo sapiens
agaacccccctcccca

SEQ ID NO: 1937794 - DNA, 19 bp, Homo sapiens
agaacccccctccccaagg

SEQ ID NO: 1937795 - DNA, 18 bp, Homo sapiens
acattgtataggccatct

SEQ ID NO: 1937796 - DNA, 23 bp, Homo sapiens
acattgtataggccatctgtaaa

SEQ ID NO: 1937797 - DNA, 20 bp, Homo sapiens
acatttaatatcctgccttt

SEQ ID NO: 1937798 - DNA, 14 bp, Homo sapiens
acatttggctccac

SEQ ID NO: 1937799 - DNA, 14 bp, Homo sapiens
acatttttaattga

SEQ ID NO: 1937800 - DNA, 15 bp, Homo sapiens
accaaccctcagagc

SEQ ID NO: 1937801 - DNA, 23 bp, Homo sapiens
accaacgggtctgtgggactggc

SEQ ID NO: 1937802 - DNA, 21 bp, Homo sapiens
accaactatgcgtaaatcaac

SEQ ID NO: 1937803 - DNA, 12 bp, Homo sapiens
accaagcagctt

SEQ ID NO: 1937804 - DNA, 14 bp, Homo sapiens
accaagccgtggct

SEQ ID NO: 1937805 - DNA, 16 bp, Homo sapiens
accaagccgtggcttc

SEQ ID NO: 1937806 - DNA, 17 bp, Homo sapiens
accaagccgtggcttcc

SEQ ID NO: 1937807 - DNA, 19 bp, Homo sapiens
accacacacacccttcccc

SEQ ID NO: 1937808 - DNA, 20 bp, Homo sapiens
accacacacacccttcccca

SEQ ID NO: 1937809 - DNA, 12 bp, Homo sapiens
accaccaacagg

SEQ ID NO: 1937810 - DNA, 16 bp, Homo sapiens
accacctctggccctg

SEQ ID NO: 1937811 - DNA, 14 bp, Homo sapiens
accacctgtacata

SEQ ID NO: 1937812 - DNA, 16 bp, Homo sapiens
accacctgtacataca

SEQ ID NO: 1937813 - DNA, 22 bp, Homo sapiens
accaccttgcactattggactt

SEQ ID NO: 1937814 - DNA, 16 bp, Homo sapiens
accacgtctccctggc

SEQ ID NO: 1937815 - DNA, 19 bp, Homo sapiens
accagctctttggtgccag

SEQ ID NO: 1937816 - DNA, 15 bp, Homo sapiens
accaggaggcctggg

SEQ ID NO: 1937817 - DNA, 13 bp, Homo sapiens
accaggctgcagg

SEQ ID NO: 1937818 - DNA, 14 bp, Homo sapiens
accaggctgcaggt

SEQ ID NO: 1937819 - DNA, 20 bp, Homo sapiens
accaggctgcaggtggggtt

SEQ ID NO: 1937820 - DNA, 18 bp, Homo sapiens
accaggggttccccagga

SEQ ID NO: 1937821 - DNA, 18 bp, Homo sapiens
accataatgttacattat

SEQ ID NO: 1937822 - DNA, 12 bp, Homo sapiens
accattccccat

SEQ ID NO: 1937823 - DNA, 21 bp, Homo sapiens
accattggttaatctggactt

SEQ ID NO: 1937824 - DNA, 19 bp, Homo sapiens
accattttgcgatgtgttt

SEQ ID NO: 1937825 - DNA, 21 bp, Homo sapiens
accattttgcgatgtgtttta

SEQ ID NO: 1937826 - DNA, 18 bp, Homo sapiens
acccacactacgcagaag

SEQ ID NO: 1937827 - DNA, 17 bp, Homo sapiens
acccacttccctgcaag

SEQ ID NO: 1937828 - DNA, 15 bp, Homo sapiens
acccagccctcatcc

SEQ ID NO: 1937829 - DNA, 19 bp, Homo sapiens
accccaccctgtctgcagg

SEQ ID NO: 1937830 - DNA, 18 bp, Homo sapiens
accccaggcaatagtcaa

SEQ ID NO: 1937831 - DNA, 13 bp, Homo sapiens
acccccacctccc

SEQ ID NO: 1937832 - DNA, 14 bp, Homo sapiens
acccccctccccaa

SEQ ID NO: 1937833 - DNA, 15 bp, Homo sapiens
accccgtccctttcc

SEQ ID NO: 1937834 - DNA, 22 bp, Homo sapiens
accccgtccctttccctgcatc

SEQ ID NO: 1937835 - DNA, 22 bp, Homo sapiens
acccctaaagagatactttgat

SEQ ID NO: 1937836 - DNA, 20 bp, Homo sapiens
acccctaatcgccctgagct

SEQ ID NO: 1937837 - DNA, 15 bp, Homo sapiens
acccctaccctttcc

SEQ ID NO: 1937838 - DNA, 18 bp, Homo sapiens
acccctcccctaatgcct

SEQ ID NO: 1937839 - DNA, 14 bp, Homo sapiens
acccctcttccccc

SEQ ID NO: 1937840 - DNA, 22 bp, Homo sapiens
acccctcttcccccttcccctg

SEQ ID NO: 1937841 - DNA, 21 bp, Homo sapiens
acccctgaactggccccagct

SEQ ID NO: 1937842 - DNA, 23 bp, Homo sapiens
acccctgaactggccccagctcc

SEQ ID NO: 1937843 - DNA, 15 bp, Homo sapiens
acccctggcttttca

SEQ ID NO: 1937844 - DNA, 18 bp, Homo sapiens
acccctggcttttcactg

SEQ ID NO: 1937845 - DNA, 21 bp, Homo sapiens
acccctggcttttcactgctg

SEQ ID NO: 1937846 - DNA, 17 bp, Homo sapiens
acccgacaacatttctg

SEQ ID NO: 1937847 - DNA, 12 bp, Homo sapiens
acccgtcctggg

SEQ ID NO: 1937848 - DNA, 17 bp, Homo sapiens
accctaggtctccaccc

SEQ ID NO: 1937849 - DNA, 20 bp, Homo sapiens
accctaggtctccacccctc

SEQ ID NO: 1937850 - DNA, 21 bp, Homo sapiens
accctaggtctccacccctca

SEQ ID NO: 1937851 - DNA, 10 bp, Homo sapiens
accctccctg

SEQ ID NO: 1937852 - DNA, 13 bp, Homo sapiens
accctccctgtcc

SEQ ID NO: 1937853 - DNA, 15 bp, Homo sapiens
accctccctgtcccc

SEQ ID NO: 1937854 - DNA, 17 bp, Homo sapiens
accctccctgtcccctg

SEQ ID NO: 1937855 - DNA, 22 bp, Homo sapiens
accctctctgtccaatctgcaa

SEQ ID NO: 1937856 - DNA, 17 bp, Homo sapiens
accctctgcagggcagc

SEQ ID NO: 1937857 - DNA, 15 bp, Homo sapiens
accctctgctatgtc

SEQ ID NO: 1937858 - DNA, 18 bp, Homo sapiens
accctgcacctcattcca

SEQ ID NO: 1937859 - DNA, 13 bp, Homo sapiens
accctgccagggg

SEQ ID NO: 1937860 - DNA, 10 bp, Homo sapiens
acccttcccc

SEQ ID NO: 1937861 - DNA, 13 bp, Homo sapiens
acccttccccact

SEQ ID NO: 1937862 - DNA, 14 bp, Homo sapiens
acccttgaatttct

SEQ ID NO: 1937863 - DNA, 19 bp, Homo sapiens
acccttgaatttctagaca

SEQ ID NO: 1937864 - DNA, 12 bp, Homo sapiens
accgagccagca

SEQ ID NO: 1937865 - DNA, 20 bp, Homo sapiens
accgagtctcttctccactg

SEQ ID NO: 1937866 - DNA, 15 bp, Homo sapiens
acctaattagagcag

SEQ ID NO: 1937867 - DNA, 19 bp, Homo sapiens
acctaattagagcagatga

SEQ ID NO: 1937868 - DNA, 13 bp, Homo sapiens
acctataaatact

SEQ ID NO: 1937869 - DNA, 17 bp, Homo sapiens
acctcagttttatcatt

SEQ ID NO: 1937870 - DNA, 13 bp, Homo sapiens
acctccctgcagc

SEQ ID NO: 1937871 - DNA, 16 bp, Homo sapiens
acctcgctggactctc

SEQ ID NO: 1937872 - DNA, 19 bp, Homo sapiens
acctctggccaaatatgca

SEQ ID NO: 1937873 - DNA, 22 bp, Homo sapiens
acctctggccaaatatgcactt

SEQ ID NO: 1937874 - DNA, 12 bp, Homo sapiens
acctctggccct

SEQ ID NO: 1937875 - DNA, 14 bp, Homo sapiens
acctctggctagag

SEQ ID NO: 1937876 - DNA, 17 bp, Homo sapiens
acctcttcagaggccct

SEQ ID NO: 1937877 - DNA, 18 bp, Homo sapiens
acctgaaaacactgtgca

SEQ ID NO: 1937878 - DNA, 20 bp, Homo sapiens
acctgaaaacactgtgcaca

SEQ ID NO: 1937879 - DNA, 16 bp, Homo sapiens
acctgacactcccttg

SEQ ID NO: 1937880 - DNA, 17 bp, Homo sapiens
acctgacactcccttgg

SEQ ID NO: 1937881 - DNA, 14 bp, Homo sapiens
acctgaccagactg

SEQ ID NO: 1937882 - DNA, 17 bp, Homo sapiens
acctgccaggctgcagg

SEQ ID NO: 1937883 - DNA, 17 bp, Homo sapiens
acctgcccccactcagc

SEQ ID NO: 1937884 - DNA, 21 bp, Homo sapiens
acctggatccagccattcctg

SEQ ID NO: 1937885 - DNA, 22 bp, Homo sapiens
acctggttccggaatcctgtcc

SEQ ID NO: 1937886 - DNA, 11 bp, Homo sapiens
acctgtaatca

SEQ ID NO: 1937887 - DNA, 20 bp, Homo sapiens
acctgtattgtctgacttct

SEQ ID NO: 1937888 - DNA, 19 bp, Homo sapiens
acctgtgcttcgggccctt

SEQ ID NO: 1937889 - DNA, 22 bp, Homo sapiens
acctgtgcttcgggcccttccc

SEQ ID NO: 1937890 - DNA, 23 bp, Homo sapiens
acctgtgcttcgggcccttccca

SEQ ID NO: 1937891 - DNA, 19 bp, Homo sapiens
accttcaaactagggccaa

SEQ ID NO: 1937892 - DNA, 23 bp, Homo sapiens
accttcattttctaattctcttt

SEQ ID NO: 1937893 - DNA, 11 bp, Homo sapiens
accttctctta

SEQ ID NO: 1937894 - DNA, 21 bp, Homo sapiens
aggtgctacacccttttccag

SEQ ID NO: 1937895 - DNA, 19 bp, Homo sapiens
aggtggtaagaacacctga

SEQ ID NO: 1937896 - DNA, 14 bp, Homo sapiens
aggtggtcttggag

SEQ ID NO: 1937897 - DNA, 19 bp, Homo sapiens
aggtggtcttggagaggag

SEQ ID NO: 1937898 - DNA, 21 bp, Homo sapiens
aggtggtcttggagaggaggt

SEQ ID NO: 1937899 - DNA, 13 bp, Homo sapiens
aggtgtggagtgg

SEQ ID NO: 1937900 - DNA, 23 bp, Homo sapiens
aggttaataggaggacagaacca

SEQ ID NO: 1937901 - DNA, 16 bp, Homo sapiens
aggttggaactgctgc

SEQ ID NO: 1937902 - DNA, 18 bp, Homo sapiens
aggttggaactgctgcca

SEQ ID NO: 1937903 - DNA, 17 bp, Homo sapiens
aggttgtaaatgtgttt

SEQ ID NO: 1937904 - DNA, 16 bp, Homo sapiens
aggttgtctgaagtca

SEQ ID NO: 1937905 - DNA, 15 bp, Homo sapiens
agtaaaaataaaatt

SEQ ID NO: 1937906 - DNA, 13 bp, Homo sapiens
agtaaaattacag

SEQ ID NO: 1937907 - DNA, 18 bp, Homo sapiens
agtaaaattacagaagaa

SEQ ID NO: 1937908 - DNA, 15 bp, Homo sapiens
agtaaagaaatgaca

SEQ ID NO: 1937909 - DNA, 19 bp, Homo sapiens
agtaactaagcacattatg

SEQ ID NO: 1937910 - DNA, 22 bp, Homo sapiens
agtagagatttcatagctattt

SEQ ID NO: 1937911 - DNA, 17 bp, Homo sapiens
agtataacagcaaataa

SEQ ID NO: 1937912 - DNA, 16 bp, Homo sapiens
agtattctatgtaaaa

SEQ ID NO: 1937913 - DNA, 20 bp, Homo sapiens
agtatttcaaattggagctt

SEQ ID NO: 1937914 - DNA, 16 bp, Homo sapiens
agtatttgcatattct

SEQ ID NO: 1937915 - DNA, 15 bp, Homo sapiens
agtcaacctgcctga

SEQ ID NO: 1937916 - DNA, 22 bp, Homo sapiens
agtcaagattcccggctggact

SEQ ID NO: 1937917 - DNA, 16 bp, Homo sapiens
agtcacactgctggga

SEQ ID NO: 1937918 - DNA, 23 bp, Homo sapiens
agtcataccaatgaaaaaatgta

SEQ ID NO: 1937919 - DNA, 18 bp, Homo sapiens
agtcatgacatttctcaa

SEQ ID NO: 1937920 - DNA, 22 bp, Homo sapiens
agtccaacgtggggcagcacag

SEQ ID NO: 1937921 - DNA, 17 bp, Homo sapiens
agtccaactacagccaa

SEQ ID NO: 1937922 - DNA, 22 bp, Homo sapiens
agtccacgccgggtcgcctgcc

SEQ ID NO: 1937923 - DNA, 17 bp, Homo sapiens
agtctcactagcacatg

SEQ ID NO: 1937924 - DNA, 13 bp, Homo sapiens
agtctctgagcag

SEQ ID NO: 1937925 - DNA, 18 bp, Homo sapiens
agtctcttctccactgga

SEQ ID NO: 1937926 - DNA, 21 bp, Homo sapiens
agtctcttctccactggatgg

SEQ ID NO: 1937927 - DNA, 14 bp, Homo sapiens
agtctgtgcctcag

SEQ ID NO: 1937928 - DNA, 15 bp, Homo sapiens
agtctgtgcctcagt

SEQ ID NO: 1937929 - DNA, 17 bp, Homo sapiens
agtcttccatcagcagt

SEQ ID NO: 1937930 - DNA, 19 bp, Homo sapiens
agtcttccatcagcagtga

SEQ ID NO: 1937931 - DNA, 20 bp, Homo sapiens
agtcttccatcagcagtgat

SEQ ID NO: 1937932 - DNA, 15 bp, Homo sapiens
agtcttccatttgca

SEQ ID NO: 1937933 - DNA, 17 bp, Homo sapiens
agtcttccatttgcaag

SEQ ID NO: 1937934 - DNA, 23 bp, Homo sapiens
agtcttgagtgggccccctctct

SEQ ID NO: 1937935 - DNA, 15 bp, Homo sapiens
agtgaacataactgt

SEQ ID NO: 1937936 - DNA, 15 bp, Homo sapiens
agtgaagcccaggag

SEQ ID NO: 1937937 - DNA, 17 bp, Homo sapiens
agtgaagcccaggagga

SEQ ID NO: 1937938 - DNA, 22 bp, Homo sapiens
agtgaatacatggtagcagggt

SEQ ID NO: 1937939 - DNA, 13 bp, Homo sapiens
agtgaatgattca

SEQ ID NO: 1937940 - DNA, 17 bp, Homo sapiens
agtgactctggctgcca

SEQ ID NO: 1937941 - DNA, 19 bp, Homo sapiens
agtgactctggctgccaag

SEQ ID NO: 1937942 - DNA, 20 bp, Homo sapiens
agtgactctggctgccaaga

SEQ ID NO: 1937943 - DNA, 21 bp, Homo sapiens
agtgagacccagccctcatcc

SEQ ID NO: 1937944 - DNA, 15 bp, Homo sapiens
agtgagggtcagaga

SEQ ID NO: 1937945 - DNA, 23 bp, Homo sapiens
agtgagggtcagagaggagtcag

SEQ ID NO: 1937946 - DNA, 15 bp, Homo sapiens
agtgcaacagtagca

SEQ ID NO: 1937947 - DNA, 22 bp, Homo sapiens
agtgcaatccatgtatctgtat

SEQ ID NO: 1937948 - DNA, 17 bp, Homo sapiens
agtgccacatggccgct

SEQ ID NO: 1937949 - DNA, 15 bp, Homo sapiens
agtgccatccctgag

SEQ ID NO: 1937950 - DNA, 16 bp, Homo sapiens
agtgccatccctgaga

SEQ ID NO: 1937951 - DNA, 15 bp, Homo sapiens
agtgcgtccacgagc

SEQ ID NO: 1937952 - DNA, 15 bp, Homo sapiens
agtgctcagttccaa

SEQ ID NO: 1937953 - DNA, 16 bp, Homo sapiens
agtgctcagttccaat

SEQ ID NO: 1937954 - DNA, 11 bp, Homo sapiens
agtgctccctc

SEQ ID NO: 1937955 - DNA, 17 bp, Homo sapiens
agtgctccctcacatgt

SEQ ID NO: 1937956 - DNA, 11 bp, Homo sapiens
agtgctctgat

SEQ ID NO: 1937957 - DNA, 21 bp, Homo sapiens
agtgctctgatccctctacag

SEQ ID NO: 1937958 - DNA, 16 bp, Homo sapiens
agtggactgtgtccct

SEQ ID NO: 1937959 - DNA, 23 bp, Homo sapiens
agtggaggggtcagcaggggggt

SEQ ID NO: 1937960 - DNA, 13 bp, Homo sapiens
agtggatctggag

SEQ ID NO: 1937961 - DNA, 21 bp, Homo sapiens
agtggatctggagtctgaagg

SEQ ID NO: 1937962 - DNA, 15 bp, Homo sapiens
agtggcctgagaaga

SEQ ID NO: 1937963 - DNA, 19 bp, Homo sapiens
agtggcttactacatgtgg

SEQ ID NO: 1937964 - DNA, 17 bp, Homo sapiens
agtgggagtgggagagg

SEQ ID NO: 1937965 - DNA, 14 bp, Homo sapiens
agtgggccccctct

SEQ ID NO: 1937966 - DNA, 15 bp, Homo sapiens
agtggtctatttctc

SEQ ID NO: 1937967 - DNA, 16 bp, Homo sapiens
agtggtggtgtctcac

SEQ ID NO: 1937968 - DNA, 17 bp, Homo sapiens
agtgtataccacctgta

SEQ ID NO: 1937969 - DNA, 20 bp, Homo sapiens
agtgtataccacctgtacat

SEQ ID NO: 1937970 - DNA, 21 bp, Homo sapiens
agtgtatctcgaagtcttcca

SEQ ID NO: 1937971 - DNA, 13 bp, Homo sapiens
agtgtctttccac

SEQ ID NO: 1937972 - DNA, 14 bp, Homo sapiens
agtgtgaccaggca

SEQ ID NO: 1937973 - DNA, 15 bp, Homo sapiens
agtgtgaggccaggg

SEQ ID NO: 1937974 - DNA, 13 bp, Homo sapiens
agtgtgcaaagaa

SEQ ID NO: 1937975 - DNA, 14 bp, Homo sapiens
agtgtgccaccctc

SEQ ID NO: 1937976 - DNA, 17 bp, Homo sapiens
agtgtgccaccctctgc

SEQ ID NO: 1937977 - DNA, 18 bp, Homo sapiens
agtgtgccaccctctgca

SEQ ID NO: 1937978 - DNA, 21 bp, Homo sapiens
agtgttcaaactactgtacat

SEQ ID NO: 1937979 - DNA, 13 bp, Homo sapiens
agtgttttctggg

SEQ ID NO: 1937980 - DNA, 15 bp, Homo sapiens
agtgttttctgggat

SEQ ID NO: 1937981 - DNA, 13 bp, Homo sapiens
agttaacatctga

SEQ ID NO: 1937982 - DNA, 17 bp, Homo sapiens
agttaacatctgaagtg

SEQ ID NO: 1937983 - DNA, 17 bp, Homo sapiens
agttaatgtactttcat

SEQ ID NO: 1937984 - DNA, 18 bp, Homo sapiens
agttattgacaaactctc

SEQ ID NO: 1937985 - DNA, 22 bp, Homo sapiens
agttcatatgtaccatgtacat

SEQ ID NO: 1937986 - DNA, 14 bp, Homo sapiens
agttccaatgtgcc

SEQ ID NO: 1937987 - DNA, 21 bp, Homo sapiens
agttccagataaaaacaatat

SEQ ID NO: 1937988 - DNA, 13 bp, Homo sapiens
agttctcacattt

SEQ ID NO: 1937989 - DNA, 18 bp, Homo sapiens
agttctcatccacagagg

SEQ ID NO: 1937990 - DNA, 18 bp, Homo sapiens
agttgaggggcttccctc

SEQ ID NO: 1937991 - DNA, 22 bp, Homo sapiens
agttgaggggcttccctctgct

SEQ ID NO: 1937992 - DNA, 20 bp, Homo sapiens
agttgtggagagtgcaacag

SEQ ID NO: 1937993 - DNA, 16 bp, Homo sapiens
agttgttagtgatttg

SEQ ID NO: 1937994 - DNA, 20 bp, Homo sapiens
agttgttagtgatttgctat

SEQ ID NO: 1937995 - DNA, 19 bp, Homo sapiens
agtttctgtaattggcttt

SEQ ID NO: 1937996 - DNA, 14 bp, Homo sapiens
agtttgtccacaca

SEQ ID NO: 1937997 - DNA, 13 bp, Homo sapiens
agttttatcattt

SEQ ID NO: 1937998 - DNA, 14 bp, Homo sapiens
agttttatcatttt

SEQ ID NO: 1937999 - DNA, 16 bp, Homo sapiens
ataaaattaaagctga

SEQ ID NO: 1938000 - DNA, 19 bp, Homo sapiens
ataaactaattttgtacgt

SEQ ID NO: 1938001 - DNA, 17 bp, Homo sapiens
ataaagttattaatagc

SEQ ID NO: 1938002 - DNA, 17 bp, Homo sapiens
ataaatactaaatatga

SEQ ID NO: 1938003 - DNA, 21 bp, Homo sapiens
ataaatactaaatatgaaatt

SEQ ID NO: 1938004 - DNA, 13 bp, Homo sapiens
ataaatatctatt

SEQ ID NO: 1938005 - DNA, 14 bp, Homo sapiens
ataaatccaagact

SEQ ID NO: 1938006 - DNA, 17 bp, Homo sapiens
ataaatcgcattaatga

SEQ ID NO: 1938007 - DNA, 20 bp, Homo sapiens
ataaatgggtaacactgatt

SEQ ID NO: 1938008 - DNA, 22 bp, Homo sapiens
ataacaaggaaaacagtaacta

SEQ ID NO: 1938009 - DNA, 14 bp, Homo sapiens
ataacagcaaataa

SEQ ID NO: 1938010 - DNA, 16 bp, Homo sapiens
ataagtatttcaaatt

SEQ ID NO: 1938011 - DNA, 19 bp, Homo sapiens
ataagtatttcaaattgga

SEQ ID NO: 1938012 - DNA, 20 bp, Homo sapiens
ataagtttcactgacttaga

SEQ ID NO: 1938013 - DNA, 21 bp, Homo sapiens
ataagtttctgggacctcagt

SEQ ID NO: 1938014 - DNA, 12 bp, Homo sapiens
ataataaaacca

SEQ ID NO: 1938015 - DNA, 15 bp, Homo sapiens
ataataaatgtacat

SEQ ID NO: 1938016 - DNA, 13 bp, Homo sapiens
ataatgaagaatg

SEQ ID NO: 1938017 - DNA, 21 bp, Homo sapiens
ataatgacgtattgtgaaatt

SEQ ID NO: 1938018 - DNA, 22 bp, Homo sapiens
ataatgacgtattgtgaaattt

SEQ ID NO: 1938019 - DNA, 19 bp, Homo sapiens
ataattttttagttaaaat

SEQ ID NO: 1938020 - DNA, 21 bp, Homo sapiens
ataattttttagttaaaatct

SEQ ID NO: 1938021 - DNA, 22 bp, Homo sapiens
ataattttttagttaaaatcta

SEQ ID NO: 1938022 - DNA, 18 bp, Homo sapiens
atacaccgggcctggaga

SEQ ID NO: 1938023 - DNA, 20 bp, Homo sapiens
atacagaactctttcaaaac

SEQ ID NO: 1938024 - DNA, 19 bp, Homo sapiens
atacagtcttccatttgca

SEQ ID NO: 1938025 - DNA, 12 bp, Homo sapiens
atacatttttaa

SEQ ID NO: 1938026 - DNA, 20 bp, Homo sapiens
ataccaaaattatttcagaa

SEQ ID NO: 1938027 - DNA, 16 bp, Homo sapiens
ataccagcgaggaggc

SEQ ID NO: 1938028 - DNA, 20 bp, Homo sapiens
ataccctaggtctccacccc

SEQ ID NO: 1938029 - DNA, 23 bp, Homo sapiens
atacctggatccagccattcctg

SEQ ID NO: 1938030 - DNA, 19 bp, Homo sapiens
agattcccggctggacttt

SEQ ID NO: 1938031 - DNA, 20 bp, Homo sapiens
agattcccggctggactttt

SEQ ID NO: 1938032 - DNA, 23 bp, Homo sapiens
agattggagaaacccttgaaaag

SEQ ID NO: 1938033 - DNA, 20 bp, Homo sapiens
agattttttctttaaataaa

SEQ ID NO: 1938034 - DNA, 12 bp, Homo sapiens
agcaacatgaat

SEQ ID NO: 1938035 - DNA, 13 bp, Homo sapiens
agcaacatgaatt

SEQ ID NO: 1938036 - DNA, 18 bp, Homo sapiens
agcaaggcaagaagtggg

SEQ ID NO: 1938037 - DNA, 16 bp, Homo sapiens
agcaagtactttgtct

SEQ ID NO: 1938038 - DNA, 14 bp, Homo sapiens
agcaatgcctgcct

SEQ ID NO: 1938039 - DNA, 14 bp, Homo sapiens
agcacaagaagtgg

SEQ ID NO: 1938040 - DNA, 22 bp, Homo sapiens
agcacaagaagtgggagtggga

SEQ ID NO: 1938041 - DNA, 16 bp, Homo sapiens
agcacagaaggaggag

SEQ ID NO: 1938042 - DNA, 17 bp, Homo sapiens
agcacgaaatgttattt

SEQ ID NO: 1938043 - DNA, 18 bp, Homo sapiens
agcacgaaatgttatttt

SEQ ID NO: 1938044 - DNA, 20 bp, Homo sapiens
agcactttgaaaatatttct

SEQ ID NO: 1938045 - DNA, 14 bp, Homo sapiens
agcagctagagctc

SEQ ID NO: 1938046 - DNA, 18 bp, Homo sapiens
aggagagaatgagagagt

SEQ ID NO: 1938047 - DNA, 17 bp, Homo sapiens
aggagagaccttctctt

SEQ ID NO: 1938048 - DNA, 14 bp, Homo sapiens
aggagaggctgctg

SEQ ID NO: 1938049 - DNA, 22 bp, Homo sapiens
aggagatgctccttgggccctt

SEQ ID NO: 1938050 - DNA, 15 bp, Homo sapiens
aggagccccattcct

SEQ ID NO: 1938051 - DNA, 16 bp, Homo sapiens
aggagcttccagatgg

SEQ ID NO: 1938052 - DNA, 22 bp, Homo sapiens
aggaggacctggggggggcaag

SEQ ID NO: 1938053 - DNA, 23 bp, Homo sapiens
aggaggacctggggggggcaaga

SEQ ID NO: 1938054 - DNA, 21 bp, Homo sapiens
aggaggaggtttaggtcaaga

SEQ ID NO: 1938055 - DNA, 14 bp, Homo sapiens
aggaggcagaacca

SEQ ID NO: 1938056 - DNA, 13 bp, Homo sapiens
aggaggctccaga

SEQ ID NO: 1938057 - DNA, 14 bp, Homo sapiens
aggagggtggcact

SEQ ID NO: 1938058 - DNA, 15 bp, Homo sapiens
aggaggtgtggagtg

SEQ ID NO: 1938059 - DNA, 16 bp, Homo sapiens
aggaggtgtggagtgg

SEQ ID NO: 1938060 - DNA, 19 bp, Homo sapiens
aggaggtgtggagtggagg

SEQ ID NO: 1938061 - DNA, 14 bp, Homo sapiens
aggagtcagagaga

SEQ ID NO: 1938062 - DNA, 12 bp, Homo sapiens
aggatgggaagg

SEQ ID NO: 1938063 - DNA, 20 bp, Homo sapiens
aggatttcatgatttcattt

SEQ ID NO: 1938064 - DNA, 23 bp, Homo sapiens
aggatttgtgttttacagtatat

SEQ ID NO: 1938065 - DNA, 18 bp, Homo sapiens
aggcaaatccgaaatcag

SEQ ID NO: 1938066 - DNA, 15 bp, Homo sapiens
aggcaagaagtggga

SEQ ID NO: 1938067 - DNA, 21 bp, Homo sapiens
aggcaagacaccttcccagct

SEQ ID NO: 1938068 - DNA, 14 bp, Homo sapiens
aggcaagctggcag

SEQ ID NO: 1938069 - DNA, 18 bp, Homo sapiens
aggcacacagctgcagag

SEQ ID NO: 1938070 - DNA, 23 bp, Homo sapiens
aggcacacagctgcagagacaga

SEQ ID NO: 1938071 - DNA, 20 bp, Homo sapiens
aggcagaatggtgggctcca

SEQ ID NO: 1938072 - DNA, 22 bp, Homo sapiens
aggcagagattgggggggcttg

SEQ ID NO: 1938073 - DNA, 23 bp, Homo sapiens
aggcagagattgggggggcttgg

SEQ ID NO: 1938074 - DNA, 16 bp, Homo sapiens
aggcagctctgtcgtg

SEQ ID NO: 1938075 - DNA, 17 bp, Homo sapiens
aggcagctgaaaagtaa

SEQ ID NO: 1938076 - DNA, 19 bp, Homo sapiens
aggcaggggctgggcagag

SEQ ID NO: 1938077 - DNA, 12 bp, Homo sapiens
aggcagtggcag

SEQ ID NO: 1938078 - DNA, 19 bp, Homo sapiens
aggcatgcgaatgagctgg

SEQ ID NO: 1938079 - DNA, 18 bp, Homo sapiens
aggcatggcccagcctgg

SEQ ID NO: 1938080 - DNA, 14 bp, Homo sapiens
aggccacgggggag

SEQ ID NO: 1938081 - DNA, 15 bp, Homo sapiens
aggccagggcagagt

SEQ ID NO: 1938082 - DNA, 14 bp, Homo sapiens
aggccatctgtaaa

SEQ ID NO: 1938083 - DNA, 15 bp, Homo sapiens
aggccctcgctgcca

SEQ ID NO: 1938084 - DNA, 15 bp, Homo sapiens
aggccctctctgcag

SEQ ID NO: 1938085 - DNA, 17 bp, Homo sapiens
aggccctctctgcagtc

SEQ ID NO: 1938086 - DNA, 13 bp, Homo sapiens
aggcccttcctct

SEQ ID NO: 1938087 - DNA, 17 bp, Homo sapiens
aggcccttcctctccac

SEQ ID NO: 1938088 - DNA, 24 bp, Homo sapiens
aggccgaggcaggggctgggcaga

SEQ ID NO: 1938089 - DNA, 16 bp, Homo sapiens
aggcctgccccccttc

SEQ ID NO: 1938090 - DNA, 22 bp, Homo sapiens
aggcctgccccccttcccaccc

SEQ ID NO: 1938091 - DNA, 23 bp, Homo sapiens
aggcctgccccccttcccacccc

SEQ ID NO: 1938092 - DNA, 16 bp, Homo sapiens
aggcctgggagatgca

SEQ ID NO: 1938093 - DNA, 15 bp, Homo sapiens
aggcctggtctggag

SEQ ID NO: 1938094 - DNA, 21 bp, Homo sapiens
aggcctggtctggagccccta

SEQ ID NO: 1938095 - DNA, 24 bp, Homo sapiens
aggcctggtctggagcccctatcc

SEQ ID NO: 1938096 - DNA, 21 bp, Homo sapiens
aggctaaaacaaatctcagaa

SEQ ID NO: 1938097 - DNA, 20 bp, Homo sapiens
aggctaatcaatacccttgg

SEQ ID NO: 1938098 - DNA, 21 bp, Homo sapiens
aggctaatcaatacccttggc

SEQ ID NO: 1938099 - DNA, 21 bp, Homo sapiens
aggctcacccccttctccatc

SEQ ID NO: 1938100 - DNA, 17 bp, Homo sapiens
aggctcaggctgcccag

SEQ ID NO: 1938101 - DNA, 14 bp, Homo sapiens
aggctccagagggc

SEQ ID NO: 1938102 - DNA, 14 bp, Homo sapiens
aggctgcaagctgc

SEQ ID NO: 1938103 - DNA, 14 bp, Homo sapiens
aggctgcagggaca

SEQ ID NO: 1938104 - DNA, 16 bp, Homo sapiens
aggctgccgctgctct

SEQ ID NO: 1938105 - DNA, 23 bp, Homo sapiens
aggctgccgctgctctcccaggt

SEQ ID NO: 1938106 - DNA, 16 bp, Homo sapiens
aggcttctctctgtgg

SEQ ID NO: 1938107 - DNA, 19 bp, Homo sapiens
aggcttctgggacttgaaa

SEQ ID NO: 1938108 - DNA, 18 bp, Homo sapiens
agggaaaattatttgcat

SEQ ID NO: 1938109 - DNA, 14 bp, Homo sapiens
agggaaatccaact

SEQ ID NO: 1938110 - DNA, 19 bp, Homo sapiens
agggaaatccaactccagg

SEQ ID NO: 1938111 - DNA, 18 bp, Homo sapiens
agggaacagacctcggct

SEQ ID NO: 1938112 - DNA, 23 bp, Homo sapiens
agggaattttcattggatgcagt

SEQ ID NO: 1938113 - DNA, 23 bp, Homo sapiens
agggacatattcatttggaaata

SEQ ID NO: 1938114 - DNA, 20 bp, Homo sapiens
agggaccagcccagcctgca

SEQ ID NO: 1938115 - DNA, 15 bp, Homo sapiens
agggagaaggagagg

SEQ ID NO: 1938116 - DNA, 21 bp, Homo sapiens
agggagaaggagaggctctga

SEQ ID NO: 1938117 - DNA, 13 bp, Homo sapiens
agggagagagaga

SEQ ID NO: 1938118 - DNA, 22 bp, Homo sapiens
agggagggaacagacctcggct

SEQ ID NO: 1938119 - DNA, 16 bp, Homo sapiens
agggatccctcatctg

SEQ ID NO: 1938120 - DNA, 16 bp, Homo sapiens
agggcaaaccaggctg

SEQ ID NO: 1938121 - DNA, 17 bp, Homo sapiens
agggcactggtggcccg

SEQ ID NO: 1938122 - DNA, 19 bp, Homo sapiens
agggcagagtgagacccag

SEQ ID NO: 1938123 - DNA, 15 bp, Homo sapiens
agggcagcagggcta

SEQ ID NO: 1938124 - DNA, 23 bp, Homo sapiens
agggcagcctgtgggagaaggga

SEQ ID NO: 1938125 - DNA, 12 bp, Homo sapiens
agggcagggccc

SEQ ID NO: 1938126 - DNA, 20 bp, Homo sapiens
agggcagtcgatagagctgt

SEQ ID NO: 1938127 - DNA, 21 bp, Homo sapiens
agggcccccggctcggcctct

SEQ ID NO: 1938128 - DNA, 15 bp, Homo sapiens
agggcctggcctggt

SEQ ID NO: 1938129 - DNA, 14 bp, Homo sapiens
agggcgcctgggtc

SEQ ID NO: 1938130 - DNA, 18 bp, Homo sapiens
agggcgctgagggcaggg

SEQ ID NO: 1938131 - DNA, 15 bp, Homo sapiens
agggctaccctgagc

SEQ ID NO: 1938132 - DNA, 18 bp, Homo sapiens
agggctaccctgagctga

SEQ ID NO: 1938133 - DNA, 20 bp, Homo sapiens
agggctaccctgagctgagg

SEQ ID NO: 1938134 - DNA, 21 bp, Homo sapiens
agggctaccctgagctgaggc

SEQ ID NO: 1938135 - DNA, 18 bp, Homo sapiens
agggctccagggccaggg

SEQ ID NO: 1938136 - DNA, 22 bp, Homo sapiens
agggctgggcgcctctgtcctg

SEQ ID NO: 1938137 - DNA, 21 bp, Homo sapiens
aggggacagatcttgagcaag

SEQ ID NO: 1938138 - DNA, 20 bp, Homo sapiens
aggggatctaaaaggaggac

SEQ ID NO: 1938139 - DNA, 13 bp, Homo sapiens
aggggccagaggc

SEQ ID NO: 1938140 - DNA, 14 bp, Homo sapiens
aggggccagaggct

SEQ ID NO: 1938141 - DNA, 17 bp, Homo sapiens
aggggccagaggctcgt

SEQ ID NO: 1938142 - DNA, 14 bp, Homo sapiens
aggggcccctcctc

SEQ ID NO: 1938143 - DNA, 18 bp, Homo sapiens
aggggcccctcctccaga

SEQ ID NO: 1938144 - DNA, 13 bp, Homo sapiens
aggggcctggcag

SEQ ID NO: 1938145 - DNA, 12 bp, Homo sapiens
aggggcctggcc

SEQ ID NO: 1938146 - DNA, 15 bp, Homo sapiens
agggggccacctccc

SEQ ID NO: 1938147 - DNA, 18 bp, Homo sapiens
agggggctattccctgga

SEQ ID NO: 1938148 - DNA, 21 bp, Homo sapiens
aggggggttgggttccagaca

SEQ ID NO: 1938149 - DNA, 15 bp, Homo sapiens
aggggtcagcagggg

SEQ ID NO: 1938150 - DNA, 17 bp, Homo sapiens
agggtacagcccaggcg

SEQ ID NO: 1938151 - DNA, 22 bp, Homo sapiens
agggtcaggaaggatgagcatt

SEQ ID NO: 1938152 - DNA, 16 bp, Homo sapiens
agggtgaggcgtggga

SEQ ID NO: 1938153 - DNA, 22 bp, Homo sapiens
agggtgggcgtgacttcagact

SEQ ID NO: 1938154 - DNA, 16 bp, Homo sapiens
agggttaaagaaaggc

SEQ ID NO: 1938155 - DNA, 13 bp, Homo sapiens
agggttctagaag

SEQ ID NO: 1938156 - DNA, 15 bp, Homo sapiens
agggttctagaaggg

SEQ ID NO: 1938157 - DNA, 21 bp, Homo sapiens
aggtaatccaagatattttaa

SEQ ID NO: 1938158 - DNA, 21 bp, Homo sapiens
aggtatcattttctgcattta

SEQ ID NO: 1938159 - DNA, 23 bp, Homo sapiens
aggtcccgagccccctgtccttc

SEQ ID NO: 1938160 - DNA, 15 bp, Homo sapiens
aggtcctttccttct

SEQ ID NO: 1938161 - DNA, 14 bp, Homo sapiens
aggtctccacccct

SEQ ID NO: 1938162 - DNA, 16 bp, Homo sapiens
aggtctccacccctca

SEQ ID NO: 1938163 - DNA, 17 bp, Homo sapiens
aggtctccacccctcaa

SEQ ID NO: 1938164 - DNA, 19 bp, Homo sapiens
aggtctccacccctcaagc

SEQ ID NO: 1938165 - DNA, 13 bp, Homo sapiens
aggtgagggaagc

SEQ ID NO: 1938166 - DNA, 22 bp, Homo sapiens
aggtgcacagacgtccctccac

SEQ ID NO: 1938167 - DNA, 13 bp, Homo sapiens
aggtgcccagtct

SEQ ID NO: 1938168 - DNA, 18 bp, Homo sapiens
aggtgcccagtcttgagt

SEQ ID NO: 1938169 - DNA, 21 bp, Homo sapiens
aggtgcccagtcttgagtggg

SEQ ID NO: 1938170 - DNA, 16 bp, Homo sapiens
tagctgagctggaaag

SEQ ID NO: 1938171 - DNA, 20 bp, Homo sapiens
tagctgcatttgtctggcct

SEQ ID NO: 1938172 - DNA, 21 bp, Homo sapiens
tagctggagagagagttctca

SEQ ID NO: 1938173 - DNA, 16 bp, Homo sapiens
taggaggacagaacca

SEQ ID NO: 1938174 - DNA, 14 bp, Homo sapiens
taggatttgtgttt

SEQ ID NO: 1938175 - DNA, 14 bp, Homo sapiens
taggccatctgtaa

SEQ ID NO: 1938176 - DNA, 22 bp, Homo sapiens
taggcttacaatgtgcactgaa

SEQ ID NO: 1938177 - DNA, 23 bp, Homo sapiens
tagggccaagcccagcactgctt

SEQ ID NO: 1938178 - DNA, 11 bp, Homo sapiens
taggggtgggg

SEQ ID NO: 1938179 - DNA, 19 bp, Homo sapiens
taggggtgggggagaatgg

SEQ ID NO: 1938180 - DNA, 18 bp, Homo sapiens
taggtcaagaagaagatg

SEQ ID NO: 1938181 - DNA, 20 bp, Homo sapiens
taggtctccacccctcaagc

SEQ ID NO: 1938182 - DNA, 13 bp, Homo sapiens
taggtgtctttta

SEQ ID NO: 1938183 - DNA, 19 bp, Homo sapiens
taggttaataggaggacag

SEQ ID NO: 1938184 - DNA, 12 bp, Homo sapiens
taggttctaaaa

SEQ ID NO: 1938185 - DNA, 14 bp, Homo sapiens
tagtaaagaaatga

SEQ ID NO: 1938186 - DNA, 17 bp, Homo sapiens
tagtgatctgaacagaa

SEQ ID NO: 1938187 - DNA, 18 bp, Homo sapiens
tagtgatctgaacagaaa

SEQ ID NO: 1938188 - DNA, 15 bp, Homo sapiens
tagtgccatggccag

SEQ ID NO: 1938189 - DNA, 16 bp, Homo sapiens
tagtgccatggccagg

SEQ ID NO: 1938190 - DNA, 22 bp, Homo sapiens
tagtgcctgtgatcgtgtgttg

SEQ ID NO: 1938191 - DNA, 17 bp, Homo sapiens
tagtgtataccacctgt

SEQ ID NO: 1938192 - DNA, 18 bp, Homo sapiens
tagtgtataccacctgta

SEQ ID NO: 1938193 - DNA, 21 bp, Homo sapiens
tagtgtataccacctgtacat

SEQ ID NO: 1938194 - DNA, 11 bp, Homo sapiens
tagttaaaatc

SEQ ID NO: 1938195 - DNA, 21 bp, Homo sapiens
tagtttgattattcagtgtca

SEQ ID NO: 1938196 - DNA, 17 bp, Homo sapiens
tataaagttattaatag

SEQ ID NO: 1938197 - DNA, 13 bp, Homo sapiens
tataaatatcaca

SEQ ID NO: 1938198 - DNA, 18 bp, Homo sapiens
tataaatggtgagaatta

SEQ ID NO: 1938199 - DNA, 19 bp, Homo sapiens
tataaatggtgagaattaa

SEQ ID NO: 1938200 - DNA, 20 bp, Homo sapiens
tataaatggtgagaattaaa

SEQ ID NO: 1938201 - DNA, 19 bp, Homo sapiens
tataactatgttgataaaa

SEQ ID NO: 1938202 - DNA, 13 bp, Homo sapiens
tataataaaacca

SEQ ID NO: 1938203 - DNA, 22 bp, Homo sapiens
tataatacttaaaaatatgtga

SEQ ID NO: 1938204 - DNA, 17 bp, Homo sapiens
tataatgttgttattta

SEQ ID NO: 1938205 - DNA, 18 bp, Homo sapiens
tataatgttgttatttaa

SEQ ID NO: 1938206 - DNA, 19 bp, Homo sapiens
tatacaatgagtaaaatca

SEQ ID NO: 1938207 - DNA, 23 bp, Homo sapiens
tatacaatgagtaaaatcacaga

SEQ ID NO: 1938208 - DNA, 16 bp, Homo sapiens
tataccacctgtacat

SEQ ID NO: 1938209 - DNA, 19 bp, Homo sapiens
tataccacctgtacataca

SEQ ID NO: 1938210 - DNA, 20 bp, Homo sapiens
tatacgcagcgtgctttaaa

SEQ ID NO: 1938211 - DNA, 17 bp, Homo sapiens
tataggccatctgtaaa

SEQ ID NO: 1938212 - DNA, 18 bp, Homo sapiens
tatagtgatgtaatcttg

SEQ ID NO: 1938213 - DNA, 19 bp, Homo sapiens
tatagtgtataccacctgt

SEQ ID NO: 1938214 - DNA, 13 bp, Homo sapiens
tatagttttacac

SEQ ID NO: 1938215 - DNA, 13 bp, Homo sapiens
tatatataaatat

SEQ ID NO: 1938216 - DNA, 18 bp, Homo sapiens
tatatataaatatctatt

SEQ ID NO: 1938217 - DNA, 14 bp, Homo sapiens
tatatattgcatag

SEQ ID NO: 1938218 - DNA, 19 bp, Homo sapiens
tatatcttaagataatatt

SEQ ID NO: 1938219 - DNA, 21 bp, Homo sapiens
tatatgcacttataattttcc

SEQ ID NO: 1938220 - DNA, 15 bp, Homo sapiens
tatattacttttgta

SEQ ID NO: 1938221 - DNA, 18 bp, Homo sapiens
ccctgccctcactccact

SEQ ID NO: 1938222 - DNA, 21 bp, Homo sapiens
ccctgccctcactccactccc

SEQ ID NO: 1938223 - DNA, 17 bp, Homo sapiens
ccctgcgccctccctcc

SEQ ID NO: 1938224 - DNA, 23 bp, Homo sapiens
ccctgcgccctccctccctccac

SEQ ID NO: 1938225 - DNA, 22 bp, Homo sapiens
ccctgctttgggctgccctggt

SEQ ID NO: 1938226 - DNA, 23 bp, Homo sapiens
ccctgctttgggctgccctggtg

SEQ ID NO: 1938227 - DNA, 12 bp, Homo sapiens
ccctggccccag

SEQ ID NO: 1938228 - DNA, 13 bp, Homo sapiens
ccctggcttttca

SEQ ID NO: 1938229 - DNA, 19 bp, Homo sapiens
ccctggcttttcactgctg

SEQ ID NO: 1938230 - DNA, 23 bp, Homo sapiens
ccctggtactcccccagccctca

SEQ ID NO: 1938231 - DNA, 14 bp, Homo sapiens
ccctgtctgcaggc

SEQ ID NO: 1938232 - DNA, 16 bp, Homo sapiens
ccctgtctgcaggcca

SEQ ID NO: 1938233 - DNA, 13 bp, Homo sapiens
ccctgtgatgcct

SEQ ID NO: 1938234 - DNA, 19 bp, Homo sapiens
ccctgtgtgtcgttccctt

SEQ ID NO: 1938235 - DNA, 13 bp, Homo sapiens
ccctgttcactct

SEQ ID NO: 1938236 - DNA, 13 bp, Homo sapiens
cccttccccactc

SEQ ID NO: 1938237 - DNA, 18 bp, Homo sapiens
cccttccccactcccgtg

SEQ ID NO: 1938238 - DNA, 20 bp, Homo sapiens
cccttcctctccactgcctt

SEQ ID NO: 1938239 - DNA, 21 bp, Homo sapiens
ccctttacattttgtgcagtg

SEQ ID NO: 1938240 - DNA, 17 bp, Homo sapiens
ccctttccctgcatccc

SEQ ID NO: 1938241 - DNA, 18 bp, Homo sapiens
ccctttccctgcatccct

SEQ ID NO: 1938242 - DNA, 23 bp, Homo sapiens
cccttttagtggtggtgtctcac

SEQ ID NO: 1938243 - DNA, 13 bp, Homo sapiens
ccgacagcctggc

SEQ ID NO: 1938244 - DNA, 14 bp, Homo sapiens
ccgacagcctggca

SEQ ID NO: 1938245 - DNA, 14 bp, Homo sapiens
ccgactctctccat

SEQ ID NO: 1938246 - DNA, 17 bp, Homo sapiens
ccgagccccctgtcctt

SEQ ID NO: 1938247 - DNA, 17 bp, Homo sapiens
ccgaggcaggggctggg

SEQ ID NO: 1938248 - DNA, 15 bp, Homo sapiens
ccgagtatctgtaac

SEQ ID NO: 1938249 - DNA, 19 bp, Homo sapiens
ccgagtctcttctccactg

SEQ ID NO: 1938250 - DNA, 21 bp, Homo sapiens
ccgagtctcttctccactgga

SEQ ID NO: 1938251 - DNA, 12 bp, Homo sapiens
ccgccctctgcc

SEQ ID NO: 1938252 - DNA, 13 bp, Homo sapiens
ccgccctctgccc

SEQ ID NO: 1938253 - DNA, 13 bp, Homo sapiens
ccgcctctgagcc

SEQ ID NO: 1938254 - DNA, 15 bp, Homo sapiens
ccgcgagggcctgcg

SEQ ID NO: 1938255 - DNA, 19 bp, Homo sapiens
ccgctcagccctccctgcc

SEQ ID NO: 1938256 - DNA, 19 bp, Homo sapiens
ccgctgcccacgtcccggg

SEQ ID NO: 1938257 - DNA, 11 bp, Homo sapiens
ccgctgggaga

SEQ ID NO: 1938258 - DNA, 17 bp, Homo sapiens
ccgctgttttggggtct

SEQ ID NO: 1938259 - DNA, 15 bp, Homo sapiens
ccgcttggagcagag

SEQ ID NO: 1938260 - DNA, 18 bp, Homo sapiens
ccggaaggacacagtcag

SEQ ID NO: 1938261 - DNA, 16 bp, Homo sapiens
ccggaggggcctggca

SEQ ID NO: 1938262 - DNA, 19 bp, Homo sapiens
ccggatgacacaaatacca

SEQ ID NO: 1938263 - DNA, 23 bp, Homo sapiens
ccggcagcctggttccctctttc

SEQ ID NO: 1938264 - DNA, 15 bp, Homo sapiens
ccggcccacgtcctg

SEQ ID NO: 1938265 - DNA, 17 bp, Homo sapiens
ccgggacctggtgctgc

SEQ ID NO: 1938266 - DNA, 21 bp, Homo sapiens
ccgggatgcgcctgatcacca

SEQ ID NO: 1938267 - DNA, 17 bp, Homo sapiens
ccgggggaagctgagcc

SEQ ID NO: 1938268 - DNA, 12 bp, Homo sapiens
ccgggggtgggg

SEQ ID NO: 1938269 - DNA, 19 bp, Homo sapiens
ccgggggtgggggcctgct

SEQ ID NO: 1938270 - DNA, 21 bp, Homo sapiens
ccgggggtgggggcctgctgt

SEQ ID NO: 1938271 - DNA, 14 bp, Homo sapiens
ccgggtctgcctct

SEQ ID NO: 1938272 - DNA, 13 bp, Homo sapiens
ccgggtggcagcg

SEQ ID NO: 1938273 - DNA, 18 bp, Homo sapiens
ccgggtggcagcgcccag

SEQ ID NO: 1938274 - DNA, 23 bp, Homo sapiens
ccgtacgactcttttccaaacac

SEQ ID NO: 1938275 - DNA, 12 bp, Homo sapiens
ccgtatttcaga

SEQ ID NO: 1938276 - DNA, 15 bp, Homo sapiens
ccgtccctttccctg

SEQ ID NO: 1938277 - DNA, 15 bp, Homo sapiens
ccgtcggaatggtaa

SEQ ID NO: 1938278 - DNA, 17 bp, Homo sapiens
gtaaattattgtaaact

SEQ ID NO: 1938279 - DNA, 18 bp, Homo sapiens
gtaacctcttcagaggcc

SEQ ID NO: 1938280 - DNA, 20 bp, Homo sapiens
gtaacctcttcagaggccct

SEQ ID NO: 1938281 - DNA, 13 bp, Homo sapiens
gtaactgttcttg

SEQ ID NO: 1938282 - DNA, 16 bp, Homo sapiens
gtaaggacttgtgcct

SEQ ID NO: 1938283 - DNA, 17 bp, Homo sapiens
gtaaggcagctctgtcg

SEQ ID NO: 1938284 - DNA, 14 bp, Homo sapiens
gtaatcaatgtttc

SEQ ID NO: 1938285 - DNA, 22 bp, Homo sapiens
gtaattctaaatgaatgtttac

SEQ ID NO: 1938286 - DNA, 21 bp, Homo sapiens
gtacaagtgctcagttccaat

SEQ ID NO: 1938287 - DNA, 21 bp, Homo sapiens
gtacagttatttatgcctctg

SEQ ID NO: 1938288 - DNA, 21 bp, Homo sapiens
gtaccaatcattttaattatt

SEQ ID NO: 1938289 - DNA, 18 bp, Homo sapiens
gtacctattgaacatgtg

SEQ ID NO: 1938290 - DNA, 17 bp, Homo sapiens
gtacctgcccccaatcc

SEQ ID NO: 1938291 - DNA, 15 bp, Homo sapiens
gtactcaaatgtagc

SEQ ID NO: 1938292 - DNA, 16 bp, Homo sapiens
gtactgagccttgtaa

SEQ ID NO: 1938293 - DNA, 21 bp, Homo sapiens
gtactgagttctcatccacag

SEQ ID NO: 1938294 - DNA, 14 bp, Homo sapiens
gtagaagagggaga

SEQ ID NO: 1938295 - DNA, 16 bp, Homo sapiens
gtagaagagggagaag

SEQ ID NO: 1938296 - DNA, 14 bp, Homo sapiens
gtagagaggacagt

SEQ ID NO: 1938297 - DNA, 15 bp, Homo sapiens
gtaggagctgagctt

SEQ ID NO: 1938298 - DNA, 21 bp, Homo sapiens
gtagggggcctgagttgaggg

SEQ ID NO: 1938299 - DNA, 16 bp, Homo sapiens
gtagggtgaggcgtgg

SEQ ID NO: 1938300 - DNA, 17 bp, Homo sapiens
gtagggttgccagtcct

SEQ ID NO: 1938301 - DNA, 23 bp, Homo sapiens
gtaggtatcattttctgcattta

SEQ ID NO: 1938302 - DNA, 15 bp, Homo sapiens
gtaggttgaggacag

SEQ ID NO: 1938303 - DNA, 15 bp, Homo sapiens
gtataataaaaccaa

SEQ ID NO: 1938304 - DNA, 18 bp, Homo sapiens
gtataccacctgtacata

SEQ ID NO: 1938305 - DNA, 16 bp, Homo sapiens
gtatatatttaggatt

SEQ ID NO: 1938306 - DNA, 14 bp, Homo sapiens
gtatatcttaagat

SEQ ID NO: 1938307 - DNA, 14 bp, Homo sapiens
gtatattcatttca

SEQ ID NO: 1938308 - DNA, 22 bp, Homo sapiens
gtatcaggacccagaggaaggg

SEQ ID NO: 1938309 - DNA, 15 bp, Homo sapiens
gtatctgtaaccctt

SEQ ID NO: 1938310 - DNA, 18 bp, Homo sapiens
gtatctgtaacccttgaa

SEQ ID NO: 1938311 - DNA, 18 bp, Homo sapiens
gtatgaataaagacacct

SEQ ID NO: 1938312 - DNA, 23 bp, Homo sapiens
gtatgggtcattctcacctgaat

SEQ ID NO: 1938313 - DNA, 23 bp, Homo sapiens
gtattaagctaatggtcctgtta

SEQ ID NO: 1938314 - DNA, 20 bp, Homo sapiens
gtattacttttctgcaatgt

SEQ ID NO: 1938315 - DNA, 13 bp, Homo sapiens
gtattctctgagc

SEQ ID NO: 1938316 - DNA, 13 bp, Homo sapiens
gtattgccacctc

SEQ ID NO: 1938317 - DNA, 19 bp, Homo sapiens
gtattgccacctctggcca

SEQ ID NO: 1938318 - DNA, 13 bp, Homo sapiens
gtatttcaaattg

SEQ ID NO: 1938319 - DNA, 11 bp, Homo sapiens
gtatttcagac

SEQ ID NO: 1938320 - DNA, 14 bp, Homo sapiens
gtcaaacgtgaaaa

SEQ ID NO: 1938321 - DNA, 21 bp, Homo sapiens
gtcaaccttgtgtgagtgtga

SEQ ID NO: 1938322 - DNA, 17 bp, Homo sapiens
gtcaagaagaagatgga

SEQ ID NO: 1938323 - DNA, 17 bp, Homo sapiens
gtcaagtgcgtccacga

SEQ ID NO: 1938324 - DNA, 22 bp, Homo sapiens
gtcaagttcatagtttctgtaa

SEQ ID NO: 1938325 - DNA, 17 bp, Homo sapiens
gtcaagttccgtctcct

SEQ ID NO: 1938326 - DNA, 18 bp, Homo sapiens
gtcaataattgtggagag

SEQ ID NO: 1938327 - DNA, 14 bp, Homo sapiens
gtcaatgtttgctt

SEQ ID NO: 1938328 - DNA, 15 bp, Homo sapiens
gtcacactgctggga

SEQ ID NO: 1938329 - DNA, 13 bp, Homo sapiens
gtcacagaggcag

SEQ ID NO: 1938330 - DNA, 17 bp, Homo sapiens
gtcacagaggcagtggc

SEQ ID NO: 1938331 - DNA, 23 bp, Homo sapiens
gtcactggtaccggatgcagacc

SEQ ID NO: 1938332 - DNA, 16 bp, Homo sapiens
gtcagacgcctgagga

SEQ ID NO: 1938333 - DNA, 17 bp, Homo sapiens
gtcagacgcctgaggaa

SEQ ID NO: 1938334 - DNA, 13 bp, Homo sapiens
gtcagagcccagg

SEQ ID NO: 1938335 - DNA, 13 bp, Homo sapiens
gtcagcagggggg

SEQ ID NO: 1938336 - DNA, 14 bp, Homo sapiens
gtcagcccagtggg

SEQ ID NO: 1938337 - DNA, 15 bp, Homo sapiens
gtcagccctgctgtc

SEQ ID NO: 1938338 - DNA, 14 bp, Homo sapiens
gtcaggccacggca

SEQ ID NO: 1938339 - DNA, 15 bp, Homo sapiens
gtcaggccacggcag

SEQ ID NO: 1938340 - DNA, 16 bp, Homo sapiens
gtcaggccacggcagc

SEQ ID NO: 1938341 - DNA, 16 bp, Homo sapiens
gtcagtaccttcaaac

SEQ ID NO: 1938342 - DNA, 18 bp, Homo sapiens
gtcagtgaagcccaggag

SEQ ID NO: 1938343 - DNA, 19 bp, Homo sapiens
gtcagtgtgcaaagaaaag

SEQ ID NO: 1938344 - DNA, 16 bp, Homo sapiens
gtcagtgtgccaccct

SEQ ID NO: 1938345 - DNA, 19 bp, Homo sapiens
gtcagtgtgccaccctctg

SEQ ID NO: 1938346 - DNA, 22 bp, Homo sapiens
gtcagtgtgccaccctctgcag

SEQ ID NO: 1938347 - DNA, 23 bp, Homo sapiens
gtcagtgtgccaccctctgcagg

SEQ ID NO: 1938348 - DNA, 18 bp, Homo sapiens
gtcataactaaataaagc

SEQ ID NO: 1938349 - DNA, 15 bp, Homo sapiens
gtcataccaatgaaa

SEQ ID NO: 1938350 - DNA, 16 bp, Homo sapiens
gtcatctcagctggat

SEQ ID NO: 1938351 - DNA, 16 bp, Homo sapiens
gtcatgagctgagcag

SEQ ID NO: 1938352 - DNA, 18 bp, Homo sapiens
gtcatgagctgagcaggg

SEQ ID NO: 1938353 - DNA, 14 bp, Homo sapiens
gtcattctcacctg

SEQ ID NO: 1938354 - DNA, 22 bp, Homo sapiens
gtcatttgctgagcatgtactg

SEQ ID NO: 1938355 - DNA, 20 bp, Homo sapiens
gtccaacgtggggcagcaca

SEQ ID NO: 1938356 - DNA, 21 bp, Homo sapiens
gtccaacgtggggcagcacag

SEQ ID NO: 1938357 - DNA, 21 bp, Homo sapiens
gtccaatctgcaagtcccagg

SEQ ID NO: 1938358 - DNA, 20 bp, Homo sapiens
gtccacacaagacagcagag

SEQ ID NO: 1938359 - DNA, 16 bp, Homo sapiens
gtccacatctaacaaa

SEQ ID NO: 1938360 - DNA, 17 bp, Homo sapiens
gtccacccgtttccaag

SEQ ID NO: 1938361 - DNA, 19 bp, Homo sapiens
gtccacccgtttccaagcc

SEQ ID NO: 1938362 - DNA, 20 bp, Homo sapiens
gtccacccgtttccaagcct

SEQ ID NO: 1938363 - DNA, 22 bp, Homo sapiens
gtccacccgtttccaagcctgg

SEQ ID NO: 1938364 - DNA, 19 bp, Homo sapiens
gtccatgaaaaacagcaga

SEQ ID NO: 1938365 - DNA, 14 bp, Homo sapiens
gtccatgggcagag

SEQ ID NO: 1938366 - DNA, 16 bp, Homo sapiens
gtccatgggcagagcc

SEQ ID NO: 1938367 - DNA, 18 bp, Homo sapiens
gtccatttacctggaaac

SEQ ID NO: 1938368 - DNA, 22 bp, Homo sapiens
gtcccaccagggaccagcccag

SEQ ID NO: 1938369 - DNA, 20 bp, Homo sapiens
gtcccgagccccctgtcctt

SEQ ID NO: 1938370 - DNA, 19 bp, Homo sapiens
gtcccgagggcgcctgggt

SEQ ID NO: 1938371 - DNA, 20 bp, Homo sapiens
gtcccgagggcgcctgggtc

SEQ ID NO: 1938372 - DNA, 23 bp, Homo sapiens
gtccctaccgagtctcttctcca

SEQ ID NO: 1938373 - DNA, 17 bp, Homo sapiens
gtccctgcgtctcctgc

SEQ ID NO: 1938374 - DNA, 10 bp, Homo sapiens
gtccctttcc

SEQ ID NO: 1938375 - DNA, 15 bp, Homo sapiens
gtccgatctttgact

SEQ ID NO: 1938376 - DNA, 19 bp, Homo sapiens
gtcctcccagctgacggca

SEQ ID NO: 1938377 - DNA, 14 bp, Homo sapiens
gtcctcggcagctc

SEQ ID NO: 1938378 - DNA, 22 bp, Homo sapiens
gtcctgcaagtccatagctgag

SEQ ID NO: 1938379 - DNA, 23 bp, Homo sapiens
gtcctggggtggttggaggcctg

SEQ ID NO: 1938380 - DNA, 17 bp, Homo sapiens
gtcctgggtgctgtcat

SEQ ID NO: 1938381 - DNA, 16 bp, Homo sapiens
gtccttcccacggcca

SEQ ID NO: 1938382 - DNA, 18 bp, Homo sapiens
taaagtacgtgtttactt

SEQ ID NO: 1938383 - DNA, 13 bp, Homo sapiens
taaatacagtctt

SEQ ID NO: 1938384 - DNA, 16 bp, Homo sapiens
taaatactaaatatga

SEQ ID NO: 1938385 - DNA, 20 bp, Homo sapiens
taaatagtaaaaataaaatt

SEQ ID NO: 1938386 - DNA, 17 bp, Homo sapiens
taaatatatttaagata

SEQ ID NO: 1938387 - DNA, 13 bp, Homo sapiens
taaatatcacaaa

SEQ ID NO: 1938388 - DNA, 16 bp, Homo sapiens
taaatatcacaaagtt

SEQ ID NO: 1938389 - DNA, 23 bp, Homo sapiens
taaatatctatttatctgtctga

SEQ ID NO: 1938390 - DNA, 13 bp, Homo sapiens
taaatatgaaatt

SEQ ID NO: 1938391 - DNA, 14 bp, Homo sapiens
taaatatgaaattt

SEQ ID NO: 1938392 - DNA, 17 bp, Homo sapiens
taaatattcttgtccac

SEQ ID NO: 1938393 - DNA, 21 bp, Homo sapiens
taaatattcttgtccacattc

SEQ ID NO: 1938394 - DNA, 22 bp, Homo sapiens
taaatattcttgtccacattct

SEQ ID NO: 1938395 - DNA, 22 bp, Homo sapiens
taaatcaattctgatacagcct

SEQ ID NO: 1938396 - DNA, 13 bp, Homo sapiens
taaatcagaatct

SEQ ID NO: 1938397 - DNA, 18 bp, Homo sapiens
taaatcatttatctggat

SEQ ID NO: 1938398 - DNA, 13 bp, Homo sapiens
taaatgaatgttt

SEQ ID NO: 1938399 - DNA, 17 bp, Homo sapiens
taaatggtgagaattaa

SEQ ID NO: 1938400 - DNA, 18 bp, Homo sapiens
taaattattgtaaacttt

SEQ ID NO: 1938401 - DNA, 15 bp, Homo sapiens
taaattttcagaaag

SEQ ID NO: 1938402 - DNA, 22 bp, Homo sapiens
taacaactatgatttggaaaat

SEQ ID NO: 1938403 - DNA, 16 bp, Homo sapiens
taacaaggaaaacagt

SEQ ID NO: 1938404 - DNA, 13 bp, Homo sapiens
taacaattcctct

SEQ ID NO: 1938405 - DNA, 16 bp, Homo sapiens
taacatatattgttat

SEQ ID NO: 1938406 - DNA, 19 bp, Homo sapiens
taaccattggttaatctgg

SEQ ID NO: 1938407 - DNA, 17 bp, Homo sapiens
taacccttgaatttcta

SEQ ID NO: 1938408 - DNA, 18 bp, Homo sapiens
taactgccttaaaacttt

SEQ ID NO: 1938409 - DNA, 15 bp, Homo sapiens
taactttgcatgttc

SEQ ID NO: 1938410 - DNA, 18 bp, Homo sapiens
taactttgcatgttcttg

SEQ ID NO: 1938411 - DNA, 14 bp, Homo sapiens
taagagaatccaca

SEQ ID NO: 1938412 - DNA, 15 bp, Homo sapiens
taagataatatttaa

SEQ ID NO: 1938413 - DNA, 15 bp, Homo sapiens
taagatgaaattgcc

SEQ ID NO: 1938414 - DNA, 17 bp, Homo sapiens
taagcagaccactgata

SEQ ID NO: 1938415 - DNA, 20 bp, Homo sapiens
taagcagaccactgataaaa

SEQ ID NO: 1938416 - DNA, 17 bp, Homo sapiens
taagccacttaaaatgt

SEQ ID NO: 1938417 - DNA, 19 bp, Homo sapiens
taagccacttaaaatgttc

SEQ ID NO: 1938418 - DNA, 20 bp, Homo sapiens
taagctcaaggcgtgaggat

SEQ ID NO: 1938419 - DNA, 16 bp, Homo sapiens
taaggacttgtgcctc

SEQ ID NO: 1938420 - DNA, 18 bp, Homo sapiens
taaggatgggaaggaggg

SEQ ID NO: 1938421 - DNA, 12 bp, Homo sapiens
taagtaacttgt

SEQ ID NO: 1938422 - DNA, 16 bp, Homo sapiens
taagtttgatttcatt

SEQ ID NO: 1938423 - DNA, 19 bp, Homo sapiens
taataaaaccaaagaatag

SEQ ID NO: 1938424 - DNA, 17 bp, Homo sapiens
taataaatgtacattaa

SEQ ID NO: 1938425 - DNA, 19 bp, Homo sapiens
taataaatgtacattaatt

SEQ ID NO: 1938426 - DNA, 18 bp, Homo sapiens
taatatatataatactta

SEQ ID NO: 1938427 - DNA, 23 bp, Homo sapiens
gggcccctcctccagagcctggg

SEQ ID NO: 1938428 - DNA, 17 bp, Homo sapiens
gggccctttgagtgcag

SEQ ID NO: 1938429 - DNA, 15 bp, Homo sapiens
gggccggcagcctgg

SEQ ID NO: 1938430 - DNA, 15 bp, Homo sapiens
gggcctgctgtgggt

SEQ ID NO: 1938431 - DNA, 22 bp, Homo sapiens
gggcctggcagccgtgccttca

SEQ ID NO: 1938432 - DNA, 23 bp, Homo sapiens
gggcgcaagcgacacaggctgcc

SEQ ID NO: 1938433 - DNA, 16 bp, Homo sapiens
gggcgctgagggcagg

SEQ ID NO: 1938434 - DNA, 20 bp, Homo sapiens
gggcggcctgcagaccctgc

SEQ ID NO: 1938435 - DNA, 14 bp, Homo sapiens
gggctaaccagttc

SEQ ID NO: 1938436 - DNA, 19 bp, Homo sapiens
gggctaccctgagctgagg

SEQ ID NO: 1938437 - DNA, 20 bp, Homo sapiens
gggctaccctgagctgaggc

SEQ ID NO: 1938438 - DNA, 21 bp, Homo sapiens
gggctagtaataaaatattta

SEQ ID NO: 1938439 - DNA, 14 bp, Homo sapiens
gggctattccctgg

SEQ ID NO: 1938440 - DNA, 17 bp, Homo sapiens
gggctattccctggaga

SEQ ID NO: 1938441 - DNA, 12 bp, Homo sapiens
gggctccagagt

SEQ ID NO: 1938442 - DNA, 20 bp, Homo sapiens
gggctccagagtaggtgggt

SEQ ID NO: 1938443 - DNA, 12 bp, Homo sapiens
gggctccctgac

SEQ ID NO: 1938444 - DNA, 13 bp, Homo sapiens
gggctgccctggt

SEQ ID NO: 1938445 - DNA, 13 bp, Homo sapiens
gggctgggcagct

SEQ ID NO: 1938446 - DNA, 21 bp, Homo sapiens
gggctggtgacccagtcagag

SEQ ID NO: 1938447 - DNA, 15 bp, Homo sapiens
gggcttagaatgggg

SEQ ID NO: 1938448 - DNA, 16 bp, Homo sapiens
gggcttagaatggggc

SEQ ID NO: 1938449 - DNA, 18 bp, Homo sapiens
gggcttccctctgctcca

SEQ ID NO: 1938450 - DNA, 16 bp, Homo sapiens
gggcttggggtagaga

SEQ ID NO: 1938451 - DNA, 18 bp, Homo sapiens
gggcttggggtagagagg

SEQ ID NO: 1938452 - DNA, 20 bp, Homo sapiens
gggcttggggtagagaggac

SEQ ID NO: 1938453 - DNA, 21 bp, Homo sapiens
gggcttggggtagagaggaca

SEQ ID NO: 1938454 - DNA, 18 bp, Homo sapiens
ggggatctaaaaggagga

SEQ ID NO: 1938455 - DNA, 12 bp, Homo sapiens
ggggatgcaggc

SEQ ID NO: 1938456 - DNA, 20 bp, Homo sapiens
ggggcaagagctcaggagaa

SEQ ID NO: 1938457 - DNA, 13 bp, Homo sapiens
ggggccagaggct

SEQ ID NO: 1938458 - DNA, 11 bp, Homo sapiens
ggggcctggca

SEQ ID NO: 1938459 - DNA, 18 bp, Homo sapiens
ggggcttccatggtggtt

SEQ ID NO: 1938460 - DNA, 14 bp, Homo sapiens
ggggcttccctctg

SEQ ID NO: 1938461 - DNA, 19 bp, Homo sapiens
ggggcttggggtagagagg

SEQ ID NO: 1938462 - DNA, 15 bp, Homo sapiens
gggggcctgctgtgg

SEQ ID NO: 1938463 - DNA, 21 bp, Homo sapiens
gggggcttggggtagagagga

SEQ ID NO: 1938464 - DNA, 21 bp, Homo sapiens
gggggtgccaaccacctctgg

SEQ ID NO: 1938465 - DNA, 22 bp, Homo sapiens
gggggtgtcacagaggcagtgg

SEQ ID NO: 1938466 - DNA, 15 bp, Homo sapiens
ggggtctccaggagg

SEQ ID NO: 1938467 - DNA, 15 bp, Homo sapiens
ggggtggggcttgga

SEQ ID NO: 1938468 - DNA, 14 bp, Homo sapiens
gggtagggggcctg

SEQ ID NO: 1938469 - DNA, 15 bp, Homo sapiens
gggtagggggcctga

SEQ ID NO: 1938470 - DNA, 12 bp, Homo sapiens
gggtcagtgtgc

SEQ ID NO: 1938471 - DNA, 14 bp, Homo sapiens
gggtcgcctgccct

SEQ ID NO: 1938472 - DNA, 19 bp, Homo sapiens
gggtctccaggaggagact

SEQ ID NO: 1938473 - DNA, 18 bp, Homo sapiens
gggtctgggaggcaggtc

SEQ ID NO: 1938474 - DNA, 19 bp, Homo sapiens
gggtctgtgggactggccc

SEQ ID NO: 1938475 - DNA, 21 bp, Homo sapiens
gggtgcaatgataatgaagaa

SEQ ID NO: 1938476 - DNA, 21 bp, Homo sapiens
gggtgccaaccacctctggcc

SEQ ID NO: 1938477 - DNA, 23 bp, Homo sapiens
gggtgccaaccacctctggccct

SEQ ID NO: 1938478 - DNA, 21 bp, Homo sapiens
gggtggcagcgcccagcctgg

SEQ ID NO: 1938479 - DNA, 19 bp, Homo sapiens
gggtgggagccacagggac

SEQ ID NO: 1938480 - DNA, 13 bp, Homo sapiens
gggtggggcggga

SEQ ID NO: 1938481 - DNA, 15 bp, Homo sapiens
gggtggggcgggagg

SEQ ID NO: 1938482 - DNA, 16 bp, Homo sapiens
gggtgggggcctgctg

SEQ ID NO: 1938483 - DNA, 24 bp, Homo sapiens
gggtgggggcctgctgtgggtcag

SEQ ID NO: 1938484 - DNA, 14 bp, Homo sapiens
gggttaaagaaagg

SEQ ID NO: 1938485 - DNA, 17 bp, Homo sapiens
gggttaaagaaaggcag

SEQ ID NO: 1938486 - DNA, 16 bp, Homo sapiens
gggttctagaaggggc

SEQ ID NO: 1938487 - DNA, 16 bp, Homo sapiens
gggttgggttccagac

SEQ ID NO: 1938488 - DNA, 18 bp, Homo sapiens
gggttgggttccagacag

SEQ ID NO: 1938489 - DNA, 15 bp, Homo sapiens
gggttttcacttcct

SEQ ID NO: 1938490 - DNA, 20 bp, Homo sapiens
ggtaaaaagagaaggcaagc

SEQ ID NO: 1938491 - DNA, 12 bp, Homo sapiens
ggtaacactgat

SEQ ID NO: 1938492 - DNA, 15 bp, Homo sapiens
ggtaattaaggcagc

SEQ ID NO: 1938493 - DNA, 13 bp, Homo sapiens
ggtagggggcctg

SEQ ID NO: 1938494 - DNA, 16 bp, Homo sapiens
ggtcaataattgtgga

SEQ ID NO: 1938495 - DNA, 15 bp, Homo sapiens
ggtcactgccatgga

SEQ ID NO: 1938496 - DNA, 23 bp, Homo sapiens
ggtcactgcccacctgccaggct

SEQ ID NO: 1938497 - DNA, 13 bp, Homo sapiens
ggtcagagcccag

SEQ ID NO: 1938498 - DNA, 15 bp, Homo sapiens
ggtcagagcccagga

SEQ ID NO: 1938499 - DNA, 22 bp, Homo sapiens
ggtcaggaaggatgagcattta

SEQ ID NO: 1938500 - DNA, 20 bp, Homo sapiens
ggtcagtgaagcccaggagg

SEQ ID NO: 1938501 - DNA, 17 bp, Homo sapiens
ggtcagtgtgccaccct

SEQ ID NO: 1938502 - DNA, 16 bp, Homo sapiens
ggtccatgggcagagc

SEQ ID NO: 1938503 - DNA, 18 bp, Homo sapiens
ggtccatgggcagagccc

SEQ ID NO: 1938504 - DNA, 20 bp, Homo sapiens
ggtcccgagccccctgtcct

SEQ ID NO: 1938505 - DNA, 18 bp, Homo sapiens
ggtccctgcgtctcctgc

SEQ ID NO: 1938506 - DNA, 12 bp, Homo sapiens
ggtcgcctgccc

SEQ ID NO: 1938507 - DNA, 20 bp, Homo sapiens
ggtctatttctcccttcaat

SEQ ID NO: 1938508 - DNA, 13 bp, Homo sapiens
ggtctccacccct

SEQ ID NO: 1938509 - DNA, 14 bp, Homo sapiens
ggtctccacccctc

SEQ ID NO: 1938510 - DNA, 13 bp, Homo sapiens
ggtctggagcccc

SEQ ID NO: 1938511 - DNA, 11 bp, Homo sapiens
ggtctgggagg

SEQ ID NO: 1938512 - DNA, 14 bp, Homo sapiens
ggtctgggaggcag

SEQ ID NO: 1938513 - DNA, 15 bp, Homo sapiens
ggtctgggaggcagg

SEQ ID NO: 1938514 - DNA, 23 bp, Homo sapiens
ggtctgtcccgggtactcagtca

SEQ ID NO: 1938515 - DNA, 20 bp, Homo sapiens
ggtcttggagaggaggtgtg

SEQ ID NO: 1938516 - DNA, 21 bp, Homo sapiens
ggtctttgaaatatgcatgta

SEQ ID NO: 1938517 - DNA, 23 bp, Homo sapiens
ggtctttgaaatatgcatgtact

SEQ ID NO: 1938518 - DNA, 21 bp, Homo sapiens
ggtgaggtgggggtctggcct

SEQ ID NO: 1938519 - DNA, 18 bp, Homo sapiens
ggtgccaaccacctctgg

SEQ ID NO: 1938520 - DNA, 22 bp, Homo sapiens
ggtgccaaccacctctggccct

SEQ ID NO: 1938521 - DNA, 23 bp, Homo sapiens
ggtgccaaccacctctggccctg

SEQ ID NO: 1938522 - DNA, 20 bp, Homo sapiens
ggtgctctggctggagagga

SEQ ID NO: 1938523 - DNA, 17 bp, Homo sapiens
ggtgctgcctctacctg

SEQ ID NO: 1938524 - DNA, 20 bp, Homo sapiens
ggtgctgtcatgcccagctt

SEQ ID NO: 1938525 - DNA, 18 bp, Homo sapiens
ggtggcagcgcccagcct

SEQ ID NO: 1938526 - DNA, 16 bp, Homo sapiens
ggtggccgggggtggg

SEQ ID NO: 1938527 - DNA, 15 bp, Homo sapiens
ggtgggagccacagg

SEQ ID NO: 1938528 - DNA, 13 bp, Homo sapiens
ggtgggctccaga

SEQ ID NO: 1938529 - DNA, 16 bp, Homo sapiens
ggtgggggcctgctgt

SEQ ID NO: 1938530 - DNA, 14 bp, Homo sapiens
ggtggtcttggaga

SEQ ID NO: 1938531 - DNA, 13 bp, Homo sapiens
ggtggtgtctcac

SEQ ID NO: 1938532 - DNA, 13 bp, Homo sapiens
ggtggttggaggc

SEQ ID NO: 1938533 - DNA, 14 bp, Homo sapiens
ggtggttggaggcc

SEQ ID NO: 1938534 - DNA, 17 bp, Homo sapiens
ggtgtcacagaggcagt

SEQ ID NO: 1938535 - DNA, 18 bp, Homo sapiens
ggtgtcacagaggcagtg

SEQ ID NO: 1938536 - DNA, 21 bp, Homo sapiens
ggtgtggagtggaggggtcag

SEQ ID NO: 1938537 - DNA, 17 bp, Homo sapiens
ggaaggggccagaggct

SEQ ID NO: 1938538 - DNA, 13 bp, Homo sapiens
ggaagtcaaagca

SEQ ID NO: 1938539 - DNA, 17 bp, Homo sapiens
ggaagtggcctgagaag

SEQ ID NO: 1938540 - DNA, 14 bp, Homo sapiens
ggaagttgctgtgc

SEQ ID NO: 1938541 - DNA, 13 bp, Homo sapiens
ggaataataccta

SEQ ID NO: 1938542 - DNA, 16 bp, Homo sapiens
ggaatataaatatcac

SEQ ID NO: 1938543 - DNA, 23 bp, Homo sapiens
ggacagaaccaacgggtctgtgg

SEQ ID NO: 1938544 - DNA, 15 bp, Homo sapiens
ggacaggaagcacag

SEQ ID NO: 1938545 - DNA, 23 bp, Homo sapiens
ggacaggaagcacagcaggttta

SEQ ID NO: 1938546 - DNA, 18 bp, Homo sapiens
ggacagttgggtgtgaga

SEQ ID NO: 1938547 - DNA, 18 bp, Homo sapiens
ggaccacgtctccctggc

SEQ ID NO: 1938548 - DNA, 17 bp, Homo sapiens
ggaccagcccagcctgc

SEQ ID NO: 1938549 - DNA, 20 bp, Homo sapiens
ggacccggaggggcctggca

SEQ ID NO: 1938550 - DNA, 21 bp, Homo sapiens
ggacccggaggggcctggcag

SEQ ID NO: 1938551 - DNA, 13 bp, Homo sapiens
ggaccctcccagg

SEQ ID NO: 1938552 - DNA, 14 bp, Homo sapiens
ggacgcctgggggt

SEQ ID NO: 1938553 - DNA, 19 bp, Homo sapiens
ggacgcctgggggtgccag

SEQ ID NO: 1938554 - DNA, 20 bp, Homo sapiens
ggacgcctgggggtgccagg

SEQ ID NO: 1938555 - DNA, 20 bp, Homo sapiens
ggactctcagtctctgagca

SEQ ID NO: 1938556 - DNA, 21 bp, Homo sapiens
ggactctcagtctctgagcag

SEQ ID NO: 1938557 - DNA, 23 bp, Homo sapiens
ggacttcaaaatcagtgatggga

SEQ ID NO: 1938558 - DNA, 15 bp, Homo sapiens
ggacttgaaatcaaa

SEQ ID NO: 1938559 - DNA, 21 bp, Homo sapiens
ggacttgtgcctcttgggaga

SEQ ID NO: 1938560 - DNA, 21 bp, Homo sapiens
ggactttcttttcgccgtggc

SEQ ID NO: 1938561 - DNA, 13 bp, Homo sapiens
ggagaactagaga

SEQ ID NO: 1938562 - DNA, 15 bp, Homo sapiens
ggagaaggagaggct

SEQ ID NO: 1938563 - DNA, 13 bp, Homo sapiens
ggagaaggcctgc

SEQ ID NO: 1938564 - DNA, 16 bp, Homo sapiens
ggagaaggcctgcccc

SEQ ID NO: 1938565 - DNA, 15 bp, Homo sapiens
ggagaagggacagcg

SEQ ID NO: 1938566 - DNA, 12 bp, Homo sapiens
ggagacaatcta

SEQ ID NO: 1938567 - DNA, 14 bp, Homo sapiens
ggagaccctgtctt

SEQ ID NO: 1938568 - DNA, 20 bp, Homo sapiens
ggagactgggctgagggagc

SEQ ID NO: 1938569 - DNA, 17 bp, Homo sapiens
ggagagaatgagagagt

SEQ ID NO: 1938570 - DNA, 18 bp, Homo sapiens
ggagagaatgagagagtg

SEQ ID NO: 1938571 - DNA, 17 bp, Homo sapiens
ggagagaccttctctta

SEQ ID NO: 1938572 - DNA, 15 bp, Homo sapiens
ggagaggaaaagcca

SEQ ID NO: 1938573 - DNA, 14 bp, Homo sapiens
ggagaggaagcaca

SEQ ID NO: 1938574 - DNA, 12 bp, Homo sapiens
ggagaggaagcc

SEQ ID NO: 1938575 - DNA, 12 bp, Homo sapiens
ggagaggagaga

SEQ ID NO: 1938576 - DNA, 18 bp, Homo sapiens
ggagaggagaggctgctg

SEQ ID NO: 1938577 - DNA, 14 bp, Homo sapiens
ggagaggagtgcgc

SEQ ID NO: 1938578 - DNA, 18 bp, Homo sapiens
ggagaggctctgaaagct

SEQ ID NO: 1938579 - DNA, 17 bp, Homo sapiens
ggagaggctgctgtcac

SEQ ID NO: 1938580 - DNA, 23 bp, Homo sapiens
ggagaggtcttttttaaaaggaa

SEQ ID NO: 1938581 - DNA, 19 bp, Homo sapiens
ggagatgcatctgtggcct

SEQ ID NO: 1938582 - DNA, 19 bp, Homo sapiens
ggagatggaggaaagtgat

SEQ ID NO: 1938583 - DNA, 14 bp, Homo sapiens
ggagccacaggcag

SEQ ID NO: 1938584 - DNA, 15 bp, Homo sapiens
ggagccacaggcaga

SEQ ID NO: 1938585 - DNA, 14 bp, Homo sapiens
ggagccacagggac

SEQ ID NO: 1938586 - DNA, 12 bp, Homo sapiens
ggagccagctct

SEQ ID NO: 1938587 - DNA, 22 bp, Homo sapiens
ggagccgcaggggcccctcctc

SEQ ID NO: 1938588 - DNA, 17 bp, Homo sapiens
ggagccgggtctgcctc

SEQ ID NO: 1938589 - DNA, 20 bp, Homo sapiens
ggagcctcctgaccctgtga

SEQ ID NO: 1938590 - DNA, 15 bp, Homo sapiens
ggagcttccagatgg

SEQ ID NO: 1938591 - DNA, 23 bp, Homo sapiens
ggaggacaaaggtgattttcctg

SEQ ID NO: 1938592 - DNA, 14 bp, Homo sapiens
ggaggacagggagg

SEQ ID NO: 1938593 - DNA, 18 bp, Homo sapiens
ggaggaggcagaaccagc

SEQ ID NO: 1938594 - DNA, 16 bp, Homo sapiens
ggaggcacacagctgc

SEQ ID NO: 1938595 - DNA, 16 bp, Homo sapiens
ggaggcagaaccagct

SEQ ID NO: 1938596 - DNA, 22 bp, Homo sapiens
ggaggcaggtcccgagccccct

SEQ ID NO: 1938597 - DNA, 22 bp, Homo sapiens
ggaggccacgggggaggccgag

SEQ ID NO: 1938598 - DNA, 16 bp, Homo sapiens
ggaggccgaggcaggg

SEQ ID NO: 1938599 - DNA, 21 bp, Homo sapiens
ggaggcctgggagatgcagct

SEQ ID NO: 1938600 - DNA, 15 bp, Homo sapiens
ggaggcctggtctgg

SEQ ID NO: 1938601 - DNA, 17 bp, Homo sapiens
ggaggcctggtctggag

SEQ ID NO: 1938602 - DNA, 21 bp, Homo sapiens
ggaggctcacccccttctcca

SEQ ID NO: 1938603 - DNA, 17 bp, Homo sapiens
ggagggcagcagggcta

SEQ ID NO: 1938604 - DNA, 19 bp, Homo sapiens
ggagggccacatgggaggc

SEQ ID NO: 1938605 - DNA, 13 bp, Homo sapiens
ggaggggcctggc

SEQ ID NO: 1938606 - DNA, 14 bp, Homo sapiens
ggaggggcctggca

SEQ ID NO: 1938607 - DNA, 18 bp, Homo sapiens
ggaggggcctggcagccg

SEQ ID NO: 1938608 - DNA, 16 bp, Homo sapiens
ggaggggcctggcctg

SEQ ID NO: 1938609 - DNA, 23 bp, Homo sapiens
ggaggggtcagcaggggggttgg

SEQ ID NO: 1938610 - DNA, 22 bp, Homo sapiens
ggaggtgtggagtggaggggtc

SEQ ID NO: 1938611 - DNA, 14 bp, Homo sapiens
ggagtcagagagaa

SEQ ID NO: 1938612 - DNA, 18 bp, Homo sapiens
ggagtctgaaggagagga

SEQ ID NO: 1938613 - DNA, 20 bp, Homo sapiens
ggagtctgaaggagaggagt

SEQ ID NO: 1938614 - DNA, 12 bp, Homo sapiens
ggagtgccacat

SEQ ID NO: 1938615 - DNA, 20 bp, Homo sapiens
ggagtgccacatggccgctg

SEQ ID NO: 1938616 - DNA, 16 bp, Homo sapiens
ggagtgccacgtggcc

SEQ ID NO: 1938617 - DNA, 14 bp, Homo sapiens
ggagtggaaacaaa

SEQ ID NO: 1938618 - DNA, 21 bp, Homo sapiens
ggagtggaggggtcagcaggg

SEQ ID NO: 1938619 - DNA, 13 bp, Homo sapiens
ggagtgggagagg

SEQ ID NO: 1938620 - DNA, 13 bp, Homo sapiens
ggagtgggctctc

SEQ ID NO: 1938621 - DNA, 23 bp, Homo sapiens
ggagtgtgtgggggtctgggagg

SEQ ID NO: 1938622 - DNA, 17 bp, Homo sapiens
ggataggagcttccaga

SEQ ID NO: 1938623 - DNA, 11 bp, Homo sapiens
ggatccagaga

SEQ ID NO: 1938624 - DNA, 18 bp, Homo sapiens
ggatccctcatctgtccc

SEQ ID NO: 1938625 - DNA, 22 bp, Homo sapiens
ggatccctcatctgtccctccg

SEQ ID NO: 1938626 - DNA, 17 bp, Homo sapiens
ggatctcattggaccct

SEQ ID NO: 1938627 - DNA, 18 bp, Homo sapiens
ggatgcagagtcagcaga

SEQ ID NO: 1938628 - DNA, 17 bp, Homo sapiens
ggatgggaaggagggag

SEQ ID NO: 1938629 - DNA, 19 bp, Homo sapiens
ggatggggcatgtggccaa

SEQ ID NO: 1938630 - DNA, 19 bp, Homo sapiens
ggatggtcatcgtgacagc

SEQ ID NO: 1938631 - DNA, 14 bp, Homo sapiens
ggatgtggttaccg

SEQ ID NO: 1938632 - DNA, 13 bp, Homo sapiens
ggattgagtctgt

SEQ ID NO: 1938633 - DNA, 15 bp, Homo sapiens
ggattggtaccagag

SEQ ID NO: 1938634 - DNA, 17 bp, Homo sapiens
ggatttcaagggactgg

SEQ ID NO: 1938635 - DNA, 19 bp, Homo sapiens
ggatttgggttggaagtga

SEQ ID NO: 1938636 - DNA, 20 bp, Homo sapiens
ggcaaatccgaaatcagcag

SEQ ID NO: 1938637 - DNA, 11 bp, Homo sapiens
ggcaaatctcc

SEQ ID NO: 1938638 - DNA, 23 bp, Homo sapiens
ggcaacttgggaactagactccc

SEQ ID NO: 1938639 - DNA, 14 bp, Homo sapiens
ggcaagccacagaa

SEQ ID NO: 1938640 - DNA, 14 bp, Homo sapiens
ggcaagctggcagg

SEQ ID NO: 1938641 - DNA, 17 bp, Homo sapiens
ggcacaccctctctgtc

SEQ ID NO: 1938642 - DNA, 22 bp, Homo sapiens
ggcactgatgggcactggaaaa

SEQ ID NO: 1938643 - DNA, 15 bp, Homo sapiens
ggcactggtggcccg

SEQ ID NO: 1938644 - DNA, 16 bp, Homo sapiens
ggcagaatggtgggct

SEQ ID NO: 1938645 - DNA, 21 bp, Homo sapiens
ggcagaatggtgggctccaga

SEQ ID NO: 1938646 - DNA, 22 bp, Homo sapiens
ggcagaatggtgggctccagag

SEQ ID NO: 1938647 - DNA, 15 bp, Homo sapiens
ggcagaccagagagc

SEQ ID NO: 1938648 - DNA, 19 bp, Homo sapiens
ggcagagattgggggggct

SEQ ID NO: 1938649 - DNA, 14 bp, Homo sapiens
ggcagaggggagag

SEQ ID NO: 1938650 - DNA, 19 bp, Homo sapiens
ggcagaggggagaggaagc

SEQ ID NO: 1938651 - DNA, 20 bp, Homo sapiens
ggcagaggggagaggaagca

SEQ ID NO: 1938652 - DNA, 12 bp, Homo sapiens
ggcagcctgtgg

SEQ ID NO: 1938653 - DNA, 21 bp, Homo sapiens
ggcagcctgtgggagaaggga

SEQ ID NO: 1938654 - DNA, 22 bp, Homo sapiens
ggcagcgcccagcctggcccca

SEQ ID NO: 1938655 - DNA, 15 bp, Homo sapiens
ggcagcgctcctgga

SEQ ID NO: 1938656 - DNA, 16 bp, Homo sapiens
ggcaggggctgggcag

SEQ ID NO: 1938657 - DNA, 16 bp, Homo sapiens
ggcagtcacactgctg

SEQ ID NO: 1938658 - DNA, 19 bp, Homo sapiens
ggcagtcacactgctggga

SEQ ID NO: 1938659 - DNA, 16 bp, Homo sapiens
gggagccgcaggggcc

SEQ ID NO: 1938660 - DNA, 16 bp, Homo sapiens
gggaggccgaggcagg

SEQ ID NO: 1938661 - DNA, 16 bp, Homo sapiens
gggagggaacagacct

SEQ ID NO: 1938662 - DNA, 11 bp, Homo sapiens
gggagggcagc

SEQ ID NO: 1938663 - DNA, 14 bp, Homo sapiens
gggaggggaaccag

SEQ ID NO: 1938664 - DNA, 15 bp, Homo sapiens
gggagggtgggcgtg

SEQ ID NO: 1938665 - DNA, 19 bp, Homo sapiens
gggatgaattgcctgtcct

SEQ ID NO: 1938666 - DNA, 18 bp, Homo sapiens
gggatggtggagggccac

SEQ ID NO: 1938667 - DNA, 18 bp, Homo sapiens
gggatttcaagggactgg

SEQ ID NO: 1938668 - DNA, 19 bp, Homo sapiens
gggcaagagctcaggagaa

SEQ ID NO: 1938669 - DNA, 23 bp, Homo sapiens
gggcaagagctcaggagaaggcc

SEQ ID NO: 1938670 - DNA, 13 bp, Homo sapiens
gggcactggtggc

SEQ ID NO: 1938671 - DNA, 18 bp, Homo sapiens
gggcagaccagagagctc

SEQ ID NO: 1938672 - DNA, 14 bp, Homo sapiens
gggcagagcccaag

SEQ ID NO: 1938673 - DNA, 16 bp, Homo sapiens
gggcagcccctcccca

SEQ ID NO: 1938674 - DNA, 16 bp, Homo sapiens
gggcagcctgtgggag

SEQ ID NO: 1938675 - DNA, 17 bp, Homo sapiens
gggcagcctgtgggaga

SEQ ID NO: 1938676 - DNA, 13 bp, Homo sapiens
gggcagggcctgg

SEQ ID NO: 1938677 - DNA, 12 bp, Homo sapiens
gggcagtggaga

SEQ ID NO: 1938678 - DNA, 23 bp, Homo sapiens
gggccaagccagggttccagaca

SEQ ID NO: 1938679 - DNA, 12 bp, Homo sapiens
gggccagaggct

SEQ ID NO: 1938680 - DNA, 13 bp, Homo sapiens
gggccccctctct

SEQ ID NO: 1938681 - DNA, 11 bp, Homo sapiens
gcgcctgggtc

SEQ ID NO: 1938682 - DNA, 23 bp, Homo sapiens
gcgctgagggcagggttctagaa

SEQ ID NO: 1938683 - DNA, 18 bp, Homo sapiens
gcgctggcagcgctcctg

SEQ ID NO: 1938684 - DNA, 17 bp, Homo sapiens
gcggaaaccgggtggca

SEQ ID NO: 1938685 - DNA, 12 bp, Homo sapiens
gcggcagagagg

SEQ ID NO: 1938686 - DNA, 16 bp, Homo sapiens
gcggccgcctgtcctt

SEQ ID NO: 1938687 - DNA, 18 bp, Homo sapiens
gcggcctgcagaccctgc

SEQ ID NO: 1938688 - DNA, 14 bp, Homo sapiens
gcgggctgggcagc

SEQ ID NO: 1938689 - DNA, 18 bp, Homo sapiens
gcgggtaaaaagagaagg

SEQ ID NO: 1938690 - DNA, 22 bp, Homo sapiens
gcgggtaaaaagagaaggcaag

SEQ ID NO: 1938691 - DNA, 21 bp, Homo sapiens
gcggtcaataattgtggagag

SEQ ID NO: 1938692 - DNA, 22 bp, Homo sapiens
gcggtcactgcccacctgccag

SEQ ID NO: 1938693 - DNA, 16 bp, Homo sapiens
gcgtcctcctctgtga

SEQ ID NO: 1938694 - DNA, 18 bp, Homo sapiens
gcgtctgagcggccgcct

SEQ ID NO: 1938695 - DNA, 19 bp, Homo sapiens
gcgtctgagcggccgcctg

SEQ ID NO: 1938696 - DNA, 21 bp, Homo sapiens
gcgtgacttcagactctctcc

SEQ ID NO: 1938697 - DNA, 19 bp, Homo sapiens
gctaaagcaatatgcattt

SEQ ID NO: 1938698 - DNA, 14 bp, Homo sapiens
gctaatcagcattc

SEQ ID NO: 1938699 - DNA, 22 bp, Homo sapiens
gctaatggtcctgttatgtcat

SEQ ID NO: 1938700 - DNA, 15 bp, Homo sapiens
gctaattaggaagct

SEQ ID NO: 1938701 - DNA, 19 bp, Homo sapiens
gctaccctgagctgaggca

SEQ ID NO: 1938702 - DNA, 17 bp, Homo sapiens
gctagagcattctgggg

SEQ ID NO: 1938703 - DNA, 14 bp, Homo sapiens
gctagtctgtgcct

SEQ ID NO: 1938704 - DNA, 15 bp, Homo sapiens
gctagtctgtgcctc

SEQ ID NO: 1938705 - DNA, 19 bp, Homo sapiens
gctatagtgtataccacct

SEQ ID NO: 1938706 - DNA, 22 bp, Homo sapiens
gctatagtgtataccacctgta

SEQ ID NO: 1938707 - DNA, 23 bp, Homo sapiens
gctatagtgtataccacctgtac

SEQ ID NO: 1938708 - DNA, 15 bp, Homo sapiens
gctcacacatgagat

SEQ ID NO: 1938709 - DNA, 20 bp, Homo sapiens
gctcacattccctctcatcc

SEQ ID NO: 1938710 - DNA, 16 bp, Homo sapiens
gctcacccccttctcc

SEQ ID NO: 1938711 - DNA, 18 bp, Homo sapiens
gctcacccccttctccat

SEQ ID NO: 1938712 - DNA, 20 bp, Homo sapiens
gctcacccccttctccatcc

SEQ ID NO: 1938713 - DNA, 22 bp, Homo sapiens
gctcacccccttctccatccac

SEQ ID NO: 1938714 - DNA, 16 bp, Homo sapiens
gctcagccctccctgc

SEQ ID NO: 1938715 - DNA, 13 bp, Homo sapiens
gctcaggctgccc

SEQ ID NO: 1938716 - DNA, 12 bp, Homo sapiens
gctccagagggc

SEQ ID NO: 1938717 - DNA, 20 bp, Homo sapiens
gctccagagggcactctgct

SEQ ID NO: 1938718 - DNA, 21 bp, Homo sapiens
gctccagcgtggcctccgtga

SEQ ID NO: 1938719 - DNA, 12 bp, Homo sapiens
gctccattccca

SEQ ID NO: 1938720 - DNA, 16 bp, Homo sapiens
gctcccacaggccctt

SEQ ID NO: 1938721 - DNA, 17 bp, Homo sapiens
gctcccacaggcccttc

SEQ ID NO: 1938722 - DNA, 22 bp, Homo sapiens
gctcccacaggcccttcctctc

SEQ ID NO: 1938723 - DNA, 18 bp, Homo sapiens
gctccctgactgggagtt

SEQ ID NO: 1938724 - DNA, 16 bp, Homo sapiens
gctcctcccggtgccc

SEQ ID NO: 1938725 - DNA, 19 bp, Homo sapiens
gctcctcccggtgcccaag

SEQ ID NO: 1938726 - DNA, 14 bp, Homo sapiens
gctcctcttcctgc

SEQ ID NO: 1938727 - DNA, 11 bp, Homo sapiens
gctccttgggc

SEQ ID NO: 1938728 - DNA, 15 bp, Homo sapiens
gctcggcctcttgag

SEQ ID NO: 1938729 - DNA, 15 bp, Homo sapiens
gctcgggacttcaaa

SEQ ID NO: 1938730 - DNA, 12 bp, Homo sapiens
gctctcccaggt

SEQ ID NO: 1938731 - DNA, 15 bp, Homo sapiens
gctctgaaagctgct

SEQ ID NO: 1938732 - DNA, 16 bp, Homo sapiens
gctctgaaagctgctt

SEQ ID NO: 1938733 - DNA, 17 bp, Homo sapiens
gctctgaaagctgcttc

SEQ ID NO: 1938734 - DNA, 18 bp, Homo sapiens
gctctgaaagctgcttct

SEQ ID NO: 1938735 - DNA, 23 bp, Homo sapiens
gctctgatccctctacagagctt

SEQ ID NO: 1938736 - DNA, 17 bp, Homo sapiens
gctctgcgtgtcacctg

SEQ ID NO: 1938737 - DNA, 15 bp, Homo sapiens
gctctggctggagag

SEQ ID NO: 1938738 - DNA, 15 bp, Homo sapiens
gctctgggggctcca

SEQ ID NO: 1938739 - DNA, 23 bp, Homo sapiens
gctctgtatcaggacccagagga

SEQ ID NO: 1938740 - DNA, 20 bp, Homo sapiens
gctgaagtctctttttcttc

SEQ ID NO: 1938741 - DNA, 20 bp, Homo sapiens
gctgactggccccagggact

SEQ ID NO: 1938742 - DNA, 19 bp, Homo sapiens
gctgactgtactcctccca

SEQ ID NO: 1938743 - DNA, 21 bp, Homo sapiens
gctgactgtactcctcccagg

SEQ ID NO: 1938744 - DNA, 13 bp, Homo sapiens
gctgacttgcaga

SEQ ID NO: 1938745 - DNA, 19 bp, Homo sapiens
gctgagcccctccctcctg

SEQ ID NO: 1938746 - DNA, 15 bp, Homo sapiens
gctgagggcagggtt

SEQ ID NO: 1938747 - DNA, 18 bp, Homo sapiens
gctgccacacttcaggct

SEQ ID NO: 1938748 - DNA, 21 bp, Homo sapiens
gctgccacacttcaggctctt

SEQ ID NO: 1938749 - DNA, 21 bp, Homo sapiens
gctgccatgattttggccact

SEQ ID NO: 1938750 - DNA, 16 bp, Homo sapiens
gctgcccagcggctct

SEQ ID NO: 1938751 - DNA, 13 bp, Homo sapiens
gctgccctggtgc

SEQ ID NO: 1938752 - DNA, 14 bp, Homo sapiens
gctgccctggtgct

SEQ ID NO: 1938753 - DNA, 23 bp, Homo sapiens
gctgccctggtgctgccacactt

SEQ ID NO: 1938754 - DNA, 21 bp, Homo sapiens
gctgcctctacctgacactcc

SEQ ID NO: 1938755 - DNA, 15 bp, Homo sapiens
gctgccttagaacct

SEQ ID NO: 1938756 - DNA, 20 bp, Homo sapiens
gctgccttagaacctttctt

SEQ ID NO: 1938757 - DNA, 15 bp, Homo sapiens
gctgctcctagaggg

SEQ ID NO: 1938758 - DNA, 13 bp, Homo sapiens
gctgctcctcgca

SEQ ID NO: 1938759 - DNA, 15 bp, Homo sapiens
gctgctctcccaggt

SEQ ID NO: 1938760 - DNA, 16 bp, Homo sapiens
gctggaagaacatcaa

SEQ ID NO: 1938761 - DNA, 18 bp, Homo sapiens
gctggaagaacatcaaga

SEQ ID NO: 1938762 - DNA, 21 bp, Homo sapiens
gctggactctcagtctctgag

SEQ ID NO: 1938763 - DNA, 21 bp, Homo sapiens
gctggacttttgcagcttcct

SEQ ID NO: 1938764 - DNA, 18 bp, Homo sapiens
gctggagtgggctctctg

SEQ ID NO: 1938765 - DNA, 19 bp, Homo sapiens
gctggcaaagacagaagcc

SEQ ID NO: 1938766 - DNA, 17 bp, Homo sapiens
gctggcagcgctcctgg

SEQ ID NO: 1938767 - DNA, 20 bp, Homo sapiens
gctggcaggagggtggcact

SEQ ID NO: 1938768 - DNA, 20 bp, Homo sapiens
gctggctgccttagaacctt

SEQ ID NO: 1938769 - DNA, 16 bp, Homo sapiens
gctgggagagccaagg

SEQ ID NO: 1938770 - DNA, 19 bp, Homo sapiens
gctgggcagaggggagagg

SEQ ID NO: 1938771 - DNA, 20 bp, Homo sapiens
gctgggcagaggggagagga

SEQ ID NO: 1938772 - DNA, 19 bp, Homo sapiens
gctgggcgcctctgtcctg

SEQ ID NO: 1938773 - DNA, 20 bp, Homo sapiens
gctgggcgcctctgtcctgg

SEQ ID NO: 1938774 - DNA, 23 bp, Homo sapiens
gctgggcgcctctgtcctggccc

SEQ ID NO: 1938775 - DNA, 22 bp, Homo sapiens
gctgggtgtgtttcaggacagc

SEQ ID NO: 1938776 - DNA, 17 bp, Homo sapiens
gctgggtttgggcagtg

SEQ ID NO: 1938777 - DNA, 13 bp, Homo sapiens
gctggtcactgcc

SEQ ID NO: 1938778 - DNA, 13 bp, Homo sapiens
gctgtagaaggag

SEQ ID NO: 1938779 - DNA, 16 bp, Homo sapiens
gctgtcagaccttctt

SEQ ID NO: 1938780 - DNA, 16 bp, Homo sapiens
gctgtcatgcccagct

SEQ ID NO: 1938781 - DNA, 18 bp, Homo sapiens
gctgtcatgcccagcttg

SEQ ID NO: 1938782 - DNA, 16 bp, Homo sapiens
gctgtccctcctgagg

SEQ ID NO: 1938783 - DNA, 20 bp, Homo sapiens
gctgtccctcctgaggtctg

SEQ ID NO: 1938784 - DNA, 20 bp, Homo sapiens
gctgtgccccatcagcagct

SEQ ID NO: 1938785 - DNA, 22 bp, Homo sapiens
gctgtggcccctccttctcccc

SEQ ID NO: 1938786 - DNA, 20 bp, Homo sapiens
gctgtgggtcagtgtgccac

SEQ ID NO: 1938787 - DNA, 19 bp, Homo sapiens
gctgtgtggggagggtggg

SEQ ID NO: 1938788 - DNA, 19 bp, Homo sapiens
gctgttttaacggcctgca

SEQ ID NO: 1938789 - DNA, 16 bp, Homo sapiens
gctgttttggggtctt

SEQ ID NO: 1938790 - DNA, 21 bp, Homo sapiens
gcttactacatgtgggagctt

SEQ ID NO: 1938791 - DNA, 10 bp, Homo sapiens
gcttccagat

SEQ ID NO: 1938792 - DNA, 12 bp, Homo sapiens
gcttccctctgc

SEQ ID NO: 1938793 - DNA, 18 bp, Homo sapiens
gcttccctgactcattct

SEQ ID NO: 1938794 - DNA, 22 bp, Homo sapiens
gcttcctttgtttttttttcct

SEQ ID NO: 1938795 - DNA, 13 bp, Homo sapiens
gcttcggcctgct

SEQ ID NO: 1938796 - DNA, 14 bp, Homo sapiens
gcttctctctgtgg

SEQ ID NO: 1938797 - DNA, 12 bp, Homo sapiens
gcttctgctcac

SEQ ID NO: 1938798 - DNA, 19 bp, Homo sapiens
gcttctgctcacattccct

SEQ ID NO: 1938799 - DNA, 21 bp, Homo sapiens
gcttctgctcacattccctct

SEQ ID NO: 1938800 - DNA, 22 bp, Homo sapiens
gcttctgctcacattccctctc

SEQ ID NO: 1938801 - DNA, 22 bp, Homo sapiens
gcttctgtgcatttgtgtctgc

SEQ ID NO: 1938802 - DNA, 13 bp, Homo sapiens
gcttgaaagaaaa

SEQ ID NO: 1938803 - DNA, 21 bp, Homo sapiens
gcttgcactttgtgagtattc

SEQ ID NO: 1938804 - DNA, 23 bp, Homo sapiens
gcttgcatttctttatttctgtc

SEQ ID NO: 1938805 - DNA, 18 bp, Homo sapiens
gcttggggtagagaggac

SEQ ID NO: 1938806 - DNA, 14 bp, Homo sapiens
gcttgtagggtgag

SEQ ID NO: 1938807 - DNA, 20 bp, Homo sapiens
gcttgtagggtgaggcgtgg

SEQ ID NO: 1938808 - DNA, 21 bp, Homo sapiens
gctttgtaaaccggctggacc

SEQ ID NO: 1938809 - DNA, 22 bp, Homo sapiens
gccagggggtttgaggaccctc

SEQ ID NO: 1938810 - DNA, 13 bp, Homo sapiens
gccagggttccag

SEQ ID NO: 1938811 - DNA, 14 bp, Homo sapiens
gccagggttccaga

SEQ ID NO: 1938812 - DNA, 22 bp, Homo sapiens
gccagggttccagacagggtgg

SEQ ID NO: 1938813 - DNA, 14 bp, Homo sapiens
gccatattccagca

SEQ ID NO: 1938814 - DNA, 12 bp, Homo sapiens
gccatccctgag

SEQ ID NO: 1938815 - DNA, 23 bp, Homo sapiens
gccatccctgagagaccagaccg

SEQ ID NO: 1938816 - DNA, 22 bp, Homo sapiens
gccatctgcgacaccaccaaca

SEQ ID NO: 1938817 - DNA, 22 bp, Homo sapiens
gccatctgtaaatatcccagag

SEQ ID NO: 1938818 - DNA, 15 bp, Homo sapiens
gccatgattttggcc

SEQ ID NO: 1938819 - DNA, 22 bp, Homo sapiens
gccatgattttggccactttgc

SEQ ID NO: 1938820 - DNA, 13 bp, Homo sapiens
gccatggccagga

SEQ ID NO: 1938821 - DNA, 21 bp, Homo sapiens
gcccaagaatagatgctgact

SEQ ID NO: 1938822 - DNA, 12 bp, Homo sapiens
gcccacccctct

SEQ ID NO: 1938823 - DNA, 13 bp, Homo sapiens
gcccacctgccag

SEQ ID NO: 1938824 - DNA, 14 bp, Homo sapiens
gcccacctgccagg

SEQ ID NO: 1938825 - DNA, 15 bp, Homo sapiens
gcccacctgccaggc

SEQ ID NO: 1938826 - DNA, 21 bp, Homo sapiens
gcccacctgccaggctgcagg

SEQ ID NO: 1938827 - DNA, 22 bp, Homo sapiens
gcccacctgccaggctgcaggg

SEQ ID NO: 1938828 - DNA, 17 bp, Homo sapiens
gcccactctgaccgggc

SEQ ID NO: 1938829 - DNA, 20 bp, Homo sapiens
gcccagcactgcttgaggaa

SEQ ID NO: 1938830 - DNA, 21 bp, Homo sapiens
gcccagcactgcttgaggaaa

SEQ ID NO: 1938831 - DNA, 12 bp, Homo sapiens
gcccagcctgca

SEQ ID NO: 1938832 - DNA, 11 bp, Homo sapiens
gcccagcctgg

SEQ ID NO: 1938833 - DNA, 14 bp, Homo sapiens
gcccagcctggagc

SEQ ID NO: 1938834 - DNA, 17 bp, Homo sapiens
gcccagcctggccccaa

SEQ ID NO: 1938835 - DNA, 20 bp, Homo sapiens
gcccagcctggccccaagca

SEQ ID NO: 1938836 - DNA, 20 bp, Homo sapiens
gcccagcggctcttcctgga

SEQ ID NO: 1938837 - DNA, 15 bp, Homo sapiens
gcccaggaggacctg

SEQ ID NO: 1938838 - DNA, 15 bp, Homo sapiens
gcccaggcggtcact

SEQ ID NO: 1938839 - DNA, 17 bp, Homo sapiens
gcccagtcttgagtggg

SEQ ID NO: 1938840 - DNA, 23 bp, Homo sapiens
gccccacccctgaactggcccca

SEQ ID NO: 1938841 - DNA, 16 bp, Homo sapiens
gccccagctcctcttc

SEQ ID NO: 1938842 - DNA, 20 bp, Homo sapiens
gccccagctcctcttcctgc

SEQ ID NO: 1938843 - DNA, 18 bp, Homo sapiens
gccccaggctcaggctgc

SEQ ID NO: 1938844 - DNA, 21 bp, Homo sapiens
gccccaggctcaggctgccca

SEQ ID NO: 1938845 - DNA, 22 bp, Homo sapiens
gccccaggctcaggctgcccag

SEQ ID NO: 1938846 - DNA, 12 bp, Homo sapiens
gccccagggcag

SEQ ID NO: 1938847 - DNA, 19 bp, Homo sapiens
gccccatcagcagcttgac

SEQ ID NO: 1938848 - DNA, 15 bp, Homo sapiens
gccccattcctggga

SEQ ID NO: 1938849 - DNA, 16 bp, Homo sapiens
gcccccagctgctcct

SEQ ID NO: 1938850 - DNA, 15 bp, Homo sapiens
gccccccttcccacc

SEQ ID NO: 1938851 - DNA, 18 bp, Homo sapiens
gccccccttcccacccct

SEQ ID NO: 1938852 - DNA, 14 bp, Homo sapiens
gcccccgccctctg

SEQ ID NO: 1938853 - DNA, 15 bp, Homo sapiens
gcccccgccctctgc

SEQ ID NO: 1938854 - DNA, 21 bp, Homo sapiens
gccccctgtccttcccacggc

SEQ ID NO: 1938855 - DNA, 14 bp, Homo sapiens
gcccctatcctgca

SEQ ID NO: 1938856 - DNA, 20 bp, Homo sapiens
gcccctatcctgcaccctct

SEQ ID NO: 1938857 - DNA, 14 bp, Homo sapiens
gcccctcccttcaa

SEQ ID NO: 1938858 - DNA, 14 bp, Homo sapiens
gcccctcctccaga

SEQ ID NO: 1938859 - DNA, 23 bp, Homo sapiens
gcccctccttctcccctccagac

SEQ ID NO: 1938860 - DNA, 14 bp, Homo sapiens
gcccgacagcctgg

SEQ ID NO: 1938861 - DNA, 16 bp, Homo sapiens
gcccgacagcctggca

SEQ ID NO: 1938862 - DNA, 19 bp, Homo sapiens
gcccgacagcctggcacag

SEQ ID NO: 1938863 - DNA, 16 bp, Homo sapiens
gcccgactctctccat

SEQ ID NO: 1938864 - DNA, 19 bp, Homo sapiens
gcccggaagttgctgtgcc

SEQ ID NO: 1938865 - DNA, 17 bp, Homo sapiens
gccctcactccactccc

SEQ ID NO: 1938866 - DNA, 16 bp, Homo sapiens
gccctccctccctcca

SEQ ID NO: 1938867 - DNA, 17 bp, Homo sapiens
gccctccctccctccac

SEQ ID NO: 1938868 - DNA, 14 bp, Homo sapiens
gccctcgctgccag

SEQ ID NO: 1938869 - DNA, 15 bp, Homo sapiens
gccctcgctgccagc

SEQ ID NO: 1938870 - DNA, 14 bp, Homo sapiens
gccctctctgcagt

SEQ ID NO: 1938871 - DNA, 15 bp, Homo sapiens
gccctctgcccccag

SEQ ID NO: 1938872 - DNA, 20 bp, Homo sapiens
gccctctgcccccagctgct

SEQ ID NO: 1938873 - DNA, 14 bp, Homo sapiens
gccctgcaaaagga

SEQ ID NO: 1938874 - DNA, 20 bp, Homo sapiens
gccctgctttgggctgccct

SEQ ID NO: 1938875 - DNA, 21 bp, Homo sapiens
gccctgctttgggctgccctg

SEQ ID NO: 1938876 - DNA, 15 bp, Homo sapiens
gccctggctcccaca

SEQ ID NO: 1938877 - DNA, 19 bp, Homo sapiens
gccctggctcccacaggcc

SEQ ID NO: 1938878 - DNA, 16 bp, Homo sapiens
gccctggtgctgccac

SEQ ID NO: 1938879 - DNA, 12 bp, Homo sapiens
gcccttcctctc

SEQ ID NO: 1938880 - DNA, 22 bp, Homo sapiens
gcccttcctctccactgccttc

SEQ ID NO: 1938881 - DNA, 18 bp, Homo sapiens
gcccttttagtggtggtg

SEQ ID NO: 1938882 - DNA, 12 bp, Homo sapiens
gccgaggcaggg

SEQ ID NO: 1938883 - DNA, 20 bp, Homo sapiens
gccgaggcaggggctgggca

SEQ ID NO: 1938884 - DNA, 19 bp, Homo sapiens
gccgcaggggcccctcctc

SEQ ID NO: 1938885 - DNA, 17 bp, Homo sapiens
gccgctgagcgaggaga

SEQ ID NO: 1938886 - DNA, 17 bp, Homo sapiens
gccgctgctctcccagg

SEQ ID NO: 1938887 - DNA, 12 bp, Homo sapiens
gccgctgggaga

SEQ ID NO: 1938888 - DNA, 17 bp, Homo sapiens
gccgctgggagagccaa

SEQ ID NO: 1938889 - DNA, 23 bp, Homo sapiens
gccggcccacgtcctgggtgctg

SEQ ID NO: 1938890 - DNA, 22 bp, Homo sapiens
gccgggggtgggggcctgctgt

SEQ ID NO: 1938891 - DNA, 23 bp, Homo sapiens
gccgggggtgggggcctgctgtg

SEQ ID NO: 1938892 - DNA, 14 bp, Homo sapiens
gccgggtctgcctc

SEQ ID NO: 1938893 - DNA, 11 bp, Homo sapiens
gccgtgagagc

SEQ ID NO: 1938894 - DNA, 11 bp, Homo sapiens
gccgtggcttc

SEQ ID NO: 1938895 - DNA, 13 bp, Homo sapiens
gccgtggcttccc

SEQ ID NO: 1938896 - DNA, 22 bp, Homo sapiens
gccgtggcttcccgctcagccc

SEQ ID NO: 1938897 - DNA, 22 bp, Homo sapiens
gccgttagggaaatccaactcc

SEQ ID NO: 1938898 - DNA, 19 bp, Homo sapiens
gcctagtgaaggcttctct

SEQ ID NO: 1938899 - DNA, 16 bp, Homo sapiens
gcctagtggggagggg

SEQ ID NO: 1938900 - DNA, 20 bp, Homo sapiens
gcctagtggggaggggcctg

SEQ ID NO: 1938901 - DNA, 23 bp, Homo sapiens
gcctcagtgagatcagtcagctc

SEQ ID NO: 1938902 - DNA, 19 bp, Homo sapiens
gcctcatgctctctataga

SEQ ID NO: 1938903 - DNA, 20 bp, Homo sapiens
gcctccagcacatgcggctt

SEQ ID NO: 1938904 - DNA, 16 bp, Homo sapiens
gcctccgtatttcaga

SEQ ID NO: 1938905 - DNA, 13 bp, Homo sapiens
gcctcctctgtcc

SEQ ID NO: 1938906 - DNA, 13 bp, Homo sapiens
gcctctgagccag

SEQ ID NO: 1938907 - DNA, 15 bp, Homo sapiens
gcctctgagccagga

SEQ ID NO: 1938908 - DNA, 14 bp, Homo sapiens
gcctctgtcctggc

SEQ ID NO: 1938909 - DNA, 20 bp, Homo sapiens
gcctctgtcctggcccggga

SEQ ID NO: 1938910 - DNA, 22 bp, Homo sapiens
gcctcttcctccctccctgcag

SEQ ID NO: 1938911 - DNA, 15 bp, Homo sapiens
gcctcttctgggagg

SEQ ID NO: 1938912 - DNA, 13 bp, Homo sapiens
gcctgctgtgggt

SEQ ID NO: 1938913 - DNA, 14 bp, Homo sapiens
gcctggagccgtgg

SEQ ID NO: 1938914 - DNA, 14 bp, Homo sapiens
gcctggcacagggc

SEQ ID NO: 1938915 - DNA, 21 bp, Homo sapiens
gcctggcagccgtgccttcag

SEQ ID NO: 1938916 - DNA, 22 bp, Homo sapiens
gcctggcagccgtgccttcagc

SEQ ID NO: 1938917 - DNA, 12 bp, Homo sapiens
gcctggcctggt

SEQ ID NO: 1938918 - DNA, 18 bp, Homo sapiens
gcctgggagatgcagctg

SEQ ID NO: 1938919 - DNA, 19 bp, Homo sapiens
gcctgggagatgcagctgg

SEQ ID NO: 1938920 - DNA, 14 bp, Homo sapiens
gcctgggccactgg

SEQ ID NO: 1938921 - DNA, 18 bp, Homo sapiens
gcctgggccactggcatc

SEQ ID NO: 1938922 - DNA, 16 bp, Homo sapiens
gcctgggggtgccagg

SEQ ID NO: 1938923 - DNA, 12 bp, Homo sapiens
gcctgggtcctc

SEQ ID NO: 1938924 - DNA, 14 bp, Homo sapiens
gcctggtctggagc

SEQ ID NO: 1938925 - DNA, 20 bp, Homo sapiens
gcctggttccctctttcctg

SEQ ID NO: 1938926 - DNA, 16 bp, Homo sapiens
gcctgtgtgtaagctg

SEQ ID NO: 1938927 - DNA, 20 bp, Homo sapiens
gcctgtgtgtaagctgactg

SEQ ID NO: 1938928 - DNA, 21 bp, Homo sapiens
gcctgtgtgtaagctgactgg

SEQ ID NO: 1938929 - DNA, 13 bp, Homo sapiens
gccttcctcctgg

SEQ ID NO: 1938930 - DNA, 23 bp, Homo sapiens
gccttcgatacaccgggcctgga

SEQ ID NO: 1938931 - DNA, 15 bp, Homo sapiens
gccttggttcctcca

SEQ ID NO: 1938932 - DNA, 18 bp, Homo sapiens
gccttggttcctccagca

SEQ ID NO: 1938933 - DNA, 20 bp, Homo sapiens
gccttgtaattctaaatgaa

SEQ ID NO: 1938934 - DNA, 18 bp, Homo sapiens
gcctttggcaattcttct

SEQ ID NO: 1938935 - DNA, 14 bp, Homo sapiens
gcgaatgagctggg

SEQ ID NO: 1938936 - DNA, 17 bp, Homo sapiens
gcgaggaggctccagag

SEQ ID NO: 1938937 - DNA, 12 bp, Homo sapiens
gcgagggcctgc

SEQ ID NO: 1938938 - DNA, 12 bp, Homo sapiens
gcgcacacacac

SEQ ID NO: 1938939 - DNA, 16 bp, Homo sapiens
gcgccaccgtgggaga

SEQ ID NO: 1938940 - DNA, 13 bp, Homo sapiens
gcgccccttcccc

SEQ ID NO: 1938941 - DNA, 22 bp, Homo sapiens
gcagaatggtgggctccagagt

SEQ ID NO: 1938942 - DNA, 18 bp, Homo sapiens
gcagacagcaagggcttg

SEQ ID NO: 1938943 - DNA, 14 bp, Homo sapiens
gcagaccagagagc

SEQ ID NO: 1938944 - DNA, 17 bp, Homo sapiens
gcagaccagagagctca

SEQ ID NO: 1938945 - DNA, 22 bp, Homo sapiens
gcagaccccaccctgtctgcag

SEQ ID NO: 1938946 - DNA, 15 bp, Homo sapiens
gcagaccctgccagg

SEQ ID NO: 1938947 - DNA, 14 bp, Homo sapiens
gcagacctgggact

SEQ ID NO: 1938948 - DNA, 15 bp, Homo sapiens
gcagagacagagagg

SEQ ID NO: 1938949 - DNA, 18 bp, Homo sapiens
gcagagattgggggggct

SEQ ID NO: 1938950 - DNA, 21 bp, Homo sapiens
gcagagattgggggggcttgg

SEQ ID NO: 1938951 - DNA, 22 bp, Homo sapiens
gcagagattgggggggcttggg

SEQ ID NO: 1938952 - DNA, 22 bp, Homo sapiens
gcagagccatctgcgacaccac

SEQ ID NO: 1938953 - DNA, 14 bp, Homo sapiens
gcagaggggagagg

SEQ ID NO: 1938954 - DNA, 16 bp, Homo sapiens
gcagaggggagaggaa

SEQ ID NO: 1938955 - DNA, 21 bp, Homo sapiens
gcagagtaaaattacagaaga

SEQ ID NO: 1938956 - DNA, 22 bp, Homo sapiens
gcagagtaaaattacagaagaa

SEQ ID NO: 1938957 - DNA, 13 bp, Homo sapiens
gcagagtcagcag

SEQ ID NO: 1938958 - DNA, 17 bp, Homo sapiens
gcagatatgtattactt

SEQ ID NO: 1938959 - DNA, 12 bp, Homo sapiens
gcagcagggcta

SEQ ID NO: 1938960 - DNA, 17 bp, Homo sapiens
gcagcagggctaccctg

SEQ ID NO: 1938961 - DNA, 19 bp, Homo sapiens
gcagcagggctaccctgag

SEQ ID NO: 1938962 - DNA, 17 bp, Homo sapiens
gcagccgctgagcgagg

SEQ ID NO: 1938963 - DNA, 18 bp, Homo sapiens
gcagcctggttccctctt

SEQ ID NO: 1938964 - DNA, 22 bp, Homo sapiens
gcagcctggttccctctttcct

SEQ ID NO: 1938965 - DNA, 13 bp, Homo sapiens
gcagcctgtggga

SEQ ID NO: 1938966 - DNA, 16 bp, Homo sapiens
gcagcgtctgagcggc

SEQ ID NO: 1938967 - DNA, 14 bp, Homo sapiens
gcagctctgtcgtg

SEQ ID NO: 1938968 - DNA, 20 bp, Homo sapiens
gcagctggatggggcggcct

SEQ ID NO: 1938969 - DNA, 13 bp, Homo sapiens
gcagctgggcact

SEQ ID NO: 1938970 - DNA, 14 bp, Homo sapiens
gcagctgttagagt

SEQ ID NO: 1938971 - DNA, 16 bp, Homo sapiens
gcagcttccttccaag

SEQ ID NO: 1938972 - DNA, 17 bp, Homo sapiens
gcaggagggtggcactt

SEQ ID NO: 1938973 - DNA, 22 bp, Homo sapiens
gcagggaattttcattggatgc

SEQ ID NO: 1938974 - DNA, 12 bp, Homo sapiens
gcagggcagcct

SEQ ID NO: 1938975 - DNA, 13 bp, Homo sapiens
gcagggcagcctg

SEQ ID NO: 1938976 - DNA, 19 bp, Homo sapiens
gcagggcagcctgtgggag

SEQ ID NO: 1938977 - DNA, 21 bp, Homo sapiens
gcagggcagcctgtgggagaa

SEQ ID NO: 1938978 - DNA, 16 bp, Homo sapiens
gcagggcctggcctgg

SEQ ID NO: 1938979 - DNA, 17 bp, Homo sapiens
gcagggctaccctgagc

SEQ ID NO: 1938980 - DNA, 21 bp, Homo sapiens
gcagggctaccctgagctgag

SEQ ID NO: 1938981 - DNA, 23 bp, Homo sapiens
gcagggctaccctgagctgaggc

SEQ ID NO: 1938982 - DNA, 14 bp, Homo sapiens
gcaggggctgggca

SEQ ID NO: 1938983 - DNA, 21 bp, Homo sapiens
gcaggggctgggcagagggga

SEQ ID NO: 1938984 - DNA, 13 bp, Homo sapiens
gcagggttctaga

SEQ ID NO: 1938985 - DNA, 14 bp, Homo sapiens
gcagggttctagaa

SEQ ID NO: 1938986 - DNA, 16 bp, Homo sapiens
gcagtcacactgctgg

SEQ ID NO: 1938987 - DNA, 17 bp, Homo sapiens
gcagtcacactgctggg

SEQ ID NO: 1938988 - DNA, 18 bp, Homo sapiens
gcagtcacactgctggga

SEQ ID NO: 1938989 - DNA, 16 bp, Homo sapiens
gcagtcctcggcagct

SEQ ID NO: 1938990 - DNA, 17 bp, Homo sapiens
gcagtcctcggcagctc

SEQ ID NO: 1938991 - DNA, 19 bp, Homo sapiens
gcagtcctgatcagagccg

SEQ ID NO: 1938992 - DNA, 18 bp, Homo sapiens
gcagtctttttctacagc

SEQ ID NO: 1938993 - DNA, 12 bp, Homo sapiens
gcagtgaaactt

SEQ ID NO: 1938994 - DNA, 20 bp, Homo sapiens
gcagtgaatgattcagtgtt

SEQ ID NO: 1938995 - DNA, 17 bp, Homo sapiens
gcagtggactgtgtccc

SEQ ID NO: 1938996 - DNA, 15 bp, Homo sapiens
gcagtggagagggga

SEQ ID NO: 1938997 - DNA, 21 bp, Homo sapiens
gcagtgggacagggcatggcc

SEQ ID NO: 1938998 - DNA, 16 bp, Homo sapiens
gcataacaattcctct

SEQ ID NO: 1938999 - DNA, 22 bp, Homo sapiens
gcatacccagtgtctaccttca

SEQ ID NO: 1939000 - DNA, 16 bp, Homo sapiens
gcatattcttatgtat

SEQ ID NO: 1939001 - DNA, 18 bp, Homo sapiens
gcatcattctttctgcta

SEQ ID NO: 1939002 - DNA, 18 bp, Homo sapiens
gcatccgcctctgagcca

SEQ ID NO: 1939003 - DNA, 19 bp, Homo sapiens
gcatccgcctctgagccag

SEQ ID NO: 1939004 - DNA, 23 bp, Homo sapiens
gcatccgcctctgagccaggagc

SEQ ID NO: 1939005 - DNA, 18 bp, Homo sapiens
gcatcctccacaatagca

SEQ ID NO: 1939006 - DNA, 15 bp, Homo sapiens
gcatctcagcccaca

SEQ ID NO: 1939007 - DNA, 21 bp, Homo sapiens
gcatctcccagataatgtgaa

SEQ ID NO: 1939008 - DNA, 14 bp, Homo sapiens
gcatctgtggcctg

SEQ ID NO: 1939009 - DNA, 16 bp, Homo sapiens
gcatctgtggcctggg

SEQ ID NO: 1939010 - DNA, 19 bp, Homo sapiens
gcatctgtggcctggggcc

SEQ ID NO: 1939011 - DNA, 21 bp, Homo sapiens
gcatgcactgttccccctgtg

SEQ ID NO: 1939012 - DNA, 22 bp, Homo sapiens
gcatgcactgttccccctgtgc

SEQ ID NO: 1939013 - DNA, 17 bp, Homo sapiens
gcatggccaggtggcca

SEQ ID NO: 1939014 - DNA, 15 bp, Homo sapiens
gcatggcccagcctg

SEQ ID NO: 1939015 - DNA, 17 bp, Homo sapiens
gcatggcccagcctgga

SEQ ID NO: 1939016 - DNA, 20 bp, Homo sapiens
gcatggccgcaacttcccag

SEQ ID NO: 1939017 - DNA, 21 bp, Homo sapiens
gcatggccgcaacttcccagg

SEQ ID NO: 1939018 - DNA, 22 bp, Homo sapiens
gcatggccgcaacttcccaggc

SEQ ID NO: 1939019 - DNA, 21 bp, Homo sapiens
gcatgtactttatattttcta

SEQ ID NO: 1939020 - DNA, 22 bp, Homo sapiens
gcatgtactttatattttctat

SEQ ID NO: 1939021 - DNA, 22 bp, Homo sapiens
gcattatttgaaaacactgctg

SEQ ID NO: 1939022 - DNA, 16 bp, Homo sapiens
gcattcctttctttaa

SEQ ID NO: 1939023 - DNA, 13 bp, Homo sapiens
gcattctagtact

SEQ ID NO: 1939024 - DNA, 18 bp, Homo sapiens
gcattctcactcctacct

SEQ ID NO: 1939025 - DNA, 19 bp, Homo sapiens
gcattctggggtggggctt

SEQ ID NO: 1939026 - DNA, 22 bp, Homo sapiens
gcattctggggtggggcttgga

SEQ ID NO: 1939027 - DNA, 14 bp, Homo sapiens
gcattgccaagggc

SEQ ID NO: 1939028 - DNA, 18 bp, Homo sapiens
gcatttgtgtctgcctgc

SEQ ID NO: 1939029 - DNA, 12 bp, Homo sapiens
gccaaatatgca

SEQ ID NO: 1939030 - DNA, 17 bp, Homo sapiens
gccaaatatgcactttc

SEQ ID NO: 1939031 - DNA, 20 bp, Homo sapiens
gccaaatatgcactttccct

SEQ ID NO: 1939032 - DNA, 17 bp, Homo sapiens
gccaaattgcagaagaa

SEQ ID NO: 1939033 - DNA, 18 bp, Homo sapiens
gccaaattgcagaagaaa

SEQ ID NO: 1939034 - DNA, 19 bp, Homo sapiens
gccaagccagggttccaga

SEQ ID NO: 1939035 - DNA, 23 bp, Homo sapiens
gccaagggctccagggccagggt

SEQ ID NO: 1939036 - DNA, 11 bp, Homo sapiens
gccacagaaat

SEQ ID NO: 1939037 - DNA, 13 bp, Homo sapiens
gccacagccccaa

SEQ ID NO: 1939038 - DNA, 21 bp, Homo sapiens
gccacagcctcccctgccagg

SEQ ID NO: 1939039 - DNA, 14 bp, Homo sapiens
gccacaggcagacg

SEQ ID NO: 1939040 - DNA, 23 bp, Homo sapiens
gccacaggctgcaagctgcaggg

SEQ ID NO: 1939041 - DNA, 15 bp, Homo sapiens
gccacatggccgctg

SEQ ID NO: 1939042 - DNA, 19 bp, Homo sapiens
gccaccaagagggacgcct

SEQ ID NO: 1939043 - DNA, 14 bp, Homo sapiens
gccacccagccagg

SEQ ID NO: 1939044 - DNA, 17 bp, Homo sapiens
gccaccgcgagggcctg

SEQ ID NO: 1939045 - DNA, 20 bp, Homo sapiens
gccaccgcgagggcctgcgt

SEQ ID NO: 1939046 - DNA, 15 bp, Homo sapiens
gccacctccccaggc

SEQ ID NO: 1939047 - DNA, 12 bp, Homo sapiens
gccacgggggag

SEQ ID NO: 1939048 - DNA, 17 bp, Homo sapiens
gccacgtgctggagagt

SEQ ID NO: 1939049 - DNA, 15 bp, Homo sapiens
gccacgtggccgctg

SEQ ID NO: 1939050 - DNA, 21 bp, Homo sapiens
gccacgtggccgctgcccacg

SEQ ID NO: 1939051 - DNA, 14 bp, Homo sapiens
gccactcctctgac

SEQ ID NO: 1939052 - DNA, 23 bp, Homo sapiens
gccactcctctgactcagggctc

SEQ ID NO: 1939053 - DNA, 21 bp, Homo sapiens
gccactgcagtcacccctgtc

SEQ ID NO: 1939054 - DNA, 21 bp, Homo sapiens
gccactggcatctctggagtg

SEQ ID NO: 1939055 - DNA, 18 bp, Homo sapiens
gccacttaaaatgttcac

SEQ ID NO: 1939056 - DNA, 17 bp, Homo sapiens
gccactttgcagacctg

SEQ ID NO: 1939057 - DNA, 23 bp, Homo sapiens
gccactttgcagacctgggactt

SEQ ID NO: 1939058 - DNA, 17 bp, Homo sapiens
gccagctctgggggctc

SEQ ID NO: 1939059 - DNA, 23 bp, Homo sapiens
gccagctctgtatcaggacccag

SEQ ID NO: 1939060 - DNA, 12 bp, Homo sapiens
gccaggactctc

SEQ ID NO: 1939061 - DNA, 11 bp, Homo sapiens
gccaggagacc

SEQ ID NO: 1939062 - DNA, 17 bp, Homo sapiens
gccaggagaccctgtct

SEQ ID NO: 1939063 - DNA, 18 bp, Homo sapiens
gccaggaggggctgtcca

SEQ ID NO: 1939064 - DNA, 20 bp, Homo sapiens
gccaggagtgggtttccctg

SEQ ID NO: 1939065 - DNA, 22 bp, Homo sapiens
gccaggcatggcccagcctgga

SEQ ID NO: 1939066 - DNA, 19 bp, Homo sapiens
ctcctctgactcagggctc

SEQ ID NO: 1939067 - DNA, 22 bp, Homo sapiens
ctcctctgactcagggctcctg

SEQ ID NO: 1939068 - DNA, 11 bp, Homo sapiens
ctcctctgtcc

SEQ ID NO: 1939069 - DNA, 23 bp, Homo sapiens
ctcctcttcctgcctctctcatg

SEQ ID NO: 1939070 - DNA, 13 bp, Homo sapiens
ctcctgaccctgt

SEQ ID NO: 1939071 - DNA, 14 bp, Homo sapiens
ctcctgaccctgtg

SEQ ID NO: 1939072 - DNA, 15 bp, Homo sapiens
ctcctgaccctgtga

SEQ ID NO: 1939073 - DNA, 20 bp, Homo sapiens
ctcctgaccctgtgatgcct

SEQ ID NO: 1939074 - DNA, 17 bp, Homo sapiens
ctcctgaggtctggatt

SEQ ID NO: 1939075 - DNA, 16 bp, Homo sapiens
ctcctgccttcctcct

SEQ ID NO: 1939076 - DNA, 19 bp, Homo sapiens
ctcctgccttcctcctggg

SEQ ID NO: 1939077 - DNA, 20 bp, Homo sapiens
ctcctgccttcctcctgggc

SEQ ID NO: 1939078 - DNA, 12 bp, Homo sapiens
ctcctgggccct

SEQ ID NO: 1939079 - DNA, 14 bp, Homo sapiens
ctcctgggccctct

SEQ ID NO: 1939080 - DNA, 15 bp, Homo sapiens
ctcctgggccctctc

SEQ ID NO: 1939081 - DNA, 20 bp, Homo sapiens
ctcctgggccctctctgctc

SEQ ID NO: 1939082 - DNA, 13 bp, Homo sapiens
ctcctgttcctgc

SEQ ID NO: 1939083 - DNA, 22 bp, Homo sapiens
ctcctgttcctgccttctcttc

SEQ ID NO: 1939084 - DNA, 13 bp, Homo sapiens
ctccttcctggag

SEQ ID NO: 1939085 - DNA, 15 bp, Homo sapiens
ctccttctcccctcc

SEQ ID NO: 1939086 - DNA, 17 bp, Homo sapiens
ctccttctcccctccag

SEQ ID NO: 1939087 - DNA, 19 bp, Homo sapiens
ctccttgccgctgggagag

SEQ ID NO: 1939088 - DNA, 20 bp, Homo sapiens
ctccttgccgctgggagagc

SEQ ID NO: 1939089 - DNA, 15 bp, Homo sapiens
ctccttgttctgctc

SEQ ID NO: 1939090 - DNA, 16 bp, Homo sapiens
ctccttgttctgctct

SEQ ID NO: 1939091 - DNA, 13 bp, Homo sapiens
ctcctttcacaac

SEQ ID NO: 1939092 - DNA, 17 bp, Homo sapiens
ctcctttcacaaccttc

SEQ ID NO: 1939093 - DNA, 17 bp, Homo sapiens
ctcgcatccgcctctga

SEQ ID NO: 1939094 - DNA, 22 bp, Homo sapiens
ctcgcatccgcctctgagccag

SEQ ID NO: 1939095 - DNA, 16 bp, Homo sapiens
ctcgctgccagctctg

SEQ ID NO: 1939096 - DNA, 22 bp, Homo sapiens
ctcggcctcttgagagccccac

SEQ ID NO: 1939097 - DNA, 16 bp, Homo sapiens
ctcggctggaagaaca

SEQ ID NO: 1939098 - DNA, 22 bp, Homo sapiens
ctcggctgtgtggggagggtgg

SEQ ID NO: 1939099 - DNA, 14 bp, Homo sapiens
ctcgtcttcctctc

SEQ ID NO: 1939100 - DNA, 16 bp, Homo sapiens
ctcgtcttcctctctc

SEQ ID NO: 1939101 - DNA, 23 bp, Homo sapiens
ctctaaaagggggctattccctg

SEQ ID NO: 1939102 - DNA, 14 bp, Homo sapiens
ctctaattaaaatg

SEQ ID NO: 1939103 - DNA, 17 bp, Homo sapiens
ctctacagagcttccct

SEQ ID NO: 1939104 - DNA, 19 bp, Homo sapiens
ctctacccatattacagat

SEQ ID NO: 1939105 - DNA, 17 bp, Homo sapiens
ctctacttagcatgtcc

SEQ ID NO: 1939106 - DNA, 19 bp, Homo sapiens
ctctacttagcatgtccct

SEQ ID NO: 1939107 - DNA, 17 bp, Homo sapiens
ctctcaggaccaaagct

SEQ ID NO: 1939108 - DNA, 20 bp, Homo sapiens
ctctcatccaggtcctttcc

SEQ ID NO: 1939109 - DNA, 14 bp, Homo sapiens
ctctccagccctat

SEQ ID NO: 1939110 - DNA, 16 bp, Homo sapiens
ctctccctccactcct

SEQ ID NO: 1939111 - DNA, 18 bp, Homo sapiens
ctctccctccactcctcc

SEQ ID NO: 1939112 - DNA, 21 bp, Homo sapiens
ctctcctctctctccctccac

SEQ ID NO: 1939113 - DNA, 19 bp, Homo sapiens
ctctcggctggaagaacat

SEQ ID NO: 1939114 - DNA, 21 bp, Homo sapiens
ctctctcacctacttcctcct

SEQ ID NO: 1939115 - DNA, 18 bp, Homo sapiens
ctctctcctctctctccc

SEQ ID NO: 1939116 - DNA, 13 bp, Homo sapiens
ctctctctcacct

SEQ ID NO: 1939117 - DNA, 12 bp, Homo sapiens
ctctctctccct

SEQ ID NO: 1939118 - DNA, 15 bp, Homo sapiens
ctctctggacctgac

SEQ ID NO: 1939119 - DNA, 22 bp, Homo sapiens
ctctctggacctgaccagactg

SEQ ID NO: 1939120 - DNA, 17 bp, Homo sapiens
ctctctgtccaatctgc

SEQ ID NO: 1939121 - DNA, 23 bp, Homo sapiens
ctctctgtttaccctccctgtcc

SEQ ID NO: 1939122 - DNA, 12 bp, Homo sapiens
ctctctttgtcc

SEQ ID NO: 1939123 - DNA, 12 bp, Homo sapiens
ctctgaaaccag

SEQ ID NO: 1939124 - DNA, 16 bp, Homo sapiens
ctctgaaagctgcttc

SEQ ID NO: 1939125 - DNA, 12 bp, Homo sapiens
ctctgagccagg

SEQ ID NO: 1939126 - DNA, 23 bp, Homo sapiens
ctctgagccaggagcctcctgac

SEQ ID NO: 1939127 - DNA, 16 bp, Homo sapiens
ctctgagctgtgcagg

SEQ ID NO: 1939128 - DNA, 16 bp, Homo sapiens
ctctgcagggcagcct

SEQ ID NO: 1939129 - DNA, 19 bp, Homo sapiens
ctctgcagggcagcctgtg

SEQ ID NO: 1939130 - DNA, 18 bp, Homo sapiens
ctctgcccccagctgctc

SEQ ID NO: 1939131 - DNA, 13 bp, Homo sapiens
ctctggagtgtgt

SEQ ID NO: 1939132 - DNA, 12 bp, Homo sapiens
ctctggctgcca

SEQ ID NO: 1939133 - DNA, 15 bp, Homo sapiens
ctctggctgccaaga

SEQ ID NO: 1939134 - DNA, 16 bp, Homo sapiens
ctctggctggagagga

SEQ ID NO: 1939135 - DNA, 23 bp, Homo sapiens
ctctgggccaagtcaaagacatt

SEQ ID NO: 1939136 - DNA, 15 bp, Homo sapiens
ctctgtaaaatgaac

SEQ ID NO: 1939137 - DNA, 22 bp, Homo sapiens
ctctgtatcaggacccagagga

SEQ ID NO: 1939138 - DNA, 14 bp, Homo sapiens
ctctgtattctgca

SEQ ID NO: 1939139 - DNA, 14 bp, Homo sapiens
ctctgtccaggcac

SEQ ID NO: 1939140 - DNA, 17 bp, Homo sapiens
ctctgtgaccaatgtct

SEQ ID NO: 1939141 - DNA, 14 bp, Homo sapiens
ctcttcctgcctct

SEQ ID NO: 1939142 - DNA, 15 bp, Homo sapiens
ctcttctatcctgca

SEQ ID NO: 1939143 - DNA, 12 bp, Homo sapiens
ctcttctccact

SEQ ID NO: 1939144 - DNA, 17 bp, Homo sapiens
ctcttctccactggatg

SEQ ID NO: 1939145 - DNA, 15 bp, Homo sapiens
ctcttctcctttcac

SEQ ID NO: 1939146 - DNA, 16 bp, Homo sapiens
ctcttctcctttcaca

SEQ ID NO: 1939147 - DNA, 14 bp, Homo sapiens
ctctttcagtctac

SEQ ID NO: 1939148 - DNA, 20 bp, Homo sapiens
ctctttcctgtgccaggact

SEQ ID NO: 1939149 - DNA, 14 bp, Homo sapiens
ctagtaggagctga

SEQ ID NO: 1939150 - DNA, 21 bp, Homo sapiens
ctagtgaaggcttctctctgt

SEQ ID NO: 1939151 - DNA, 21 bp, Homo sapiens
ctataccctaggtctccaccc

SEQ ID NO: 1939152 - DNA, 13 bp, Homo sapiens
ctatagaggagga

SEQ ID NO: 1939153 - DNA, 18 bp, Homo sapiens
ctatagtgtataccacct

SEQ ID NO: 1939154 - DNA, 21 bp, Homo sapiens
ctatagtgtataccacctgta

SEQ ID NO: 1939155 - DNA, 19 bp, Homo sapiens
ctatatgtggcattccttt

SEQ ID NO: 1939156 - DNA, 21 bp, Homo sapiens
ctatatgtggcattcctttct

SEQ ID NO: 1939157 - DNA, 18 bp, Homo sapiens
ctatattaggcctgtgtg

SEQ ID NO: 1939158 - DNA, 15 bp, Homo sapiens
ctatatttgtaactt

SEQ ID NO: 1939159 - DNA, 18 bp, Homo sapiens
ctatcatgtcaaacgtga

SEQ ID NO: 1939160 - DNA, 14 bp, Homo sapiens
ctatcttttcatct

SEQ ID NO: 1939161 - DNA, 19 bp, Homo sapiens
ctatgatttggaaaataaa

SEQ ID NO: 1939162 - DNA, 17 bp, Homo sapiens
ctatgcacctataaata

SEQ ID NO: 1939163 - DNA, 18 bp, Homo sapiens
ctatgcacctataaatac

SEQ ID NO: 1939164 - DNA, 19 bp, Homo sapiens
ctatgcacctataaatact

SEQ ID NO: 1939165 - DNA, 20 bp, Homo sapiens
ctatggaaagggtgtggctt

SEQ ID NO: 1939166 - DNA, 22 bp, Homo sapiens
ctatggaaagggtgtggcttgg

SEQ ID NO: 1939167 - DNA, 17 bp, Homo sapiens
ctatggggagaaaagac

SEQ ID NO: 1939168 - DNA, 21 bp, Homo sapiens
ctatgtaaattattgtaaact

SEQ ID NO: 1939169 - DNA, 23 bp, Homo sapiens
ctatgtccatgaaaaacagcaga

SEQ ID NO: 1939170 - DNA, 12 bp, Homo sapiens
ctatgtctgtga

SEQ ID NO: 1939171 - DNA, 20 bp, Homo sapiens
ctatgtttttgttcaaagcc

SEQ ID NO: 1939172 - DNA, 13 bp, Homo sapiens
ctattcaaaataa

SEQ ID NO: 1939173 - DNA, 19 bp, Homo sapiens
ctattcagaataaatgggt

SEQ ID NO: 1939174 - DNA, 17 bp, Homo sapiens
ctattcttaagcacttt

SEQ ID NO: 1939175 - DNA, 11 bp, Homo sapiens
ctatttatctg

SEQ ID NO: 1939176 - DNA, 16 bp, Homo sapiens
ctatttatctgtctga

SEQ ID NO: 1939177 - DNA, 16 bp, Homo sapiens
ctatttctcctccatg

SEQ ID NO: 1939178 - DNA, 18 bp, Homo sapiens
ctatttttttgttgctgt

SEQ ID NO: 1939179 - DNA, 20 bp, Homo sapiens
ctcaaagtttttacagtgta

SEQ ID NO: 1939180 - DNA, 21 bp, Homo sapiens
ctcaaagtttttacagtgtat

SEQ ID NO: 1939181 - DNA, 13 bp, Homo sapiens
ctcaagccaggag

SEQ ID NO: 1939182 - DNA, 18 bp, Homo sapiens
ctcaagccaggagaccct

SEQ ID NO: 1939183 - DNA, 17 bp, Homo sapiens
ctcacaggttcacccag

SEQ ID NO: 1939184 - DNA, 19 bp, Homo sapiens
ctcacattccctctcatcc

SEQ ID NO: 1939185 - DNA, 16 bp, Homo sapiens
ctcacccccttctcca

SEQ ID NO: 1939186 - DNA, 17 bp, Homo sapiens
ctcacccccttctccat

SEQ ID NO: 1939187 - DNA, 19 bp, Homo sapiens
ctcacccccttctccatcc

SEQ ID NO: 1939188 - DNA, 20 bp, Homo sapiens
ctcacccccttctccatcca

SEQ ID NO: 1939189 - DNA, 14 bp, Homo sapiens
ctcacctacttcct

SEQ ID NO: 1939190 - DNA, 15 bp, Homo sapiens
ctcactagaatattc

SEQ ID NO: 1939191 - DNA, 13 bp, Homo sapiens
ctcactccactcc

SEQ ID NO: 1939192 - DNA, 16 bp, Homo sapiens
ctcactccactcccct

SEQ ID NO: 1939193 - DNA, 16 bp, Homo sapiens
ctcactcctacctggt

SEQ ID NO: 1939194 - DNA, 13 bp, Homo sapiens
ctcactgagaagg

SEQ ID NO: 1939195 - DNA, 22 bp, Homo sapiens
ctcactgagaaggccccagggc

SEQ ID NO: 1939196 - DNA, 14 bp, Homo sapiens
ctcagccctccctg

SEQ ID NO: 1939197 - DNA, 20 bp, Homo sapiens
ctcagccctccctgcccctc

SEQ ID NO: 1939198 - DNA, 23 bp, Homo sapiens
ctcagcctccggatgacacaaat

SEQ ID NO: 1939199 - DNA, 17 bp, Homo sapiens
ctcagcctctgaatatg

SEQ ID NO: 1939200 - DNA, 21 bp, Homo sapiens
ctcaggaccaaagctttcatg

SEQ ID NO: 1939201 - DNA, 23 bp, Homo sapiens
ctcaggagaaggcctgcccccct

SEQ ID NO: 1939202 - DNA, 14 bp, Homo sapiens
ctcaggctgcccag

SEQ ID NO: 1939203 - DNA, 15 bp, Homo sapiens
ctcaggctgcccagc

SEQ ID NO: 1939204 - DNA, 20 bp, Homo sapiens
ctcaggtcagggtgaggatg

SEQ ID NO: 1939205 - DNA, 14 bp, Homo sapiens
ctcaggttgtctga

SEQ ID NO: 1939206 - DNA, 13 bp, Homo sapiens
ctcagtctctgag

SEQ ID NO: 1939207 - DNA, 22 bp, Homo sapiens
ctcagtgagatcagtcagctcc

SEQ ID NO: 1939208 - DNA, 14 bp, Homo sapiens
ctcagttccaatgt

SEQ ID NO: 1939209 - DNA, 18 bp, Homo sapiens
ctcagttttatcattttc

SEQ ID NO: 1939210 - DNA, 14 bp, Homo sapiens
ctcatcattctctg

SEQ ID NO: 1939211 - DNA, 15 bp, Homo sapiens
ctcatccaggtcctt

SEQ ID NO: 1939212 - DNA, 15 bp, Homo sapiens
ctcatctgtccctcc

SEQ ID NO: 1939213 - DNA, 18 bp, Homo sapiens
ctcatctgtccctccggg

SEQ ID NO: 1939214 - DNA, 20 bp, Homo sapiens
ctcattaattcaattaaaac

SEQ ID NO: 1939215 - DNA, 22 bp, Homo sapiens
ctcattaattcaattaaaacca

SEQ ID NO: 1939216 - DNA, 17 bp, Homo sapiens
ctcattctgaaggagcc

SEQ ID NO: 1939217 - DNA, 19 bp, Homo sapiens
ctcattctgaaggagcccc

SEQ ID NO: 1939218 - DNA, 14 bp, Homo sapiens
ctccacacctccac

SEQ ID NO: 1939219 - DNA, 14 bp, Homo sapiens
ctccacatcctcca

SEQ ID NO: 1939220 - DNA, 15 bp, Homo sapiens
ctccacatcctccac

SEQ ID NO: 1939221 - DNA, 17 bp, Homo sapiens
ctccacatcctccacgt

SEQ ID NO: 1939222 - DNA, 13 bp, Homo sapiens
ctccacccctcaa

SEQ ID NO: 1939223 - DNA, 20 bp, Homo sapiens
ctccacgttctgctcatcat

SEQ ID NO: 1939224 - DNA, 17 bp, Homo sapiens
ccttggttcctccagca

SEQ ID NO: 1939225 - DNA, 16 bp, Homo sapiens
ccttgtaattctaaat

SEQ ID NO: 1939226 - DNA, 15 bp, Homo sapiens
ccttgtgtctgttgc

SEQ ID NO: 1939227 - DNA, 14 bp, Homo sapiens
ccttgttgatgcca

SEQ ID NO: 1939228 - DNA, 15 bp, Homo sapiens
cctttacttgacctc

SEQ ID NO: 1939229 - DNA, 16 bp, Homo sapiens
cctttatgttttaata

SEQ ID NO: 1939230 - DNA, 19 bp, Homo sapiens
cctttcccaggtgctacac

SEQ ID NO: 1939231 - DNA, 18 bp, Homo sapiens
cctttccctgcatccctt

SEQ ID NO: 1939232 - DNA, 19 bp, Homo sapiens
cctttgagtgcagtcctga

SEQ ID NO: 1939233 - DNA, 16 bp, Homo sapiens
cctttgcgtggatcaa

SEQ ID NO: 1939234 - DNA, 16 bp, Homo sapiens
cctttggcacaccctc

SEQ ID NO: 1939235 - DNA, 21 bp, Homo sapiens
cctttttaaatgagacttgtt

SEQ ID NO: 1939236 - DNA, 19 bp, Homo sapiens
cgaatacttttgccctttg

SEQ ID NO: 1939237 - DNA, 20 bp, Homo sapiens
cgaatgagctgggccctggg

SEQ ID NO: 1939238 - DNA, 17 bp, Homo sapiens
cgacacaggctgccgct

SEQ ID NO: 1939239 - DNA, 12 bp, Homo sapiens
cgacagcctggc

SEQ ID NO: 1939240 - DNA, 14 bp, Homo sapiens
cgacagcctggcac

SEQ ID NO: 1939241 - DNA, 17 bp, Homo sapiens
cgacccggggcgggctg

SEQ ID NO: 1939242 - DNA, 19 bp, Homo sapiens
cgactctctccatcagaag

SEQ ID NO: 1939243 - DNA, 21 bp, Homo sapiens
cgagagacttgtggcctggga

SEQ ID NO: 1939244 - DNA, 15 bp, Homo sapiens
cgagccccctgtcct

SEQ ID NO: 1939245 - DNA, 17 bp, Homo sapiens
cgaggcagaatggtggg

SEQ ID NO: 1939246 - DNA, 20 bp, Homo sapiens
cgaggcagaatggtgggctc

SEQ ID NO: 1939247 - DNA, 18 bp, Homo sapiens
cgagggcgcctgggtcct

SEQ ID NO: 1939248 - DNA, 14 bp, Homo sapiens
cgaggtcaaggaga

SEQ ID NO: 1939249 - DNA, 16 bp, Homo sapiens
cgagtctcttctccac

SEQ ID NO: 1939250 - DNA, 20 bp, Homo sapiens
cgagtctcttctccactgga

SEQ ID NO: 1939251 - DNA, 18 bp, Homo sapiens
cgatacaccgggcctgga

SEQ ID NO: 1939252 - DNA, 21 bp, Homo sapiens
cgatgttaaaacaaattaaaa

SEQ ID NO: 1939253 - DNA, 17 bp, Homo sapiens
cgcaagcgacacaggct

SEQ ID NO: 1939254 - DNA, 10 bp, Homo sapiens
cgcagccctg

SEQ ID NO: 1939255 - DNA, 16 bp, Homo sapiens
cgccacactggccggc

SEQ ID NO: 1939256 - DNA, 13 bp, Homo sapiens
cgcccagcctggc

SEQ ID NO: 1939257 - DNA, 21 bp, Homo sapiens
cgccctccctccctccacacc

SEQ ID NO: 1939258 - DNA, 18 bp, Homo sapiens
cgcctctgagccaggagc

SEQ ID NO: 1939259 - DNA, 15 bp, Homo sapiens
cgcctctgtcctggc

SEQ ID NO: 1939260 - DNA, 20 bp, Homo sapiens
cgcctgaggaacccttacag

SEQ ID NO: 1939261 - DNA, 12 bp, Homo sapiens
cgcctgtccttg

SEQ ID NO: 1939262 - DNA, 23 bp, Homo sapiens
cgctgagggcagggttctagaag

SEQ ID NO: 1939263 - DNA, 13 bp, Homo sapiens
cgctgctctccca

SEQ ID NO: 1939264 - DNA, 15 bp, Homo sapiens
cgctgctctcccagg

SEQ ID NO: 1939265 - DNA, 14 bp, Homo sapiens
cggaagtggcctga

SEQ ID NO: 1939266 - DNA, 20 bp, Homo sapiens
cggaagtggcctgagaagag

SEQ ID NO: 1939267 - DNA, 15 bp, Homo sapiens
cggaatcctgtcctc

SEQ ID NO: 1939268 - DNA, 18 bp, Homo sapiens
cggaatcctgtcctcagc

SEQ ID NO: 1939269 - DNA, 18 bp, Homo sapiens
cggagatgcatctgtggc

SEQ ID NO: 1939270 - DNA, 16 bp, Homo sapiens
cggaggggcctggcag

SEQ ID NO: 1939271 - DNA, 11 bp, Homo sapiens
cggcagagagg

SEQ ID NO: 1939272 - DNA, 19 bp, Homo sapiens
cggcatgagggctgagatg

SEQ ID NO: 1939273 - DNA, 18 bp, Homo sapiens
cggcccacgtcctgggtg

SEQ ID NO: 1939274 - DNA, 17 bp, Homo sapiens
cggcccccgccctctgc

SEQ ID NO: 1939275 - DNA, 18 bp, Homo sapiens
cggcccccgccctctgcc

SEQ ID NO: 1939276 - DNA, 21 bp, Homo sapiens
cggcccccgccctctgccccc

SEQ ID NO: 1939277 - DNA, 19 bp, Homo sapiens
cggcctcttgagagcccca

SEQ ID NO: 1939278 - DNA, 20 bp, Homo sapiens
cggcctgcagaccctgccag

SEQ ID NO: 1939279 - DNA, 18 bp, Homo sapiens
cggctggaccacgtctcc

SEQ ID NO: 1939280 - DNA, 13 bp, Homo sapiens
cgggacctggtgc

SEQ ID NO: 1939281 - DNA, 16 bp, Homo sapiens
cgggcctggagaacta

SEQ ID NO: 1939282 - DNA, 17 bp, Homo sapiens
cgggctgggcagctgtt

SEQ ID NO: 1939283 - DNA, 17 bp, Homo sapiens
cgggggaagctgagccc

SEQ ID NO: 1939284 - DNA, 18 bp, Homo sapiens
cgggggaggccgaggcag

SEQ ID NO: 1939285 - DNA, 19 bp, Homo sapiens
cgggggaggccgaggcagg

SEQ ID NO: 1939286 - DNA, 20 bp, Homo sapiens
cgggggaggccgaggcaggg

SEQ ID NO: 1939287 - DNA, 20 bp, Homo sapiens
cgggggtgggggcctgctgt

SEQ ID NO: 1939288 - DNA, 13 bp, Homo sapiens
cgggtctgcctct

SEQ ID NO: 1939289 - DNA, 16 bp, Homo sapiens
cgggtctgtgggactg

SEQ ID NO: 1939290 - DNA, 14 bp, Homo sapiens
cggtcaataattgt

SEQ ID NO: 1939291 - DNA, 22 bp, Homo sapiens
cggtcaataattgtggagagga

SEQ ID NO: 1939292 - DNA, 22 bp, Homo sapiens
cggtcactgcccacctgccagg

SEQ ID NO: 1939293 - DNA, 12 bp, Homo sapiens
cctctccactgc

SEQ ID NO: 1939294 - DNA, 16 bp, Homo sapiens
cctctccactgccttc

SEQ ID NO: 1939295 - DNA, 14 bp, Homo sapiens
cctctcccaaataa

SEQ ID NO: 1939296 - DNA, 14 bp, Homo sapiens
cctctctcatggct

SEQ ID NO: 1939297 - DNA, 12 bp, Homo sapiens
cctctctctcac

SEQ ID NO: 1939298 - DNA, 18 bp, Homo sapiens
cctctctctccctccact

SEQ ID NO: 1939299 - DNA, 20 bp, Homo sapiens
cctctctctccctccactcc

SEQ ID NO: 1939300 - DNA, 15 bp, Homo sapiens
cctctctgcagtcct

SEQ ID NO: 1939301 - DNA, 18 bp, Homo sapiens
cctctctgtttaccctcc

SEQ ID NO: 1939302 - DNA, 17 bp, Homo sapiens
cctctcttaccccgtcc

SEQ ID NO: 1939303 - DNA, 18 bp, Homo sapiens
cctctcttaccccgtccc

SEQ ID NO: 1939304 - DNA, 13 bp, Homo sapiens
cctctctttgagt

SEQ ID NO: 1939305 - DNA, 17 bp, Homo sapiens
cctctgactcagggctc

SEQ ID NO: 1939306 - DNA, 19 bp, Homo sapiens
cctctgactcagggctcct

SEQ ID NO: 1939307 - DNA, 11 bp, Homo sapiens
cctctgagcca

SEQ ID NO: 1939308 - DNA, 13 bp, Homo sapiens
cctctgagccagg

SEQ ID NO: 1939309 - DNA, 16 bp, Homo sapiens
cctctgagccaggagc

SEQ ID NO: 1939310 - DNA, 18 bp, Homo sapiens
cctctgagccaggagcct

SEQ ID NO: 1939311 - DNA, 18 bp, Homo sapiens
cctctgcagggcagcctg

SEQ ID NO: 1939312 - DNA, 18 bp, Homo sapiens
cctctgctatgtctgtga

SEQ ID NO: 1939313 - DNA, 20 bp, Homo sapiens
cctctgctatgtctgtgatg

SEQ ID NO: 1939314 - DNA, 11 bp, Homo sapiens
cctctgctcca

SEQ ID NO: 1939315 - DNA, 23 bp, Homo sapiens
cctctggccaaatatgcactttc

SEQ ID NO: 1939316 - DNA, 19 bp, Homo sapiens
cctctgtgaccaatgtctt

SEQ ID NO: 1939317 - DNA, 15 bp, Homo sapiens
cctcttcccccttcc

SEQ ID NO: 1939318 - DNA, 22 bp, Homo sapiens
cctcttcctccctccctgcagg

SEQ ID NO: 1939319 - DNA, 18 bp, Homo sapiens
cctcttctgggagggcag

SEQ ID NO: 1939320 - DNA, 21 bp, Homo sapiens
cctcttctgggagggcagcag

SEQ ID NO: 1939321 - DNA, 14 bp, Homo sapiens
cctcttgggagacg

SEQ ID NO: 1939322 - DNA, 21 bp, Homo sapiens
cctcttttcccttgtgtgagg

SEQ ID NO: 1939323 - DNA, 18 bp, Homo sapiens
cctgaactggccccagct

SEQ ID NO: 1939324 - DNA, 20 bp, Homo sapiens
cctgaactggccccagctcc

SEQ ID NO: 1939325 - DNA, 19 bp, Homo sapiens
cctgaagtaagcaaagact

SEQ ID NO: 1939326 - DNA, 17 bp, Homo sapiens
cctgaatccctttcagt

SEQ ID NO: 1939327 - DNA, 15 bp, Homo sapiens
cctgacaacttctga

SEQ ID NO: 1939328 - DNA, 22 bp, Homo sapiens
cctgacacaggggacactgaac

SEQ ID NO: 1939329 - DNA, 16 bp, Homo sapiens
cctgacagaaggactc

SEQ ID NO: 1939330 - DNA, 17 bp, Homo sapiens
cctgcaaaaggactctc

SEQ ID NO: 1939331 - DNA, 18 bp, Homo sapiens
cctgcaagggcgtggtgg

SEQ ID NO: 1939332 - DNA, 23 bp, Homo sapiens
cctgcaaggtgcacctgccccag

SEQ ID NO: 1939333 - DNA, 12 bp, Homo sapiens
cctgcaccctct

SEQ ID NO: 1939334 - DNA, 19 bp, Homo sapiens
cctgcatcccttggcccct

SEQ ID NO: 1939335 - DNA, 16 bp, Homo sapiens
cctgccaggctgcagg

SEQ ID NO: 1939336 - DNA, 13 bp, Homo sapiens
cctgccagggcag

SEQ ID NO: 1939337 - DNA, 12 bp, Homo sapiens
cctgccccaggc

SEQ ID NO: 1939338 - DNA, 13 bp, Homo sapiens
cctgccccaggct

SEQ ID NO: 1939339 - DNA, 16 bp, Homo sapiens
cctgcccccaatccat

SEQ ID NO: 1939340 - DNA, 12 bp, Homo sapiens
cctgcccccctt

SEQ ID NO: 1939341 - DNA, 18 bp, Homo sapiens
cctgcccctcccttcaac

SEQ ID NO: 1939342 - DNA, 13 bp, Homo sapiens
cctgccctcactc

SEQ ID NO: 1939343 - DNA, 20 bp, Homo sapiens
cctgccctcactccactccc

SEQ ID NO: 1939344 - DNA, 16 bp, Homo sapiens
cctgccttcctcctgg

SEQ ID NO: 1939345 - DNA, 17 bp, Homo sapiens
cctgcgccctccctccc

SEQ ID NO: 1939346 - DNA, 17 bp, Homo sapiens
cctgctttgggctgccc

SEQ ID NO: 1939347 - DNA, 19 bp, Homo sapiens
cctgctttgggctgccctg

SEQ ID NO: 1939348 - DNA, 23 bp, Homo sapiens
cctgctttgggctgccctggtgc

SEQ ID NO: 1939349 - DNA, 14 bp, Homo sapiens
cctggacagtgaga

SEQ ID NO: 1939350 - DNA, 15 bp, Homo sapiens
cctggacagtgagag

SEQ ID NO: 1939351 - DNA, 12 bp, Homo sapiens
cctggagaacta

SEQ ID NO: 1939352 - DNA, 19 bp, Homo sapiens
cctggagccgtggccgagg

SEQ ID NO: 1939353 - DNA, 20 bp, Homo sapiens
cctggatccagccattcctg

SEQ ID NO: 1939354 - DNA, 13 bp, Homo sapiens
cctggatcccttt

SEQ ID NO: 1939355 - DNA, 17 bp, Homo sapiens
cctggatccctttcact

SEQ ID NO: 1939356 - DNA, 16 bp, Homo sapiens
ccatgggcagagccca

SEQ ID NO: 1939357 - DNA, 20 bp, Homo sapiens
ccatggtggtttcagaaagg

SEQ ID NO: 1939358 - DNA, 16 bp, Homo sapiens
ccatgtagaaaatttg

SEQ ID NO: 1939359 - DNA, 17 bp, Homo sapiens
ccatgtagaagagggag

SEQ ID NO: 1939360 - DNA, 20 bp, Homo sapiens
ccattaacaggtctttgaaa

SEQ ID NO: 1939361 - DNA, 16 bp, Homo sapiens
ccattaccttaaaatt

SEQ ID NO: 1939362 - DNA, 22 bp, Homo sapiens
ccattattctagggtcttactc

SEQ ID NO: 1939363 - DNA, 13 bp, Homo sapiens
ccattgaattctt

SEQ ID NO: 1939364 - DNA, 17 bp, Homo sapiens
ccattggttaatctgga

SEQ ID NO: 1939365 - DNA, 15 bp, Homo sapiens
ccatttacctggaaa

SEQ ID NO: 1939366 - DNA, 15 bp, Homo sapiens
ccatttcttcccaag

SEQ ID NO: 1939367 - DNA, 15 bp, Homo sapiens
ccattttaagaaaac

SEQ ID NO: 1939368 - DNA, 18 bp, Homo sapiens
ccattttgtctggctgtg

SEQ ID NO: 1939369 - DNA, 21 bp, Homo sapiens
ccattttgtctggctgtggcc

SEQ ID NO: 1939370 - DNA, 20 bp, Homo sapiens
cccaagaatagatgctgact

SEQ ID NO: 1939371 - DNA, 21 bp, Homo sapiens
cccaagaatagatgctgactg

SEQ ID NO: 1939372 - DNA, 13 bp, Homo sapiens
cccacacacccca

SEQ ID NO: 1939373 - DNA, 19 bp, Homo sapiens
cccacaggacatttctcta

SEQ ID NO: 1939374 - DNA, 15 bp, Homo sapiens
cccaccacacacacc

SEQ ID NO: 1939375 - DNA, 15 bp, Homo sapiens
cccacccctcttccc

SEQ ID NO: 1939376 - DNA, 14 bp, Homo sapiens
cccacctgccaggc

SEQ ID NO: 1939377 - DNA, 22 bp, Homo sapiens
cccacctgccaggctgcaggga

SEQ ID NO: 1939378 - DNA, 15 bp, Homo sapiens
cccacgtcccgggca

SEQ ID NO: 1939379 - DNA, 16 bp, Homo sapiens
cccacgtcctgggtgc

SEQ ID NO: 1939380 - DNA, 23 bp, Homo sapiens
cccagaggaaggggccagaggct

SEQ ID NO: 1939381 - DNA, 16 bp, Homo sapiens
cccagaggattgctgc

SEQ ID NO: 1939382 - DNA, 19 bp, Homo sapiens
cccagccctcatcccgagc

SEQ ID NO: 1939383 - DNA, 12 bp, Homo sapiens
cccagcctgcat

SEQ ID NO: 1939384 - DNA, 11 bp, Homo sapiens
cccagcctgga

SEQ ID NO: 1939385 - DNA, 15 bp, Homo sapiens
cccagcctggagccg

SEQ ID NO: 1939386 - DNA, 19 bp, Homo sapiens
cccagcggctcttcctgga

SEQ ID NO: 1939387 - DNA, 12 bp, Homo sapiens
cccagctctgaa

SEQ ID NO: 1939388 - DNA, 14 bp, Homo sapiens
cccagctctgaaac

SEQ ID NO: 1939389 - DNA, 13 bp, Homo sapiens
cccagctgctcct

SEQ ID NO: 1939390 - DNA, 13 bp, Homo sapiens
cccaggaggacct

SEQ ID NO: 1939391 - DNA, 18 bp, Homo sapiens
cccaggcgccccttcccc

SEQ ID NO: 1939392 - DNA, 19 bp, Homo sapiens
cccaggctcaggctgccca

SEQ ID NO: 1939393 - DNA, 14 bp, Homo sapiens
cccatgggctgctg

SEQ ID NO: 1939394 - DNA, 12 bp, Homo sapiens
ccccaaggaaga

SEQ ID NO: 1939395 - DNA, 19 bp, Homo sapiens
ccccaccctgtctgcaggc

SEQ ID NO: 1939396 - DNA, 11 bp, Homo sapiens
ccccagctcct

SEQ ID NO: 1939397 - DNA, 19 bp, Homo sapiens
ccccagctgctcctcgcag

SEQ ID NO: 1939398 - DNA, 22 bp, Homo sapiens
ccccaggctcaggctgcccagc

SEQ ID NO: 1939399 - DNA, 13 bp, Homo sapiens
ccccatcagtgct

SEQ ID NO: 1939400 - DNA, 19 bp, Homo sapiens
ccccatggtgcagtgaaga

SEQ ID NO: 1939401 - DNA, 13 bp, Homo sapiens
cccccaatccatg

SEQ ID NO: 1939402 - DNA, 10 bp, Homo sapiens
ccccctctct

SEQ ID NO: 1939403 - DNA, 14 bp, Homo sapiens
ccccgccctctgcc

SEQ ID NO: 1939404 - DNA, 17 bp, Homo sapiens
ccccgtccctttccctg

SEQ ID NO: 1939405 - DNA, 18 bp, Homo sapiens
cccctaatgcctgcggag

SEQ ID NO: 1939406 - DNA, 14 bp, Homo sapiens
cccctatcctgcac

SEQ ID NO: 1939407 - DNA, 18 bp, Homo sapiens
gacaaggtgtttctctgt

SEQ ID NO: 1939408 - DNA, 20 bp, Homo sapiens
gacaatctaaaaaatatctt

SEQ ID NO: 1939409 - DNA, 21 bp, Homo sapiens
gacacaaaggacaaaaatata

SEQ ID NO: 1939410 - DNA, 18 bp, Homo sapiens
gacaccttcccagctgct

SEQ ID NO: 1939411 - DNA, 19 bp, Homo sapiens
gacagaaccaacgggtctg

SEQ ID NO: 1939412 - DNA, 18 bp, Homo sapiens
gacagagaggacgtgggc

SEQ ID NO: 1939413 - DNA, 20 bp, Homo sapiens
gacagagctggttgggaaga

SEQ ID NO: 1939414 - DNA, 15 bp, Homo sapiens
gacagatcttgagca

SEQ ID NO: 1939415 - DNA, 23 bp, Homo sapiens
gacagcgggtaaaaagagaaggc

SEQ ID NO: 1939416 - DNA, 19 bp, Homo sapiens
gacaggaagcacagcaggt

SEQ ID NO: 1939417 - DNA, 14 bp, Homo sapiens
gacaggcagaatca

SEQ ID NO: 1939418 - DNA, 12 bp, Homo sapiens
gacagggtgggg

SEQ ID NO: 1939419 - DNA, 23 bp, Homo sapiens
gacagggtggggcttagaatggg

SEQ ID NO: 1939420 - DNA, 19 bp, Homo sapiens
gacagtattgccacctctg

SEQ ID NO: 1939421 - DNA, 16 bp, Homo sapiens
gacagtcaaggagtgg

SEQ ID NO: 1939422 - DNA, 15 bp, Homo sapiens
gacagttcatatgta

SEQ ID NO: 1939423 - DNA, 17 bp, Homo sapiens
gacagttcatatgtacc

SEQ ID NO: 1939424 - DNA, 17 bp, Homo sapiens
gacatccaagcttcctt

SEQ ID NO: 1939425 - DNA, 18 bp, Homo sapiens
gacatccccctccttgcc

SEQ ID NO: 1939426 - DNA, 19 bp, Homo sapiens
gacatcttagtatttgcat

SEQ ID NO: 1939427 - DNA, 20 bp, Homo sapiens
gacatgaagattctttccca

SEQ ID NO: 1939428 - DNA, 12 bp, Homo sapiens
gacatgaatatg

SEQ ID NO: 1939429 - DNA, 14 bp, Homo sapiens
gacatgcgggctgg

SEQ ID NO: 1939430 - DNA, 20 bp, Homo sapiens
gacatggattggatttcagt

SEQ ID NO: 1939431 - DNA, 21 bp, Homo sapiens
gacatggtgtgccacaggctg

SEQ ID NO: 1939432 - DNA, 13 bp, Homo sapiens
gacatttctcaaa

SEQ ID NO: 1939433 - DNA, 16 bp, Homo sapiens
gacatttctctaagag

SEQ ID NO: 1939434 - DNA, 17 bp, Homo sapiens
gaccacgtctccctggc

SEQ ID NO: 1939435 - DNA, 14 bp, Homo sapiens
gaccactgttatca

SEQ ID NO: 1939436 - DNA, 20 bp, Homo sapiens
gaccagactgtgggtccctg

SEQ ID NO: 1939437 - DNA, 15 bp, Homo sapiens
gaccagcccagcctg

SEQ ID NO: 1939438 - DNA, 16 bp, Homo sapiens
gaccagcccagcctgc

SEQ ID NO: 1939439 - DNA, 17 bp, Homo sapiens
gacccagccctcatccc

SEQ ID NO: 1939440 - DNA, 21 bp, Homo sapiens
gaccccaccctgtctgcaggc

SEQ ID NO: 1939441 - DNA, 15 bp, Homo sapiens
gaccccagagtaggg

SEQ ID NO: 1939442 - DNA, 19 bp, Homo sapiens
gacccctcccctaatgcct

SEQ ID NO: 1939443 - DNA, 13 bp, Homo sapiens
gacccctggcttt

SEQ ID NO: 1939444 - DNA, 21 bp, Homo sapiens
gacccctggcttttcactgct

SEQ ID NO: 1939445 - DNA, 19 bp, Homo sapiens
gacccggaggggcctggca

SEQ ID NO: 1939446 - DNA, 16 bp, Homo sapiens
gaccctaaatcttgac

SEQ ID NO: 1939447 - DNA, 12 bp, Homo sapiens
gaccctgccagg

SEQ ID NO: 1939448 - DNA, 16 bp, Homo sapiens
gaccttgatgtcttga

SEQ ID NO: 1939449 - DNA, 13 bp, Homo sapiens
gacgacccggggc

SEQ ID NO: 1939450 - DNA, 19 bp, Homo sapiens
gacgatgtcaaccttgtgt

SEQ ID NO: 1939451 - DNA, 14 bp, Homo sapiens
gacgcctgaggaac

SEQ ID NO: 1939452 - DNA, 19 bp, Homo sapiens
gacgcctgggggtgccagg

SEQ ID NO: 1939453 - DNA, 14 bp, Homo sapiens
gacggaagtggcct

SEQ ID NO: 1939454 - DNA, 18 bp, Homo sapiens
gacgggggttggggtggg

SEQ ID NO: 1939455 - DNA, 22 bp, Homo sapiens
gacgtccctccacgttcacccc

SEQ ID NO: 1939456 - DNA, 17 bp, Homo sapiens
gactctctccatcagaa

SEQ ID NO: 1939457 - DNA, 19 bp, Homo sapiens
gactctctccatcagaagg

SEQ ID NO: 1939458 - DNA, 17 bp, Homo sapiens
gactcttttgccattaa

SEQ ID NO: 1939459 - DNA, 19 bp, Homo sapiens
gactgaccttgatgtcttg

SEQ ID NO: 1939460 - DNA, 14 bp, Homo sapiens
gactgggctgaggg

SEQ ID NO: 1939461 - DNA, 19 bp, Homo sapiens
gactggtcccccatgggct

SEQ ID NO: 1939462 - DNA, 23 bp, Homo sapiens
gactggtcccccatgggctgctg

SEQ ID NO: 1939463 - DNA, 18 bp, Homo sapiens
gactgtactcctcccagg

SEQ ID NO: 1939464 - DNA, 22 bp, Homo sapiens
gactgtctcaagagggcactgg

SEQ ID NO: 1939465 - DNA, 15 bp, Homo sapiens
gacttcagactctct

SEQ ID NO: 1939466 - DNA, 19 bp, Homo sapiens
gacttcagactctctcctc

SEQ ID NO: 1939467 - DNA, 20 bp, Homo sapiens
gacttcagactctctcctct

SEQ ID NO: 1939468 - DNA, 23 bp, Homo sapiens
gacttcagactctctcctctctc

SEQ ID NO: 1939469 - DNA, 16 bp, Homo sapiens
gacttggataggagct

SEQ ID NO: 1939470 - DNA, 20 bp, Homo sapiens
gagaaggacccggaggggcc

SEQ ID NO: 1939471 - DNA, 15 bp, Homo sapiens
gagaaggagaggctc

SEQ ID NO: 1939472 - DNA, 20 bp, Homo sapiens
gagaaggcaagctggcagga

SEQ ID NO: 1939473 - DNA, 13 bp, Homo sapiens
gagaatggctctg

SEQ ID NO: 1939474 - DNA, 13 bp, Homo sapiens
gagaattaaaata

SEQ ID NO: 1939475 - DNA, 14 bp, Homo sapiens
gagacaatctaaaa

SEQ ID NO: 1939476 - DNA, 22 bp, Homo sapiens
gagacagagaggacgtgggcgg

SEQ ID NO: 1939477 - DNA, 22 bp, Homo sapiens
gagacggtcatgcaagaaagca

SEQ ID NO: 1939478 - DNA, 15 bp, Homo sapiens
gagactactctgcct

SEQ ID NO: 1939479 - DNA, 21 bp, Homo sapiens
gagactagatttatgaataca

SEQ ID NO: 1939480 - DNA, 14 bp, Homo sapiens
gagactgggctgag

SEQ ID NO: 1939481 - DNA, 21 bp, Homo sapiens
gagactgggctgagggagcct

SEQ ID NO: 1939482 - DNA, 22 bp, Homo sapiens
gagactgtctcaagagggcact

SEQ ID NO: 1939483 - DNA, 23 bp, Homo sapiens
gagactgtctcaagagggcactg

SEQ ID NO: 1939484 - DNA, 16 bp, Homo sapiens
gagagcagggctgggc

SEQ ID NO: 1939485 - DNA, 21 bp, Homo sapiens
gagagcccaatcactgcctat

SEQ ID NO: 1939486 - DNA, 13 bp, Homo sapiens
gagaggaagccac

SEQ ID NO: 1939487 - DNA, 11 bp, Homo sapiens
gagaggagaga

SEQ ID NO: 1939488 - DNA, 20 bp, Homo sapiens
gagaggaggtgtggagtgga

SEQ ID NO: 1939489 - DNA, 22 bp, Homo sapiens
gagaggaggtgtggagtggagg

SEQ ID NO: 1939490 - DNA, 21 bp, Homo sapiens
gagaggctctgaaagctgctt

SEQ ID NO: 1939491 - DNA, 15 bp, Homo sapiens
gagataccagcgagg

SEQ ID NO: 1939492 - DNA, 22 bp, Homo sapiens
gagatatttacatgaattgcat

SEQ ID NO: 1939493 - DNA, 18 bp, Homo sapiens
gagatattttccatttta

SEQ ID NO: 1939494 - DNA, 21 bp, Homo sapiens
gagatgcatctgtggcctggg

SEQ ID NO: 1939495 - DNA, 23 bp, Homo sapiens
gagatgcatctgtggcctggggc

SEQ ID NO: 1939496 - DNA, 17 bp, Homo sapiens
gagattgggggggcttg

SEQ ID NO: 1939497 - DNA, 19 bp, Homo sapiens
gagattgggggggcttggg

SEQ ID NO: 1939498 - DNA, 22 bp, Homo sapiens
gagcaaaggggtcccatagagg

SEQ ID NO: 1939499 - DNA, 20 bp, Homo sapiens
gagcaaggcaagaagtggga

SEQ ID NO: 1939500 - DNA, 14 bp, Homo sapiens
gagcacctccacat

SEQ ID NO: 1939501 - DNA, 15 bp, Homo sapiens
gagcagaggggctga

SEQ ID NO: 1939502 - DNA, 20 bp, Homo sapiens
gagcagctgggcactgggcc

SEQ ID NO: 1939503 - DNA, 21 bp, Homo sapiens
gagcatccggcatgagggctg

SEQ ID NO: 1939504 - DNA, 21 bp, Homo sapiens
gagcatgaaactatgcaccta

SEQ ID NO: 1939505 - DNA, 22 bp, Homo sapiens
gagcatgtactgagccttgtaa

SEQ ID NO: 1939506 - DNA, 19 bp, Homo sapiens
gagcattgtggctgtcagc

SEQ ID NO: 1939507 - DNA, 14 bp, Homo sapiens
gagccacaggcaga

SEQ ID NO: 1939508 - DNA, 13 bp, Homo sapiens
gagccagcagctg

SEQ ID NO: 1939509 - DNA, 13 bp, Homo sapiens
gagccagctctgg

SEQ ID NO: 1939510 - DNA, 12 bp, Homo sapiens
gagccaggagcc

SEQ ID NO: 1939511 - DNA, 18 bp, Homo sapiens
gagcccaatcactgccta

SEQ ID NO: 1939512 - DNA, 18 bp, Homo sapiens
gagccccattcctgggaa

SEQ ID NO: 1939513 - DNA, 22 bp, Homo sapiens
gagccccctgtccttcccacgg

SEQ ID NO: 1939514 - DNA, 18 bp, Homo sapiens
gagcccctatcctgcacc

SEQ ID NO: 1939515 - DNA, 17 bp, Homo sapiens
gagccctgccctcactc

SEQ ID NO: 1939516 - DNA, 22 bp, Homo sapiens
gagccgggtctgcctcttctgg

SEQ ID NO: 1939517 - DNA, 23 bp, Homo sapiens
gagcctatggaaagggtgtggct

SEQ ID NO: 1939518 - DNA, 12 bp, Homo sapiens
gagcggccgcct

SEQ ID NO: 1939519 - DNA, 17 bp, Homo sapiens
gagcggccgcctgtcct

SEQ ID NO: 1939520 - DNA, 16 bp, Homo sapiens
gagctgagcagggaga

SEQ ID NO: 1939521 - DNA, 17 bp, Homo sapiens
gagctgcagttgtgaaa

SEQ ID NO: 1939522 - DNA, 12 bp, Homo sapiens
gagctggggaag

SEQ ID NO: 1939523 - DNA, 17 bp, Homo sapiens
gagctgtttactaggga

SEQ ID NO: 1939524 - DNA, 16 bp, Homo sapiens
gagcttcatggcagaa

SEQ ID NO: 1939525 - DNA, 17 bp, Homo sapiens
gagcttccctgactcat

SEQ ID NO: 1939526 - DNA, 19 bp, Homo sapiens
gagcttgattctaaagggg

SEQ ID NO: 1939527 - DNA, 21 bp, Homo sapiens
gagcttgattctaaaggggac

SEQ ID NO: 1939528 - DNA, 23 bp, Homo sapiens
gaggaaaaccaagccgtggcttc

SEQ ID NO: 1939529 - DNA, 14 bp, Homo sapiens
gaggaaaagccagt

SEQ ID NO: 1939530 - DNA, 14 bp, Homo sapiens
gaggaaaagcccag

SEQ ID NO: 1939531 - DNA, 15 bp, Homo sapiens
gaggaaaagcccagg

SEQ ID NO: 1939532 - DNA, 21 bp, Homo sapiens
gaggaagcacaagaagtggga

SEQ ID NO: 1939533 - DNA, 16 bp, Homo sapiens
gaggaagggcccccgg

SEQ ID NO: 1939534 - DNA, 15 bp, Homo sapiens
gaggacgtgggcggc

SEQ ID NO: 1939535 - DNA, 13 bp, Homo sapiens
gaggaggaggcag

SEQ ID NO: 1939536 - DNA, 15 bp, Homo sapiens
gaggaggcagaacca

SEQ ID NO: 1939537 - DNA, 20 bp, Homo sapiens
gaggatggcctctgctaagc

SEQ ID NO: 1939538 - DNA, 23 bp, Homo sapiens
gaggatggtcatcgtgacagcag

SEQ ID NO: 1939539 - DNA, 15 bp, Homo sapiens
gaggcagaatggtgg

SEQ ID NO: 1939540 - DNA, 23 bp, Homo sapiens
gaggcagaatggtgggctccaga

SEQ ID NO: 1939541 - DNA, 20 bp, Homo sapiens
gaggcagcagtgtgaggcca

SEQ ID NO: 1939542 - DNA, 12 bp, Homo sapiens
ctgatccctcta

SEQ ID NO: 1939543 - DNA, 14 bp, Homo sapiens
ctgcaacagcctgt

SEQ ID NO: 1939544 - DNA, 23 bp, Homo sapiens
ctgcaagtcccagggagctctgc

SEQ ID NO: 1939545 - DNA, 18 bp, Homo sapiens
ctgcacagtgcatctcag

SEQ ID NO: 1939546 - DNA, 13 bp, Homo sapiens
ctgcaccctctgc

SEQ ID NO: 1939547 - DNA, 20 bp, Homo sapiens
ctgcagaacagcttcatgtt

SEQ ID NO: 1939548 - DNA, 15 bp, Homo sapiens
ctgcagaccctgcca

SEQ ID NO: 1939549 - DNA, 17 bp, Homo sapiens
ctgcagaccctgccagg

SEQ ID NO: 1939550 - DNA, 18 bp, Homo sapiens
ctgcagaccctgccaggg

SEQ ID NO: 1939551 - DNA, 19 bp, Homo sapiens
ctgcagctttgaggctggc

SEQ ID NO: 1939552 - DNA, 13 bp, Homo sapiens
ctgcaggatcctt

SEQ ID NO: 1939553 - DNA, 14 bp, Homo sapiens
ctgcaggccacccc

SEQ ID NO: 1939554 - DNA, 18 bp, Homo sapiens
ctgcagggacagttgggt

SEQ ID NO: 1939555 - DNA, 18 bp, Homo sapiens
ctgcagggcagcctgtgg

SEQ ID NO: 1939556 - DNA, 15 bp, Homo sapiens
ctgcagtcacccctg

SEQ ID NO: 1939557 - DNA, 22 bp, Homo sapiens
ctgcagtgggttctccaaacta

SEQ ID NO: 1939558 - DNA, 15 bp, Homo sapiens
ctgcatcccttggcc

SEQ ID NO: 1939559 - DNA, 22 bp, Homo sapiens
ctgcatcccttggcccctctct

SEQ ID NO: 1939560 - DNA, 17 bp, Homo sapiens
ctgcatttgtctggcct

SEQ ID NO: 1939561 - DNA, 17 bp, Homo sapiens
ctgccacacttcaggct

SEQ ID NO: 1939562 - DNA, 16 bp, Homo sapiens
ctgccagaagtgtgtt

SEQ ID NO: 1939563 - DNA, 21 bp, Homo sapiens
ctgccagaagtgtgttttggt

SEQ ID NO: 1939564 - DNA, 12 bp, Homo sapiens
ctgccagggcag

SEQ ID NO: 1939565 - DNA, 15 bp, Homo sapiens
ctgccagggcagggc

SEQ ID NO: 1939566 - DNA, 18 bp, Homo sapiens
ctgccatgattttggcca

SEQ ID NO: 1939567 - DNA, 21 bp, Homo sapiens
ctgccatgattttggccactt

SEQ ID NO: 1939568 - DNA, 23 bp, Homo sapiens
ctgccatggaggcacacagctgc

SEQ ID NO: 1939569 - DNA, 14 bp, Homo sapiens
ctgcccacctgcca

SEQ ID NO: 1939570 - DNA, 23 bp, Homo sapiens
ctgcccacgtcccgggcactgtc

SEQ ID NO: 1939571 - DNA, 21 bp, Homo sapiens
ctgcccagcggctcttcctgg

SEQ ID NO: 1939572 - DNA, 17 bp, Homo sapiens
ctgcccccactcagcat

SEQ ID NO: 1939573 - DNA, 21 bp, Homo sapiens
ctgcccccagctgctcctcgc

SEQ ID NO: 1939574 - DNA, 17 bp, Homo sapiens
ctgcccctcccttcaac

SEQ ID NO: 1939575 - DNA, 14 bp, Homo sapiens
ctgccctcactcca

SEQ ID NO: 1939576 - DNA, 18 bp, Homo sapiens
ctgccctggtgctgccac

SEQ ID NO: 1939577 - DNA, 20 bp, Homo sapiens
ctgccctggtgctgccacac

SEQ ID NO: 1939578 - DNA, 21 bp, Homo sapiens
ctgccctggtgctgccacact

SEQ ID NO: 1939579 - DNA, 18 bp, Homo sapiens
ctgccgctgctctcccag

SEQ ID NO: 1939580 - DNA, 23 bp, Homo sapiens
ctgccgtgagagcccaatcactg

SEQ ID NO: 1939581 - DNA, 17 bp, Homo sapiens
ctgcctcatgctctcta

SEQ ID NO: 1939582 - DNA, 17 bp, Homo sapiens
ctgcctcttctgggagg

SEQ ID NO: 1939583 - DNA, 22 bp, Homo sapiens
ctgcctcttctgggagggcagc

SEQ ID NO: 1939584 - DNA, 14 bp, Homo sapiens
ctgccttcctcctg

SEQ ID NO: 1939585 - DNA, 21 bp, Homo sapiens
ctgccttcctcctgggccctc

SEQ ID NO: 1939586 - DNA, 11 bp, Homo sapiens
ctgccttctct

SEQ ID NO: 1939587 - DNA, 13 bp, Homo sapiens
ctgcgccctccct

SEQ ID NO: 1939588 - DNA, 16 bp, Homo sapiens
ctgcgtctcctcgtcc

SEQ ID NO: 1939589 - DNA, 17 bp, Homo sapiens
ctgcgtctcctgcccac

SEQ ID NO: 1939590 - DNA, 17 bp, Homo sapiens
ctgctatattaggcctg

SEQ ID NO: 1939591 - DNA, 18 bp, Homo sapiens
ctgctatgtctgtgatgt

SEQ ID NO: 1939592 - DNA, 14 bp, Homo sapiens
ctgctcacattccc

SEQ ID NO: 1939593 - DNA, 12 bp, Homo sapiens
ctgctcctggga

SEQ ID NO: 1939594 - DNA, 13 bp, Homo sapiens
ctgctctcccagg

SEQ ID NO: 1939595 - DNA, 18 bp, Homo sapiens
ctgctgccatgattttgg

SEQ ID NO: 1939596 - DNA, 23 bp, Homo sapiens
ctgctgccatgattttggccact

SEQ ID NO: 1939597 - DNA, 20 bp, Homo sapiens
ctgctggaaaggcccggaga

SEQ ID NO: 1939598 - DNA, 14 bp, Homo sapiens
ctgctggctgcctt

SEQ ID NO: 1939599 - DNA, 23 bp, Homo sapiens
ctgctgtcagaccttcttccaca

SEQ ID NO: 1939600 - DNA, 15 bp, Homo sapiens
ctgctgtccctcctg

SEQ ID NO: 1939601 - DNA, 18 bp, Homo sapiens
ctgctgtgggtcagtgtg

SEQ ID NO: 1939602 - DNA, 19 bp, Homo sapiens
ctgctgtgggtcagtgtgc

SEQ ID NO: 1939603 - DNA, 21 bp, Homo sapiens
ctgctgtgggtcagtgtgcca

SEQ ID NO: 1939604 - DNA, 19 bp, Homo sapiens
ctgctgttctttaaatgcg

SEQ ID NO: 1939605 - DNA, 13 bp, Homo sapiens
ctgcttgaggaaa

SEQ ID NO: 1939606 - DNA, 14 bp, Homo sapiens
ctgcttgcatttct

SEQ ID NO: 1939607 - DNA, 22 bp, Homo sapiens
ctgctttgggctgccctggtgc

SEQ ID NO: 1939608 - DNA, 23 bp, Homo sapiens
ctgcttttgtcactcggctttgg

SEQ ID NO: 1939609 - DNA, 19 bp, Homo sapiens
ctggaaaacatagagtaga

SEQ ID NO: 1939610 - DNA, 23 bp, Homo sapiens
ctggaaaggatgcttctgctcac

SEQ ID NO: 1939611 - DNA, 21 bp, Homo sapiens
ctggaagaacatcaagatacc

SEQ ID NO: 1939612 - DNA, 14 bp, Homo sapiens
ctggaatgtaatca

SEQ ID NO: 1939613 - DNA, 15 bp, Homo sapiens
ctggaatgtaatcaa

SEQ ID NO: 1939614 - DNA, 20 bp, Homo sapiens
ctggaatgtaatcaatgttt

SEQ ID NO: 1939615 - DNA, 18 bp, Homo sapiens
ctggacagtgagagcagg

SEQ ID NO: 1939616 - DNA, 23 bp, Homo sapiens
ctggacatgaagattctttccca

SEQ ID NO: 1939617 - DNA, 17 bp, Homo sapiens
ctggactctcagtctct

SEQ ID NO: 1939618 - DNA, 20 bp, Homo sapiens
ctggacttttgcagcttcct

SEQ ID NO: 1939619 - DNA, 22 bp, Homo sapiens
ctggacttttgcagcttccttc

SEQ ID NO: 1939620 - DNA, 22 bp, Homo sapiens
ctggagcccctatcctgcaccc

SEQ ID NO: 1939621 - DNA, 19 bp, Homo sapiens
ctggagtctgaaggagagg

SEQ ID NO: 1939622 - DNA, 20 bp, Homo sapiens
ctggagtctgaaggagagga

SEQ ID NO: 1939623 - DNA, 14 bp, Homo sapiens
ctggatccctttca

SEQ ID NO: 1939624 - DNA, 22 bp, Homo sapiens
ctggatggggcggcctgcagac

SEQ ID NO: 1939625 - DNA, 18 bp, Homo sapiens
ctggcaaagacagaagcc

SEQ ID NO: 1939626 - DNA, 17 bp, Homo sapiens
ctggcacagggcagtgg

SEQ ID NO: 1939627 - DNA, 20 bp, Homo sapiens
ctggcacctgggtgctctgg

SEQ ID NO: 1939628 - DNA, 19 bp, Homo sapiens
ctggcagccgtgccttcag

SEQ ID NO: 1939629 - DNA, 22 bp, Homo sapiens
ctggcagccgtgccttcagctc

SEQ ID NO: 1939630 - DNA, 14 bp, Homo sapiens
ctggcaggagggtg

SEQ ID NO: 1939631 - DNA, 16 bp, Homo sapiens
ctggcaggagggtggc

SEQ ID NO: 1939632 - DNA, 17 bp, Homo sapiens
ctggcatctctggagtg

SEQ ID NO: 1939633 - DNA, 13 bp, Homo sapiens
ctggccaaatatg

SEQ ID NO: 1939634 - DNA, 20 bp, Homo sapiens
ctggccaaatatgcactttc

SEQ ID NO: 1939635 - DNA, 13 bp, Homo sapiens
ctggcccacccct

SEQ ID NO: 1939636 - DNA, 15 bp, Homo sapiens
ctggcccacccctct

SEQ ID NO: 1939637 - DNA, 16 bp, Homo sapiens
ctggcccacccctctt

SEQ ID NO: 1939638 - DNA, 23 bp, Homo sapiens
ctggccccagctcctcttcctgc

SEQ ID NO: 1939639 - DNA, 14 bp, Homo sapiens
ctggccccagtgac

SEQ ID NO: 1939640 - DNA, 17 bp, Homo sapiens
ctggccccatggtcagc

SEQ ID NO: 1939641 - DNA, 12 bp, Homo sapiens
ctggccctgttg

SEQ ID NO: 1939642 - DNA, 13 bp, Homo sapiens
ctggccctgttgt

SEQ ID NO: 1939643 - DNA, 22 bp, Homo sapiens
ctggccggcccacgtcctgggt

SEQ ID NO: 1939644 - DNA, 23 bp, Homo sapiens
ctggccggcccacgtcctgggtg

SEQ ID NO: 1939645 - DNA, 21 bp, Homo sapiens
ctggcctagtggggaggggcc

SEQ ID NO: 1939646 - DNA, 19 bp, Homo sapiens
ctggccttggttcctccag

SEQ ID NO: 1939647 - DNA, 20 bp, Homo sapiens
ctggccttggttcctccagc

SEQ ID NO: 1939648 - DNA, 22 bp, Homo sapiens
ctggccttggttcctccagcaa

SEQ ID NO: 1939649 - DNA, 20 bp, Homo sapiens
ctggcggggtctgctcctgg

SEQ ID NO: 1939650 - DNA, 22 bp, Homo sapiens
ctggctcccacaggcccttcct

SEQ ID NO: 1939651 - DNA, 17 bp, Homo sapiens
ctggctccttcagcagc

SEQ ID NO: 1939652 - DNA, 19 bp, Homo sapiens
ctggctgccttagaacctt

SEQ ID NO: 1939653 - DNA, 13 bp, Homo sapiens
ctggctggagagg

SEQ ID NO: 1939654 - DNA, 14 bp, Homo sapiens
ctggcttcacagat

SEQ ID NO: 1939655 - DNA, 23 bp, Homo sapiens
ctggctttgggtagtgccatggc

SEQ ID NO: 1939656 - DNA, 20 bp, Homo sapiens
ctggcttttcactgctggct

SEQ ID NO: 1939657 - DNA, 22 bp, Homo sapiens
ctggcttttcactgctggctgc

SEQ ID NO: 1939658 - DNA, 23 bp, Homo sapiens
ctggcttttcactgctggctgcc

SEQ ID NO: 1939659 - DNA, 22 bp, Homo sapiens
ctgggaatggggtgggagccac

SEQ ID NO: 1939660 - DNA, 17 bp, Homo sapiens
ctgggagagccaaggcc

SEQ ID NO: 1939661 - DNA, 20 bp, Homo sapiens
ctgggagagccaaggcctat

SEQ ID NO: 1939662 - DNA, 14 bp, Homo sapiens
ctgggagatgcagc

SEQ ID NO: 1939663 - DNA, 18 bp, Homo sapiens
ctgggagatgcagctgga

SEQ ID NO: 1939664 - DNA, 19 bp, Homo sapiens
ctgggagatgcagctggat

SEQ ID NO: 1939665 - DNA, 11 bp, Homo sapiens
ctgggagggca

SEQ ID NO: 1939666 - DNA, 22 bp, Homo sapiens
ctgggagggcagcagggctacc

SEQ ID NO: 1939667 - DNA, 23 bp, Homo sapiens
ctgggagttgatcgcctttccca

SEQ ID NO: 1939668 - DNA, 23 bp, Homo sapiens
ctgggatggggcatgtggccaag

SEQ ID NO: 1939669 - DNA, 15 bp, Homo sapiens
ctgggcactcctccc

SEQ ID NO: 1939670 - DNA, 14 bp, Homo sapiens
ctgggcactgggcc

SEQ ID NO: 1939671 - DNA, 21 bp, Homo sapiens
ctgggcagaggggagaggaag

SEQ ID NO: 1939672 - DNA, 12 bp, Homo sapiens
ctgggcagctgt

SEQ ID NO: 1939673 - DNA, 15 bp, Homo sapiens
cttcctctccactgc

SEQ ID NO: 1939674 - DNA, 21 bp, Homo sapiens
cttcctctccactgccttcga

SEQ ID NO: 1939675 - DNA, 15 bp, Homo sapiens
cttcctctctctcac

SEQ ID NO: 1939676 - DNA, 13 bp, Homo sapiens
cttcctgcctctc

SEQ ID NO: 1939677 - DNA, 22 bp, Homo sapiens
cttcctggacagtgagagcagg

SEQ ID NO: 1939678 - DNA, 22 bp, Homo sapiens
cttcctggagactgcccagcta

SEQ ID NO: 1939679 - DNA, 22 bp, Homo sapiens
cttccttccaagtcttcctgac

SEQ ID NO: 1939680 - DNA, 13 bp, Homo sapiens
cttcggcctgctt

SEQ ID NO: 1939681 - DNA, 16 bp, Homo sapiens
cttcgggcccttccca

SEQ ID NO: 1939682 - DNA, 21 bp, Homo sapiens
cttctacttttaagttgctga

SEQ ID NO: 1939683 - DNA, 13 bp, Homo sapiens
cttctatcctgca

SEQ ID NO: 1939684 - DNA, 13 bp, Homo sapiens
cttctccactgga

SEQ ID NO: 1939685 - DNA, 12 bp, Homo sapiens
cttctcccctcc

SEQ ID NO: 1939686 - DNA, 17 bp, Homo sapiens
cttctcccctccagacc

SEQ ID NO: 1939687 - DNA, 20 bp, Homo sapiens
cttctcccctccagacccct

SEQ ID NO: 1939688 - DNA, 22 bp, Homo sapiens
cttctcccctccagacccctac

SEQ ID NO: 1939689 - DNA, 23 bp, Homo sapiens
cttctcctggaccctggaagcag

SEQ ID NO: 1939690 - DNA, 20 bp, Homo sapiens
cttctcctttcacaaccttc

SEQ ID NO: 1939691 - DNA, 22 bp, Homo sapiens
cttctcgtcttcctctctctca

SEQ ID NO: 1939692 - DNA, 15 bp, Homo sapiens
cttctctcacctcct

SEQ ID NO: 1939693 - DNA, 13 bp, Homo sapiens
cttctctcccaca

SEQ ID NO: 1939694 - DNA, 14 bp, Homo sapiens
cttctgatctgaga

SEQ ID NO: 1939695 - DNA, 18 bp, Homo sapiens
cttctgctcacattccct

SEQ ID NO: 1939696 - DNA, 22 bp, Homo sapiens
cttctgctcacattccctctca

SEQ ID NO: 1939697 - DNA, 15 bp, Homo sapiens
cttctgggagggcag

SEQ ID NO: 1939698 - DNA, 21 bp, Homo sapiens
cttctgtgcatttgtgtctgc

SEQ ID NO: 1939699 - DNA, 15 bp, Homo sapiens
cttctgtggctcaca

SEQ ID NO: 1939700 - DNA, 22 bp, Homo sapiens
cttctgtggctcacagaaccct

SEQ ID NO: 1939701 - DNA, 21 bp, Homo sapiens
cttcttaaatgagaaggaatt

SEQ ID NO: 1939702 - DNA, 13 bp, Homo sapiens
cttcttgggggca

SEQ ID NO: 1939703 - DNA, 12 bp, Homo sapiens
cttctttcatgt

SEQ ID NO: 1939704 - DNA, 13 bp, Homo sapiens
cttgaaagaaaat

SEQ ID NO: 1939705 - DNA, 20 bp, Homo sapiens
cttgaattgtaactgttctt

SEQ ID NO: 1939706 - DNA, 16 bp, Homo sapiens
cttgaatttctagaca

SEQ ID NO: 1939707 - DNA, 16 bp, Homo sapiens
cttgagccagtaattg

SEQ ID NO: 1939708 - DNA, 19 bp, Homo sapiens
cttgagtgggccccctctc

SEQ ID NO: 1939709 - DNA, 20 bp, Homo sapiens
cttgattctaaaggggacag

SEQ ID NO: 1939710 - DNA, 17 bp, Homo sapiens
cttgcactattggactt

SEQ ID NO: 1939711 - DNA, 18 bp, Homo sapiens
cttgcactattggacttt

SEQ ID NO: 1939712 - DNA, 14 bp, Homo sapiens
cttgcactttgtga

SEQ ID NO: 1939713 - DNA, 17 bp, Homo sapiens
cttgccgctgggagagc

SEQ ID NO: 1939714 - DNA, 19 bp, Homo sapiens
cttgccgctgggagagcca

SEQ ID NO: 1939715 - DNA, 20 bp, Homo sapiens
cttgccttattagagtgtct

SEQ ID NO: 1939716 - DNA, 19 bp, Homo sapiens
cttgcgcttttgctggtca

SEQ ID NO: 1939717 - DNA, 12 bp, Homo sapiens
cttggagaggag

SEQ ID NO: 1939718 - DNA, 22 bp, Homo sapiens
cttggagccaatggagactgtc

SEQ ID NO: 1939719 - DNA, 21 bp, Homo sapiens
cttggaggcaacctcccattt

SEQ ID NO: 1939720 - DNA, 15 bp, Homo sapiens
cttggataggagctt

SEQ ID NO: 1939721 - DNA, 20 bp, Homo sapiens
cttggataggagcttccaga

SEQ ID NO: 1939722 - DNA, 21 bp, Homo sapiens
cttggataggagcttccagat

SEQ ID NO: 1939723 - DNA, 18 bp, Homo sapiens
cttggatgtacctgcccc

SEQ ID NO: 1939724 - DNA, 12 bp, Homo sapiens
cttggcccctct

SEQ ID NO: 1939725 - DNA, 17 bp, Homo sapiens
cttggctgtagaaggag

SEQ ID NO: 1939726 - DNA, 17 bp, Homo sapiens
cttgggacggaagtggc

SEQ ID NO: 1939727 - DNA, 23 bp, Homo sapiens
cttgggacggaagtggcctgaga

SEQ ID NO: 1939728 - DNA, 19 bp, Homo sapiens
cttgggccctttgagtgca

SEQ ID NO: 1939729 - DNA, 19 bp, Homo sapiens
cttgggggtggggctgcat

SEQ ID NO: 1939730 - DNA, 21 bp, Homo sapiens
cttgggggtggggctgcatcc

SEQ ID NO: 1939731 - DNA, 18 bp, Homo sapiens
cttggtgaggaggaggca

SEQ ID NO: 1939732 - DNA, 13 bp, Homo sapiens
cttggttccccca

SEQ ID NO: 1939733 - DNA, 13 bp, Homo sapiens
cttggttcctcca

SEQ ID NO: 1939734 - DNA, 13 bp, Homo sapiens
cttgtaattctaa

SEQ ID NO: 1939735 - DNA, 16 bp, Homo sapiens
cttgtaattctaaatg

SEQ ID NO: 1939736 - DNA, 13 bp, Homo sapiens
cttgtagggtgag

SEQ ID NO: 1939737 - DNA, 19 bp, Homo sapiens
cttgtagggtgaggcgtgg

SEQ ID NO: 1939738 - DNA, 18 bp, Homo sapiens
cttgtcaaggaatgttat

SEQ ID NO: 1939739 - DNA, 17 bp, Homo sapiens
cttgtcacaaagtgaga

SEQ ID NO: 1939740 - DNA, 22 bp, Homo sapiens
cttgtcacaaagtgagaaatta

SEQ ID NO: 1939741 - DNA, 16 bp, Homo sapiens
cttgtgcctcttggga

SEQ ID NO: 1939742 - DNA, 14 bp, Homo sapiens
cttgtgtgagggca

SEQ ID NO: 1939743 - DNA, 14 bp, Homo sapiens
cttgtgttactaat

SEQ ID NO: 1939744 - DNA, 17 bp, Homo sapiens
cttgtgttactaatttg

SEQ ID NO: 1939745 - DNA, 23 bp, Homo sapiens
cttgtgttactaatttgtataac

SEQ ID NO: 1939746 - DNA, 13 bp, Homo sapiens
cttgttttgttat

SEQ ID NO: 1939747 - DNA, 17 bp, Homo sapiens
ctttaaactataggtaa

SEQ ID NO: 1939748 - DNA, 19 bp, Homo sapiens
ctttaacagtaatgttctt

SEQ ID NO: 1939749 - DNA, 13 bp, Homo sapiens
ctttacgtatttt

SEQ ID NO: 1939750 - DNA, 20 bp, Homo sapiens
ctttagaaactgagtcctgt

SEQ ID NO: 1939751 - DNA, 17 bp, Homo sapiens
ctttatgttttaatatc

SEQ ID NO: 1939752 - DNA, 14 bp, Homo sapiens
ctttatttctgtct

SEQ ID NO: 1939753 - DNA, 18 bp, Homo sapiens
ctttatttgaataacaag

SEQ ID NO: 1939754 - DNA, 16 bp, Homo sapiens
ctttcacaaccttctg

SEQ ID NO: 1939755 - DNA, 15 bp, Homo sapiens
ctttcactgaagtga

SEQ ID NO: 1939756 - DNA, 19 bp, Homo sapiens
ctttcagtttgtccacaca

SEQ ID NO: 1939757 - DNA, 22 bp, Homo sapiens
ctttcagtttgtccacacaaga

SEQ ID NO: 1939758 - DNA, 13 bp, Homo sapiens
ctttcatgtaagt

SEQ ID NO: 1939759 - DNA, 21 bp, Homo sapiens
ctttccctagaaagccatatt

SEQ ID NO: 1939760 - DNA, 16 bp, Homo sapiens
ctttccctgcatccct

SEQ ID NO: 1939761 - DNA, 20 bp, Homo sapiens
ctttctcagcctctgaatat

SEQ ID NO: 1939762 - DNA, 19 bp, Homo sapiens
ctttctgacaataaataat

SEQ ID NO: 1939763 - DNA, 21 bp, Homo sapiens
ctttcttttcgccgtggctgc

SEQ ID NO: 1939764 - DNA, 22 bp, Homo sapiens
ctttcttttctggaatgtaatc

SEQ ID NO: 1939765 - DNA, 15 bp, Homo sapiens
ctttgaaaatatttc

SEQ ID NO: 1939766 - DNA, 20 bp, Homo sapiens
ctttgaaaatatttctatgt

SEQ ID NO: 1939767 - DNA, 16 bp, Homo sapiens
ctttgaaatgaatata

SEQ ID NO: 1939768 - DNA, 16 bp, Homo sapiens
ctttgaagtcatacca

SEQ ID NO: 1939769 - DNA, 16 bp, Homo sapiens
ctttgaggtctaaaca

SEQ ID NO: 1939770 - DNA, 21 bp, Homo sapiens
ctttgagtgcagtcctgatca

SEQ ID NO: 1939771 - DNA, 21 bp, Homo sapiens
ctttgataattactttccagc

SEQ ID NO: 1939772 - DNA, 21 bp, Homo sapiens
tgggtttgggcagtggagagg

SEQ ID NO: 1939773 - DNA, 18 bp, Homo sapiens
tggtagcagggtctttgt

SEQ ID NO: 1939774 - DNA, 23 bp, Homo sapiens
tggtatatatttaggatttgtgt

SEQ ID NO: 1939775 - DNA, 22 bp, Homo sapiens
tggtcactgccatggaggcaca

SEQ ID NO: 1939776 - DNA, 15 bp, Homo sapiens
tggtcagccctaggg

SEQ ID NO: 1939777 - DNA, 19 bp, Homo sapiens
tggtcagccctagggtgga

SEQ ID NO: 1939778 - DNA, 22 bp, Homo sapiens
tggtcagtgaagcccaggagga

SEQ ID NO: 1939779 - DNA, 24 bp, Homo sapiens
tggtcagtgaagcccaggaggacc

SEQ ID NO: 1939780 - DNA, 13 bp, Homo sapiens
tggtcagtgtgca

SEQ ID NO: 1939781 - DNA, 19 bp, Homo sapiens
tggtccaggcttgggctcc

SEQ ID NO: 1939782 - DNA, 12 bp, Homo sapiens
tggtcctttggg

SEQ ID NO: 1939783 - DNA, 13 bp, Homo sapiens
tggtctatttctc

SEQ ID NO: 1939784 - DNA, 15 bp, Homo sapiens
tggtcttggagagga

SEQ ID NO: 1939785 - DNA, 17 bp, Homo sapiens
tggtgagaattaaaata

SEQ ID NO: 1939786 - DNA, 23 bp, Homo sapiens
tggtgagaattaaaataaaacgt

SEQ ID NO: 1939787 - DNA, 14 bp, Homo sapiens
tggtgaggaggagg

SEQ ID NO: 1939788 - DNA, 12 bp, Homo sapiens
tggtgcagtgaa

SEQ ID NO: 1939789 - DNA, 19 bp, Homo sapiens
tggtggcccgacagcctgg

SEQ ID NO: 1939790 - DNA, 14 bp, Homo sapiens
tggtgggctccaga

SEQ ID NO: 1939791 - DNA, 14 bp, Homo sapiens
tggtggtttcagaa

SEQ ID NO: 1939792 - DNA, 19 bp, Homo sapiens
tggtgtgtccccctctgtc

SEQ ID NO: 1939793 - DNA, 16 bp, Homo sapiens
tggttaccgagtatct

SEQ ID NO: 1939794 - DNA, 20 bp, Homo sapiens
tggttaccgagtatctgtaa

SEQ ID NO: 1939795 - DNA, 22 bp, Homo sapiens
tggttaccgagtatctgtaacc

SEQ ID NO: 1939796 - DNA, 22 bp, Homo sapiens
tggtttcagaaagggcagcccc

SEQ ID NO: 1939797 - DNA, 15 bp, Homo sapiens
tggtttgcagagctt

SEQ ID NO: 1939798 - DNA, 20 bp, Homo sapiens
tgtaaactttttcaatggtt

SEQ ID NO: 1939799 - DNA, 11 bp, Homo sapiens
tgtaaattatt

SEQ ID NO: 1939800 - DNA, 18 bp, Homo sapiens
tgtaaattattgtaaact

SEQ ID NO: 1939801 - DNA, 16 bp, Homo sapiens
tgtaacccttgaattt

SEQ ID NO: 1939802 - DNA, 19 bp, Homo sapiens
tgtaacctcttcagaggcc

SEQ ID NO: 1939803 - DNA, 19 bp, Homo sapiens
tgtaactttgcatgttctt

SEQ ID NO: 1939804 - DNA, 17 bp, Homo sapiens
tgtaagctgactggccc

SEQ ID NO: 1939805 - DNA, 17 bp, Homo sapiens
tgtaataatattttaga

SEQ ID NO: 1939806 - DNA, 16 bp, Homo sapiens
tgtaatccgaatctct

SEQ ID NO: 1939807 - DNA, 21 bp, Homo sapiens
tgtacaagtgctcagttccaa

SEQ ID NO: 1939808 - DNA, 18 bp, Homo sapiens
tgtacctgcccccaatcc

SEQ ID NO: 1939809 - DNA, 21 bp, Homo sapiens
tgtacctgcccccactcagca

SEQ ID NO: 1939810 - DNA, 19 bp, Homo sapiens
tgtactgagccttgtaatt

SEQ ID NO: 1939811 - DNA, 23 bp, Homo sapiens
tgtagaaaatttgttattttgca

SEQ ID NO: 1939812 - DNA, 24 bp, Homo sapiens
tgtagaagagggagaaggagaggc

SEQ ID NO: 1939813 - DNA, 17 bp, Homo sapiens
tgtagaaggagacagag

SEQ ID NO: 1939814 - DNA, 17 bp, Homo sapiens
tgtagagtggtctattt

SEQ ID NO: 1939815 - DNA, 19 bp, Homo sapiens
tgtagctaattaggaagct

SEQ ID NO: 1939816 - DNA, 21 bp, Homo sapiens
tgtataggccatctgtaaata

SEQ ID NO: 1939817 - DNA, 20 bp, Homo sapiens
tgtatagttttacactctag

SEQ ID NO: 1939818 - DNA, 20 bp, Homo sapiens
tgtatctcgaagtcttccat

SEQ ID NO: 1939819 - DNA, 11 bp, Homo sapiens
tgtatgtgttt

SEQ ID NO: 1939820 - DNA, 19 bp, Homo sapiens
tgtatgtgtttataattgt

SEQ ID NO: 1939821 - DNA, 14 bp, Homo sapiens
tgtattctctgagc

SEQ ID NO: 1939822 - DNA, 19 bp, Homo sapiens
tgtattctctgagctgtgc

SEQ ID NO: 1939823 - DNA, 19 bp, Homo sapiens
tgtcaaatatatttaacta

SEQ ID NO: 1939824 - DNA, 21 bp, Homo sapiens
tgtcaaatatatttaactatt

SEQ ID NO: 1939825 - DNA, 19 bp, Homo sapiens
tgtcaaccttgtgtgagtg

SEQ ID NO: 1939826 - DNA, 20 bp, Homo sapiens
tgtcacaaagtgagaaatta

SEQ ID NO: 1939827 - DNA, 20 bp, Homo sapiens
tgtcacagaggcagtggcag

SEQ ID NO: 1939828 - DNA, 20 bp, Homo sapiens
tgtcacctagcagatatgta

SEQ ID NO: 1939829 - DNA, 20 bp, Homo sapiens
tgtcagtaccttcaaactag

SEQ ID NO: 1939830 - DNA, 22 bp, Homo sapiens
tgtcatgcccagcttggagtgc

SEQ ID NO: 1939831 - DNA, 20 bp, Homo sapiens
tgtccacacaagacagcaga

SEQ ID NO: 1939832 - DNA, 17 bp, Homo sapiens
tgtccacgactgtctcc

SEQ ID NO: 1939833 - DNA, 19 bp, Homo sapiens
tgtccacgactgtctccat

SEQ ID NO: 1939834 - DNA, 20 bp, Homo sapiens
tgtccatgatgtccttgtta

SEQ ID NO: 1939835 - DNA, 17 bp, Homo sapiens
tgtccattgtccaatcc

SEQ ID NO: 1939836 - DNA, 19 bp, Homo sapiens
tgtccatttacctggaaac

SEQ ID NO: 1939837 - DNA, 14 bp, Homo sapiens
tgtcccagcccctg

SEQ ID NO: 1939838 - DNA, 22 bp, Homo sapiens
tgtccctaccgagtctcttctc

SEQ ID NO: 1939839 - DNA, 13 bp, Homo sapiens
tgtccctcctgag

SEQ ID NO: 1939840 - DNA, 14 bp, Homo sapiens
tgtccctcctgagg

SEQ ID NO: 1939841 - DNA, 20 bp, Homo sapiens
tgtccctttctgtgtgaaga

SEQ ID NO: 1939842 - DNA, 20 bp, Homo sapiens
tgtccttcccacggccactg

SEQ ID NO: 1939843 - DNA, 23 bp, Homo sapiens
tgtccttcccacggccactgcag

SEQ ID NO: 1939844 - DNA, 18 bp, Homo sapiens
tgtccttctctcacctcc

SEQ ID NO: 1939845 - DNA, 19 bp, Homo sapiens
tgtcgtaacagcaggagca

SEQ ID NO: 1939846 - DNA, 17 bp, Homo sapiens
tgtcgtggtagcagatg

SEQ ID NO: 1939847 - DNA, 20 bp, Homo sapiens
tgtcgttcccttgtgtctgt

SEQ ID NO: 1939848 - DNA, 23 bp, Homo sapiens
tgtcgttcccttgtgtctgttgc

SEQ ID NO: 1939849 - DNA, 15 bp, Homo sapiens
tgtctccatggccct

SEQ ID NO: 1939850 - DNA, 15 bp, Homo sapiens
tgtctgagccctgcc

SEQ ID NO: 1939851 - DNA, 16 bp, Homo sapiens
tgtctgagccctgccc

SEQ ID NO: 1939852 - DNA, 19 bp, Homo sapiens
tgtctgagccctgccctca

SEQ ID NO: 1939853 - DNA, 21 bp, Homo sapiens
tgtctgagccctgccctcact

SEQ ID NO: 1939854 - DNA, 22 bp, Homo sapiens
tgtctgagccctgccctcactc

SEQ ID NO: 1939855 - DNA, 13 bp, Homo sapiens
tgtctgcaggcca

SEQ ID NO: 1939856 - DNA, 15 bp, Homo sapiens
tgtctgcgccgctgt

SEQ ID NO: 1939857 - DNA, 22 bp, Homo sapiens
tgtcttgatgcatgcactgttc

SEQ ID NO: 1939858 - DNA, 23 bp, Homo sapiens
tgtcttgctatggggagaaaaga

SEQ ID NO: 1939859 - DNA, 20 bp, Homo sapiens
tgtcttttatatttgaatta

SEQ ID NO: 1939860 - DNA, 14 bp, Homo sapiens
tgtgaaatttgtta

SEQ ID NO: 1939861 - DNA, 22 bp, Homo sapiens
tgtgaggccagggcagagtgag

SEQ ID NO: 1939862 - DNA, 22 bp, Homo sapiens
tgtgagggatggggagcagctg

SEQ ID NO: 1939863 - DNA, 22 bp, Homo sapiens
tgtgagggcaaaccaggctgca

SEQ ID NO: 1939864 - DNA, 13 bp, Homo sapiens
tgtgatcgtctga

SEQ ID NO: 1939865 - DNA, 16 bp, Homo sapiens
tgtgatgaatactgta

SEQ ID NO: 1939866 - DNA, 17 bp, Homo sapiens
tgtgattaattattgaa

SEQ ID NO: 1939867 - DNA, 13 bp, Homo sapiens
tgtgcaccagggt

SEQ ID NO: 1939868 - DNA, 16 bp, Homo sapiens
tgtgcaggtggggaga

SEQ ID NO: 1939869 - DNA, 12 bp, Homo sapiens
tgtgcagtgttg

SEQ ID NO: 1939870 - DNA, 13 bp, Homo sapiens
tgtgccaccctct

SEQ ID NO: 1939871 - DNA, 15 bp, Homo sapiens
tgtgccaccctctgc

SEQ ID NO: 1939872 - DNA, 18 bp, Homo sapiens
tgtgccaccctctgcagg

SEQ ID NO: 1939873 - DNA, 19 bp, Homo sapiens
tgtgccaccctctgcaggg

SEQ ID NO: 1939874 - DNA, 22 bp, Homo sapiens
tgtgcccccagacgcacgtggg

SEQ ID NO: 1939875 - DNA, 16 bp, Homo sapiens
tgtgcctcttgggaga

SEQ ID NO: 1939876 - DNA, 17 bp, Homo sapiens
tgtgcctcttgggagac

SEQ ID NO: 1939877 - DNA, 16 bp, Homo sapiens
tgtgctcgggagtggc

SEQ ID NO: 1939878 - DNA, 21 bp, Homo sapiens
tgtgctgttgtttaaaataaa

SEQ ID NO: 1939879 - DNA, 17 bp, Homo sapiens
tgtggaaaaaaaaagaa

SEQ ID NO: 1939880 - DNA, 15 bp, Homo sapiens
tgtggagaggagaga

SEQ ID NO: 1939881 - DNA, 17 bp, Homo sapiens
tgtggagaggagagaat

SEQ ID NO: 1939882 - DNA, 13 bp, Homo sapiens
tgtggagtggagg

SEQ ID NO: 1939883 - DNA, 12 bp, Homo sapiens
tgtggcccctcc

SEQ ID NO: 1939884 - DNA, 13 bp, Homo sapiens
tgtggcctggggc

SEQ ID NO: 1939885 - DNA, 15 bp, Homo sapiens
tgtggctgtcagcag

SEQ ID NO: 1939886 - DNA, 18 bp, Homo sapiens
tgtgggactggcccaccc

SEQ ID NO: 1939887 - DNA, 16 bp, Homo sapiens
tgtgggtcagtgtgcc

SEQ ID NO: 1939888 - DNA, 18 bp, Homo sapiens
tgtgtccacgactgtctc

SEQ ID NO: 1939889 - DNA, 19 bp, Homo sapiens
tgtgtccacgactgtctcc

SEQ ID NO: 1939890 - DNA, 21 bp, Homo sapiens
tgtgtccccctctgtccaggc

SEQ ID NO: 1939891 - DNA, 17 bp, Homo sapiens
tgtgtctgcctgcctca

SEQ ID NO: 1939892 - DNA, 22 bp, Homo sapiens
tgtgtgggggtctgggaggcag

SEQ ID NO: 1939893 - DNA, 16 bp, Homo sapiens
tgtgtgtaagctgact

SEQ ID NO: 1939894 - DNA, 22 bp, Homo sapiens
tgtgtgtccacgactgtctcca

SEQ ID NO: 1939895 - DNA, 24 bp, Homo sapiens
tgtgttgccattttgtctggctgt

SEQ ID NO: 1939896 - DNA, 16 bp, Homo sapiens
tgtgtttataattgtt

SEQ ID NO: 1939897 - DNA, 22 bp, Homo sapiens
tgtgtttgtatataaatggtga

SEQ ID NO: 1939898 - DNA, 14 bp, Homo sapiens
tgtgttttacagta

SEQ ID NO: 1939899 - DNA, 19 bp, Homo sapiens
tgtgttttacagtatatct

SEQ ID NO: 1939900 - DNA, 15 bp, Homo sapiens
tgttacattattatc

SEQ ID NO: 1939901 - DNA, 22 bp, Homo sapiens
tgttacctgaaaacactgtgca

SEQ ID NO: 1939902 - DNA, 22 bp, Homo sapiens
tgttacggcagtcacactgctg

SEQ ID NO: 1939903 - DNA, 18 bp, Homo sapiens
tgttagagtccaacgtgg

SEQ ID NO: 1939904 - DNA, 15 bp, Homo sapiens
tgttatacattttta

SEQ ID NO: 1939905 - DNA, 19 bp, Homo sapiens
tgttatcaccgtgggctcc

SEQ ID NO: 1939906 - DNA, 23 bp, Homo sapiens
tgttattagagattacctcctga

SEQ ID NO: 1939907 - DNA, 19 bp, Homo sapiens
tggccactttgcagacctg

SEQ ID NO: 1939908 - DNA, 21 bp, Homo sapiens
tggccactttgcagacctggg

SEQ ID NO: 1939909 - DNA, 11 bp, Homo sapiens
tggccaggtgg

SEQ ID NO: 1939910 - DNA, 13 bp, Homo sapiens
tggcccacccctc

SEQ ID NO: 1939911 - DNA, 18 bp, Homo sapiens
tggcccacccctcttccc

SEQ ID NO: 1939912 - DNA, 20 bp, Homo sapiens
tggcccacccctcttccccc

SEQ ID NO: 1939913 - DNA, 13 bp, Homo sapiens
tggcccagcctgg

SEQ ID NO: 1939914 - DNA, 16 bp, Homo sapiens
tggcccagcctggagc

SEQ ID NO: 1939915 - DNA, 17 bp, Homo sapiens
tggcccctccttctccc

SEQ ID NO: 1939916 - DNA, 18 bp, Homo sapiens
tggcccctccttctcccc

SEQ ID NO: 1939917 - DNA, 21 bp, Homo sapiens
tggcccctccttctcccctcc

SEQ ID NO: 1939918 - DNA, 23 bp, Homo sapiens
tggcccctctctgtttaccctcc

SEQ ID NO: 1939919 - DNA, 14 bp, Homo sapiens
tggcccgacagcct

SEQ ID NO: 1939920 - DNA, 18 bp, Homo sapiens
tggcccgacagcctggca

SEQ ID NO: 1939921 - DNA, 15 bp, Homo sapiens
tggccctgcaaaagg

SEQ ID NO: 1939922 - DNA, 14 bp, Homo sapiens
tggccgctgcccac

SEQ ID NO: 1939923 - DNA, 19 bp, Homo sapiens
tggccggtgtggccctgca

SEQ ID NO: 1939924 - DNA, 22 bp, Homo sapiens
tggcctagtggggaggggcctg

SEQ ID NO: 1939925 - DNA, 18 bp, Homo sapiens
tggcctgggtggggcagg

SEQ ID NO: 1939926 - DNA, 20 bp, Homo sapiens
tggcctggtccaggcttggg

SEQ ID NO: 1939927 - DNA, 20 bp, Homo sapiens
tggccttggttcctccagca

SEQ ID NO: 1939928 - DNA, 16 bp, Homo sapiens
tggctagtctgtgcct

SEQ ID NO: 1939929 - DNA, 17 bp, Homo sapiens
tggctgggtttgggcag

SEQ ID NO: 1939930 - DNA, 14 bp, Homo sapiens
tggctgtcagcagg

SEQ ID NO: 1939931 - DNA, 17 bp, Homo sapiens
tggctgtgattaattat

SEQ ID NO: 1939932 - DNA, 18 bp, Homo sapiens
tggctgtggcccctcctt

SEQ ID NO: 1939933 - DNA, 20 bp, Homo sapiens
tggcttcaatctacgatgtt

SEQ ID NO: 1939934 - DNA, 15 bp, Homo sapiens
tggcttcggcctgct

SEQ ID NO: 1939935 - DNA, 12 bp, Homo sapiens
tggcttgtaggg

SEQ ID NO: 1939936 - DNA, 16 bp, Homo sapiens
tggcttgtagggtgag

SEQ ID NO: 1939937 - DNA, 14 bp, Homo sapiens
tggcttttcactgc

SEQ ID NO: 1939938 - DNA, 21 bp, Homo sapiens
tggcttttcactgctggctgc

SEQ ID NO: 1939939 - DNA, 22 bp, Homo sapiens
tggcttttcactgctggctgcc

SEQ ID NO: 1939940 - DNA, 20 bp, Homo sapiens
tgggaaccccttcatcctct

SEQ ID NO: 1939941 - DNA, 12 bp, Homo sapiens
tgggaaggaggg

SEQ ID NO: 1939942 - DNA, 13 bp, Homo sapiens
tgggaatggggtg

SEQ ID NO: 1939943 - DNA, 15 bp, Homo sapiens
tgggacaatggcaat

SEQ ID NO: 1939944 - DNA, 16 bp, Homo sapiens
tgggacagggcatggc

SEQ ID NO: 1939945 - DNA, 20 bp, Homo sapiens
tgggacggaagtggcctgag

SEQ ID NO: 1939946 - DNA, 12 bp, Homo sapiens
tgggactggccc

SEQ ID NO: 1939947 - DNA, 13 bp, Homo sapiens
tgggagaggaagc

SEQ ID NO: 1939948 - DNA, 14 bp, Homo sapiens
tgggagatgcagct

SEQ ID NO: 1939949 - DNA, 15 bp, Homo sapiens
tgggagatgcagctg

SEQ ID NO: 1939950 - DNA, 13 bp, Homo sapiens
tgggagccacagg

SEQ ID NO: 1939951 - DNA, 14 bp, Homo sapiens
tgggagccgggtct

SEQ ID NO: 1939952 - DNA, 11 bp, Homo sapiens
tgggaggcagg

SEQ ID NO: 1939953 - DNA, 23 bp, Homo sapiens
tgggaggcaggtcccgagccccc

SEQ ID NO: 1939954 - DNA, 13 bp, Homo sapiens
tgggaggctcacc

SEQ ID NO: 1939955 - DNA, 22 bp, Homo sapiens
tgggaggctcacccccttctcc

SEQ ID NO: 1939956 - DNA, 17 bp, Homo sapiens
tgggagggcagcagggc

SEQ ID NO: 1939957 - DNA, 18 bp, Homo sapiens
tgggagggcagcagggct

SEQ ID NO: 1939958 - DNA, 14 bp, Homo sapiens
tgggagtgggagag

SEQ ID NO: 1939959 - DNA, 16 bp, Homo sapiens
tgggagtgggagagga

SEQ ID NO: 1939960 - DNA, 15 bp, Homo sapiens
tgggatccagagaga

SEQ ID NO: 1939961 - DNA, 17 bp, Homo sapiens
tgggatccagagagaag

SEQ ID NO: 1939962 - DNA, 18 bp, Homo sapiens
tgggatccagagagaagc

SEQ ID NO: 1939963 - DNA, 18 bp, Homo sapiens
tgggatggtggagggcca

SEQ ID NO: 1939964 - DNA, 16 bp, Homo sapiens
tgggattgagtctgtg

SEQ ID NO: 1939965 - DNA, 21 bp, Homo sapiens
tgggcaaagcctagtgaaggc

SEQ ID NO: 1939966 - DNA, 14 bp, Homo sapiens
tgggcactgggccg

SEQ ID NO: 1939967 - DNA, 15 bp, Homo sapiens
tgggcatcaaagatg

SEQ ID NO: 1939968 - DNA, 14 bp, Homo sapiens
tgggccaagccagg

SEQ ID NO: 1939969 - DNA, 13 bp, Homo sapiens
tgggccctctctg

SEQ ID NO: 1939970 - DNA, 16 bp, Homo sapiens
tgggccctctctgctc

SEQ ID NO: 1939971 - DNA, 15 bp, Homo sapiens
tgggccggcagcctg

SEQ ID NO: 1939972 - DNA, 22 bp, Homo sapiens
tgggcgcctctgtcctggcccg

SEQ ID NO: 1939973 - DNA, 15 bp, Homo sapiens
tgggcggcagagagg

SEQ ID NO: 1939974 - DNA, 16 bp, Homo sapiens
tgggctccagagtagg

SEQ ID NO: 1939975 - DNA, 19 bp, Homo sapiens
tgggctccctgactgggag

SEQ ID NO: 1939976 - DNA, 22 bp, Homo sapiens
tgggctctctggacctgaccag

SEQ ID NO: 1939977 - DNA, 11 bp, Homo sapiens
tgggctgaggg

SEQ ID NO: 1939978 - DNA, 15 bp, Homo sapiens
tgggctgccctggtg

SEQ ID NO: 1939979 - DNA, 14 bp, Homo sapiens
tgggctggagtggg

SEQ ID NO: 1939980 - DNA, 17 bp, Homo sapiens
tggggagactgggctga

SEQ ID NO: 1939981 - DNA, 21 bp, Homo sapiens
tggggagactgggctgaggga

SEQ ID NO: 1939982 - DNA, 17 bp, Homo sapiens
tggggaggggcctggcc

SEQ ID NO: 1939983 - DNA, 17 bp, Homo sapiens
tggggagggtgggcgtg

SEQ ID NO: 1939984 - DNA, 14 bp, Homo sapiens
tggggcagcacaga

SEQ ID NO: 1939985 - DNA, 16 bp, Homo sapiens
tggggcagcacagaga

SEQ ID NO: 1939986 - DNA, 15 bp, Homo sapiens
tggggcagggcctgg

SEQ ID NO: 1939987 - DNA, 17 bp, Homo sapiens
tggggcagggcctggcc

SEQ ID NO: 1939988 - DNA, 15 bp, Homo sapiens
tggggcggcctgcag

SEQ ID NO: 1939989 - DNA, 18 bp, Homo sapiens
tgggggcctgctgtgggt

SEQ ID NO: 1939990 - DNA, 14 bp, Homo sapiens
tgggggggcttggg

SEQ ID NO: 1939991 - DNA, 18 bp, Homo sapiens
tgggggtctgggaggcag

SEQ ID NO: 1939992 - DNA, 16 bp, Homo sapiens
tgggggtggggctgca

SEQ ID NO: 1939993 - DNA, 17 bp, Homo sapiens
tggggtagagaggacag

SEQ ID NO: 1939994 - DNA, 17 bp, Homo sapiens
tggggtggggcttggaa

SEQ ID NO: 1939995 - DNA, 18 bp, Homo sapiens
tggggttttcacttccta

SEQ ID NO: 1939996 - DNA, 19 bp, Homo sapiens
tggggttttcacttcctag

SEQ ID NO: 1939997 - DNA, 21 bp, Homo sapiens
tgggtagtgccatggccagga

SEQ ID NO: 1939998 - DNA, 19 bp, Homo sapiens
tgggtatattcatttcaaa

SEQ ID NO: 1939999 - DNA, 16 bp, Homo sapiens
tgggtcagtgtgccac

SEQ ID NO: 1940000 - DNA, 17 bp, Homo sapiens
tgggtccatgggcagag

SEQ ID NO: 1940001 - DNA, 20 bp, Homo sapiens
tgggtccctgcgtctcctgc

SEQ ID NO: 1940002 - DNA, 22 bp, Homo sapiens
tgggtcttcagggggccaggtg

SEQ ID NO: 1940003 - DNA, 23 bp, Homo sapiens
tgggtgctgtcatgcccagcttg

SEQ ID NO: 1940004 - DNA, 17 bp, Homo sapiens
tgggttggaaaacagta

SEQ ID NO: 1940005 - DNA, 15 bp, Homo sapiens
tgggtttgggcagtg

SEQ ID NO: 1940006 - DNA, 14 bp, Homo sapiens
tgcagagtcagcag

SEQ ID NO: 1940007 - DNA, 17 bp, Homo sapiens
tgcagataacagctggt

SEQ ID NO: 1940008 - DNA, 15 bp, Homo sapiens
tgcagggaaaattat

SEQ ID NO: 1940009 - DNA, 17 bp, Homo sapiens
tgcagggacagttgggt

SEQ ID NO: 1940010 - DNA, 13 bp, Homo sapiens
tgcagggcagcct

SEQ ID NO: 1940011 - DNA, 21 bp, Homo sapiens
tgcagggcagcctgtgggaga

SEQ ID NO: 1940012 - DNA, 22 bp, Homo sapiens
tgcagggcagcctgtgggagaa

SEQ ID NO: 1940013 - DNA, 13 bp, Homo sapiens
tgcaggtggggag

SEQ ID NO: 1940014 - DNA, 23 bp, Homo sapiens
tgcaggtggggttttcacttcct

SEQ ID NO: 1940015 - DNA, 18 bp, Homo sapiens
tgcagtcctcggcagctc

SEQ ID NO: 1940016 - DNA, 19 bp, Homo sapiens
tgcagtcctcggcagctcc

SEQ ID NO: 1940017 - DNA, 23 bp, Homo sapiens
tgcagtgattattttttaaagtc

SEQ ID NO: 1940018 - DNA, 18 bp, Homo sapiens
tgcataacaattcctcta

SEQ ID NO: 1940019 - DNA, 23 bp, Homo sapiens
tgcataccaggggttccccagga

SEQ ID NO: 1940020 - DNA, 16 bp, Homo sapiens
tgcatacgtaaaaatg

SEQ ID NO: 1940021 - DNA, 22 bp, Homo sapiens
tgcatcccttggcccctctctg

SEQ ID NO: 1940022 - DNA, 13 bp, Homo sapiens
tgcatctcagccc

SEQ ID NO: 1940023 - DNA, 14 bp, Homo sapiens
tgcatctcagccca

SEQ ID NO: 1940024 - DNA, 15 bp, Homo sapiens
tgcatctcagcccac

SEQ ID NO: 1940025 - DNA, 18 bp, Homo sapiens
tgcatctcccagataatg

SEQ ID NO: 1940026 - DNA, 24 bp, Homo sapiens
tgcatttaaatacagtcttccatt

SEQ ID NO: 1940027 - DNA, 14 bp, Homo sapiens
tgcatttgtgtctg

SEQ ID NO: 1940028 - DNA, 15 bp, Homo sapiens
tgccacacttcaggc

SEQ ID NO: 1940029 - DNA, 13 bp, Homo sapiens
tgccacagcctcc

SEQ ID NO: 1940030 - DNA, 17 bp, Homo sapiens
tgccacagcctcccctg

SEQ ID NO: 1940031 - DNA, 22 bp, Homo sapiens
tgccacagcctcccctgccagg

SEQ ID NO: 1940032 - DNA, 23 bp, Homo sapiens
tgccacaggctgcaagctgcagg

SEQ ID NO: 1940033 - DNA, 17 bp, Homo sapiens
tgccacatggccgctgc

SEQ ID NO: 1940034 - DNA, 19 bp, Homo sapiens
tgccacatggccgctgccc

SEQ ID NO: 1940035 - DNA, 13 bp, Homo sapiens
tgccaccctctgc

SEQ ID NO: 1940036 - DNA, 18 bp, Homo sapiens
tgccaccctctgcagggc

SEQ ID NO: 1940037 - DNA, 16 bp, Homo sapiens
tgccacttggccacca

SEQ ID NO: 1940038 - DNA, 17 bp, Homo sapiens
tgccacttggccaccag

SEQ ID NO: 1940039 - DNA, 13 bp, Homo sapiens
tgccagaagtgtg

SEQ ID NO: 1940040 - DNA, 13 bp, Homo sapiens
tgccaggactctc

SEQ ID NO: 1940041 - DNA, 15 bp, Homo sapiens
tgccaggccagtaaa

SEQ ID NO: 1940042 - DNA, 14 bp, Homo sapiens
tgccaggctgcagg

SEQ ID NO: 1940043 - DNA, 16 bp, Homo sapiens
tgccaggctgcaggga

SEQ ID NO: 1940044 - DNA, 23 bp, Homo sapiens
tgccagggggtttgaggaccctc

SEQ ID NO: 1940045 - DNA, 17 bp, Homo sapiens
tgccatattttcaccat

SEQ ID NO: 1940046 - DNA, 13 bp, Homo sapiens
tgccatcatctcc

SEQ ID NO: 1940047 - DNA, 13 bp, Homo sapiens
tgccatccctgag

SEQ ID NO: 1940048 - DNA, 18 bp, Homo sapiens
tgccatggaggcacacag

SEQ ID NO: 1940049 - DNA, 15 bp, Homo sapiens
tgccatggccaggag

SEQ ID NO: 1940050 - DNA, 13 bp, Homo sapiens
tgccatttcttcc

SEQ ID NO: 1940051 - DNA, 19 bp, Homo sapiens
tgccatttcttcccaaggc

SEQ ID NO: 1940052 - DNA, 19 bp, Homo sapiens
tgccattttgtctggctgt

SEQ ID NO: 1940053 - DNA, 20 bp, Homo sapiens
tgccattttgtctggctgtg

SEQ ID NO: 1940054 - DNA, 16 bp, Homo sapiens
tgcccacacaccccaa

SEQ ID NO: 1940055 - DNA, 14 bp, Homo sapiens
tgcccacctgccag

SEQ ID NO: 1940056 - DNA, 15 bp, Homo sapiens
tgcccacctgccagg

SEQ ID NO: 1940057 - DNA, 16 bp, Homo sapiens
tgcccacctgccaggc

SEQ ID NO: 1940058 - DNA, 17 bp, Homo sapiens
tgcccacgtcccgggca

SEQ ID NO: 1940059 - DNA, 19 bp, Homo sapiens
tgcccacgtcccgggcact

SEQ ID NO: 1940060 - DNA, 18 bp, Homo sapiens
tgcccactctgaccgggc

SEQ ID NO: 1940061 - DNA, 24 bp, Homo sapiens
tgcccagcggctcttcctggacag

SEQ ID NO: 1940062 - DNA, 15 bp, Homo sapiens
tgcccagtcttgagt

SEQ ID NO: 1940063 - DNA, 15 bp, Homo sapiens
tgccccatcagcagc

SEQ ID NO: 1940064 - DNA, 16 bp, Homo sapiens
tgccccatcagtgctc

SEQ ID NO: 1940065 - DNA, 18 bp, Homo sapiens
tgccccatcagtgctccc

SEQ ID NO: 1940066 - DNA, 20 bp, Homo sapiens
tgccccatcagtgctccctc

SEQ ID NO: 1940067 - DNA, 21 bp, Homo sapiens
tgccccatcagtgctccctca

SEQ ID NO: 1940068 - DNA, 18 bp, Homo sapiens
tgccgctgctctcccagg

SEQ ID NO: 1940069 - DNA, 15 bp, Homo sapiens
tgccgctgggagagc

SEQ ID NO: 1940070 - DNA, 22 bp, Homo sapiens
tgccgctgggagagccaaggcc

SEQ ID NO: 1940071 - DNA, 20 bp, Homo sapiens
tgcctataaaggaaacacgt

SEQ ID NO: 1940072 - DNA, 17 bp, Homo sapiens
tgcctcctctgtcctca

SEQ ID NO: 1940073 - DNA, 15 bp, Homo sapiens
tgcctcttctgggag

SEQ ID NO: 1940074 - DNA, 13 bp, Homo sapiens
tgcctcttgggag

SEQ ID NO: 1940075 - DNA, 14 bp, Homo sapiens
tgcctcttgggaga

SEQ ID NO: 1940076 - DNA, 17 bp, Homo sapiens
tgcctgacacaggggac

SEQ ID NO: 1940077 - DNA, 18 bp, Homo sapiens
tgcctgacatttggagtg

SEQ ID NO: 1940078 - DNA, 15 bp, Homo sapiens
tgccttaaaacttta

SEQ ID NO: 1940079 - DNA, 21 bp, Homo sapiens
tgccttagaacctttcttaca

SEQ ID NO: 1940080 - DNA, 13 bp, Homo sapiens
tgccttcagctct

SEQ ID NO: 1940081 - DNA, 17 bp, Homo sapiens
tgccttcagctctacag

SEQ ID NO: 1940082 - DNA, 14 bp, Homo sapiens
tgccttcctcctgg

SEQ ID NO: 1940083 - DNA, 19 bp, Homo sapiens
tgccttcctcctgggccct

SEQ ID NO: 1940084 - DNA, 20 bp, Homo sapiens
tgccttcctcctgggccctc

SEQ ID NO: 1940085 - DNA, 18 bp, Homo sapiens
tgcgaactctcaggacta

SEQ ID NO: 1940086 - DNA, 17 bp, Homo sapiens
tgcgacaccaccaacag

SEQ ID NO: 1940087 - DNA, 12 bp, Homo sapiens
tgcgatgtgttt

SEQ ID NO: 1940088 - DNA, 21 bp, Homo sapiens
tgcgcaaagagtgtgctcggg

SEQ ID NO: 1940089 - DNA, 11 bp, Homo sapiens
tgcgccctccc

SEQ ID NO: 1940090 - DNA, 14 bp, Homo sapiens
tgcgccctccctcc

SEQ ID NO: 1940091 - DNA, 17 bp, Homo sapiens
tgcgccctccctccctc

SEQ ID NO: 1940092 - DNA, 19 bp, Homo sapiens
tgcgccctccctccctcca

SEQ ID NO: 1940093 - DNA, 18 bp, Homo sapiens
tgcggcttccgagggcac

SEQ ID NO: 1940094 - DNA, 17 bp, Homo sapiens
tgcgggctgggcagctg

SEQ ID NO: 1940095 - DNA, 22 bp, Homo sapiens
tgctatcatatattataagatt

SEQ ID NO: 1940096 - DNA, 23 bp, Homo sapiens
tgctatcatatattataagattt

SEQ ID NO: 1940097 - DNA, 12 bp, Homo sapiens
tgctatggggag

SEQ ID NO: 1940098 - DNA, 18 bp, Homo sapiens
tgctatggggagaaaaga

SEQ ID NO: 1940099 - DNA, 22 bp, Homo sapiens
tgctatggggagaaaagacatg

SEQ ID NO: 1940100 - DNA, 17 bp, Homo sapiens
tgctcacattccctctc

SEQ ID NO: 1940101 - DNA, 15 bp, Homo sapiens
tgctcatcattctct

SEQ ID NO: 1940102 - DNA, 20 bp, Homo sapiens
tgctcatcattctctgtctc

SEQ ID NO: 1940103 - DNA, 14 bp, Homo sapiens
tgctcctacccctg

SEQ ID NO: 1940104 - DNA, 15 bp, Homo sapiens
tgctccttgggccct

SEQ ID NO: 1940105 - DNA, 12 bp, Homo sapiens
tgctctcccagg

SEQ ID NO: 1940106 - DNA, 13 bp, Homo sapiens
tgctctcccaggt

SEQ ID NO: 1940107 - DNA, 23 bp, Homo sapiens
tgctctgcgtgtcacctgtgctt

SEQ ID NO: 1940108 - DNA, 19 bp, Homo sapiens
tgctctggctggagaggaa

SEQ ID NO: 1940109 - DNA, 18 bp, Homo sapiens
tgctcttacccacactac

SEQ ID NO: 1940110 - DNA, 18 bp, Homo sapiens
tgctgccccatcagtgct

SEQ ID NO: 1940111 - DNA, 13 bp, Homo sapiens
tgctggctgcctt

SEQ ID NO: 1940112 - DNA, 15 bp, Homo sapiens
tgctggctgccttag

SEQ ID NO: 1940113 - DNA, 19 bp, Homo sapiens
tgctgtaataatattttag

SEQ ID NO: 1940114 - DNA, 23 bp, Homo sapiens
tgctgtcagaccttcttccacag

SEQ ID NO: 1940115 - DNA, 14 bp, Homo sapiens
tgctgtcatgccca

SEQ ID NO: 1940116 - DNA, 13 bp, Homo sapiens
tgctgtccctcct

SEQ ID NO: 1940117 - DNA, 21 bp, Homo sapiens
tgctgtggattttgtggcttc

SEQ ID NO: 1940118 - DNA, 19 bp, Homo sapiens
tgctgtgggtcagtgtgcc

SEQ ID NO: 1940119 - DNA, 17 bp, Homo sapiens
tgctgttgtctgccgtg

SEQ ID NO: 1940120 - DNA, 16 bp, Homo sapiens
tgctgtttatatatat

SEQ ID NO: 1940121 - DNA, 20 bp, Homo sapiens
tgcttatgtatgcctattca

SEQ ID NO: 1940122 - DNA, 13 bp, Homo sapiens
tgcttctgctcac

SEQ ID NO: 1940123 - DNA, 23 bp, Homo sapiens
tgcttctgctcacattccctctc

SEQ ID NO: 1940124 - DNA, 13 bp, Homo sapiens
tgcttctggggga

SEQ ID NO: 1940125 - DNA, 12 bp, Homo sapiens
tgcttctgtgca

SEQ ID NO: 1940126 - DNA, 14 bp, Homo sapiens
tgcttgaaagaaaa

SEQ ID NO: 1940127 - DNA, 17 bp, Homo sapiens
tgcttgcatttctttat

SEQ ID NO: 1940128 - DNA, 15 bp, Homo sapiens
tgctttgggctgccc

SEQ ID NO: 1940129 - DNA, 16 bp, Homo sapiens
tgctttgggctgccct

SEQ ID NO: 1940130 - DNA, 17 bp, Homo sapiens
tgctttgggctgccctg

SEQ ID NO: 1940131 - DNA, 19 bp, Homo sapiens
tgctttgggctgccctggt

SEQ ID NO: 1940132 - DNA, 24 bp, Homo sapiens
tgctttgtccatgatgtccttgtt

SEQ ID NO: 1940133 - DNA, 15 bp, Homo sapiens
tggaaaaagaaattc

SEQ ID NO: 1940134 - DNA, 17 bp, Homo sapiens
tggaaaacaaggaagtc

SEQ ID NO: 1940135 - DNA, 15 bp, Homo sapiens
tggaaaataaatcaa

SEQ ID NO: 1940136 - DNA, 21 bp, Homo sapiens
tggaaaccagaatgattttga

SEQ ID NO: 1940137 - DNA, 23 bp, Homo sapiens
tggaaaggatgcttctgctcaca

SEQ ID NO: 1940138 - DNA, 21 bp, Homo sapiens
tggaaagggtgtggcttggaa

SEQ ID NO: 1940139 - DNA, 16 bp, Homo sapiens
tggaactgctgccatg

SEQ ID NO: 1940140 - DNA, 21 bp, Homo sapiens
tggaagaacatcaagatacct

SEQ ID NO: 1940141 - DNA, 20 bp, Homo sapiens
tggaagggcgctgagggcag

SEQ ID NO: 1940142 - DNA, 19 bp, Homo sapiens
tggaagtgagggtcagaga

SEQ ID NO: 1940143 - DNA, 19 bp, Homo sapiens
tcttgtaatccgaatctct

SEQ ID NO: 1940144 - DNA, 14 bp, Homo sapiens
tcttgtccacattc

SEQ ID NO: 1940145 - DNA, 15 bp, Homo sapiens
tcttgtccacattct

SEQ ID NO: 1940146 - DNA, 16 bp, Homo sapiens
tcttgtccacattcta

SEQ ID NO: 1940147 - DNA, 17 bp, Homo sapiens
tcttgtccacattctac

SEQ ID NO: 1940148 - DNA, 15 bp, Homo sapiens
tcttgttttgttata

SEQ ID NO: 1940149 - DNA, 20 bp, Homo sapiens
tctttaaagaggagcctttc

SEQ ID NO: 1940150 - DNA, 14 bp, Homo sapiens
tctttatttctgtc

SEQ ID NO: 1940151 - DNA, 15 bp, Homo sapiens
tctttcatgtaagta

SEQ ID NO: 1940152 - DNA, 22 bp, Homo sapiens
tctttccaaattgatgggtggg

SEQ ID NO: 1940153 - DNA, 19 bp, Homo sapiens
tctttccacggagccactc

SEQ ID NO: 1940154 - DNA, 17 bp, Homo sapiens
tctttgacctcaatgga

SEQ ID NO: 1940155 - DNA, 20 bp, Homo sapiens
tctttgagtcaagtcaaata

SEQ ID NO: 1940156 - DNA, 16 bp, Homo sapiens
tctttgctcccagttt

SEQ ID NO: 1940157 - DNA, 22 bp, Homo sapiens
tctttgtcccggataggctaat

SEQ ID NO: 1940158 - DNA, 19 bp, Homo sapiens
tcttttccaaacacaggca

SEQ ID NO: 1940159 - DNA, 22 bp, Homo sapiens
tcttttcgccgtggctgcggca

SEQ ID NO: 1940160 - DNA, 16 bp, Homo sapiens
tgaaaatatttctatg

SEQ ID NO: 1940161 - DNA, 15 bp, Homo sapiens
tgaaaatgtcttgtg

SEQ ID NO: 1940162 - DNA, 17 bp, Homo sapiens
tgaaacaagaagccaca

SEQ ID NO: 1940163 - DNA, 16 bp, Homo sapiens
tgaaacttgtgctata

SEQ ID NO: 1940164 - DNA, 13 bp, Homo sapiens
tgaaagctgcttc

SEQ ID NO: 1940165 - DNA, 20 bp, Homo sapiens
tgaaagctgcttctggggga

SEQ ID NO: 1940166 - DNA, 16 bp, Homo sapiens
tgaaatacctttgcct

SEQ ID NO: 1940167 - DNA, 14 bp, Homo sapiens
tgaaattaacctct

SEQ ID NO: 1940168 - DNA, 14 bp, Homo sapiens
tgaacttttcagga

SEQ ID NO: 1940169 - DNA, 19 bp, Homo sapiens
tgaagacacgcccgactct

SEQ ID NO: 1940170 - DNA, 21 bp, Homo sapiens
tgaagattctttcccaattca

SEQ ID NO: 1940171 - DNA, 13 bp, Homo sapiens
tgaagcccaggag

SEQ ID NO: 1940172 - DNA, 13 bp, Homo sapiens
tgaaggagaggag

SEQ ID NO: 1940173 - DNA, 13 bp, Homo sapiens
tgaaggcttctct

SEQ ID NO: 1940174 - DNA, 19 bp, Homo sapiens
tgaaggcttctctctgtgg

SEQ ID NO: 1940175 - DNA, 14 bp, Homo sapiens
tgaaggtgtcagaa

SEQ ID NO: 1940176 - DNA, 18 bp, Homo sapiens
tgaaggttggaactgctg

SEQ ID NO: 1940177 - DNA, 13 bp, Homo sapiens
tgaagtaagcaaa

SEQ ID NO: 1940178 - DNA, 14 bp, Homo sapiens
tgaagtaagcaaag

SEQ ID NO: 1940179 - DNA, 17 bp, Homo sapiens
tgaagtatctgtacctg

SEQ ID NO: 1940180 - DNA, 21 bp, Homo sapiens
tgaagtcactgcacagtgcat

SEQ ID NO: 1940181 - DNA, 23 bp, Homo sapiens
tgaagtcatagataatagtacat

SEQ ID NO: 1940182 - DNA, 20 bp, Homo sapiens
tgaagtctctttttcttcct

SEQ ID NO: 1940183 - DNA, 20 bp, Homo sapiens
tgaataacaaggaaaacagt

SEQ ID NO: 1940184 - DNA, 22 bp, Homo sapiens
tgaatataccccttagtgtttg

SEQ ID NO: 1940185 - DNA, 15 bp, Homo sapiens
tgaatattggacatt

SEQ ID NO: 1940186 - DNA, 16 bp, Homo sapiens
tgaatgcataaaatgt

SEQ ID NO: 1940187 - DNA, 19 bp, Homo sapiens
tgaatgtttacactctttg

SEQ ID NO: 1940188 - DNA, 19 bp, Homo sapiens
tgaatttaataatctgtag

SEQ ID NO: 1940189 - DNA, 16 bp, Homo sapiens
tgaatttctagacagt

SEQ ID NO: 1940190 - DNA, 16 bp, Homo sapiens
tgacaataaataatat

SEQ ID NO: 1940191 - DNA, 22 bp, Homo sapiens
tgacacaggggacactgaacct

SEQ ID NO: 1940192 - DNA, 19 bp, Homo sapiens
tgttattattggcttgcac

SEQ ID NO: 1940193 - DNA, 18 bp, Homo sapiens
tgttcaaactactgtaca

SEQ ID NO: 1940194 - DNA, 19 bp, Homo sapiens
tgttcaaagaacccccctc

SEQ ID NO: 1940195 - DNA, 21 bp, Homo sapiens
tgttcaaagccagcgtcctcc

SEQ ID NO: 1940196 - DNA, 13 bp, Homo sapiens
tgttcaacaagag

SEQ ID NO: 1940197 - DNA, 17 bp, Homo sapiens
tgttcacttttgacaaa

SEQ ID NO: 1940198 - DNA, 21 bp, Homo sapiens
tgttcagaagttgttagtgat

SEQ ID NO: 1940199 - DNA, 19 bp, Homo sapiens
tgttccatcctgtacaagt

SEQ ID NO: 1940200 - DNA, 21 bp, Homo sapiens
tgttccatcctgtacaagtgc

SEQ ID NO: 1940201 - DNA, 15 bp, Homo sapiens
tgttccccctgtgca

SEQ ID NO: 1940202 - DNA, 17 bp, Homo sapiens
tgttccccttccactga

SEQ ID NO: 1940203 - DNA, 19 bp, Homo sapiens
tgttcgtggagccacaggc

SEQ ID NO: 1940204 - DNA, 14 bp, Homo sapiens
tgttcttgttttgt

SEQ ID NO: 1940205 - DNA, 18 bp, Homo sapiens
tgttgaagtcaaatttgg

SEQ ID NO: 1940206 - DNA, 13 bp, Homo sapiens
tgttgaatgtttg

SEQ ID NO: 1940207 - DNA, 17 bp, Homo sapiens
tgttgctgtctggcttt

SEQ ID NO: 1940208 - DNA, 22 bp, Homo sapiens
tgttgtgggggtgtcacagagg

SEQ ID NO: 1940209 - DNA, 13 bp, Homo sapiens
tgttgttatttaa

SEQ ID NO: 1940210 - DNA, 17 bp, Homo sapiens
tgttgttcagaagttgt

SEQ ID NO: 1940211 - DNA, 15 bp, Homo sapiens
tgtttaccctccctg

SEQ ID NO: 1940212 - DNA, 16 bp, Homo sapiens
tgtttaccctccctgt

SEQ ID NO: 1940213 - DNA, 19 bp, Homo sapiens
tgtttaccctccctgtccc

SEQ ID NO: 1940214 - DNA, 21 bp, Homo sapiens
tgtttagagcagttaacatct

SEQ ID NO: 1940215 - DNA, 23 bp, Homo sapiens
tgtttcaggacagctgcttctgt

SEQ ID NO: 1940216 - DNA, 14 bp, Homo sapiens
tgtttctctgtaaa

SEQ ID NO: 1940217 - DNA, 12 bp, Homo sapiens
tgtttgatgtgt

SEQ ID NO: 1940218 - DNA, 20 bp, Homo sapiens
tgtttgatgtgtatgtgttt

SEQ ID NO: 1940219 - DNA, 16 bp, Homo sapiens
tgtttggaatttaaga

SEQ ID NO: 1940220 - DNA, 16 bp, Homo sapiens
tgtttgtatataaatg

SEQ ID NO: 1940221 - DNA, 14 bp, Homo sapiens
tgtttgtgctgtgg

SEQ ID NO: 1940222 - DNA, 17 bp, Homo sapiens
tgttttacaatggctgg

SEQ ID NO: 1940223 - DNA, 17 bp, Homo sapiens
tgttttacagtatatct

SEQ ID NO: 1940224 - DNA, 18 bp, Homo sapiens
tgttttacagtatatctt

SEQ ID NO: 1940225 - DNA, 23 bp, Homo sapiens
tgttttggtatgcactggttcct

SEQ ID NO: 1940226 - DNA, 18 bp, Homo sapiens
tgttttttttttccactt

SEQ ID NO: 1940227 - DNA, 14 bp, Homo sapiens
ttaaaaatatgtga

SEQ ID NO: 1940228 - DNA, 18 bp, Homo sapiens
ttaaaacaaattaaaaac

SEQ ID NO: 1940229 - DNA, 19 bp, Homo sapiens
ttaaaaccattaccttaaa

SEQ ID NO: 1940230 - DNA, 13 bp, Homo sapiens
ttaaaataaaacg

SEQ ID NO: 1940231 - DNA, 20 bp, Homo sapiens
ttaaaccaaacggaactctt

SEQ ID NO: 1940232 - DNA, 16 bp, Homo sapiens
ttaaagaggagccttt

SEQ ID NO: 1940233 - DNA, 16 bp, Homo sapiens
ttaaagtaacatttaa

SEQ ID NO: 1940234 - DNA, 14 bp, Homo sapiens
ttaaatcagaatct

SEQ ID NO: 1940235 - DNA, 16 bp, Homo sapiens
ttaacatatattgtta

SEQ ID NO: 1940236 - DNA, 15 bp, Homo sapiens
ttaacatctgaagtg

SEQ ID NO: 1940237 - DNA, 18 bp, Homo sapiens
ttaacctcaggttccaaa

SEQ ID NO: 1940238 - DNA, 15 bp, Homo sapiens
ttaataagtttcact

SEQ ID NO: 1940239 - DNA, 20 bp, Homo sapiens
ttaatagccatttgaagaag

SEQ ID NO: 1940240 - DNA, 15 bp, Homo sapiens
ttaatgaaataccaa

SEQ ID NO: 1940241 - DNA, 14 bp, Homo sapiens
ttaatgaagaaagt

SEQ ID NO: 1940242 - DNA, 14 bp, Homo sapiens
ttaattattattta

SEQ ID NO: 1940243 - DNA, 15 bp, Homo sapiens
ttaattcaattaaaa

SEQ ID NO: 1940244 - DNA, 18 bp, Homo sapiens
ttaattggttaatcactt

SEQ ID NO: 1940245 - DNA, 14 bp, Homo sapiens
ttacaatacaatag

SEQ ID NO: 1940246 - DNA, 21 bp, Homo sapiens
ttacaatttctttaaatcatt

SEQ ID NO: 1940247 - DNA, 15 bp, Homo sapiens
ttacactctttgtaa

SEQ ID NO: 1940248 - DNA, 17 bp, Homo sapiens
ttacagtaggagcccag

SEQ ID NO: 1940249 - DNA, 13 bp, Homo sapiens
ttacagtgtatct

SEQ ID NO: 1940250 - DNA, 17 bp, Homo sapiens
ttacatgaattgcattt

SEQ ID NO: 1940251 - DNA, 16 bp, Homo sapiens
ttacattttgtgcagt

SEQ ID NO: 1940252 - DNA, 13 bp, Homo sapiens
ttaccctccctgt

SEQ ID NO: 1940253 - DNA, 16 bp, Homo sapiens
ttaccctccctgtccc

SEQ ID NO: 1940254 - DNA, 20 bp, Homo sapiens
ttacctgaaaacactgtgca

SEQ ID NO: 1940255 - DNA, 22 bp, Homo sapiens
ttacctgaaaacactgtgcaca

SEQ ID NO: 1940256 - DNA, 21 bp, Homo sapiens
ttactaagatgaaattgccaa

SEQ ID NO: 1940257 - DNA, 20 bp, Homo sapiens
ttactaatttgtataaccca

SEQ ID NO: 1940258 - DNA, 16 bp, Homo sapiens
ttactagggatccctc

SEQ ID NO: 1940259 - DNA, 21 bp, Homo sapiens
ttactatcatgtcaaacgtga

SEQ ID NO: 1940260 - DNA, 18 bp, Homo sapiens
ttactcaaaatgcaggac

SEQ ID NO: 1940261 - DNA, 17 bp, Homo sapiens
ttacttttctgcaatgt

SEQ ID NO: 1940262 - DNA, 13 bp, Homo sapiens
ttacttttgtaaa

SEQ ID NO: 1940263 - DNA, 16 bp, Homo sapiens
ttagaaatgatttcaa

SEQ ID NO: 1940264 - DNA, 17 bp, Homo sapiens
ttagaaattgcatttcc

SEQ ID NO: 1940265 - DNA, 13 bp, Homo sapiens
ttagaatggggct

SEQ ID NO: 1940266 - DNA, 21 bp, Homo sapiens
ttagagcagatgacccctccc

SEQ ID NO: 1940267 - DNA, 21 bp, Homo sapiens
ttaggcttacaatgtgcactg

SEQ ID NO: 1940268 - DNA, 20 bp, Homo sapiens
ttagggcggggagaagagca

SEQ ID NO: 1940269 - DNA, 17 bp, Homo sapiens
ttagggtacagcccagg

SEQ ID NO: 1940270 - DNA, 19 bp, Homo sapiens
ttagggtacagcccaggcg

SEQ ID NO: 1940271 - DNA, 12 bp, Homo sapiens
ttagtaacatgt

SEQ ID NO: 1940272 - DNA, 16 bp, Homo sapiens
ttagtatttgcatatt

SEQ ID NO: 1940273 - DNA, 13 bp, Homo sapiens
ttagttaaaatct

SEQ ID NO: 1940274 - DNA, 19 bp, Homo sapiens
ttagttaaaatctattttg

SEQ ID NO: 1940275 - DNA, 23 bp, Homo sapiens
ttataagatttttaggtgtcttt

SEQ ID NO: 1940276 - DNA, 18 bp, Homo sapiens
ttataagtaacttgtcaa

SEQ ID NO: 1940277 - DNA, 13 bp, Homo sapiens
ttataatatacta

SEQ ID NO: 1940278 - DNA, 14 bp, Homo sapiens
ttataattttccta

SEQ ID NO: 1940279 - DNA, 16 bp, Homo sapiens
ttatattacttttgta

SEQ ID NO: 1940280 - DNA, 19 bp, Homo sapiens
ttatattacttttgtaaat

SEQ ID NO: 1940281 - DNA, 22 bp, Homo sapiens
ttatattacttttgtaaatatt

SEQ ID NO: 1940282 - DNA, 18 bp, Homo sapiens
ttatatttgaattagtaa

SEQ ID NO: 1940283 - DNA, 15 bp, Homo sapiens
ttatcaacaatagtg

SEQ ID NO: 1940284 - DNA, 23 bp, Homo sapiens
ttatgggaaccccttcatcctct

SEQ ID NO: 1940285 - DNA, 15 bp, Homo sapiens
ttattaaatcagaat

SEQ ID NO: 1940286 - DNA, 17 bp, Homo sapiens
ttattaacatatattgt

SEQ ID NO: 1940287 - DNA, 19 bp, Homo sapiens
ttattagcattttcaagaa

SEQ ID NO: 1940288 - DNA, 17 bp, Homo sapiens
ttattcacttgtgtttg

SEQ ID NO: 1940289 - DNA, 21 bp, Homo sapiens
ttattcacttgtgtttgtata

SEQ ID NO: 1940290 - DNA, 13 bp, Homo sapiens
ttattcagtgtca

SEQ ID NO: 1940291 - DNA, 15 bp, Homo sapiens
ttattgtaaactttt

SEQ ID NO: 1940292 - DNA, 19 bp, Homo sapiens
ttattgtaaactttttcaa

SEQ ID NO: 1940293 - DNA, 12 bp, Homo sapiens
ttattgtacttg

SEQ ID NO: 1940294 - DNA, 15 bp, Homo sapiens
ttatttcagaaatgt

SEQ ID NO: 1940295 - DNA, 11 bp, Homo sapiens
ttatttgcata

SEQ ID NO: 1940296 - DNA, 17 bp, Homo sapiens
ttcaaaaccttttgaaa

SEQ ID NO: 1940297 - DNA, 21 bp, Homo sapiens
ttcaaaataaacaataaatgg

SEQ ID NO: 1940298 - DNA, 22 bp, Homo sapiens
ttcaaaatcagtgatgggagta

SEQ ID NO: 1940299 - DNA, 17 bp, Homo sapiens
ttcaaactactgtacat

SEQ ID NO: 1940300 - DNA, 21 bp, Homo sapiens
ttcaaagaacccccctcccca

SEQ ID NO: 1940301 - DNA, 21 bp, Homo sapiens
ttcaaagccagcgtcctcctc

SEQ ID NO: 1940302 - DNA, 23 bp, Homo sapiens
ttcaaagccagcgtcctcctctg

SEQ ID NO: 1940303 - DNA, 15 bp, Homo sapiens
ttcaaccattcccca

SEQ ID NO: 1940304 - DNA, 20 bp, Homo sapiens
ttcaaccattccccatggga

SEQ ID NO: 1940305 - DNA, 15 bp, Homo sapiens
ttcaacgcagccctg

SEQ ID NO: 1940306 - DNA, 16 bp, Homo sapiens
ttcaacgcagccctgc

SEQ ID NO: 1940307 - DNA, 19 bp, Homo sapiens
ttcaacgcagccctgcttt

SEQ ID NO: 1940308 - DNA, 18 bp, Homo sapiens
ttcaatggttgggacaat

SEQ ID NO: 1940309 - DNA, 23 bp, Homo sapiens
ttcaatggttgggacaatggcaa

SEQ ID NO: 1940310 - DNA, 15 bp, Homo sapiens
ttcaccatctttcta

SEQ ID NO: 1940311 - DNA, 14 bp, Homo sapiens
ttcaccctcctcat

SEQ ID NO: 1940312 - DNA, 15 bp, Homo sapiens
ttcactgaagtgaat

SEQ ID NO: 1940313 - DNA, 18 bp, Homo sapiens
ttcactgaagtgaataca

SEQ ID NO: 1940314 - DNA, 12 bp, Homo sapiens
ttcactgacact

SEQ ID NO: 1940315 - DNA, 19 bp, Homo sapiens
ttcactgctggctgcctta

SEQ ID NO: 1940316 - DNA, 14 bp, Homo sapiens
ttcagaataaatgg

SEQ ID NO: 1940317 - DNA, 15 bp, Homo sapiens
ttcagactctctcct

SEQ ID NO: 1940318 - DNA, 23 bp, Homo sapiens
ttcagaggccctcgctgccagct

SEQ ID NO: 1940319 - DNA, 13 bp, Homo sapiens
ttcaggacagctg

SEQ ID NO: 1940320 - DNA, 15 bp, Homo sapiens
ttcagtaaacaccat

SEQ ID NO: 1940321 - DNA, 14 bp, Homo sapiens
ttcatagctattta

SEQ ID NO: 1940322 - DNA, 13 bp, Homo sapiens
ttcatctcattaa

SEQ ID NO: 1940323 - DNA, 15 bp, Homo sapiens
ttcattggatgcagt

SEQ ID NO: 1940324 - DNA, 13 bp, Homo sapiens
ttcatttttccta

SEQ ID NO: 1940325 - DNA, 15 bp, Homo sapiens
ttccaagcctgggcc

SEQ ID NO: 1940326 - DNA, 16 bp, Homo sapiens
ttccaagcctgggcca

SEQ ID NO: 1940327 - DNA, 15 bp, Homo sapiens
ttccaagtcttcctg

SEQ ID NO: 1940328 - DNA, 16 bp, Homo sapiens
ttccaatgtgcccagt

SEQ ID NO: 1940329 - DNA, 11 bp, Homo sapiens
ttcccccttcc

SEQ ID NO: 1940330 - DNA, 12 bp, Homo sapiens
ttcccccttccc

SEQ ID NO: 1940331 - DNA, 15 bp, Homo sapiens
ttccccttccactga

SEQ ID NO: 1940332 - DNA, 14 bp, Homo sapiens
ttcccgctcagccc

SEQ ID NO: 1940333 - DNA, 15 bp, Homo sapiens
ttcccgctcagccct

SEQ ID NO: 1940334 - DNA, 16 bp, Homo sapiens
ttcccgctcagccctc

SEQ ID NO: 1940335 - DNA, 15 bp, Homo sapiens
ttccctagaaagcca

SEQ ID NO: 1940336 - DNA, 21 bp, Homo sapiens
ttccctagaaagccatattcc

SEQ ID NO: 1940337 - DNA, 21 bp, Homo sapiens
ttccctagatggttccctttg

SEQ ID NO: 1940338 - DNA, 14 bp, Homo sapiens
ttccctctttcctg

SEQ ID NO: 1940339 - DNA, 16 bp, Homo sapiens
ttccctgactcattct

SEQ ID NO: 1940340 - DNA, 20 bp, Homo sapiens
ttccctggagaccccagagt

SEQ ID NO: 1940341 - DNA, 19 bp, Homo sapiens
ttccctttcactgaagtga

SEQ ID NO: 1940342 - DNA, 13 bp, Homo sapiens
ttccgtctcctct

SEQ ID NO: 1940343 - DNA, 14 bp, Homo sapiens
ttccgtctcctctc

SEQ ID NO: 1940344 - DNA, 12 bp, Homo sapiens
ttcctccctcca

SEQ ID NO: 1940345 - DNA, 18 bp, Homo sapiens
ttcctccctccctgcagg

SEQ ID NO: 1940346 - DNA, 21 bp, Homo sapiens
ttcctcctgggccctctctgc

SEQ ID NO: 1940347 - DNA, 23 bp, Homo sapiens
ttcctctaattaaaatgtgcagt

SEQ ID NO: 1940348 - DNA, 18 bp, Homo sapiens
ttcctctccactgccttc

SEQ ID NO: 1940349 - DNA, 19 bp, Homo sapiens
ttcctctcggctggaagaa

SEQ ID NO: 1940350 - DNA, 18 bp, Homo sapiens
ttcctgccgcaacagttt

SEQ ID NO: 1940351 - DNA, 21 bp, Homo sapiens
ttcctgtgccaggactctctt

SEQ ID NO: 1940352 - DNA, 23 bp, Homo sapiens
ttcctgtgccaggactctctttc

SEQ ID NO: 1940353 - DNA, 12 bp, Homo sapiens
ttccttctcgtc

SEQ ID NO: 1940354 - DNA, 19 bp, Homo sapiens
ttccttctcgtcttcctct

SEQ ID NO: 1940355 - DNA, 20 bp, Homo sapiens
ttcgccgtggctgcggcacc

SEQ ID NO: 1940356 - DNA, 12 bp, Homo sapiens
ttctaaatgaat

SEQ ID NO: 1940357 - DNA, 18 bp, Homo sapiens
ttctaaatgaatgtttac

SEQ ID NO: 1940358 - DNA, 12 bp, Homo sapiens
ttctaagtcttt

SEQ ID NO: 1940359 - DNA, 18 bp, Homo sapiens
ttctagacactgaaggca

SEQ ID NO: 1940360 - DNA, 17 bp, Homo sapiens
ttctagacagtattgcc

SEQ ID NO: 1940361 - DNA, 14 bp, Homo sapiens
ttctatatatacaa

SEQ ID NO: 1940362 - DNA, 21 bp, Homo sapiens
ttctatgtaaattattgtaaa

SEQ ID NO: 1940363 - DNA, 24 bp, Homo sapiens
ttctatgtaaattattgtaaactt

SEQ ID NO: 1940364 - DNA, 19 bp, Homo sapiens
ttctatttctcctccatgg

SEQ ID NO: 1940365 - DNA, 14 bp, Homo sapiens
ttctcccctccaga

SEQ ID NO: 1940366 - DNA, 13 bp, Homo sapiens
ttctcctctccca

SEQ ID NO: 1940367 - DNA, 16 bp, Homo sapiens
ttctcgtcttcctctc

SEQ ID NO: 1940368 - DNA, 22 bp, Homo sapiens
ttctcgtcttcctctctctcac

SEQ ID NO: 1940369 - DNA, 13 bp, Homo sapiens
ttctctcacctcc

SEQ ID NO: 1940370 - DNA, 13 bp, Homo sapiens
ttctctcccacac

SEQ ID NO: 1940371 - DNA, 12 bp, Homo sapiens
ttctctgtctca

SEQ ID NO: 1940372 - DNA, 17 bp, Homo sapiens
ttctgaatattggacat

SEQ ID NO: 1940373 - DNA, 16 bp, Homo sapiens
ttctgcaacagcctgt

SEQ ID NO: 1940374 - DNA, 22 bp, Homo sapiens
ttctggaatgtaatcaatgttt

SEQ ID NO: 1940375 - DNA, 14 bp, Homo sapiens
ttctgggagggcag

SEQ ID NO: 1940376 - DNA, 19 bp, Homo sapiens
ttctgtctcataattgtca

SEQ ID NO: 1940377 - DNA, 15 bp, Homo sapiens
ttcttaagcactttg

SEQ ID NO: 1940378 - DNA, 21 bp, Homo sapiens
ttcttatgtatgtgaaagtta

SEQ ID NO: 1940379 - DNA, 17 bp, Homo sapiens
ttcttatgttgcccagt

SEQ ID NO: 1940380 - DNA, 21 bp, Homo sapiens
ttcttcataacaattttagga

SEQ ID NO: 1940381 - DNA, 20 bp, Homo sapiens
ttcttcctctcggctggaag

SEQ ID NO: 1940382 - DNA, 21 bp, Homo sapiens
ttcttgaatttaataatctgt

SEQ ID NO: 1940383 - DNA, 16 bp, Homo sapiens
ttcttggttgaggaaa

SEQ ID NO: 1940384 - DNA, 20 bp, Homo sapiens
ttcttgtccacattctactt

SEQ ID NO: 1940385 - DNA, 16 bp, Homo sapiens
ttcttgttacggcagt

SEQ ID NO: 1940386 - DNA, 21 bp, Homo sapiens
ttcttgttttgttatataaaa

SEQ ID NO: 1940387 - DNA, 13 bp, Homo sapiens
ttctttcatgtaa

SEQ ID NO: 1940388 - DNA, 13 bp, Homo sapiens
ttctttctgctat

SEQ ID NO: 1940389 - DNA, 18 bp, Homo sapiens
ttgaaatatgcatgtact

SEQ ID NO: 1940390 - DNA, 18 bp, Homo sapiens
ttgaagtatctgtacctg

SEQ ID NO: 1940391 - DNA, 15 bp, Homo sapiens
ttgaattgtaactgt

SEQ ID NO: 1940392 - DNA, 20 bp, Homo sapiens
ttgaccgtttttatattact

SEQ ID NO: 1940393 - DNA, 17 bp, Homo sapiens
ttgacctttgaggtcta

SEQ ID NO: 1940394 - DNA, 21 bp, Homo sapiens
ttgacctttgaggtctaaaca

SEQ ID NO: 1940395 - DNA, 21 bp, Homo sapiens
ttgagagcgctggcctcttcc

SEQ ID NO: 1940396 - DNA, 22 bp, Homo sapiens
ttgagatctgctgacagatgtt

SEQ ID NO: 1940397 - DNA, 23 bp, Homo sapiens
ttgaggaaaacaagcattcacaa

SEQ ID NO: 1940398 - DNA, 18 bp, Homo sapiens
ttgaggaccctcccaggt

SEQ ID NO: 1940399 - DNA, 14 bp, Homo sapiens
ttgagtgctctgat

SEQ ID NO: 1940400 - DNA, 14 bp, Homo sapiens
ttgagttttcagtg

SEQ ID NO: 1940401 - DNA, 22 bp, Homo sapiens
ttgatattttcaacgcagccct

SEQ ID NO: 1940402 - DNA, 15 bp, Homo sapiens
ttgatgtgtatgtgt

SEQ ID NO: 1940403 - DNA, 17 bp, Homo sapiens
ttgattattcagtgtca

SEQ ID NO: 1940404 - DNA, 20 bp, Homo sapiens
ttgcaactggtatatattta

SEQ ID NO: 1940405 - DNA, 11 bp, Homo sapiens
ttgcagaagaa

SEQ ID NO: 1940406 - DNA, 15 bp, Homo sapiens
ttgcagaagaaactc

SEQ ID NO: 1940407 - DNA, 18 bp, Homo sapiens
ttgcagacctgggacttt

SEQ ID NO: 1940408 - DNA, 20 bp, Homo sapiens
ttgcagacctgggactttag

SEQ ID NO: 1940409 - DNA, 19 bp, Homo sapiens
ttgcagcctagtaggagct

SEQ ID NO: 1940410 - DNA, 11 bp, Homo sapiens
ttgcatttctt

SEQ ID NO: 1940411 - DNA, 17 bp, Homo sapiens
ttgccacctctggccaa

SEQ ID NO: 1940412 - DNA, 15 bp, Homo sapiens
ttgccagtcctgcaa

SEQ ID NO: 1940413 - DNA, 19 bp, Homo sapiens
ttgccatattttcaccatt

SEQ ID NO: 1940414 - DNA, 14 bp, Homo sapiens
ttgccatttcttcc

SEQ ID NO: 1940415 - DNA, 24 bp, Homo sapiens
ttgccgctgggagagccaaggcct

SEQ ID NO: 1940416 - DNA, 19 bp, Homo sapiens
ttgctatcatatattataa

SEQ ID NO: 1940417 - DNA, 15 bp, Homo sapiens
ttgctgattcttgag

SEQ ID NO: 1940418 - DNA, 19 bp, Homo sapiens
ttgctgccccatcagtgct

SEQ ID NO: 1940419 - DNA, 20 bp, Homo sapiens
ttgctgccccatcagtgctc

SEQ ID NO: 1940420 - DNA, 15 bp, Homo sapiens
ttgctgtctggcttt

SEQ ID NO: 1940421 - DNA, 12 bp, Homo sapiens
ttgcttgaaaga

SEQ ID NO: 1940422 - DNA, 12 bp, Homo sapiens
ttggaaaataaa

SEQ ID NO: 1940423 - DNA, 15 bp, Homo sapiens
ttggaaaataaatca

SEQ ID NO: 1940424 - DNA, 14 bp, Homo sapiens
ttggagcttcatgg

SEQ ID NO: 1940425 - DNA, 23 bp, Homo sapiens
ttggagtgccacatggccgctgc

SEQ ID NO: 1940426 - DNA, 19 bp, Homo sapiens
ttggagtgttccccttcca

SEQ ID NO: 1940427 - DNA, 22 bp, Homo sapiens
ttggagtgttccccttccactg

SEQ ID NO: 1940428 - DNA, 20 bp, Homo sapiens
ttggattggtaccagagcct

SEQ ID NO: 1940429 - DNA, 17 bp, Homo sapiens
ttggcaatgccatcatc

SEQ ID NO: 1940430 - DNA, 15 bp, Homo sapiens
ttggcactgatgggc

SEQ ID NO: 1940431 - DNA, 15 bp, Homo sapiens
ttggctcgggacttc

SEQ ID NO: 1940432 - DNA, 21 bp, Homo sapiens
ttggctgtagaaggagacaga

SEQ ID NO: 1940433 - DNA, 15 bp, Homo sapiens
ttgggaggctggagt

SEQ ID NO: 1940434 - DNA, 19 bp, Homo sapiens
ttggggtggggcgggaggc

SEQ ID NO: 1940435 - DNA, 13 bp, Homo sapiens
ttgggttccagac

SEQ ID NO: 1940436 - DNA, 17 bp, Homo sapiens
ttggtgaggaggaggca

SEQ ID NO: 1940437 - DNA, 18 bp, Homo sapiens
ttggttcccccactgatc

SEQ ID NO: 1940438 - DNA, 15 bp, Homo sapiens
ttggttcctccagca

SEQ ID NO: 1940439 - DNA, 18 bp, Homo sapiens
ttggtttttaaaacccag

SEQ ID NO: 1940440 - DNA, 16 bp, Homo sapiens
ttgtaaatattcttgt

SEQ ID NO: 1940441 - DNA, 23 bp, Homo sapiens
ttgtaaatgtttaatatctgact

SEQ ID NO: 1940442 - DNA, 16 bp, Homo sapiens
ttgtaactttgcatgt

SEQ ID NO: 1940443 - DNA, 15 bp, Homo sapiens
ttgtaaggtactgaa

SEQ ID NO: 1940444 - DNA, 14 bp, Homo sapiens
ttgtaattctaaat

SEQ ID NO: 1940445 - DNA, 15 bp, Homo sapiens
ttgtataggccatct

SEQ ID NO: 1940446 - DNA, 17 bp, Homo sapiens
ttgtataggccatctgt

SEQ ID NO: 1940447 - DNA, 23 bp, Homo sapiens
ttgtataggccatctgtaaatat

SEQ ID NO: 1940448 - DNA, 16 bp, Homo sapiens
ttgtatataaatggtg

SEQ ID NO: 1940449 - DNA, 15 bp, Homo sapiens
ttgtattgtttcaat

SEQ ID NO: 1940450 - DNA, 19 bp, Homo sapiens
ttgtcacctagcagatatg

SEQ ID NO: 1940451 - DNA, 17 bp, Homo sapiens
ttgtctcgaaataattt

SEQ ID NO: 1940452 - DNA, 17 bp, Homo sapiens
ttgtctgaagtcactgc

SEQ ID NO: 1940453 - DNA, 21 bp, Homo sapiens
ttgtctgaagtcactgcacag

SEQ ID NO: 1940454 - DNA, 14 bp, Homo sapiens
ttgtgaaatttgtt

SEQ ID NO: 1940455 - DNA, 13 bp, Homo sapiens
ttgtggatactat

SEQ ID NO: 1940456 - DNA, 13 bp, Homo sapiens
ttgtgtacttgac

SEQ ID NO: 1940457 - DNA, 18 bp, Homo sapiens
ttgtgtctgcctgcctca

SEQ ID NO: 1940458 - DNA, 18 bp, Homo sapiens
ttgtgtttgtatataaat

SEQ ID NO: 1940459 - DNA, 22 bp, Homo sapiens
ttgttaggggtgggggagaatg

SEQ ID NO: 1940460 - DNA, 16 bp, Homo sapiens
aagatgagaagccaaa

SEQ ID NO: 1940461 - DNA, 17 bp, Homo sapiens
aagatgagaagccaaag

SEQ ID NO: 1940462 - DNA, 21 bp, Homo sapiens
aagatggattggtgtaaaagg

SEQ ID NO: 1940463 - DNA, 13 bp, Homo sapiens
aagattctttccc

SEQ ID NO: 1940464 - DNA, 22 bp, Homo sapiens
aagcaaagactttcctcttagt

SEQ ID NO: 1940465 - DNA, 19 bp, Homo sapiens
aagcaatatgcatttaaat

SEQ ID NO: 1940466 - DNA, 13 bp, Homo sapiens
aagcacattatgt

SEQ ID NO: 1940467 - DNA, 15 bp, Homo sapiens
aagcacgaaatgtta

SEQ ID NO: 1940468 - DNA, 21 bp, Homo sapiens
aagcactttgaaaatatttct

SEQ ID NO: 1940469 - DNA, 13 bp, Homo sapiens
aagccacagaaat

SEQ ID NO: 1940470 - DNA, 20 bp, Homo sapiens
aagccacgtgctggagagta

SEQ ID NO: 1940471 - DNA, 18 bp, Homo sapiens
aagccacttaaaatgttc

SEQ ID NO: 1940472 - DNA, 14 bp, Homo sapiens
aagccaggagaccc

SEQ ID NO: 1940473 - DNA, 18 bp, Homo sapiens
aagccagggttccagaca

SEQ ID NO: 1940474 - DNA, 13 bp, Homo sapiens
aagccatattcca

SEQ ID NO: 1940475 - DNA, 19 bp, Homo sapiens
aagccatattccagcagtg

SEQ ID NO: 1940476 - DNA, 20 bp, Homo sapiens
aagcccagcactgcttgagg

SEQ ID NO: 1940477 - DNA, 22 bp, Homo sapiens
aagcccatcaattatagaaagc

SEQ ID NO: 1940478 - DNA, 13 bp, Homo sapiens
aagccccctttga

SEQ ID NO: 1940479 - DNA, 14 bp, Homo sapiens
aagccgtggcttcc

SEQ ID NO: 1940480 - DNA, 13 bp, Homo sapiens
aagcctcagagaa

SEQ ID NO: 1940481 - DNA, 15 bp, Homo sapiens
aagcctgggccactg

SEQ ID NO: 1940482 - DNA, 21 bp, Homo sapiens
aagctaaatcctttactgtta

SEQ ID NO: 1940483 - DNA, 14 bp, Homo sapiens
aagctgcttctggg

SEQ ID NO: 1940484 - DNA, 22 bp, Homo sapiens
aagctttcatgtaaactgtgca

SEQ ID NO: 1940485 - DNA, 22 bp, Homo sapiens
aaggaaacacgtttagaaatga

SEQ ID NO: 1940486 - DNA, 21 bp, Homo sapiens
aaggaagtcaaagcaaggaaa

SEQ ID NO: 1940487 - DNA, 19 bp, Homo sapiens
aaggaatgttatcagtatt

SEQ ID NO: 1940488 - DNA, 18 bp, Homo sapiens
aaggacccggaggggcct

SEQ ID NO: 1940489 - DNA, 21 bp, Homo sapiens
aaggacccggaggggcctggc

SEQ ID NO: 1940490 - DNA, 15 bp, Homo sapiens
aaggactctaaaagg

SEQ ID NO: 1940491 - DNA, 14 bp, Homo sapiens
aaggacttgtgcct

SEQ ID NO: 1940492 - DNA, 12 bp, Homo sapiens
aaggagaggagt

SEQ ID NO: 1940493 - DNA, 23 bp, Homo sapiens
aaggagaggagtgcgctagagca

SEQ ID NO: 1940494 - DNA, 17 bp, Homo sapiens
aaggagccccattcctg

SEQ ID NO: 1940495 - DNA, 17 bp, Homo sapiens
aaggagggtcaggaagg

SEQ ID NO: 1940496 - DNA, 23 bp, Homo sapiens
aaggatgcttctgctcacattcc

SEQ ID NO: 1940497 - DNA, 15 bp, Homo sapiens
aaggcaaacccatca

SEQ ID NO: 1940498 - DNA, 20 bp, Homo sapiens
aaggcagctgaaaagtaaat

SEQ ID NO: 1940499 - DNA, 16 bp, Homo sapiens
aaggcctgcccccctt

SEQ ID NO: 1940500 - DNA, 20 bp, Homo sapiens
aaggcctgccccccttccca

SEQ ID NO: 1940501 - DNA, 19 bp, Homo sapiens
aaggctgagaggagagaga

SEQ ID NO: 1940502 - DNA, 17 bp, Homo sapiens
aagggcagcccctcccc

SEQ ID NO: 1940503 - DNA, 17 bp, Homo sapiens
aaggggccagaggctcg

SEQ ID NO: 1940504 - DNA, 18 bp, Homo sapiens
aagggtgggcatcaaaga

SEQ ID NO: 1940505 - DNA, 23 bp, Homo sapiens
aagggtgggcatcaaagatgaga

SEQ ID NO: 1940506 - DNA, 14 bp, Homo sapiens
aaggtggtcttgga

SEQ ID NO: 1940507 - DNA, 20 bp, Homo sapiens
aaggtggtcttggagaggag

SEQ ID NO: 1940508 - DNA, 17 bp, Homo sapiens
aaggttggaactgctgc

SEQ ID NO: 1940509 - DNA, 13 bp, Homo sapiens
aagtaagcaaaga

SEQ ID NO: 1940510 - DNA, 14 bp, Homo sapiens
aagtacctattgaa

SEQ ID NO: 1940511 - DNA, 13 bp, Homo sapiens
aagtatctgtacc

SEQ ID NO: 1940512 - DNA, 13 bp, Homo sapiens
aagtatttcaaat

SEQ ID NO: 1940513 - DNA, 21 bp, Homo sapiens
aagtatttcaaattggagctt

SEQ ID NO: 1940514 - DNA, 16 bp, Homo sapiens
aagtcaacctgcctga

SEQ ID NO: 1940515 - DNA, 22 bp, Homo sapiens
aagtcccagggagctctgcata

SEQ ID NO: 1940516 - DNA, 17 bp, Homo sapiens
aagtcctacaagctaaa

SEQ ID NO: 1940517 - DNA, 19 bp, Homo sapiens
aagtctctttttcttcctc

SEQ ID NO: 1940518 - DNA, 15 bp, Homo sapiens
aagtcttctttcatg

SEQ ID NO: 1940519 - DNA, 16 bp, Homo sapiens
aagtcttctttcatgt

SEQ ID NO: 1940520 - DNA, 18 bp, Homo sapiens
aagtcttctttcatgtaa

SEQ ID NO: 1940521 - DNA, 16 bp, Homo sapiens
aagtgctcagttccaa

SEQ ID NO: 1940522 - DNA, 22 bp, Homo sapiens
aagtggaaaaagaaattctgtt

SEQ ID NO: 1940523 - DNA, 19 bp, Homo sapiens
aagtgggattcaggaatgg

SEQ ID NO: 1940524 - DNA, 20 bp, Homo sapiens
aagttacaaattgcttgaaa

SEQ ID NO: 1940525 - DNA, 14 bp, Homo sapiens
aagttattgacaaa

SEQ ID NO: 1940526 - DNA, 18 bp, Homo sapiens
aagttattgacaaactct

SEQ ID NO: 1940527 - DNA, 18 bp, Homo sapiens
aagttcatagtttctgta

SEQ ID NO: 1940528 - DNA, 22 bp, Homo sapiens
aagttccgtctcctctccagcc

SEQ ID NO: 1940529 - DNA, 20 bp, Homo sapiens
aagttccttatgtatattta

SEQ ID NO: 1940530 - DNA, 15 bp, Homo sapiens
aagtttgatttcatt

SEQ ID NO: 1940531 - DNA, 15 bp, Homo sapiens
aagttttaacctcag

SEQ ID NO: 1940532 - DNA, 19 bp, Homo sapiens
aagtttttacagtgtatct

SEQ ID NO: 1940533 - DNA, 19 bp, Homo sapiens
aataaagtacgtgtttact

SEQ ID NO: 1940534 - DNA, 15 bp, Homo sapiens
aataacttgtgttac

SEQ ID NO: 1940535 - DNA, 22 bp, Homo sapiens
aataagaaacaactctttgaga

SEQ ID NO: 1940536 - DNA, 14 bp, Homo sapiens
aataagtcatttta

SEQ ID NO: 1940537 - DNA, 15 bp, Homo sapiens
aataatattttagaa

SEQ ID NO: 1940538 - DNA, 14 bp, Homo sapiens
aataattgtggaga

SEQ ID NO: 1940539 - DNA, 19 bp, Homo sapiens
aatacaatagtatgcagct

SEQ ID NO: 1940540 - DNA, 16 bp, Homo sapiens
aatacagggcattttg

SEQ ID NO: 1940541 - DNA, 12 bp, Homo sapiens
aataccagagca

SEQ ID NO: 1940542 - DNA, 23 bp, Homo sapiens
aatacccccgtcggaatggtaac

SEQ ID NO: 1940543 - DNA, 13 bp, Homo sapiens
aatacgcttgagc

SEQ ID NO: 1940544 - DNA, 19 bp, Homo sapiens
aatactaaatatgaaattt

SEQ ID NO: 1940545 - DNA, 22 bp, Homo sapiens
aatagataaagtgcctataaag

SEQ ID NO: 1940546 - DNA, 16 bp, Homo sapiens
aatagatgctgactgt

SEQ ID NO: 1940547 - DNA, 18 bp, Homo sapiens
aataggaggacagaacca

SEQ ID NO: 1940548 - DNA, 13 bp, Homo sapiens
aataggcaaaggg

SEQ ID NO: 1940549 - DNA, 19 bp, Homo sapiens
aatataccccttagtgttt

SEQ ID NO: 1940550 - DNA, 13 bp, Homo sapiens
aatatatataata

SEQ ID NO: 1940551 - DNA, 21 bp, Homo sapiens
aatatatgtaaattataagta

SEQ ID NO: 1940552 - DNA, 20 bp, Homo sapiens
aatatcacaaagttgtttaa

SEQ ID NO: 1940553 - DNA, 20 bp, Homo sapiens
aatatcccagagaacaatca

SEQ ID NO: 1940554 - DNA, 22 bp, Homo sapiens
aatatcctgccttttaccttca

SEQ ID NO: 1940555 - DNA, 17 bp, Homo sapiens
aatatctgactgaaatt

SEQ ID NO: 1940556 - DNA, 21 bp, Homo sapiens
aatatgaaattttaccatttt

SEQ ID NO: 1940557 - DNA, 18 bp, Homo sapiens
aatatgattagtaaagaa

SEQ ID NO: 1940558 - DNA, 19 bp, Homo sapiens
aatatgattagtaaagaaa

SEQ ID NO: 1940559 - DNA, 20 bp, Homo sapiens
aatatgattctcctctccca

SEQ ID NO: 1940560 - DNA, 21 bp, Homo sapiens
aatatgattctcctctcccaa

SEQ ID NO: 1940561 - DNA, 20 bp, Homo sapiens
aatatgcatctaataaaaaa

SEQ ID NO: 1940562 - DNA, 12 bp, Homo sapiens
aatatgcatgta

SEQ ID NO: 1940563 - DNA, 14 bp, Homo sapiens
aatatgcatgtact

SEQ ID NO: 1940564 - DNA, 15 bp, Homo sapiens
aatattccctagaaa

SEQ ID NO: 1940565 - DNA, 21 bp, Homo sapiens
aatattcttgtccacattcta

SEQ ID NO: 1940566 - DNA, 16 bp, Homo sapiens
aatatttctatgtaaa

SEQ ID NO: 1940567 - DNA, 18 bp, Homo sapiens
aatatttctatgtaaatt

SEQ ID NO: 1940568 - DNA, 23 bp, Homo sapiens
aatcaagttggcttctaatcaaa

SEQ ID NO: 1940569 - DNA, 22 bp, Homo sapiens
aatcaatgctataactatgttg

SEQ ID NO: 1940570 - DNA, 14 bp, Homo sapiens
aatcacagattttt

SEQ ID NO: 1940571 - DNA, 22 bp, Homo sapiens
aatcactattcttaagcacttt

SEQ ID NO: 1940572 - DNA, 12 bp, Homo sapiens
aatcagcattct

SEQ ID NO: 1940573 - DNA, 19 bp, Homo sapiens
aatcattttaattattatt

SEQ ID NO: 1940574 - DNA, 15 bp, Homo sapiens
aatccaagactgtca

SEQ ID NO: 1940575 - DNA, 16 bp, Homo sapiens
aatccacataaaagaa

SEQ ID NO: 1940576 - DNA, 20 bp, Homo sapiens
aatcctgtcaatgtttgctt

SEQ ID NO: 1940577 - DNA, 13 bp, Homo sapiens
aatcctttactgt

SEQ ID NO: 1940578 - DNA, 23 bp, Homo sapiens
aatcggcaacagggcttctcttt

SEQ ID NO: 1940579 - DNA, 16 bp, Homo sapiens
aatctaaaaaatatct

SEQ ID NO: 1940580 - DNA, 18 bp, Homo sapiens
aatctacgatgttaaaac

SEQ ID NO: 1940581 - DNA, 13 bp, Homo sapiens
aatcttaacaaaa

SEQ ID NO: 1940582 - DNA, 22 bp, Homo sapiens
aatcttaagagaatccacataa

SEQ ID NO: 1940583 - DNA, 22 bp, Homo sapiens
aatcttgactacagtcaggaaa

SEQ ID NO: 1940584 - DNA, 17 bp, Homo sapiens
aatgaaataccaactat

SEQ ID NO: 1940585 - DNA, 17 bp, Homo sapiens
aatgaatgcataaaatg

SEQ ID NO: 1940586 - DNA, 23 bp, Homo sapiens
aatgacgtattgtgaaatttgtt

SEQ ID NO: 1940587 - DNA, 19 bp, Homo sapiens
aatgagctgggccctgggt

SEQ ID NO: 1940588 - DNA, 16 bp, Homo sapiens
aatgatactgtctaag

SEQ ID NO: 1940589 - DNA, 21 bp, Homo sapiens
aatgatattcaatcttaacaa

SEQ ID NO: 1940590 - DNA, 13 bp, Homo sapiens
aatgattcagtgt

SEQ ID NO: 1940591 - DNA, 22 bp, Homo sapiens
aatgattcagtgttaaatgtga

SEQ ID NO: 1940592 - DNA, 13 bp, Homo sapiens
acattccctctca

SEQ ID NO: 1940593 - DNA, 13 bp, Homo sapiens
acattctacttca

SEQ ID NO: 1940594 - DNA, 19 bp, Homo sapiens
acattctacttcagctttg

SEQ ID NO: 1940595 - DNA, 12 bp, Homo sapiens
acatttctcaaa

SEQ ID NO: 1940596 - DNA, 17 bp, Homo sapiens
acattttttttcaagtg

SEQ ID NO: 1940597 - DNA, 15 bp, Homo sapiens
accaaaaaatctata

SEQ ID NO: 1940598 - DNA, 16 bp, Homo sapiens
accaaaattatttcag

SEQ ID NO: 1940599 - DNA, 18 bp, Homo sapiens
accaaacggaactcttca

SEQ ID NO: 1940600 - DNA, 14 bp, Homo sapiens
accaacgggtctgt

SEQ ID NO: 1940601 - DNA, 13 bp, Homo sapiens
accaatcatttta

SEQ ID NO: 1940602 - DNA, 20 bp, Homo sapiens
accaatcattttaattatta

SEQ ID NO: 1940603 - DNA, 13 bp, Homo sapiens
accaatcctggac

SEQ ID NO: 1940604 - DNA, 14 bp, Homo sapiens
accaatgaaaaaat

SEQ ID NO: 1940605 - DNA, 13 bp, Homo sapiens
accacacacaccc

SEQ ID NO: 1940606 - DNA, 18 bp, Homo sapiens
accacacacacccttccc

SEQ ID NO: 1940607 - DNA, 21 bp, Homo sapiens
accacacacacccttccccac

SEQ ID NO: 1940608 - DNA, 13 bp, Homo sapiens
accacctctggcc

SEQ ID NO: 1940609 - DNA, 24 bp, Homo sapiens
accacgtctccctggccccagtga

SEQ ID NO: 1940610 - DNA, 16 bp, Homo sapiens
accactgtgtatttaa

SEQ ID NO: 1940611 - DNA, 14 bp, Homo sapiens
accacttatttcta

SEQ ID NO: 1940612 - DNA, 15 bp, Homo sapiens
accagaagcaacaga

SEQ ID NO: 1940613 - DNA, 21 bp, Homo sapiens
accagagcctatggaaagggt

SEQ ID NO: 1940614 - DNA, 23 bp, Homo sapiens
accagcgaggaggctccagaggg

SEQ ID NO: 1940615 - DNA, 17 bp, Homo sapiens
accagggaccagcccag

SEQ ID NO: 1940616 - DNA, 12 bp, Homo sapiens
accagggctctg

SEQ ID NO: 1940617 - DNA, 22 bp, Homo sapiens
accagggctctgtattctgcaa

SEQ ID NO: 1940618 - DNA, 20 bp, Homo sapiens
accagggttgaccccagagg

SEQ ID NO: 1940619 - DNA, 21 bp, Homo sapiens
accagggttgaccccagagga

SEQ ID NO: 1940620 - DNA, 17 bp, Homo sapiens
accagtccacgccgggt

SEQ ID NO: 1940621 - DNA, 15 bp, Homo sapiens
accataatgttacat

SEQ ID NO: 1940622 - DNA, 17 bp, Homo sapiens
accatgtacatgaagaa

SEQ ID NO: 1940623 - DNA, 17 bp, Homo sapiens
accatgtagaaaatttg

SEQ ID NO: 1940624 - DNA, 19 bp, Homo sapiens
accatgtcgtagttactct

SEQ ID NO: 1940625 - DNA, 15 bp, Homo sapiens
acccaataattctgt

SEQ ID NO: 1940626 - DNA, 19 bp, Homo sapiens
acccacactacgcagaaga

SEQ ID NO: 1940627 - DNA, 20 bp, Homo sapiens
acccacactacgcagaagag

SEQ ID NO: 1940628 - DNA, 23 bp, Homo sapiens
acccacactacgcagaagagaaa

SEQ ID NO: 1940629 - DNA, 15 bp, Homo sapiens
acccacttccctgca

SEQ ID NO: 1940630 - DNA, 18 bp, Homo sapiens
acccacttccctgcaagg

SEQ ID NO: 1940631 - DNA, 14 bp, Homo sapiens
acccagccaggagg

SEQ ID NO: 1940632 - DNA, 16 bp, Homo sapiens
acccagccctcatccc

SEQ ID NO: 1940633 - DNA, 20 bp, Homo sapiens
accccaccacacacaccctt

SEQ ID NO: 1940634 - DNA, 17 bp, Homo sapiens
acccccacctccctgca

SEQ ID NO: 1940635 - DNA, 20 bp, Homo sapiens
acccccgtcggaatggtaac

SEQ ID NO: 1940636 - DNA, 19 bp, Homo sapiens
acccccttctccatccaca

SEQ ID NO: 1940637 - DNA, 20 bp, Homo sapiens
accccgtccctttccctgca

SEQ ID NO: 1940638 - DNA, 21 bp, Homo sapiens
accccgtccctttccctgcat

SEQ ID NO: 1940639 - DNA, 15 bp, Homo sapiens
acccctcaagccagg

SEQ ID NO: 1940640 - DNA, 18 bp, Homo sapiens
acccctcaagccaggaga

SEQ ID NO: 1940641 - DNA, 20 bp, Homo sapiens
acccctcaagccaggagacc

SEQ ID NO: 1940642 - DNA, 18 bp, Homo sapiens
acccctcttcccccttcc

SEQ ID NO: 1940643 - DNA, 19 bp, Homo sapiens
acccctcttcccccttccc

SEQ ID NO: 1940644 - DNA, 18 bp, Homo sapiens
acccctgaactggcccca

SEQ ID NO: 1940645 - DNA, 19 bp, Homo sapiens
acccctggcttttcactgc

SEQ ID NO: 1940646 - DNA, 20 bp, Homo sapiens
acccctggcttttcactgct

SEQ ID NO: 1940647 - DNA, 21 bp, Homo sapiens
acccctgtctgcgccgctgtg

SEQ ID NO: 1940648 - DNA, 18 bp, Homo sapiens
acccctttggcacaccct

SEQ ID NO: 1940649 - DNA, 18 bp, Homo sapiens
acccgacaacatttctgc

SEQ ID NO: 1940650 - DNA, 22 bp, Homo sapiens
acccggcccccgccctctgccc

SEQ ID NO: 1940651 - DNA, 14 bp, Homo sapiens
acccgtttccaagc

SEQ ID NO: 1940652 - DNA, 15 bp, Homo sapiens
acccgtttccaagcc

SEQ ID NO: 1940653 - DNA, 18 bp, Homo sapiens
accctaggtctccacccc

SEQ ID NO: 1940654 - DNA, 22 bp, Homo sapiens
accctaggtctccacccctcaa

SEQ ID NO: 1940655 - DNA, 24 bp, Homo sapiens
accctaggtctccacccctcaagc

SEQ ID NO: 1940656 - DNA, 11 bp, Homo sapiens
accctcccagg

SEQ ID NO: 1940657 - DNA, 14 bp, Homo sapiens
accctccctgtccc

SEQ ID NO: 1940658 - DNA, 14 bp, Homo sapiens
accctctctgtcca

SEQ ID NO: 1940659 - DNA, 20 bp, Homo sapiens
accctctctgtccaatctgc

SEQ ID NO: 1940660 - DNA, 23 bp, Homo sapiens
accctctctgtccaatctgcaag

SEQ ID NO: 1940661 - DNA, 16 bp, Homo sapiens
accctctgcagggcag

SEQ ID NO: 1940662 - DNA, 23 bp, Homo sapiens
accctctgcagggcagcctgtgg

SEQ ID NO: 1940663 - DNA, 19 bp, Homo sapiens
accctctgctatgtctgtg

SEQ ID NO: 1940664 - DNA, 14 bp, Homo sapiens
accctgtctgcagg

SEQ ID NO: 1940665 - DNA, 23 bp, Homo sapiens
accctgtctgcaggccaccccca

SEQ ID NO: 1940666 - DNA, 22 bp, Homo sapiens
accctgttttattgagttctga

SEQ ID NO: 1940667 - DNA, 15 bp, Homo sapiens
acccttccccactcc

SEQ ID NO: 1940668 - DNA, 16 bp, Homo sapiens
acccttccccactccc

SEQ ID NO: 1940669 - DNA, 17 bp, Homo sapiens
acccttccccactcccg

SEQ ID NO: 1940670 - DNA, 13 bp, Homo sapiens
acccttgaaaaga

SEQ ID NO: 1940671 - DNA, 16 bp, Homo sapiens
accgagtctcttctcc

SEQ ID NO: 1940672 - DNA, 24 bp, Homo sapiens
accgagtctcttctccactggatg

SEQ ID NO: 1940673 - DNA, 17 bp, Homo sapiens
accggcaatttccggcc

SEQ ID NO: 1940674 - DNA, 13 bp, Homo sapiens
accgggcttcctc

SEQ ID NO: 1940675 - DNA, 16 bp, Homo sapiens
accgggggctctgagc

SEQ ID NO: 1940676 - DNA, 14 bp, Homo sapiens
accgtgggctccct

SEQ ID NO: 1940677 - DNA, 18 bp, Homo sapiens
accgtttttatattactt

SEQ ID NO: 1940678 - DNA, 19 bp, Homo sapiens
accgtttttatattacttt

SEQ ID NO: 1940679 - DNA, 21 bp, Homo sapiens
accgtttttatattacttttg

SEQ ID NO: 1940680 - DNA, 16 bp, Homo sapiens
acctcaatggaggttt

SEQ ID NO: 1940681 - DNA, 18 bp, Homo sapiens
acctcagttttatcattt

SEQ ID NO: 1940682 - DNA, 12 bp, Homo sapiens
acctcattccaa

SEQ ID NO: 1940683 - DNA, 14 bp, Homo sapiens
acctccccaggccg

SEQ ID NO: 1940684 - DNA, 20 bp, Homo sapiens
acctccccaggccgtggctg

SEQ ID NO: 1940685 - DNA, 14 bp, Homo sapiens
acctcgctggactc

SEQ ID NO: 1940686 - DNA, 21 bp, Homo sapiens
acctctggccaaatatgcact

SEQ ID NO: 1940687 - DNA, 23 bp, Homo sapiens
acctctggccaaatatgcacttt

SEQ ID NO: 1940688 - DNA, 18 bp, Homo sapiens
acctcttcagaggccctc

SEQ ID NO: 1940689 - DNA, 11 bp, Homo sapiens
acctgaaaaca

SEQ ID NO: 1940690 - DNA, 18 bp, Homo sapiens
acctgaattcgagacagg

SEQ ID NO: 1940691 - DNA, 15 bp, Homo sapiens
acctgacaacttctg

SEQ ID NO: 1940692 - DNA, 16 bp, Homo sapiens
acctgacaacttctga

SEQ ID NO: 1940693 - DNA, 18 bp, Homo sapiens
acctgacaacttctgaat

SEQ ID NO: 1940694 - DNA, 15 bp, Homo sapiens
acctgccaggctgca

SEQ ID NO: 1940695 - DNA, 19 bp, Homo sapiens
acctgcccccactcagcat

SEQ ID NO: 1940696 - DNA, 21 bp, Homo sapiens
acctgcctgacatttggagtg

SEQ ID NO: 1940697 - DNA, 21 bp, Homo sapiens
acctgggtgctctggctggag

SEQ ID NO: 1940698 - DNA, 16 bp, Homo sapiens
acctggtgctgcctct

SEQ ID NO: 1940699 - DNA, 11 bp, Homo sapiens
accttaaaatt

SEQ ID NO: 1940700 - DNA, 22 bp, Homo sapiens
accttagatgttctaagtcttt

SEQ ID NO: 1940701 - DNA, 15 bp, Homo sapiens
accttctgtggctca

SEQ ID NO: 1940702 - DNA, 13 bp, Homo sapiens
accttcttccaca

SEQ ID NO: 1940703 - DNA, 17 bp, Homo sapiens
accttgttgatgccagc

SEQ ID NO: 1940704 - DNA, 20 bp, Homo sapiens
accttgttgatgccagctgt

SEQ ID NO: 1940705 - DNA, 24 bp, Homo sapiens
acctttatgttttaatatcctagg

SEQ ID NO: 1940706 - DNA, 21 bp, Homo sapiens
acctttgcgtggatcaagctt

SEQ ID NO: 1940707 - DNA, 12 bp, Homo sapiens
acgaaatgttat

SEQ ID NO: 1940708 - DNA, 23 bp, Homo sapiens
acgaaatgttattttttaattat

SEQ ID NO: 1940709 - DNA, 22 bp, Homo sapiens
acgaatacttttgccctttgat

SEQ ID NO: 1940710 - DNA, 21 bp, Homo sapiens
acgactcttttccaaacacag

SEQ ID NO: 1940711 - DNA, 22 bp, Homo sapiens
acgatgtcaaccttgtgtgagt

SEQ ID NO: 1940712 - DNA, 20 bp, Homo sapiens
acgcacgtgggtcttcaggg

SEQ ID NO: 1940713 - DNA, 12 bp, Homo sapiens
acgcagccctgc

SEQ ID NO: 1940714 - DNA, 21 bp, Homo sapiens
acgcctgaggaacccttacag

SEQ ID NO: 1940715 - DNA, 21 bp, Homo sapiens
acgcgcgcgcgcgcacacaca

SEQ ID NO: 1940716 - DNA, 21 bp, Homo sapiens
acggaagtggcctgagaagag

SEQ ID NO: 1940717 - DNA, 18 bp, Homo sapiens
acggagccactcctctga

SEQ ID NO: 1940718 - DNA, 23 bp, Homo sapiens
acggcagtaaatccacagtgagt

SEQ ID NO: 1940719 - DNA, 12 bp, Homo sapiens
acggccactgca

SEQ ID NO: 1940720 - DNA, 21 bp, Homo sapiens
acggccactgcagtcacccct

SEQ ID NO: 1940721 - DNA, 20 bp, Homo sapiens
acgggggaggccgaggcagg

SEQ ID NO: 1940722 - DNA, 21 bp, Homo sapiens
acgggggaggccgaggcaggg

SEQ ID NO: 1940723 - DNA, 15 bp, Homo sapiens
aggcatctgctgtaa

SEQ ID NO: 1940724 - DNA, 18 bp, Homo sapiens
aggcatctgctgtaataa

SEQ ID NO: 1940725 - DNA, 20 bp, Homo sapiens
aggcatgcgaatgagctggg

SEQ ID NO: 1940726 - DNA, 16 bp, Homo sapiens
aggcatggcccagcct

SEQ ID NO: 1940727 - DNA, 14 bp, Homo sapiens
aggcattgccaagg

SEQ ID NO: 1940728 - DNA, 20 bp, Homo sapiens
aggcattgccaagggctttg

SEQ ID NO: 1940729 - DNA, 12 bp, Homo sapiens
aggccaccccca

SEQ ID NO: 1940730 - DNA, 20 bp, Homo sapiens
aggccacctccaaggactct

SEQ ID NO: 1940731 - DNA, 22 bp, Homo sapiens
aggccacgggggaggccgaggc

SEQ ID NO: 1940732 - DNA, 13 bp, Homo sapiens
aggccatctgtaa

SEQ ID NO: 1940733 - DNA, 17 bp, Homo sapiens
aggccatctgtaaatat

SEQ ID NO: 1940734 - DNA, 23 bp, Homo sapiens
aggccatctgtaaatatcccaga

SEQ ID NO: 1940735 - DNA, 14 bp, Homo sapiens
aggccgaggcaggg

SEQ ID NO: 1940736 - DNA, 15 bp, Homo sapiens
aggcctgcccccctt

SEQ ID NO: 1940737 - DNA, 12 bp, Homo sapiens
aggcctggtctg

SEQ ID NO: 1940738 - DNA, 14 bp, Homo sapiens
aggcctggtctgga

SEQ ID NO: 1940739 - DNA, 16 bp, Homo sapiens
aggcctggtctggagc

SEQ ID NO: 1940740 - DNA, 22 bp, Homo sapiens
aggcctggtctggagcccctat

SEQ ID NO: 1940741 - DNA, 23 bp, Homo sapiens
aggcctggtctggagcccctatc

SEQ ID NO: 1940742 - DNA, 17 bp, Homo sapiens
aggcggtcactgcccac

SEQ ID NO: 1940743 - DNA, 14 bp, Homo sapiens
aggcgtgaggatgg

SEQ ID NO: 1940744 - DNA, 18 bp, Homo sapiens
aggcgtgggatccagaga

SEQ ID NO: 1940745 - DNA, 22 bp, Homo sapiens
aggcgtgggatccagagagaag

SEQ ID NO: 1940746 - DNA, 23 bp, Homo sapiens
aggcgtgggatccagagagaagc

SEQ ID NO: 1940747 - DNA, 16 bp, Homo sapiens
aggctaaaacaaatct

SEQ ID NO: 1940748 - DNA, 22 bp, Homo sapiens
aggctaatcaatacccttggca

SEQ ID NO: 1940749 - DNA, 15 bp, Homo sapiens
aggctagatcatgaa

SEQ ID NO: 1940750 - DNA, 13 bp, Homo sapiens
aggctccagaggg

SEQ ID NO: 1940751 - DNA, 15 bp, Homo sapiens
aggctccagagggca

SEQ ID NO: 1940752 - DNA, 13 bp, Homo sapiens
aggctcttctcct

SEQ ID NO: 1940753 - DNA, 12 bp, Homo sapiens
aggctgcccagc

SEQ ID NO: 1940754 - DNA, 18 bp, Homo sapiens
aggctgcccagcggctct

SEQ ID NO: 1940755 - DNA, 21 bp, Homo sapiens
aggctgcccagcggctcttcc

SEQ ID NO: 1940756 - DNA, 20 bp, Homo sapiens
aggctgccgctgctctccca

SEQ ID NO: 1940757 - DNA, 18 bp, Homo sapiens
aggctgttttaacggcct

SEQ ID NO: 1940758 - DNA, 13 bp, Homo sapiens
agggaagggcctg

SEQ ID NO: 1940759 - DNA, 21 bp, Homo sapiens
agggaattttcattggatgca

SEQ ID NO: 1940760 - DNA, 21 bp, Homo sapiens
agggacagcgggtaaaaagag

SEQ ID NO: 1940761 - DNA, 23 bp, Homo sapiens
agggacagttgggtgtgagaata

SEQ ID NO: 1940762 - DNA, 19 bp, Homo sapiens
agggaccagcccagcctgc

SEQ ID NO: 1940763 - DNA, 13 bp, Homo sapiens
agggacgcctggg

SEQ ID NO: 1940764 - DNA, 18 bp, Homo sapiens
agggagacaatctaaaaa

SEQ ID NO: 1940765 - DNA, 17 bp, Homo sapiens
agggatagcactgagca

SEQ ID NO: 1940766 - DNA, 22 bp, Homo sapiens
agggatccctcatctgtccctc

SEQ ID NO: 1940767 - DNA, 20 bp, Homo sapiens
agggatggggagcagctggg

SEQ ID NO: 1940768 - DNA, 21 bp, Homo sapiens
agggcaaaccaggctgcaggt

SEQ ID NO: 1940769 - DNA, 14 bp, Homo sapiens
agggcactggtggc

SEQ ID NO: 1940770 - DNA, 16 bp, Homo sapiens
agggcactggtggccc

SEQ ID NO: 1940771 - DNA, 12 bp, Homo sapiens
agggcagagtga

SEQ ID NO: 1940772 - DNA, 14 bp, Homo sapiens
agggcagcagggct

SEQ ID NO: 1940773 - DNA, 14 bp, Homo sapiens
agggcagcccctcc

SEQ ID NO: 1940774 - DNA, 17 bp, Homo sapiens
agggcagcccctcccca

SEQ ID NO: 1940775 - DNA, 18 bp, Homo sapiens
agggcagcctgtgggaga

SEQ ID NO: 1940776 - DNA, 22 bp, Homo sapiens
agggcagggttctagaaggggc

SEQ ID NO: 1940777 - DNA, 17 bp, Homo sapiens
agggcatggccaggtgg

SEQ ID NO: 1940778 - DNA, 21 bp, Homo sapiens
agggccaagcccagcactgct

SEQ ID NO: 1940779 - DNA, 18 bp, Homo sapiens
agggcccccggctcggcc

SEQ ID NO: 1940780 - DNA, 12 bp, Homo sapiens
agggcctggcct

SEQ ID NO: 1940781 - DNA, 14 bp, Homo sapiens
agggcctggcctgg

SEQ ID NO: 1940782 - DNA, 13 bp, Homo sapiens
agggcgcctgggt

SEQ ID NO: 1940783 - DNA, 21 bp, Homo sapiens
agggcgcctgggtcctcccag

SEQ ID NO: 1940784 - DNA, 22 bp, Homo sapiens
agggcgcctgggtcctcccagc

SEQ ID NO: 1940785 - DNA, 23 bp, Homo sapiens
agggcgcctgggtcctcccagct

SEQ ID NO: 1940786 - DNA, 17 bp, Homo sapiens
agggctaccctgagctg

SEQ ID NO: 1940787 - DNA, 23 bp, Homo sapiens
agggctaccctgagctgaggcag

SEQ ID NO: 1940788 - DNA, 17 bp, Homo sapiens
agggctccagggccagg

SEQ ID NO: 1940789 - DNA, 21 bp, Homo sapiens
agggctgggcactcctcccct

SEQ ID NO: 1940790 - DNA, 19 bp, Homo sapiens
agggctgggcgcctctgtc

SEQ ID NO: 1940791 - DNA, 20 bp, Homo sapiens
agggctgggcgcctctgtcc

SEQ ID NO: 1940792 - DNA, 21 bp, Homo sapiens
aggggatctaaaaggaggaca

SEQ ID NO: 1940793 - DNA, 22 bp, Homo sapiens
aggggatctaaaaggaggacag

SEQ ID NO: 1940794 - DNA, 24 bp, Homo sapiens
aggggatctaaaaggaggacaggg

SEQ ID NO: 1940795 - DNA, 15 bp, Homo sapiens
aggggccagaggctc

SEQ ID NO: 1940796 - DNA, 15 bp, Homo sapiens
aggggcctggcagcc

SEQ ID NO: 1940797 - DNA, 18 bp, Homo sapiens
aggggcctggcagccgtg

SEQ ID NO: 1940798 - DNA, 14 bp, Homo sapiens
aggggcctggcctg

SEQ ID NO: 1940799 - DNA, 17 bp, Homo sapiens
aggggcctggcctgggt

SEQ ID NO: 1940800 - DNA, 13 bp, Homo sapiens
aggggctgggcag

SEQ ID NO: 1940801 - DNA, 14 bp, Homo sapiens
aggggctgggcaga

SEQ ID NO: 1940802 - DNA, 16 bp, Homo sapiens
aggggctgggcagagg

SEQ ID NO: 1940803 - DNA, 16 bp, Homo sapiens
aggggcttccctctgc

SEQ ID NO: 1940804 - DNA, 17 bp, Homo sapiens
aggggcttccctctgct

SEQ ID NO: 1940805 - DNA, 19 bp, Homo sapiens
agggggccacctccccagg

SEQ ID NO: 1940806 - DNA, 15 bp, Homo sapiens
agggggccaggtgca

SEQ ID NO: 1940807 - DNA, 12 bp, Homo sapiens
aggggggttggg

SEQ ID NO: 1940808 - DNA, 13 bp, Homo sapiens
aggggtcagcagg

SEQ ID NO: 1940809 - DNA, 17 bp, Homo sapiens
aggggtgggggagaatg

SEQ ID NO: 1940810 - DNA, 19 bp, Homo sapiens
agggtcagacgcctgagga

SEQ ID NO: 1940811 - DNA, 13 bp, Homo sapiens
agggtcaggaagg

SEQ ID NO: 1940812 - DNA, 22 bp, Homo sapiens
agggtgaggcgtgggatccaga

SEQ ID NO: 1940813 - DNA, 15 bp, Homo sapiens
agggtggggcttaga

SEQ ID NO: 1940814 - DNA, 16 bp, Homo sapiens
agggtgtgagggatgg

SEQ ID NO: 1940815 - DNA, 13 bp, Homo sapiens
agggtgtggcttg

SEQ ID NO: 1940816 - DNA, 21 bp, Homo sapiens
agggttaaagaaaggcagaga

SEQ ID NO: 1940817 - DNA, 13 bp, Homo sapiens
agggttccagaca

SEQ ID NO: 1940818 - DNA, 22 bp, Homo sapiens
agggttctagaaggggcgaggc

SEQ ID NO: 1940819 - DNA, 16 bp, Homo sapiens
agggttgaccccagag

SEQ ID NO: 1940820 - DNA, 17 bp, Homo sapiens
agggttgaccccagagg

SEQ ID NO: 1940821 - DNA, 19 bp, Homo sapiens
aggtcaagaagaagatgga

SEQ ID NO: 1940822 - DNA, 23 bp, Homo sapiens
aggtcaagttcatagtttctgta

SEQ ID NO: 1940823 - DNA, 14 bp, Homo sapiens
aggtcagagcccag

SEQ ID NO: 1940824 - DNA, 19 bp, Homo sapiens
aggtcccgagccccctgtc

SEQ ID NO: 1940825 - DNA, 21 bp, Homo sapiens
aggtcccgagccccctgtcct

SEQ ID NO: 1940826 - DNA, 21 bp, Homo sapiens
aggtcctttccttctcgtctt

SEQ ID NO: 1940827 - DNA, 23 bp, Homo sapiens
aggtctccacccctcaagccagg

SEQ ID NO: 1940828 - DNA, 22 bp, Homo sapiens
aggtctttgaaatatgcatgta

SEQ ID NO: 1940829 - DNA, 20 bp, Homo sapiens
aggtgaacgctcagcgctgg

SEQ ID NO: 1940830 - DNA, 17 bp, Homo sapiens
aggtgcacctgccccag

SEQ ID NO: 1940831 - DNA, 18 bp, Homo sapiens
aggtggggagactgggct

SEQ ID NO: 1940832 - DNA, 16 bp, Homo sapiens
aggtgggggtctggcc

SEQ ID NO: 1940833 - DNA, 13 bp, Homo sapiens
aggtgggtcttgg

SEQ ID NO: 1940834 - DNA, 18 bp, Homo sapiens
aggtggtcttggagagga

SEQ ID NO: 1940835 - DNA, 20 bp, Homo sapiens
aggtggtcttggagaggagg

SEQ ID NO: 1940836 - DNA, 22 bp, Homo sapiens
aggtggtcttggagaggaggtg

SEQ ID NO: 1940837 - DNA, 16 bp, Homo sapiens
aggtgtggagtggagg

SEQ ID NO: 1940838 - DNA, 14 bp, Homo sapiens
aggtgtttctctgt

SEQ ID NO: 1940839 - DNA, 13 bp, Homo sapiens
aggttaaggggat

SEQ ID NO: 1940840 - DNA, 18 bp, Homo sapiens
aggttccgcttggagcag

SEQ ID NO: 1940841 - DNA, 19 bp, Homo sapiens
aggttggaactgctgccat

SEQ ID NO: 1940842 - DNA, 12 bp, Homo sapiens
agtaaaatcaca

SEQ ID NO: 1940843 - DNA, 22 bp, Homo sapiens
agtaaaattattccctgaattg

SEQ ID NO: 1940844 - DNA, 11 bp, Homo sapiens
agtaaacacca

SEQ ID NO: 1940845 - DNA, 15 bp, Homo sapiens
agtaactaagcacat

SEQ ID NO: 1940846 - DNA, 18 bp, Homo sapiens
agtaaggcagctctgtcg

SEQ ID NO: 1940847 - DNA, 22 bp, Homo sapiens
agtaattggtccgatctttgac

SEQ ID NO: 1940848 - DNA, 16 bp, Homo sapiens
agtaccaatcatttta

SEQ ID NO: 1940849 - DNA, 18 bp, Homo sapiens
agtagcaccctggattga

SEQ ID NO: 1940850 - DNA, 23 bp, Homo sapiens
agtaggttgaggacaggagaggg

SEQ ID NO: 1940851 - DNA, 12 bp, Homo sapiens
agtagtcatttc

SEQ ID NO: 1940852 - DNA, 14 bp, Homo sapiens
agtagtcatttcat

SEQ ID NO: 1940853 - DNA, 17 bp, Homo sapiens
agtatctgtacctgccc

SEQ ID NO: 1940854 - DNA, 16 bp, Homo sapiens
agtatgaataaagaca

SEQ ID NO: 1940855 - DNA, 18 bp, Homo sapiens
attgaaaaaatagagcct

SEQ ID NO: 1940856 - DNA, 20 bp, Homo sapiens
attgaattcttggttgagga

SEQ ID NO: 1940857 - DNA, 13 bp, Homo sapiens
attgacaaactct

SEQ ID NO: 1940858 - DNA, 16 bp, Homo sapiens
attgactggtccccca

SEQ ID NO: 1940859 - DNA, 15 bp, Homo sapiens
attgagttttcagtg

SEQ ID NO: 1940860 - DNA, 19 bp, Homo sapiens
attgatcggagcctcctct

SEQ ID NO: 1940861 - DNA, 14 bp, Homo sapiens
attgcagaagaaac

SEQ ID NO: 1940862 - DNA, 18 bp, Homo sapiens
attgccacctctggccaa

SEQ ID NO: 1940863 - DNA, 20 bp, Homo sapiens
attgccacctctggccaaat

SEQ ID NO: 1940864 - DNA, 22 bp, Homo sapiens
attgcctttggcaattcttctt

SEQ ID NO: 1940865 - DNA, 23 bp, Homo sapiens
attgcttgaaagaaaatatgcat

SEQ ID NO: 1940866 - DNA, 14 bp, Homo sapiens
attggcttgcactt

SEQ ID NO: 1940867 - DNA, 13 bp, Homo sapiens
attgggagtagga

SEQ ID NO: 1940868 - DNA, 18 bp, Homo sapiens
attggtaaagaatggaag

SEQ ID NO: 1940869 - DNA, 15 bp, Homo sapiens
attgtaaactttttc

SEQ ID NO: 1940870 - DNA, 15 bp, Homo sapiens
attgtaactgttctt

SEQ ID NO: 1940871 - DNA, 17 bp, Homo sapiens
attgtcaaaaaccagaa

SEQ ID NO: 1940872 - DNA, 13 bp, Homo sapiens
attgtgtttgtgt

SEQ ID NO: 1940873 - DNA, 17 bp, Homo sapiens
attgtgtttgtgtgctg

SEQ ID NO: 1940874 - DNA, 20 bp, Homo sapiens
attgtgtttgtgtgctgttg

SEQ ID NO: 1940875 - DNA, 11 bp, Homo sapiens
atttaaaatag

SEQ ID NO: 1940876 - DNA, 21 bp, Homo sapiens
atttaaaatagttccagataa

SEQ ID NO: 1940877 - DNA, 19 bp, Homo sapiens
atttaaagaacaccctata

SEQ ID NO: 1940878 - DNA, 21 bp, Homo sapiens
atttaaattttcagaaagcat

SEQ ID NO: 1940879 - DNA, 15 bp, Homo sapiens
atttaactatttaga

SEQ ID NO: 1940880 - DNA, 20 bp, Homo sapiens
atttaatagataaagtgcct

SEQ ID NO: 1940881 - DNA, 15 bp, Homo sapiens
atttaggatttgtgt

SEQ ID NO: 1940882 - DNA, 21 bp, Homo sapiens
atttaggatttgtgttttaca

SEQ ID NO: 1940883 - DNA, 20 bp, Homo sapiens
atttataaactaattttgta

SEQ ID NO: 1940884 - DNA, 22 bp, Homo sapiens
atttataaatatatttaagata

SEQ ID NO: 1940885 - DNA, 22 bp, Homo sapiens
atttcatagctatttagagata

SEQ ID NO: 1940886 - DNA, 21 bp, Homo sapiens
atttctagacagtattgccac

SEQ ID NO: 1940887 - DNA, 23 bp, Homo sapiens
atttctagacagtattgccacct

SEQ ID NO: 1940888 - DNA, 16 bp, Homo sapiens
atttctatgtaaatta

SEQ ID NO: 1940889 - DNA, 21 bp, Homo sapiens
atttctatgtaaattattgta

SEQ ID NO: 1940890 - DNA, 18 bp, Homo sapiens
atttctatttctcctcca

SEQ ID NO: 1940891 - DNA, 13 bp, Homo sapiens
atttctcaaagtt

SEQ ID NO: 1940892 - DNA, 22 bp, Homo sapiens
atttctcaaagtttttacagtg

SEQ ID NO: 1940893 - DNA, 23 bp, Homo sapiens
atttctcaaagtttttacagtgt

SEQ ID NO: 1940894 - DNA, 15 bp, Homo sapiens
atttctttatttctg

SEQ ID NO: 1940895 - DNA, 14 bp, Homo sapiens
atttgaagtggaaa

SEQ ID NO: 1940896 - DNA, 14 bp, Homo sapiens
atttgagtgctctg

SEQ ID NO: 1940897 - DNA, 19 bp, Homo sapiens
atttgcaactttagaaaga

SEQ ID NO: 1940898 - DNA, 19 bp, Homo sapiens
atttgtaactttgcatgtt

SEQ ID NO: 1940899 - DNA, 23 bp, Homo sapiens
atttgtgttttacagtatatctt

SEQ ID NO: 1940900 - DNA, 18 bp, Homo sapiens
attttaccattttgcgat

SEQ ID NO: 1940901 - DNA, 14 bp, Homo sapiens
attttagatgttta

SEQ ID NO: 1940902 - DNA, 17 bp, Homo sapiens
attttcagaaagcatct

SEQ ID NO: 1940903 - DNA, 17 bp, Homo sapiens
attttctatatttgtaa

SEQ ID NO: 1940904 - DNA, 18 bp, Homo sapiens
attttgccagtgggaact

SEQ ID NO: 1940905 - DNA, 12 bp, Homo sapiens
attttggccact

SEQ ID NO: 1940906 - DNA, 16 bp, Homo sapiens
attttggggaactgtt

SEQ ID NO: 1940907 - DNA, 22 bp, Homo sapiens
attttggtaaaatacttcttga

SEQ ID NO: 1940908 - DNA, 19 bp, Homo sapiens
attttgtattgtttcaatt

SEQ ID NO: 1940909 - DNA, 15 bp, Homo sapiens
attttgtctggctgt

SEQ ID NO: 1940910 - DNA, 17 bp, Homo sapiens
attttgtctggctgtgg

SEQ ID NO: 1940911 - DNA, 12 bp, Homo sapiens
attttgtgcagt

SEQ ID NO: 1940912 - DNA, 19 bp, Homo sapiens
atttttaggtgtcttttaa

SEQ ID NO: 1940913 - DNA, 19 bp, Homo sapiens
atttttatcccatctcact

SEQ ID NO: 1940914 - DNA, 21 bp, Homo sapiens
atttttggacttagtgcaaca

SEQ ID NO: 1940915 - DNA, 22 bp, Homo sapiens
attttttaaagtcttctttcat

SEQ ID NO: 1940916 - DNA, 15 bp, Homo sapiens
atttttttgttgctg

SEQ ID NO: 1940917 - DNA, 16 bp, Homo sapiens
caaaaacatggccaca

SEQ ID NO: 1940918 - DNA, 20 bp, Homo sapiens
caaaacgggttactaagatg

SEQ ID NO: 1940919 - DNA, 12 bp, Homo sapiens
caaaatgcagga

SEQ ID NO: 1940920 - DNA, 15 bp, Homo sapiens
caaaattatttcaga

SEQ ID NO: 1940921 - DNA, 17 bp, Homo sapiens
caaaattatttcagaaa

SEQ ID NO: 1940922 - DNA, 13 bp, Homo sapiens
caaaccaggctgc

SEQ ID NO: 1940923 - DNA, 16 bp, Homo sapiens
caaaccaggctgcagg

SEQ ID NO: 1940924 - DNA, 13 bp, Homo sapiens
caaactagattca

SEQ ID NO: 1940925 - DNA, 13 bp, Homo sapiens
caaactagggcca

SEQ ID NO: 1940926 - DNA, 17 bp, Homo sapiens
caaactggggcctccct

SEQ ID NO: 1940927 - DNA, 18 bp, Homo sapiens
caaagaaatagcaagaga

SEQ ID NO: 1940928 - DNA, 15 bp, Homo sapiens
caaagcaaggaaact

SEQ ID NO: 1940929 - DNA, 20 bp, Homo sapiens
caaagccagcgtcctcctct

SEQ ID NO: 1940930 - DNA, 22 bp, Homo sapiens
caaagcccctacaactccagcc

SEQ ID NO: 1940931 - DNA, 14 bp, Homo sapiens
caaagggagagaga

SEQ ID NO: 1940932 - DNA, 16 bp, Homo sapiens
caaagtttttacagtg

SEQ ID NO: 1940933 - DNA, 17 bp, Homo sapiens
caaagtttttacagtgt

SEQ ID NO: 1940934 - DNA, 19 bp, Homo sapiens
caaagtttttacagtgtat

SEQ ID NO: 1940935 - DNA, 22 bp, Homo sapiens
caaataccagagcacagattca

SEQ ID NO: 1940936 - DNA, 16 bp, Homo sapiens
caaatatatttaacta

SEQ ID NO: 1940937 - DNA, 21 bp, Homo sapiens
caaatatatttaactatttag

SEQ ID NO: 1940938 - DNA, 22 bp, Homo sapiens
caaatatatttaactatttaga

SEQ ID NO: 1940939 - DNA, 14 bp, Homo sapiens
caaatatgcacttt

SEQ ID NO: 1940940 - DNA, 15 bp, Homo sapiens
caaatatgcactttc

SEQ ID NO: 1940941 - DNA, 22 bp, Homo sapiens
caaatgagatgtatgcccaaag

SEQ ID NO: 1940942 - DNA, 20 bp, Homo sapiens
caaattgatgggtgggctag

SEQ ID NO: 1940943 - DNA, 17 bp, Homo sapiens
caaattgcttgaaagaa

SEQ ID NO: 1940944 - DNA, 21 bp, Homo sapiens
caaattggagcttcatggcag

SEQ ID NO: 1940945 - DNA, 19 bp, Homo sapiens
caaatttcatctttccaaa

SEQ ID NO: 1940946 - DNA, 19 bp, Homo sapiens
caacaatttctactttgaa

SEQ ID NO: 1940947 - DNA, 20 bp, Homo sapiens
caacacaatcaaaagattaa

SEQ ID NO: 1940948 - DNA, 16 bp, Homo sapiens
caacagggcttctctt

SEQ ID NO: 1940949 - DNA, 22 bp, Homo sapiens
caacaggttgaggctaaaacaa

SEQ ID NO: 1940950 - DNA, 22 bp, Homo sapiens
caacagttttttatgctaatca

SEQ ID NO: 1940951 - DNA, 18 bp, Homo sapiens
caaccactatcttttgtt

SEQ ID NO: 1940952 - DNA, 12 bp, Homo sapiens
caacgcagccct

SEQ ID NO: 1940953 - DNA, 18 bp, Homo sapiens
caacgcagccctgctttg

SEQ ID NO: 1940954 - DNA, 14 bp, Homo sapiens
caacgggtctgtgg

SEQ ID NO: 1940955 - DNA, 15 bp, Homo sapiens
caacgggtctgtggg

SEQ ID NO: 1940956 - DNA, 12 bp, Homo sapiens
caacgtggggca

SEQ ID NO: 1940957 - DNA, 20 bp, Homo sapiens
caactacagccaaattgcag

SEQ ID NO: 1940958 - DNA, 13 bp, Homo sapiens
caactccagccac

SEQ ID NO: 1940959 - DNA, 13 bp, Homo sapiens
caactctttgaga

SEQ ID NO: 1940960 - DNA, 12 bp, Homo sapiens
caacttgggaac

SEQ ID NO: 1940961 - DNA, 16 bp, Homo sapiens
caacttgtaaatgtgg

SEQ ID NO: 1940962 - DNA, 20 bp, Homo sapiens
caagaagtgggagtgggaga

SEQ ID NO: 1940963 - DNA, 17 bp, Homo sapiens
caagacagcagagccat

SEQ ID NO: 1940964 - DNA, 22 bp, Homo sapiens
caagacagcagagccatctgcg

SEQ ID NO: 1940965 - DNA, 18 bp, Homo sapiens
caagagactactctgcct

SEQ ID NO: 1940966 - DNA, 14 bp, Homo sapiens
caagagctcaggag

SEQ ID NO: 1940967 - DNA, 18 bp, Homo sapiens
caagagctcaggagaagg

SEQ ID NO: 1940968 - DNA, 19 bp, Homo sapiens
caagagggacgcctggggg

SEQ ID NO: 1940969 - DNA, 18 bp, Homo sapiens
caagagggcactggtggc

SEQ ID NO: 1940970 - DNA, 20 bp, Homo sapiens
caagattcccggctggactt

SEQ ID NO: 1940971 - DNA, 17 bp, Homo sapiens
caagcaggaaatgaaaa

SEQ ID NO: 1940972 - DNA, 12 bp, Homo sapiens
caagccacagaa

SEQ ID NO: 1940973 - DNA, 14 bp, Homo sapiens
caagccaggagacc

SEQ ID NO: 1940974 - DNA, 19 bp, Homo sapiens
caagccaggagaccctgtc

SEQ ID NO: 1940975 - DNA, 16 bp, Homo sapiens
caagccagggttccag

SEQ ID NO: 1940976 - DNA, 15 bp, Homo sapiens
caagccgtggcttcc

SEQ ID NO: 1940977 - DNA, 17 bp, Homo sapiens
caagccgtggcttcccg

SEQ ID NO: 1940978 - DNA, 19 bp, Homo sapiens
caagcctgggccactggca

SEQ ID NO: 1940979 - DNA, 14 bp, Homo sapiens
caagctggcaggag

SEQ ID NO: 1940980 - DNA, 18 bp, Homo sapiens
caagctggcaggagggtg

SEQ ID NO: 1940981 - DNA, 15 bp, Homo sapiens
caaggcaagaagtgg

SEQ ID NO: 1940982 - DNA, 15 bp, Homo sapiens
caaggcctatgccac

SEQ ID NO: 1940983 - DNA, 18 bp, Homo sapiens
caaggcctatgccacctg

SEQ ID NO: 1940984 - DNA, 22 bp, Homo sapiens
caaggcctatgccacctgcagc

SEQ ID NO: 1940985 - DNA, 20 bp, Homo sapiens
caagggctttgttttgcaca

SEQ ID NO: 1940986 - DNA, 19 bp, Homo sapiens
caaggtggtcttggagagg

SEQ ID NO: 1940987 - DNA, 14 bp, Homo sapiens
catgcagcatctaa

SEQ ID NO: 1940988 - DNA, 14 bp, Homo sapiens
catgcatcaagtta

SEQ ID NO: 1940989 - DNA, 18 bp, Homo sapiens
catgcgggctgggcagct

SEQ ID NO: 1940990 - DNA, 19 bp, Homo sapiens
catgcgggctgggcagctg

SEQ ID NO: 1940991 - DNA, 20 bp, Homo sapiens
catgcgggctgggcagctgt

SEQ ID NO: 1940992 - DNA, 21 bp, Homo sapiens
catgcgggctgggcagctgtt

SEQ ID NO: 1940993 - DNA, 13 bp, Homo sapiens
catggaggcacac

SEQ ID NO: 1940994 - DNA, 16 bp, Homo sapiens
catggaggcacacagc

SEQ ID NO: 1940995 - DNA, 13 bp, Homo sapiens
catggcagaaggc

SEQ ID NO: 1940996 - DNA, 13 bp, Homo sapiens
catggccacatcc

SEQ ID NO: 1940997 - DNA, 13 bp, Homo sapiens
catggccaggagt

SEQ ID NO: 1940998 - DNA, 13 bp, Homo sapiens
catggccaggtgg

SEQ ID NO: 1940999 - DNA, 14 bp, Homo sapiens
catggccaggtggc

SEQ ID NO: 1941000 - DNA, 13 bp, Homo sapiens
catggcccagcct

SEQ ID NO: 1941001 - DNA, 17 bp, Homo sapiens
catggcccagcctggag

SEQ ID NO: 1941002 - DNA, 18 bp, Homo sapiens
catggcccagcctggagc

SEQ ID NO: 1941003 - DNA, 21 bp, Homo sapiens
catggccgcaacttcccaggc

SEQ ID NO: 1941004 - DNA, 14 bp, Homo sapiens
catggccgctgccc

SEQ ID NO: 1941005 - DNA, 16 bp, Homo sapiens
catggccgctgcccac

SEQ ID NO: 1941006 - DNA, 21 bp, Homo sapiens
catggccgctgcccacgtccc

SEQ ID NO: 1941007 - DNA, 21 bp, Homo sapiens
catggccgtgtagaccctaac

SEQ ID NO: 1941008 - DNA, 17 bp, Homo sapiens
catgggcagagcccaag

SEQ ID NO: 1941009 - DNA, 16 bp, Homo sapiens
catggtcagccctagg

SEQ ID NO: 1941010 - DNA, 16 bp, Homo sapiens
catgtaaactgtgcac

SEQ ID NO: 1941011 - DNA, 23 bp, Homo sapiens
catgtaagtagcaaacagggctt

SEQ ID NO: 1941012 - DNA, 15 bp, Homo sapiens
catgtacatgaagaa

SEQ ID NO: 1941013 - DNA, 17 bp, Homo sapiens
catgtagaagagggaga

SEQ ID NO: 1941014 - DNA, 18 bp, Homo sapiens
catgtagaagagggagaa

SEQ ID NO: 1941015 - DNA, 19 bp, Homo sapiens
catgtagaagagggagaag

SEQ ID NO: 1941016 - DNA, 14 bp, Homo sapiens
catgtcaaacgtga

SEQ ID NO: 1941017 - DNA, 19 bp, Homo sapiens
catgtcaaacgtgaaaatg

SEQ ID NO: 1941018 - DNA, 12 bp, Homo sapiens
catgtggccaag

SEQ ID NO: 1941019 - DNA, 12 bp, Homo sapiens
catgtgggagct

SEQ ID NO: 1941020 - DNA, 12 bp, Homo sapiens
catgtgtgtcca

SEQ ID NO: 1941021 - DNA, 16 bp, Homo sapiens
catgtgttaagtattt

SEQ ID NO: 1941022 - DNA, 20 bp, Homo sapiens
catgttcttgttttgttata

SEQ ID NO: 1941023 - DNA, 18 bp, Homo sapiens
cattaattcaattaaaac

SEQ ID NO: 1941024 - DNA, 19 bp, Homo sapiens
cattattaaatcagaatct

SEQ ID NO: 1941025 - DNA, 13 bp, Homo sapiens
cattattatcaac

SEQ ID NO: 1941026 - DNA, 20 bp, Homo sapiens
cattcaaaaacatggccaca

SEQ ID NO: 1941027 - DNA, 22 bp, Homo sapiens
cattcaataagcatcaaactct

SEQ ID NO: 1941028 - DNA, 14 bp, Homo sapiens
cattctctgtctca

SEQ ID NO: 1941029 - DNA, 16 bp, Homo sapiens
cattctgaaggagccc

SEQ ID NO: 1941030 - DNA, 18 bp, Homo sapiens
cattctggggtggggctt

SEQ ID NO: 1941031 - DNA, 15 bp, Homo sapiens
cattcttctctccca

SEQ ID NO: 1941032 - DNA, 22 bp, Homo sapiens
cattgaagggggatgcaggcaa

SEQ ID NO: 1941033 - DNA, 23 bp, Homo sapiens
cattgaattcttggttgaggaaa

SEQ ID NO: 1941034 - DNA, 18 bp, Homo sapiens
cattgcaaaaatatttta

SEQ ID NO: 1941035 - DNA, 15 bp, Homo sapiens
cattgccaagggctt

SEQ ID NO: 1941036 - DNA, 21 bp, Homo sapiens
cattgcctgatttgttccttc

SEQ ID NO: 1941037 - DNA, 12 bp, Homo sapiens
cattggatgcag

SEQ ID NO: 1941038 - DNA, 21 bp, Homo sapiens
cattgtataggccatctgtaa

SEQ ID NO: 1941039 - DNA, 20 bp, Homo sapiens
catttaaatacagtcttcca

SEQ ID NO: 1941040 - DNA, 19 bp, Homo sapiens
catttctatttctcctcca

SEQ ID NO: 1941041 - DNA, 15 bp, Homo sapiens
catttctctaagaga

SEQ ID NO: 1941042 - DNA, 14 bp, Homo sapiens
catttcttcccaag

SEQ ID NO: 1941043 - DNA, 17 bp, Homo sapiens
catttctttatttctgt

SEQ ID NO: 1941044 - DNA, 17 bp, Homo sapiens
cattttgcgatgtgttt

SEQ ID NO: 1941045 - DNA, 16 bp, Homo sapiens
cattttgtctggctgt

SEQ ID NO: 1941046 - DNA, 15 bp, Homo sapiens
cattttttttcaagt

SEQ ID NO: 1941047 - DNA, 15 bp, Homo sapiens
ccaaacaagcgccac

SEQ ID NO: 1941048 - DNA, 16 bp, Homo sapiens
ccaaataaactcctta

SEQ ID NO: 1941049 - DNA, 14 bp, Homo sapiens
ccaaattgcagaag

SEQ ID NO: 1941050 - DNA, 15 bp, Homo sapiens
ccaacatttcctcag

SEQ ID NO: 1941051 - DNA, 21 bp, Homo sapiens
ccaaccacctctggccctgtt

SEQ ID NO: 1941052 - DNA, 23 bp, Homo sapiens
ccaaccttagatgttctaagtct

SEQ ID NO: 1941053 - DNA, 21 bp, Homo sapiens
ccaacgggtctgtgggactgg

SEQ ID NO: 1941054 - DNA, 19 bp, Homo sapiens
ccaagccagggttccagac

SEQ ID NO: 1941055 - DNA, 14 bp, Homo sapiens
ccaagccgtggctt

SEQ ID NO: 1941056 - DNA, 15 bp, Homo sapiens
ccaagccgtggcttc

SEQ ID NO: 1941057 - DNA, 16 bp, Homo sapiens
ccaagccgtggcttcc

SEQ ID NO: 1941058 - DNA, 23 bp, Homo sapiens
ccaagccgtggcttcccgctcag

SEQ ID NO: 1941059 - DNA, 19 bp, Homo sapiens
ccaagcctgggccactggc

SEQ ID NO: 1941060 - DNA, 23 bp, Homo sapiens
ccaagcctgggccactggcatct

SEQ ID NO: 1941061 - DNA, 17 bp, Homo sapiens
ccaaggcctatgccacc

SEQ ID NO: 1941062 - DNA, 20 bp, Homo sapiens
ccaaggcctatgccacctgc

SEQ ID NO: 1941063 - DNA, 23 bp, Homo sapiens
ccaaggcctatgccacctgcagc

SEQ ID NO: 1941064 - DNA, 21 bp, Homo sapiens
ccaagggctttgttttgcaca

SEQ ID NO: 1941065 - DNA, 13 bp, Homo sapiens
ccaatcacattca

SEQ ID NO: 1941066 - DNA, 19 bp, Homo sapiens
ccaatcacattcaggcatg

SEQ ID NO: 1941067 - DNA, 14 bp, Homo sapiens
ccaatcattttaat

SEQ ID NO: 1941068 - DNA, 22 bp, Homo sapiens
ccaatcattttaattattattc

SEQ ID NO: 1941069 - DNA, 21 bp, Homo sapiens
ccaatccctgtgtgtcgttcc

SEQ ID NO: 1941070 - DNA, 13 bp, Homo sapiens
ccaatcctatgtt

SEQ ID NO: 1941071 - DNA, 21 bp, Homo sapiens
ccaatggagactgtctcaaga

SEQ ID NO: 1941072 - DNA, 14 bp, Homo sapiens
ccaatgtgcccagt

SEQ ID NO: 1941073 - DNA, 16 bp, Homo sapiens
ccacacttcaggctct

SEQ ID NO: 1941074 - DNA, 22 bp, Homo sapiens
ccacacttcaggctcttctcct

SEQ ID NO: 1941075 - DNA, 19 bp, Homo sapiens
ccacagaggccaggcatgg

SEQ ID NO: 1941076 - DNA, 23 bp, Homo sapiens
ccacagagtgccatccctgagag

SEQ ID NO: 1941077 - DNA, 19 bp, Homo sapiens
ccacaggcccttcctctcc

SEQ ID NO: 1941078 - DNA, 22 bp, Homo sapiens
ccacaggcccttcctctccact

SEQ ID NO: 1941079 - DNA, 19 bp, Homo sapiens
ccacatagtgatggttccc

SEQ ID NO: 1941080 - DNA, 22 bp, Homo sapiens
ccacatccaacatttcctcagg

SEQ ID NO: 1941081 - DNA, 22 bp, Homo sapiens
ccaccacacacacccttcccca

SEQ ID NO: 1941082 - DNA, 12 bp, Homo sapiens
ccacccagccag

SEQ ID NO: 1941083 - DNA, 14 bp, Homo sapiens
ccacccctcttccc

SEQ ID NO: 1941084 - DNA, 16 bp, Homo sapiens
ccacccctcttccccc

SEQ ID NO: 1941085 - DNA, 21 bp, Homo sapiens
ccacccctgaactggccccag

SEQ ID NO: 1941086 - DNA, 15 bp, Homo sapiens
ccacccgtttccaag

SEQ ID NO: 1941087 - DNA, 18 bp, Homo sapiens
ccacccgtttccaagcct

SEQ ID NO: 1941088 - DNA, 16 bp, Homo sapiens
ccaccctgtctgcagg

SEQ ID NO: 1941089 - DNA, 15 bp, Homo sapiens
ccacctccctgcagc

SEQ ID NO: 1941090 - DNA, 17 bp, Homo sapiens
ccacctccctgcagctt

SEQ ID NO: 1941091 - DNA, 13 bp, Homo sapiens
ccacctgcagcgt

SEQ ID NO: 1941092 - DNA, 15 bp, Homo sapiens
ccacctgccaggctg

SEQ ID NO: 1941093 - DNA, 20 bp, Homo sapiens
ccacctgccaggctgcaggg

SEQ ID NO: 1941094 - DNA, 13 bp, Homo sapiens
ccacctgtacata

SEQ ID NO: 1941095 - DNA, 20 bp, Homo sapiens
ccacctttatgttttaatat

SEQ ID NO: 1941096 - DNA, 16 bp, Homo sapiens
ccacgactgtctccat

SEQ ID NO: 1941097 - DNA, 22 bp, Homo sapiens
ccacgccgggtcgcctgccctg

SEQ ID NO: 1941098 - DNA, 20 bp, Homo sapiens
ccacggagccactcctctga

SEQ ID NO: 1941099 - DNA, 17 bp, Homo sapiens
ccacgggggaggccgag

SEQ ID NO: 1941100 - DNA, 23 bp, Homo sapiens
ccacgggggaggccgaggcaggg

SEQ ID NO: 1941101 - DNA, 17 bp, Homo sapiens
ccacgtgctggagagta

SEQ ID NO: 1941102 - DNA, 15 bp, Homo sapiens
ccacgttcacccctc

SEQ ID NO: 1941103 - DNA, 17 bp, Homo sapiens
ccacgttcacccctcca

SEQ ID NO: 1941104 - DNA, 15 bp, Homo sapiens
ccactaccctccctc

SEQ ID NO: 1941105 - DNA, 17 bp, Homo sapiens
ccactaggtgcccagtc

SEQ ID NO: 1941106 - DNA, 18 bp, Homo sapiens
ccactaggtgcccagtct

SEQ ID NO: 1941107 - DNA, 21 bp, Homo sapiens
ccactaggtgcccagtcttga

SEQ ID NO: 1941108 - DNA, 22 bp, Homo sapiens
ccactccagacccctggctttt

SEQ ID NO: 1941109 - DNA, 12 bp, Homo sapiens
ccactcccctca

SEQ ID NO: 1941110 - DNA, 18 bp, Homo sapiens
ccactcccctcatccact

SEQ ID NO: 1941111 - DNA, 17 bp, Homo sapiens
ccactcctcccaactct

SEQ ID NO: 1941112 - DNA, 18 bp, Homo sapiens
ccactcctcccaactctg

SEQ ID NO: 1941113 - DNA, 15 bp, Homo sapiens
ccactggcatctctg

SEQ ID NO: 1941114 - DNA, 18 bp, Homo sapiens
ccacttccctgcaaggtg

SEQ ID NO: 1941115 - DNA, 15 bp, Homo sapiens
ccactttgcagacct

SEQ ID NO: 1941116 - DNA, 19 bp, Homo sapiens
ccactttgcagacctggga

SEQ ID NO: 1941117 - DNA, 23 bp, Homo sapiens
ccactttgcagacctgggacttt

SEQ ID NO: 1941118 - DNA, 15 bp, Homo sapiens
ccagaatgattttga

SEQ ID NO: 1941119 - DNA, 12 bp, Homo sapiens
cctggcctgggt

SEQ ID NO: 1941120 - DNA, 17 bp, Homo sapiens
cctggctcccacaggcc

SEQ ID NO: 1941121 - DNA, 16 bp, Homo sapiens
cctggcttttcactgc

SEQ ID NO: 1941122 - DNA, 18 bp, Homo sapiens
cctggcttttcactgctg

SEQ ID NO: 1941123 - DNA, 21 bp, Homo sapiens
cctggcttttcactgctggct

SEQ ID NO: 1941124 - DNA, 17 bp, Homo sapiens
cctgggagatgcagctg

SEQ ID NO: 1941125 - DNA, 19 bp, Homo sapiens
cctgggagatgcagctgga

SEQ ID NO: 1941126 - DNA, 14 bp, Homo sapiens
cctgggccactggc

SEQ ID NO: 1941127 - DNA, 16 bp, Homo sapiens
cctgggccactggcat

SEQ ID NO: 1941128 - DNA, 14 bp, Homo sapiens
cctgggccctctct

SEQ ID NO: 1941129 - DNA, 15 bp, Homo sapiens
cctgggccctctctg

SEQ ID NO: 1941130 - DNA, 15 bp, Homo sapiens
cctgggggtgccagg

SEQ ID NO: 1941131 - DNA, 21 bp, Homo sapiens
cctggggtggttggaggcctg

SEQ ID NO: 1941132 - DNA, 16 bp, Homo sapiens
cctgggtcctcccagc

SEQ ID NO: 1941133 - DNA, 20 bp, Homo sapiens
cctggtactcccccagccct

SEQ ID NO: 1941134 - DNA, 18 bp, Homo sapiens
cctggtctggagccccta

SEQ ID NO: 1941135 - DNA, 20 bp, Homo sapiens
cctggtctggagcccctatc

SEQ ID NO: 1941136 - DNA, 18 bp, Homo sapiens
cctggtgctgccacactt

SEQ ID NO: 1941137 - DNA, 13 bp, Homo sapiens
cctggttccctct

SEQ ID NO: 1941138 - DNA, 14 bp, Homo sapiens
cctggttccctctt

SEQ ID NO: 1941139 - DNA, 18 bp, Homo sapiens
cctggttccctctttcct

SEQ ID NO: 1941140 - DNA, 21 bp, Homo sapiens
cctgtaacctcttcagaggcc

SEQ ID NO: 1941141 - DNA, 10 bp, Homo sapiens
cctgtccttc

SEQ ID NO: 1941142 - DNA, 18 bp, Homo sapiens
cctgtccttcccacggcc

SEQ ID NO: 1941143 - DNA, 21 bp, Homo sapiens
cctgtccttctctcacctcct

SEQ ID NO: 1941144 - DNA, 18 bp, Homo sapiens
cctgtctttgctgtttat

SEQ ID NO: 1941145 - DNA, 19 bp, Homo sapiens
cctgtctttgctgtttata

SEQ ID NO: 1941146 - DNA, 23 bp, Homo sapiens
cctgtctttgctgtttatatata

SEQ ID NO: 1941147 - DNA, 16 bp, Homo sapiens
cctgtgatcgtgtgtt

SEQ ID NO: 1941148 - DNA, 14 bp, Homo sapiens
cctgtgatgcctga

SEQ ID NO: 1941149 - DNA, 19 bp, Homo sapiens
cctgtgatgcctgacacag

SEQ ID NO: 1941150 - DNA, 20 bp, Homo sapiens
cctgtgcagccgctgagcga

SEQ ID NO: 1941151 - DNA, 21 bp, Homo sapiens
cctgtgcagccgctgagcgag

SEQ ID NO: 1941152 - DNA, 22 bp, Homo sapiens
cctgtgccaggactctctttct

SEQ ID NO: 1941153 - DNA, 15 bp, Homo sapiens
cctgtgggagaaggg

SEQ ID NO: 1941154 - DNA, 19 bp, Homo sapiens
cctgtgggagaagggacag

SEQ ID NO: 1941155 - DNA, 23 bp, Homo sapiens
cctgtgtccacatctaacaaagt

SEQ ID NO: 1941156 - DNA, 18 bp, Homo sapiens
cctgtgtgtaagctgact

SEQ ID NO: 1941157 - DNA, 22 bp, Homo sapiens
cctgttacctaattagagcaga

SEQ ID NO: 1941158 - DNA, 21 bp, Homo sapiens
cctgttcactctacttagcat

SEQ ID NO: 1941159 - DNA, 16 bp, Homo sapiens
cctgttcctgccttct

SEQ ID NO: 1941160 - DNA, 21 bp, Homo sapiens
cctgttcctgccttctcttct

SEQ ID NO: 1941161 - DNA, 17 bp, Homo sapiens
cctgtttgggaggctgg

SEQ ID NO: 1941162 - DNA, 23 bp, Homo sapiens
cctgttttattgagttctgaagg

SEQ ID NO: 1941163 - DNA, 14 bp, Homo sapiens
ccttaagtggctgt

SEQ ID NO: 1941164 - DNA, 20 bp, Homo sapiens
ccttagaaaagactgacctt

SEQ ID NO: 1941165 - DNA, 14 bp, Homo sapiens
ccttagaacctttc

SEQ ID NO: 1941166 - DNA, 16 bp, Homo sapiens
ccttagaacctttctt

SEQ ID NO: 1941167 - DNA, 20 bp, Homo sapiens
ccttcccacggccactgcag

SEQ ID NO: 1941168 - DNA, 16 bp, Homo sapiens
ccttcccagctgctcc

SEQ ID NO: 1941169 - DNA, 18 bp, Homo sapiens
ccttcccagctgctccta

SEQ ID NO: 1941170 - DNA, 15 bp, Homo sapiens
ccttccccactcccg

SEQ ID NO: 1941171 - DNA, 19 bp, Homo sapiens
ccttccccctccaatccca

SEQ ID NO: 1941172 - DNA, 23 bp, Homo sapiens
ccttcccctgcgccctccctccc

SEQ ID NO: 1941173 - DNA, 17 bp, Homo sapiens
ccttcctctccactgcc

SEQ ID NO: 1941174 - DNA, 15 bp, Homo sapiens
ccttcgatacaccgg

SEQ ID NO: 1941175 - DNA, 23 bp, Homo sapiens
ccttcgatacaccgggcctggag

SEQ ID NO: 1941176 - DNA, 13 bp, Homo sapiens
ccttctccatcca

SEQ ID NO: 1941177 - DNA, 16 bp, Homo sapiens
ccttctcccctccaga

SEQ ID NO: 1941178 - DNA, 18 bp, Homo sapiens
ccttctctcacctcctaa

SEQ ID NO: 1941179 - DNA, 19 bp, Homo sapiens
ccttctctcacctcctaaa

SEQ ID NO: 1941180 - DNA, 18 bp, Homo sapiens
ccttctcttctatcctgc

SEQ ID NO: 1941181 - DNA, 21 bp, Homo sapiens
ccttgcgcttttgctggtcac

SEQ ID NO: 1941182 - DNA, 15 bp, Homo sapiens
ccttggcccctctct

SEQ ID NO: 1941183 - DNA, 13 bp, Homo sapiens
ccttgggctccct

SEQ ID NO: 1941184 - DNA, 16 bp, Homo sapiens
ccttggttcccccact

SEQ ID NO: 1941185 - DNA, 14 bp, Homo sapiens
ccttggttcctcca

SEQ ID NO: 1941186 - DNA, 19 bp, Homo sapiens
ccttgtaattctaaatgaa

SEQ ID NO: 1941187 - DNA, 23 bp, Homo sapiens
ccttgtgtgagtgtgacgggggt

SEQ ID NO: 1941188 - DNA, 22 bp, Homo sapiens
cctttagaaactgagtcctgtt

SEQ ID NO: 1941189 - DNA, 18 bp, Homo sapiens
cctttatgttttaatatc

SEQ ID NO: 1941190 - DNA, 15 bp, Homo sapiens
cctttcacaaccttc

SEQ ID NO: 1941191 - DNA, 14 bp, Homo sapiens
cctttccctgcatc

SEQ ID NO: 1941192 - DNA, 17 bp, Homo sapiens
cctttccctgcatccct

SEQ ID NO: 1941193 - DNA, 13 bp, Homo sapiens
cctttgaggtcta

SEQ ID NO: 1941194 - DNA, 22 bp, Homo sapiens
cctttgagtgcagtcctgatca

SEQ ID NO: 1941195 - DNA, 21 bp, Homo sapiens
cctttgattaaagactccagt

SEQ ID NO: 1941196 - DNA, 19 bp, Homo sapiens
cctttggcacaccctctct

SEQ ID NO: 1941197 - DNA, 22 bp, Homo sapiens
cctttggcacaccctctctgtc

SEQ ID NO: 1941198 - DNA, 17 bp, Homo sapiens
cctttgttgctgtctgg

SEQ ID NO: 1941199 - DNA, 21 bp, Homo sapiens
ccttttgaaattaacctctca

SEQ ID NO: 1941200 - DNA, 16 bp, Homo sapiens
cgacaacatttctgcc

SEQ ID NO: 1941201 - DNA, 13 bp, Homo sapiens
cgacacaggctgc

SEQ ID NO: 1941202 - DNA, 18 bp, Homo sapiens
cgactctctccatcagaa

SEQ ID NO: 1941203 - DNA, 17 bp, Homo sapiens
cgagacaggcagaatca

SEQ ID NO: 1941204 - DNA, 16 bp, Homo sapiens
cgagccccctgtcctt

SEQ ID NO: 1941205 - DNA, 17 bp, Homo sapiens
cgagccccctgtccttc

SEQ ID NO: 1941206 - DNA, 14 bp, Homo sapiens
cgaggcaggggctg

SEQ ID NO: 1941207 - DNA, 16 bp, Homo sapiens
cgaggcaggggctggg

SEQ ID NO: 1941208 - DNA, 20 bp, Homo sapiens
cgaggcaggggctgggcaga

SEQ ID NO: 1941209 - DNA, 21 bp, Homo sapiens
cgaggcaggggctgggcagag

SEQ ID NO: 1941210 - DNA, 15 bp, Homo sapiens
cgagggcgcctgggt

SEQ ID NO: 1941211 - DNA, 21 bp, Homo sapiens
cgatgtcaaccttgtgtgagt

SEQ ID NO: 1941212 - DNA, 13 bp, Homo sapiens
cgatgtgttttat

SEQ ID NO: 1941213 - DNA, 16 bp, Homo sapiens
cgcaacttcccaggcc

SEQ ID NO: 1941214 - DNA, 14 bp, Homo sapiens
cgcacacacactct

SEQ ID NO: 1941215 - DNA, 18 bp, Homo sapiens
cgcacgtgggtcttcagg

SEQ ID NO: 1941216 - DNA, 17 bp, Homo sapiens
cgcacttcccatttgtg

SEQ ID NO: 1941217 - DNA, 13 bp, Homo sapiens
cgcagccctgctt

SEQ ID NO: 1941218 - DNA, 21 bp, Homo sapiens
cgcaggggcccctcctccaga

SEQ ID NO: 1941219 - DNA, 13 bp, Homo sapiens
cgccctccctccc

SEQ ID NO: 1941220 - DNA, 15 bp, Homo sapiens
cgccctctgccccca

SEQ ID NO: 1941221 - DNA, 18 bp, Homo sapiens
cgccgctgtgctgttgtc

SEQ ID NO: 1941222 - DNA, 13 bp, Homo sapiens
cgccgtggctgcg

SEQ ID NO: 1941223 - DNA, 14 bp, Homo sapiens
cgcctctgagccag

SEQ ID NO: 1941224 - DNA, 14 bp, Homo sapiens
cgcctctgtcctgg

SEQ ID NO: 1941225 - DNA, 19 bp, Homo sapiens
cgcctctgtcctggcccgg

SEQ ID NO: 1941226 - DNA, 19 bp, Homo sapiens
cgcctgggtcctcccagct

SEQ ID NO: 1941227 - DNA, 21 bp, Homo sapiens
cgcctgggtcctcccagctga

SEQ ID NO: 1941228 - DNA, 16 bp, Homo sapiens
cgcgatacagacccac

SEQ ID NO: 1941229 - DNA, 13 bp, Homo sapiens
cgcgcacacacac

SEQ ID NO: 1941230 - DNA, 16 bp, Homo sapiens
cgcgcgcgcgcacaca

SEQ ID NO: 1941231 - DNA, 17 bp, Homo sapiens
cgcgtggtcacaggacg

SEQ ID NO: 1941232 - DNA, 12 bp, Homo sapiens
cgctcagccctc

SEQ ID NO: 1941233 - DNA, 14 bp, Homo sapiens
cgctgacttgcaga

SEQ ID NO: 1941234 - DNA, 14 bp, Homo sapiens
cgctgagggcaggg

SEQ ID NO: 1941235 - DNA, 22 bp, Homo sapiens
cgctgagggcagggttctagaa

SEQ ID NO: 1941236 - DNA, 18 bp, Homo sapiens
cgctgctctcccaggtga

SEQ ID NO: 1941237 - DNA, 18 bp, Homo sapiens
cgctgctgtgacaggcag

SEQ ID NO: 1941238 - DNA, 20 bp, Homo sapiens
cgctggactctcagtctctg

SEQ ID NO: 1941239 - DNA, 14 bp, Homo sapiens
cgcttggagcagag

SEQ ID NO: 1941240 - DNA, 17 bp, Homo sapiens
cggaatcctgtcctcag

SEQ ID NO: 1941241 - DNA, 21 bp, Homo sapiens
cggaatcctgtcctcagcttc

SEQ ID NO: 1941242 - DNA, 17 bp, Homo sapiens
cggagccactcctctga

SEQ ID NO: 1941243 - DNA, 18 bp, Homo sapiens
cggaggggcctggcagcc

SEQ ID NO: 1941244 - DNA, 13 bp, Homo sapiens
cggataggctaat

SEQ ID NO: 1941245 - DNA, 14 bp, Homo sapiens
cggattatctagag

SEQ ID NO: 1941246 - DNA, 19 bp, Homo sapiens
cggcaacagggcttctctt

SEQ ID NO: 1941247 - DNA, 22 bp, Homo sapiens
cggcaacagggcttctcttttt

SEQ ID NO: 1941248 - DNA, 13 bp, Homo sapiens
cggccactgcagt

SEQ ID NO: 1941249 - DNA, 17 bp, Homo sapiens
cggccactgcagtcacc

SEQ ID NO: 1941250 - DNA, 17 bp, Homo sapiens
cggcctcttgagagccc

SEQ ID NO: 1941251 - DNA, 23 bp, Homo sapiens
ctgcttctgtgcatttgtgtctg

SEQ ID NO: 1941252 - DNA, 14 bp, Homo sapiens
ctgcttgaggaaaa

SEQ ID NO: 1941253 - DNA, 19 bp, Homo sapiens
ctggaaaggatgcttctgc

SEQ ID NO: 1941254 - DNA, 20 bp, Homo sapiens
ctggaaaggatgcttctgct

SEQ ID NO: 1941255 - DNA, 13 bp, Homo sapiens
ctggaagaacatc

SEQ ID NO: 1941256 - DNA, 17 bp, Homo sapiens
ctggaagaacatcaaga

SEQ ID NO: 1941257 - DNA, 19 bp, Homo sapiens
ctggaagaacatcaagata

SEQ ID NO: 1941258 - DNA, 20 bp, Homo sapiens
ctggaagaacatcaagatac

SEQ ID NO: 1941259 - DNA, 21 bp, Homo sapiens
ctggaatgtaatcaatgtttc

SEQ ID NO: 1941260 - DNA, 22 bp, Homo sapiens
ctggacagtgagagcagggctg

SEQ ID NO: 1941261 - DNA, 21 bp, Homo sapiens
ctggaccacgtctccctggcc

SEQ ID NO: 1941262 - DNA, 15 bp, Homo sapiens
ctggacctgaccaga

SEQ ID NO: 1941263 - DNA, 19 bp, Homo sapiens
ctggactctcagtctctga

SEQ ID NO: 1941264 - DNA, 20 bp, Homo sapiens
ctggactctcagtctctgag

SEQ ID NO: 1941265 - DNA, 21 bp, Homo sapiens
ctggactctcagtctctgagc

SEQ ID NO: 1941266 - DNA, 20 bp, Homo sapiens
ctggagaccccagagtaggg

SEQ ID NO: 1941267 - DNA, 23 bp, Homo sapiens
ctggagagtagacatccccctcc

SEQ ID NO: 1941268 - DNA, 13 bp, Homo sapiens
ctggagtctgaag

SEQ ID NO: 1941269 - DNA, 16 bp, Homo sapiens
ctggagtctgaaggag

SEQ ID NO: 1941270 - DNA, 17 bp, Homo sapiens
ctggagtctgaaggaga

SEQ ID NO: 1941271 - DNA, 21 bp, Homo sapiens
ctggagtctgaaggagaggag

SEQ ID NO: 1941272 - DNA, 16 bp, Homo sapiens
ctggagtgggctctct

SEQ ID NO: 1941273 - DNA, 23 bp, Homo sapiens
ctggagtgggctctctggacctg

SEQ ID NO: 1941274 - DNA, 21 bp, Homo sapiens
ctggatggaggaaaaccaagc

SEQ ID NO: 1941275 - DNA, 15 bp, Homo sapiens
ctggcacagggcagt

SEQ ID NO: 1941276 - DNA, 19 bp, Homo sapiens
ctggcaggagggtggcact

SEQ ID NO: 1941277 - DNA, 14 bp, Homo sapiens
ctggcatctctgga

SEQ ID NO: 1941278 - DNA, 17 bp, Homo sapiens
ctggcccacccctcttc

SEQ ID NO: 1941279 - DNA, 19 bp, Homo sapiens
ctggcccacccctcttccc

SEQ ID NO: 1941280 - DNA, 22 bp, Homo sapiens
ctggcccacccctcttccccct

SEQ ID NO: 1941281 - DNA, 15 bp, Homo sapiens
ctggccctgttgtgg

SEQ ID NO: 1941282 - DNA, 23 bp, Homo sapiens
ctggcctagtggggaggggcctg

SEQ ID NO: 1941283 - DNA, 14 bp, Homo sapiens
ctggcctcttcctc

SEQ ID NO: 1941284 - DNA, 16 bp, Homo sapiens
ctggcctggtccaggc

SEQ ID NO: 1941285 - DNA, 18 bp, Homo sapiens
ctggccttggttcctcca

SEQ ID NO: 1941286 - DNA, 14 bp, Homo sapiens
ctggcggggtctgc

SEQ ID NO: 1941287 - DNA, 22 bp, Homo sapiens
ctggcggggtctgctcctggga

SEQ ID NO: 1941288 - DNA, 17 bp, Homo sapiens
ctggctacgacttggga

SEQ ID NO: 1941289 - DNA, 20 bp, Homo sapiens
ctggctacgacttgggacgg

SEQ ID NO: 1941290 - DNA, 14 bp, Homo sapiens
ctggctagaggaca

SEQ ID NO: 1941291 - DNA, 18 bp, Homo sapiens
ctggctgtggcccctcct

SEQ ID NO: 1941292 - DNA, 22 bp, Homo sapiens
ctggctgtggcccctccttctc

SEQ ID NO: 1941293 - DNA, 15 bp, Homo sapiens
ctggcttttcactgc

SEQ ID NO: 1941294 - DNA, 17 bp, Homo sapiens
ctggcttttcactgctg

SEQ ID NO: 1941295 - DNA, 19 bp, Homo sapiens
ctggcttttcactgctggc

SEQ ID NO: 1941296 - DNA, 16 bp, Homo sapiens
ctgggaaatattccct

SEQ ID NO: 1941297 - DNA, 18 bp, Homo sapiens
ctgggaaatattccctag

SEQ ID NO: 1941298 - DNA, 12 bp, Homo sapiens
ctgggacttgaa

SEQ ID NO: 1941299 - DNA, 16 bp, Homo sapiens
ctgggagagccaaggc

SEQ ID NO: 1941300 - DNA, 23 bp, Homo sapiens
ctgggagagccaaggcctatgcc

SEQ ID NO: 1941301 - DNA, 13 bp, Homo sapiens
ctgggagggcagc

SEQ ID NO: 1941302 - DNA, 16 bp, Homo sapiens
ctgggccactggcatc

SEQ ID NO: 1941303 - DNA, 18 bp, Homo sapiens
ctgggccctctctgctct

SEQ ID NO: 1941304 - DNA, 19 bp, Homo sapiens
ctgggcgcaagcgacacag

SEQ ID NO: 1941305 - DNA, 12 bp, Homo sapiens
ctgggctgaggg

SEQ ID NO: 1941306 - DNA, 16 bp, Homo sapiens
ctgggctgagggagcc

SEQ ID NO: 1941307 - DNA, 19 bp, Homo sapiens
ctgggctgagggagcctgg

SEQ ID NO: 1941308 - DNA, 19 bp, Homo sapiens
ctggggggggcaagagctc

SEQ ID NO: 1941309 - DNA, 15 bp, Homo sapiens
ctgggggtgccaacc

SEQ ID NO: 1941310 - DNA, 16 bp, Homo sapiens
ctggggtggggcttgg

SEQ ID NO: 1941311 - DNA, 22 bp, Homo sapiens
ctggggtggttggaggcctggt

SEQ ID NO: 1941312 - DNA, 15 bp, Homo sapiens
ctgggtcctcccagc

SEQ ID NO: 1941313 - DNA, 18 bp, Homo sapiens
ctgggttggaaaacagta

SEQ ID NO: 1941314 - DNA, 14 bp, Homo sapiens
ctgggtttgggcag

SEQ ID NO: 1941315 - DNA, 21 bp, Homo sapiens
ctgggtttgggcagtggagag

SEQ ID NO: 1941316 - DNA, 22 bp, Homo sapiens
ctgggtttgggcagtggagagg

SEQ ID NO: 1941317 - DNA, 22 bp, Homo sapiens
ctgggttttgtattctctgagc

SEQ ID NO: 1941318 - DNA, 14 bp, Homo sapiens
ctggtcactgccat

SEQ ID NO: 1941319 - DNA, 18 bp, Homo sapiens
ctggtcagtgaagcccag

SEQ ID NO: 1941320 - DNA, 19 bp, Homo sapiens
ctggtcccccatgggctgc

SEQ ID NO: 1941321 - DNA, 18 bp, Homo sapiens
ctggtctggagcccctat

SEQ ID NO: 1941322 - DNA, 20 bp, Homo sapiens
ctggtctggagcccctatcc

SEQ ID NO: 1941323 - DNA, 21 bp, Homo sapiens
ctggtctggagcccctatcct

SEQ ID NO: 1941324 - DNA, 14 bp, Homo sapiens
ctggtgctgcctct

SEQ ID NO: 1941325 - DNA, 21 bp, Homo sapiens
ctggtggcccgacagcctggc

SEQ ID NO: 1941326 - DNA, 22 bp, Homo sapiens
ctggtggcccgacagcctggca

SEQ ID NO: 1941327 - DNA, 18 bp, Homo sapiens
ctggttccggaatcctgt

SEQ ID NO: 1941328 - DNA, 16 bp, Homo sapiens
ctggttccttaagtgg

SEQ ID NO: 1941329 - DNA, 20 bp, Homo sapiens
ctggttccttaagtggctgt

SEQ ID NO: 1941330 - DNA, 18 bp, Homo sapiens
ctggttgagggagtgggg

SEQ ID NO: 1941331 - DNA, 20 bp, Homo sapiens
ctggttggtgttgcagaagg

SEQ ID NO: 1941332 - DNA, 13 bp, Homo sapiens
ctgtaaaatgaac

SEQ ID NO: 1941333 - DNA, 11 bp, Homo sapiens
ctgtaaatatc

SEQ ID NO: 1941334 - DNA, 23 bp, Homo sapiens
ctgtaaatatcccagagaacaat

SEQ ID NO: 1941335 - DNA, 14 bp, Homo sapiens
ctgtaacccttgaa

SEQ ID NO: 1941336 - DNA, 19 bp, Homo sapiens
ctgtaacccttgaatttct

SEQ ID NO: 1941337 - DNA, 23 bp, Homo sapiens
ctgtaacctcttcagaggccctc

SEQ ID NO: 1941338 - DNA, 19 bp, Homo sapiens
ctgtaatcatataataaat

SEQ ID NO: 1941339 - DNA, 16 bp, Homo sapiens
ctgtacatacattgta

SEQ ID NO: 1941340 - DNA, 12 bp, Homo sapiens
ctgtactgagtt

SEQ ID NO: 1941341 - DNA, 24 bp, Homo sapiens
ctgtagggtaattagtaacatgtg

SEQ ID NO: 1941342 - DNA, 20 bp, Homo sapiens
ctgtattaactgaattctga

SEQ ID NO: 1941343 - DNA, 17 bp, Homo sapiens
ctgtattagtcacagag

SEQ ID NO: 1941344 - DNA, 19 bp, Homo sapiens
ctgtattagtcacagagat

SEQ ID NO: 1941345 - DNA, 20 bp, Homo sapiens
ctgtattctgcaacagcctg

SEQ ID NO: 1941346 - DNA, 20 bp, Homo sapiens
ctgtcagaccttcttccaca

SEQ ID NO: 1941347 - DNA, 13 bp, Homo sapiens
ctgtccctcctga

SEQ ID NO: 1941348 - DNA, 15 bp, Homo sapiens
ctgtccctcctgagg

SEQ ID NO: 1941349 - DNA, 22 bp, Homo sapiens
ctgtcctcattcttctctccca

SEQ ID NO: 1941350 - DNA, 18 bp, Homo sapiens
ctgtcctggcccgggagc

SEQ ID NO: 1941351 - DNA, 20 bp, Homo sapiens
ctgtccttctctcacctcct

SEQ ID NO: 1941352 - DNA, 17 bp, Homo sapiens
ctgtcgtggtagcagat

SEQ ID NO: 1941353 - DNA, 20 bp, Homo sapiens
ctgtctaagaataatgacgt

SEQ ID NO: 1941354 - DNA, 12 bp, Homo sapiens
ctgtctcatcca

SEQ ID NO: 1941355 - DNA, 21 bp, Homo sapiens
ctgtctcatccatcatcatgt

SEQ ID NO: 1941356 - DNA, 13 bp, Homo sapiens
ctgtctgagccct

SEQ ID NO: 1941357 - DNA, 19 bp, Homo sapiens
ctgtctgagccctgccctc

SEQ ID NO: 1941358 - DNA, 21 bp, Homo sapiens
ctgtctgagccctgccctcac

SEQ ID NO: 1941359 - DNA, 22 bp, Homo sapiens
ctgtctgagccctgccctcact

SEQ ID NO: 1941360 - DNA, 11 bp, Homo sapiens
ctgtctgcagg

SEQ ID NO: 1941361 - DNA, 17 bp, Homo sapiens
ctgtgatgcctgacaca

SEQ ID NO: 1941362 - DNA, 14 bp, Homo sapiens
ctgtgattaattat

SEQ ID NO: 1941363 - DNA, 20 bp, Homo sapiens
ctgtgattgccatttcttcc

SEQ ID NO: 1941364 - DNA, 16 bp, Homo sapiens
ctgtgcagccgctgag

SEQ ID NO: 1941365 - DNA, 18 bp, Homo sapiens
ctgtgcatttgtgtctgc

SEQ ID NO: 1941366 - DNA, 13 bp, Homo sapiens
ctgtgctgttgtc

SEQ ID NO: 1941367 - DNA, 20 bp, Homo sapiens
ctgtgcttcgggcccttccc

SEQ ID NO: 1941368 - DNA, 13 bp, Homo sapiens
ctgtggccaaagg

SEQ ID NO: 1941369 - DNA, 19 bp, Homo sapiens
ctgtggcccctccttctcc

SEQ ID NO: 1941370 - DNA, 22 bp, Homo sapiens
ctgtggcccctccttctcccct

SEQ ID NO: 1941371 - DNA, 19 bp, Homo sapiens
ctgtgggactggcccaccc

SEQ ID NO: 1941372 - DNA, 21 bp, Homo sapiens
ctgtgggactggcccacccct

SEQ ID NO: 1941373 - DNA, 22 bp, Homo sapiens
ctgtgggagaagggacagcggg

SEQ ID NO: 1941374 - DNA, 14 bp, Homo sapiens
ctgtgggtccctgc

SEQ ID NO: 1941375 - DNA, 22 bp, Homo sapiens
ctgtgggtccctgcgtctcctg

SEQ ID NO: 1941376 - DNA, 23 bp, Homo sapiens
ctgtgggtccctgcgtctcctgc

SEQ ID NO: 1941377 - DNA, 18 bp, Homo sapiens
ctgtgtgtaagctgactg

SEQ ID NO: 1941378 - DNA, 15 bp, Homo sapiens
ctgttcactctactt

SEQ ID NO: 1941379 - DNA, 20 bp, Homo sapiens
ctgttgacatccaagcttcc

SEQ ID NO: 1941380 - DNA, 17 bp, Homo sapiens
ctgttgtttgatgtgta

SEQ ID NO: 1941381 - DNA, 17 bp, Homo sapiens
ctgtttaccctccctgt

SEQ ID NO: 1941382 - DNA, 19 bp, Homo sapiens
gcagcctagtaggagctga

SEQ ID NO: 1941383 - DNA, 17 bp, Homo sapiens
gcagcctggttccctct

SEQ ID NO: 1941384 - DNA, 15 bp, Homo sapiens
gcagcctgtgggaga

SEQ ID NO: 1941385 - DNA, 20 bp, Homo sapiens
gcagcctgtgggagaaggga

SEQ ID NO: 1941386 - DNA, 23 bp, Homo sapiens
gcagcctgtgggagaagggacag

SEQ ID NO: 1941387 - DNA, 15 bp, Homo sapiens
gcagcgcccagcctg

SEQ ID NO: 1941388 - DNA, 22 bp, Homo sapiens
gcagcgtctgagcggccgcctg

SEQ ID NO: 1941389 - DNA, 14 bp, Homo sapiens
gcagctgggcactg

SEQ ID NO: 1941390 - DNA, 17 bp, Homo sapiens
gcagctgttagagtcca

SEQ ID NO: 1941391 - DNA, 14 bp, Homo sapiens
gcaggagggtggca

SEQ ID NO: 1941392 - DNA, 15 bp, Homo sapiens
gcaggagggtggcac

SEQ ID NO: 1941393 - DNA, 23 bp, Homo sapiens
gcaggcaagacaccttcccagct

SEQ ID NO: 1941394 - DNA, 17 bp, Homo sapiens
gcaggcaccagcagcag

SEQ ID NO: 1941395 - DNA, 23 bp, Homo sapiens
gcaggccacccccacctccctgc

SEQ ID NO: 1941396 - DNA, 21 bp, Homo sapiens
gcagggaaaattatttgcata

SEQ ID NO: 1941397 - DNA, 16 bp, Homo sapiens
gcagggacagttgggt

SEQ ID NO: 1941398 - DNA, 14 bp, Homo sapiens
gcagggcagcctgt

SEQ ID NO: 1941399 - DNA, 20 bp, Homo sapiens
gcagggcagcctgtgggaga

SEQ ID NO: 1941400 - DNA, 23 bp, Homo sapiens
gcagggcagcctgtgggagaagg

SEQ ID NO: 1941401 - DNA, 15 bp, Homo sapiens
gcagggcctggcctg

SEQ ID NO: 1941402 - DNA, 22 bp, Homo sapiens
gcagggctaccctgagctgagg

SEQ ID NO: 1941403 - DNA, 23 bp, Homo sapiens
gcagggctgggcgcctctgtcct

SEQ ID NO: 1941404 - DNA, 13 bp, Homo sapiens
gcaggggcccctc

SEQ ID NO: 1941405 - DNA, 16 bp, Homo sapiens
gcaggggcccctcctc

SEQ ID NO: 1941406 - DNA, 13 bp, Homo sapiens
gcaggggggttgg

SEQ ID NO: 1941407 - DNA, 14 bp, Homo sapiens
gcaggggggttggg

SEQ ID NO: 1941408 - DNA, 13 bp, Homo sapiens
gcagggtctttgt

SEQ ID NO: 1941409 - DNA, 19 bp, Homo sapiens
gcagggtctttgtgtgctg

SEQ ID NO: 1941410 - DNA, 18 bp, Homo sapiens
gcaggtcccgagccccct

SEQ ID NO: 1941411 - DNA, 17 bp, Homo sapiens
gcaggtggggagactgg

SEQ ID NO: 1941412 - DNA, 21 bp, Homo sapiens
gcaggtggggagactgggctg

SEQ ID NO: 1941413 - DNA, 15 bp, Homo sapiens
gcagtaaatccacag

SEQ ID NO: 1941414 - DNA, 19 bp, Homo sapiens
gcagtcattatccaggtaa

SEQ ID NO: 1941415 - DNA, 17 bp, Homo sapiens
gcagtggagaggggact

SEQ ID NO: 1941416 - DNA, 21 bp, Homo sapiens
gcagtggagaggggacttgga

SEQ ID NO: 1941417 - DNA, 21 bp, Homo sapiens
gcagtgtgaggccagggcaga

SEQ ID NO: 1941418 - DNA, 20 bp, Homo sapiens
gcatcccttggcccctctct

SEQ ID NO: 1941419 - DNA, 22 bp, Homo sapiens
gcatcccttggcccctctctgt

SEQ ID NO: 1941420 - DNA, 13 bp, Homo sapiens
gcatccgcctctg

SEQ ID NO: 1941421 - DNA, 21 bp, Homo sapiens
gcatccgcctctgagccagga

SEQ ID NO: 1941422 - DNA, 13 bp, Homo sapiens
gcatctcagccca

SEQ ID NO: 1941423 - DNA, 14 bp, Homo sapiens
gcatctcagcccac

SEQ ID NO: 1941424 - DNA, 18 bp, Homo sapiens
gcatctgtggcctggggc

SEQ ID NO: 1941425 - DNA, 20 bp, Homo sapiens
gcatgaaactatgcacctat

SEQ ID NO: 1941426 - DNA, 16 bp, Homo sapiens
gcatgcactgttcccc

SEQ ID NO: 1941427 - DNA, 18 bp, Homo sapiens
gcatgcggcaaaccgcat

SEQ ID NO: 1941428 - DNA, 16 bp, Homo sapiens
gcatggcccagcctgg

SEQ ID NO: 1941429 - DNA, 23 bp, Homo sapiens
gcatggccgcaacttcccaggcc

SEQ ID NO: 1941430 - DNA, 11 bp, Homo sapiens
gcatgtacttt

SEQ ID NO: 1941431 - DNA, 19 bp, Homo sapiens
gcatgttcttgttttgtta

SEQ ID NO: 1941432 - DNA, 13 bp, Homo sapiens
gcattctcactcc

SEQ ID NO: 1941433 - DNA, 15 bp, Homo sapiens
gcattctcactccta

SEQ ID NO: 1941434 - DNA, 16 bp, Homo sapiens
gcattgccaagggctt

SEQ ID NO: 1941435 - DNA, 19 bp, Homo sapiens
gcattgtggctgtcagcag

SEQ ID NO: 1941436 - DNA, 18 bp, Homo sapiens
gcatttctttatttctgt

SEQ ID NO: 1941437 - DNA, 23 bp, Homo sapiens
gccaaaggagggtcaggaaggat

SEQ ID NO: 1941438 - DNA, 15 bp, Homo sapiens
gccaaattgcagaag

SEQ ID NO: 1941439 - DNA, 23 bp, Homo sapiens
gccaaccacctctggccctgttg

SEQ ID NO: 1941440 - DNA, 20 bp, Homo sapiens
gccaagccagggttccagac

SEQ ID NO: 1941441 - DNA, 21 bp, Homo sapiens
gccaagccagggttccagaca

SEQ ID NO: 1941442 - DNA, 21 bp, Homo sapiens
gccaaggcctatgccacctgc

SEQ ID NO: 1941443 - DNA, 22 bp, Homo sapiens
gccacacttcaggctcttctcc

SEQ ID NO: 1941444 - DNA, 23 bp, Homo sapiens
gccacacttcaggctcttctcct

SEQ ID NO: 1941445 - DNA, 22 bp, Homo sapiens
gccaccaagagggacgcctggg

SEQ ID NO: 1941446 - DNA, 15 bp, Homo sapiens
gccacccagccagga

SEQ ID NO: 1941447 - DNA, 23 bp, Homo sapiens
gccacccccacctccctgcagct

SEQ ID NO: 1941448 - DNA, 15 bp, Homo sapiens
gccacgtgctggaga

SEQ ID NO: 1941449 - DNA, 14 bp, Homo sapiens
gccacgtggccgct

SEQ ID NO: 1941450 - DNA, 19 bp, Homo sapiens
gccacgtggccgctgccca

SEQ ID NO: 1941451 - DNA, 15 bp, Homo sapiens
gccactcctctgact

SEQ ID NO: 1941452 - DNA, 21 bp, Homo sapiens
gccactcctctgactcagggc

SEQ ID NO: 1941453 - DNA, 20 bp, Homo sapiens
gccacttggccaccaggact

SEQ ID NO: 1941454 - DNA, 16 bp, Homo sapiens
gccactttgcagacct

SEQ ID NO: 1941455 - DNA, 20 bp, Homo sapiens
gccactttgcagacctggga

SEQ ID NO: 1941456 - DNA, 12 bp, Homo sapiens
gccagcgtcctc

SEQ ID NO: 1941457 - DNA, 13 bp, Homo sapiens
gccagcgtcctcc

SEQ ID NO: 1941458 - DNA, 15 bp, Homo sapiens
gccagctctgtatca

SEQ ID NO: 1941459 - DNA, 16 bp, Homo sapiens
gccagctgtactgagt

SEQ ID NO: 1941460 - DNA, 17 bp, Homo sapiens
gccagctgtactgagtt

SEQ ID NO: 1941461 - DNA, 10 bp, Homo sapiens
gccaggagac

SEQ ID NO: 1941462 - DNA, 16 bp, Homo sapiens
gccaggagcctcctga

SEQ ID NO: 1941463 - DNA, 21 bp, Homo sapiens
gccaggagtgggtttccctgc

SEQ ID NO: 1941464 - DNA, 19 bp, Homo sapiens
gccaggcatggcccagcct

SEQ ID NO: 1941465 - DNA, 20 bp, Homo sapiens
gccaggccagtaaaagtata

SEQ ID NO: 1941466 - DNA, 13 bp, Homo sapiens
gccaggctgcagg

SEQ ID NO: 1941467 - DNA, 16 bp, Homo sapiens
gccaggctgcagggac

SEQ ID NO: 1941468 - DNA, 15 bp, Homo sapiens
gccagggttccagac

SEQ ID NO: 1941469 - DNA, 23 bp, Homo sapiens
gccagggttccagacagggtggg

SEQ ID NO: 1941470 - DNA, 13 bp, Homo sapiens
gccaggtttgtta

SEQ ID NO: 1941471 - DNA, 17 bp, Homo sapiens
gccatattttcaccatt

SEQ ID NO: 1941472 - DNA, 13 bp, Homo sapiens
gccatccctgaga

SEQ ID NO: 1941473 - DNA, 18 bp, Homo sapiens
gccatgattttggccact

SEQ ID NO: 1941474 - DNA, 16 bp, Homo sapiens
gccatggaggcacaca

SEQ ID NO: 1941475 - DNA, 15 bp, Homo sapiens
gcccaatcactgcct

SEQ ID NO: 1941476 - DNA, 23 bp, Homo sapiens
gcccacccctcttcccccttccc

SEQ ID NO: 1941477 - DNA, 16 bp, Homo sapiens
gcccacctgccaggct

SEQ ID NO: 1941478 - DNA, 18 bp, Homo sapiens
gcccacctgccaggctgc

SEQ ID NO: 1941479 - DNA, 19 bp, Homo sapiens
gcccacctgccaggctgca

SEQ ID NO: 1941480 - DNA, 20 bp, Homo sapiens
gcccacctgccaggctgcag

SEQ ID NO: 1941481 - DNA, 16 bp, Homo sapiens
gcccacgtcccgggca

SEQ ID NO: 1941482 - DNA, 15 bp, Homo sapiens
gcccacgtcctgggt

SEQ ID NO: 1941483 - DNA, 17 bp, Homo sapiens
gcccacgtcctgggtgc

SEQ ID NO: 1941484 - DNA, 13 bp, Homo sapiens
gcccagcctgcat

SEQ ID NO: 1941485 - DNA, 12 bp, Homo sapiens
gcccagcctgga

SEQ ID NO: 1941486 - DNA, 13 bp, Homo sapiens
gcccagcctggag

SEQ ID NO: 1941487 - DNA, 15 bp, Homo sapiens
gcccagcctggagcc

SEQ ID NO: 1941488 - DNA, 13 bp, Homo sapiens
gcccagcttggag

SEQ ID NO: 1941489 - DNA, 19 bp, Homo sapiens
gcccagcttggagtgccac

SEQ ID NO: 1941490 - DNA, 21 bp, Homo sapiens
gcccagcttggagtgccacgt

SEQ ID NO: 1941491 - DNA, 14 bp, Homo sapiens
gcccagtcttgagt

SEQ ID NO: 1941492 - DNA, 23 bp, Homo sapiens
gccccaggctcaggctgcccagc

SEQ ID NO: 1941493 - DNA, 12 bp, Homo sapiens
gcccccagacgc

SEQ ID NO: 1941494 - DNA, 18 bp, Homo sapiens
gcccccagctgctcctcg

SEQ ID NO: 1941495 - DNA, 13 bp, Homo sapiens
gccccccttccca

SEQ ID NO: 1941496 - DNA, 16 bp, Homo sapiens
gcccccgccctctgcc

SEQ ID NO: 1941497 - DNA, 18 bp, Homo sapiens
gcccccggctcggcctct

SEQ ID NO: 1941498 - DNA, 14 bp, Homo sapiens
gccccctgtccttc

SEQ ID NO: 1941499 - DNA, 17 bp, Homo sapiens
gcccctatcctgcaccc

SEQ ID NO: 1941500 - DNA, 18 bp, Homo sapiens
gcccctatcctgcaccct

SEQ ID NO: 1941501 - DNA, 14 bp, Homo sapiens
gcccctccctcctg

SEQ ID NO: 1941502 - DNA, 22 bp, Homo sapiens
gcccctcctccagagcctgggc

SEQ ID NO: 1941503 - DNA, 13 bp, Homo sapiens
gcccctccttctc

SEQ ID NO: 1941504 - DNA, 14 bp, Homo sapiens
gcccctccttctcc

SEQ ID NO: 1941505 - DNA, 15 bp, Homo sapiens
gcccctccttctccc

SEQ ID NO: 1941506 - DNA, 16 bp, Homo sapiens
gcccctccttctcccc

SEQ ID NO: 1941507 - DNA, 19 bp, Homo sapiens
gcccctccttctcccctcc

SEQ ID NO: 1941508 - DNA, 20 bp, Homo sapiens
gcccctccttctcccctcca

SEQ ID NO: 1941509 - DNA, 22 bp, Homo sapiens
gcccctccttctcccctccaga

SEQ ID NO: 1941510 - DNA, 21 bp, Homo sapiens
gcccctctctgtttaccctcc

SEQ ID NO: 1941511 - DNA, 12 bp, Homo sapiens
gccccttccccc

SEQ ID NO: 1941512 - DNA, 15 bp, Homo sapiens
gcccgacagcctggc

SEQ ID NO: 1941513 - DNA, 15 bp, Homo sapiens
gcccgggagccgcag

SEQ ID NO: 1941514 - DNA, 19 bp, Homo sapiens
ggatctaaaaggaggacag

SEQ ID NO: 1941515 - DNA, 17 bp, Homo sapiens
ggatcttacccacttcc

SEQ ID NO: 1941516 - DNA, 22 bp, Homo sapiens
ggatcttacccacttccctgca

SEQ ID NO: 1941517 - DNA, 23 bp, Homo sapiens
ggatcttacccacttccctgcaa

SEQ ID NO: 1941518 - DNA, 13 bp, Homo sapiens
ggatgagcattta

SEQ ID NO: 1941519 - DNA, 12 bp, Homo sapiens
ggatgggaagga

SEQ ID NO: 1941520 - DNA, 18 bp, Homo sapiens
ggatggggagcagctggg

SEQ ID NO: 1941521 - DNA, 17 bp, Homo sapiens
ggatggggcggcctgca

SEQ ID NO: 1941522 - DNA, 22 bp, Homo sapiens
ggatggtcatcgtgacagcagc

SEQ ID NO: 1941523 - DNA, 12 bp, Homo sapiens
ggattcaggaat

SEQ ID NO: 1941524 - DNA, 20 bp, Homo sapiens
ggattgatcggagcctcctc

SEQ ID NO: 1941525 - DNA, 20 bp, Homo sapiens
ggcaagacaccttcccagct

SEQ ID NO: 1941526 - DNA, 22 bp, Homo sapiens
ggcaagacaccttcccagctgc

SEQ ID NO: 1941527 - DNA, 20 bp, Homo sapiens
ggcaagagctcaggagaagg

SEQ ID NO: 1941528 - DNA, 22 bp, Homo sapiens
ggcaagagctcaggagaaggcc

SEQ ID NO: 1941529 - DNA, 16 bp, Homo sapiens
ggcaagctggcaggag

SEQ ID NO: 1941530 - DNA, 22 bp, Homo sapiens
ggcaagcttggctgtagaagga

SEQ ID NO: 1941531 - DNA, 20 bp, Homo sapiens
ggcactgggccggcagcctg

SEQ ID NO: 1941532 - DNA, 19 bp, Homo sapiens
ggcactgtcatgcccagct

SEQ ID NO: 1941533 - DNA, 21 bp, Homo sapiens
ggcactgtcatgcccagcttg

SEQ ID NO: 1941534 - DNA, 22 bp, Homo sapiens
ggcacttcgtggatgacctcct

SEQ ID NO: 1941535 - DNA, 18 bp, Homo sapiens
ggcagaccagagagctca

SEQ ID NO: 1941536 - DNA, 21 bp, Homo sapiens
ggcagagattgggggggcttg

SEQ ID NO: 1941537 - DNA, 21 bp, Homo sapiens
ggcagcagggctaccctgagc

SEQ ID NO: 1941538 - DNA, 14 bp, Homo sapiens
ggcagcagtgtgag

SEQ ID NO: 1941539 - DNA, 11 bp, Homo sapiens
ggcagcccctc

SEQ ID NO: 1941540 - DNA, 18 bp, Homo sapiens
ggcagccgtgccttcagc

SEQ ID NO: 1941541 - DNA, 21 bp, Homo sapiens
ggcagccgtgccttcagctct

SEQ ID NO: 1941542 - DNA, 15 bp, Homo sapiens
ggcagcctgtgggag

SEQ ID NO: 1941543 - DNA, 17 bp, Homo sapiens
ggcagcctgtgggagaa

SEQ ID NO: 1941544 - DNA, 15 bp, Homo sapiens
ggcagcgcccagcct

SEQ ID NO: 1941545 - DNA, 18 bp, Homo sapiens
ggcagcgcccagcctggc

SEQ ID NO: 1941546 - DNA, 16 bp, Homo sapiens
ggcaggagggtggcac

SEQ ID NO: 1941547 - DNA, 13 bp, Homo sapiens
ggcagggcctggc

SEQ ID NO: 1941548 - DNA, 13 bp, Homo sapiens
ggcaggggctggg

SEQ ID NO: 1941549 - DNA, 17 bp, Homo sapiens
ggcaggggctgggcaga

SEQ ID NO: 1941550 - DNA, 19 bp, Homo sapiens
ggcaggggctgggcagagg

SEQ ID NO: 1941551 - DNA, 13 bp, Homo sapiens
ggcagggttctag

SEQ ID NO: 1941552 - DNA, 17 bp, Homo sapiens
ggcagggttctagaagg

SEQ ID NO: 1941553 - DNA, 18 bp, Homo sapiens
ggcagggttctagaaggg

SEQ ID NO: 1941554 - DNA, 20 bp, Homo sapiens
ggcaggtcccgagccccctg

SEQ ID NO: 1941555 - DNA, 21 bp, Homo sapiens
ggcaggtcccgagccccctgt

SEQ ID NO: 1941556 - DNA, 21 bp, Homo sapiens
ggcatggcccagcctggagcc

SEQ ID NO: 1941557 - DNA, 17 bp, Homo sapiens
ggccaaatatgcacttt

SEQ ID NO: 1941558 - DNA, 18 bp, Homo sapiens
ggccacatgggaggctca

SEQ ID NO: 1941559 - DNA, 22 bp, Homo sapiens
ggccacccccacctccctgcag

SEQ ID NO: 1941560 - DNA, 23 bp, Homo sapiens
ggccacgggggaggccgaggcag

SEQ ID NO: 1941561 - DNA, 17 bp, Homo sapiens
ggccactttgcagacct

SEQ ID NO: 1941562 - DNA, 23 bp, Homo sapiens
ggccaggcatggcccagcctgga

SEQ ID NO: 1941563 - DNA, 14 bp, Homo sapiens
ggccaggtgcacag

SEQ ID NO: 1941564 - DNA, 12 bp, Homo sapiens
ggcccacccctc

SEQ ID NO: 1941565 - DNA, 17 bp, Homo sapiens
ggcccacgtcctgggtg

SEQ ID NO: 1941566 - DNA, 12 bp, Homo sapiens
ggcccagcctgg

SEQ ID NO: 1941567 - DNA, 15 bp, Homo sapiens
ggcccagcctggagc

SEQ ID NO: 1941568 - DNA, 15 bp, Homo sapiens
ggcccccgccctctg

SEQ ID NO: 1941569 - DNA, 17 bp, Homo sapiens
ggcccccgccctctgcc

SEQ ID NO: 1941570 - DNA, 20 bp, Homo sapiens
ggcccctccttctcccctcc

SEQ ID NO: 1941571 - DNA, 17 bp, Homo sapiens
ggcccgacagcctggca

SEQ ID NO: 1941572 - DNA, 20 bp, Homo sapiens
ggcccggagatgcatctgtg

SEQ ID NO: 1941573 - DNA, 15 bp, Homo sapiens
ggccctcgctgccag

SEQ ID NO: 1941574 - DNA, 22 bp, Homo sapiens
ggccctcgctgccagctctgta

SEQ ID NO: 1941575 - DNA, 23 bp, Homo sapiens
ggccctcgctgccagctctgtat

SEQ ID NO: 1941576 - DNA, 19 bp, Homo sapiens
ggccctgcaaaaggactct

SEQ ID NO: 1941577 - DNA, 22 bp, Homo sapiens
ggccctgcaaaaggactctcag

SEQ ID NO: 1941578 - DNA, 15 bp, Homo sapiens
ggccctgcaagggcg

SEQ ID NO: 1941579 - DNA, 12 bp, Homo sapiens
ggccgaggcagg

SEQ ID NO: 1941580 - DNA, 23 bp, Homo sapiens
ggccgaggcaggggctgggcaga

SEQ ID NO: 1941581 - DNA, 15 bp, Homo sapiens
ggccgcaacttccca

SEQ ID NO: 1941582 - DNA, 18 bp, Homo sapiens
ggccgcaacttcccaggc

SEQ ID NO: 1941583 - DNA, 14 bp, Homo sapiens
ggccgcctgtcctt

SEQ ID NO: 1941584 - DNA, 15 bp, Homo sapiens
ggccgcctgtccttg

SEQ ID NO: 1941585 - DNA, 19 bp, Homo sapiens
ggccgggggtgggggcctg

SEQ ID NO: 1941586 - DNA, 15 bp, Homo sapiens
ggccggtgtggccct

SEQ ID NO: 1941587 - DNA, 18 bp, Homo sapiens
ggcctcttgagagcccca

SEQ ID NO: 1941588 - DNA, 19 bp, Homo sapiens
ggcctcttgagagccccac

SEQ ID NO: 1941589 - DNA, 17 bp, Homo sapiens
ggcctgccccccttccc

SEQ ID NO: 1941590 - DNA, 18 bp, Homo sapiens
ggcctgccccccttccca

SEQ ID NO: 1941591 - DNA, 22 bp, Homo sapiens
ggcctgggagatgcagctggat

SEQ ID NO: 1941592 - DNA, 22 bp, Homo sapiens
ggcctgggtggggcagggcctg

SEQ ID NO: 1941593 - DNA, 15 bp, Homo sapiens
ggcctgtgtgtaagc

SEQ ID NO: 1941594 - DNA, 22 bp, Homo sapiens
ggcctgtgtgtaagctgactgg

SEQ ID NO: 1941595 - DNA, 22 bp, Homo sapiens
ggcgcaagcgacacaggctgcc

SEQ ID NO: 1941596 - DNA, 18 bp, Homo sapiens
ggcggcctgcagaccctg

SEQ ID NO: 1941597 - DNA, 16 bp, Homo sapiens
ggcgtgggatccagag

SEQ ID NO: 1941598 - DNA, 16 bp, Homo sapiens
ggctattccctggaga

SEQ ID NO: 1941599 - DNA, 22 bp, Homo sapiens
ggctcacccccttctccatcca

SEQ ID NO: 1941600 - DNA, 16 bp, Homo sapiens
ggctcaggctgcccag

SEQ ID NO: 1941601 - DNA, 16 bp, Homo sapiens
ggctccagagggcact

SEQ ID NO: 1941602 - DNA, 17 bp, Homo sapiens
ggctccctgactgggag

SEQ ID NO: 1941603 - DNA, 18 bp, Homo sapiens
ggctcgttgactggctgt

SEQ ID NO: 1941604 - DNA, 10 bp, Homo sapiens
ggctctggct

SEQ ID NO: 1941605 - DNA, 13 bp, Homo sapiens
ggctcttcctgga

SEQ ID NO: 1941606 - DNA, 12 bp, Homo sapiens
ggctcttctcct

SEQ ID NO: 1941607 - DNA, 15 bp, Homo sapiens
ggctgagggagcctg

SEQ ID NO: 1941608 - DNA, 18 bp, Homo sapiens
ggctgcaagctgcaggga

SEQ ID NO: 1941609 - DNA, 17 bp, Homo sapiens
ggctgcccacacacccc

SEQ ID NO: 1941610 - DNA, 23 bp, Homo sapiens
ggctgcccagcggctcttcctgg

SEQ ID NO: 1941611 - DNA, 15 bp, Homo sapiens
ggctgccctggtgct

SEQ ID NO: 1941612 - DNA, 19 bp, Homo sapiens
ggctgccgctgctctccca

SEQ ID NO: 1941613 - DNA, 21 bp, Homo sapiens
ggctgccgctgctctcccagg

SEQ ID NO: 1941614 - DNA, 16 bp, Homo sapiens
ggctgccttagaacct

SEQ ID NO: 1941615 - DNA, 20 bp, Homo sapiens
ggctgctggaaaggcccgga

SEQ ID NO: 1941616 - DNA, 22 bp, Homo sapiens
ggctggaccacgtctccctggc

SEQ ID NO: 1941617 - DNA, 13 bp, Homo sapiens
ggctggagtgggc

SEQ ID NO: 1941618 - DNA, 14 bp, Homo sapiens
ggctggagtgggct

SEQ ID NO: 1941619 - DNA, 20 bp, Homo sapiens
ggctggcggggtctgctcct

SEQ ID NO: 1941620 - DNA, 14 bp, Homo sapiens
ggctgggcagctgt

SEQ ID NO: 1941621 - DNA, 22 bp, Homo sapiens
ggctgggtttgggcagtggaga

SEQ ID NO: 1941622 - DNA, 19 bp, Homo sapiens
ggctgtccaatcacattca

SEQ ID NO: 1941623 - DNA, 12 bp, Homo sapiens
ggctgtggcccc

SEQ ID NO: 1941624 - DNA, 14 bp, Homo sapiens
ggctgtggcccctc

SEQ ID NO: 1941625 - DNA, 16 bp, Homo sapiens
ggctgtggcccctcct

SEQ ID NO: 1941626 - DNA, 20 bp, Homo sapiens
ggctgttttaacggcctgca

SEQ ID NO: 1941627 - DNA, 17 bp, Homo sapiens
ggcttccatggtggttt

SEQ ID NO: 1941628 - DNA, 22 bp, Homo sapiens
ggcttccatggtggtttcagaa

SEQ ID NO: 1941629 - DNA, 15 bp, Homo sapiens
ggcttcccgctcagc

SEQ ID NO: 1941630 - DNA, 16 bp, Homo sapiens
ggcttcccgctcagcc

SEQ ID NO: 1941631 - DNA, 18 bp, Homo sapiens
ggcttcccgctcagccct

SEQ ID NO: 1941632 - DNA, 16 bp, Homo sapiens
ggcttcctccctccac

SEQ ID NO: 1941633 - DNA, 15 bp, Homo sapiens
ggcttcggcctgctt

SEQ ID NO: 1941634 - DNA, 14 bp, Homo sapiens
ggcttctctctgtg

SEQ ID NO: 1941635 - DNA, 16 bp, Homo sapiens
ggcttggaagggcgct

SEQ ID NO: 1941636 - DNA, 15 bp, Homo sapiens
ggcttggggtagaga

SEQ ID NO: 1941637 - DNA, 18 bp, Homo sapiens
ggcttggggtagagagga

SEQ ID NO: 1941638 - DNA, 20 bp, Homo sapiens
ggcttggggtagagaggaca

SEQ ID NO: 1941639 - DNA, 18 bp, Homo sapiens
ggctttggctcgggactt

SEQ ID NO: 1941640 - DNA, 15 bp, Homo sapiens
ggcttttcactgctg

SEQ ID NO: 1941641 - DNA, 17 bp, Homo sapiens
ggcttttcactgctggc

SEQ ID NO: 1941642 - DNA, 19 bp, Homo sapiens
ggcttttcactgctggctg

SEQ ID NO: 1941643 - DNA, 18 bp, Homo sapiens
gggaaatccaactccagg

SEQ ID NO: 1941644 - DNA, 20 bp, Homo sapiens
gggaagctgagcccctccct

SEQ ID NO: 1941645 - DNA, 14 bp, Homo sapiens
gggaagtggcttaa

SEQ ID NO: 1941646 - DNA, 22 bp, Homo sapiens
tgctgttgtttaaaataaaagt

SEQ ID NO: 1941647 - DNA, 23 bp, Homo sapiens
tgctgttgtttaaaataaaagta

SEQ ID NO: 1941648 - DNA, 13 bp, Homo sapiens
tgcttcgggccct

SEQ ID NO: 1941649 - DNA, 15 bp, Homo sapiens
tgcttcgggcccttc

SEQ ID NO: 1941650 - DNA, 21 bp, Homo sapiens
tgcttgaaagaaaatatgcat

SEQ ID NO: 1941651 - DNA, 12 bp, Homo sapiens
tgcttgaggaaa

SEQ ID NO: 1941652 - DNA, 13 bp, Homo sapiens
tgcttgaggaaaa

SEQ ID NO: 1941653 - DNA, 14 bp, Homo sapiens
tgctttgggctgcc

SEQ ID NO: 1941654 - DNA, 18 bp, Homo sapiens
tgctttgggctgccctgg

SEQ ID NO: 1941655 - DNA, 21 bp, Homo sapiens
tgctttgggctgccctggtgc

SEQ ID NO: 1941656 - DNA, 15 bp, Homo sapiens
tggaaaaaaaaagaa

SEQ ID NO: 1941657 - DNA, 18 bp, Homo sapiens
tggaaaaagaaattctgt

SEQ ID NO: 1941658 - DNA, 13 bp, Homo sapiens
tggaaagggtgtg

SEQ ID NO: 1941659 - DNA, 22 bp, Homo sapiens
tggaaagggtgtggcttggaac

SEQ ID NO: 1941660 - DNA, 13 bp, Homo sapiens
tggaagaacatca

SEQ ID NO: 1941661 - DNA, 17 bp, Homo sapiens
tggaagaacatcaagat

SEQ ID NO: 1941662 - DNA, 21 bp, Homo sapiens
tggaagtgagggtcagagagg

SEQ ID NO: 1941663 - DNA, 21 bp, Homo sapiens
tggaagtgtgtgatctgtggg

SEQ ID NO: 1941664 - DNA, 15 bp, Homo sapiens
tggaatattgtccat

SEQ ID NO: 1941665 - DNA, 12 bp, Homo sapiens
tggaatttaaga

SEQ ID NO: 1941666 - DNA, 11 bp, Homo sapiens
tggacagtgag

SEQ ID NO: 1941667 - DNA, 18 bp, Homo sapiens
tggacatgaagattcttt

SEQ ID NO: 1941668 - DNA, 13 bp, Homo sapiens
tggacccttccat

SEQ ID NO: 1941669 - DNA, 14 bp, Homo sapiens
tggacctgaccaga

SEQ ID NO: 1941670 - DNA, 20 bp, Homo sapiens
tggactctcagtctctgagc

SEQ ID NO: 1941671 - DNA, 22 bp, Homo sapiens
tggactttggaaggaggtgcct

SEQ ID NO: 1941672 - DNA, 21 bp, Homo sapiens
tggagaagctccctgaagtaa

SEQ ID NO: 1941673 - DNA, 14 bp, Homo sapiens
tggagactgtctca

SEQ ID NO: 1941674 - DNA, 17 bp, Homo sapiens
tggagactgtctcaaga

SEQ ID NO: 1941675 - DNA, 13 bp, Homo sapiens
tggagaggagaga

SEQ ID NO: 1941676 - DNA, 13 bp, Homo sapiens
tggagagtagaca

SEQ ID NO: 1941677 - DNA, 17 bp, Homo sapiens
tggagatgacagaaata

SEQ ID NO: 1941678 - DNA, 20 bp, Homo sapiens
tggagattttgctaatacat

SEQ ID NO: 1941679 - DNA, 16 bp, Homo sapiens
tggagcagaggggctg

SEQ ID NO: 1941680 - DNA, 17 bp, Homo sapiens
tggagcagaggggctga

SEQ ID NO: 1941681 - DNA, 17 bp, Homo sapiens
tggagccaatggagact

SEQ ID NO: 1941682 - DNA, 15 bp, Homo sapiens
tggagccacaggcag

SEQ ID NO: 1941683 - DNA, 17 bp, Homo sapiens
tggagccgtggccgagg

SEQ ID NO: 1941684 - DNA, 20 bp, Homo sapiens
tggagcgtttttgctggctt

SEQ ID NO: 1941685 - DNA, 23 bp, Homo sapiens
tggaggaaaaccaagccgtggct

SEQ ID NO: 1941686 - DNA, 20 bp, Homo sapiens
tggagtctgaaggagaggag

SEQ ID NO: 1941687 - DNA, 21 bp, Homo sapiens
tggagtctgaaggagaggagt

SEQ ID NO: 1941688 - DNA, 18 bp, Homo sapiens
tggagtgccacatggccg

SEQ ID NO: 1941689 - DNA, 21 bp, Homo sapiens
tggagtgccacatggccgctg

SEQ ID NO: 1941690 - DNA, 21 bp, Homo sapiens
tggagtgccacgtggccgctg

SEQ ID NO: 1941691 - DNA, 22 bp, Homo sapiens
tggagtgtgtgggggtctggga

SEQ ID NO: 1941692 - DNA, 19 bp, Homo sapiens
tggagtgttccccttccac

SEQ ID NO: 1941693 - DNA, 22 bp, Homo sapiens
tggagtgttccccttccactga

SEQ ID NO: 1941694 - DNA, 19 bp, Homo sapiens
tggatcaagcttgtgtact

SEQ ID NO: 1941695 - DNA, 17 bp, Homo sapiens
tggattggtgtaaaagg

SEQ ID NO: 1941696 - DNA, 19 bp, Homo sapiens
tggcaatgccatcatctcc

SEQ ID NO: 1941697 - DNA, 18 bp, Homo sapiens
tggcacaccctctctgtc

SEQ ID NO: 1941698 - DNA, 18 bp, Homo sapiens
tggcacagggcagtggga

SEQ ID NO: 1941699 - DNA, 18 bp, Homo sapiens
tggcactgatgggcactg

SEQ ID NO: 1941700 - DNA, 19 bp, Homo sapiens
tggcactgatgggcactgg

SEQ ID NO: 1941701 - DNA, 16 bp, Homo sapiens
tggcagccgtgccttc

SEQ ID NO: 1941702 - DNA, 21 bp, Homo sapiens
tggcaggacactgcagaacag

SEQ ID NO: 1941703 - DNA, 13 bp, Homo sapiens
tggcaggagggtg

SEQ ID NO: 1941704 - DNA, 18 bp, Homo sapiens
tggcatctctggagtgtg

SEQ ID NO: 1941705 - DNA, 14 bp, Homo sapiens
tggccaaatatgca

SEQ ID NO: 1941706 - DNA, 18 bp, Homo sapiens
tggccaaatatgcacttt

SEQ ID NO: 1941707 - DNA, 20 bp, Homo sapiens
tggccactccagacccctgg

SEQ ID NO: 1941708 - DNA, 22 bp, Homo sapiens
tggccactccagacccctggct

SEQ ID NO: 1941709 - DNA, 18 bp, Homo sapiens
tggccactttgcagacct

SEQ ID NO: 1941710 - DNA, 22 bp, Homo sapiens
tggccactttgcagacctggga

SEQ ID NO: 1941711 - DNA, 14 bp, Homo sapiens
tggccaggagtggg

SEQ ID NO: 1941712 - DNA, 16 bp, Homo sapiens
tggccaggtggccact

SEQ ID NO: 1941713 - DNA, 20 bp, Homo sapiens
tggccattttgtaccagggc

SEQ ID NO: 1941714 - DNA, 22 bp, Homo sapiens
tggcccacccctcttccccctt

SEQ ID NO: 1941715 - DNA, 23 bp, Homo sapiens
tggcccacccctcttcccccttc

SEQ ID NO: 1941716 - DNA, 14 bp, Homo sapiens
tggcccagcctgga

SEQ ID NO: 1941717 - DNA, 19 bp, Homo sapiens
tggcccagcctggagccgt

SEQ ID NO: 1941718 - DNA, 13 bp, Homo sapiens
tggccccagtgac

SEQ ID NO: 1941719 - DNA, 23 bp, Homo sapiens
tggcccctccttctcccctccag

SEQ ID NO: 1941720 - DNA, 10 bp, Homo sapiens
tggcccctct

SEQ ID NO: 1941721 - DNA, 16 bp, Homo sapiens
tggcccgacagcctgg

SEQ ID NO: 1941722 - DNA, 17 bp, Homo sapiens
tggcccgacagcctggc

SEQ ID NO: 1941723 - DNA, 20 bp, Homo sapiens
tggccgcaacttcccaggcc

SEQ ID NO: 1941724 - DNA, 23 bp, Homo sapiens
tggccggcccacgtcctgggtgc

SEQ ID NO: 1941725 - DNA, 20 bp, Homo sapiens
tggcctagtggggaggggcc

SEQ ID NO: 1941726 - DNA, 14 bp, Homo sapiens
tggcctggtccagg

SEQ ID NO: 1941727 - DNA, 18 bp, Homo sapiens
tggccttggttcctccag

SEQ ID NO: 1941728 - DNA, 15 bp, Homo sapiens
tggctagtctgtgcc

SEQ ID NO: 1941729 - DNA, 14 bp, Homo sapiens
tggctcccacaggc

SEQ ID NO: 1941730 - DNA, 20 bp, Homo sapiens
tggctcccacaggcccttcc

SEQ ID NO: 1941731 - DNA, 14 bp, Homo sapiens
tggctcctcccggt

SEQ ID NO: 1941732 - DNA, 18 bp, Homo sapiens
tggctcctcccggtgccc

SEQ ID NO: 1941733 - DNA, 16 bp, Homo sapiens
tggctgcggcaccctt

SEQ ID NO: 1941734 - DNA, 17 bp, Homo sapiens
tggctgcggcacccttg

SEQ ID NO: 1941735 - DNA, 21 bp, Homo sapiens
tggctggagaggaaaagccag

SEQ ID NO: 1941736 - DNA, 20 bp, Homo sapiens
tggctgggtttgggcagtgg

SEQ ID NO: 1941737 - DNA, 22 bp, Homo sapiens
tggctgggtttgggcagtggag

SEQ ID NO: 1941738 - DNA, 23 bp, Homo sapiens
tggctgtggcccctccttctccc

SEQ ID NO: 1941739 - DNA, 20 bp, Homo sapiens
tggcttactacatgtgggag

SEQ ID NO: 1941740 - DNA, 23 bp, Homo sapiens
tggcttactacatgtgggagctt

SEQ ID NO: 1941741 - DNA, 22 bp, Homo sapiens
tggcttcaatctacgatgttaa

SEQ ID NO: 1941742 - DNA, 16 bp, Homo sapiens
tggcttcccgctcagc

SEQ ID NO: 1941743 - DNA, 20 bp, Homo sapiens
tggcttcccgctcagccctc

SEQ ID NO: 1941744 - DNA, 21 bp, Homo sapiens
tggcttcccgctcagccctcc

SEQ ID NO: 1941745 - DNA, 22 bp, Homo sapiens
tggcttgtagggtgaggcgtgg

SEQ ID NO: 1941746 - DNA, 15 bp, Homo sapiens
tggcttttcactgct

SEQ ID NO: 1941747 - DNA, 22 bp, Homo sapiens
tgggaaccccttcatcctctga

SEQ ID NO: 1941748 - DNA, 14 bp, Homo sapiens
tgggacggaagtgg

SEQ ID NO: 1941749 - DNA, 16 bp, Homo sapiens
tgggactggcccaccc

SEQ ID NO: 1941750 - DNA, 18 bp, Homo sapiens
tgggactggcccacccct

SEQ ID NO: 1941751 - DNA, 13 bp, Homo sapiens
tgggagagccaag

SEQ ID NO: 1941752 - DNA, 14 bp, Homo sapiens
tgggagaggaagcc

SEQ ID NO: 1941753 - DNA, 18 bp, Homo sapiens
tgggagaggagaggctgc

SEQ ID NO: 1941754 - DNA, 17 bp, Homo sapiens
tgggagatgcagctgga

SEQ ID NO: 1941755 - DNA, 16 bp, Homo sapiens
tgggagccacagggac

SEQ ID NO: 1941756 - DNA, 23 bp, Homo sapiens
tgggagccgggtctgcctcttct

SEQ ID NO: 1941757 - DNA, 14 bp, Homo sapiens
tgggagggcagcag

SEQ ID NO: 1941758 - DNA, 19 bp, Homo sapiens
tgggagggcagcagggcta

SEQ ID NO: 1941759 - DNA, 13 bp, Homo sapiens
tgggagtgggaga

SEQ ID NO: 1941760 - DNA, 23 bp, Homo sapiens
tgggcactgggccggcagcctgg

SEQ ID NO: 1941761 - DNA, 16 bp, Homo sapiens
tgggcagaggggagag

SEQ ID NO: 1941762 - DNA, 19 bp, Homo sapiens
tgggcagaggggagaggaa

SEQ ID NO: 1941763 - DNA, 22 bp, Homo sapiens
tgggcagaggggagaggaagca

SEQ ID NO: 1941764 - DNA, 23 bp, Homo sapiens
tgggcaggggttccagcttccct

SEQ ID NO: 1941765 - DNA, 13 bp, Homo sapiens
tgggcagtggaga

SEQ ID NO: 1941766 - DNA, 15 bp, Homo sapiens
tgggccaagccaggg

SEQ ID NO: 1941767 - DNA, 19 bp, Homo sapiens
tgggccactggcatctctg

SEQ ID NO: 1941768 - DNA, 18 bp, Homo sapiens
tgggccctctctgctctg

SEQ ID NO: 1941769 - DNA, 16 bp, Homo sapiens
tgggccggcagcctgg

SEQ ID NO: 1941770 - DNA, 17 bp, Homo sapiens
tgggccggcagcctggt

SEQ ID NO: 1941771 - DNA, 11 bp, Homo sapiens
tgggctccaga

SEQ ID NO: 1941772 - DNA, 14 bp, Homo sapiens
tgggctccagagta

SEQ ID NO: 1941773 - DNA, 15 bp, Homo sapiens
tgggctccctgactg

SEQ ID NO: 1941774 - DNA, 19 bp, Homo sapiens
tgggctctctggacctgac

SEQ ID NO: 1941775 - DNA, 16 bp, Homo sapiens
tgggctgagggagcct

SEQ ID NO: 1941776 - DNA, 13 bp, Homo sapiens
tgggctgccctgg

SEQ ID NO: 1941777 - DNA, 14 bp, Homo sapiens
tgggctgccctggt

SEQ ID NO: 1941778 - DNA, 15 bp, Homo sapiens
ttctgctcacattcc

SEQ ID NO: 1941779 - DNA, 17 bp, Homo sapiens
ttctgctcacattccct

SEQ ID NO: 1941780 - DNA, 18 bp, Homo sapiens
ttctgctcacattccctc

SEQ ID NO: 1941781 - DNA, 13 bp, Homo sapiens
ttctgctcatcat

SEQ ID NO: 1941782 - DNA, 14 bp, Homo sapiens
ttctgctcatcatt

SEQ ID NO: 1941783 - DNA, 21 bp, Homo sapiens
ttctgctcatcattctctgtc

SEQ ID NO: 1941784 - DNA, 15 bp, Homo sapiens
ttctggaatgtaatc

SEQ ID NO: 1941785 - DNA, 16 bp, Homo sapiens
ttctggggtggggctt

SEQ ID NO: 1941786 - DNA, 22 bp, Homo sapiens
ttctgtgcatttgtgtctgcct

SEQ ID NO: 1941787 - DNA, 24 bp, Homo sapiens
ttctgtgcatttgtgtctgcctgc

SEQ ID NO: 1941788 - DNA, 13 bp, Homo sapiens
ttctgtgtgaaga

SEQ ID NO: 1941789 - DNA, 23 bp, Homo sapiens
ttcttaagcactttgaaaatatt

SEQ ID NO: 1941790 - DNA, 21 bp, Homo sapiens
ttcttctaggttctaaaaatt

SEQ ID NO: 1941791 - DNA, 22 bp, Homo sapiens
ttgaaaaaatagagcctgaggg

SEQ ID NO: 1941792 - DNA, 16 bp, Homo sapiens
ttgaaatatgcatgta

SEQ ID NO: 1941793 - DNA, 16 bp, Homo sapiens
ttgaaatcaaatgttt

SEQ ID NO: 1941794 - DNA, 18 bp, Homo sapiens
ttgaaattaacctctcac

SEQ ID NO: 1941795 - DNA, 13 bp, Homo sapiens
ttgaatcacagta

SEQ ID NO: 1941796 - DNA, 23 bp, Homo sapiens
ttgaattacagggaagaaatcaa

SEQ ID NO: 1941797 - DNA, 18 bp, Homo sapiens
ttgaattgtaactgttct

SEQ ID NO: 1941798 - DNA, 20 bp, Homo sapiens
ttgacaaggtgtttctctgt

SEQ ID NO: 1941799 - DNA, 15 bp, Homo sapiens
ttgactataacaaaa

SEQ ID NO: 1941800 - DNA, 21 bp, Homo sapiens
ttgactcttttgccattaaac

SEQ ID NO: 1941801 - DNA, 18 bp, Homo sapiens
ttgagagcgctggcctct

SEQ ID NO: 1941802 - DNA, 23 bp, Homo sapiens
ttgagcaaggcaagaagtgggat

SEQ ID NO: 1941803 - DNA, 15 bp, Homo sapiens
ttgagccttttatta

SEQ ID NO: 1941804 - DNA, 17 bp, Homo sapiens
ttgaggaaaattaatat

SEQ ID NO: 1941805 - DNA, 17 bp, Homo sapiens
ttgaggaccctcccagg

SEQ ID NO: 1941806 - DNA, 15 bp, Homo sapiens
ttgaggctaaaacaa

SEQ ID NO: 1941807 - DNA, 14 bp, Homo sapiens
ttgagtctgtgcca

SEQ ID NO: 1941808 - DNA, 14 bp, Homo sapiens
ttgatgccagctgt

SEQ ID NO: 1941809 - DNA, 14 bp, Homo sapiens
ttgatggagatatt

SEQ ID NO: 1941810 - DNA, 23 bp, Homo sapiens
ttgatggtgatgaaatgtaaata

SEQ ID NO: 1941811 - DNA, 18 bp, Homo sapiens
ttgatgtgtatgtgttta

SEQ ID NO: 1941812 - DNA, 22 bp, Homo sapiens
ttgatgtgtatgtgtttataat

SEQ ID NO: 1941813 - DNA, 17 bp, Homo sapiens
ttgcaactggtatatat

SEQ ID NO: 1941814 - DNA, 21 bp, Homo sapiens
ttgcaactttagaaagaaatt

SEQ ID NO: 1941815 - DNA, 13 bp, Homo sapiens
ttgcaagggaaaa

SEQ ID NO: 1941816 - DNA, 19 bp, Homo sapiens
ttgcaagggaaaagtctct

SEQ ID NO: 1941817 - DNA, 22 bp, Homo sapiens
ttgcaagggaaaagtctcttgt

SEQ ID NO: 1941818 - DNA, 17 bp, Homo sapiens
ttgcagacctgggactt

SEQ ID NO: 1941819 - DNA, 23 bp, Homo sapiens
ttgcatagtaccaatcattttaa

SEQ ID NO: 1941820 - DNA, 20 bp, Homo sapiens
ttgcatctcccagataatgt

SEQ ID NO: 1941821 - DNA, 22 bp, Homo sapiens
ttgcatgttcttgttttgttat

SEQ ID NO: 1941822 - DNA, 14 bp, Homo sapiens
ttgcatttctttat

SEQ ID NO: 1941823 - DNA, 19 bp, Homo sapiens
ttgccacctctggccaaat

SEQ ID NO: 1941824 - DNA, 22 bp, Homo sapiens
ttgccacttggccaccaggact

SEQ ID NO: 1941825 - DNA, 16 bp, Homo sapiens
ttgccatttcttccca

SEQ ID NO: 1941826 - DNA, 17 bp, Homo sapiens
ttgccatttcttcccaa

SEQ ID NO: 1941827 - DNA, 17 bp, Homo sapiens
ttgccttctagacactg

SEQ ID NO: 1941828 - DNA, 12 bp, Homo sapiens
ttgcgatgtgtt

SEQ ID NO: 1941829 - DNA, 13 bp, Homo sapiens
ttgcgatgtgttt

SEQ ID NO: 1941830 - DNA, 16 bp, Homo sapiens
ttgcgtggatcaagct

SEQ ID NO: 1941831 - DNA, 11 bp, Homo sapiens
ttgctcctacc

SEQ ID NO: 1941832 - DNA, 16 bp, Homo sapiens
ttgctggcaaagacag

SEQ ID NO: 1941833 - DNA, 15 bp, Homo sapiens
ttgctggtcactgcc

SEQ ID NO: 1941834 - DNA, 22 bp, Homo sapiens
ttgctgttgttcagaagttgtt

SEQ ID NO: 1941835 - DNA, 16 bp, Homo sapiens
ttgctttgtatgcact

SEQ ID NO: 1941836 - DNA, 21 bp, Homo sapiens
ttggaagggcgctgagggcag

SEQ ID NO: 1941837 - DNA, 16 bp, Homo sapiens
ttggacccttccatgg

SEQ ID NO: 1941838 - DNA, 23 bp, Homo sapiens
ttggagtgccacgtggccgctgc

SEQ ID NO: 1941839 - DNA, 20 bp, Homo sapiens
ttggatttagagactgtaaa

SEQ ID NO: 1941840 - DNA, 16 bp, Homo sapiens
ttggcaattcttcttc

SEQ ID NO: 1941841 - DNA, 20 bp, Homo sapiens
ttggcaattcttcttctcaa

SEQ ID NO: 1941842 - DNA, 19 bp, Homo sapiens
ttggcacaccctctctgtc

SEQ ID NO: 1941843 - DNA, 14 bp, Homo sapiens
ttggcttgcacttt

SEQ ID NO: 1941844 - DNA, 20 bp, Homo sapiens
ttgggacggaagtggcctga

SEQ ID NO: 1941845 - DNA, 12 bp, Homo sapiens
ttgggggcagac

SEQ ID NO: 1941846 - DNA, 16 bp, Homo sapiens
ttggggtagagaggac

SEQ ID NO: 1941847 - DNA, 21 bp, Homo sapiens
ttggggtggggcgggaggcca

SEQ ID NO: 1941848 - DNA, 21 bp, Homo sapiens
ttggtgtgaatgctgtacctt

SEQ ID NO: 1941849 - DNA, 23 bp, Homo sapiens
ttggtgtgttcgtggagccacag

SEQ ID NO: 1941850 - DNA, 14 bp, Homo sapiens
ttgtaaatattctt

SEQ ID NO: 1941851 - DNA, 16 bp, Homo sapiens
ttgtaaatgtggtaaa

SEQ ID NO: 1941852 - DNA, 17 bp, Homo sapiens
ttgtaactttgcatgtt

SEQ ID NO: 1941853 - DNA, 13 bp, Homo sapiens
ttgtaaggacttg

SEQ ID NO: 1941854 - DNA, 16 bp, Homo sapiens
ttgtaaggacttgtgc

SEQ ID NO: 1941855 - DNA, 17 bp, Homo sapiens
ttgtacgtatgaatgat

SEQ ID NO: 1941856 - DNA, 19 bp, Homo sapiens
ttgtataggccatctgtaa

SEQ ID NO: 1941857 - DNA, 20 bp, Homo sapiens
ttgtataggccatctgtaaa

SEQ ID NO: 1941858 - DNA, 20 bp, Homo sapiens
ttgtatgatcctaatgaatg

SEQ ID NO: 1941859 - DNA, 20 bp, Homo sapiens
ttgtattctctgagctgtgc

SEQ ID NO: 1941860 - DNA, 23 bp, Homo sapiens
ttgtcaaggaatgttatcagtat

SEQ ID NO: 1941861 - DNA, 18 bp, Homo sapiens
ttgtcacaacactgaacc

SEQ ID NO: 1941862 - DNA, 21 bp, Homo sapiens
ttgtctggctgtggcccctcc

SEQ ID NO: 1941863 - DNA, 22 bp, Homo sapiens
ttgtctggctgtggcccctcct

SEQ ID NO: 1941864 - DNA, 11 bp, Homo sapiens
ttgtgaaagca

SEQ ID NO: 1941865 - DNA, 11 bp, Homo sapiens
ttgtgaaattt

SEQ ID NO: 1941866 - DNA, 16 bp, Homo sapiens
ttgtgaaatttgttaa

SEQ ID NO: 1941867 - DNA, 19 bp, Homo sapiens
ttgtgaaatttgttaatat

SEQ ID NO: 1941868 - DNA, 23 bp, Homo sapiens
ttgtgaaatttgttaatatatat

SEQ ID NO: 1941869 - DNA, 17 bp, Homo sapiens
ttgtgagtattctatgt

SEQ ID NO: 1941870 - DNA, 23 bp, Homo sapiens
ttgtgatcagaccataatgttac

SEQ ID NO: 1941871 - DNA, 13 bp, Homo sapiens
ttgtggagaggag

SEQ ID NO: 1941872 - DNA, 15 bp, Homo sapiens
ttgtggagaggagag

SEQ ID NO: 1941873 - DNA, 13 bp, Homo sapiens
ttgtggcctggga

SEQ ID NO: 1941874 - DNA, 15 bp, Homo sapiens
ttgtggctgtcagca

SEQ ID NO: 1941875 - DNA, 23 bp, Homo sapiens
ttgtgggggtgtcacagaggcag

SEQ ID NO: 1941876 - DNA, 14 bp, Homo sapiens
ttgtgtttgtatat

SEQ ID NO: 1941877 - DNA, 16 bp, Homo sapiens
ttgtgtttgtatataa

SEQ ID NO: 1941878 - DNA, 16 bp, Homo sapiens
ttgtgttttacagtat

SEQ ID NO: 1941879 - DNA, 13 bp, Homo sapiens
ttgttaggggtgg

SEQ ID NO: 1941880 - DNA, 16 bp, Homo sapiens
ttgttagtgatttgct

SEQ ID NO: 1941881 - DNA, 15 bp, Homo sapiens
ttgttattttgcaac

SEQ ID NO: 1941882 - DNA, 22 bp, Homo sapiens
ttgttattttgcaacctcgctg

SEQ ID NO: 1941883 - DNA, 17 bp, Homo sapiens
ttgtttatccttaagaa

SEQ ID NO: 1941884 - DNA, 16 bp, Homo sapiens
ttgtttcaattgcatc

SEQ ID NO: 1941885 - DNA, 20 bp, Homo sapiens
ttgttttgcacactttgcca

SEQ ID NO: 1941886 - DNA, 19 bp, Homo sapiens
ttgttttttttttccactt

SEQ ID NO: 1941887 - DNA, 20 bp, Homo sapiens
tttaaaaaaaaacattcaaa

SEQ ID NO: 1941888 - DNA, 21 bp, Homo sapiens
tttaaagtcttctttcatgta

SEQ ID NO: 1941889 - DNA, 20 bp, Homo sapiens
tttaaatacagtcttccatt

SEQ ID NO: 1941890 - DNA, 19 bp, Homo sapiens
tttaagcgaggcagaatgg

SEQ ID NO: 1941891 - DNA, 23 bp, Homo sapiens
tttaattattatttatatatgta

SEQ ID NO: 1941892 - DNA, 18 bp, Homo sapiens
tttaattttcctctaatt

SEQ ID NO: 1941893 - DNA, 16 bp, Homo sapiens
tttacactctttgtaa

SEQ ID NO: 1941894 - DNA, 14 bp, Homo sapiens
tttacagtatatct

SEQ ID NO: 1941895 - DNA, 23 bp, Homo sapiens
tttaccagcctccgtatttcaga

SEQ ID NO: 1941896 - DNA, 18 bp, Homo sapiens
tttactagggatccctca

SEQ ID NO: 1941897 - DNA, 15 bp, Homo sapiens
tttagaaatgatttc

SEQ ID NO: 1941898 - DNA, 20 bp, Homo sapiens
tttagagcagttaacatctg

SEQ ID NO: 1941899 - DNA, 22 bp, Homo sapiens
tttaggatttgtgttttacagt

SEQ ID NO: 1941900 - DNA, 22 bp, Homo sapiens
tttaggtcaagaagaagatgga

SEQ ID NO: 1941901 - DNA, 19 bp, Homo sapiens
tttaggtgtcttttaatga

SEQ ID NO: 1941902 - DNA, 20 bp, Homo sapiens
tttatattacttttgtaaat

SEQ ID NO: 1941903 - DNA, 13 bp, Homo sapiens
tttatattttcta

SEQ ID NO: 1941904 - DNA, 14 bp, Homo sapiens
tttatattttctat

SEQ ID NO: 1941905 - DNA, 20 bp, Homo sapiens
tttatattttctatatttgt

SEQ ID NO: 1941906 - DNA, 20 bp, Homo sapiens
tttattcacttgtgtttgta

SEQ ID NO: 1941907 - DNA, 12 bp, Homo sapiens
tttatttctgtc

SEQ ID NO: 1941908 - DNA, 17 bp, Homo sapiens
tttcaaagggagagaga

SEQ ID NO: 1941909 - DNA, 10 bp, Homo sapiens
aaaaaaagaa

SEQ ID NO: 1941910 - DNA, 16 bp, Homo sapiens
aaaaaatgtatatgca

SEQ ID NO: 1941911 - DNA, 17 bp, Homo sapiens
aaaaagaaattctgtta

SEQ ID NO: 1941912 - DNA, 12 bp, Homo sapiens
aaaaatataaag

SEQ ID NO: 1941913 - DNA, 14 bp, Homo sapiens
aaaaattgtgatca

SEQ ID NO: 1941914 - DNA, 13 bp, Homo sapiens
aaaacaatatatg

SEQ ID NO: 1941915 - DNA, 14 bp, Homo sapiens
aaaacaatatatgt

SEQ ID NO: 1941916 - DNA, 16 bp, Homo sapiens
aaaacacctaagtgac

SEQ ID NO: 1941917 - DNA, 13 bp, Homo sapiens
aaaaccaaagaat

SEQ ID NO: 1941918 - DNA, 15 bp, Homo sapiens
aaaaccagaattagg

SEQ ID NO: 1941919 - DNA, 21 bp, Homo sapiens
aaaacctctttccaaaggctg

SEQ ID NO: 1941920 - DNA, 12 bp, Homo sapiens
aaaagaaattct

SEQ ID NO: 1941921 - DNA, 19 bp, Homo sapiens
aaaagaagaaactattttt

SEQ ID NO: 1941922 - DNA, 16 bp, Homo sapiens
aaaagattaacaacac

SEQ ID NO: 1941923 - DNA, 10 bp, Homo sapiens
aaaagcccag

SEQ ID NO: 1941924 - DNA, 13 bp, Homo sapiens
aaaatatcttagg

SEQ ID NO: 1941925 - DNA, 16 bp, Homo sapiens
aaaatctattttgtct

SEQ ID NO: 1941926 - DNA, 17 bp, Homo sapiens
aaaatgtatatgcactt

SEQ ID NO: 1941927 - DNA, 18 bp, Homo sapiens
aaaatgtcttgtgttacc

SEQ ID NO: 1941928 - DNA, 12 bp, Homo sapiens
aaaatgtgcagt

SEQ ID NO: 1941929 - DNA, 14 bp, Homo sapiens
aaaattatttcaga

SEQ ID NO: 1941930 - DNA, 13 bp, Homo sapiens
aaaatttttttct

SEQ ID NO: 1941931 - DNA, 18 bp, Homo sapiens
aaaatttttttctttcga

SEQ ID NO: 1941932 - DNA, 12 bp, Homo sapiens
aaacaaatctca

SEQ ID NO: 1941933 - DNA, 22 bp, Homo sapiens
aaacaacaatttctactttgaa

SEQ ID NO: 1941934 - DNA, 17 bp, Homo sapiens
aaacaactctttgagaa

SEQ ID NO: 1941935 - DNA, 13 bp, Homo sapiens
aaacaagcgccac

SEQ ID NO: 1941936 - DNA, 15 bp, Homo sapiens
aaacacacacacaca

SEQ ID NO: 1941937 - DNA, 21 bp, Homo sapiens
aaacactttggccacagcccc

SEQ ID NO: 1941938 - DNA, 23 bp, Homo sapiens
aaacatggccacatccaacattt

SEQ ID NO: 1941939 - DNA, 23 bp, Homo sapiens
aaacattcaaaaacatggccaca

SEQ ID NO: 1941940 - DNA, 16 bp, Homo sapiens
aaaccaagccgtggct

SEQ ID NO: 1941941 - DNA, 18 bp, Homo sapiens
aaaccagaatgattttga

SEQ ID NO: 1941942 - DNA, 16 bp, Homo sapiens
aaaccaggctgcaggt

SEQ ID NO: 1941943 - DNA, 18 bp, Homo sapiens
aaaccattaccttaaaat

SEQ ID NO: 1941944 - DNA, 13 bp, Homo sapiens
aaaccttttgaaa

SEQ ID NO: 1941945 - DNA, 18 bp, Homo sapiens
aaactagggccaagccca

SEQ ID NO: 1941946 - DNA, 18 bp, Homo sapiens
aaactatgcacctataaa

SEQ ID NO: 1941947 - DNA, 18 bp, Homo sapiens
aaactattttttaaaaat

SEQ ID NO: 1941948 - DNA, 13 bp, Homo sapiens
aaactgagtcctg

SEQ ID NO: 1941949 - DNA, 12 bp, Homo sapiens
aaactgtgcacc

SEQ ID NO: 1941950 - DNA, 14 bp, Homo sapiens
aaagaaaatatgca

SEQ ID NO: 1941951 - DNA, 15 bp, Homo sapiens
aaagaaaatatgcat

SEQ ID NO: 1941952 - DNA, 16 bp, Homo sapiens
aaagaagaaactattt

SEQ ID NO: 1941953 - DNA, 21 bp, Homo sapiens
aaagaatagggagacaatcta

SEQ ID NO: 1941954 - DNA, 17 bp, Homo sapiens
aaagaatggaaggtgga

SEQ ID NO: 1941955 - DNA, 19 bp, Homo sapiens
aaagacacctactgagtgg

SEQ ID NO: 1941956 - DNA, 14 bp, Homo sapiens
aaagaggagccttt

SEQ ID NO: 1941957 - DNA, 22 bp, Homo sapiens
aaagaggagcctttccagaact

SEQ ID NO: 1941958 - DNA, 21 bp, Homo sapiens
aaagatacagaactctttcaa

SEQ ID NO: 1941959 - DNA, 15 bp, Homo sapiens
aaagattaacaacac

SEQ ID NO: 1941960 - DNA, 20 bp, Homo sapiens
aaagcagacagcaagggctt

SEQ ID NO: 1941961 - DNA, 21 bp, Homo sapiens
aaagccagcgtcctcctctgt

SEQ ID NO: 1941962 - DNA, 14 bp, Homo sapiens
aaagccatattcca

SEQ ID NO: 1941963 - DNA, 20 bp, Homo sapiens
aaagccatattccagcagtg

SEQ ID NO: 1941964 - DNA, 17 bp, Homo sapiens
aaaggaatcatttctat

SEQ ID NO: 1941965 - DNA, 15 bp, Homo sapiens
aaaggcagagattgg

SEQ ID NO: 1941966 - DNA, 17 bp, Homo sapiens
aaagggcagcccctccc

SEQ ID NO: 1941967 - DNA, 14 bp, Homo sapiens
aaaggtgattttcc

SEQ ID NO: 1941968 - DNA, 12 bp, Homo sapiens
aaagtctcttgt

SEQ ID NO: 1941969 - DNA, 18 bp, Homo sapiens
aaagtcttctttcatgta

SEQ ID NO: 1941970 - DNA, 19 bp, Homo sapiens
aaagtggaaaacaaggaag

SEQ ID NO: 1941971 - DNA, 14 bp, Homo sapiens
aaagttctgtactc

SEQ ID NO: 1941972 - DNA, 12 bp, Homo sapiens
aaagttgtttaa

SEQ ID NO: 1941973 - DNA, 20 bp, Homo sapiens
aaataaagcttgcaacaaaa

SEQ ID NO: 1941974 - DNA, 16 bp, Homo sapiens
aaataaatccaagact

SEQ ID NO: 1941975 - DNA, 22 bp, Homo sapiens
aaataacttgtgttactaattt

SEQ ID NO: 1941976 - DNA, 21 bp, Homo sapiens
aaataccaaaattatttcaga

SEQ ID NO: 1941977 - DNA, 13 bp, Homo sapiens
aaataccagagca

SEQ ID NO: 1941978 - DNA, 22 bp, Homo sapiens
aaatactgtttttaacaactat

SEQ ID NO: 1941979 - DNA, 21 bp, Homo sapiens
aaatatatttaagataattat

SEQ ID NO: 1941980 - DNA, 22 bp, Homo sapiens
aaatatatttaagataattata

SEQ ID NO: 1941981 - DNA, 21 bp, Homo sapiens
aaatatcccagagaacaatca

SEQ ID NO: 1941982 - DNA, 13 bp, Homo sapiens
aaatatgaaattt

SEQ ID NO: 1941983 - DNA, 14 bp, Homo sapiens
aaatatgcactttc

SEQ ID NO: 1941984 - DNA, 20 bp, Homo sapiens
aaatatgcactttccctaga

SEQ ID NO: 1941985 - DNA, 21 bp, Homo sapiens
aaatatgcactttccctagaa

SEQ ID NO: 1941986 - DNA, 16 bp, Homo sapiens
aaatatgcatgtactt

SEQ ID NO: 1941987 - DNA, 17 bp, Homo sapiens
aaatatgcatgtacttt

SEQ ID NO: 1941988 - DNA, 16 bp, Homo sapiens
aaatatgttgatgaaa

SEQ ID NO: 1941989 - DNA, 19 bp, Homo sapiens
aaatatttaaaaaaaaaca

SEQ ID NO: 1941990 - DNA, 20 bp, Homo sapiens
taagtggctgtgattaatta

SEQ ID NO: 1941991 - DNA, 12 bp, Homo sapiens
taataaaaccaa

SEQ ID NO: 1941992 - DNA, 15 bp, Homo sapiens
taataatattttaga

SEQ ID NO: 1941993 - DNA, 16 bp, Homo sapiens
taatataactgcctta

SEQ ID NO: 1941994 - DNA, 21 bp, Homo sapiens
taatataactgccttaaaact

SEQ ID NO: 1941995 - DNA, 14 bp, Homo sapiens
taatatttaaaata

SEQ ID NO: 1941996 - DNA, 18 bp, Homo sapiens
taatcaatgtttcttcta

SEQ ID NO: 1941997 - DNA, 19 bp, Homo sapiens
taatcacttaacctgcttt

SEQ ID NO: 1941998 - DNA, 22 bp, Homo sapiens
taatcttgaattgtaactgttc

SEQ ID NO: 1941999 - DNA, 16 bp, Homo sapiens
taatgacccggccccc

SEQ ID NO: 1942000 - DNA, 19 bp, Homo sapiens
taatgacgtattgtgaaat

SEQ ID NO: 1942001 - DNA, 23 bp, Homo sapiens
taatgatgtcgtttgaatcacag

SEQ ID NO: 1942002 - DNA, 21 bp, Homo sapiens
taatgtgaaaatggtccagga

SEQ ID NO: 1942003 - DNA, 14 bp, Homo sapiens
taatgttgttattt

SEQ ID NO: 1942004 - DNA, 17 bp, Homo sapiens
taattaaaatgtgcagt

SEQ ID NO: 1942005 - DNA, 19 bp, Homo sapiens
taattaaaatgtgcagtat

SEQ ID NO: 1942006 - DNA, 14 bp, Homo sapiens
taattattattctt

SEQ ID NO: 1942007 - DNA, 13 bp, Homo sapiens
taattattattta

SEQ ID NO: 1942008 - DNA, 22 bp, Homo sapiens
taattattatttatatatgtat

SEQ ID NO: 1942009 - DNA, 14 bp, Homo sapiens
taattcaattaaaa

SEQ ID NO: 1942010 - DNA, 18 bp, Homo sapiens
taattcaattaaaaccat

SEQ ID NO: 1942011 - DNA, 18 bp, Homo sapiens
taattctaaatgaatgtt

SEQ ID NO: 1942012 - DNA, 19 bp, Homo sapiens
taattgtcaaaaaccagaa

SEQ ID NO: 1942013 - DNA, 15 bp, Homo sapiens
taattgttatacatt

SEQ ID NO: 1942014 - DNA, 22 bp, Homo sapiens
taattttcctctaattaaaatg

SEQ ID NO: 1942015 - DNA, 14 bp, Homo sapiens
taattttgtacgta

SEQ ID NO: 1942016 - DNA, 18 bp, Homo sapiens
taattttttagttaaaat

SEQ ID NO: 1942017 - DNA, 19 bp, Homo sapiens
taattttttagttaaaatc

SEQ ID NO: 1942018 - DNA, 17 bp, Homo sapiens
tacaaataaatccaaga

SEQ ID NO: 1942019 - DNA, 15 bp, Homo sapiens
tacaccgggcctgga

SEQ ID NO: 1942020 - DNA, 17 bp, Homo sapiens
tacagaactctttcaaa

SEQ ID NO: 1942021 - DNA, 19 bp, Homo sapiens
tacagaagaagctcctgaa

SEQ ID NO: 1942022 - DNA, 16 bp, Homo sapiens
tacagagcttccctga

SEQ ID NO: 1942023 - DNA, 16 bp, Homo sapiens
tacagctaatcagcat

SEQ ID NO: 1942024 - DNA, 15 bp, Homo sapiens
tacagctatttctca

SEQ ID NO: 1942025 - DNA, 16 bp, Homo sapiens
tacagggaagaaatca

SEQ ID NO: 1942026 - DNA, 13 bp, Homo sapiens
tacagtaggagcc

SEQ ID NO: 1942027 - DNA, 14 bp, Homo sapiens
tacagtatatctta

SEQ ID NO: 1942028 - DNA, 19 bp, Homo sapiens
tacagtcttccatttgcaa

SEQ ID NO: 1942029 - DNA, 16 bp, Homo sapiens
tacagtgtatctcgaa

SEQ ID NO: 1942030 - DNA, 13 bp, Homo sapiens
tacatacattgta

SEQ ID NO: 1942031 - DNA, 18 bp, Homo sapiens
tacatgaattgcatttta

SEQ ID NO: 1942032 - DNA, 16 bp, Homo sapiens
tacatggtagcagggt

SEQ ID NO: 1942033 - DNA, 20 bp, Homo sapiens
tacattagcagtttgctttg

SEQ ID NO: 1942034 - DNA, 23 bp, Homo sapiens
tacattgtataggccatctgtaa

SEQ ID NO: 1942035 - DNA, 13 bp, Homo sapiens
taccaaaatgaag

SEQ ID NO: 1942036 - DNA, 21 bp, Homo sapiens
taccacttatttctaaatcct

SEQ ID NO: 1942037 - DNA, 21 bp, Homo sapiens
taccagcctccgtatttcaga

SEQ ID NO: 1942038 - DNA, 13 bp, Homo sapiens
taccagcgaggag

SEQ ID NO: 1942039 - DNA, 20 bp, Homo sapiens
taccagcgaggaggctccag

SEQ ID NO: 1942040 - DNA, 19 bp, Homo sapiens
taccaggggttccccagga

SEQ ID NO: 1942041 - DNA, 20 bp, Homo sapiens
taccaggggttccccaggag

SEQ ID NO: 1942042 - DNA, 14 bp, Homo sapiens
taccattttgcgat

SEQ ID NO: 1942043 - DNA, 23 bp, Homo sapiens
tacccctttggcacaccctctct

SEQ ID NO: 1942044 - DNA, 11 bp, Homo sapiens
taccctccctg

SEQ ID NO: 1942045 - DNA, 17 bp, Homo sapiens
taccctccctgtcccct

SEQ ID NO: 1942046 - DNA, 12 bp, Homo sapiens
taccctttccca

SEQ ID NO: 1942047 - DNA, 16 bp, Homo sapiens
taccgagtatctgtaa

SEQ ID NO: 1942048 - DNA, 20 bp, Homo sapiens
tacctaattagagcagatga

SEQ ID NO: 1942049 - DNA, 21 bp, Homo sapiens
tacctttctgacaataaataa

SEQ ID NO: 1942050 - DNA, 15 bp, Homo sapiens
tacctttgcgtggat

SEQ ID NO: 1942051 - DNA, 21 bp, Homo sapiens
tacctttgcgtggatcaagct

SEQ ID NO: 1942052 - DNA, 24 bp, Homo sapiens
tacgctccatcgctgtcatctcag

SEQ ID NO: 1942053 - DNA, 18 bp, Homo sapiens
tactaagatgaaattgcc

SEQ ID NO: 1942054 - DNA, 19 bp, Homo sapiens
tactaagatgaaattgcca

SEQ ID NO: 1942055 - DNA, 20 bp, Homo sapiens
tactaagatgaaattgccaa

SEQ ID NO: 1942056 - DNA, 21 bp, Homo sapiens
tactagggatccctcatctgt

SEQ ID NO: 1942057 - DNA, 17 bp, Homo sapiens
tactatcttttcatctc

SEQ ID NO: 1942058 - DNA, 17 bp, Homo sapiens
tactgtattttgtattg

SEQ ID NO: 1942059 - DNA, 18 bp, Homo sapiens
tactttgaagtcatacca

SEQ ID NO: 1942060 - DNA, 23 bp, Homo sapiens
tactttgatattttcaacgcagc

SEQ ID NO: 1942061 - DNA, 19 bp, Homo sapiens
tactttgtcttgatcctca

SEQ ID NO: 1942062 - DNA, 16 bp, Homo sapiens
tacttttctgcaatgt

SEQ ID NO: 1942063 - DNA, 15 bp, Homo sapiens
tacttttgccctttg

SEQ ID NO: 1942064 - DNA, 12 bp, Homo sapiens
tacttttgtaaa

SEQ ID NO: 1942065 - DNA, 14 bp, Homo sapiens
tacttttgtaaata

SEQ ID NO: 1942066 - DNA, 19 bp, Homo sapiens
tagaaaatgtttggaattt

SEQ ID NO: 1942067 - DNA, 15 bp, Homo sapiens
tagaaacttccaaat

SEQ ID NO: 1942068 - DNA, 22 bp, Homo sapiens
tagaaagccaaatcaaaatatg

SEQ ID NO: 1942069 - DNA, 18 bp, Homo sapiens
tagaaagccatattccag

SEQ ID NO: 1942070 - DNA, 23 bp, Homo sapiens
tagaaccaggcaacttgggaact

SEQ ID NO: 1942071 - DNA, 22 bp, Homo sapiens
tagaagagggagaaggagaggc

SEQ ID NO: 1942072 - DNA, 15 bp, Homo sapiens
tagaaggagacagag

SEQ ID NO: 1942073 - DNA, 15 bp, Homo sapiens
tagaatataaacaca

SEQ ID NO: 1942074 - DNA, 18 bp, Homo sapiens
tagaatataaacacataa

SEQ ID NO: 1942075 - DNA, 13 bp, Homo sapiens
tagaatggggctt

SEQ ID NO: 1942076 - DNA, 16 bp, Homo sapiens
tagacactgaaggcaa

SEQ ID NO: 1942077 - DNA, 22 bp, Homo sapiens
tagacagtattgccacctctgg

SEQ ID NO: 1942078 - DNA, 18 bp, Homo sapiens
tagagattacctcctgag

SEQ ID NO: 1942079 - DNA, 14 bp, Homo sapiens
tagagattcttagc

SEQ ID NO: 1942080 - DNA, 15 bp, Homo sapiens
tagagatttcatagc

SEQ ID NO: 1942081 - DNA, 17 bp, Homo sapiens
tagaggggacaagccag

SEQ ID NO: 1942082 - DNA, 16 bp, Homo sapiens
tagaggtgagggaagc

SEQ ID NO: 1942083 - DNA, 19 bp, Homo sapiens
tagagtggtctatttctcc

SEQ ID NO: 1942084 - DNA, 20 bp, Homo sapiens
tagattagatcttttaagcc

SEQ ID NO: 1942085 - DNA, 22 bp, Homo sapiens
tagcagggtctttgtgtgctgt

SEQ ID NO: 1942086 - DNA, 16 bp, Homo sapiens
taggaagtaaattata

SEQ ID NO: 1942087 - DNA, 15 bp, Homo sapiens
taggagcttccagat

SEQ ID NO: 1942088 - DNA, 17 bp, Homo sapiens
taggccatctgtaaata

SEQ ID NO: 1942089 - DNA, 14 bp, Homo sapiens
tagggaagggcctg

SEQ ID NO: 1942090 - DNA, 18 bp, Homo sapiens
tagggtacagcccaggcg

SEQ ID NO: 1942091 - DNA, 16 bp, Homo sapiens
tagggtctgtcccggg

SEQ ID NO: 1942092 - DNA, 16 bp, Homo sapiens
taggtcaagaagaaga

SEQ ID NO: 1942093 - DNA, 14 bp, Homo sapiens
taggtctccacccc

SEQ ID NO: 1942094 - DNA, 15 bp, Homo sapiens
taggtctccacccct

SEQ ID NO: 1942095 - DNA, 23 bp, Homo sapiens
taggtgcccagtcttgagtgggc

SEQ ID NO: 1942096 - DNA, 16 bp, Homo sapiens
taggtgggtcttggat

SEQ ID NO: 1942097 - DNA, 18 bp, Homo sapiens
taggttgaggacaggaga

SEQ ID NO: 1942098 - DNA, 16 bp, Homo sapiens
tagtaccaatcatttt

SEQ ID NO: 1942099 - DNA, 23 bp, Homo sapiens
tagtaccaatcattttaattatt

SEQ ID NO: 1942100 - DNA, 15 bp, Homo sapiens
tagtcttcaagcaga

SEQ ID NO: 1942101 - DNA, 13 bp, Homo sapiens
tagtgatggttcc

SEQ ID NO: 1942102 - DNA, 14 bp, Homo sapiens
tagtgatggttccc

SEQ ID NO: 1942103 - DNA, 13 bp, Homo sapiens
tagtgatttgcta

SEQ ID NO: 1942104 - DNA, 14 bp, Homo sapiens
tagtgccatggcca

SEQ ID NO: 1942105 - DNA, 20 bp, Homo sapiens
tagtgtttgggtatattcat

SEQ ID NO: 1942106 - DNA, 14 bp, Homo sapiens
tagttactcattca

SEQ ID NO: 1942107 - DNA, 15 bp, Homo sapiens
tagttttacactcta

SEQ ID NO: 1942108 - DNA, 23 bp, Homo sapiens
tagttttcatacacagcctgggc

SEQ ID NO: 1942109 - DNA, 22 bp, Homo sapiens
tataaaaaaattgtaaatgttt

SEQ ID NO: 1942110 - DNA, 14 bp, Homo sapiens
tataaaggaaacac

SEQ ID NO: 1942111 - DNA, 13 bp, Homo sapiens
tataaagttatta

SEQ ID NO: 1942112 - DNA, 15 bp, Homo sapiens
tataaatatatttaa

SEQ ID NO: 1942113 - DNA, 12 bp, Homo sapiens
tataaatatcta

SEQ ID NO: 1942114 - DNA, 22 bp, Homo sapiens
tataaatggtgagaattaaaat

SEQ ID NO: 1942115 - DNA, 14 bp, Homo sapiens
tataataaaaccaa

SEQ ID NO: 1942116 - DNA, 17 bp, Homo sapiens
tataatacttaaaaata

SEQ ID NO: 1942117 - DNA, 12 bp, Homo sapiens
tataattgttat

SEQ ID NO: 1942118 - DNA, 20 bp, Homo sapiens
tatacaatgagtaaaatcac

SEQ ID NO: 1942119 - DNA, 13 bp, Homo sapiens
tataccacctgta

SEQ ID NO: 1942120 - DNA, 17 bp, Homo sapiens
tataccacctgtacata

SEQ ID NO: 1942121 - DNA, 13 bp, Homo sapiens
tatagtgatgtaa

SEQ ID NO: 1942122 - DNA, 22 bp, Homo sapiens
tatagtgtataccacctgtaca

SEQ ID NO: 1942123 - DNA, 12 bp, Homo sapiens
tcactgctggct

SEQ ID NO: 1942124 - DNA, 15 bp, Homo sapiens
tcactgctggctgcc

SEQ ID NO: 1942125 - DNA, 22 bp, Homo sapiens
tcactgctggctgccttagaac

SEQ ID NO: 1942126 - DNA, 18 bp, Homo sapiens
tcactgctgtccctcctg

SEQ ID NO: 1942127 - DNA, 20 bp, Homo sapiens
tcactgctgtccctcctgag

SEQ ID NO: 1942128 - DNA, 17 bp, Homo sapiens
tcacttgtgcagtgttg

SEQ ID NO: 1942129 - DNA, 20 bp, Homo sapiens
tcacttgtgtttgtatataa

SEQ ID NO: 1942130 - DNA, 20 bp, Homo sapiens
tcagaaagggcagcccctcc

SEQ ID NO: 1942131 - DNA, 18 bp, Homo sapiens
tcagaaatgtacaacttt

SEQ ID NO: 1942132 - DNA, 12 bp, Homo sapiens
tcagaataaatg

SEQ ID NO: 1942133 - DNA, 15 bp, Homo sapiens
tcagaccttcttcca

SEQ ID NO: 1942134 - DNA, 17 bp, Homo sapiens
tcagacgcctgaggaac

SEQ ID NO: 1942135 - DNA, 20 bp, Homo sapiens
tcagagaggagtcagagaga

SEQ ID NO: 1942136 - DNA, 22 bp, Homo sapiens
tcagaggccctcgctgccagct

SEQ ID NO: 1942137 - DNA, 21 bp, Homo sapiens
tcagagtggccaatccctgtg

SEQ ID NO: 1942138 - DNA, 12 bp, Homo sapiens
tcagcagtgatt

SEQ ID NO: 1942139 - DNA, 17 bp, Homo sapiens
tcagcattctcactcct

SEQ ID NO: 1942140 - DNA, 16 bp, Homo sapiens
tcagctccttcctgga

SEQ ID NO: 1942141 - DNA, 22 bp, Homo sapiens
tcaggaaaggaatcatttctat

SEQ ID NO: 1942142 - DNA, 16 bp, Homo sapiens
tcaggaatgggccaag

SEQ ID NO: 1942143 - DNA, 17 bp, Homo sapiens
tcaggacagctgcttct

SEQ ID NO: 1942144 - DNA, 19 bp, Homo sapiens
tcaggacagctgcttctgt

SEQ ID NO: 1942145 - DNA, 16 bp, Homo sapiens
tcaggacccagaggaa

SEQ ID NO: 1942146 - DNA, 22 bp, Homo sapiens
tcaggcatgcgaatgagctggg

SEQ ID NO: 1942147 - DNA, 17 bp, Homo sapiens
tcaggccacggcagcct

SEQ ID NO: 1942148 - DNA, 16 bp, Homo sapiens
tcaggctgcccagcgg

SEQ ID NO: 1942149 - DNA, 16 bp, Homo sapiens
tcaggtcagagcccag

SEQ ID NO: 1942150 - DNA, 19 bp, Homo sapiens
tcaggtcagagcccaggaa

SEQ ID NO: 1942151 - DNA, 22 bp, Homo sapiens
tcaggttgtctgaagtcactgc

SEQ ID NO: 1942152 - DNA, 14 bp, Homo sapiens
tcagtcagcccagt

SEQ ID NO: 1942153 - DNA, 15 bp, Homo sapiens
tcagtctctgagcag

SEQ ID NO: 1942154 - DNA, 20 bp, Homo sapiens
tcagtctctgagcagtgaat

SEQ ID NO: 1942155 - DNA, 17 bp, Homo sapiens
tcagtgaagcccaggag

SEQ ID NO: 1942156 - DNA, 18 bp, Homo sapiens
tcagtgaagcccaggagg

SEQ ID NO: 1942157 - DNA, 12 bp, Homo sapiens
tcagtgatggga

SEQ ID NO: 1942158 - DNA, 13 bp, Homo sapiens
tcagtgtgccacc

SEQ ID NO: 1942159 - DNA, 17 bp, Homo sapiens
tcagttttatcattttc

SEQ ID NO: 1942160 - DNA, 15 bp, Homo sapiens
tcataagtatttcaa

SEQ ID NO: 1942161 - DNA, 23 bp, Homo sapiens
tcataattgtcaaaaaccagaat

SEQ ID NO: 1942162 - DNA, 15 bp, Homo sapiens
tcatagtttctgtaa

SEQ ID NO: 1942163 - DNA, 22 bp, Homo sapiens
tcatatatatgcatacgtaaaa

SEQ ID NO: 1942164 - DNA, 21 bp, Homo sapiens
tcatatgtaccatgtacatga

SEQ ID NO: 1942165 - DNA, 13 bp, Homo sapiens
tcatcattctctg

SEQ ID NO: 1942166 - DNA, 18 bp, Homo sapiens
tcatccacagaggccagg

SEQ ID NO: 1942167 - DNA, 19 bp, Homo sapiens
tcatccaggtcctttcctt

SEQ ID NO: 1942168 - DNA, 16 bp, Homo sapiens
tcatccatcatcatgt

SEQ ID NO: 1942169 - DNA, 22 bp, Homo sapiens
tcatctcctgccttcctcctgg

SEQ ID NO: 1942170 - DNA, 12 bp, Homo sapiens
tcatctgtccct

SEQ ID NO: 1942171 - DNA, 17 bp, Homo sapiens
tcatctgtccctccggg

SEQ ID NO: 1942172 - DNA, 18 bp, Homo sapiens
tcatctgtccctccggga

SEQ ID NO: 1942173 - DNA, 16 bp, Homo sapiens
tcatcttcttcaccat

SEQ ID NO: 1942174 - DNA, 17 bp, Homo sapiens
tcatgatttcatttcaa

SEQ ID NO: 1942175 - DNA, 23 bp, Homo sapiens
tcatgatttcatttcaactgttt

SEQ ID NO: 1942176 - DNA, 15 bp, Homo sapiens
tcatgatttgcaact

SEQ ID NO: 1942177 - DNA, 16 bp, Homo sapiens
tcatgatttgcaactt

SEQ ID NO: 1942178 - DNA, 14 bp, Homo sapiens
tcatgcccagcttg

SEQ ID NO: 1942179 - DNA, 16 bp, Homo sapiens
tcatgtaaactgtgca

SEQ ID NO: 1942180 - DNA, 17 bp, Homo sapiens
tcatgtaagtagcaaac

SEQ ID NO: 1942181 - DNA, 15 bp, Homo sapiens
tcatgttgaagtcaa

SEQ ID NO: 1942182 - DNA, 18 bp, Homo sapiens
tcattaattcaattaaaa

SEQ ID NO: 1942183 - DNA, 15 bp, Homo sapiens
tcattctctgtctca

SEQ ID NO: 1942184 - DNA, 19 bp, Homo sapiens
tcatttatctggattttta

SEQ ID NO: 1942185 - DNA, 13 bp, Homo sapiens
tcatttctatttc

SEQ ID NO: 1942186 - DNA, 17 bp, Homo sapiens
tcatttctatttctcct

SEQ ID NO: 1942187 - DNA, 12 bp, Homo sapiens
tcattttgcaac

SEQ ID NO: 1942188 - DNA, 14 bp, Homo sapiens
tcattttgcaactt

SEQ ID NO: 1942189 - DNA, 15 bp, Homo sapiens
tccaaattgatgggt

SEQ ID NO: 1942190 - DNA, 19 bp, Homo sapiens
tccaaattgatgggtgggc

SEQ ID NO: 1942191 - DNA, 12 bp, Homo sapiens
tccaagcctggg

SEQ ID NO: 1942192 - DNA, 13 bp, Homo sapiens
tccaagcctgggc

SEQ ID NO: 1942193 - DNA, 19 bp, Homo sapiens
tccaagcctgggccactgg

SEQ ID NO: 1942194 - DNA, 18 bp, Homo sapiens
tccaatgtgcccagtcat

SEQ ID NO: 1942195 - DNA, 19 bp, Homo sapiens
tccaatgtgcccagtcatg

SEQ ID NO: 1942196 - DNA, 20 bp, Homo sapiens
tccaatgtgcccagtcatga

SEQ ID NO: 1942197 - DNA, 13 bp, Homo sapiens
tccacacaagaca

SEQ ID NO: 1942198 - DNA, 15 bp, Homo sapiens
tccacagaggccagg

SEQ ID NO: 1942199 - DNA, 12 bp, Homo sapiens
tccacatcctcc

SEQ ID NO: 1942200 - DNA, 15 bp, Homo sapiens
tccaccaaattctga

SEQ ID NO: 1942201 - DNA, 17 bp, Homo sapiens
tccacgactgtctccat

SEQ ID NO: 1942202 - DNA, 22 bp, Homo sapiens
tccacgcttagggtctgtcccg

SEQ ID NO: 1942203 - DNA, 20 bp, Homo sapiens
tccacggagccactcctctg

SEQ ID NO: 1942204 - DNA, 17 bp, Homo sapiens
tccacgttcacccctcc

SEQ ID NO: 1942205 - DNA, 21 bp, Homo sapiens
tccactaccctccctcgcatc

SEQ ID NO: 1942206 - DNA, 17 bp, Homo sapiens
tccactaggtgcccagt

SEQ ID NO: 1942207 - DNA, 14 bp, Homo sapiens
tccactcccctcat

SEQ ID NO: 1942208 - DNA, 15 bp, Homo sapiens
tccactgagggcagt

SEQ ID NO: 1942209 - DNA, 15 bp, Homo sapiens
tccactgccttcgat

SEQ ID NO: 1942210 - DNA, 23 bp, Homo sapiens
tccacttagaaattgcatttcct

SEQ ID NO: 1942211 - DNA, 22 bp, Homo sapiens
tccagacagagtggatctggag

SEQ ID NO: 1942212 - DNA, 9 bp, Homo sapiens
tccagaccc

SEQ ID NO: 1942213 - DNA, 11 bp, Homo sapiens
tccagacccct

SEQ ID NO: 1942214 - DNA, 14 bp, Homo sapiens
tccagacccctacc

SEQ ID NO: 1942215 - DNA, 20 bp, Homo sapiens
tccagacccctaccctttcc

SEQ ID NO: 1942216 - DNA, 23 bp, Homo sapiens
tccagacccctggcttttcactg

SEQ ID NO: 1942217 - DNA, 10 bp, Homo sapiens
tccagagaga

SEQ ID NO: 1942218 - DNA, 18 bp, Homo sapiens
tccagagagaagcacccc

SEQ ID NO: 1942219 - DNA, 21 bp, Homo sapiens
tccagagagaagcaccccacc

SEQ ID NO: 1942220 - DNA, 22 bp, Homo sapiens
tccagagagaagcaccccacca

SEQ ID NO: 1942221 - DNA, 17 bp, Homo sapiens
tccagagagtggctcct

SEQ ID NO: 1942222 - DNA, 12 bp, Homo sapiens
tccagagggcac

SEQ ID NO: 1942223 - DNA, 17 bp, Homo sapiens
tccagataaaaacaata

SEQ ID NO: 1942224 - DNA, 18 bp, Homo sapiens
tccagccacccagccagg

SEQ ID NO: 1942225 - DNA, 19 bp, Homo sapiens
tccagccacccagccagga

SEQ ID NO: 1942226 - DNA, 15 bp, Homo sapiens
tccagccattcctga

SEQ ID NO: 1942227 - DNA, 19 bp, Homo sapiens
tccagctgggttggaaaac

SEQ ID NO: 1942228 - DNA, 16 bp, Homo sapiens
tccaggagaaggccaa

SEQ ID NO: 1942229 - DNA, 23 bp, Homo sapiens
tccaggagaaggccaattcctat

SEQ ID NO: 1942230 - DNA, 16 bp, Homo sapiens
tccaggtcctttcctt

SEQ ID NO: 1942231 - DNA, 22 bp, Homo sapiens
tccagttaaaaaaaattttaat

SEQ ID NO: 1942232 - DNA, 18 bp, Homo sapiens
tccatgggagaaaataga

SEQ ID NO: 1942233 - DNA, 16 bp, Homo sapiens
tccatgggcagagccc

SEQ ID NO: 1942234 - DNA, 18 bp, Homo sapiens
tccatggtggtttcagaa

SEQ ID NO: 1942235 - DNA, 23 bp, Homo sapiens
tccatggtggtttcagaaagggc

SEQ ID NO: 1942236 - DNA, 18 bp, Homo sapiens
tccatgtagaagagggag

SEQ ID NO: 1942237 - DNA, 15 bp, Homo sapiens
tccatttacctggaa

SEQ ID NO: 1942238 - DNA, 21 bp, Homo sapiens
tccatttacctggaaaccaga

SEQ ID NO: 1942239 - DNA, 16 bp, Homo sapiens
tcccaaataaactcct

SEQ ID NO: 1942240 - DNA, 21 bp, Homo sapiens
tcccacaggacatttctctaa

SEQ ID NO: 1942241 - DNA, 15 bp, Homo sapiens
tcccacaggcccttc

SEQ ID NO: 1942242 - DNA, 11 bp, Homo sapiens
tcccaccaggg

SEQ ID NO: 1942243 - DNA, 12 bp, Homo sapiens
tcccacccctat

SEQ ID NO: 1942244 - DNA, 22 bp, Homo sapiens
tcccacccctataccctaggtc

SEQ ID NO: 1942245 - DNA, 14 bp, Homo sapiens
tcccacggccactg

SEQ ID NO: 1942246 - DNA, 18 bp, Homo sapiens
tcccacggccactgcagt

SEQ ID NO: 1942247 - DNA, 19 bp, Homo sapiens
tcccacggccactgcagtc

SEQ ID NO: 1942248 - DNA, 14 bp, Homo sapiens
tcccagagaacaat

SEQ ID NO: 1942249 - DNA, 19 bp, Homo sapiens
tcccagagaacaatcacta

SEQ ID NO: 1942250 - DNA, 24 bp, Homo sapiens
tcccagagaacaatcactattctt

SEQ ID NO: 1942251 - DNA, 16 bp, Homo sapiens
tcccagataatgtgaa

SEQ ID NO: 1942252 - DNA, 14 bp, Homo sapiens
tcccagcccctggt

SEQ ID NO: 1942253 - DNA, 20 bp, Homo sapiens
tcccaggcgccccttccccc

SEQ ID NO: 1942254 - DNA, 17 bp, Homo sapiens
tcccatagccaggaaac

SEQ ID NO: 1942255 - DNA, 21 bp, Homo sapiens
tcccatggatgtttcttcttt

SEQ ID NO: 1942256 - DNA, 23 bp, Homo sapiens
tctccacccctcaagccaggaga

SEQ ID NO: 1942257 - DNA, 15 bp, Homo sapiens
tctcccacacaagca

SEQ ID NO: 1942258 - DNA, 15 bp, Homo sapiens
tctcccctccagacc

SEQ ID NO: 1942259 - DNA, 16 bp, Homo sapiens
tctcccgaatcctgag

SEQ ID NO: 1942260 - DNA, 18 bp, Homo sapiens
tctcctctcccaaataaa

SEQ ID NO: 1942261 - DNA, 22 bp, Homo sapiens
tctcctctctctccctccactc

SEQ ID NO: 1942262 - DNA, 16 bp, Homo sapiens
tctcctgcccactctg

SEQ ID NO: 1942263 - DNA, 21 bp, Homo sapiens
tctcctggaccctggaagcag

SEQ ID NO: 1942264 - DNA, 13 bp, Homo sapiens
tctctcacctact

SEQ ID NO: 1942265 - DNA, 16 bp, Homo sapiens
tctctcctctctctcc

SEQ ID NO: 1942266 - DNA, 14 bp, Homo sapiens
tctctctccctcca

SEQ ID NO: 1942267 - DNA, 11 bp, Homo sapiens
tctctctgtgg

SEQ ID NO: 1942268 - DNA, 15 bp, Homo sapiens
tctctgagctgtgca

SEQ ID NO: 1942269 - DNA, 16 bp, Homo sapiens
tctctgagctgtgcag

SEQ ID NO: 1942270 - DNA, 16 bp, Homo sapiens
tctctggacctgacca

SEQ ID NO: 1942271 - DNA, 21 bp, Homo sapiens
tctctgtctcatccatcatca

SEQ ID NO: 1942272 - DNA, 21 bp, Homo sapiens
tctctgtttaccctccctgtc

SEQ ID NO: 1942273 - DNA, 11 bp, Homo sapiens
tctcttctcca

SEQ ID NO: 1942274 - DNA, 13 bp, Homo sapiens
tctctttgtaagg

SEQ ID NO: 1942275 - DNA, 14 bp, Homo sapiens
tctctttttcttcc

SEQ ID NO: 1942276 - DNA, 23 bp, Homo sapiens
tctgaaagtatcaccaaaaaatc

SEQ ID NO: 1942277 - DNA, 21 bp, Homo sapiens
tctgaaggagccccattcctg

SEQ ID NO: 1942278 - DNA, 23 bp, Homo sapiens
tctgaaggttggaactgctgcca

SEQ ID NO: 1942279 - DNA, 16 bp, Homo sapiens
tctgaagtcactgcac

SEQ ID NO: 1942280 - DNA, 23 bp, Homo sapiens
tctgaccgggcttcctccctcca

SEQ ID NO: 1942281 - DNA, 15 bp, Homo sapiens
tctgactcagggctc

SEQ ID NO: 1942282 - DNA, 22 bp, Homo sapiens
tctgagccaccgcgagggcctg

SEQ ID NO: 1942283 - DNA, 14 bp, Homo sapiens
tctgagccaggagc

SEQ ID NO: 1942284 - DNA, 16 bp, Homo sapiens
tctgagccctgccctc

SEQ ID NO: 1942285 - DNA, 16 bp, Homo sapiens
tctgagcggccgcctg

SEQ ID NO: 1942286 - DNA, 17 bp, Homo sapiens
tctgagcggccgcctgt

SEQ ID NO: 1942287 - DNA, 22 bp, Homo sapiens
tctgagcggccgcctgtccttg

SEQ ID NO: 1942288 - DNA, 21 bp, Homo sapiens
tctgatgcaagcaagaaacac

SEQ ID NO: 1942289 - DNA, 12 bp, Homo sapiens
tctgcagggcag

SEQ ID NO: 1942290 - DNA, 18 bp, Homo sapiens
tctgcagggcagcctgtg

SEQ ID NO: 1942291 - DNA, 21 bp, Homo sapiens
tctgcagggcagcctgtggga

SEQ ID NO: 1942292 - DNA, 22 bp, Homo sapiens
tctgcagggcagcctgtgggag

SEQ ID NO: 1942293 - DNA, 16 bp, Homo sapiens
tctgcccccagctgct

SEQ ID NO: 1942294 - DNA, 18 bp, Homo sapiens
tctgcctcttctgggagg

SEQ ID NO: 1942295 - DNA, 22 bp, Homo sapiens
tctgcctgcctcatgctctcta

SEQ ID NO: 1942296 - DNA, 18 bp, Homo sapiens
tctgcgccgctgtgctgt

SEQ ID NO: 1942297 - DNA, 16 bp, Homo sapiens
tctgctatgtctgtga

SEQ ID NO: 1942298 - DNA, 17 bp, Homo sapiens
tctgctcacattccctc

SEQ ID NO: 1942299 - DNA, 18 bp, Homo sapiens
tctgctcacattccctct

SEQ ID NO: 1942300 - DNA, 21 bp, Homo sapiens
tctgctccacagaaaccctgt

SEQ ID NO: 1942301 - DNA, 15 bp, Homo sapiens
tctggaatgtaatca

SEQ ID NO: 1942302 - DNA, 22 bp, Homo sapiens
tctggaatgtaatcaatgtttc

SEQ ID NO: 1942303 - DNA, 20 bp, Homo sapiens
tctggagcccctatcctgca

SEQ ID NO: 1942304 - DNA, 13 bp, Homo sapiens
tctggagtctgaa

SEQ ID NO: 1942305 - DNA, 12 bp, Homo sapiens
tctggagtgtgt

SEQ ID NO: 1942306 - DNA, 16 bp, Homo sapiens
tctggccaaatatgca

SEQ ID NO: 1942307 - DNA, 15 bp, Homo sapiens
tctggccctgttgtg

SEQ ID NO: 1942308 - DNA, 18 bp, Homo sapiens
tctggccctgttgtgggg

SEQ ID NO: 1942309 - DNA, 22 bp, Homo sapiens
tctggcctagtggggaggggcc

SEQ ID NO: 1942310 - DNA, 22 bp, Homo sapiens
tctggctggagaggaaaagcca

SEQ ID NO: 1942311 - DNA, 13 bp, Homo sapiens
tctggctgtggcc

SEQ ID NO: 1942312 - DNA, 14 bp, Homo sapiens
tctggctgtggccc

SEQ ID NO: 1942313 - DNA, 19 bp, Homo sapiens
tctggctgtggcccctcct

SEQ ID NO: 1942314 - DNA, 13 bp, Homo sapiens
tctgggacctcag

SEQ ID NO: 1942315 - DNA, 14 bp, Homo sapiens
tctgggaggcaggt

SEQ ID NO: 1942316 - DNA, 14 bp, Homo sapiens
tctggggtggggct

SEQ ID NO: 1942317 - DNA, 22 bp, Homo sapiens
tctggtcagtgaagcccaggag

SEQ ID NO: 1942318 - DNA, 23 bp, Homo sapiens
tctgtacctgcccccactcagca

SEQ ID NO: 1942319 - DNA, 14 bp, Homo sapiens
tctgtattctgcaa

SEQ ID NO: 1942320 - DNA, 13 bp, Homo sapiens
tctgtctcatcca

SEQ ID NO: 1942321 - DNA, 16 bp, Homo sapiens
tctgtctgagccctgc

SEQ ID NO: 1942322 - DNA, 19 bp, Homo sapiens
tctgtctgagccctgccct

SEQ ID NO: 1942323 - DNA, 23 bp, Homo sapiens
tctgtgacaaatgttgacctttg

SEQ ID NO: 1942324 - DNA, 16 bp, Homo sapiens
tctgtgaccaatgtct

SEQ ID NO: 1942325 - DNA, 18 bp, Homo sapiens
tctgtgaccaatgtcttg

SEQ ID NO: 1942326 - DNA, 21 bp, Homo sapiens
tctgtgattgccatttcttcc

SEQ ID NO: 1942327 - DNA, 22 bp, Homo sapiens
tctgtgattgccatttcttccc

SEQ ID NO: 1942328 - DNA, 23 bp, Homo sapiens
tctgtgattgccatttcttccca

SEQ ID NO: 1942329 - DNA, 17 bp, Homo sapiens
tctgtgcctcagtgaga

SEQ ID NO: 1942330 - DNA, 16 bp, Homo sapiens
tctgtgggactggccc

SEQ ID NO: 1942331 - DNA, 17 bp, Homo sapiens
tctgtgggactggccca

SEQ ID NO: 1942332 - DNA, 23 bp, Homo sapiens
tctgtgggactggcccacccctc

SEQ ID NO: 1942333 - DNA, 16 bp, Homo sapiens
tctgtttaccctccct

SEQ ID NO: 1942334 - DNA, 18 bp, Homo sapiens
tctgtttaccctccctgt

SEQ ID NO: 1942335 - DNA, 20 bp, Homo sapiens
tctgtttaccctccctgtcc

SEQ ID NO: 1942336 - DNA, 18 bp, Homo sapiens
tcttaatataactgcctt

SEQ ID NO: 1942337 - DNA, 21 bp, Homo sapiens
tcttacccacttccctgcaag

SEQ ID NO: 1942338 - DNA, 22 bp, Homo sapiens
tcttacccacttccctgcaagg

SEQ ID NO: 1942339 - DNA, 14 bp, Homo sapiens
tcttagggtacagc

SEQ ID NO: 1942340 - DNA, 18 bp, Homo sapiens
tcttagggtacagcccag

SEQ ID NO: 1942341 - DNA, 20 bp, Homo sapiens
tcttcaagtttttttcaaag

SEQ ID NO: 1942342 - DNA, 21 bp, Homo sapiens
tcttcaagtttttttcaaagt

SEQ ID NO: 1942343 - DNA, 14 bp, Homo sapiens
tcttcagaggccct

SEQ ID NO: 1942344 - DNA, 15 bp, Homo sapiens
tcttcagaggccctc

SEQ ID NO: 1942345 - DNA, 15 bp, Homo sapiens
tcttcagggggccag

SEQ ID NO: 1942346 - DNA, 20 bp, Homo sapiens
tcttcataacaattttagga

SEQ ID NO: 1942347 - DNA, 14 bp, Homo sapiens
tcttccatttgcaa

SEQ ID NO: 1942348 - DNA, 13 bp, Homo sapiens
tcttcccccttcc

SEQ ID NO: 1942349 - DNA, 20 bp, Homo sapiens
tcttcctccctccctgcagg

SEQ ID NO: 1942350 - DNA, 13 bp, Homo sapiens
tcttcctctctct

SEQ ID NO: 1942351 - DNA, 22 bp, Homo sapiens
tcttcctgaccaccttgcacta

SEQ ID NO: 1942352 - DNA, 17 bp, Homo sapiens
tcttctaggttctaaaa

SEQ ID NO: 1942353 - DNA, 14 bp, Homo sapiens
tcttctatcctgca

SEQ ID NO: 1942354 - DNA, 12 bp, Homo sapiens
tcttctccactg

SEQ ID NO: 1942355 - DNA, 13 bp, Homo sapiens
tcttctcctttca

SEQ ID NO: 1942356 - DNA, 15 bp, Homo sapiens
tcttctctcccacac

SEQ ID NO: 1942357 - DNA, 17 bp, Homo sapiens
tcttctgggagggcagc

SEQ ID NO: 1942358 - DNA, 14 bp, Homo sapiens
tcttcttcaccatt

SEQ ID NO: 1942359 - DNA, 19 bp, Homo sapiens
tcttcttgggggcagacca

SEQ ID NO: 1942360 - DNA, 23 bp, Homo sapiens
tcttgaatttaataatctgtagg

SEQ ID NO: 1942361 - DNA, 19 bp, Homo sapiens
tcttgagagcgctggcctc

SEQ ID NO: 1942362 - DNA, 21 bp, Homo sapiens
tcttgagtgggccccctctct

SEQ ID NO: 1942363 - DNA, 13 bp, Homo sapiens
tcttgatgcatgc

SEQ ID NO: 1942364 - DNA, 14 bp, Homo sapiens
tcttggagaggagg

SEQ ID NO: 1942365 - DNA, 23 bp, Homo sapiens
tcttgggggcagaccagagagct

SEQ ID NO: 1942366 - DNA, 15 bp, Homo sapiens
tcttggttgaggaaa

SEQ ID NO: 1942367 - DNA, 14 bp, Homo sapiens
tcttgttttgttat

SEQ ID NO: 1942368 - DNA, 19 bp, Homo sapiens
tctttaaactataggtaat

SEQ ID NO: 1942369 - DNA, 13 bp, Homo sapiens
tctttatttctgt

SEQ ID NO: 1942370 - DNA, 23 bp, Homo sapiens
tctttcaaaaccttttgaaatta

SEQ ID NO: 1942371 - DNA, 21 bp, Homo sapiens
tctttccaaattgatgggtgg

SEQ ID NO: 1942372 - DNA, 23 bp, Homo sapiens
tctttccacggagccactcctct

SEQ ID NO: 1942373 - DNA, 14 bp, Homo sapiens
tctttcctgtgcca

SEQ ID NO: 1942374 - DNA, 16 bp, Homo sapiens
tctttgtaaggacttg

SEQ ID NO: 1942375 - DNA, 18 bp, Homo sapiens
tctttgtaaggacttgtg

SEQ ID NO: 1942376 - DNA, 22 bp, Homo sapiens
tctttgtaaggacttgtgcctc

SEQ ID NO: 1942377 - DNA, 14 bp, Homo sapiens
tcttttcaaacaca

SEQ ID NO: 1942378 - DNA, 15 bp, Homo sapiens
tcttttcaaacacac

SEQ ID NO: 1942379 - DNA, 19 bp, Homo sapiens
tcttttctggaatgtaatc

SEQ ID NO: 1942380 - DNA, 17 bp, Homo sapiens
tctttttccagcttgag

SEQ ID NO: 1942381 - DNA, 22 bp, Homo sapiens
tgaaaaaatagagcctgaggga

SEQ ID NO: 1942382 - DNA, 13 bp, Homo sapiens
tgaaaaacagcag

SEQ ID NO: 1942383 - DNA, 14 bp, Homo sapiens
tgaaaaacagcaga

SEQ ID NO: 1942384 - DNA, 16 bp, Homo sapiens
tgaaaacactgtgcac

SEQ ID NO: 1942385 - DNA, 14 bp, Homo sapiens
tgaaaatatttcta

SEQ ID NO: 1942386 - DNA, 13 bp, Homo sapiens
tgaaaatgtcttg

SEQ ID NO: 1942387 - DNA, 14 bp, Homo sapiens
tgaaaatgtcttgt

SEQ ID NO: 1942388 - DNA, 22 bp, Homo sapiens
cagtgggatcttacccacttcc

SEQ ID NO: 1942389 - DNA, 11 bp, Homo sapiens
cagtgtgccac

SEQ ID NO: 1942390 - DNA, 17 bp, Homo sapiens
cagtgtgccaccctctg

SEQ ID NO: 1942391 - DNA, 18 bp, Homo sapiens
cagtgtgccaccctctgc

SEQ ID NO: 1942392 - DNA, 19 bp, Homo sapiens
cagtgttagggaagggcct

SEQ ID NO: 1942393 - DNA, 15 bp, Homo sapiens
cagtgttttctggga

SEQ ID NO: 1942394 - DNA, 19 bp, Homo sapiens
cagttaaaaaaaattttaa

SEQ ID NO: 1942395 - DNA, 17 bp, Homo sapiens
cagttcaatcaaacttt

SEQ ID NO: 1942396 - DNA, 21 bp, Homo sapiens
cagttccctacgaggagtgtt

SEQ ID NO: 1942397 - DNA, 14 bp, Homo sapiens
cagttgtgaaagca

SEQ ID NO: 1942398 - DNA, 22 bp, Homo sapiens
cagttgtgaaagcaccatcatc

SEQ ID NO: 1942399 - DNA, 22 bp, Homo sapiens
cagtttaggacccaaggtggtc

SEQ ID NO: 1942400 - DNA, 12 bp, Homo sapiens
cagtttgctttg

SEQ ID NO: 1942401 - DNA, 19 bp, Homo sapiens
cagttttcagtcaagttcc

SEQ ID NO: 1942402 - DNA, 16 bp, Homo sapiens
cagttttttatgctaa

SEQ ID NO: 1942403 - DNA, 14 bp, Homo sapiens
cataacaattcctc

SEQ ID NO: 1942404 - DNA, 15 bp, Homo sapiens
cataagtatttcaaa

SEQ ID NO: 1942405 - DNA, 12 bp, Homo sapiens
cataattgtcaa

SEQ ID NO: 1942406 - DNA, 21 bp, Homo sapiens
cataccaggggttccccagga

SEQ ID NO: 1942407 - DNA, 22 bp, Homo sapiens
catagtgatggttcccctgttc

SEQ ID NO: 1942408 - DNA, 20 bp, Homo sapiens
catagtttctgtaattggct

SEQ ID NO: 1942409 - DNA, 17 bp, Homo sapiens
catataatgttgttatt

SEQ ID NO: 1942410 - DNA, 23 bp, Homo sapiens
catatgattgtgcacatacttga

SEQ ID NO: 1942411 - DNA, 21 bp, Homo sapiens
catcaagcacagaaggaggag

SEQ ID NO: 1942412 - DNA, 16 bp, Homo sapiens
catcaattatagaaag

SEQ ID NO: 1942413 - DNA, 16 bp, Homo sapiens
catcagtgctccctca

SEQ ID NO: 1942414 - DNA, 23 bp, Homo sapiens
catcatagaggatgatgtaatta

SEQ ID NO: 1942415 - DNA, 13 bp, Homo sapiens
catcatctcctgc

SEQ ID NO: 1942416 - DNA, 18 bp, Homo sapiens
catcatgagccgttgcta

SEQ ID NO: 1942417 - DNA, 21 bp, Homo sapiens
catcatgagccgttgctaatg

SEQ ID NO: 1942418 - DNA, 14 bp, Homo sapiens
catcattctctgtc

SEQ ID NO: 1942419 - DNA, 16 bp, Homo sapiens
catcattctctgtctc

SEQ ID NO: 1942420 - DNA, 24 bp, Homo sapiens
catcattctctgtctcatccatca

SEQ ID NO: 1942421 - DNA, 19 bp, Homo sapiens
catccaacatttcctcagg

SEQ ID NO: 1942422 - DNA, 17 bp, Homo sapiens
catccacatgggagccg

SEQ ID NO: 1942423 - DNA, 20 bp, Homo sapiens
catccactaggtgcccagtc

SEQ ID NO: 1942424 - DNA, 13 bp, Homo sapiens
catccatcatcat

SEQ ID NO: 1942425 - DNA, 13 bp, Homo sapiens
ccactcctcccaa

SEQ ID NO: 1942426 - DNA, 17 bp, Homo sapiens
ccactgcggaacaggag

SEQ ID NO: 1942427 - DNA, 18 bp, Homo sapiens
ccactggcatctctggag

SEQ ID NO: 1942428 - DNA, 14 bp, Homo sapiens
ccactgttatcaaa

SEQ ID NO: 1942429 - DNA, 19 bp, Homo sapiens
ccacttagaaattgcattt

SEQ ID NO: 1942430 - DNA, 15 bp, Homo sapiens
ccacttatttctaaa

SEQ ID NO: 1942431 - DNA, 16 bp, Homo sapiens
ccacttccctgcaagg

SEQ ID NO: 1942432 - DNA, 13 bp, Homo sapiens
ccacttggccacc

SEQ ID NO: 1942433 - DNA, 15 bp, Homo sapiens
ccacttggccaccag

SEQ ID NO: 1942434 - DNA, 19 bp, Homo sapiens
ccacttggccaccaggact

SEQ ID NO: 1942435 - DNA, 16 bp, Homo sapiens
ccacttgggtcttccc

SEQ ID NO: 1942436 - DNA, 18 bp, Homo sapiens
ccagacagagtggatctg

SEQ ID NO: 1942437 - DNA, 14 bp, Homo sapiens
ccagacccctggct

SEQ ID NO: 1942438 - DNA, 17 bp, Homo sapiens
ccagacccctggctttt

SEQ ID NO: 1942439 - DNA, 18 bp, Homo sapiens
ccagacgcacgtgggtct

SEQ ID NO: 1942440 - DNA, 23 bp, Homo sapiens
ccagacgcacgtgggtcttcagg

SEQ ID NO: 1942441 - DNA, 16 bp, Homo sapiens
ccagagaacaatcact

SEQ ID NO: 1942442 - DNA, 18 bp, Homo sapiens
ccagagaacaatcactat

SEQ ID NO: 1942443 - DNA, 12 bp, Homo sapiens
ccagagagaagc

SEQ ID NO: 1942444 - DNA, 16 bp, Homo sapiens
ccagagagtggctcct

SEQ ID NO: 1942445 - DNA, 19 bp, Homo sapiens
ccagagcctatggaaaggg

SEQ ID NO: 1942446 - DNA, 13 bp, Homo sapiens
ccagagcctgggc

SEQ ID NO: 1942447 - DNA, 23 bp, Homo sapiens
ccagagtagggttgccagtcctg

SEQ ID NO: 1942448 - DNA, 18 bp, Homo sapiens
ccagagtaggtgggtctt

SEQ ID NO: 1942449 - DNA, 23 bp, Homo sapiens
ccagatgcctcctctgtcctcat

SEQ ID NO: 1942450 - DNA, 23 bp, Homo sapiens
ccagcacatgcggcttccgaggg

SEQ ID NO: 1942451 - DNA, 12 bp, Homo sapiens
ccagcactgctt

SEQ ID NO: 1942452 - DNA, 18 bp, Homo sapiens
ccagcactgcttgaggaa

SEQ ID NO: 1942453 - DNA, 19 bp, Homo sapiens
ccagcactgcttgaggaaa

SEQ ID NO: 1942454 - DNA, 17 bp, Homo sapiens
ccagcagctgaagtctc

SEQ ID NO: 1942455 - DNA, 14 bp, Homo sapiens
ccagcccagcctgc

SEQ ID NO: 1942456 - DNA, 13 bp, Homo sapiens
ccagccctcatcc

SEQ ID NO: 1942457 - DNA, 14 bp, Homo sapiens
ccagccctcatccc

SEQ ID NO: 1942458 - DNA, 19 bp, Homo sapiens
ccagcctccgtatttcaga

SEQ ID NO: 1942459 - DNA, 14 bp, Homo sapiens
ccagcctggcccca

SEQ ID NO: 1942460 - DNA, 22 bp, Homo sapiens
ccagcggctcttcctggacagt

SEQ ID NO: 1942461 - DNA, 19 bp, Homo sapiens
ccagcgtcctcctctgtga

SEQ ID NO: 1942462 - DNA, 21 bp, Homo sapiens
ccagctctgaaaccagtgtta

SEQ ID NO: 1942463 - DNA, 14 bp, Homo sapiens
ccagctctgtatca

SEQ ID NO: 1942464 - DNA, 16 bp, Homo sapiens
ccagctctttggtgcc

SEQ ID NO: 1942465 - DNA, 12 bp, Homo sapiens
ccagctgctcct

SEQ ID NO: 1942466 - DNA, 16 bp, Homo sapiens
ccagctgctcctcgca

SEQ ID NO: 1942467 - DNA, 17 bp, Homo sapiens
ccagctgggttggaaaa

SEQ ID NO: 1942468 - DNA, 23 bp, Homo sapiens
ccagctgtactgagttctcatcc

SEQ ID NO: 1942469 - DNA, 19 bp, Homo sapiens
ccagcttggagtgccacat

SEQ ID NO: 1942470 - DNA, 20 bp, Homo sapiens
ccagcttggagtgccacgtg

SEQ ID NO: 1942471 - DNA, 17 bp, Homo sapiens
ccaggaattctcacagg

SEQ ID NO: 1942472 - DNA, 17 bp, Homo sapiens
ccaggagaccctgtctt

SEQ ID NO: 1942473 - DNA, 13 bp, Homo sapiens
ccaggaggcctgg

SEQ ID NO: 1942474 - DNA, 20 bp, Homo sapiens
ccaggcatggcccagcctgg

SEQ ID NO: 1942475 - DNA, 23 bp, Homo sapiens
ccaggcatggcccagcctggagc

SEQ ID NO: 1942476 - DNA, 12 bp, Homo sapiens
ccaggccctctc

SEQ ID NO: 1942477 - DNA, 18 bp, Homo sapiens
ccaggccctctctgcagt

SEQ ID NO: 1942478 - DNA, 19 bp, Homo sapiens
ccaggccctctctgcagtc

SEQ ID NO: 1942479 - DNA, 14 bp, Homo sapiens
ccaggccgtggctg

SEQ ID NO: 1942480 - DNA, 16 bp, Homo sapiens
ccaggccgtggctgcc

SEQ ID NO: 1942481 - DNA, 18 bp, Homo sapiens
ccaggcgccccttccccc

SEQ ID NO: 1942482 - DNA, 19 bp, Homo sapiens
ccaggcgccccttccccct

SEQ ID NO: 1942483 - DNA, 19 bp, Homo sapiens
ccaggctcaggctgcccag

SEQ ID NO: 1942484 - DNA, 20 bp, Homo sapiens
ccaggctcaggctgcccagc

SEQ ID NO: 1942485 - DNA, 21 bp, Homo sapiens
ccaggctcaggctgcccagcg

SEQ ID NO: 1942486 - DNA, 14 bp, Homo sapiens
ccaggctgcaggtg

SEQ ID NO: 1942487 - DNA, 13 bp, Homo sapiens
ccagggagctctg

SEQ ID NO: 1942488 - DNA, 17 bp, Homo sapiens
ccaggggttccccagga

SEQ ID NO: 1942489 - DNA, 22 bp, Homo sapiens
ccagggttaaagaaaggcagag

SEQ ID NO: 1942490 - DNA, 14 bp, Homo sapiens
ccaggtcctttcct

SEQ ID NO: 1942491 - DNA, 16 bp, Homo sapiens
ccaggtgcacagacgt

SEQ ID NO: 1942492 - DNA, 21 bp, Homo sapiens
ccaggtggccactccagaccc

SEQ ID NO: 1942493 - DNA, 17 bp, Homo sapiens
ccagtaaggcagctctg

SEQ ID NO: 1942494 - DNA, 15 bp, Homo sapiens
ccagtctgaacctga

SEQ ID NO: 1942495 - DNA, 16 bp, Homo sapiens
ccagtctgttccccat

SEQ ID NO: 1942496 - DNA, 16 bp, Homo sapiens
ccagttctctttgtaa

SEQ ID NO: 1942497 - DNA, 16 bp, Homo sapiens
ccatagctgagctgga

SEQ ID NO: 1942498 - DNA, 17 bp, Homo sapiens
ccatcaacaaaaattgt

SEQ ID NO: 1942499 - DNA, 22 bp, Homo sapiens
ccatcactgctgtccctcctga

SEQ ID NO: 1942500 - DNA, 14 bp, Homo sapiens
ccatcagcagtgat

SEQ ID NO: 1942501 - DNA, 16 bp, Homo sapiens
ccatcatcatgtgtgt

SEQ ID NO: 1942502 - DNA, 12 bp, Homo sapiens
ccatccctgaga

SEQ ID NO: 1942503 - DNA, 22 bp, Homo sapiens
ccatcctgtacaagtgctcagt

SEQ ID NO: 1942504 - DNA, 11 bp, Homo sapiens
ccatctgtaaa

SEQ ID NO: 1942505 - DNA, 13 bp, Homo sapiens
ccatctgtaaata

SEQ ID NO: 1942506 - DNA, 13 bp, Homo sapiens
ccatgatgtcctt

SEQ ID NO: 1942507 - DNA, 16 bp, Homo sapiens
ccatgattttggccac

SEQ ID NO: 1942508 - DNA, 13 bp, Homo sapiens
ccatggaggcaca

SEQ ID NO: 1942509 - DNA, 21 bp, Homo sapiens
ccatggaggcacacagctgca

SEQ ID NO: 1942510 - DNA, 13 bp, Homo sapiens
ccatggccaggag

SEQ ID NO: 1942511 - DNA, 18 bp, Homo sapiens
ccatggccaggagtgggt

SEQ ID NO: 1942512 - DNA, 23 bp, Homo sapiens
caagtgcaatccatgtatctgta

SEQ ID NO: 1942513 - DNA, 19 bp, Homo sapiens
caagttaatgtactttcat

SEQ ID NO: 1942514 - DNA, 17 bp, Homo sapiens
caagttcatagtttctg

SEQ ID NO: 1942515 - DNA, 16 bp, Homo sapiens
caagttccgtctcctc

SEQ ID NO: 1942516 - DNA, 20 bp, Homo sapiens
caagttccgtctcctctcca

SEQ ID NO: 1942517 - DNA, 15 bp, Homo sapiens
caagtttcagagtca

SEQ ID NO: 1942518 - DNA, 15 bp, Homo sapiens
caataattgtggaga

SEQ ID NO: 1942519 - DNA, 22 bp, Homo sapiens
caataattgtggagaggagaga

SEQ ID NO: 1942520 - DNA, 22 bp, Homo sapiens
caatcaaactttcagctttttt

SEQ ID NO: 1942521 - DNA, 17 bp, Homo sapiens
caatcattttaattatt

SEQ ID NO: 1942522 - DNA, 16 bp, Homo sapiens
caatcccaccaaccct

SEQ ID NO: 1942523 - DNA, 20 bp, Homo sapiens
caatcctatgtttttgttca

SEQ ID NO: 1942524 - DNA, 11 bp, Homo sapiens
caatcctggac

SEQ ID NO: 1942525 - DNA, 15 bp, Homo sapiens
caatcctgtcaatgt

SEQ ID NO: 1942526 - DNA, 12 bp, Homo sapiens
caatctaaaaaa

SEQ ID NO: 1942527 - DNA, 19 bp, Homo sapiens
caatctgcaagtcccaggg

SEQ ID NO: 1942528 - DNA, 15 bp, Homo sapiens
caatgaaaaaatgta

SEQ ID NO: 1942529 - DNA, 19 bp, Homo sapiens
caatgagtaaaatcacaga

SEQ ID NO: 1942530 - DNA, 13 bp, Homo sapiens
caatgccatcatc

SEQ ID NO: 1942531 - DNA, 19 bp, Homo sapiens
caatggaatataaatatca

SEQ ID NO: 1942532 - DNA, 21 bp, Homo sapiens
caatggctgggtttgggcagt

SEQ ID NO: 1942533 - DNA, 11 bp, Homo sapiens
caatgtcttga

SEQ ID NO: 1942534 - DNA, 16 bp, Homo sapiens
caatgtgcccagtcat

SEQ ID NO: 1942535 - DNA, 20 bp, Homo sapiens
caattcacatctaacctcat

SEQ ID NO: 1942536 - DNA, 18 bp, Homo sapiens
caattctgatacagcctt

SEQ ID NO: 1942537 - DNA, 20 bp, Homo sapiens
caatttctactttgaagtca

SEQ ID NO: 1942538 - DNA, 11 bp, Homo sapiens
cacacacactc

SEQ ID NO: 1942539 - DNA, 19 bp, Homo sapiens
cacacattttaattttcct

SEQ ID NO: 1942540 - DNA, 15 bp, Homo sapiens
cacacccttccccac

SEQ ID NO: 1942541 - DNA, 18 bp, Homo sapiens
cacacccttccccactcc

SEQ ID NO: 1942542 - DNA, 13 bp, Homo sapiens
cacacctccaccc

SEQ ID NO: 1942543 - DNA, 14 bp, Homo sapiens
cacacctccacccg

SEQ ID NO: 1942544 - DNA, 17 bp, Homo sapiens
cacacttcaggctcttc

SEQ ID NO: 1942545 - DNA, 18 bp, Homo sapiens
cacacttcaggctcttct

SEQ ID NO: 1942546 - DNA, 20 bp, Homo sapiens
cacacttcaggctcttctcc

SEQ ID NO: 1942547 - DNA, 21 bp, Homo sapiens
cacacttcaggctcttctcct

SEQ ID NO: 1942548 - DNA, 14 bp, Homo sapiens
cacagaaaccctgt

SEQ ID NO: 1942549 - DNA, 9 bp, Homo sapiens
cacagaaat

SEQ ID NO: 1942550 - DNA, 11 bp, Homo sapiens
cacagaggcag

SEQ ID NO: 1942551 - DNA, 12 bp, Homo sapiens
cacagaggcagt

SEQ ID NO: 1942552 - DNA, 15 bp, Homo sapiens
cacagaggccaggca

SEQ ID NO: 1942553 - DNA, 18 bp, Homo sapiens
cacagagtgccatccctg

SEQ ID NO: 1942554 - DNA, 19 bp, Homo sapiens
cacagattttttctttaaa

SEQ ID NO: 1942555 - DNA, 19 bp, Homo sapiens
cacagcctcccctgccagg

SEQ ID NO: 1942556 - DNA, 17 bp, Homo sapiens
cacaggacatttctcta

SEQ ID NO: 1942557 - DNA, 12 bp, Homo sapiens
cacaggcagacg

SEQ ID NO: 1942558 - DNA, 15 bp, Homo sapiens
cacaggcccttcctc

SEQ ID NO: 1942559 - DNA, 16 bp, Homo sapiens
cacaggcccttcctct

SEQ ID NO: 1942560 - DNA, 17 bp, Homo sapiens
cacaggcccttcctctc

SEQ ID NO: 1942561 - DNA, 12 bp, Homo sapiens
cacaggctgccg

SEQ ID NO: 1942562 - DNA, 14 bp, Homo sapiens
cacagtgcatctca

SEQ ID NO: 1942563 - DNA, 22 bp, Homo sapiens
cacatcctccacgttctgctca

SEQ ID NO: 1942564 - DNA, 18 bp, Homo sapiens
cacatctgtgtcttgttt

SEQ ID NO: 1942565 - DNA, 23 bp, Homo sapiens
cacatctgtgtcttgtttggaat

SEQ ID NO: 1942566 - DNA, 17 bp, Homo sapiens
cacattctacttcagct

SEQ ID NO: 1942567 - DNA, 22 bp, Homo sapiens
caccaaaaaatctatagtttga

SEQ ID NO: 1942568 - DNA, 13 bp, Homo sapiens
caccaaccctcag

SEQ ID NO: 1942569 - DNA, 17 bp, Homo sapiens
caccacacacacccttc

SEQ ID NO: 1942570 - DNA, 19 bp, Homo sapiens
caccacacacacccttccc

SEQ ID NO: 1942571 - DNA, 13 bp, Homo sapiens
caccaccaacagg

SEQ ID NO: 1942572 - DNA, 22 bp, Homo sapiens
caccagggaccagcccagcctg

SEQ ID NO: 1942573 - DNA, 19 bp, Homo sapiens
caccagtccacgccgggtc

SEQ ID NO: 1942574 - DNA, 19 bp, Homo sapiens
cacccctcaagccaggaga

SEQ ID NO: 1942575 - DNA, 16 bp, Homo sapiens
cacccctcttccccct

SEQ ID NO: 1942576 - DNA, 19 bp, Homo sapiens
cacccctcttcccccttcc

SEQ ID NO: 1942577 - DNA, 17 bp, Homo sapiens
cacccgtttccaagcct

SEQ ID NO: 1942578 - DNA, 19 bp, Homo sapiens
cacccgtttccaagcctgg

SEQ ID NO: 1942579 - DNA, 16 bp, Homo sapiens
caccctctgcagggca

SEQ ID NO: 1942580 - DNA, 23 bp, Homo sapiens
caccctctgctatgtctgtgatg

SEQ ID NO: 1942581 - DNA, 16 bp, Homo sapiens
caccctgtctgcaggc

SEQ ID NO: 1942582 - DNA, 17 bp, Homo sapiens
cacccttccccactccc

SEQ ID NO: 1942583 - DNA, 21 bp, Homo sapiens
cacccttccccactcccgtga

SEQ ID NO: 1942584 - DNA, 17 bp, Homo sapiens
cacccttttccagctgg

SEQ ID NO: 1942585 - DNA, 18 bp, Homo sapiens
caccgccacactggccgg

SEQ ID NO: 1942586 - DNA, 17 bp, Homo sapiens
caccgtgggctccctga

SEQ ID NO: 1942587 - DNA, 18 bp, Homo sapiens
caccgtgggctccctgac

SEQ ID NO: 1942588 - DNA, 12 bp, Homo sapiens
cacctactgagt

SEQ ID NO: 1942589 - DNA, 16 bp, Homo sapiens
cacctacttcctcctc

SEQ ID NO: 1942590 - DNA, 12 bp, Homo sapiens
cacctccacccg

SEQ ID NO: 1942591 - DNA, 14 bp, Homo sapiens
cacctccacccgtc

SEQ ID NO: 1942592 - DNA, 21 bp, Homo sapiens
cacctccccaggccgtggctg

SEQ ID NO: 1942593 - DNA, 13 bp, Homo sapiens
cacctccctgcag

SEQ ID NO: 1942594 - DNA, 16 bp, Homo sapiens
cacctccctgcagctt

SEQ ID NO: 1942595 - DNA, 13 bp, Homo sapiens
cacctctggccct

SEQ ID NO: 1942596 - DNA, 19 bp, Homo sapiens
cacctgggtgctctggctg

SEQ ID NO: 1942597 - DNA, 18 bp, Homo sapiens
cacctgtacatacattgt

SEQ ID NO: 1942598 - DNA, 14 bp, Homo sapiens
caccttcccagctg

SEQ ID NO: 1942599 - DNA, 19 bp, Homo sapiens
caccttcccagctgctcct

SEQ ID NO: 1942600 - DNA, 15 bp, Homo sapiens
cacgaaatgttattt

SEQ ID NO: 1942601 - DNA, 16 bp, Homo sapiens
cacgaaatgttatttt

SEQ ID NO: 1942602 - DNA, 17 bp, Homo sapiens
cacgcccgactctctcc

SEQ ID NO: 1942603 - DNA, 19 bp, Homo sapiens
cacgcccgactctctccat

SEQ ID NO: 1942604 - DNA, 19 bp, Homo sapiens
cacggacaggaagcacagc

SEQ ID NO: 1942605 - DNA, 16 bp, Homo sapiens
cacggagccactcctc

SEQ ID NO: 1942606 - DNA, 23 bp, Homo sapiens
cacgtagtagggtcaggccacgg

SEQ ID NO: 1942607 - DNA, 16 bp, Homo sapiens
cacgtcccgggcactg

SEQ ID NO: 1942608 - DNA, 13 bp, Homo sapiens
cacgtcctgggtg

SEQ ID NO: 1942609 - DNA, 16 bp, Homo sapiens
cacgtctccctggccc

SEQ ID NO: 1942610 - DNA, 18 bp, Homo sapiens
cacgtctccctggcccca

SEQ ID NO: 1942611 - DNA, 16 bp, Homo sapiens
cacgtgtttgtgctgt

SEQ ID NO: 1942612 - DNA, 13 bp, Homo sapiens
cacgttcacccct

SEQ ID NO: 1942613 - DNA, 20 bp, Homo sapiens
cactaccgggggctctgagc

SEQ ID NO: 1942614 - DNA, 17 bp, Homo sapiens
cactattcttaagcact

SEQ ID NO: 1942615 - DNA, 18 bp, Homo sapiens
cactattcttaagcactt

SEQ ID NO: 1942616 - DNA, 20 bp, Homo sapiens
cactattcttaagcactttg

SEQ ID NO: 1942617 - DNA, 13 bp, Homo sapiens
cactccactcccc

SEQ ID NO: 1942618 - DNA, 15 bp, Homo sapiens
cactccactcccctc

SEQ ID NO: 1942619 - DNA, 16 bp, Homo sapiens
cactccactcccctca

SEQ ID NO: 1942620 - DNA, 17 bp, Homo sapiens
cactccactcccctcat

SEQ ID NO: 1942621 - DNA, 16 bp, Homo sapiens
cactccagacccctgg

SEQ ID NO: 1942622 - DNA, 16 bp, Homo sapiens
cactcccctcatccac

SEQ ID NO: 1942623 - DNA, 20 bp, Homo sapiens
cactcccttgggctccctgt

SEQ ID NO: 1942624 - DNA, 20 bp, Homo sapiens
cactcctctgactcagggct

SEQ ID NO: 1942625 - DNA, 16 bp, Homo sapiens
cagcctggagccgtgg

SEQ ID NO: 1942626 - DNA, 13 bp, Homo sapiens
cagcctggcacag

SEQ ID NO: 1942627 - DNA, 21 bp, Homo sapiens
cagcctggcacagggcagtgg

SEQ ID NO: 1942628 - DNA, 17 bp, Homo sapiens
cagcctggttccctctt

SEQ ID NO: 1942629 - DNA, 20 bp, Homo sapiens
cagcctggttccctctttcc

SEQ ID NO: 1942630 - DNA, 22 bp, Homo sapiens
cagcctggttccctctttcctg

SEQ ID NO: 1942631 - DNA, 16 bp, Homo sapiens
cagcgaggaggctcca

SEQ ID NO: 1942632 - DNA, 18 bp, Homo sapiens
cagcgaggaggctccaga

SEQ ID NO: 1942633 - DNA, 13 bp, Homo sapiens
cagcgctcctgga

SEQ ID NO: 1942634 - DNA, 15 bp, Homo sapiens
cagcgggtaaaaaga

SEQ ID NO: 1942635 - DNA, 18 bp, Homo sapiens
cagcgtcctcctctgtga

SEQ ID NO: 1942636 - DNA, 19 bp, Homo sapiens
cagcgtctgagcggccgcc

SEQ ID NO: 1942637 - DNA, 19 bp, Homo sapiens
cagcgtgctttaaaaaata

SEQ ID NO: 1942638 - DNA, 12 bp, Homo sapiens
cagctaaagcaa

SEQ ID NO: 1942639 - DNA, 18 bp, Homo sapiens
cagctaggttaataggag

SEQ ID NO: 1942640 - DNA, 23 bp, Homo sapiens
cagctaggttaataggaggacag

SEQ ID NO: 1942641 - DNA, 23 bp, Homo sapiens
cagctatttctcatcaattctct

SEQ ID NO: 1942642 - DNA, 19 bp, Homo sapiens
cagctccggaaggacacag

SEQ ID NO: 1942643 - DNA, 15 bp, Homo sapiens
cagctgaaatactga

SEQ ID NO: 1942644 - DNA, 20 bp, Homo sapiens
cagctgaagtctctttttct

SEQ ID NO: 1942645 - DNA, 17 bp, Homo sapiens
cagctgctcctcgcagt

SEQ ID NO: 1942646 - DNA, 15 bp, Homo sapiens
cagctgcttctgtgc

SEQ ID NO: 1942647 - DNA, 17 bp, Homo sapiens
cagctgggttggaaaac

SEQ ID NO: 1942648 - DNA, 15 bp, Homo sapiens
cagctgtactgagtt

SEQ ID NO: 1942649 - DNA, 17 bp, Homo sapiens
cagcttggagtgccaca

SEQ ID NO: 1942650 - DNA, 15 bp, Homo sapiens
cagctttgaggctgg

SEQ ID NO: 1942651 - DNA, 16 bp, Homo sapiens
cagctttgaggctggc

SEQ ID NO: 1942652 - DNA, 13 bp, Homo sapiens
caggaagcacagc

SEQ ID NO: 1942653 - DNA, 14 bp, Homo sapiens
caggaagcacagca

SEQ ID NO: 1942654 - DNA, 15 bp, Homo sapiens
caggaatgggccaag

SEQ ID NO: 1942655 - DNA, 20 bp, Homo sapiens
caggaattctcacaggttca

SEQ ID NO: 1942656 - DNA, 19 bp, Homo sapiens
attgcagaagaaactcctg

SEQ ID NO: 1942657 - DNA, 21 bp, Homo sapiens
attgccacctctggccaaata

SEQ ID NO: 1942658 - DNA, 23 bp, Homo sapiens
attgccacctctggccaaatatg

SEQ ID NO: 1942659 - DNA, 20 bp, Homo sapiens
attgctggcaaagacagaag

SEQ ID NO: 1942660 - DNA, 16 bp, Homo sapiens
attgcttgaaagaaaa

SEQ ID NO: 1942661 - DNA, 15 bp, Homo sapiens
attggacccttccat

SEQ ID NO: 1942662 - DNA, 18 bp, Homo sapiens
attggtgtgaatgctgta

SEQ ID NO: 1942663 - DNA, 21 bp, Homo sapiens
attggtgtgaatgctgtacct

SEQ ID NO: 1942664 - DNA, 17 bp, Homo sapiens
attggttaatctggact

SEQ ID NO: 1942665 - DNA, 19 bp, Homo sapiens
attgtaaactttttcaatg

SEQ ID NO: 1942666 - DNA, 18 bp, Homo sapiens
attgtaaatgtttaatat

SEQ ID NO: 1942667 - DNA, 13 bp, Homo sapiens
attgtaactgttc

SEQ ID NO: 1942668 - DNA, 13 bp, Homo sapiens
attgtataggcca

SEQ ID NO: 1942669 - DNA, 19 bp, Homo sapiens
attgtataggccatctgta

SEQ ID NO: 1942670 - DNA, 20 bp, Homo sapiens
attgtataggccatctgtaa

SEQ ID NO: 1942671 - DNA, 22 bp, Homo sapiens
attgtataggccatctgtaaat

SEQ ID NO: 1942672 - DNA, 19 bp, Homo sapiens
attgtcaaaaaccagaatt

SEQ ID NO: 1942673 - DNA, 18 bp, Homo sapiens
attgtccaatcctatgtt

SEQ ID NO: 1942674 - DNA, 18 bp, Homo sapiens
attgtctgacttctcagg

SEQ ID NO: 1942675 - DNA, 20 bp, Homo sapiens
attgtgaaatttgttaatat

SEQ ID NO: 1942676 - DNA, 23 bp, Homo sapiens
attgtgatcagaccataatgtta

SEQ ID NO: 1942677 - DNA, 14 bp, Homo sapiens
attgtggagaggag

SEQ ID NO: 1942678 - DNA, 14 bp, Homo sapiens
atttaaaaaaaaac

SEQ ID NO: 1942679 - DNA, 17 bp, Homo sapiens
atttaaattttcagaaa

SEQ ID NO: 1942680 - DNA, 17 bp, Homo sapiens
atttaactatttagaga

SEQ ID NO: 1942681 - DNA, 15 bp, Homo sapiens
atttaataatctgta

SEQ ID NO: 1942682 - DNA, 23 bp, Homo sapiens
atttaccagcctccgtatttcag

SEQ ID NO: 1942683 - DNA, 17 bp, Homo sapiens
atttaggatttgtgttt

SEQ ID NO: 1942684 - DNA, 23 bp, Homo sapiens
atttataaactaattttgtacgt

SEQ ID NO: 1942685 - DNA, 14 bp, Homo sapiens
atttatctgtctga

SEQ ID NO: 1942686 - DNA, 22 bp, Homo sapiens
atttcaaaatgatattcaatct

SEQ ID NO: 1942687 - DNA, 21 bp, Homo sapiens
atttcactgacactgcgaact

SEQ ID NO: 1942688 - DNA, 15 bp, Homo sapiens
atttcatctttccaa

SEQ ID NO: 1942689 - DNA, 22 bp, Homo sapiens
atttcctcaacgttgctcccca

SEQ ID NO: 1942690 - DNA, 17 bp, Homo sapiens
atttctaaatcctcact

SEQ ID NO: 1942691 - DNA, 18 bp, Homo sapiens
atttctaaatcctcacta

SEQ ID NO: 1942692 - DNA, 18 bp, Homo sapiens
atttctactttgaagtca

SEQ ID NO: 1942693 - DNA, 20 bp, Homo sapiens
atttctagacagtattgcca

SEQ ID NO: 1942694 - DNA, 15 bp, Homo sapiens
atttctatgtaaatt

SEQ ID NO: 1942695 - DNA, 15 bp, Homo sapiens
atttctatttctcct

SEQ ID NO: 1942696 - DNA, 20 bp, Homo sapiens
atttctatttctcctccatg

SEQ ID NO: 1942697 - DNA, 15 bp, Homo sapiens
atttctgtctcataa

SEQ ID NO: 1942698 - DNA, 16 bp, Homo sapiens
atttctttatttctgt

SEQ ID NO: 1942699 - DNA, 17 bp, Homo sapiens
atttctttatttctgtc

SEQ ID NO: 1942700 - DNA, 16 bp, Homo sapiens
atttgagtgctctgat

SEQ ID NO: 1942701 - DNA, 20 bp, Homo sapiens
atttgcaagggaaaagtctc

SEQ ID NO: 1942702 - DNA, 21 bp, Homo sapiens
atttgcataacaattcctcta

SEQ ID NO: 1942703 - DNA, 12 bp, Homo sapiens
atttggaaaata

SEQ ID NO: 1942704 - DNA, 18 bp, Homo sapiens
atttggctccactgtaaa

SEQ ID NO: 1942705 - DNA, 16 bp, Homo sapiens
atttgtaactttgcat

SEQ ID NO: 1942706 - DNA, 14 bp, Homo sapiens
atttgttaatatat

SEQ ID NO: 1942707 - DNA, 15 bp, Homo sapiens
atttgttaatatata

SEQ ID NO: 1942708 - DNA, 17 bp, Homo sapiens
atttgttaatatatata

SEQ ID NO: 1942709 - DNA, 21 bp, Homo sapiens
atttgttaatatatataatac

SEQ ID NO: 1942710 - DNA, 17 bp, Homo sapiens
atttgttattttgcaac

SEQ ID NO: 1942711 - DNA, 18 bp, Homo sapiens
atttgtttatccttaaga

SEQ ID NO: 1942712 - DNA, 23 bp, Homo sapiens
attttaattattattcttcataa

SEQ ID NO: 1942713 - DNA, 20 bp, Homo sapiens
attttcataagtatttcaaa

SEQ ID NO: 1942714 - DNA, 16 bp, Homo sapiens
attttcattggatgca

SEQ ID NO: 1942715 - DNA, 21 bp, Homo sapiens
attttcctaataaagttctgt

SEQ ID NO: 1942716 - DNA, 20 bp, Homo sapiens
attttctatatttgtaactt

SEQ ID NO: 1942717 - DNA, 16 bp, Homo sapiens
attttggccactttgc

SEQ ID NO: 1942718 - DNA, 18 bp, Homo sapiens
attttggtccaagttgtg

SEQ ID NO: 1942719 - DNA, 20 bp, Homo sapiens
attttttaattattatttat

SEQ ID NO: 1942720 - DNA, 17 bp, Homo sapiens
caaaatcagtgatggga

SEQ ID NO: 1942721 - DNA, 11 bp, Homo sapiens
caaacacacac

SEQ ID NO: 1942722 - DNA, 12 bp, Homo sapiens
caaacacacaca

SEQ ID NO: 1942723 - DNA, 14 bp, Homo sapiens
caaacacacacaca

SEQ ID NO: 1942724 - DNA, 15 bp, Homo sapiens
caaaccaggctgcag

SEQ ID NO: 1942725 - DNA, 14 bp, Homo sapiens
caaagaaatagcaa

SEQ ID NO: 1942726 - DNA, 15 bp, Homo sapiens
caaagaaccaggagg

SEQ ID NO: 1942727 - DNA, 14 bp, Homo sapiens
caaagaacccccct

SEQ ID NO: 1942728 - DNA, 16 bp, Homo sapiens
caaagaacccccctcc

SEQ ID NO: 1942729 - DNA, 17 bp, Homo sapiens
caaagaacccccctccc

SEQ ID NO: 1942730 - DNA, 21 bp, Homo sapiens
caaagaatagtttggttcttc

SEQ ID NO: 1942731 - DNA, 14 bp, Homo sapiens
caaagacagaagcc

SEQ ID NO: 1942732 - DNA, 21 bp, Homo sapiens
caaagccagcgtcctcctctg

SEQ ID NO: 1942733 - DNA, 14 bp, Homo sapiens
caaagtgagaaatt

SEQ ID NO: 1942734 - DNA, 16 bp, Homo sapiens
caaagttgtttaacta

SEQ ID NO: 1942735 - DNA, 21 bp, Homo sapiens
caaagtttttacagtgtatct

SEQ ID NO: 1942736 - DNA, 15 bp, Homo sapiens
caaatatatttaact

SEQ ID NO: 1942737 - DNA, 17 bp, Homo sapiens
caaatatgattctcctc

SEQ ID NO: 1942738 - DNA, 19 bp, Homo sapiens
caaatatgattctcctctc

SEQ ID NO: 1942739 - DNA, 21 bp, Homo sapiens
caaatatgattctcctctccc

SEQ ID NO: 1942740 - DNA, 13 bp, Homo sapiens
caaatatgcactt

SEQ ID NO: 1942741 - DNA, 21 bp, Homo sapiens
caaatgagatgtatgcccaaa

SEQ ID NO: 1942742 - DNA, 13 bp, Homo sapiens
caaatgttgacct

SEQ ID NO: 1942743 - DNA, 23 bp, Homo sapiens
caaatgttgacctttgaggtcta

SEQ ID NO: 1942744 - DNA, 17 bp, Homo sapiens
caaatttcatctttcca

SEQ ID NO: 1942745 - DNA, 13 bp, Homo sapiens
caacaatttctac

SEQ ID NO: 1942746 - DNA, 18 bp, Homo sapiens
caacactgccagaagtgt

SEQ ID NO: 1942747 - DNA, 22 bp, Homo sapiens
caacactgccagaagtgtgttt

SEQ ID NO: 1942748 - DNA, 10 bp, Homo sapiens
caacagaaac

SEQ ID NO: 1942749 - DNA, 11 bp, Homo sapiens
caacagcctgt

SEQ ID NO: 1942750 - DNA, 22 bp, Homo sapiens
caacagcctgtttgggaggctg

SEQ ID NO: 1942751 - DNA, 17 bp, Homo sapiens
caacatgaattaagaac

SEQ ID NO: 1942752 - DNA, 23 bp, Homo sapiens
caacatttctgccaggtttgtta

SEQ ID NO: 1942753 - DNA, 14 bp, Homo sapiens
caaccacctctggc

SEQ ID NO: 1942754 - DNA, 16 bp, Homo sapiens
caaccacctctggccc

SEQ ID NO: 1942755 - DNA, 18 bp, Homo sapiens
caaccacctctggccctg

SEQ ID NO: 1942756 - DNA, 23 bp, Homo sapiens
caaccatgagaccactgttatca

SEQ ID NO: 1942757 - DNA, 21 bp, Homo sapiens
caaccctcagagccaccccta

SEQ ID NO: 1942758 - DNA, 16 bp, Homo sapiens
caaccttctgtggctc

SEQ ID NO: 1942759 - DNA, 15 bp, Homo sapiens
caacgtggggcagca

SEQ ID NO: 1942760 - DNA, 17 bp, Homo sapiens
caacgtggggcagcaca

SEQ ID NO: 1942761 - DNA, 18 bp, Homo sapiens
caactatgatttggaaaa

SEQ ID NO: 1942762 - DNA, 22 bp, Homo sapiens
caactatgatttggaaaataaa

SEQ ID NO: 1942763 - DNA, 20 bp, Homo sapiens
caactccagccacccagcca

SEQ ID NO: 1942764 - DNA, 22 bp, Homo sapiens
caactccagccacccagccagg

SEQ ID NO: 1942765 - DNA, 23 bp, Homo sapiens
caactccagggttaaagaaaggc

SEQ ID NO: 1942766 - DNA, 22 bp, Homo sapiens
caactctggccttggttcctcc

SEQ ID NO: 1942767 - DNA, 16 bp, Homo sapiens
caactctttgagaaac

SEQ ID NO: 1942768 - DNA, 16 bp, Homo sapiens
caactggtatatattt

SEQ ID NO: 1942769 - DNA, 14 bp, Homo sapiens
caactttagaaaga

SEQ ID NO: 1942770 - DNA, 16 bp, Homo sapiens
caactttagaaagaaa

SEQ ID NO: 1942771 - DNA, 17 bp, Homo sapiens
caagacaccttcccagc

SEQ ID NO: 1942772 - DNA, 18 bp, Homo sapiens
caagacaccttcccagct

SEQ ID NO: 1942773 - DNA, 16 bp, Homo sapiens
caagagactactctgc

SEQ ID NO: 1942774 - DNA, 22 bp, Homo sapiens
caagagatgagaaacaacagaa

SEQ ID NO: 1942775 - DNA, 19 bp, Homo sapiens
caagagggcactggtggcc

SEQ ID NO: 1942776 - DNA, 13 bp, Homo sapiens
caagcaagaaaca

SEQ ID NO: 1942777 - DNA, 18 bp, Homo sapiens
caagcaagaaacactggg

SEQ ID NO: 1942778 - DNA, 21 bp, Homo sapiens
caagcagattggagaaaccct

SEQ ID NO: 1942779 - DNA, 13 bp, Homo sapiens
caagccaggagac

SEQ ID NO: 1942780 - DNA, 22 bp, Homo sapiens
caagccaggccctctctgcagt

SEQ ID NO: 1942781 - DNA, 19 bp, Homo sapiens
caagccagggttccagaca

SEQ ID NO: 1942782 - DNA, 17 bp, Homo sapiens
caagcccagcactgctt

SEQ ID NO: 1942783 - DNA, 16 bp, Homo sapiens
caagccgtggcttccc

SEQ ID NO: 1942784 - DNA, 18 bp, Homo sapiens
caagcctgggccactggc

SEQ ID NO: 1942785 - DNA, 12 bp, Homo sapiens
caagctggcagg

SEQ ID NO: 1942786 - DNA, 12 bp, Homo sapiens
caaggaagtcaa

SEQ ID NO: 1942787 - DNA, 16 bp, Homo sapiens
caaggcctatgccacc

SEQ ID NO: 1942788 - DNA, 16 bp, Homo sapiens
caaggcgtgaggatgg

SEQ ID NO: 1942789 - DNA, 15 bp, Homo sapiens
caagggaaaagtctc

SEQ ID NO: 1942790 - DNA, 15 bp, Homo sapiens
caaggtggtcttgga

SEQ ID NO: 1942791 - DNA, 21 bp, Homo sapiens
caagtcccagggagctctgca

SEQ ID NO: 1942792 - DNA, 22 bp, Homo sapiens
atgcactttccctagaaagcca

SEQ ID NO: 1942793 - DNA, 17 bp, Homo sapiens
atgcatgtactttatat

SEQ ID NO: 1942794 - DNA, 18 bp, Homo sapiens
atgcattaacttttgtaa

SEQ ID NO: 1942795 - DNA, 14 bp, Homo sapiens
atgccacctgcagc

SEQ ID NO: 1942796 - DNA, 14 bp, Homo sapiens
atgccatcatctcc

SEQ ID NO: 1942797 - DNA, 23 bp, Homo sapiens
atgccattgacaaggtgtttctc

SEQ ID NO: 1942798 - DNA, 20 bp, Homo sapiens
atgcccagcttggagtgcca

SEQ ID NO: 1942799 - DNA, 16 bp, Homo sapiens
atgcgaatgagctggg

SEQ ID NO: 1942800 - DNA, 22 bp, Homo sapiens
atgcgaatgagctgggccctgg

SEQ ID NO: 1942801 - DNA, 17 bp, Homo sapiens
atgcgggctgggcagct

SEQ ID NO: 1942802 - DNA, 20 bp, Homo sapiens
atgctctctatagaggagga

SEQ ID NO: 1942803 - DNA, 16 bp, Homo sapiens
atggaggaaaaccaag

SEQ ID NO: 1942804 - DNA, 15 bp, Homo sapiens
atggatgtttcttct

SEQ ID NO: 1942805 - DNA, 14 bp, Homo sapiens
atggcaataggaca

SEQ ID NO: 1942806 - DNA, 20 bp, Homo sapiens
atggcagaaggcaaacccat

SEQ ID NO: 1942807 - DNA, 15 bp, Homo sapiens
atggccaggagtggg

SEQ ID NO: 1942808 - DNA, 15 bp, Homo sapiens
atggcccagcctgga

SEQ ID NO: 1942809 - DNA, 22 bp, Homo sapiens
atggccgcaacttcccaggccg

SEQ ID NO: 1942810 - DNA, 13 bp, Homo sapiens
atggccgctgccc

SEQ ID NO: 1942811 - DNA, 16 bp, Homo sapiens
atggcttagttttcat

SEQ ID NO: 1942812 - DNA, 17 bp, Homo sapiens
atgggaaggagggaggt

SEQ ID NO: 1942813 - DNA, 18 bp, Homo sapiens
atgggaggaaaagcccag

SEQ ID NO: 1942814 - DNA, 14 bp, Homo sapiens
atgggcactggaaa

SEQ ID NO: 1942815 - DNA, 14 bp, Homo sapiens
atgggccaagccag

SEQ ID NO: 1942816 - DNA, 16 bp, Homo sapiens
atggggagcagctggg

SEQ ID NO: 1942817 - DNA, 17 bp, Homo sapiens
atggggcggcctgcaga

SEQ ID NO: 1942818 - DNA, 18 bp, Homo sapiens
atggggcggcctgcagac

SEQ ID NO: 1942819 - DNA, 20 bp, Homo sapiens
atggggtgggagccacaggg

SEQ ID NO: 1942820 - DNA, 21 bp, Homo sapiens
atgggttttgttaggggtggg

SEQ ID NO: 1942821 - DNA, 22 bp, Homo sapiens
atggtaaccgagccagcagctg

SEQ ID NO: 1942822 - DNA, 13 bp, Homo sapiens
atggtccaggaga

SEQ ID NO: 1942823 - DNA, 14 bp, Homo sapiens
atggtgagaattaa

SEQ ID NO: 1942824 - DNA, 17 bp, Homo sapiens
atggtgatgaaatgtaa

SEQ ID NO: 1942825 - DNA, 11 bp, Homo sapiens
atggtgcagtg

SEQ ID NO: 1942826 - DNA, 16 bp, Homo sapiens
atggtgcagtgaagaa

SEQ ID NO: 1942827 - DNA, 13 bp, Homo sapiens
atggtggagggcc

SEQ ID NO: 1942828 - DNA, 17 bp, Homo sapiens
atggtggtttcagaaag

SEQ ID NO: 1942829 - DNA, 21 bp, Homo sapiens
atggtggtttcagaaagggca

SEQ ID NO: 1942830 - DNA, 17 bp, Homo sapiens
atggtgtgccacaggct

SEQ ID NO: 1942831 - DNA, 20 bp, Homo sapiens
atgtaaaaatatatatgtat

SEQ ID NO: 1942832 - DNA, 16 bp, Homo sapiens
atgtaaattattgtaa

SEQ ID NO: 1942833 - DNA, 17 bp, Homo sapiens
atgtaaattattgtaaa

SEQ ID NO: 1942834 - DNA, 15 bp, Homo sapiens
atgtaccatgtacat

SEQ ID NO: 1942835 - DNA, 21 bp, Homo sapiens
atgtactttatattttctata

SEQ ID NO: 1942836 - DNA, 14 bp, Homo sapiens
atgtagaaaatttg

SEQ ID NO: 1942837 - DNA, 16 bp, Homo sapiens
atgtagaagagggaga

SEQ ID NO: 1942838 - DNA, 21 bp, Homo sapiens
atgtagcaaaatacatgacat

SEQ ID NO: 1942839 - DNA, 14 bp, Homo sapiens
atgtaggaagtagg

SEQ ID NO: 1942840 - DNA, 17 bp, Homo sapiens
atgtatttataaatata

SEQ ID NO: 1942841 - DNA, 19 bp, Homo sapiens
atgtcaaccttgtgtgagt

SEQ ID NO: 1942842 - DNA, 21 bp, Homo sapiens
atgtcagtagtgcctgtgatc

SEQ ID NO: 1942843 - DNA, 16 bp, Homo sapiens
atgtccatgaaaaaca

SEQ ID NO: 1942844 - DNA, 10 bp, Homo sapiens
atgtctgtga

SEQ ID NO: 1942845 - DNA, 10 bp, Homo sapiens
atgtcttgtg

SEQ ID NO: 1942846 - DNA, 22 bp, Homo sapiens
atgtgaaaatggtccaggagaa

SEQ ID NO: 1942847 - DNA, 19 bp, Homo sapiens
atgtgatgaatactgtatt

SEQ ID NO: 1942848 - DNA, 23 bp, Homo sapiens
atgtgcactgaatcgtttcatgt

SEQ ID NO: 1942849 - DNA, 12 bp, Homo sapiens
atgtgcccccag

SEQ ID NO: 1942850 - DNA, 23 bp, Homo sapiens
atgtggttaccgagtatctgtaa

SEQ ID NO: 1942851 - DNA, 15 bp, Homo sapiens
atgtgtatgtgttta

SEQ ID NO: 1942852 - DNA, 19 bp, Homo sapiens
atgttaattaaagtaaaat

SEQ ID NO: 1942853 - DNA, 22 bp, Homo sapiens
atgttaattaaagtaaaattat

SEQ ID NO: 1942854 - DNA, 14 bp, Homo sapiens
atgttcacttttga

SEQ ID NO: 1942855 - DNA, 14 bp, Homo sapiens
atgttgttatttaa

SEQ ID NO: 1942856 - DNA, 15 bp, Homo sapiens
atgttgttatttaaa

SEQ ID NO: 1942857 - DNA, 17 bp, Homo sapiens
atgtttaatatctgact

SEQ ID NO: 1942858 - DNA, 22 bp, Homo sapiens
atgtttcttctaggttctaaaa

SEQ ID NO: 1942859 - DNA, 22 bp, Homo sapiens
atgtttgcaactggtatatatt

SEQ ID NO: 1942860 - DNA, 13 bp, Homo sapiens
atgttttaatatc

SEQ ID NO: 1942861 - DNA, 18 bp, Homo sapiens
atgttttacaatggctgg

SEQ ID NO: 1942862 - DNA, 22 bp, Homo sapiens
attaaaataaaacgttatctca

SEQ ID NO: 1942863 - DNA, 14 bp, Homo sapiens
attaaaatcctcaa

SEQ ID NO: 1942864 - DNA, 16 bp, Homo sapiens
attaaaatcctcaatc

SEQ ID NO: 1942865 - DNA, 17 bp, Homo sapiens
attaaaccaagcagctt

SEQ ID NO: 1942866 - DNA, 15 bp, Homo sapiens
attaaagactccagt

SEQ ID NO: 1942867 - DNA, 18 bp, Homo sapiens
attaacaggtctttgaaa

SEQ ID NO: 1942868 - DNA, 19 bp, Homo sapiens
attaacaggtctttgaaat

SEQ ID NO: 1942869 - DNA, 13 bp, Homo sapiens
attaacatatatt

SEQ ID NO: 1942870 - DNA, 13 bp, Homo sapiens
attaacctctcac

SEQ ID NO: 1942871 - DNA, 13 bp, Homo sapiens
attaacttttgta

SEQ ID NO: 1942872 - DNA, 14 bp, Homo sapiens
attaacttttgtaa

SEQ ID NO: 1942873 - DNA, 20 bp, Homo sapiens
attaagccacttaaaatgtt

SEQ ID NO: 1942874 - DNA, 15 bp, Homo sapiens
attaatatcacagca

SEQ ID NO: 1942875 - DNA, 15 bp, Homo sapiens
attacagaagaagct

SEQ ID NO: 1942876 - DNA, 19 bp, Homo sapiens
attacagatgggcaaatta

SEQ ID NO: 1942877 - DNA, 17 bp, Homo sapiens
attacctcctgagaaaa

SEQ ID NO: 1942878 - DNA, 18 bp, Homo sapiens
attacttttctgcaatgt

SEQ ID NO: 1942879 - DNA, 15 bp, Homo sapiens
attacttttgtaaat

SEQ ID NO: 1942880 - DNA, 18 bp, Homo sapiens
attacttttgtaaatatt

SEQ ID NO: 1942881 - DNA, 21 bp, Homo sapiens
attagagcagatgacccctcc

SEQ ID NO: 1942882 - DNA, 17 bp, Homo sapiens
attagagtgtctttcca

SEQ ID NO: 1942883 - DNA, 21 bp, Homo sapiens
attaggaagcttgatttgctt

SEQ ID NO: 1942884 - DNA, 14 bp, Homo sapiens
attataagtaactt

SEQ ID NO: 1942885 - DNA, 23 bp, Homo sapiens
attatagtgatgtaatcttgaat

SEQ ID NO: 1942886 - DNA, 17 bp, Homo sapiens
attatccaggtaatcca

SEQ ID NO: 1942887 - DNA, 16 bp, Homo sapiens
attattaaatcagaat

SEQ ID NO: 1942888 - DNA, 21 bp, Homo sapiens
attattaaatcggcaacaggg

SEQ ID NO: 1942889 - DNA, 14 bp, Homo sapiens
attattcagtgtca

SEQ ID NO: 1942890 - DNA, 15 bp, Homo sapiens
attattcagtgtcac

SEQ ID NO: 1942891 - DNA, 15 bp, Homo sapiens
attattccctgaatt

SEQ ID NO: 1942892 - DNA, 15 bp, Homo sapiens
attattggcttgcac

SEQ ID NO: 1942893 - DNA, 17 bp, Homo sapiens
attattgtaaacttttt

SEQ ID NO: 1942894 - DNA, 19 bp, Homo sapiens
attattgtaaactttttca

SEQ ID NO: 1942895 - DNA, 16 bp, Homo sapiens
attatttatatatgta

SEQ ID NO: 1942896 - DNA, 13 bp, Homo sapiens
attcacaacacaa

SEQ ID NO: 1942897 - DNA, 17 bp, Homo sapiens
attcacatctaacctca

SEQ ID NO: 1942898 - DNA, 15 bp, Homo sapiens
attcacttctatata

SEQ ID NO: 1942899 - DNA, 19 bp, Homo sapiens
attcagtgttaaatgtgat

SEQ ID NO: 1942900 - DNA, 11 bp, Homo sapiens
attcatttcaa

SEQ ID NO: 1942901 - DNA, 18 bp, Homo sapiens
attccagagagtggctcc

SEQ ID NO: 1942902 - DNA, 16 bp, Homo sapiens
attcccatcactgctg

SEQ ID NO: 1942903 - DNA, 17 bp, Homo sapiens
attccctagaaacttcc

SEQ ID NO: 1942904 - DNA, 13 bp, Homo sapiens
attccctctcatc

SEQ ID NO: 1942905 - DNA, 17 bp, Homo sapiens
attcctgggaaatattc

SEQ ID NO: 1942906 - DNA, 18 bp, Homo sapiens
attctaaatgaatgttta

SEQ ID NO: 1942907 - DNA, 15 bp, Homo sapiens
attctagctttgagc

SEQ ID NO: 1942908 - DNA, 13 bp, Homo sapiens
attctcctctccc

SEQ ID NO: 1942909 - DNA, 17 bp, Homo sapiens
attctctgagctgtgca

SEQ ID NO: 1942910 - DNA, 13 bp, Homo sapiens
attctctgtctca

SEQ ID NO: 1942911 - DNA, 14 bp, Homo sapiens
attctctgtctcat

SEQ ID NO: 1942912 - DNA, 16 bp, Homo sapiens
attctctgtctcatcc

SEQ ID NO: 1942913 - DNA, 18 bp, Homo sapiens
attctctgtctcatccat

SEQ ID NO: 1942914 - DNA, 18 bp, Homo sapiens
attctcttttcaaacaca

SEQ ID NO: 1942915 - DNA, 21 bp, Homo sapiens
attctcttttcaaacacacac

SEQ ID NO: 1942916 - DNA, 18 bp, Homo sapiens
attctggggtggggcttg

SEQ ID NO: 1942917 - DNA, 20 bp, Homo sapiens
attctggggtggggcttgga

SEQ ID NO: 1942918 - DNA, 13 bp, Homo sapiens
attcttaagcact

SEQ ID NO: 1942919 - DNA, 14 bp, Homo sapiens
attcttaagcactt

SEQ ID NO: 1942920 - DNA, 15 bp, Homo sapiens
attcttaagcacttt

SEQ ID NO: 1942921 - DNA, 17 bp, Homo sapiens
attcttgtccacattct

SEQ ID NO: 1942922 - DNA, 23 bp, Homo sapiens
attcttttttcttccccctccat

SEQ ID NO: 1942923 - DNA, 18 bp, Homo sapiens
attgaagtatctgtacct

SEQ ID NO: 1942924 - DNA, 22 bp, Homo sapiens
attgaattcttggttgaggaaa

SEQ ID NO: 1942925 - DNA, 23 bp, Homo sapiens
attgaattcttggttgaggaaac

SEQ ID NO: 1942926 - DNA, 14 bp, Homo sapiens
attgacaaactctc

SEQ ID NO: 1942927 - DNA, 18 bp, Homo sapiens
attgagttcatcatgagc

SEQ ID NO: 1942928 - DNA, 18 bp, Homo sapiens
attgatagagtgttatca

SEQ ID NO: 1942929 - DNA, 23 bp, Homo sapiens
attgatcggagcctcctctctca

SEQ ID NO: 1942930 - DNA, 12 bp, Homo sapiens
agcagctgaagt

SEQ ID NO: 1942931 - DNA, 19 bp, Homo sapiens
agcagctgaagtctctttt

SEQ ID NO: 1942932 - DNA, 21 bp, Homo sapiens
agcagctgaagtctctttttc

SEQ ID NO: 1942933 - DNA, 12 bp, Homo sapiens
agcagctgggca

SEQ ID NO: 1942934 - DNA, 21 bp, Homo sapiens
agcaggaaatgaaaatgtctt

SEQ ID NO: 1942935 - DNA, 19 bp, Homo sapiens
agcagggctgggcgcctct

SEQ ID NO: 1942936 - DNA, 20 bp, Homo sapiens
agcagtgaaacttgtgctat

SEQ ID NO: 1942937 - DNA, 22 bp, Homo sapiens
agcagtgaatgattcagtgtta

SEQ ID NO: 1942938 - DNA, 17 bp, Homo sapiens
agcataagtttctggga

SEQ ID NO: 1942939 - DNA, 13 bp, Homo sapiens
agcatcaaactct

SEQ ID NO: 1942940 - DNA, 14 bp, Homo sapiens
agcatcaaactctt

SEQ ID NO: 1942941 - DNA, 13 bp, Homo sapiens
agcattctggggt

SEQ ID NO: 1942942 - DNA, 20 bp, Homo sapiens
agcattgtggctgtcagcag

SEQ ID NO: 1942943 - DNA, 13 bp, Homo sapiens
agccacccagcca

SEQ ID NO: 1942944 - DNA, 20 bp, Homo sapiens
agccacgtgctggagagtag

SEQ ID NO: 1942945 - DNA, 16 bp, Homo sapiens
agccagcgtcctcctc

SEQ ID NO: 1942946 - DNA, 18 bp, Homo sapiens
agccagcgtcctcctctg

SEQ ID NO: 1942947 - DNA, 21 bp, Homo sapiens
agccagcgtcctcctctgtga

SEQ ID NO: 1942948 - DNA, 23 bp, Homo sapiens
agccagcgtcctcctctgtgacc

SEQ ID NO: 1942949 - DNA, 13 bp, Homo sapiens
agccagctctggg

SEQ ID NO: 1942950 - DNA, 18 bp, Homo sapiens
agccaggagaccctgtct

SEQ ID NO: 1942951 - DNA, 21 bp, Homo sapiens
agccaggccctctctgcagtc

SEQ ID NO: 1942952 - DNA, 16 bp, Homo sapiens
agccagggttccagac

SEQ ID NO: 1942953 - DNA, 18 bp, Homo sapiens
agccagggttccagacag

SEQ ID NO: 1942954 - DNA, 20 bp, Homo sapiens
agccagtaaggcagctctgt

SEQ ID NO: 1942955 - DNA, 21 bp, Homo sapiens
agccattcacaacacaatcaa

SEQ ID NO: 1942956 - DNA, 17 bp, Homo sapiens
agcccaatcactgccta

SEQ ID NO: 1942957 - DNA, 21 bp, Homo sapiens
agcccagcactgcttgaggaa

SEQ ID NO: 1942958 - DNA, 13 bp, Homo sapiens
agcccagcctgca

SEQ ID NO: 1942959 - DNA, 14 bp, Homo sapiens
agcccagctctgaa

SEQ ID NO: 1942960 - DNA, 20 bp, Homo sapiens
agcccaggaattctcacagg

SEQ ID NO: 1942961 - DNA, 11 bp, Homo sapiens
agcccaggaga

SEQ ID NO: 1942962 - DNA, 23 bp, Homo sapiens
agcccaggagaagtcccaccagg

SEQ ID NO: 1942963 - DNA, 16 bp, Homo sapiens
agcccaggaggacctg

SEQ ID NO: 1942964 - DNA, 13 bp, Homo sapiens
agccccattcctg

SEQ ID NO: 1942965 - DNA, 16 bp, Homo sapiens
agccccattcctggga

SEQ ID NO: 1942966 - DNA, 17 bp, Homo sapiens
agccccctttgattgag

SEQ ID NO: 1942967 - DNA, 23 bp, Homo sapiens
agcccctatcctgcaccctctgc

SEQ ID NO: 1942968 - DNA, 12 bp, Homo sapiens
agcccctcccca

SEQ ID NO: 1942969 - DNA, 21 bp, Homo sapiens
agcccctccccatggtgcagt

SEQ ID NO: 1942970 - DNA, 20 bp, Homo sapiens
agccctagggtggagagcca

SEQ ID NO: 1942971 - DNA, 16 bp, Homo sapiens
agccctcatcccgagc

SEQ ID NO: 1942972 - DNA, 15 bp, Homo sapiens
agccctgccctcact

SEQ ID NO: 1942973 - DNA, 19 bp, Homo sapiens
agccctgctttgggctgcc

SEQ ID NO: 1942974 - DNA, 23 bp, Homo sapiens
agccctgctttgggctgccctgg

SEQ ID NO: 1942975 - DNA, 15 bp, Homo sapiens
agccgctgagcgagg

SEQ ID NO: 1942976 - DNA, 16 bp, Homo sapiens
agccgggtctgcctct

SEQ ID NO: 1942977 - DNA, 20 bp, Homo sapiens
agccgggtctgcctcttctg

SEQ ID NO: 1942978 - DNA, 21 bp, Homo sapiens
agccgggtctgcctcttctgg

SEQ ID NO: 1942979 - DNA, 22 bp, Homo sapiens
agccgggtctgcctcttctggg

SEQ ID NO: 1942980 - DNA, 15 bp, Homo sapiens
agccgtgccttcagc

SEQ ID NO: 1942981 - DNA, 16 bp, Homo sapiens
agccgtgccttcagct

SEQ ID NO: 1942982 - DNA, 22 bp, Homo sapiens
agccgtggccgagggcttccct

SEQ ID NO: 1942983 - DNA, 22 bp, Homo sapiens
agccgtggcttcccgctcagcc

SEQ ID NO: 1942984 - DNA, 14 bp, Homo sapiens
agcctagtgaaggc

SEQ ID NO: 1942985 - DNA, 23 bp, Homo sapiens
agcctagtgaaggcttctctctg

SEQ ID NO: 1942986 - DNA, 15 bp, Homo sapiens
agcctcccctgccag

SEQ ID NO: 1942987 - DNA, 16 bp, Homo sapiens
agcctcccctgccagg

SEQ ID NO: 1942988 - DNA, 17 bp, Homo sapiens
agcctcccctgccaggg

SEQ ID NO: 1942989 - DNA, 12 bp, Homo sapiens
agcctcctgacc

SEQ ID NO: 1942990 - DNA, 17 bp, Homo sapiens
agcctggcacagggcag

SEQ ID NO: 1942991 - DNA, 18 bp, Homo sapiens
agcctggcacagggcagt

SEQ ID NO: 1942992 - DNA, 16 bp, Homo sapiens
agcctggccccatggt

SEQ ID NO: 1942993 - DNA, 15 bp, Homo sapiens
agcctggttccctct

SEQ ID NO: 1942994 - DNA, 18 bp, Homo sapiens
agcctggttccctctttc

SEQ ID NO: 1942995 - DNA, 21 bp, Homo sapiens
agcctggttccctctttcctg

SEQ ID NO: 1942996 - DNA, 16 bp, Homo sapiens
agcctgtgggagaagg

SEQ ID NO: 1942997 - DNA, 18 bp, Homo sapiens
agcctgtttgggaggctg

SEQ ID NO: 1942998 - DNA, 18 bp, Homo sapiens
agccttgtaattctaaat

SEQ ID NO: 1942999 - DNA, 19 bp, Homo sapiens
agccttttattaacatata

SEQ ID NO: 1943000 - DNA, 13 bp, Homo sapiens
agcgacacaggct

SEQ ID NO: 1943001 - DNA, 21 bp, Homo sapiens
agcgaggcagaatggtgggct

SEQ ID NO: 1943002 - DNA, 21 bp, Homo sapiens
agcgatgatgtccccttccct

SEQ ID NO: 1943003 - DNA, 20 bp, Homo sapiens
agcgctggcagcgctcctgg

SEQ ID NO: 1943004 - DNA, 12 bp, Homo sapiens
agcgctggcctc

SEQ ID NO: 1943005 - DNA, 17 bp, Homo sapiens
agcgggtaaaaagagaa

SEQ ID NO: 1943006 - DNA, 16 bp, Homo sapiens
agcgtcctcctctgtg

SEQ ID NO: 1943007 - DNA, 13 bp, Homo sapiens
agctaaatccttt

SEQ ID NO: 1943008 - DNA, 18 bp, Homo sapiens
agctaatggtcctgttat

SEQ ID NO: 1943009 - DNA, 14 bp, Homo sapiens
agctcaggagaagg

SEQ ID NO: 1943010 - DNA, 18 bp, Homo sapiens
agctcaggagaaggcctg

SEQ ID NO: 1943011 - DNA, 22 bp, Homo sapiens
agctcaggagaaggcctgcccc

SEQ ID NO: 1943012 - DNA, 13 bp, Homo sapiens
agctccttcctgg

SEQ ID NO: 1943013 - DNA, 12 bp, Homo sapiens
agctctgcatta

SEQ ID NO: 1943014 - DNA, 22 bp, Homo sapiens
agctctgtatcaggacccagag

SEQ ID NO: 1943015 - DNA, 22 bp, Homo sapiens
agctgactggccccagggactc

SEQ ID NO: 1943016 - DNA, 15 bp, Homo sapiens
agctgaggcagcagt

SEQ ID NO: 1943017 - DNA, 17 bp, Homo sapiens
agctgaggcagcagtgt

SEQ ID NO: 1943018 - DNA, 13 bp, Homo sapiens
agctgctcctaga

SEQ ID NO: 1943019 - DNA, 20 bp, Homo sapiens
agctgcttctgggggatttc

SEQ ID NO: 1943020 - DNA, 22 bp, Homo sapiens
agctggatctccattctctcag

SEQ ID NO: 1943021 - DNA, 17 bp, Homo sapiens
agctggcaggagggtgg

SEQ ID NO: 1943022 - DNA, 20 bp, Homo sapiens
agctgggttggaaaacagta

SEQ ID NO: 1943023 - DNA, 16 bp, Homo sapiens
agctgtactgagttct

SEQ ID NO: 1943024 - DNA, 12 bp, Homo sapiens
agctgtgcaggt

SEQ ID NO: 1943025 - DNA, 21 bp, Homo sapiens
agctgttcaacaagagtaaat

SEQ ID NO: 1943026 - DNA, 19 bp, Homo sapiens
agcttcatggcagaaggca

SEQ ID NO: 1943027 - DNA, 14 bp, Homo sapiens
agcttccttccaag

SEQ ID NO: 1943028 - DNA, 18 bp, Homo sapiens
agcttcttaaatgagaag

SEQ ID NO: 1943029 - DNA, 22 bp, Homo sapiens
agcttcttaatataactgcctt

SEQ ID NO: 1943030 - DNA, 15 bp, Homo sapiens
agcttggagtgccac

SEQ ID NO: 1943031 - DNA, 19 bp, Homo sapiens
agcttggagtgccacgtgg

SEQ ID NO: 1943032 - DNA, 16 bp, Homo sapiens
agcttggctgtagaag

SEQ ID NO: 1943033 - DNA, 21 bp, Homo sapiens
agcttttttttcagccattca

SEQ ID NO: 1943034 - DNA, 12 bp, Homo sapiens
aggaaaacagta

SEQ ID NO: 1943035 - DNA, 20 bp, Homo sapiens
aggaaaaccaagccgtggct

SEQ ID NO: 1943036 - DNA, 18 bp, Homo sapiens
aggaaacacgtttagaaa

SEQ ID NO: 1943037 - DNA, 21 bp, Homo sapiens
aggaaacacgtttagaaatga

SEQ ID NO: 1943038 - DNA, 19 bp, Homo sapiens
aggaaatgaaaatgtcttg

SEQ ID NO: 1943039 - DNA, 19 bp, Homo sapiens
aggaacccttacagtagga

SEQ ID NO: 1943040 - DNA, 17 bp, Homo sapiens
aggaagaattacaattt

SEQ ID NO: 1943041 - DNA, 21 bp, Homo sapiens
aggaagcacaagaagtgggag

SEQ ID NO: 1943042 - DNA, 16 bp, Homo sapiens
aggaagcacagcaggt

SEQ ID NO: 1943043 - DNA, 14 bp, Homo sapiens
aggaagccacgtgc

SEQ ID NO: 1943044 - DNA, 20 bp, Homo sapiens
aggaagccacgtgctggaga

SEQ ID NO: 1943045 - DNA, 14 bp, Homo sapiens
aggaaggatgagca

SEQ ID NO: 1943046 - DNA, 22 bp, Homo sapiens
aggaaggctgagaggagagaga

SEQ ID NO: 1943047 - DNA, 23 bp, Homo sapiens
aggaagggcccccggctcggcct

SEQ ID NO: 1943048 - DNA, 18 bp, Homo sapiens
aggaatgttatcagtatt

SEQ ID NO: 1943049 - DNA, 15 bp, Homo sapiens
aggacaaaaatataa

SEQ ID NO: 1943050 - DNA, 17 bp, Homo sapiens
aggacactgcagaacag

SEQ ID NO: 1943051 - DNA, 15 bp, Homo sapiens
aggacagacttagga

SEQ ID NO: 1943052 - DNA, 19 bp, Homo sapiens
aggaccagtcaacctgggc

SEQ ID NO: 1943053 - DNA, 20 bp, Homo sapiens
aggacccaaggtggtcttgg

SEQ ID NO: 1943054 - DNA, 15 bp, Homo sapiens
aggaccctcccaggt

SEQ ID NO: 1943055 - DNA, 14 bp, Homo sapiens
aggacgtgggcggc

SEQ ID NO: 1943056 - DNA, 14 bp, Homo sapiens
aggactctctttct

SEQ ID NO: 1943057 - DNA, 14 bp, Homo sapiens
aggacttgtgcctc

SEQ ID NO: 1943058 - DNA, 17 bp, Homo sapiens
aggagaaggcctgcccc

SEQ ID NO: 1943059 - DNA, 19 bp, Homo sapiens
aggagaaggcctgcccccc

SEQ ID NO: 1943060 - DNA, 15 bp, Homo sapiens
aggagaccctgtctt

SEQ ID NO: 1943061 - DNA, 14 bp, Homo sapiens
aggagagaatgaga

SEQ ID NO: 1943062 - DNA, 12 bp, Homo sapiens
atacgtaaaaat

SEQ ID NO: 1943063 - DNA, 18 bp, Homo sapiens
atactaaatatgaaattt

SEQ ID NO: 1943064 - DNA, 22 bp, Homo sapiens
atactgtatgccggctccttca

SEQ ID NO: 1943065 - DNA, 13 bp, Homo sapiens
atacttgagactg

SEQ ID NO: 1943066 - DNA, 13 bp, Homo sapiens
atagagcctgagg

SEQ ID NO: 1943067 - DNA, 21 bp, Homo sapiens
atagaggatgatgtaattaaa

SEQ ID NO: 1943068 - DNA, 20 bp, Homo sapiens
atagataagagtagaaactg

SEQ ID NO: 1943069 - DNA, 13 bp, Homo sapiens
atagcaagagatg

SEQ ID NO: 1943070 - DNA, 19 bp, Homo sapiens
atagccatttgaagaagga

SEQ ID NO: 1943071 - DNA, 13 bp, Homo sapiens
atagctatttaga

SEQ ID NO: 1943072 - DNA, 13 bp, Homo sapiens
atagctgagctgg

SEQ ID NO: 1943073 - DNA, 18 bp, Homo sapiens
ataggccatctgtaaata

SEQ ID NO: 1943074 - DNA, 22 bp, Homo sapiens
atagtatgcagctaaaaaataa

SEQ ID NO: 1943075 - DNA, 18 bp, Homo sapiens
atagtgtataccacctgt

SEQ ID NO: 1943076 - DNA, 19 bp, Homo sapiens
atagtgtataccacctgta

SEQ ID NO: 1943077 - DNA, 15 bp, Homo sapiens
atagtttctgtaatt

SEQ ID NO: 1943078 - DNA, 21 bp, Homo sapiens
atataaaaaaattgtaaatgt

SEQ ID NO: 1943079 - DNA, 14 bp, Homo sapiens
atataaatatcaca

SEQ ID NO: 1943080 - DNA, 15 bp, Homo sapiens
atataaatatcacaa

SEQ ID NO: 1943081 - DNA, 13 bp, Homo sapiens
atataactgcctt

SEQ ID NO: 1943082 - DNA, 21 bp, Homo sapiens
atataataaatgtacattaat

SEQ ID NO: 1943083 - DNA, 15 bp, Homo sapiens
atataatacttaaaa

SEQ ID NO: 1943084 - DNA, 21 bp, Homo sapiens
atataatgttgttatttaaag

SEQ ID NO: 1943085 - DNA, 15 bp, Homo sapiens
atatataaatatcta

SEQ ID NO: 1943086 - DNA, 22 bp, Homo sapiens
atatatgaaaggcttctgggac

SEQ ID NO: 1943087 - DNA, 15 bp, Homo sapiens
atatattataagatt

SEQ ID NO: 1943088 - DNA, 20 bp, Homo sapiens
atatcaataaatagatgagt

SEQ ID NO: 1943089 - DNA, 11 bp, Homo sapiens
atatcccagag

SEQ ID NO: 1943090 - DNA, 13 bp, Homo sapiens
atatcccagagaa

SEQ ID NO: 1943091 - DNA, 20 bp, Homo sapiens
atatctgactgaaattaaac

SEQ ID NO: 1943092 - DNA, 19 bp, Homo sapiens
atatctgtgcaatggaata

SEQ ID NO: 1943093 - DNA, 23 bp, Homo sapiens
atatctgtgcaatggaatataaa

SEQ ID NO: 1943094 - DNA, 23 bp, Homo sapiens
atatgaggatgcagagtcagcag

SEQ ID NO: 1943095 - DNA, 17 bp, Homo sapiens
atatgattctcctctcc

SEQ ID NO: 1943096 - DNA, 19 bp, Homo sapiens
atatgattctcctctccca

SEQ ID NO: 1943097 - DNA, 13 bp, Homo sapiens
atatgcactttcc

SEQ ID NO: 1943098 - DNA, 20 bp, Homo sapiens
atatgcactttccctagaaa

SEQ ID NO: 1943099 - DNA, 12 bp, Homo sapiens
atatgcatgtac

SEQ ID NO: 1943100 - DNA, 19 bp, Homo sapiens
atatgtaccatgtacatga

SEQ ID NO: 1943101 - DNA, 14 bp, Homo sapiens
atatgtgagcatga

SEQ ID NO: 1943102 - DNA, 19 bp, Homo sapiens
atatgtgagcatgaaacta

SEQ ID NO: 1943103 - DNA, 18 bp, Homo sapiens
atattacttttgtaaata

SEQ ID NO: 1943104 - DNA, 19 bp, Homo sapiens
atattacttttgtaaatat

SEQ ID NO: 1943105 - DNA, 20 bp, Homo sapiens
atattacttttgtaaatatt

SEQ ID NO: 1943106 - DNA, 22 bp, Homo sapiens
atattacttttgtaaatattct

SEQ ID NO: 1943107 - DNA, 17 bp, Homo sapiens
atattccctagaaactt

SEQ ID NO: 1943108 - DNA, 23 bp, Homo sapiens
atattccctagaaacttccaaat

SEQ ID NO: 1943109 - DNA, 23 bp, Homo sapiens
atattcttgtccacattctactt

SEQ ID NO: 1943110 - DNA, 12 bp, Homo sapiens
atattggacatt

SEQ ID NO: 1943111 - DNA, 18 bp, Homo sapiens
atatttaggatttgtgtt

SEQ ID NO: 1943112 - DNA, 14 bp, Homo sapiens
atatttgtaacttt

SEQ ID NO: 1943113 - DNA, 19 bp, Homo sapiens
atattttcaacgcagccct

SEQ ID NO: 1943114 - DNA, 21 bp, Homo sapiens
atcaaaactttcttttctgga

SEQ ID NO: 1943115 - DNA, 17 bp, Homo sapiens
atcaagcttgtgtactt

SEQ ID NO: 1943116 - DNA, 19 bp, Homo sapiens
atcaagcttgtgtacttga

SEQ ID NO: 1943117 - DNA, 18 bp, Homo sapiens
atcaataaatagatgagt

SEQ ID NO: 1943118 - DNA, 21 bp, Homo sapiens
atcaatacccttggcactgat

SEQ ID NO: 1943119 - DNA, 20 bp, Homo sapiens
atcaccgtgggctccctgac

SEQ ID NO: 1943120 - DNA, 13 bp, Homo sapiens
atcactattctta

SEQ ID NO: 1943121 - DNA, 23 bp, Homo sapiens
atcactattcttaagcactttga

SEQ ID NO: 1943122 - DNA, 16 bp, Homo sapiens
atcagaccataatgtt

SEQ ID NO: 1943123 - DNA, 20 bp, Homo sapiens
atcaggacccagaggaaggg

SEQ ID NO: 1943124 - DNA, 18 bp, Homo sapiens
atcagggaggtcattttg

SEQ ID NO: 1943125 - DNA, 18 bp, Homo sapiens
atcaggtcagagcccagg

SEQ ID NO: 1943126 - DNA, 15 bp, Homo sapiens
atcagtgatgggagt

SEQ ID NO: 1943127 - DNA, 21 bp, Homo sapiens
atcatagaggatgatgtaatt

SEQ ID NO: 1943128 - DNA, 21 bp, Homo sapiens
atcattctctgtctcatccat

SEQ ID NO: 1943129 - DNA, 15 bp, Homo sapiens
atcatttctatttct

SEQ ID NO: 1943130 - DNA, 13 bp, Homo sapiens
atccaactccagg

SEQ ID NO: 1943131 - DNA, 17 bp, Homo sapiens
atccacagtgagttggg

SEQ ID NO: 1943132 - DNA, 13 bp, Homo sapiens
atccacataaaag

SEQ ID NO: 1943133 - DNA, 14 bp, Homo sapiens
atccacataaaaga

SEQ ID NO: 1943134 - DNA, 22 bp, Homo sapiens
atccacctgcagcccttttagt

SEQ ID NO: 1943135 - DNA, 16 bp, Homo sapiens
atccactaggtgccca

SEQ ID NO: 1943136 - DNA, 16 bp, Homo sapiens
atccaggtcctttcct

SEQ ID NO: 1943137 - DNA, 17 bp, Homo sapiens
atccaggtcctttcctt

SEQ ID NO: 1943138 - DNA, 14 bp, Homo sapiens
atcccagagaacaa

SEQ ID NO: 1943139 - DNA, 15 bp, Homo sapiens
atcccatctcacttt

SEQ ID NO: 1943140 - DNA, 20 bp, Homo sapiens
atcccatggatgtttcttct

SEQ ID NO: 1943141 - DNA, 14 bp, Homo sapiens
atccccctccttgc

SEQ ID NO: 1943142 - DNA, 21 bp, Homo sapiens
atccctagtcttcaagcagat

SEQ ID NO: 1943143 - DNA, 20 bp, Homo sapiens
atccctctacagagcttccc

SEQ ID NO: 1943144 - DNA, 18 bp, Homo sapiens
atcccttggcccctctct

SEQ ID NO: 1943145 - DNA, 14 bp, Homo sapiens
atccgaatctcttt

SEQ ID NO: 1943146 - DNA, 21 bp, Homo sapiens
atccgcctctgagccaggagc

SEQ ID NO: 1943147 - DNA, 12 bp, Homo sapiens
atcctatgtttt

SEQ ID NO: 1943148 - DNA, 12 bp, Homo sapiens
atcctcaatcca

SEQ ID NO: 1943149 - DNA, 22 bp, Homo sapiens
atcctcactgagaaggccccag

SEQ ID NO: 1943150 - DNA, 22 bp, Homo sapiens
atcctgaggggatatccctatg

SEQ ID NO: 1943151 - DNA, 16 bp, Homo sapiens
atcctgcaccctctgc

SEQ ID NO: 1943152 - DNA, 17 bp, Homo sapiens
atcctgcaccctctgct

SEQ ID NO: 1943153 - DNA, 17 bp, Homo sapiens
atcctgtcctcagcttc

SEQ ID NO: 1943154 - DNA, 20 bp, Homo sapiens
atccttaagaattccatcta

SEQ ID NO: 1943155 - DNA, 19 bp, Homo sapiens
atcgccctgagctactgct

SEQ ID NO: 1943156 - DNA, 21 bp, Homo sapiens
atcggcaacagggcttctctt

SEQ ID NO: 1943157 - DNA, 13 bp, Homo sapiens
atctaacctcatc

SEQ ID NO: 1943158 - DNA, 11 bp, Homo sapiens
atctcagccca

SEQ ID NO: 1943159 - DNA, 15 bp, Homo sapiens
atctcattggaccct

SEQ ID NO: 1943160 - DNA, 17 bp, Homo sapiens
atctcctgccttcctcc

SEQ ID NO: 1943161 - DNA, 17 bp, Homo sapiens
atctctgctttggaaat

SEQ ID NO: 1943162 - DNA, 22 bp, Homo sapiens
atctgaagtgtctaatgcatta

SEQ ID NO: 1943163 - DNA, 17 bp, Homo sapiens
atctgactgaaattaaa

SEQ ID NO: 1943164 - DNA, 14 bp, Homo sapiens
atctgctgtaataa

SEQ ID NO: 1943165 - DNA, 17 bp, Homo sapiens
atctgctgtaataatat

SEQ ID NO: 1943166 - DNA, 23 bp, Homo sapiens
atctggagtctgaaggagaggag

SEQ ID NO: 1943167 - DNA, 18 bp, Homo sapiens
atctgtaaatatcccaga

SEQ ID NO: 1943168 - DNA, 13 bp, Homo sapiens
atctgtctgagcc

SEQ ID NO: 1943169 - DNA, 14 bp, Homo sapiens
atctgtctgagccc

SEQ ID NO: 1943170 - DNA, 16 bp, Homo sapiens
atctgtctgagccctg

SEQ ID NO: 1943171 - DNA, 19 bp, Homo sapiens
atctgtctgagccctgccc

SEQ ID NO: 1943172 - DNA, 15 bp, Homo sapiens
atctgtgtcttgttt

SEQ ID NO: 1943173 - DNA, 22 bp, Homo sapiens
atcttaagagaatccacataaa

SEQ ID NO: 1943174 - DNA, 18 bp, Homo sapiens
atcttaagataatattta

SEQ ID NO: 1943175 - DNA, 14 bp, Homo sapiens
atcttgagcaaggc

SEQ ID NO: 1943176 - DNA, 12 bp, Homo sapiens
atctttccaaat

SEQ ID NO: 1943177 - DNA, 15 bp, Homo sapiens
atcttttcatctcat

SEQ ID NO: 1943178 - DNA, 18 bp, Homo sapiens
atctttttccagcttgag

SEQ ID NO: 1943179 - DNA, 16 bp, Homo sapiens
atgaaaaaatgtatat

SEQ ID NO: 1943180 - DNA, 13 bp, Homo sapiens
atgaaaatgtctt

SEQ ID NO: 1943181 - DNA, 14 bp, Homo sapiens
atgaaaatgtcttg

SEQ ID NO: 1943182 - DNA, 15 bp, Homo sapiens
atgaaaatgtcttgt

SEQ ID NO: 1943183 - DNA, 18 bp, Homo sapiens
atgaaagttaatttgaat

SEQ ID NO: 1943184 - DNA, 15 bp, Homo sapiens
atgaacggtgagcat

SEQ ID NO: 1943185 - DNA, 18 bp, Homo sapiens
atgaacgttttctcttca

SEQ ID NO: 1943186 - DNA, 14 bp, Homo sapiens
atgaactcaacttt

SEQ ID NO: 1943187 - DNA, 22 bp, Homo sapiens
atgacccggcccccgccctctg

SEQ ID NO: 1943188 - DNA, 18 bp, Homo sapiens
atgagaaggaatttgagt

SEQ ID NO: 1943189 - DNA, 21 bp, Homo sapiens
atgagaatttgagtgctctga

SEQ ID NO: 1943190 - DNA, 14 bp, Homo sapiens
atgagagagtgtgg

SEQ ID NO: 1943191 - DNA, 17 bp, Homo sapiens
atgagctgggccctggg

SEQ ID NO: 1943192 - DNA, 14 bp, Homo sapiens
atgagggctgagat

SEQ ID NO: 1943193 - DNA, 19 bp, Homo sapiens
atgagtctcactagcacat

SEQ ID NO: 1943194 - DNA, 22 bp, Homo sapiens
atgatactgtctaagaataatg

SEQ ID NO: 1943195 - DNA, 15 bp, Homo sapiens
atgattagtaaagaa

SEQ ID NO: 1943196 - DNA, 13 bp, Homo sapiens
atgattctcctct

SEQ ID NO: 1943197 - DNA, 17 bp, Homo sapiens
atgattctcctctccca

SEQ ID NO: 1943198 - DNA, 22 bp, Homo sapiens
atgattgtgcacatacttgaga

SEQ ID NO: 1943199 - DNA, 16 bp, Homo sapiens
ggcattcctttcttta

SEQ ID NO: 1943200 - DNA, 22 bp, Homo sapiens
ggccaaaggagggtcaggaagg

SEQ ID NO: 1943201 - DNA, 16 bp, Homo sapiens
ggccaaatatgcactt

SEQ ID NO: 1943202 - DNA, 24 bp, Homo sapiens
ggccaaatatgcactttccctaga

SEQ ID NO: 1943203 - DNA, 22 bp, Homo sapiens
ggccaagccagggttccagaca

SEQ ID NO: 1943204 - DNA, 16 bp, Homo sapiens
ggccaagggctccagg

SEQ ID NO: 1943205 - DNA, 20 bp, Homo sapiens
ggccacccccacctccctgc

SEQ ID NO: 1943206 - DNA, 13 bp, Homo sapiens
ggccactgcagtc

SEQ ID NO: 1943207 - DNA, 20 bp, Homo sapiens
ggccactgcagtcacccctg

SEQ ID NO: 1943208 - DNA, 24 bp, Homo sapiens
ggccactgcagtcacccctgtctg

SEQ ID NO: 1943209 - DNA, 11 bp, Homo sapiens
ggccagaggct

SEQ ID NO: 1943210 - DNA, 17 bp, Homo sapiens
ggccaggagtgggtttc

SEQ ID NO: 1943211 - DNA, 19 bp, Homo sapiens
ggccaggtggccactccag

SEQ ID NO: 1943212 - DNA, 19 bp, Homo sapiens
ggccatctgtaaatatccc

SEQ ID NO: 1943213 - DNA, 15 bp, Homo sapiens
ggcccacccctcttc

SEQ ID NO: 1943214 - DNA, 12 bp, Homo sapiens
ggccccagctcc

SEQ ID NO: 1943215 - DNA, 15 bp, Homo sapiens
ggcccctccttctcc

SEQ ID NO: 1943216 - DNA, 15 bp, Homo sapiens
ggcccgacagcctgg

SEQ ID NO: 1943217 - DNA, 13 bp, Homo sapiens
ggccctctctgca

SEQ ID NO: 1943218 - DNA, 14 bp, Homo sapiens
ggccctctctgctc

SEQ ID NO: 1943219 - DNA, 15 bp, Homo sapiens
ggccctctctgctct

SEQ ID NO: 1943220 - DNA, 21 bp, Homo sapiens
ggccctctctgctctgcgtgt

SEQ ID NO: 1943221 - DNA, 15 bp, Homo sapiens
ggcccttcctctcca

SEQ ID NO: 1943222 - DNA, 18 bp, Homo sapiens
ggcccttcctctccactg

SEQ ID NO: 1943223 - DNA, 23 bp, Homo sapiens
ggcccttcctctccactgccttc

SEQ ID NO: 1943224 - DNA, 17 bp, Homo sapiens
ggccgaggcaggggctg

SEQ ID NO: 1943225 - DNA, 19 bp, Homo sapiens
ggccgctgctgtgacaggc

SEQ ID NO: 1943226 - DNA, 14 bp, Homo sapiens
ggccggcagcctgg

SEQ ID NO: 1943227 - DNA, 15 bp, Homo sapiens
ggccggcagcctggt

SEQ ID NO: 1943228 - DNA, 19 bp, Homo sapiens
ggccggcccacgtcctggg

SEQ ID NO: 1943229 - DNA, 15 bp, Homo sapiens
ggccgggggtggggg

SEQ ID NO: 1943230 - DNA, 21 bp, Homo sapiens
ggcctagtggggaggggcctg

SEQ ID NO: 1943231 - DNA, 17 bp, Homo sapiens
ggcctatgccacctgca

SEQ ID NO: 1943232 - DNA, 15 bp, Homo sapiens
ggcctccgtgaccca

SEQ ID NO: 1943233 - DNA, 16 bp, Homo sapiens
ggcctcttcctccctc

SEQ ID NO: 1943234 - DNA, 23 bp, Homo sapiens
ggcctcttcctccctccctgcag

SEQ ID NO: 1943235 - DNA, 14 bp, Homo sapiens
ggcctgagaagagt

SEQ ID NO: 1943236 - DNA, 20 bp, Homo sapiens
ggcctgcagaccctgccagg

SEQ ID NO: 1943237 - DNA, 22 bp, Homo sapiens
ggcctgcagaccctgccagggg

SEQ ID NO: 1943238 - DNA, 12 bp, Homo sapiens
ggcctgcccccc

SEQ ID NO: 1943239 - DNA, 13 bp, Homo sapiens
ggcctgcccccct

SEQ ID NO: 1943240 - DNA, 14 bp, Homo sapiens
ggcctggcctgggt

SEQ ID NO: 1943241 - DNA, 15 bp, Homo sapiens
ggcctggcctgggtg

SEQ ID NO: 1943242 - DNA, 20 bp, Homo sapiens
ggcctgggagatgcagctgg

SEQ ID NO: 1943243 - DNA, 21 bp, Homo sapiens
ggcctgggtggggcagggcct

SEQ ID NO: 1943244 - DNA, 16 bp, Homo sapiens
ggcctggtctggagcc

SEQ ID NO: 1943245 - DNA, 19 bp, Homo sapiens
ggccttggttcctccagca

SEQ ID NO: 1943246 - DNA, 12 bp, Homo sapiens
ggcgactgtgaa

SEQ ID NO: 1943247 - DNA, 19 bp, Homo sapiens
ggcgcaagcgacacaggct

SEQ ID NO: 1943248 - DNA, 12 bp, Homo sapiens
ggcgcctgggtc

SEQ ID NO: 1943249 - DNA, 22 bp, Homo sapiens
ggcgggaggccacgggggaggc

SEQ ID NO: 1943250 - DNA, 23 bp, Homo sapiens
ggcggtcaataattgtggagagg

SEQ ID NO: 1943251 - DNA, 19 bp, Homo sapiens
ggcgtgggatccagagaga

SEQ ID NO: 1943252 - DNA, 19 bp, Homo sapiens
ggctaccctgagctgaggc

SEQ ID NO: 1943253 - DNA, 22 bp, Homo sapiens
ggctagaggacatattcacagt

SEQ ID NO: 1943254 - DNA, 13 bp, Homo sapiens
ggctagtctgtgc

SEQ ID NO: 1943255 - DNA, 17 bp, Homo sapiens
ggctagtctgtgcctca

SEQ ID NO: 1943256 - DNA, 15 bp, Homo sapiens
ggctattccctggag

SEQ ID NO: 1943257 - DNA, 17 bp, Homo sapiens
ggctcacccccttctcc

SEQ ID NO: 1943258 - DNA, 22 bp, Homo sapiens
ggctccagagggcactctgctt

SEQ ID NO: 1943259 - DNA, 18 bp, Homo sapiens
ggctccagagtaggtggg

SEQ ID NO: 1943260 - DNA, 16 bp, Homo sapiens
ggctccagcgtggcct

SEQ ID NO: 1943261 - DNA, 13 bp, Homo sapiens
ggctccagggcca

SEQ ID NO: 1943262 - DNA, 18 bp, Homo sapiens
ggctcccacaggcccttc

SEQ ID NO: 1943263 - DNA, 19 bp, Homo sapiens
ggctcccacaggcccttcc

SEQ ID NO: 1943264 - DNA, 20 bp, Homo sapiens
ggctcccacaggcccttcct

SEQ ID NO: 1943265 - DNA, 20 bp, Homo sapiens
ggctccctgtaacctcttca

SEQ ID NO: 1943266 - DNA, 17 bp, Homo sapiens
ggctcctcccggtgccc

SEQ ID NO: 1943267 - DNA, 16 bp, Homo sapiens
ggctctgtattctgca

SEQ ID NO: 1943268 - DNA, 13 bp, Homo sapiens
ggctcttctcctt

SEQ ID NO: 1943269 - DNA, 16 bp, Homo sapiens
ggctcttctcctttca

SEQ ID NO: 1943270 - DNA, 16 bp, Homo sapiens
ggctgaatagcagaag

SEQ ID NO: 1943271 - DNA, 15 bp, Homo sapiens
ggctgatgtcttctt

SEQ ID NO: 1943272 - DNA, 12 bp, Homo sapiens
ggctgcagggac

SEQ ID NO: 1943273 - DNA, 19 bp, Homo sapiens
ggctgcccacacaccccaa

SEQ ID NO: 1943274 - DNA, 13 bp, Homo sapiens
ggctgccctggtg

SEQ ID NO: 1943275 - DNA, 16 bp, Homo sapiens
ggctgccctggtgctg

SEQ ID NO: 1943276 - DNA, 21 bp, Homo sapiens
ggctggacttttgcagcttcc

SEQ ID NO: 1943277 - DNA, 12 bp, Homo sapiens
ggctgggcagag

SEQ ID NO: 1943278 - DNA, 17 bp, Homo sapiens
ggctgggcgcctctgtc

SEQ ID NO: 1943279 - DNA, 15 bp, Homo sapiens
ggctgtcagcaggaa

SEQ ID NO: 1943280 - DNA, 16 bp, Homo sapiens
ggctgtcagcaggaag

SEQ ID NO: 1943281 - DNA, 17 bp, Homo sapiens
ggctgtcagcaggaagc

SEQ ID NO: 1943282 - DNA, 15 bp, Homo sapiens
ggctgtggcccctcc

SEQ ID NO: 1943283 - DNA, 17 bp, Homo sapiens
ggctgtggcccctcctt

SEQ ID NO: 1943284 - DNA, 22 bp, Homo sapiens
ggcttactacatgtgggagctt

SEQ ID NO: 1943285 - DNA, 12 bp, Homo sapiens
ggcttcacagat

SEQ ID NO: 1943286 - DNA, 14 bp, Homo sapiens
ggcttccatggtgg

SEQ ID NO: 1943287 - DNA, 19 bp, Homo sapiens
ggcttcccgctcagccctc

SEQ ID NO: 1943288 - DNA, 22 bp, Homo sapiens
ggcttcccgctcagccctccct

SEQ ID NO: 1943289 - DNA, 14 bp, Homo sapiens
ggcttccctctgct

SEQ ID NO: 1943290 - DNA, 15 bp, Homo sapiens
ggcttccctctgctc

SEQ ID NO: 1943291 - DNA, 16 bp, Homo sapiens
ggcttccctctgctcc

SEQ ID NO: 1943292 - DNA, 17 bp, Homo sapiens
ggcttccctctgctcca

SEQ ID NO: 1943293 - DNA, 19 bp, Homo sapiens
ggcttcctccctccacgct

SEQ ID NO: 1943294 - DNA, 17 bp, Homo sapiens
ggcttggggtagagagg

SEQ ID NO: 1943295 - DNA, 19 bp, Homo sapiens
ggcttggggtagagaggac

SEQ ID NO: 1943296 - DNA, 21 bp, Homo sapiens
ggcttggggtagagaggacag

SEQ ID NO: 1943297 - DNA, 16 bp, Homo sapiens
ggcttgtagggtgagg

SEQ ID NO: 1943298 - DNA, 18 bp, Homo sapiens
ggctttgccattaaaatg

SEQ ID NO: 1943299 - DNA, 22 bp, Homo sapiens
ggcttttcactgctggctgcct

SEQ ID NO: 1943300 - DNA, 19 bp, Homo sapiens
gggaagctgagcccctccc

SEQ ID NO: 1943301 - DNA, 20 bp, Homo sapiens
gggaagcttcttaaatgaga

SEQ ID NO: 1943302 - DNA, 14 bp, Homo sapiens
gggacaagccaggc

SEQ ID NO: 1943303 - DNA, 20 bp, Homo sapiens
gggacaagccaggccctctc

SEQ ID NO: 1943304 - DNA, 11 bp, Homo sapiens
gggacactgaa

SEQ ID NO: 1943305 - DNA, 20 bp, Homo sapiens
gggacagatcttgagcaagg

SEQ ID NO: 1943306 - DNA, 18 bp, Homo sapiens
gggaccagcccagcctgc

SEQ ID NO: 1943307 - DNA, 15 bp, Homo sapiens
gggagaaggagaggc

SEQ ID NO: 1943308 - DNA, 17 bp, Homo sapiens
gggagaaggagaggctc

SEQ ID NO: 1943309 - DNA, 15 bp, Homo sapiens
gggagaatggctctg

SEQ ID NO: 1943310 - DNA, 17 bp, Homo sapiens
gggagaggagaggctgc

SEQ ID NO: 1943311 - DNA, 19 bp, Homo sapiens
gggagcagctgggcactgg

SEQ ID NO: 1943312 - DNA, 23 bp, Homo sapiens
gggagccacagggacgacccggg

SEQ ID NO: 1943313 - DNA, 15 bp, Homo sapiens
gggagccgcaggggc

SEQ ID NO: 1943314 - DNA, 11 bp, Homo sapiens
ggtgtggcttg

SEQ ID NO: 1943315 - DNA, 18 bp, Homo sapiens
ggtgtgtttcaggacagc

SEQ ID NO: 1943316 - DNA, 21 bp, Homo sapiens
ggttaccgagtatctgtaacc

SEQ ID NO: 1943317 - DNA, 13 bp, Homo sapiens
ggttccagacagg

SEQ ID NO: 1943318 - DNA, 14 bp, Homo sapiens
ggttccagacaggg

SEQ ID NO: 1943319 - DNA, 16 bp, Homo sapiens
ggttccctctttcctg

SEQ ID NO: 1943320 - DNA, 15 bp, Homo sapiens
ggttccgcttggagc

SEQ ID NO: 1943321 - DNA, 13 bp, Homo sapiens
ggttcctccagca

SEQ ID NO: 1943322 - DNA, 16 bp, Homo sapiens
ggttccttaagtggct

SEQ ID NO: 1943323 - DNA, 11 bp, Homo sapiens
ggttctagaag

SEQ ID NO: 1943324 - DNA, 16 bp, Homo sapiens
ggttctagaaggggcg

SEQ ID NO: 1943325 - DNA, 18 bp, Homo sapiens
ggttctagaaggggcgag

SEQ ID NO: 1943326 - DNA, 16 bp, Homo sapiens
ggttgaccccagagga

SEQ ID NO: 1943327 - DNA, 14 bp, Homo sapiens
ggttgggttccaga

SEQ ID NO: 1943328 - DNA, 23 bp, Homo sapiens
ggtttactctgtggccaaaggag

SEQ ID NO: 1943329 - DNA, 15 bp, Homo sapiens
ggtttcagaaagggc

SEQ ID NO: 1943330 - DNA, 23 bp, Homo sapiens
ggtttgaggaccctcccaggttt

SEQ ID NO: 1943331 - DNA, 17 bp, Homo sapiens
ggttttgttaggggtgg

SEQ ID NO: 1943332 - DNA, 15 bp, Homo sapiens
gtaaaaagagaaggc

SEQ ID NO: 1943333 - DNA, 14 bp, Homo sapiens
gtaaaattacagaa

SEQ ID NO: 1943334 - DNA, 22 bp, Homo sapiens
gtaaaattattccctgaattgt

SEQ ID NO: 1943335 - DNA, 24 bp, Homo sapiens
gtaaactgtgcaccaagcaggaaa

SEQ ID NO: 1943336 - DNA, 14 bp, Homo sapiens
gtaaatgtttaata

SEQ ID NO: 1943337 - DNA, 18 bp, Homo sapiens
gtaaattataagtaactt

SEQ ID NO: 1943338 - DNA, 14 bp, Homo sapiens
gtaaattattgtaa

SEQ ID NO: 1943339 - DNA, 15 bp, Homo sapiens
gtaaattattgtaaa

SEQ ID NO: 1943340 - DNA, 16 bp, Homo sapiens
gtaaattattgtaaac

SEQ ID NO: 1943341 - DNA, 14 bp, Homo sapiens
gctttgttttgcac

SEQ ID NO: 1943342 - DNA, 12 bp, Homo sapiens
gcttttcactgc

SEQ ID NO: 1943343 - DNA, 22 bp, Homo sapiens
gcttttgctggtcactgccatg

SEQ ID NO: 1943344 - DNA, 17 bp, Homo sapiens
ggaacaggagtgactct

SEQ ID NO: 1943345 - DNA, 17 bp, Homo sapiens
ggaacatttgggagact

SEQ ID NO: 1943346 - DNA, 23 bp, Homo sapiens
ggaagaacaaatatgattctcct

SEQ ID NO: 1943347 - DNA, 14 bp, Homo sapiens
ggaagcacagcagg

SEQ ID NO: 1943348 - DNA, 19 bp, Homo sapiens
ggaagcttcttaaatgaga

SEQ ID NO: 1943349 - DNA, 15 bp, Homo sapiens
gccaggccctctctg

SEQ ID NO: 1943350 - DNA, 17 bp, Homo sapiens
gccaggccctctctgca

SEQ ID NO: 1943351 - DNA, 20 bp, Homo sapiens
gccaggccctctctgcagtc

SEQ ID NO: 1943352 - DNA, 14 bp, Homo sapiens
gccaggctgcaggg

SEQ ID NO: 1943353 - DNA, 17 bp, Homo sapiens
gccagggggtttgagga

SEQ ID NO: 1943354 - DNA, 15 bp, Homo sapiens
cccctatcctgcacc

SEQ ID NO: 1943355 - DNA, 16 bp, Homo sapiens
cccctatcctgcaccc

SEQ ID NO: 1943356 - DNA, 17 bp, Homo sapiens
cccctatcctgcaccct

SEQ ID NO: 1943357 - DNA, 21 bp, Homo sapiens
cccctatcctgcaccctctgc

SEQ ID NO: 1943358 - DNA, 11 bp, Homo sapiens
cccctccttct

SEQ ID NO: 1943359 - DNA, 12 bp, Homo sapiens
cccctccttctc

SEQ ID NO: 1943360 - DNA, 21 bp, Homo sapiens
cccctccttctcccctccaga

SEQ ID NO: 1943361 - DNA, 14 bp, Homo sapiens
cccctctgtccagg

SEQ ID NO: 1943362 - DNA, 17 bp, Homo sapiens
cccctcttcccccttcc

SEQ ID NO: 1943363 - DNA, 19 bp, Homo sapiens
cccctgaactggccccagc

SEQ ID NO: 1943364 - DNA, 15 bp, Homo sapiens
cccctgccagggcag

SEQ ID NO: 1943365 - DNA, 19 bp, Homo sapiens
cccctgccagggcagggcc

SEQ ID NO: 1943366 - DNA, 19 bp, Homo sapiens
cccctggcacctgggtgct

SEQ ID NO: 1943367 - DNA, 23 bp, Homo sapiens
cccctggcttttcactgctggct

SEQ ID NO: 1943368 - DNA, 12 bp, Homo sapiens
cccctgtccttc

SEQ ID NO: 1943369 - DNA, 14 bp, Homo sapiens
ccccttccactgag

SEQ ID NO: 1943370 - DNA, 13 bp, Homo sapiens
ccccttcccaccc

SEQ ID NO: 1943371 - DNA, 18 bp, Homo sapiens
ccccttcccctgcgccct

SEQ ID NO: 1943372 - DNA, 18 bp, Homo sapiens
cccgagccccctgtcctt

SEQ ID NO: 1943373 - DNA, 17 bp, Homo sapiens
cccgagggcgcctgggt

SEQ ID NO: 1943374 - DNA, 18 bp, Homo sapiens
cccgagggcgcctgggtc

SEQ ID NO: 1943375 - DNA, 18 bp, Homo sapiens
cccgcaatgtgcccccag

SEQ ID NO: 1943376 - DNA, 12 bp, Homo sapiens
cccgctcagccc

SEQ ID NO: 1943377 - DNA, 14 bp, Homo sapiens
cccgctcagccctc

SEQ ID NO: 1943378 - DNA, 15 bp, Homo sapiens
cccgctcagccctcc

SEQ ID NO: 1943379 - DNA, 19 bp, Homo sapiens
cccgctcagccctccctgc

SEQ ID NO: 1943380 - DNA, 23 bp, Homo sapiens
cccgctcagccctccctgcccct

SEQ ID NO: 1943381 - DNA, 19 bp, Homo sapiens
cccggcccccgccctctgc

SEQ ID NO: 1943382 - DNA, 20 bp, Homo sapiens
cccggctcggcctcttgaga

SEQ ID NO: 1943383 - DNA, 13 bp, Homo sapiens
cccggctggactt

SEQ ID NO: 1943384 - DNA, 19 bp, Homo sapiens
cccgggcactgtcatgccc

SEQ ID NO: 1943385 - DNA, 19 bp, Homo sapiens
cccgtccctttccctgcat

SEQ ID NO: 1943386 - DNA, 16 bp, Homo sapiens
ccctacttagacccag

SEQ ID NO: 1943387 - DNA, 22 bp, Homo sapiens
ccctagaaagccatattccagc

SEQ ID NO: 1943388 - DNA, 20 bp, Homo sapiens
ccctaggtctccacccctca

SEQ ID NO: 1943389 - DNA, 15 bp, Homo sapiens
ccctatgtcccagcc

SEQ ID NO: 1943390 - DNA, 21 bp, Homo sapiens
ccctcaagccaggagaccctg

SEQ ID NO: 1943391 - DNA, 21 bp, Homo sapiens
ccctcactccactcccctcat

SEQ ID NO: 1943392 - DNA, 22 bp, Homo sapiens
ccctcactccactcccctcatc

SEQ ID NO: 1943393 - DNA, 13 bp, Homo sapiens
ccctcagagccac

SEQ ID NO: 1943394 - DNA, 13 bp, Homo sapiens
ccctcatccacta

SEQ ID NO: 1943395 - DNA, 17 bp, Homo sapiens
ccctcatcccgagcacc

SEQ ID NO: 1943396 - DNA, 14 bp, Homo sapiens
ccctcatctgtccc

SEQ ID NO: 1943397 - DNA, 19 bp, Homo sapiens
ccctccacacctccacccg

SEQ ID NO: 1943398 - DNA, 14 bp, Homo sapiens
ccctccactcctcc

SEQ ID NO: 1943399 - DNA, 22 bp, Homo sapiens
ccctccagacccctaccctttc

SEQ ID NO: 1943400 - DNA, 22 bp, Homo sapiens
ccctccatgtagaagagggaga

SEQ ID NO: 1943401 - DNA, 23 bp, Homo sapiens
ccctccccatggtgcagtgaaga

SEQ ID NO: 1943402 - DNA, 13 bp, Homo sapiens
ccctccctgcagg

SEQ ID NO: 1943403 - DNA, 15 bp, Homo sapiens
ccctccctgcagggt

SEQ ID NO: 1943404 - DNA, 16 bp, Homo sapiens
ccctccctgtcccctg

SEQ ID NO: 1943405 - DNA, 24 bp, Homo sapiens
ccctcgcatccgcctctgagccag

SEQ ID NO: 1943406 - DNA, 21 bp, Homo sapiens
ccctctacagagcttccctga

SEQ ID NO: 1943407 - DNA, 18 bp, Homo sapiens
ccctctcatccaggtcct

SEQ ID NO: 1943408 - DNA, 15 bp, Homo sapiens
ccctctctgctctgc

SEQ ID NO: 1943409 - DNA, 22 bp, Homo sapiens
ccctctctgtttaccctccctg

SEQ ID NO: 1943410 - DNA, 15 bp, Homo sapiens
ccctctgcccccagc

SEQ ID NO: 1943411 - DNA, 21 bp, Homo sapiens
ccctctgctatgtctgtgatg

SEQ ID NO: 1943412 - DNA, 15 bp, Homo sapiens
ccctctgctccacag

SEQ ID NO: 1943413 - DNA, 17 bp, Homo sapiens
ccctcttcccccttccc

SEQ ID NO: 1943414 - DNA, 20 bp, Homo sapiens
ccctcttcccccttcccctg

SEQ ID NO: 1943415 - DNA, 17 bp, Homo sapiens
ccctgaactggccccag

SEQ ID NO: 1943416 - DNA, 15 bp, Homo sapiens
ccctgaattgtttga

SEQ ID NO: 1943417 - DNA, 22 bp, Homo sapiens
ccctgaattgtttgatattgtc

SEQ ID NO: 1943418 - DNA, 13 bp, Homo sapiens
ccctgagctgagg

SEQ ID NO: 1943419 - DNA, 16 bp, Homo sapiens
ccctgagctgaggcag

SEQ ID NO: 1943420 - DNA, 18 bp, Homo sapiens
ccctgcaaaaggactctc

SEQ ID NO: 1943421 - DNA, 15 bp, Homo sapiens
ccctgcaaggtgcac

SEQ ID NO: 1943422 - DNA, 20 bp, Homo sapiens
ccctgcagctttgaggctgg

SEQ ID NO: 1943423 - DNA, 23 bp, Homo sapiens
ccctgcagggtagggggcctgag

SEQ ID NO: 1943424 - DNA, 14 bp, Homo sapiens
ccctgcatcccttg

SEQ ID NO: 1943425 - DNA, 17 bp, Homo sapiens
ccctgcatcccttggcc

SEQ ID NO: 1943426 - DNA, 22 bp, Homo sapiens
ccctgcatcccttggcccctct

SEQ ID NO: 1943427 - DNA, 12 bp, Homo sapiens
ccctgccagggc

SEQ ID NO: 1943428 - DNA, 14 bp, Homo sapiens
ccctgccagggcag

SEQ ID NO: 1943429 - DNA, 18 bp, Homo sapiens
ccctgccagggggtttga

SEQ ID NO: 1943430 - DNA, 17 bp, Homo sapiens
ccctgcccctcccttca

SEQ ID NO: 1943431 - DNA, 18 bp, Homo sapiens
ccctgcccctcccttcaa

SEQ ID NO: 1943432 - DNA, 13 bp, Homo sapiens
ccctgccctcact

SEQ ID NO: 1943433 - DNA, 14 bp, Homo sapiens
ccctgccctcactc

SEQ ID NO: 1943434 - DNA, 12 bp, Homo sapiens
ccaatcatttta

SEQ ID NO: 1943435 - DNA, 16 bp, Homo sapiens
ccaatccctgtgtgtc

SEQ ID NO: 1943436 - DNA, 15 bp, Homo sapiens
ccaatgaaaaaatgt

SEQ ID NO: 1943437 - DNA, 23 bp, Homo sapiens
ccaatgaaaaaatgtatatgcac

SEQ ID NO: 1943438 - DNA, 14 bp, Homo sapiens
ccacacacaccctt

SEQ ID NO: 1943439 - DNA, 15 bp, Homo sapiens
ccacacacacccttc

SEQ ID NO: 1943440 - DNA, 17 bp, Homo sapiens
ccacacacacccttccc

SEQ ID NO: 1943441 - DNA, 20 bp, Homo sapiens
ccacacttcaggctcttctc

SEQ ID NO: 1943442 - DNA, 13 bp, Homo sapiens
ccacagaggccag

SEQ ID NO: 1943443 - DNA, 21 bp, Homo sapiens
ccacagagtgccatccctgag

SEQ ID NO: 1943444 - DNA, 16 bp, Homo sapiens
ccacagcctcccctgc

SEQ ID NO: 1943445 - DNA, 21 bp, Homo sapiens
ccacaggacatttctctaaga

SEQ ID NO: 1943446 - DNA, 15 bp, Homo sapiens
ccacaggcccttcct

SEQ ID NO: 1943447 - DNA, 18 bp, Homo sapiens
ccacaggcccttcctctc

SEQ ID NO: 1943448 - DNA, 11 bp, Homo sapiens
ccacagggacg

SEQ ID NO: 1943449 - DNA, 23 bp, Homo sapiens
ccacatagtgatggttcccctgt

SEQ ID NO: 1943450 - DNA, 23 bp, Homo sapiens
ccacatccaacatttcctcaggc

SEQ ID NO: 1943451 - DNA, 13 bp, Homo sapiens
ccacatcctccac

SEQ ID NO: 1943452 - DNA, 17 bp, Homo sapiens
ccacatggccgctgccc

SEQ ID NO: 1943453 - DNA, 13 bp, Homo sapiens
ccacattctactt

SEQ ID NO: 1943454 - DNA, 17 bp, Homo sapiens
ccacattctacttcagc

SEQ ID NO: 1943455 - DNA, 16 bp, Homo sapiens
ccaccacacacaccct

SEQ ID NO: 1943456 - DNA, 17 bp, Homo sapiens
ccaccacacacaccctt

SEQ ID NO: 1943457 - DNA, 19 bp, Homo sapiens
ccaccacacacacccttcc

SEQ ID NO: 1943458 - DNA, 16 bp, Homo sapiens
ccaccagggaccagcc

SEQ ID NO: 1943459 - DNA, 12 bp, Homo sapiens
ccaccctctgca

SEQ ID NO: 1943460 - DNA, 19 bp, Homo sapiens
ccaccctctgcagggcagc

SEQ ID NO: 1943461 - DNA, 20 bp, Homo sapiens
ccaccctctgcagggcagcc

SEQ ID NO: 1943462 - DNA, 23 bp, Homo sapiens
ccaccctttacattttgtgcagt

SEQ ID NO: 1943463 - DNA, 13 bp, Homo sapiens
ccacctccccagg

SEQ ID NO: 1943464 - DNA, 16 bp, Homo sapiens
ccacctccccaggccg

SEQ ID NO: 1943465 - DNA, 23 bp, Homo sapiens
ccacctccccaggccgtggctgc

SEQ ID NO: 1943466 - DNA, 17 bp, Homo sapiens
ccacctgccaggctgca

SEQ ID NO: 1943467 - DNA, 12 bp, Homo sapiens
ccacctgtacat

SEQ ID NO: 1943468 - DNA, 14 bp, Homo sapiens
ccacgactgtctcc

SEQ ID NO: 1943469 - DNA, 15 bp, Homo sapiens
ccacgactgtctcca

SEQ ID NO: 1943470 - DNA, 14 bp, Homo sapiens
ccacggccactgca

SEQ ID NO: 1943471 - DNA, 14 bp, Homo sapiens
ccacgtcctgggtg

SEQ ID NO: 1943472 - DNA, 14 bp, Homo sapiens
ccacgtctccctgg

SEQ ID NO: 1943473 - DNA, 15 bp, Homo sapiens
ccacgtctccctggc

SEQ ID NO: 1943474 - DNA, 14 bp, Homo sapiens
ccacgttcacccct

SEQ ID NO: 1943475 - DNA, 11 bp, Homo sapiens
ccactcagcat

SEQ ID NO: 1943476 - DNA, 20 bp, Homo sapiens
ccactccagacccctggctt

SEQ ID NO: 1943477 - DNA, 21 bp, Homo sapiens
ccactccagacccctggcttt

SEQ ID NO: 1943478 - DNA, 20 bp, Homo sapiens
ctctttcttctctctttgtc

SEQ ID NO: 1943479 - DNA, 22 bp, Homo sapiens
ctctttgtaaggacttgtgcct

SEQ ID NO: 1943480 - DNA, 15 bp, Homo sapiens
ctgaaagctgcttct

SEQ ID NO: 1943481 - DNA, 21 bp, Homo sapiens
ctgaaattaaacgagcgaaga

SEQ ID NO: 1943482 - DNA, 20 bp, Homo sapiens
ctgaaccttgttgatgccag

SEQ ID NO: 1943483 - DNA, 15 bp, Homo sapiens
ctgaactggccccag

SEQ ID NO: 1943484 - DNA, 14 bp, Homo sapiens
ctgaaggagaggag

SEQ ID NO: 1943485 - DNA, 15 bp, Homo sapiens
ctgaaggagaggagt

SEQ ID NO: 1943486 - DNA, 12 bp, Homo sapiens
ctgaaggagccc

SEQ ID NO: 1943487 - DNA, 20 bp, Homo sapiens
ctgaaggttggaactgctgc

SEQ ID NO: 1943488 - DNA, 23 bp, Homo sapiens
ctgaaggttggaactgctgccat

SEQ ID NO: 1943489 - DNA, 17 bp, Homo sapiens
ctgaagtcactgcacag

SEQ ID NO: 1943490 - DNA, 16 bp, Homo sapiens
ctgaatcgtttcatgt

SEQ ID NO: 1943491 - DNA, 18 bp, Homo sapiens
ctgacacaggggacactg

SEQ ID NO: 1943492 - DNA, 22 bp, Homo sapiens
ctgacactgcgaactctcagga

SEQ ID NO: 1943493 - DNA, 14 bp, Homo sapiens
ctgacagaaggact

SEQ ID NO: 1943494 - DNA, 21 bp, Homo sapiens
ctgaccctgtgatgcctgaca

SEQ ID NO: 1943495 - DNA, 23 bp, Homo sapiens
ctgacggcagtaaatccacagtg

SEQ ID NO: 1943496 - DNA, 16 bp, Homo sapiens
ctgactcagggctcct

SEQ ID NO: 1943497 - DNA, 18 bp, Homo sapiens
ctgactcagggctcctgg

SEQ ID NO: 1943498 - DNA, 21 bp, Homo sapiens
ctgactcagggctcctgggtt

SEQ ID NO: 1943499 - DNA, 18 bp, Homo sapiens
ctgagaagagtcgagtga

SEQ ID NO: 1943500 - DNA, 21 bp, Homo sapiens
ctgagaaggccccagggcagc

SEQ ID NO: 1943501 - DNA, 18 bp, Homo sapiens
ctgagataccagcgagga

SEQ ID NO: 1943502 - DNA, 13 bp, Homo sapiens
ctgagccaggagc

SEQ ID NO: 1943503 - DNA, 16 bp, Homo sapiens
ctgagccaggagcctc

SEQ ID NO: 1943504 - DNA, 19 bp, Homo sapiens
ctgagccaggagcctcctg

SEQ ID NO: 1943505 - DNA, 21 bp, Homo sapiens
ctgagccaggagcctcctgac

SEQ ID NO: 1943506 - DNA, 22 bp, Homo sapiens
ctgagccaggagcctcctgacc

SEQ ID NO: 1943507 - DNA, 18 bp, Homo sapiens
ctgagcccctccctcctg

SEQ ID NO: 1943508 - DNA, 19 bp, Homo sapiens
ctgagccctgccctcactc

SEQ ID NO: 1943509 - DNA, 20 bp, Homo sapiens
ctgagcgaggagatgctcct

SEQ ID NO: 1943510 - DNA, 20 bp, Homo sapiens
ctgagcggccgcctgtcctt

SEQ ID NO: 1943511 - DNA, 12 bp, Homo sapiens
ctgagctgaggc

SEQ ID NO: 1943512 - DNA, 13 bp, Homo sapiens
ctgagctgtgcag

SEQ ID NO: 1943513 - DNA, 15 bp, Homo sapiens
ctgaggcagcagtgt

SEQ ID NO: 1943514 - DNA, 24 bp, Homo sapiens
ctgaggcagcagtgtgaggccagg

SEQ ID NO: 1943515 - DNA, 12 bp, Homo sapiens
ctgagggagcct

SEQ ID NO: 1943516 - DNA, 13 bp, Homo sapiens
ctgagggagcctg

SEQ ID NO: 1943517 - DNA, 17 bp, Homo sapiens
ctgagggagcctggccc

SEQ ID NO: 1943518 - DNA, 15 bp, Homo sapiens
ctgagggatctttac

SEQ ID NO: 1943519 - DNA, 13 bp, Homo sapiens
ctgagggcagggt

SEQ ID NO: 1943520 - DNA, 19 bp, Homo sapiens
ctgagggcagggttctaga

SEQ ID NO: 1943521 - DNA, 23 bp, Homo sapiens
ctgataaaaccatgtagaaaatt

SEQ ID NO: 1943522 - DNA, 14 bp, Homo sapiens
ctgatacagcctta

SEQ ID NO: 1943523 - DNA, 14 bp, Homo sapiens
ctgatcagagccgt

SEQ ID NO: 1943524 - DNA, 20 bp, Homo sapiens
ctgatcagagccgtggtcct

SEQ ID NO: 1943525 - DNA, 17 bp, Homo sapiens
ctgggccactggcatct

SEQ ID NO: 1943526 - DNA, 18 bp, Homo sapiens
ctgggccactggcatctc

SEQ ID NO: 1943527 - DNA, 13 bp, Homo sapiens
ctgggccctgggt

SEQ ID NO: 1943528 - DNA, 17 bp, Homo sapiens
ctgggccggcagcctgg

SEQ ID NO: 1943529 - DNA, 14 bp, Homo sapiens
ctgggcgcctctgt

SEQ ID NO: 1943530 - DNA, 18 bp, Homo sapiens
ctgggcgcctctgtcctg

SEQ ID NO: 1943531 - DNA, 16 bp, Homo sapiens
ctggggcggtcaataa

SEQ ID NO: 1943532 - DNA, 19 bp, Homo sapiens
ctgggggatttcaagggac

SEQ ID NO: 1943533 - DNA, 19 bp, Homo sapiens
ctgggggtgccaggaccag

SEQ ID NO: 1943534 - DNA, 17 bp, Homo sapiens
ctggggtggttggaggc

SEQ ID NO: 1943535 - DNA, 20 bp, Homo sapiens
ctggggtggttggaggcctg

SEQ ID NO: 1943536 - DNA, 16 bp, Homo sapiens
ctgggtcctcccagct

SEQ ID NO: 1943537 - DNA, 17 bp, Homo sapiens
ctgggtcctcccagctg

SEQ ID NO: 1943538 - DNA, 13 bp, Homo sapiens
ctgggtgctctgg

SEQ ID NO: 1943539 - DNA, 19 bp, Homo sapiens
ctgggtggggcagggcctg

SEQ ID NO: 1943540 - DNA, 23 bp, Homo sapiens
ctgggtttgggcagtggagaggg

SEQ ID NO: 1943541 - DNA, 20 bp, Homo sapiens
ctgggttttgtattctctga

SEQ ID NO: 1943542 - DNA, 22 bp, Homo sapiens
ctggtcagtgaagcccaggagg

SEQ ID NO: 1943543 - DNA, 15 bp, Homo sapiens
ctggtcccccatggg

SEQ ID NO: 1943544 - DNA, 13 bp, Homo sapiens
ctggtctggagcc

SEQ ID NO: 1943545 - DNA, 13 bp, Homo sapiens
ctggtgctgccac

SEQ ID NO: 1943546 - DNA, 22 bp, Homo sapiens
ctggtgctgccacacttcaggc

SEQ ID NO: 1943547 - DNA, 21 bp, Homo sapiens
ctggttccctctttcctgtgc

SEQ ID NO: 1943548 - DNA, 21 bp, Homo sapiens
ctgtaaatttaatagataaag

SEQ ID NO: 1943549 - DNA, 22 bp, Homo sapiens
ctgtaaatttaatagataaagt

SEQ ID NO: 1943550 - DNA, 17 bp, Homo sapiens
ctgtaacatatatgaaa

SEQ ID NO: 1943551 - DNA, 15 bp, Homo sapiens
ctgtaacctcttcag

SEQ ID NO: 1943552 - DNA, 18 bp, Homo sapiens
ctgtaataatattttaga

SEQ ID NO: 1943553 - DNA, 18 bp, Homo sapiens
ctgtacatacattgtata

SEQ ID NO: 1943554 - DNA, 21 bp, Homo sapiens
ctgtacattttttttcaagtg

SEQ ID NO: 1943555 - DNA, 15 bp, Homo sapiens
ctgtacctttctgac

SEQ ID NO: 1943556 - DNA, 16 bp, Homo sapiens
ctgtactcctcccagg

SEQ ID NO: 1943557 - DNA, 14 bp, Homo sapiens
ctgtactgagttct

SEQ ID NO: 1943558 - DNA, 20 bp, Homo sapiens
ctgtactgagttctcatcca

SEQ ID NO: 1943559 - DNA, 23 bp, Homo sapiens
ctgtatcaggacccagaggaagg

SEQ ID NO: 1943560 - DNA, 21 bp, Homo sapiens
ctgtcagaccttcttccacag

SEQ ID NO: 1943561 - DNA, 16 bp, Homo sapiens
ctgtcatgcccagctt

SEQ ID NO: 1943562 - DNA, 17 bp, Homo sapiens
ctgtccaatcacattca

SEQ ID NO: 1943563 - DNA, 15 bp, Homo sapiens
ctgtccaatctgcaa

SEQ ID NO: 1943564 - DNA, 16 bp, Homo sapiens
ctgtccaatctgcaag

SEQ ID NO: 1943565 - DNA, 16 bp, Homo sapiens
ctgtccaggcactgag

SEQ ID NO: 1943566 - DNA, 15 bp, Homo sapiens
ctgtcctcagcttct

SEQ ID NO: 1943567 - DNA, 13 bp, Homo sapiens
ctgtcctggcccg

SEQ ID NO: 1943568 - DNA, 23 bp, Homo sapiens
ctgtcctggcccgggagccgcag

SEQ ID NO: 1943569 - DNA, 16 bp, Homo sapiens
ctgtccttcccacggc

SEQ ID NO: 1943570 - DNA, 17 bp, Homo sapiens
ctgtccttcccacggcc

SEQ ID NO: 1943571 - DNA, 19 bp, Homo sapiens
ctgtccttcccacggccac

SEQ ID NO: 1943572 - DNA, 18 bp, Homo sapiens
ctgtctcaagagggcact

SEQ ID NO: 1943573 - DNA, 17 bp, Homo sapiens
ctgtctcatccatcatc

SEQ ID NO: 1943574 - DNA, 20 bp, Homo sapiens
ctgtctcatccatcatcatg

SEQ ID NO: 1943575 - DNA, 20 bp, Homo sapiens
ctgtctccatggccctgcaa

SEQ ID NO: 1943576 - DNA, 14 bp, Homo sapiens
ctgtctgagccctg

SEQ ID NO: 1943577 - DNA, 24 bp, Homo sapiens
ctgtctgagccctgccctcactcc

SEQ ID NO: 1943578 - DNA, 12 bp, Homo sapiens
ctgtctgcaggc

SEQ ID NO: 1943579 - DNA, 14 bp, Homo sapiens
ctgtctgcaggcca

SEQ ID NO: 1943580 - DNA, 16 bp, Homo sapiens
ctgtctttgctgttta

SEQ ID NO: 1943581 - DNA, 16 bp, Homo sapiens
ctgtgaccaatgtctt

SEQ ID NO: 1943582 - DNA, 19 bp, Homo sapiens
ctgtgatcgtgtgttgcca

SEQ ID NO: 1943583 - DNA, 20 bp, Homo sapiens
ctgtgatcgtgtgttgccat

SEQ ID NO: 1943584 - DNA, 12 bp, Homo sapiens
ctgtgattaatt

SEQ ID NO: 1943585 - DNA, 16 bp, Homo sapiens
ctgtgcaatggaatat

SEQ ID NO: 1943586 - DNA, 20 bp, Homo sapiens
ctgtgcaatggaatataaat

SEQ ID NO: 1943587 - DNA, 21 bp, Homo sapiens
ctgtgcagccgctgagcgagg

SEQ ID NO: 1943588 - DNA, 18 bp, Homo sapiens
ctgtgccccatcagcagc

SEQ ID NO: 1943589 - DNA, 20 bp, Homo sapiens
ctgtgccccatcagcagctt

SEQ ID NO: 1943590 - DNA, 13 bp, Homo sapiens
ctgtgcctcagtg

SEQ ID NO: 1943591 - DNA, 16 bp, Homo sapiens
ctgtgcctcagtgaga

SEQ ID NO: 1943592 - DNA, 19 bp, Homo sapiens
ctgtgcttcgggcccttcc

SEQ ID NO: 1943593 - DNA, 13 bp, Homo sapiens
ctgtggcccctcc

SEQ ID NO: 1943594 - DNA, 16 bp, Homo sapiens
ctgtggcccctccttc

SEQ ID NO: 1943595 - DNA, 23 bp, Homo sapiens
ctgtgggactggcccacccctct

SEQ ID NO: 1943596 - DNA, 14 bp, Homo sapiens
ctgtgggatgggat

SEQ ID NO: 1943597 - DNA, 16 bp, Homo sapiens
ctgtgtggggagggtg

SEQ ID NO: 1943598 - DNA, 15 bp, Homo sapiens
ctgttaatgttaatt

SEQ ID NO: 1943599 - DNA, 13 bp, Homo sapiens
ctgttagtcattt

SEQ ID NO: 1943600 - DNA, 19 bp, Homo sapiens
ctgttatcaaaactttctt

SEQ ID NO: 1943601 - DNA, 12 bp, Homo sapiens
ctgttatgtcat

SEQ ID NO: 1943602 - DNA, 13 bp, Homo sapiens
ctgttcactctac

SEQ ID NO: 1943603 - DNA, 12 bp, Homo sapiens
ctgttccccctg

SEQ ID NO: 1943604 - DNA, 17 bp, Homo sapiens
ctgttccccctgtgcag

SEQ ID NO: 1943605 - DNA, 11 bp, Homo sapiens
ctgttcctgcc

SEQ ID NO: 1943606 - DNA, 18 bp, Homo sapiens
ctgttcctgccttctctt

SEQ ID NO: 1943607 - DNA, 17 bp, Homo sapiens
ctgttcttgttacggca

SEQ ID NO: 1943608 - DNA, 14 bp, Homo sapiens
ctgttgtttaaaat

SEQ ID NO: 1943609 - DNA, 14 bp, Homo sapiens
ctgtttaccctccc

SEQ ID NO: 1943610 - DNA, 15 bp, Homo sapiens
ctgtttaccctccct

SEQ ID NO: 1943611 - DNA, 13 bp, Homo sapiens
cttaaaaatatgt

SEQ ID NO: 1943612 - DNA, 17 bp, Homo sapiens
cttaagagaatccacat

SEQ ID NO: 1943613 - DNA, 20 bp, Homo sapiens
cttaagataatatttaaaat

SEQ ID NO: 1943614 - DNA, 18 bp, Homo sapiens
cttaagcactttgaaaat

SEQ ID NO: 1943615 - DNA, 19 bp, Homo sapiens
cttaagcactttgaaaata

SEQ ID NO: 1943616 - DNA, 18 bp, Homo sapiens
cttacaatgtgcactgaa

SEQ ID NO: 1943617 - DNA, 23 bp, Homo sapiens
cttacagtaggagcccagctctg

SEQ ID NO: 1943618 - DNA, 18 bp, Homo sapiens
gagggggccacctcccca

SEQ ID NO: 1943619 - DNA, 18 bp, Homo sapiens
gaggggtctccaggagga

SEQ ID NO: 1943620 - DNA, 23 bp, Homo sapiens
gaggtgctactgactttctcagc

SEQ ID NO: 1943621 - DNA, 14 bp, Homo sapiens
gaggtgggggtctg

SEQ ID NO: 1943622 - DNA, 19 bp, Homo sapiens
gaggtttaggtcaagaaga

SEQ ID NO: 1943623 - DNA, 15 bp, Homo sapiens
gagtaaaattacaga

SEQ ID NO: 1943624 - DNA, 19 bp, Homo sapiens
gagtagggttgccagtcct

SEQ ID NO: 1943625 - DNA, 11 bp, Homo sapiens
gagtcctgtta

SEQ ID NO: 1943626 - DNA, 12 bp, Homo sapiens
gagtctcttctc

SEQ ID NO: 1943627 - DNA, 15 bp, Homo sapiens
gagtctgaaggagag

SEQ ID NO: 1943628 - DNA, 14 bp, Homo sapiens
gagtgactctggct

SEQ ID NO: 1943629 - DNA, 23 bp, Homo sapiens
gagtgagacccagccctcatccc

SEQ ID NO: 1943630 - DNA, 14 bp, Homo sapiens
gagtgcagtcctga

SEQ ID NO: 1943631 - DNA, 18 bp, Homo sapiens
gagtgccacatggccgct

SEQ ID NO: 1943632 - DNA, 19 bp, Homo sapiens
gagtgccacgtggccgctg

SEQ ID NO: 1943633 - DNA, 23 bp, Homo sapiens
gagtgccacgtggccgctgccca

SEQ ID NO: 1943634 - DNA, 20 bp, Homo sapiens
gagtggaggggtcagcaggg

SEQ ID NO: 1943635 - DNA, 18 bp, Homo sapiens
gagtggatctggagtctg

SEQ ID NO: 1943636 - DNA, 20 bp, Homo sapiens
gagtggccaatccctgtgtg

SEQ ID NO: 1943637 - DNA, 16 bp, Homo sapiens
gagtgggagaggaagc

SEQ ID NO: 1943638 - DNA, 14 bp, Homo sapiens
gagtgggccccctc

SEQ ID NO: 1943639 - DNA, 13 bp, Homo sapiens
gagtgtctttcca

SEQ ID NO: 1943640 - DNA, 21 bp, Homo sapiens
gagtgtctttccacggagcca

SEQ ID NO: 1943641 - DNA, 22 bp, Homo sapiens
gagtgtctttccacggagccac

SEQ ID NO: 1943642 - DNA, 20 bp, Homo sapiens
gagtgtggaaaaaaaaagaa

SEQ ID NO: 1943643 - DNA, 19 bp, Homo sapiens
gagtgttccccttccactg

SEQ ID NO: 1943644 - DNA, 18 bp, Homo sapiens
gagttgaggggcttccct

SEQ ID NO: 1943645 - DNA, 23 bp, Homo sapiens
gagttgctcctacccctgtcctg

SEQ ID NO: 1943646 - DNA, 14 bp, Homo sapiens
gataaaaacaatat

SEQ ID NO: 1943647 - DNA, 18 bp, Homo sapiens
gataatatttaaaatagt

SEQ ID NO: 1943648 - DNA, 19 bp, Homo sapiens
gatacaccgggcctggaga

SEQ ID NO: 1943649 - DNA, 18 bp, Homo sapiens
gatactttgatattttca

SEQ ID NO: 1943650 - DNA, 17 bp, Homo sapiens
gatattcaatcttaaca

SEQ ID NO: 1943651 - DNA, 21 bp, Homo sapiens
gatattttcaacgcagccctg

SEQ ID NO: 1943652 - DNA, 22 bp, Homo sapiens
gatattttcaacgcagccctgc

SEQ ID NO: 1943653 - DNA, 20 bp, Homo sapiens
gatcaagcttgtgtacttga

SEQ ID NO: 1943654 - DNA, 12 bp, Homo sapiens
gatccagagaga

SEQ ID NO: 1943655 - DNA, 15 bp, Homo sapiens
gatccagagagaagc

SEQ ID NO: 1943656 - DNA, 15 bp, Homo sapiens
gatccagccattcct

SEQ ID NO: 1943657 - DNA, 18 bp, Homo sapiens
gatccagccattcctgaa

SEQ ID NO: 1943658 - DNA, 12 bp, Homo sapiens
gatccctcatct

SEQ ID NO: 1943659 - DNA, 23 bp, Homo sapiens
gatccctctacagagcttccctg

SEQ ID NO: 1943660 - DNA, 13 bp, Homo sapiens
gatctggagtctg

SEQ ID NO: 1943661 - DNA, 14 bp, Homo sapiens
gatctggagtctga

SEQ ID NO: 1943662 - DNA, 16 bp, Homo sapiens
gatcttacccacttcc

SEQ ID NO: 1943663 - DNA, 16 bp, Homo sapiens
gatgaactgagaaggt

SEQ ID NO: 1943664 - DNA, 22 bp, Homo sapiens
gatgaataaatgttatagctgc

SEQ ID NO: 1943665 - DNA, 22 bp, Homo sapiens
gatgacctccttagaaaagact

SEQ ID NO: 1943666 - DNA, 18 bp, Homo sapiens
gatgagcatttagggcaa

SEQ ID NO: 1943667 - DNA, 22 bp, Homo sapiens
gatgagcatttagggcaaggag

SEQ ID NO: 1943668 - DNA, 15 bp, Homo sapiens
gatgcatctgtggcc

SEQ ID NO: 1943669 - DNA, 20 bp, Homo sapiens
gatgcatctgtggcctgggg

SEQ ID NO: 1943670 - DNA, 14 bp, Homo sapiens
gatgcctgacacag

SEQ ID NO: 1943671 - DNA, 17 bp, Homo sapiens
gatgcgcctgatcacca

SEQ ID NO: 1943672 - DNA, 14 bp, Homo sapiens
gatgctccttgggc

SEQ ID NO: 1943673 - DNA, 18 bp, Homo sapiens
gatgggaaggagggaggt

SEQ ID NO: 1943674 - DNA, 18 bp, Homo sapiens
gatggggagcagctgggc

SEQ ID NO: 1943675 - DNA, 23 bp, Homo sapiens
gatgggttttgttaggggtgggg

SEQ ID NO: 1943676 - DNA, 18 bp, Homo sapiens
gatggttcccctgttcac

SEQ ID NO: 1943677 - DNA, 16 bp, Homo sapiens
gatgtatgcccaaaga

SEQ ID NO: 1943678 - DNA, 18 bp, Homo sapiens
gatgtcaaccttgtgtga

SEQ ID NO: 1943679 - DNA, 20 bp, Homo sapiens
gatgtcaaccttgtgtgagt

SEQ ID NO: 1943680 - DNA, 15 bp, Homo sapiens
gatgtcttgagagcg

SEQ ID NO: 1943681 - DNA, 19 bp, Homo sapiens
gatgttctaagtctttcca

SEQ ID NO: 1943682 - DNA, 12 bp, Homo sapiens
gatgtttcttct

SEQ ID NO: 1943683 - DNA, 13 bp, Homo sapiens
gattacctcctga

SEQ ID NO: 1943684 - DNA, 15 bp, Homo sapiens
gattagatcttttaa

SEQ ID NO: 1943685 - DNA, 13 bp, Homo sapiens
gattattcagtgt

SEQ ID NO: 1943686 - DNA, 15 bp, Homo sapiens
gattattcagtgtca

SEQ ID NO: 1943687 - DNA, 20 bp, Homo sapiens
gattccagagagtggctcct

SEQ ID NO: 1943688 - DNA, 15 bp, Homo sapiens
gattctaaaggggac

SEQ ID NO: 1943689 - DNA, 17 bp, Homo sapiens
gattctaaaggggacag

SEQ ID NO: 1943690 - DNA, 18 bp, Homo sapiens
gattctaaaggggacaga

SEQ ID NO: 1943691 - DNA, 22 bp, Homo sapiens
gattgatcggagcctcctctct

SEQ ID NO: 1943692 - DNA, 22 bp, Homo sapiens
gattgccatttcttcccaaggc

SEQ ID NO: 1943693 - DNA, 16 bp, Homo sapiens
gattggtaccagagcc

SEQ ID NO: 1943694 - DNA, 15 bp, Homo sapiens
gatttcaagggactg

SEQ ID NO: 1943695 - DNA, 13 bp, Homo sapiens
gatttcatgattt

SEQ ID NO: 1943696 - DNA, 20 bp, Homo sapiens
gatttgaagtggaaaaagaa

SEQ ID NO: 1943697 - DNA, 12 bp, Homo sapiens
gatttgcaactt

SEQ ID NO: 1943698 - DNA, 14 bp, Homo sapiens
gatttttatgtttt

SEQ ID NO: 1943699 - DNA, 15 bp, Homo sapiens
gcaaagaaaagaact

SEQ ID NO: 1943700 - DNA, 15 bp, Homo sapiens
gcaaagacagaagcc

SEQ ID NO: 1943701 - DNA, 17 bp, Homo sapiens
gcaaagacagaagcctc

SEQ ID NO: 1943702 - DNA, 18 bp, Homo sapiens
gcaaatctcctttgtcca

SEQ ID NO: 1943703 - DNA, 16 bp, Homo sapiens
gcaacagggcttctct

SEQ ID NO: 1943704 - DNA, 20 bp, Homo sapiens
gcaaccacaggcagcattta

SEQ ID NO: 1943705 - DNA, 22 bp, Homo sapiens
gcaactggtatatatttaggat

SEQ ID NO: 1943706 - DNA, 16 bp, Homo sapiens
gcaacttcccaggccg

SEQ ID NO: 1943707 - DNA, 20 bp, Homo sapiens
gcaactttagaaagaaattg

SEQ ID NO: 1943708 - DNA, 15 bp, Homo sapiens
gcaagacaccttccc

SEQ ID NO: 1943709 - DNA, 13 bp, Homo sapiens
gcaagagatgaga

SEQ ID NO: 1943710 - DNA, 16 bp, Homo sapiens
gcaagagctcaggaga

SEQ ID NO: 1943711 - DNA, 15 bp, Homo sapiens
gcaagccacagaaat

SEQ ID NO: 1943712 - DNA, 17 bp, Homo sapiens
gcaaggcaagaagtggg

SEQ ID NO: 1943713 - DNA, 18 bp, Homo sapiens
gcaatgccatcatctcct

SEQ ID NO: 1943714 - DNA, 19 bp, Homo sapiens
gcaatgccatcatctcctg

SEQ ID NO: 1943715 - DNA, 16 bp, Homo sapiens
gcaatggaatataaat

SEQ ID NO: 1943716 - DNA, 11 bp, Homo sapiens
gcacacacact

SEQ ID NO: 1943717 - DNA, 16 bp, Homo sapiens
gcacaccctctctgtc

SEQ ID NO: 1943718 - DNA, 18 bp, Homo sapiens
gcacaccctctctgtcca

SEQ ID NO: 1943719 - DNA, 18 bp, Homo sapiens
gcacagacgtccctccac

SEQ ID NO: 1943720 - DNA, 17 bp, Homo sapiens
gcacagagagggggcca

SEQ ID NO: 1943721 - DNA, 23 bp, Homo sapiens
gcacagagagggggccacctccc

SEQ ID NO: 1943722 - DNA, 16 bp, Homo sapiens
gcacagggcagtggga

SEQ ID NO: 1943723 - DNA, 13 bp, Homo sapiens
gcacagtgcatct

SEQ ID NO: 1943724 - DNA, 17 bp, Homo sapiens
gcacatctgtgtcttgt

SEQ ID NO: 1943725 - DNA, 13 bp, Homo sapiens
gcacattatgttt

SEQ ID NO: 1943726 - DNA, 23 bp, Homo sapiens
gcaccagggttgaccccagagga

SEQ ID NO: 1943727 - DNA, 16 bp, Homo sapiens
gcaccccaccacacac

SEQ ID NO: 1943728 - DNA, 22 bp, Homo sapiens
gcaccccaccacacacaccctt

SEQ ID NO: 1943729 - DNA, 23 bp, Homo sapiens
gcaccctctgctatgtctgtgat

SEQ ID NO: 1943730 - DNA, 14 bp, Homo sapiens
gcacccttaaaact

SEQ ID NO: 1943731 - DNA, 14 bp, Homo sapiens
gcacctcattccaa

SEQ ID NO: 1943732 - DNA, 13 bp, Homo sapiens
gcacctgccccag

SEQ ID NO: 1943733 - DNA, 16 bp, Homo sapiens
gcacctgccccaggct

SEQ ID NO: 1943734 - DNA, 20 bp, Homo sapiens
gcacgtagtagggtcaggcc

SEQ ID NO: 1943735 - DNA, 21 bp, Homo sapiens
gcacgtagtagggtcaggcca

SEQ ID NO: 1943736 - DNA, 23 bp, Homo sapiens
gcacgtgggtcttcagggggcca

SEQ ID NO: 1943737 - DNA, 23 bp, Homo sapiens
ctttttaggccacctccaaggac

SEQ ID NO: 1943738 - DNA, 14 bp, Homo sapiens
gaaaacaaggaagt

SEQ ID NO: 1943739 - DNA, 14 bp, Homo sapiens
gaaaacactgtgca

SEQ ID NO: 1943740 - DNA, 21 bp, Homo sapiens
gaaaacactgtgcacatctgt

SEQ ID NO: 1943741 - DNA, 14 bp, Homo sapiens
gaaaacagtaacta

SEQ ID NO: 1943742 - DNA, 22 bp, Homo sapiens
gaaaacagtaactaagcacatt

SEQ ID NO: 1943743 - DNA, 22 bp, Homo sapiens
gaaaacatagagtagacctgag

SEQ ID NO: 1943744 - DNA, 19 bp, Homo sapiens
gaaaaccaagccgtggctt

SEQ ID NO: 1943745 - DNA, 19 bp, Homo sapiens
gaaaactgcaacttgtaaa

SEQ ID NO: 1943746 - DNA, 16 bp, Homo sapiens
gaaaagtaaattgcct

SEQ ID NO: 1943747 - DNA, 15 bp, Homo sapiens
gaaaatatgcatcta

SEQ ID NO: 1943748 - DNA, 15 bp, Homo sapiens
gaaaattaatatcac

SEQ ID NO: 1943749 - DNA, 19 bp, Homo sapiens
gaaacacgtttagaaatga

SEQ ID NO: 1943750 - DNA, 22 bp, Homo sapiens
gaaaccagaatgattttgacat

SEQ ID NO: 1943751 - DNA, 14 bp, Homo sapiens
gaaaccctgtttta

SEQ ID NO: 1943752 - DNA, 15 bp, Homo sapiens
gaaactatgcaccta

SEQ ID NO: 1943753 - DNA, 20 bp, Homo sapiens
gaaactatgcacctataaat

SEQ ID NO: 1943754 - DNA, 21 bp, Homo sapiens
gaaactatgcacctataaata

SEQ ID NO: 1943755 - DNA, 17 bp, Homo sapiens
gaaactgagtcctgttc

SEQ ID NO: 1943756 - DNA, 16 bp, Homo sapiens
gaaagaaaatatgcat

SEQ ID NO: 1943757 - DNA, 17 bp, Homo sapiens
gaaagaaaatatgcatc

SEQ ID NO: 1943758 - DNA, 14 bp, Homo sapiens
gaaagccatattcc

SEQ ID NO: 1943759 - DNA, 15 bp, Homo sapiens
gaaagctgcttctgg

SEQ ID NO: 1943760 - DNA, 20 bp, Homo sapiens
gaaagctgcttctgggggat

SEQ ID NO: 1943761 - DNA, 17 bp, Homo sapiens
gaaagttccttatgtat

SEQ ID NO: 1943762 - DNA, 15 bp, Homo sapiens
gaaatatgcatgtac

SEQ ID NO: 1943763 - DNA, 16 bp, Homo sapiens
gaaatccaactccagg

SEQ ID NO: 1943764 - DNA, 21 bp, Homo sapiens
gaaatgttattttttaattat

SEQ ID NO: 1943765 - DNA, 14 bp, Homo sapiens
gaaatttgttaata

SEQ ID NO: 1943766 - DNA, 23 bp, Homo sapiens
gaacaaatatgattctcctctcc

SEQ ID NO: 1943767 - DNA, 15 bp, Homo sapiens
gaacaatcactattc

SEQ ID NO: 1943768 - DNA, 19 bp, Homo sapiens
gaacaatcactattcttaa

SEQ ID NO: 1943769 - DNA, 20 bp, Homo sapiens
gaacacctgacaacttctga

SEQ ID NO: 1943770 - DNA, 15 bp, Homo sapiens
gaacagacctcggct

SEQ ID NO: 1943771 - DNA, 15 bp, Homo sapiens
gaacagtctgaaata

SEQ ID NO: 1943772 - DNA, 13 bp, Homo sapiens
gaacatacttcag

SEQ ID NO: 1943773 - DNA, 18 bp, Homo sapiens
gaaccaacgggtctgtgg

SEQ ID NO: 1943774 - DNA, 15 bp, Homo sapiens
gaaccaggaggcctg

SEQ ID NO: 1943775 - DNA, 14 bp, Homo sapiens
gaacccccctcccc

SEQ ID NO: 1943776 - DNA, 17 bp, Homo sapiens
gaaccccttcatcctct

SEQ ID NO: 1943777 - DNA, 22 bp, Homo sapiens
gaaccttgttgatgccagctgt

SEQ ID NO: 1943778 - DNA, 20 bp, Homo sapiens
gaactcttaatcaaatagca

SEQ ID NO: 1943779 - DNA, 20 bp, Homo sapiens
gaactgcttgcatttcttta

SEQ ID NO: 1943780 - DNA, 20 bp, Homo sapiens
gaagaaactattttttaaaa

SEQ ID NO: 1943781 - DNA, 14 bp, Homo sapiens
gaagaaactcctgg

SEQ ID NO: 1943782 - DNA, 13 bp, Homo sapiens
gaagaacatcaag

SEQ ID NO: 1943783 - DNA, 12 bp, Homo sapiens
gaagcagggact

SEQ ID NO: 1943784 - DNA, 18 bp, Homo sapiens
gaagccacgtgctggaga

SEQ ID NO: 1943785 - DNA, 21 bp, Homo sapiens
gaagccacgtgctggagagta

SEQ ID NO: 1943786 - DNA, 13 bp, Homo sapiens
gaagcccaggagg

SEQ ID NO: 1943787 - DNA, 19 bp, Homo sapiens
gaaggacacagtcaggggc

SEQ ID NO: 1943788 - DNA, 22 bp, Homo sapiens
gaaggacccggaggggcctggc

SEQ ID NO: 1943789 - DNA, 15 bp, Homo sapiens
gaaggagacagagct

SEQ ID NO: 1943790 - DNA, 14 bp, Homo sapiens
gaaggagaggagtg

SEQ ID NO: 1943791 - DNA, 15 bp, Homo sapiens
gaaggagaggagtgc

SEQ ID NO: 1943792 - DNA, 20 bp, Homo sapiens
gaaggagccccattcctggg

SEQ ID NO: 1943793 - DNA, 13 bp, Homo sapiens
gaaggcaaatctc

SEQ ID NO: 1943794 - DNA, 21 bp, Homo sapiens
gaaggcaagctggcaggaggg

SEQ ID NO: 1943795 - DNA, 14 bp, Homo sapiens
gaaggcctgccccc

SEQ ID NO: 1943796 - DNA, 16 bp, Homo sapiens
gaaggcctgcccccct

SEQ ID NO: 1943797 - DNA, 21 bp, Homo sapiens
gaaggcctgccccccttccca

SEQ ID NO: 1943798 - DNA, 19 bp, Homo sapiens
gaagggcgctgagggcagg

SEQ ID NO: 1943799 - DNA, 14 bp, Homo sapiens
gaaggggccagagg

SEQ ID NO: 1943800 - DNA, 20 bp, Homo sapiens
gaaggttggaactgctgcca

SEQ ID NO: 1943801 - DNA, 20 bp, Homo sapiens
gaaggtttactctgtggcca

SEQ ID NO: 1943802 - DNA, 13 bp, Homo sapiens
gaagtaggaagta

SEQ ID NO: 1943803 - DNA, 16 bp, Homo sapiens
gaagtcaaagcaagga

SEQ ID NO: 1943804 - DNA, 22 bp, Homo sapiens
gaagtcttccatcagcagtgat

SEQ ID NO: 1943805 - DNA, 16 bp, Homo sapiens
gaagtgaatacatggt

SEQ ID NO: 1943806 - DNA, 14 bp, Homo sapiens
gaagtggcctgaga

SEQ ID NO: 1943807 - DNA, 13 bp, Homo sapiens
gaagtgggagtgg

SEQ ID NO: 1943808 - DNA, 15 bp, Homo sapiens
gaagtggggacagag

SEQ ID NO: 1943809 - DNA, 22 bp, Homo sapiens
gaagtgtctaatgcattaactt

SEQ ID NO: 1943810 - DNA, 15 bp, Homo sapiens
gaagttgttagtgat

SEQ ID NO: 1943811 - DNA, 14 bp, Homo sapiens
gaataaagacacct

SEQ ID NO: 1943812 - DNA, 19 bp, Homo sapiens
gaatacttttgccctttga

SEQ ID NO: 1943813 - DNA, 17 bp, Homo sapiens
gaatataaatatcacaa

SEQ ID NO: 1943814 - DNA, 21 bp, Homo sapiens
gaatataaatatcacaaagtt

SEQ ID NO: 1943815 - DNA, 13 bp, Homo sapiens
gaatattggacat

SEQ ID NO: 1943816 - DNA, 22 bp, Homo sapiens
gaatcatttctatttctcctcc

SEQ ID NO: 1943817 - DNA, 22 bp, Homo sapiens
gaatcctgtcctcagcttctta

SEQ ID NO: 1943818 - DNA, 18 bp, Homo sapiens
gaatctctttttgctttc

SEQ ID NO: 1943819 - DNA, 18 bp, Homo sapiens
gaatgagagagtgtggaa

SEQ ID NO: 1943820 - DNA, 21 bp, Homo sapiens
gaatgagctgggccctgggtg

SEQ ID NO: 1943821 - DNA, 22 bp, Homo sapiens
gaatgatatctttgacctcaat

SEQ ID NO: 1943822 - DNA, 15 bp, Homo sapiens
gaatgattttgacat

SEQ ID NO: 1943823 - DNA, 14 bp, Homo sapiens
gaatgctgtacctt

SEQ ID NO: 1943824 - DNA, 19 bp, Homo sapiens
gaatgggccaagccagggt

SEQ ID NO: 1943825 - DNA, 20 bp, Homo sapiens
gaatgggccaagccagggtt

SEQ ID NO: 1943826 - DNA, 11 bp, Homo sapiens
gaatggggctt

SEQ ID NO: 1943827 - DNA, 22 bp, Homo sapiens
gaatggtgggctccagagtagg

SEQ ID NO: 1943828 - DNA, 16 bp, Homo sapiens
gaatgtaatcaatgtt

SEQ ID NO: 1943829 - DNA, 14 bp, Homo sapiens
gaatgttatcagta

SEQ ID NO: 1943830 - DNA, 20 bp, Homo sapiens
gaatgtttacactctttgta

SEQ ID NO: 1943831 - DNA, 21 bp, Homo sapiens
gaatgtttacactctttgtaa

SEQ ID NO: 1943832 - DNA, 16 bp, Homo sapiens
gaatgtttgaattaca

SEQ ID NO: 1943833 - DNA, 19 bp, Homo sapiens
gaattacagggaagaaatc

SEQ ID NO: 1943834 - DNA, 20 bp, Homo sapiens
gaattccctgaagcaacact

SEQ ID NO: 1943835 - DNA, 17 bp, Homo sapiens
gaattcggtgtgcacca

SEQ ID NO: 1943836 - DNA, 13 bp, Homo sapiens
gaattctgaactt

SEQ ID NO: 1943837 - DNA, 20 bp, Homo sapiens
gaattcttggttgaggaaac

SEQ ID NO: 1943838 - DNA, 18 bp, Homo sapiens
gaatttaagaaataactt

SEQ ID NO: 1943839 - DNA, 17 bp, Homo sapiens
gaatttgagtgctctga

SEQ ID NO: 1943840 - DNA, 20 bp, Homo sapiens
gacaaagaaatagcaagaga

SEQ ID NO: 1943841 - DNA, 13 bp, Homo sapiens
gacaacatttctg

SEQ ID NO: 1943842 - DNA, 13 bp, Homo sapiens
gacaagccaggcc

SEQ ID NO: 1943843 - DNA, 14 bp, Homo sapiens
aaaggcaagcactt

SEQ ID NO: 1943844 - DNA, 22 bp, Homo sapiens
aaagggggctattccctggaga

SEQ ID NO: 1943845 - DNA, 18 bp, Homo sapiens
aaaggggtcccatagagg

SEQ ID NO: 1943846 - DNA, 17 bp, Homo sapiens
aaagttacaaattgctt

SEQ ID NO: 1943847 - DNA, 21 bp, Homo sapiens
aaagttctgtactcaaatgta

SEQ ID NO: 1943848 - DNA, 22 bp, Homo sapiens
aaataaaattaaagctgaaaac

SEQ ID NO: 1943849 - DNA, 21 bp, Homo sapiens
aaataaagtacgtgtttactt

SEQ ID NO: 1943850 - DNA, 19 bp, Homo sapiens
aaataaccaatcctggaca

SEQ ID NO: 1943851 - DNA, 15 bp, Homo sapiens
aaataacttgtgtta

SEQ ID NO: 1943852 - DNA, 19 bp, Homo sapiens
aaataagtcattttaataa

SEQ ID NO: 1943853 - DNA, 23 bp, Homo sapiens
aaatacagtcttccatttgcaag

SEQ ID NO: 1943854 - DNA, 21 bp, Homo sapiens
aaatagataagagtagaaact

SEQ ID NO: 1943855 - DNA, 16 bp, Homo sapiens
aaatagtaaaaataaa

SEQ ID NO: 1943856 - DNA, 12 bp, Homo sapiens
aaatatatttaa

SEQ ID NO: 1943857 - DNA, 18 bp, Homo sapiens
aaatatatttaactattt

SEQ ID NO: 1943858 - DNA, 20 bp, Homo sapiens
aaatatatttaagataatta

SEQ ID NO: 1943859 - DNA, 15 bp, Homo sapiens
aaatatgaaatttta

SEQ ID NO: 1943860 - DNA, 19 bp, Homo sapiens
aaatatgattctcctctcc

SEQ ID NO: 1943861 - DNA, 21 bp, Homo sapiens
aaatatgattctcctctccca

SEQ ID NO: 1943862 - DNA, 13 bp, Homo sapiens
aaatatgattgat

SEQ ID NO: 1943863 - DNA, 12 bp, Homo sapiens
aaatatgcactt

SEQ ID NO: 1943864 - DNA, 12 bp, Homo sapiens
aaatatgcatct

SEQ ID NO: 1943865 - DNA, 13 bp, Homo sapiens
aaatatgcatgta

SEQ ID NO: 1943866 - DNA, 21 bp, Homo sapiens
aaatatgtgagcatgaaacta

SEQ ID NO: 1943867 - DNA, 19 bp, Homo sapiens
aaatatgttgatgaaaaat

SEQ ID NO: 1943868 - DNA, 11 bp, Homo sapiens
aaatattcttg

SEQ ID NO: 1943869 - DNA, 21 bp, Homo sapiens
aaatattcttgtccacattct

SEQ ID NO: 1943870 - DNA, 18 bp, Homo sapiens
aaatatttctatgtaaat

SEQ ID NO: 1943871 - DNA, 22 bp, Homo sapiens
aaatcaacttgtcacaaagtga

SEQ ID NO: 1943872 - DNA, 18 bp, Homo sapiens
aaatctatagtttgattc

SEQ ID NO: 1943873 - DNA, 23 bp, Homo sapiens
aaatcttaagagaatccacataa

SEQ ID NO: 1943874 - DNA, 16 bp, Homo sapiens
aaatgaaaatgtcttg

SEQ ID NO: 1943875 - DNA, 13 bp, Homo sapiens
aaatgagaaggaa

SEQ ID NO: 1943876 - DNA, 14 bp, Homo sapiens
aaatggtccaggag

SEQ ID NO: 1943877 - DNA, 19 bp, Homo sapiens
aaatggtgagaattaaaat

SEQ ID NO: 1943878 - DNA, 12 bp, Homo sapiens
aaatgtcttgtg

SEQ ID NO: 1943879 - DNA, 12 bp, Homo sapiens
aaatgtgcagta

SEQ ID NO: 1943880 - DNA, 13 bp, Homo sapiens
aaatgttcacttt

SEQ ID NO: 1943881 - DNA, 17 bp, Homo sapiens
aaatgtttaatatctga

SEQ ID NO: 1943882 - DNA, 17 bp, Homo sapiens
aaatgtttggaatttaa

SEQ ID NO: 1943883 - DNA, 17 bp, Homo sapiens
aaattaaacgagcgaag

SEQ ID NO: 1943884 - DNA, 13 bp, Homo sapiens
aaattaaagctga

SEQ ID NO: 1943885 - DNA, 19 bp, Homo sapiens
aaattattgtaaacttttt

SEQ ID NO: 1943886 - DNA, 13 bp, Homo sapiens
aaattatttcaga

SEQ ID NO: 1943887 - DNA, 14 bp, Homo sapiens
aaattcacttctat

SEQ ID NO: 1943888 - DNA, 14 bp, Homo sapiens
aaattgatgggtgg

SEQ ID NO: 1943889 - DNA, 15 bp, Homo sapiens
aaattttcagaaagc

SEQ ID NO: 1943890 - DNA, 23 bp, Homo sapiens
aacaaatatgattctcctctccc

SEQ ID NO: 1943891 - DNA, 20 bp, Homo sapiens
aacaaattaaaaacacctaa

SEQ ID NO: 1943892 - DNA, 21 bp, Homo sapiens
aacaagaagccacagacctag

SEQ ID NO: 1943893 - DNA, 15 bp, Homo sapiens
aacaatcactattct

SEQ ID NO: 1943894 - DNA, 18 bp, Homo sapiens
aacactaacatataatgt

SEQ ID NO: 1943895 - DNA, 18 bp, Homo sapiens
aacagacctcggctgtgt

SEQ ID NO: 1943896 - DNA, 23 bp, Homo sapiens
aacagcagagtaaaattacagaa

SEQ ID NO: 1943897 - DNA, 12 bp, Homo sapiens
aacagcaggagc

SEQ ID NO: 1943898 - DNA, 23 bp, Homo sapiens
aacagcctgtttgggaggctgga

SEQ ID NO: 1943899 - DNA, 21 bp, Homo sapiens
aacaggcgttctcagcctccg

SEQ ID NO: 1943900 - DNA, 14 bp, Homo sapiens
aacatgaattaaga

SEQ ID NO: 1943901 - DNA, 15 bp, Homo sapiens
aacatgtaggaagta

SEQ ID NO: 1943902 - DNA, 21 bp, Homo sapiens
aacattcaaaaacatggccac

SEQ ID NO: 1943903 - DNA, 13 bp, Homo sapiens
aaccaagcagctt

SEQ ID NO: 1943904 - DNA, 13 bp, Homo sapiens
aaccaatcctgga

SEQ ID NO: 1943905 - DNA, 13 bp, Homo sapiens
aaccacctctggc

SEQ ID NO: 1943906 - DNA, 23 bp, Homo sapiens
aaccacctctggccctgttgtgg

SEQ ID NO: 1943907 - DNA, 23 bp, Homo sapiens
aaccactatcttttgttctacct

SEQ ID NO: 1943908 - DNA, 15 bp, Homo sapiens
aaccagctctttggt

SEQ ID NO: 1943909 - DNA, 18 bp, Homo sapiens
aaccattaccttaaaatt

SEQ ID NO: 1943910 - DNA, 21 bp, Homo sapiens
aacccttggagccaatggaga

SEQ ID NO: 1943911 - DNA, 16 bp, Homo sapiens
aacctcatcttcttca

SEQ ID NO: 1943912 - DNA, 13 bp, Homo sapiens
aacctgcttttgt

SEQ ID NO: 1943913 - DNA, 11 bp, Homo sapiens
aacgcagccct

SEQ ID NO: 1943914 - DNA, 19 bp, Homo sapiens
aacgggttactaagatgaa

SEQ ID NO: 1943915 - DNA, 14 bp, Homo sapiens
aacggttaaaactg

SEQ ID NO: 1943916 - DNA, 14 bp, Homo sapiens
aacgttgctcccca

SEQ ID NO: 1943917 - DNA, 18 bp, Homo sapiens
aactaagcacattatgtt

SEQ ID NO: 1943918 - DNA, 14 bp, Homo sapiens
aactaattttgtac

SEQ ID NO: 1943919 - DNA, 16 bp, Homo sapiens
aactaccaaaatgaag

SEQ ID NO: 1943920 - DNA, 13 bp, Homo sapiens
aactactgtacat

SEQ ID NO: 1943921 - DNA, 15 bp, Homo sapiens
aactactgtacattt

SEQ ID NO: 1943922 - DNA, 17 bp, Homo sapiens
agaactggggtgatgtt

SEQ ID NO: 1943923 - DNA, 14 bp, Homo sapiens
agaagaaactattt

SEQ ID NO: 1943924 - DNA, 13 bp, Homo sapiens
agaagagggagaa

SEQ ID NO: 1943925 - DNA, 20 bp, Homo sapiens
agaagagggagaaggagagg

SEQ ID NO: 1943926 - DNA, 21 bp, Homo sapiens
agaagagggagaaggagaggc

SEQ ID NO: 1943927 - DNA, 17 bp, Homo sapiens
agaagcaacagaaaaaa

SEQ ID NO: 1943928 - DNA, 16 bp, Homo sapiens
agaagcaccccaccac

SEQ ID NO: 1943929 - DNA, 19 bp, Homo sapiens
agaagctcctgaatccctt

SEQ ID NO: 1943930 - DNA, 15 bp, Homo sapiens
agaaggaatttgagt

SEQ ID NO: 1943931 - DNA, 17 bp, Homo sapiens
agaaggagacagagctg

SEQ ID NO: 1943932 - DNA, 13 bp, Homo sapiens
agaaggccccagg

SEQ ID NO: 1943933 - DNA, 14 bp, Homo sapiens
agaaggggcgaggc

SEQ ID NO: 1943934 - DNA, 20 bp, Homo sapiens
agaagtggggacagagcaga

SEQ ID NO: 1943935 - DNA, 14 bp, Homo sapiens
agaagtgtgttttg

SEQ ID NO: 1943936 - DNA, 14 bp, Homo sapiens
agaatccaaagtgg

SEQ ID NO: 1943937 - DNA, 16 bp, Homo sapiens
agaatgagagagtgtg

SEQ ID NO: 1943938 - DNA, 22 bp, Homo sapiens
agaatgatttccacctttatgt

SEQ ID NO: 1943939 - DNA, 15 bp, Homo sapiens
agaatggctctggct

SEQ ID NO: 1943940 - DNA, 21 bp, Homo sapiens
agaatggtgggctccagagta

SEQ ID NO: 1943941 - DNA, 22 bp, Homo sapiens
agaattgctgattcttgagttt

SEQ ID NO: 1943942 - DNA, 18 bp, Homo sapiens
agaatttgagtgctctga

SEQ ID NO: 1943943 - DNA, 17 bp, Homo sapiens
agacactgaaggcaaat

SEQ ID NO: 1943944 - DNA, 13 bp, Homo sapiens
agacagagtggat

SEQ ID NO: 1943945 - DNA, 20 bp, Homo sapiens
agacagagtggatctggagt

SEQ ID NO: 1943946 - DNA, 14 bp, Homo sapiens
agacagggtggggc

SEQ ID NO: 1943947 - DNA, 20 bp, Homo sapiens
agacagtcaaggagtggctt

SEQ ID NO: 1943948 - DNA, 23 bp, Homo sapiens
agacatccccctccttgccgctg

SEQ ID NO: 1943949 - DNA, 19 bp, Homo sapiens
agacatggggaggaaggac

SEQ ID NO: 1943950 - DNA, 12 bp, Homo sapiens
agaccagagagc

SEQ ID NO: 1943951 - DNA, 17 bp, Homo sapiens
agacccctaccctttcc

SEQ ID NO: 1943952 - DNA, 15 bp, Homo sapiens
agacccctggctttt

SEQ ID NO: 1943953 - DNA, 21 bp, Homo sapiens
agacccctggcttttcactgc

SEQ ID NO: 1943954 - DNA, 14 bp, Homo sapiens
agaccctgccaggg

SEQ ID NO: 1943955 - DNA, 20 bp, Homo sapiens
agacctgagatgctggtcaa

SEQ ID NO: 1943956 - DNA, 21 bp, Homo sapiens
agaccttcttccacagcaaat

SEQ ID NO: 1943957 - DNA, 13 bp, Homo sapiens
agacgcctgagga

SEQ ID NO: 1943958 - DNA, 15 bp, Homo sapiens
agacgcctgaggaac

SEQ ID NO: 1943959 - DNA, 21 bp, Homo sapiens
agactccagctgggttggaaa

SEQ ID NO: 1943960 - DNA, 22 bp, Homo sapiens
agactctctcctctctctccct

SEQ ID NO: 1943961 - DNA, 23 bp, Homo sapiens
agactgaccttgatgtcttgaga

SEQ ID NO: 1943962 - DNA, 14 bp, Homo sapiens
agactgggctgagg

SEQ ID NO: 1943963 - DNA, 16 bp, Homo sapiens
agactgggctgaggga

SEQ ID NO: 1943964 - DNA, 14 bp, Homo sapiens
agactgtctcaaga

SEQ ID NO: 1943965 - DNA, 17 bp, Homo sapiens
agacttgttttcccctc

SEQ ID NO: 1943966 - DNA, 17 bp, Homo sapiens
agagaatccacataaaa

SEQ ID NO: 1943967 - DNA, 18 bp, Homo sapiens
agagaatccacataaaag

SEQ ID NO: 1943968 - DNA, 19 bp, Homo sapiens
agagaatccacataaaaga

SEQ ID NO: 1943969 - DNA, 19 bp, Homo sapiens
agagaatgagagagtgtgg

SEQ ID NO: 1943970 - DNA, 20 bp, Homo sapiens
agagaccttctcttaggaca

SEQ ID NO: 1943971 - DNA, 18 bp, Homo sapiens
agagactactctgcctga

SEQ ID NO: 1943972 - DNA, 23 bp, Homo sapiens
agagagctcaagtttcagagtca

SEQ ID NO: 1943973 - DNA, 12 bp, Homo sapiens
agagaggacagt

SEQ ID NO: 1943974 - DNA, 18 bp, Homo sapiens
agagaggacagtttagga

SEQ ID NO: 1943975 - DNA, 16 bp, Homo sapiens
agagagggggccacct

SEQ ID NO: 1943976 - DNA, 19 bp, Homo sapiens
agagattacctcctgagaa

SEQ ID NO: 1943977 - DNA, 13 bp, Homo sapiens
agagattgggggg

SEQ ID NO: 1943978 - DNA, 19 bp, Homo sapiens
agagattgggggggcttgg

SEQ ID NO: 1943979 - DNA, 16 bp, Homo sapiens
agagatttcatagcta

SEQ ID NO: 1943980 - DNA, 23 bp, Homo sapiens
agagcaaatttcatctttccaaa

SEQ ID NO: 1943981 - DNA, 14 bp, Homo sapiens
agagcacagattca

SEQ ID NO: 1943982 - DNA, 20 bp, Homo sapiens
agagcagttaacatctgaag

SEQ ID NO: 1943983 - DNA, 14 bp, Homo sapiens
agagcattctgggg

SEQ ID NO: 1943984 - DNA, 14 bp, Homo sapiens
agagccatctgcga

SEQ ID NO: 1943985 - DNA, 16 bp, Homo sapiens
agagcctatggaaagg

SEQ ID NO: 1943986 - DNA, 17 bp, Homo sapiens
agagcctatggaaaggg

SEQ ID NO: 1943987 - DNA, 20 bp, Homo sapiens
agagcctatggaaagggtgt

SEQ ID NO: 1943988 - DNA, 13 bp, Homo sapiens
agagcctgggcgc

SEQ ID NO: 1943989 - DNA, 16 bp, Homo sapiens
agagctcaggagaagg

SEQ ID NO: 1943990 - DNA, 17 bp, Homo sapiens
agagctcagtatactaa

SEQ ID NO: 1943991 - DNA, 15 bp, Homo sapiens
agagctgcagttgtg

SEQ ID NO: 1943992 - DNA, 21 bp, Homo sapiens
agagctgcagttgtgaaagca

SEQ ID NO: 1943993 - DNA, 16 bp, Homo sapiens
agagctggttgggaag

SEQ ID NO: 1943994 - DNA, 13 bp, Homo sapiens
agagcttccctga

SEQ ID NO: 1943995 - DNA, 16 bp, Homo sapiens
agagcttccctgactc

SEQ ID NO: 1943996 - DNA, 13 bp, Homo sapiens
agaggaaaagcca

SEQ ID NO: 1943997 - DNA, 20 bp, Homo sapiens
agaggaagcacaagaagtgg

SEQ ID NO: 1943998 - DNA, 16 bp, Homo sapiens
agaggacatattcaca

SEQ ID NO: 1943999 - DNA, 13 bp, Homo sapiens
agaggaggtgtgg

SEQ ID NO: 1944000 - DNA, 14 bp, Homo sapiens
agaggcagtggcag

SEQ ID NO: 1944001 - DNA, 14 bp, Homo sapiens
agaggccaggcatg

SEQ ID NO: 1944002 - DNA, 19 bp, Homo sapiens
agaggccctcgctgccagc

SEQ ID NO: 1944003 - DNA, 15 bp, Homo sapiens
agagggagaaggaga

SEQ ID NO: 1944004 - DNA, 17 bp, Homo sapiens
agagggagaaggagagg

SEQ ID NO: 1944005 - DNA, 22 bp, Homo sapiens
agagggagaaggagaggctctg

SEQ ID NO: 1944006 - DNA, 12 bp, Homo sapiens
agaggggagagg

SEQ ID NO: 1944007 - DNA, 13 bp, Homo sapiens
agaggggagagga

SEQ ID NO: 1944008 - DNA, 15 bp, Homo sapiens
agaggggagaggaag

SEQ ID NO: 1944009 - DNA, 16 bp, Homo sapiens
agaggtcttttttaaa

SEQ ID NO: 1944010 - DNA, 21 bp, Homo sapiens
agagtcgagtgatatggcttg

SEQ ID NO: 1944011 - DNA, 19 bp, Homo sapiens
agagtggccaatccctgtg

SEQ ID NO: 1944012 - DNA, 12 bp, Homo sapiens
agagtggctcct

SEQ ID NO: 1944013 - DNA, 13 bp, Homo sapiens
agagtggctcctc

SEQ ID NO: 1944014 - DNA, 15 bp, Homo sapiens
agagtggctcctccc

SEQ ID NO: 1944015 - DNA, 15 bp, Homo sapiens
agagtgtctttccac

SEQ ID NO: 1944016 - DNA, 21 bp, Homo sapiens
agagtgtggaaaaaaaaagaa

SEQ ID NO: 1944017 - DNA, 19 bp, Homo sapiens
agagttgtgcacatggctt

SEQ ID NO: 1944018 - DNA, 20 bp, Homo sapiens
agataaaaacaatatatgta

SEQ ID NO: 1944019 - DNA, 13 bp, Homo sapiens
agataatatttaa

SEQ ID NO: 1944020 - DNA, 19 bp, Homo sapiens
agataatatttaaaatagt

SEQ ID NO: 1944021 - DNA, 13 bp, Homo sapiens
agataatgtgaaa

SEQ ID NO: 1944022 - DNA, 14 bp, Homo sapiens
agataccagcgagg

SEQ ID NO: 1944023 - DNA, 12 bp, Homo sapiens
agatatgtatta

SEQ ID NO: 1944024 - DNA, 20 bp, Homo sapiens
agatcaggtcagagcccagg

SEQ ID NO: 1944025 - DNA, 23 bp, Homo sapiens
agatctctgctttggaaatcaca

SEQ ID NO: 1944026 - DNA, 12 bp, Homo sapiens
agatcttgagca

SEQ ID NO: 1944027 - DNA, 15 bp, Homo sapiens
agatgacagaaatat

SEQ ID NO: 1944028 - DNA, 16 bp, Homo sapiens
agatgagaagccaaag

SEQ ID NO: 1944029 - DNA, 13 bp, Homo sapiens
agatgagtcctgt

SEQ ID NO: 1944030 - DNA, 15 bp, Homo sapiens
agatgcatctgtggc

SEQ ID NO: 1944031 - DNA, 20 bp, Homo sapiens
agatgctccttgggcccttt

SEQ ID NO: 1944032 - DNA, 20 bp, Homo sapiens
agatgctgactgtactcctc

SEQ ID NO: 1944033 - DNA, 18 bp, Homo sapiens
agatggattggtgtaaaa

SEQ ID NO: 1944034 - DNA, 14 bp, Homo sapiens
agatggttcccttt

SEQ ID NO: 1944035 - DNA, 15 bp, Homo sapiens
agattcatccattta

SEQ ID NO: 1944036 - DNA, 17 bp, Homo sapiens
agattcccggctggact

SEQ ID NO: 1944037 - DNA, 16 bp, Homo sapiens
accttctgtggctcac

SEQ ID NO: 1944038 - DNA, 20 bp, Homo sapiens
accttgatgtcttgagagcg

SEQ ID NO: 1944039 - DNA, 18 bp, Homo sapiens
accttgttgatgccagct

SEQ ID NO: 1944040 - DNA, 14 bp, Homo sapiens
acctttatgtttta

SEQ ID NO: 1944041 - DNA, 13 bp, Homo sapiens
acgaaatgttatt

SEQ ID NO: 1944042 - DNA, 19 bp, Homo sapiens
acgagctgtttactaggga

SEQ ID NO: 1944043 - DNA, 14 bp, Homo sapiens
acgcagaagagaaa

SEQ ID NO: 1944044 - DNA, 22 bp, Homo sapiens
acgcgcgcgcgcgcacacacac

SEQ ID NO: 1944045 - DNA, 11 bp, Homo sapiens
acggaactctt

SEQ ID NO: 1944046 - DNA, 17 bp, Homo sapiens
acggaagtggcctgaga

SEQ ID NO: 1944047 - DNA, 22 bp, Homo sapiens
acggaagtggcctgagaagagt

SEQ ID NO: 1944048 - DNA, 19 bp, Homo sapiens
acggagccactcctctgac

SEQ ID NO: 1944049 - DNA, 18 bp, Homo sapiens
acggattatctagagaat

SEQ ID NO: 1944050 - DNA, 20 bp, Homo sapiens
acggcagtcacactgctggg

SEQ ID NO: 1944051 - DNA, 22 bp, Homo sapiens
acggcagtcacactgctgggaa

SEQ ID NO: 1944052 - DNA, 12 bp, Homo sapiens
acgggtctgtgg

SEQ ID NO: 1944053 - DNA, 14 bp, Homo sapiens
acgtgctggagagt

SEQ ID NO: 1944054 - DNA, 15 bp, Homo sapiens
acgtgctggagagta

SEQ ID NO: 1944055 - DNA, 14 bp, Homo sapiens
acgtggggcagcac

SEQ ID NO: 1944056 - DNA, 15 bp, Homo sapiens
acgtggggcagcaca

SEQ ID NO: 1944057 - DNA, 22 bp, Homo sapiens
acgtgggtcttcagggggccag

SEQ ID NO: 1944058 - DNA, 13 bp, Homo sapiens
acgttgctcccca

SEQ ID NO: 1944059 - DNA, 16 bp, Homo sapiens
acgtttagaaatgatt

SEQ ID NO: 1944060 - DNA, 13 bp, Homo sapiens
actaaatatgaaa

SEQ ID NO: 1944061 - DNA, 16 bp, Homo sapiens
actaaatatgaaattt

SEQ ID NO: 1944062 - DNA, 17 bp, Homo sapiens
actaaatatgaaatttt

SEQ ID NO: 1944063 - DNA, 18 bp, Homo sapiens
actaagatgaaattgcca

SEQ ID NO: 1944064 - DNA, 19 bp, Homo sapiens
actaagcacattatgtttg

SEQ ID NO: 1944065 - DNA, 12 bp, Homo sapiens
actaatttgtat

SEQ ID NO: 1944066 - DNA, 20 bp, Homo sapiens
actacagccaaattgcagaa

SEQ ID NO: 1944067 - DNA, 15 bp, Homo sapiens
actacagtcaggaaa

SEQ ID NO: 1944068 - DNA, 14 bp, Homo sapiens
actaccaaaatgaa

SEQ ID NO: 1944069 - DNA, 21 bp, Homo sapiens
actaccaaaatgaagacacgc

SEQ ID NO: 1944070 - DNA, 18 bp, Homo sapiens
actaccacttatttctaa

SEQ ID NO: 1944071 - DNA, 15 bp, Homo sapiens
actactcagggaatg

SEQ ID NO: 1944072 - DNA, 12 bp, Homo sapiens
actactctgcct

SEQ ID NO: 1944073 - DNA, 15 bp, Homo sapiens
actactgtacatttt

SEQ ID NO: 1944074 - DNA, 18 bp, Homo sapiens
actagggatccctcatct

SEQ ID NO: 1944075 - DNA, 20 bp, Homo sapiens
actagggatccctcatctgt

SEQ ID NO: 1944076 - DNA, 15 bp, Homo sapiens
actaggtgcccagtc

SEQ ID NO: 1944077 - DNA, 18 bp, Homo sapiens
actatgcgtaaatcaact

SEQ ID NO: 1944078 - DNA, 19 bp, Homo sapiens
actatttttttgttgctgt

SEQ ID NO: 1944079 - DNA, 16 bp, Homo sapiens
actcagggctcctggg

SEQ ID NO: 1944080 - DNA, 13 bp, Homo sapiens
actccactcccct

SEQ ID NO: 1944081 - DNA, 19 bp, Homo sapiens
actccagacccctggcttt

SEQ ID NO: 1944082 - DNA, 21 bp, Homo sapiens
actccagggttaaagaaaggc

SEQ ID NO: 1944083 - DNA, 14 bp, Homo sapiens
actcctacctggta

SEQ ID NO: 1944084 - DNA, 19 bp, Homo sapiens
actcctcccaactctggcc

SEQ ID NO: 1944085 - DNA, 20 bp, Homo sapiens
actcctcccaactctggcct

SEQ ID NO: 1944086 - DNA, 19 bp, Homo sapiens
actctacccatattacaga

SEQ ID NO: 1944087 - DNA, 13 bp, Homo sapiens
actctagtgccat

SEQ ID NO: 1944088 - DNA, 18 bp, Homo sapiens
actctctccatcagaagg

SEQ ID NO: 1944089 - DNA, 19 bp, Homo sapiens
actctctcctctctctccc

SEQ ID NO: 1944090 - DNA, 20 bp, Homo sapiens
actctctcctctctctccct

SEQ ID NO: 1944091 - DNA, 23 bp, Homo sapiens
actctctcctctctctccctcca

SEQ ID NO: 1944092 - DNA, 18 bp, Homo sapiens
actctctttcttccacta

SEQ ID NO: 1944093 - DNA, 17 bp, Homo sapiens
actctgcctgaacactg

SEQ ID NO: 1944094 - DNA, 22 bp, Homo sapiens
actctgcctgaacactgcttct

SEQ ID NO: 1944095 - DNA, 23 bp, Homo sapiens
actctggccttggttcctccagc

SEQ ID NO: 1944096 - DNA, 16 bp, Homo sapiens
actctggctgccaaga

SEQ ID NO: 1944097 - DNA, 14 bp, Homo sapiens
actcttaatcaaat

SEQ ID NO: 1944098 - DNA, 11 bp, Homo sapiens
actctttcaaa

SEQ ID NO: 1944099 - DNA, 14 bp, Homo sapiens
actctttcttctct

SEQ ID NO: 1944100 - DNA, 21 bp, Homo sapiens
actctttcttctctctttgtc

SEQ ID NO: 1944101 - DNA, 21 bp, Homo sapiens
actcttttccaaacacaggca

SEQ ID NO: 1944102 - DNA, 17 bp, Homo sapiens
actgaacctctggctag

SEQ ID NO: 1944103 - DNA, 12 bp, Homo sapiens
actgaaggcaaa

SEQ ID NO: 1944104 - DNA, 15 bp, Homo sapiens
actgaagtgaataca

SEQ ID NO: 1944105 - DNA, 19 bp, Homo sapiens
actgaagtgaatacatggt

SEQ ID NO: 1944106 - DNA, 20 bp, Homo sapiens
actgaagtgaatacatggta

SEQ ID NO: 1944107 - DNA, 22 bp, Homo sapiens
actgaatgcttctgacttcata

SEQ ID NO: 1944108 - DNA, 18 bp, Homo sapiens
actgaggggtctccagga

SEQ ID NO: 1944109 - DNA, 21 bp, Homo sapiens
actgagtgttcaaactactgt

SEQ ID NO: 1944110 - DNA, 22 bp, Homo sapiens
actgagtgttcaaactactgta

SEQ ID NO: 1944111 - DNA, 15 bp, Homo sapiens
actgatcacaaaaac

SEQ ID NO: 1944112 - DNA, 17 bp, Homo sapiens
actgcagtcacccctgt

SEQ ID NO: 1944113 - DNA, 18 bp, Homo sapiens
actgcagtcacccctgtc

SEQ ID NO: 1944114 - DNA, 15 bp, Homo sapiens
actgcccacctgcca

SEQ ID NO: 1944115 - DNA, 17 bp, Homo sapiens
actgcccacctgccagg

SEQ ID NO: 1944116 - DNA, 15 bp, Homo sapiens
actgccttaaaactt

SEQ ID NO: 1944117 - DNA, 14 bp, Homo sapiens
actgcgaactctca

SEQ ID NO: 1944118 - DNA, 16 bp, Homo sapiens
actgcggaacaggagt

SEQ ID NO: 1944119 - DNA, 15 bp, Homo sapiens
actgctggctgcctt

SEQ ID NO: 1944120 - DNA, 18 bp, Homo sapiens
actgctgggaagtggctt

SEQ ID NO: 1944121 - DNA, 16 bp, Homo sapiens
actgctgtccctcctg

SEQ ID NO: 1944122 - DNA, 14 bp, Homo sapiens
actgcttgaggaaa

SEQ ID NO: 1944123 - DNA, 11 bp, Homo sapiens
actgcttgcat

SEQ ID NO: 1944124 - DNA, 16 bp, Homo sapiens
actgcttgcatttctt

SEQ ID NO: 1944125 - DNA, 14 bp, Homo sapiens
actggcccacccct

SEQ ID NO: 1944126 - DNA, 15 bp, Homo sapiens
actggcccacccctc

SEQ ID NO: 1944127 - DNA, 23 bp, Homo sapiens
actggcccacccctcttccccct

SEQ ID NO: 1944128 - DNA, 17 bp, Homo sapiens
actgggccggcagcctg

SEQ ID NO: 1944129 - DNA, 14 bp, Homo sapiens
actgggctgaggga

SEQ ID NO: 1944130 - DNA, 21 bp, Homo sapiens
actgggggtgccaaccacctc

SEQ ID NO: 1944131 - DNA, 16 bp, Homo sapiens
actggtatatatttag

SEQ ID NO: 1944132 - DNA, 22 bp, Homo sapiens
actggtggcccgacagcctggc

SEQ ID NO: 1944133 - DNA, 23 bp, Homo sapiens
actggttccttaagtggctgtga

SEQ ID NO: 1944134 - DNA, 17 bp, Homo sapiens
actgtaaatttaataga

SEQ ID NO: 1944135 - DNA, 14 bp, Homo sapiens
actgtacatttttt

SEQ ID NO: 1944136 - DNA, 16 bp, Homo sapiens
actgtcatgcccagct

SEQ ID NO: 1944137 - DNA, 18 bp, Homo sapiens
actgtcatgcccagcttg

SEQ ID NO: 1944138 - DNA, 19 bp, Homo sapiens
actgtctcaagagggcact

SEQ ID NO: 1944139 - DNA, 20 bp, Homo sapiens
actgtctcaagagggcactg

SEQ ID NO: 1944140 - DNA, 23 bp, Homo sapiens
actgtctcaagagggcactggtg

SEQ ID NO: 1944141 - DNA, 22 bp, Homo sapiens
actgtctccatggccctgcaaa

SEQ ID NO: 1944142 - DNA, 18 bp, Homo sapiens
actgtgaggaagagcagg

SEQ ID NO: 1944143 - DNA, 19 bp, Homo sapiens
actgtgcacatctgtgtct

SEQ ID NO: 1944144 - DNA, 15 bp, Homo sapiens
actgttccccctgtg

SEQ ID NO: 1944145 - DNA, 13 bp, Homo sapiens
actgttcttgaat

SEQ ID NO: 1944146 - DNA, 22 bp, Homo sapiens
actgtttgccttctacttttaa

SEQ ID NO: 1944147 - DNA, 16 bp, Homo sapiens
acttcaaaatcagtga

SEQ ID NO: 1944148 - DNA, 19 bp, Homo sapiens
acttcagactctctcctct

SEQ ID NO: 1944149 - DNA, 20 bp, Homo sapiens
acttcagactctctcctctc

SEQ ID NO: 1944150 - DNA, 17 bp, Homo sapiens
acttcaggctcttctcc

SEQ ID NO: 1944151 - DNA, 18 bp, Homo sapiens
acttcaggctcttctcct

SEQ ID NO: 1944152 - DNA, 19 bp, Homo sapiens
acttccaaatcccctaagc

SEQ ID NO: 1944153 - DNA, 14 bp, Homo sapiens
acttcccaggccga

SEQ ID NO: 1944154 - DNA, 13 bp, Homo sapiens
acttcctcctcct

SEQ ID NO: 1944155 - DNA, 13 bp, Homo sapiens
acttgaaatcaaa

SEQ ID NO: 1944156 - DNA, 15 bp, Homo sapiens
acttggccaccagga

SEQ ID NO: 1944157 - DNA, 20 bp, Homo sapiens
acttggtgaggaggaggcag

SEQ ID NO: 1944158 - DNA, 20 bp, Homo sapiens
acttgtaaatgtggtaaaga

SEQ ID NO: 1944159 - DNA, 20 bp, Homo sapiens
acttgtgcctcttgggagac

SEQ ID NO: 1944160 - DNA, 15 bp, Homo sapiens
acttgtgctatagtg

SEQ ID NO: 1944161 - DNA, 20 bp, Homo sapiens
acttgtgtttgtatataaat

SEQ ID NO: 1944162 - DNA, 15 bp, Homo sapiens
actttaataataaaa

SEQ ID NO: 1944163 - DNA, 22 bp, Homo sapiens
actttagggctaaccagttctc

SEQ ID NO: 1944164 - DNA, 16 bp, Homo sapiens
actttatattttctat

SEQ ID NO: 1944165 - DNA, 23 bp, Homo sapiens
actttatattttctatatttgta

SEQ ID NO: 1944166 - DNA, 15 bp, Homo sapiens
actttcttttctgga

SEQ ID NO: 1944167 - DNA, 20 bp, Homo sapiens
actttgaaaatatttctatg

SEQ ID NO: 1944168 - DNA, 17 bp, Homo sapiens
actttgcagacctggga

SEQ ID NO: 1944169 - DNA, 18 bp, Homo sapiens
actttgcagacctgggac

SEQ ID NO: 1944170 - DNA, 14 bp, Homo sapiens
actttggaaggagg

SEQ ID NO: 1944171 - DNA, 18 bp, Homo sapiens
actttggccacagcccca

SEQ ID NO: 1944172 - DNA, 19 bp, Homo sapiens
acttttgcagcttccttcc

SEQ ID NO: 1944173 - DNA, 17 bp, Homo sapiens
acttttgtaaatattct

SEQ ID NO: 1944174 - DNA, 19 bp, Homo sapiens
acagcctcccctgccaggg

SEQ ID NO: 1944175 - DNA, 15 bp, Homo sapiens
acagcctggcacagg

SEQ ID NO: 1944176 - DNA, 23 bp, Homo sapiens
acaggcaaatccgaaatcagcag

SEQ ID NO: 1944177 - DNA, 14 bp, Homo sapiens
acaggcagcattta

SEQ ID NO: 1944178 - DNA, 20 bp, Homo sapiens
acaggcgttctcagcctccg

SEQ ID NO: 1944179 - DNA, 21 bp, Homo sapiens
acaggctgcaagctgcaggga

SEQ ID NO: 1944180 - DNA, 14 bp, Homo sapiens
acagggaagaaatc

SEQ ID NO: 1944181 - DNA, 17 bp, Homo sapiens
acagggaagaaatcaag

SEQ ID NO: 1944182 - DNA, 15 bp, Homo sapiens
acagggcttctcttt

SEQ ID NO: 1944183 - DNA, 18 bp, Homo sapiens
acaggggacactgaacct

SEQ ID NO: 1944184 - DNA, 17 bp, Homo sapiens
acagggtggggcttaga

SEQ ID NO: 1944185 - DNA, 13 bp, Homo sapiens
acagtaaactcac

SEQ ID NO: 1944186 - DNA, 20 bp, Homo sapiens
acagtaactaagcacattat

SEQ ID NO: 1944187 - DNA, 17 bp, Homo sapiens
acagtatatcttaagat

SEQ ID NO: 1944188 - DNA, 12 bp, Homo sapiens
acagtattgcca

SEQ ID NO: 1944189 - DNA, 18 bp, Homo sapiens
acagtcaaggagtggctt

SEQ ID NO: 1944190 - DNA, 22 bp, Homo sapiens
acagtcaaggagtggcttacta

SEQ ID NO: 1944191 - DNA, 22 bp, Homo sapiens
acagtgaacataactgtaacat

SEQ ID NO: 1944192 - DNA, 18 bp, Homo sapiens
acagtgcatctcagccca

SEQ ID NO: 1944193 - DNA, 20 bp, Homo sapiens
acagtgtatctcgaagtctt

SEQ ID NO: 1944194 - DNA, 12 bp, Homo sapiens
acatattcattt

SEQ ID NO: 1944195 - DNA, 21 bp, Homo sapiens
acatccaacatttcctcaggc

SEQ ID NO: 1944196 - DNA, 16 bp, Homo sapiens
acatccaagcttcctt

SEQ ID NO: 1944197 - DNA, 14 bp, Homo sapiens
acatctaacaaagt

SEQ ID NO: 1944198 - DNA, 15 bp, Homo sapiens
acatctgtgtcttgt

SEQ ID NO: 1944199 - DNA, 14 bp, Homo sapiens
acatcttagtattt

SEQ ID NO: 1944200 - DNA, 17 bp, Homo sapiens
acatgaagattctttcc

SEQ ID NO: 1944201 - DNA, 18 bp, Homo sapiens
acatgaattgcattttac

SEQ ID NO: 1944202 - DNA, 19 bp, Homo sapiens
acatgcggcttccgagggc

SEQ ID NO: 1944203 - DNA, 16 bp, Homo sapiens
acatgcgggctgggca

SEQ ID NO: 1944204 - DNA, 15 bp, Homo sapiens
acatggccgctgccc

SEQ ID NO: 1944205 - DNA, 16 bp, Homo sapiens
acatggccgctgccca

SEQ ID NO: 1944206 - DNA, 23 bp, Homo sapiens
acatggtagcagggtctttgtgt

SEQ ID NO: 1944207 - DNA, 19 bp, Homo sapiens
acatggtgggtccatgggc

SEQ ID NO: 1944208 - DNA, 19 bp, Homo sapiens
acatgtcagtaccttcaaa

SEQ ID NO: 1944209 - DNA, 18 bp, Homo sapiens
acattagcagtttgcttt

SEQ ID NO: 1944210 - DNA, 18 bp, Homo sapiens
acattctacttcagcttt

SEQ ID NO: 1944211 - DNA, 20 bp, Homo sapiens
acattctgacatcttagtat

SEQ ID NO: 1944212 - DNA, 19 bp, Homo sapiens
aagccagggttccagacag

SEQ ID NO: 1944213 - DNA, 15 bp, Homo sapiens
aagcccaggaggacc

SEQ ID NO: 1944214 - DNA, 21 bp, Homo sapiens
aagctcctgaatccctttcag

SEQ ID NO: 1944215 - DNA, 22 bp, Homo sapiens
aagctcctgaatccctttcagt

SEQ ID NO: 1944216 - DNA, 21 bp, Homo sapiens
aagcttggctgtagaaggaga

SEQ ID NO: 1944217 - DNA, 23 bp, Homo sapiens
aagctttcatgtaaactgtgcac

SEQ ID NO: 1944218 - DNA, 19 bp, Homo sapiens
aaggaaacacgtttagaaa

SEQ ID NO: 1944219 - DNA, 22 bp, Homo sapiens
aaggacccggaggggcctggca

SEQ ID NO: 1944220 - DNA, 23 bp, Homo sapiens
aaggacttgtgcctcttgggaga

SEQ ID NO: 1944221 - DNA, 11 bp, Homo sapiens
aaggagaggag

SEQ ID NO: 1944222 - DNA, 20 bp, Homo sapiens
aaggcaaagcacgaaatgtt

SEQ ID NO: 1944223 - DNA, 13 bp, Homo sapiens
aaggcaaatctcc

SEQ ID NO: 1944224 - DNA, 20 bp, Homo sapiens
aaggcaaatctcctttgtcc

SEQ ID NO: 1944225 - DNA, 15 bp, Homo sapiens
aaggcaagaagtggg

SEQ ID NO: 1944226 - DNA, 16 bp, Homo sapiens
aaggcaagaagtggga

SEQ ID NO: 1944227 - DNA, 14 bp, Homo sapiens
aaggccccagggca

SEQ ID NO: 1944228 - DNA, 16 bp, Homo sapiens
aaggcccggagatgca

SEQ ID NO: 1944229 - DNA, 17 bp, Homo sapiens
aaggcttctctctgtgg

SEQ ID NO: 1944230 - DNA, 15 bp, Homo sapiens
aagggggatgcaggc

SEQ ID NO: 1944231 - DNA, 22 bp, Homo sapiens
aagggggctattccctggagac

SEQ ID NO: 1944232 - DNA, 23 bp, Homo sapiens
aagggggctattccctggagacc

SEQ ID NO: 1944233 - DNA, 14 bp, Homo sapiens
aagggtgtggcttg

SEQ ID NO: 1944234 - DNA, 16 bp, Homo sapiens
aaggtgtttctctgta

SEQ ID NO: 1944235 - DNA, 18 bp, Homo sapiens
aaggttggaactgctgcc

SEQ ID NO: 1944236 - DNA, 21 bp, Homo sapiens
aaggttggaactgctgccatg

SEQ ID NO: 1944237 - DNA, 23 bp, Homo sapiens
aaggttggaactgctgccatgat

SEQ ID NO: 1944238 - DNA, 19 bp, Homo sapiens
aagtagacttcatttttcc

SEQ ID NO: 1944239 - DNA, 15 bp, Homo sapiens
aagtatctgtacctg

SEQ ID NO: 1944240 - DNA, 22 bp, Homo sapiens
aagtatttcaaattggagcttc

SEQ ID NO: 1944241 - DNA, 22 bp, Homo sapiens
aagtattttcataagtatttca

SEQ ID NO: 1944242 - DNA, 20 bp, Homo sapiens
aagtcaaagcaaggaaacta

SEQ ID NO: 1944243 - DNA, 12 bp, Homo sapiens
aagtcactgcac

SEQ ID NO: 1944244 - DNA, 22 bp, Homo sapiens
aagtcactgcacagtgcatctc

SEQ ID NO: 1944245 - DNA, 19 bp, Homo sapiens
aagtcccaccagggaccag

SEQ ID NO: 1944246 - DNA, 15 bp, Homo sapiens
aagtctctttttctt

SEQ ID NO: 1944247 - DNA, 11 bp, Homo sapiens
aagtcttcttt

SEQ ID NO: 1944248 - DNA, 21 bp, Homo sapiens
aagtcttctttcatgtaagta

SEQ ID NO: 1944249 - DNA, 22 bp, Homo sapiens
aagtgatttgggggtgcaatga

SEQ ID NO: 1944250 - DNA, 14 bp, Homo sapiens
aagtgcctataaag

SEQ ID NO: 1944251 - DNA, 16 bp, Homo sapiens
aagtgcctataaagga

SEQ ID NO: 1944252 - DNA, 17 bp, Homo sapiens
aagtggaaaaagaaatt

SEQ ID NO: 1944253 - DNA, 15 bp, Homo sapiens
aagtggctgtgatta

SEQ ID NO: 1944254 - DNA, 16 bp, Homo sapiens
aagtgggagtgggaga

SEQ ID NO: 1944255 - DNA, 18 bp, Homo sapiens
aagtgggagtgggagagg

SEQ ID NO: 1944256 - DNA, 21 bp, Homo sapiens
aagtgggagtgggagaggaag

SEQ ID NO: 1944257 - DNA, 23 bp, Homo sapiens
aagtgggagtgggagaggaagcc

SEQ ID NO: 1944258 - DNA, 18 bp, Homo sapiens
aagttgatggtgatgaaa

SEQ ID NO: 1944259 - DNA, 15 bp, Homo sapiens
aagtttttacagtgt

SEQ ID NO: 1944260 - DNA, 11 bp, Homo sapiens
aataaaaccaa

SEQ ID NO: 1944261 - DNA, 23 bp, Homo sapiens
aataaaacgttatctcattgcaa

SEQ ID NO: 1944262 - DNA, 23 bp, Homo sapiens
aataaaattaaagctgaaaactg

SEQ ID NO: 1944263 - DNA, 13 bp, Homo sapiens
aataaataatatt

SEQ ID NO: 1944264 - DNA, 23 bp, Homo sapiens
aataagtcattttaataactaaa

SEQ ID NO: 1944265 - DNA, 23 bp, Homo sapiens
aataatgacgtattgtgaaattt

SEQ ID NO: 1944266 - DNA, 16 bp, Homo sapiens
aataattgtggagagg

SEQ ID NO: 1944267 - DNA, 17 bp, Homo sapiens
aataattgtggagagga

SEQ ID NO: 1944268 - DNA, 20 bp, Homo sapiens
aataattgtggagaggagag

SEQ ID NO: 1944269 - DNA, 21 bp, Homo sapiens
aataattttttagttaaaatc

SEQ ID NO: 1944270 - DNA, 16 bp, Homo sapiens
aatacacgaggtatga

SEQ ID NO: 1944271 - DNA, 17 bp, Homo sapiens
aatacatgacatttatt

SEQ ID NO: 1944272 - DNA, 12 bp, Homo sapiens
aatacccttggc

SEQ ID NO: 1944273 - DNA, 16 bp, Homo sapiens
aatactaaatatgaaa

SEQ ID NO: 1944274 - DNA, 16 bp, Homo sapiens
aatactgtattttgta

SEQ ID NO: 1944275 - DNA, 18 bp, Homo sapiens
aatacttaaaaatatgtg

SEQ ID NO: 1944276 - DNA, 23 bp, Homo sapiens
aatacttaaaaatatgtgagcat

SEQ ID NO: 1944277 - DNA, 16 bp, Homo sapiens
aatagagcctgaggga

SEQ ID NO: 1944278 - DNA, 20 bp, Homo sapiens
aatagataagagtagaaact

SEQ ID NO: 1944279 - DNA, 23 bp, Homo sapiens
aatagttccagataaaaacaata

SEQ ID NO: 1944280 - DNA, 13 bp, Homo sapiens
aatataactgcct

SEQ ID NO: 1944281 - DNA, 17 bp, Homo sapiens
aatatactatatttatg

SEQ ID NO: 1944282 - DNA, 12 bp, Homo sapiens
aatatatataat

SEQ ID NO: 1944283 - DNA, 14 bp, Homo sapiens
aatatatataatac

SEQ ID NO: 1944284 - DNA, 16 bp, Homo sapiens
aatatatgtaaattat

SEQ ID NO: 1944285 - DNA, 20 bp, Homo sapiens
aatatatttaactatttaga

SEQ ID NO: 1944286 - DNA, 14 bp, Homo sapiens
aatatcccagagaa

SEQ ID NO: 1944287 - DNA, 19 bp, Homo sapiens
aatatcccagagaacaatc

SEQ ID NO: 1944288 - DNA, 22 bp, Homo sapiens
aatatctatttatctgtctgag

SEQ ID NO: 1944289 - DNA, 13 bp, Homo sapiens
aatatcttaggtt

SEQ ID NO: 1944290 - DNA, 11 bp, Homo sapiens
aatatgaaatt

SEQ ID NO: 1944291 - DNA, 19 bp, Homo sapiens
aatatgaacggtgagcatt

SEQ ID NO: 1944292 - DNA, 22 bp, Homo sapiens
aatatgattagtaaagaaatga

SEQ ID NO: 1944293 - DNA, 12 bp, Homo sapiens
aatatgcacttt

SEQ ID NO: 1944294 - DNA, 22 bp, Homo sapiens
aatatgttgatgaaaaatagca

SEQ ID NO: 1944295 - DNA, 17 bp, Homo sapiens
aatattccctagaaact

SEQ ID NO: 1944296 - DNA, 14 bp, Homo sapiens
gtctttgtgtgctg

SEQ ID NO: 1944297 - DNA, 24 bp, Homo sapiens
gtcttttaatgatactgtctaaga

SEQ ID NO: 1944298 - DNA, 15 bp, Homo sapiens
gtgaaaatggtccag

SEQ ID NO: 1944299 - DNA, 13 bp, Homo sapiens
gtgaaatttgtta

SEQ ID NO: 1944300 - DNA, 13 bp, Homo sapiens
gtgaacataactg

SEQ ID NO: 1944301 - DNA, 23 bp, Homo sapiens
gtgaacattattaaatcagaatc

SEQ ID NO: 1944302 - DNA, 13 bp, Homo sapiens
gtgaatacatggt

SEQ ID NO: 1944303 - DNA, 19 bp, Homo sapiens
gtgacaaatgttgaccttt

SEQ ID NO: 1944304 - DNA, 13 bp, Homo sapiens
gtgacaggcagtg

SEQ ID NO: 1944305 - DNA, 17 bp, Homo sapiens
gtgaccaggcatcctcc

SEQ ID NO: 1944306 - DNA, 14 bp, Homo sapiens
gtgacccatgcgat

SEQ ID NO: 1944307 - DNA, 21 bp, Homo sapiens
gtgaccgggggaagctgagcc

SEQ ID NO: 1944308 - DNA, 16 bp, Homo sapiens
gtgactaccacttatt

SEQ ID NO: 1944309 - DNA, 13 bp, Homo sapiens
gtgactctggctg

SEQ ID NO: 1944310 - DNA, 17 bp, Homo sapiens
gtgactctggctgccaa

SEQ ID NO: 1944311 - DNA, 20 bp, Homo sapiens
gtgagacccagccctcatcc

SEQ ID NO: 1944312 - DNA, 17 bp, Homo sapiens
gtgagatcagtcagctc

SEQ ID NO: 1944313 - DNA, 15 bp, Homo sapiens
gtgaggaggaggcag

SEQ ID NO: 1944314 - DNA, 21 bp, Homo sapiens
gtgaggatggcctctgctaag

SEQ ID NO: 1944315 - DNA, 17 bp, Homo sapiens
gtgaggatgggaaggag

SEQ ID NO: 1944316 - DNA, 15 bp, Homo sapiens
gtgaggccagggcag

SEQ ID NO: 1944317 - DNA, 21 bp, Homo sapiens
gtgaggcgtgggatccagaga

SEQ ID NO: 1944318 - DNA, 19 bp, Homo sapiens
gtgagggcaaaccaggctg

SEQ ID NO: 1944319 - DNA, 22 bp, Homo sapiens
gtgaggtgggggtctggcctag

SEQ ID NO: 1944320 - DNA, 15 bp, Homo sapiens
gtgagttggggcgac

SEQ ID NO: 1944321 - DNA, 14 bp, Homo sapiens
gtgatgggagtaag

SEQ ID NO: 1944322 - DNA, 18 bp, Homo sapiens
gtgattgccatttcttcc

SEQ ID NO: 1944323 - DNA, 12 bp, Homo sapiens
gtgatttgctat

SEQ ID NO: 1944324 - DNA, 13 bp, Homo sapiens
gtgcaatggaata

SEQ ID NO: 1944325 - DNA, 18 bp, Homo sapiens
gtgcacatctgtgtcttg

SEQ ID NO: 1944326 - DNA, 17 bp, Homo sapiens
gtgcagaaactaccaga

SEQ ID NO: 1944327 - DNA, 13 bp, Homo sapiens
gtgcatctcagcc

SEQ ID NO: 1944328 - DNA, 18 bp, Homo sapiens
gtgcatctcagcccacat

SEQ ID NO: 1944329 - DNA, 18 bp, Homo sapiens
gtgcatttgtgtctgcct

SEQ ID NO: 1944330 - DNA, 16 bp, Homo sapiens
gtgccaaccacctctg

SEQ ID NO: 1944331 - DNA, 17 bp, Homo sapiens
gtgccaaccacctctgg

SEQ ID NO: 1944332 - DNA, 17 bp, Homo sapiens
gtgccacatggccgctg

SEQ ID NO: 1944333 - DNA, 21 bp, Homo sapiens
gtgccacatggccgctgccca

SEQ ID NO: 1944334 - DNA, 23 bp, Homo sapiens
gtgccaccctctgcagggcagcc

SEQ ID NO: 1944335 - DNA, 17 bp, Homo sapiens
gtgccaggactctcttt

SEQ ID NO: 1944336 - DNA, 15 bp, Homo sapiens
gtgccatccctgaga

SEQ ID NO: 1944337 - DNA, 15 bp, Homo sapiens
gtgccatggccagga

SEQ ID NO: 1944338 - DNA, 20 bp, Homo sapiens
gtgcccaagaatagatgctg

SEQ ID NO: 1944339 - DNA, 23 bp, Homo sapiens
gtgcccaagaatagatgctgact

SEQ ID NO: 1944340 - DNA, 14 bp, Homo sapiens
gtgcccagtcttga

SEQ ID NO: 1944341 - DNA, 20 bp, Homo sapiens
gtgcccagtcttgagtgggc

SEQ ID NO: 1944342 - DNA, 12 bp, Homo sapiens
gtgcccccagac

SEQ ID NO: 1944343 - DNA, 14 bp, Homo sapiens
gtgcctcagtgaga

SEQ ID NO: 1944344 - DNA, 21 bp, Homo sapiens
gtgctacacccttttccagct

SEQ ID NO: 1944345 - DNA, 14 bp, Homo sapiens
gtgctctggctgga

SEQ ID NO: 1944346 - DNA, 12 bp, Homo sapiens
gtgctgccacac

SEQ ID NO: 1944347 - DNA, 12 bp, Homo sapiens
gtgctgcctcta

SEQ ID NO: 1944348 - DNA, 23 bp, Homo sapiens
gtgctgtcatgcccagcttggag

SEQ ID NO: 1944349 - DNA, 14 bp, Homo sapiens
gtgcttcgggccct

SEQ ID NO: 1944350 - DNA, 17 bp, Homo sapiens
gtgcttcgggcccttcc

SEQ ID NO: 1944351 - DNA, 20 bp, Homo sapiens
gtggaaaaagaaattctgtt

SEQ ID NO: 1944352 - DNA, 21 bp, Homo sapiens
gtggaaaaagaaattctgtta

SEQ ID NO: 1944353 - DNA, 11 bp, Homo sapiens
gtggagaggag

SEQ ID NO: 1944354 - DNA, 13 bp, Homo sapiens
gtggagccacagg

SEQ ID NO: 1944355 - DNA, 23 bp, Homo sapiens
gtggcacttcgtggatgacctcc

SEQ ID NO: 1944356 - DNA, 22 bp, Homo sapiens
gtggcagcaacaaaggatttga

SEQ ID NO: 1944357 - DNA, 15 bp, Homo sapiens
gtggcagcgcccagc

SEQ ID NO: 1944358 - DNA, 19 bp, Homo sapiens
gtggcagcgcccagcctgg

SEQ ID NO: 1944359 - DNA, 20 bp, Homo sapiens
gtggccaagggctccagggc

SEQ ID NO: 1944360 - DNA, 16 bp, Homo sapiens
gtggcccgacagcctg

SEQ ID NO: 1944361 - DNA, 16 bp, Homo sapiens
gtggccctgcaagggc

SEQ ID NO: 1944362 - DNA, 21 bp, Homo sapiens
gtggccgggggtgggggcctg

SEQ ID NO: 1944363 - DNA, 20 bp, Homo sapiens
gtggctcctcccggtgccca

SEQ ID NO: 1944364 - DNA, 14 bp, Homo sapiens
gtggctgtcagcag

SEQ ID NO: 1944365 - DNA, 19 bp, Homo sapiens
gtggctgtcagcaggaagc

SEQ ID NO: 1944366 - DNA, 17 bp, Homo sapiens
gtggcttcggcctgctt

SEQ ID NO: 1944367 - DNA, 12 bp, Homo sapiens
gtgggagaggaa

SEQ ID NO: 1944368 - DNA, 13 bp, Homo sapiens
gtgggagaggtct

SEQ ID NO: 1944369 - DNA, 15 bp, Homo sapiens
gtgggagtgggagag

SEQ ID NO: 1944370 - DNA, 16 bp, Homo sapiens
gtgggagtgggagagg

SEQ ID NO: 1944371 - DNA, 17 bp, Homo sapiens
gtgggagtgggagagga

SEQ ID NO: 1944372 - DNA, 18 bp, Homo sapiens
gtgggatccagagagaag

SEQ ID NO: 1944373 - DNA, 20 bp, Homo sapiens
gtgggatccagagagaagca

SEQ ID NO: 1944374 - DNA, 21 bp, Homo sapiens
gtgggatcttacccacttccc

SEQ ID NO: 1944375 - DNA, 16 bp, Homo sapiens
gtgggcggcagagagg

SEQ ID NO: 1944376 - DNA, 17 bp, Homo sapiens
gtggggagactgggctg

SEQ ID NO: 1944377 - DNA, 19 bp, Homo sapiens
gtggggcagcacagagagg

SEQ ID NO: 1944378 - DNA, 13 bp, Homo sapiens
gtggggcgggagg

SEQ ID NO: 1944379 - DNA, 14 bp, Homo sapiens
gtggggctgcatcc

SEQ ID NO: 1944380 - DNA, 20 bp, Homo sapiens
gtggggcttagaatggggct

SEQ ID NO: 1944381 - DNA, 14 bp, Homo sapiens
gtgggggagaatgg

SEQ ID NO: 1944382 - DNA, 19 bp, Homo sapiens
gtgggggagaatggctctg

SEQ ID NO: 1944383 - DNA, 13 bp, Homo sapiens
gtgggggcctgct

SEQ ID NO: 1944384 - DNA, 15 bp, Homo sapiens
gtgggggtctgggag

SEQ ID NO: 1944385 - DNA, 19 bp, Homo sapiens
gtgggggtctgggaggcag

SEQ ID NO: 1944386 - DNA, 13 bp, Homo sapiens
gtgggtcagtgtg

SEQ ID NO: 1944387 - DNA, 18 bp, Homo sapiens
gtgggtccatgggcagag

SEQ ID NO: 1944388 - DNA, 20 bp, Homo sapiens
gtgggtccatgggcagagcc

SEQ ID NO: 1944389 - DNA, 17 bp, Homo sapiens
gtgggtttccctgcgtc

SEQ ID NO: 1944390 - DNA, 21 bp, Homo sapiens
gtggttaccgagtatctgtaa

SEQ ID NO: 1944391 - DNA, 16 bp, Homo sapiens
gtggtttcagaaaggg

SEQ ID NO: 1944392 - DNA, 23 bp, Homo sapiens
gtgtcacagaggcagtggcagca

SEQ ID NO: 1944393 - DNA, 18 bp, Homo sapiens
gtgtccacgactgtctcc

SEQ ID NO: 1944394 - DNA, 13 bp, Homo sapiens
ttccaccaaattc

SEQ ID NO: 1944395 - DNA, 24 bp, Homo sapiens
ttccacggagccactcctctgact

SEQ ID NO: 1944396 - DNA, 15 bp, Homo sapiens
ttccactgagggcag

SEQ ID NO: 1944397 - DNA, 21 bp, Homo sapiens
ttccacttagaaattgcattt

SEQ ID NO: 1944398 - DNA, 17 bp, Homo sapiens
ttccagagagtggctcc

SEQ ID NO: 1944399 - DNA, 19 bp, Homo sapiens
ttccagagagtggctcctc

SEQ ID NO: 1944400 - DNA, 20 bp, Homo sapiens
ttccagatgccttctccaga

SEQ ID NO: 1944401 - DNA, 19 bp, Homo sapiens
ttccagcagtgaaacttgt

SEQ ID NO: 1944402 - DNA, 18 bp, Homo sapiens
ttccagctggatgagaat

SEQ ID NO: 1944403 - DNA, 19 bp, Homo sapiens
ttccatcagcagtgattga

SEQ ID NO: 1944404 - DNA, 19 bp, Homo sapiens
ttccatcctgtacaagtgc

SEQ ID NO: 1944405 - DNA, 21 bp, Homo sapiens
ttccatcctgtacaagtgctc

SEQ ID NO: 1944406 - DNA, 24 bp, Homo sapiens
ttccatcctgtacaagtgctcagt

SEQ ID NO: 1944407 - DNA, 21 bp, Homo sapiens
ttccatggtgtgatcgtctga

SEQ ID NO: 1944408 - DNA, 17 bp, Homo sapiens
ttccatttgcaagggaa

SEQ ID NO: 1944409 - DNA, 14 bp, Homo sapiens
ttcccaattcacat

SEQ ID NO: 1944410 - DNA, 18 bp, Homo sapiens
ttcccacaggacatttct

SEQ ID NO: 1944411 - DNA, 12 bp, Homo sapiens
ttcccaccccta

SEQ ID NO: 1944412 - DNA, 12 bp, Homo sapiens
ttccccactccc

SEQ ID NO: 1944413 - DNA, 16 bp, Homo sapiens
ttccccactcccgtga

SEQ ID NO: 1944414 - DNA, 19 bp, Homo sapiens
ttccccctccaatcccacc

SEQ ID NO: 1944415 - DNA, 10 bp, Homo sapiens
ttcccccttc

SEQ ID NO: 1944416 - DNA, 17 bp, Homo sapiens
ttgttattttattgcct

SEQ ID NO: 1944417 - DNA, 22 bp, Homo sapiens
ttgttcaaagaacccccctccc

SEQ ID NO: 1944418 - DNA, 19 bp, Homo sapiens
ttgtttttcattcagtctt

SEQ ID NO: 1944419 - DNA, 18 bp, Homo sapiens
ttgttttttttttccact

SEQ ID NO: 1944420 - DNA, 15 bp, Homo sapiens
tttaaaataaaagta

SEQ ID NO: 1944421 - DNA, 16 bp, Homo sapiens
tttaaagtagattaga

SEQ ID NO: 1944422 - DNA, 22 bp, Homo sapiens
tttaaagtcttctttcatgtaa

SEQ ID NO: 1944423 - DNA, 23 bp, Homo sapiens
tttaacaactatgatttggaaaa

SEQ ID NO: 1944424 - DNA, 22 bp, Homo sapiens
tttaacctcaggttccaaattc

SEQ ID NO: 1944425 - DNA, 14 bp, Homo sapiens
tttaactatttaga

SEQ ID NO: 1944426 - DNA, 15 bp, Homo sapiens
tttaagataattata

SEQ ID NO: 1944427 - DNA, 12 bp, Homo sapiens
tttacagtatat

SEQ ID NO: 1944428 - DNA, 22 bp, Homo sapiens
tttaccattttgcgatgtgttt

SEQ ID NO: 1944429 - DNA, 17 bp, Homo sapiens
tttacctggaaaccaga

SEQ ID NO: 1944430 - DNA, 18 bp, Homo sapiens
tttactatcttttcatct

SEQ ID NO: 1944431 - DNA, 18 bp, Homo sapiens
tttacttggtgaggagga

SEQ ID NO: 1944432 - DNA, 13 bp, Homo sapiens
tttacttttcaca

SEQ ID NO: 1944433 - DNA, 13 bp, Homo sapiens
tttagaaagaaat

SEQ ID NO: 1944434 - DNA, 22 bp, Homo sapiens
tttagaaagaaattgtttttct

SEQ ID NO: 1944435 - DNA, 19 bp, Homo sapiens
tttagagatattttccatt

SEQ ID NO: 1944436 - DNA, 22 bp, Homo sapiens
tttatattacttttgtaaatat

SEQ ID NO: 1944437 - DNA, 12 bp, Homo sapiens
tttatcattttc

SEQ ID NO: 1944438 - DNA, 22 bp, Homo sapiens
tttattaacatatattgttatt

SEQ ID NO: 1944439 - DNA, 20 bp, Homo sapiens
tttattagcattttcaagaa

SEQ ID NO: 1944440 - DNA, 15 bp, Homo sapiens
tttcaacgcagccct

SEQ ID NO: 1944441 - DNA, 16 bp, Homo sapiens
tttcaacgcagccctg

SEQ ID NO: 1944442 - DNA, 20 bp, Homo sapiens
tttcaacgcagccctgcttt

SEQ ID NO: 1944443 - DNA, 21 bp, Homo sapiens
tttcaacgcagccctgctttg

SEQ ID NO: 1944444 - DNA, 18 bp, Homo sapiens
tttcaccatctttctaat

SEQ ID NO: 1944445 - DNA, 17 bp, Homo sapiens
tttcactgctggctgcc

SEQ ID NO: 1944446 - DNA, 20 bp, Homo sapiens
tttcactgctggctgcctta

SEQ ID NO: 1944447 - DNA, 20 bp, Homo sapiens
tttcagaaagggcagcccct

SEQ ID NO: 1944448 - DNA, 17 bp, Homo sapiens
tttcagccattcacaac

SEQ ID NO: 1944449 - DNA, 19 bp, Homo sapiens
tttcataagtatttcaaat

SEQ ID NO: 1944450 - DNA, 20 bp, Homo sapiens
tttcatctcattaattcaat

SEQ ID NO: 1944451 - DNA, 15 bp, Homo sapiens
tttcatctttccaaa

SEQ ID NO: 1944452 - DNA, 19 bp, Homo sapiens
tttcatgatttgcaacttt

SEQ ID NO: 1944453 - DNA, 11 bp, Homo sapiens
tttccaagcct

SEQ ID NO: 1944454 - DNA, 17 bp, Homo sapiens
tttccctagaaagccat

SEQ ID NO: 1944455 - DNA, 14 bp, Homo sapiens
tttccctgcatccc

SEQ ID NO: 1944456 - DNA, 18 bp, Homo sapiens
tttcctaacaggattaga

SEQ ID NO: 1944457 - DNA, 16 bp, Homo sapiens
tttcctctaattaaaa

SEQ ID NO: 1944458 - DNA, 22 bp, Homo sapiens
tttctactttgaagtcatacca

SEQ ID NO: 1944459 - DNA, 22 bp, Homo sapiens
tttctagacagtattgccacct

SEQ ID NO: 1944460 - DNA, 14 bp, Homo sapiens
tttctatgtaaatt

SEQ ID NO: 1944461 - DNA, 13 bp, Homo sapiens
tttctcaaagttt

SEQ ID NO: 1944462 - DNA, 20 bp, Homo sapiens
tttctcaaagtttttacagt

SEQ ID NO: 1944463 - DNA, 19 bp, Homo sapiens
tttctcccgaatcctgagg

SEQ ID NO: 1944464 - DNA, 14 bp, Homo sapiens
tttctcctccatgg

SEQ ID NO: 1944465 - DNA, 13 bp, Homo sapiens
tttctctgtaaaa

SEQ ID NO: 1944466 - DNA, 16 bp, Homo sapiens
tttctctgtaaaatga

SEQ ID NO: 1944467 - DNA, 16 bp, Homo sapiens
tttcttctctctttgt

SEQ ID NO: 1944468 - DNA, 17 bp, Homo sapiens
tttcttgagatctgctg

SEQ ID NO: 1944469 - DNA, 22 bp, Homo sapiens
tttcttgagatctgctgacaga

SEQ ID NO: 1944470 - DNA, 13 bp, Homo sapiens
tttctttatttct

SEQ ID NO: 1944471 - DNA, 17 bp, Homo sapiens
tttgaaaatatttctat

SEQ ID NO: 1944472 - DNA, 16 bp, Homo sapiens
tttgaaatatgcatgt

SEQ ID NO: 1944473 - DNA, 23 bp, Homo sapiens
tttgaataacaaggaaaacagta

SEQ ID NO: 1944474 - DNA, 21 bp, Homo sapiens
tttgaggctggcggggtctgc

SEQ ID NO: 1944475 - DNA, 21 bp, Homo sapiens
tttgatgtgtatgtgtttata

SEQ ID NO: 1944476 - DNA, 15 bp, Homo sapiens
tttgcaactggtata

SEQ ID NO: 1944477 - DNA, 19 bp, Homo sapiens
tttgcagcttccttccaag

SEQ ID NO: 1944478 - DNA, 22 bp, Homo sapiens
tttgcataacaattcctctact

SEQ ID NO: 1944479 - DNA, 23 bp, Homo sapiens
tttgcatagtaccaatcatttta

SEQ ID NO: 1944480 - DNA, 16 bp, Homo sapiens
tttgccagtgggaact

SEQ ID NO: 1944481 - DNA, 12 bp, Homo sapiens
tttgccctttga

SEQ ID NO: 1944482 - DNA, 17 bp, Homo sapiens
tttgcgatgtgttttat

SEQ ID NO: 1944483 - DNA, 19 bp, Homo sapiens
tttgctgagcatgtactga

SEQ ID NO: 1944484 - DNA, 17 bp, Homo sapiens
tttggcaatgccatcat

SEQ ID NO: 1944485 - DNA, 15 bp, Homo sapiens
tttgtaactttgcat

SEQ ID NO: 1944486 - DNA, 20 bp, Homo sapiens
tttgtaaggacttgtgcctc

SEQ ID NO: 1944487 - DNA, 18 bp, Homo sapiens
tttgtaaggtactgaata

SEQ ID NO: 1944488 - DNA, 20 bp, Homo sapiens
tttgtataacccatatctgt

SEQ ID NO: 1944489 - DNA, 21 bp, Homo sapiens
tttgtattgtttcaattgcat

SEQ ID NO: 1944490 - DNA, 14 bp, Homo sapiens
tttgtcactcggct

SEQ ID NO: 1944491 - DNA, 14 bp, Homo sapiens
tttgtgcagtgatt

SEQ ID NO: 1944492 - DNA, 20 bp, Homo sapiens
tttgtgtctgcctgcctcat

SEQ ID NO: 1944493 - DNA, 12 bp, Homo sapiens
tttgtgtttcag

SEQ ID NO: 1944494 - DNA, 21 bp, Homo sapiens
ttttaacctcaggttccaaat

SEQ ID NO: 1944495 - DNA, 23 bp, Homo sapiens
ttttaagcccatcaattatagaa

SEQ ID NO: 1944496 - DNA, 22 bp, Homo sapiens
ttttaatgatactgtctaagaa

SEQ ID NO: 1944497 - DNA, 23 bp, Homo sapiens
ttttaattttcctctaattaaaa

SEQ ID NO: 1944498 - DNA, 12 bp, Homo sapiens
ttttacagtgta

SEQ ID NO: 1944499 - DNA, 17 bp, Homo sapiens
ttttagaaaatgtttgg

SEQ ID NO: 1944500 - DNA, 16 bp, Homo sapiens
ttttatttttatccca

SEQ ID NO: 1944501 - DNA, 20 bp, Homo sapiens
ttttcactgctggctgcctt

SEQ ID NO: 1944502 - DNA, 18 bp, Homo sapiens
ttttcagccattcacaac

SEQ ID NO: 1944503 - DNA, 15 bp, Homo sapiens
ttttcatctcattaa

SEQ ID NO: 1944504 - DNA, 14 bp, Homo sapiens
ttttcatgtgtgat

SEQ ID NO: 1944505 - DNA, 15 bp, Homo sapiens
ttttcttccccctcc

SEQ ID NO: 1944506 - DNA, 17 bp, Homo sapiens
ttttgaaattaacctct

SEQ ID NO: 1944507 - DNA, 21 bp, Homo sapiens
ttttgcaacctcgctggactc

SEQ ID NO: 1944508 - DNA, 18 bp, Homo sapiens
ttttgcgatgtgttttat

SEQ ID NO: 1944509 - DNA, 21 bp, Homo sapiens
ttttgcgatgtgttttattca

SEQ ID NO: 1944510 - DNA, 13 bp, Homo sapiens
ttttgttgctgtt

SEQ ID NO: 1944511 - DNA, 14 bp, Homo sapiens
tttttatattactt

SEQ ID NO: 1944512 - DNA, 20 bp, Homo sapiens
tttttatattacttttgtaa

SEQ ID NO: 1944513 - DNA, 23 bp, Homo sapiens
tttttatctccccttcacatgca

SEQ ID NO: 1944514 - DNA, 13 bp, Homo sapiens
tttttcaatggtt

SEQ ID NO: 1944515 - DNA, 12 bp, Homo sapiens
ttttttaaaaat

SEQ ID NO: 1944516 - DNA, 19 bp, Homo sapiens
ggcagtcgatagagctgta

SEQ ID NO: 1944517 - DNA, 13 bp, Homo sapiens
ggcagtggagagg

SEQ ID NO: 1944518 - DNA, 13 bp, Homo sapiens
ggcatcaaagatg

SEQ ID NO: 1944519 - DNA, 15 bp, Homo sapiens
ggcatctctggagtg

SEQ ID NO: 1944520 - DNA, 22 bp, Homo sapiens
ggcatctctggagtgtgtgggg

SEQ ID NO: 1944521 - DNA, 13 bp, Homo sapiens
ggcatgagggctg

SEQ ID NO: 1944522 - DNA, 20 bp, Homo sapiens
ggcatgagggctgagatgcg

SEQ ID NO: 1944523 - DNA, 16 bp, Homo sapiens
ggcatgcgaatgagct

SEQ ID NO: 1944524 - DNA, 19 bp, Homo sapiens
ggcatgcgaatgagctggg

SEQ ID NO: 1944525 - DNA, 23 bp, Homo sapiens
ggcatgcgaatgagctgggccct

SEQ ID NO: 1944526 - DNA, 17 bp, Homo sapiens
ggcatggccaggtggcc

SEQ ID NO: 1944527 - DNA, 18 bp, Homo sapiens
ggcatggccaggtggcca

SEQ ID NO: 1944528 - DNA, 17 bp, Homo sapiens
ggcatggcccagcctgg

SEQ ID NO: 1944529 - DNA, 19 bp, Homo sapiens
ggcatggcccagcctggag

SEQ ID NO: 1944530 - DNA, 22 bp, Homo sapiens
ggcatggcccagcctggagccg

SEQ ID NO: 1944531 - DNA, 13 bp, Homo sapiens
aaaaacaatatat

SEQ ID NO: 1944532 - DNA, 12 bp, Homo sapiens
aaaaacagcaga

SEQ ID NO: 1944533 - DNA, 11 bp, Homo sapiens
aaaaatataaa

SEQ ID NO: 1944534 - DNA, 12 bp, Homo sapiens
aaaaattaaaat

SEQ ID NO: 1944535 - DNA, 19 bp, Homo sapiens
aaaaattaaaccaagcagc

SEQ ID NO: 1944536 - DNA, 14 bp, Homo sapiens
aaaaccttttgaaa

SEQ ID NO: 1944537 - DNA, 15 bp, Homo sapiens
aaaagtacaatttac

SEQ ID NO: 1944538 - DNA, 16 bp, Homo sapiens
aaaataaaagtaccta

SEQ ID NO: 1944539 - DNA, 19 bp, Homo sapiens
aaaataaaattaaagctga

SEQ ID NO: 1944540 - DNA, 13 bp, Homo sapiens
aaaataagtcatt

SEQ ID NO: 1944541 - DNA, 16 bp, Homo sapiens
aaaataagtcatttta

SEQ ID NO: 1944542 - DNA, 22 bp, Homo sapiens
aaaatagataagagtagaaact

SEQ ID NO: 1944543 - DNA, 20 bp, Homo sapiens
aaaatatatatgtatataaa

SEQ ID NO: 1944544 - DNA, 11 bp, Homo sapiens
aaaatatgcat

SEQ ID NO: 1944545 - DNA, 21 bp, Homo sapiens
aaaatatgtgagcatgaaact

SEQ ID NO: 1944546 - DNA, 21 bp, Homo sapiens
aaaatatttctatgtaaatta

SEQ ID NO: 1944547 - DNA, 18 bp, Homo sapiens
aaaatcagtgatgggagt

SEQ ID NO: 1944548 - DNA, 21 bp, Homo sapiens
aaaatgctgtattagtcacag

SEQ ID NO: 1944549 - DNA, 14 bp, Homo sapiens
aaaatgtatatgca

SEQ ID NO: 1944550 - DNA, 15 bp, Homo sapiens
aaaatgtttggaatt

SEQ ID NO: 1944551 - DNA, 21 bp, Homo sapiens
aaaatgtttggaatttaagaa

SEQ ID NO: 1944552 - DNA, 13 bp, Homo sapiens
aaaattacagaag

SEQ ID NO: 1944553 - DNA, 14 bp, Homo sapiens
aaaattacagaaga

SEQ ID NO: 1944554 - DNA, 19 bp, Homo sapiens
aaaattatttcagaaatgt

SEQ ID NO: 1944555 - DNA, 17 bp, Homo sapiens
aaaattcacttctatat

SEQ ID NO: 1944556 - DNA, 15 bp, Homo sapiens
aaaatttttttcttt

SEQ ID NO: 1944557 - DNA, 16 bp, Homo sapiens
aaacaacaatttctac

SEQ ID NO: 1944558 - DNA, 16 bp, Homo sapiens
aaacacctaagtgact

SEQ ID NO: 1944559 - DNA, 16 bp, Homo sapiens
aaacacgtttagaaat

SEQ ID NO: 1944560 - DNA, 13 bp, Homo sapiens
aaacactgtgcac

SEQ ID NO: 1944561 - DNA, 22 bp, Homo sapiens
aaacatagagtagacctgagat

SEQ ID NO: 1944562 - DNA, 21 bp, Homo sapiens
aaacatgaccctaaatcttga

SEQ ID NO: 1944563 - DNA, 19 bp, Homo sapiens
aaaccagtgttagggaagg

SEQ ID NO: 1944564 - DNA, 13 bp, Homo sapiens
aaaccatgtagaa

SEQ ID NO: 1944565 - DNA, 17 bp, Homo sapiens
aaacggttaaaactgtc

SEQ ID NO: 1944566 - DNA, 12 bp, Homo sapiens
aaacgtgaaaat

SEQ ID NO: 1944567 - DNA, 19 bp, Homo sapiens
aaactactgtacatttttt

SEQ ID NO: 1944568 - DNA, 17 bp, Homo sapiens
aaactattttttaaaaa

SEQ ID NO: 1944569 - DNA, 18 bp, Homo sapiens
aaactgagtcctgttctt

SEQ ID NO: 1944570 - DNA, 16 bp, Homo sapiens
aaactggggcctccct

SEQ ID NO: 1944571 - DNA, 12 bp, Homo sapiens
aaactgtccctt

SEQ ID NO: 1944572 - DNA, 13 bp, Homo sapiens
aaagaaaatatgc

SEQ ID NO: 1944573 - DNA, 17 bp, Homo sapiens
aaagaaaatatgcatct

SEQ ID NO: 1944574 - DNA, 15 bp, Homo sapiens
aaagaaaggcagaga

SEQ ID NO: 1944575 - DNA, 15 bp, Homo sapiens
aaagaaattctgtta

SEQ ID NO: 1944576 - DNA, 15 bp, Homo sapiens
aaagaaccaggaggc

SEQ ID NO: 1944577 - DNA, 20 bp, Homo sapiens
aaagaacccccctccccaag

SEQ ID NO: 1944578 - DNA, 18 bp, Homo sapiens
aaagaagtggggacagag

SEQ ID NO: 1944579 - DNA, 17 bp, Homo sapiens
aaagaatagtttggttc

SEQ ID NO: 1944580 - DNA, 17 bp, Homo sapiens
aaagagtgtgctcggga

SEQ ID NO: 1944581 - DNA, 20 bp, Homo sapiens
aaagcatctattcccaaaga

SEQ ID NO: 1944582 - DNA, 21 bp, Homo sapiens
aaagccatattccagcagtga

SEQ ID NO: 1944583 - DNA, 12 bp, Homo sapiens
aaagctgaaaac

SEQ ID NO: 1944584 - DNA, 15 bp, Homo sapiens
aaagctgaaaactgc

SEQ ID NO: 1944585 - DNA, 19 bp, Homo sapiens
aaagcttgcaacaaaattc

SEQ ID NO: 1944586 - DNA, 23 bp, Homo sapiens
aaaggatttgaaacttggtgtgt

SEQ ID NO: 1944587 - DNA, 17 bp, Homo sapiens
aaagggagagagagagg

SEQ ID NO: 1944588 - DNA, 19 bp, Homo sapiens
aaagggcagcccctcccca

SEQ ID NO: 1944589 - DNA, 22 bp, Homo sapiens
aaagggcagcccctccccatgg

SEQ ID NO: 1944590 - DNA, 17 bp, Homo sapiens
aaagtacgtgtttactt

SEQ ID NO: 1944591 - DNA, 20 bp, Homo sapiens
aaagtggaaaacaaggaagt

SEQ ID NO: 1944592 - DNA, 16 bp, Homo sapiens
aaagtttttacagtgt

SEQ ID NO: 1944593 - DNA, 18 bp, Homo sapiens
aaataaaacgttatctca

SEQ ID NO: 1944594 - DNA, 18 bp, Homo sapiens
aaataacttgtgttacta

SEQ ID NO: 1944595 - DNA, 19 bp, Homo sapiens
aaataacttgtgttactaa

SEQ ID NO: 1944596 - DNA, 24 bp, Homo sapiens
aaataagaaacaactctttgagaa

SEQ ID NO: 1944597 - DNA, 22 bp, Homo sapiens
aaataagtcattttaataacta

SEQ ID NO: 1944598 - DNA, 13 bp, Homo sapiens
aaatacatgacat

SEQ ID NO: 1944599 - DNA, 23 bp, Homo sapiens
aaataccaaaattatttcagaaa

SEQ ID NO: 1944600 - DNA, 13 bp, Homo sapiens
aaatagtaaaaat

SEQ ID NO: 1944601 - DNA, 13 bp, Homo sapiens
aaatatgcacttt

SEQ ID NO: 1944602 - DNA, 18 bp, Homo sapiens
aaatattccctagaaact

SEQ ID NO: 1944603 - DNA, 19 bp, Homo sapiens
aaatattccctagaaactt

SEQ ID NO: 1944604 - DNA, 17 bp, Homo sapiens
aaatattcttgtccaca

SEQ ID NO: 1944605 - DNA, 20 bp, Homo sapiens
aaatattcttgtccacattc

SEQ ID NO: 1944606 - DNA, 22 bp, Homo sapiens
aaatattcttgtccacattcta

SEQ ID NO: 1944607 - DNA, 18 bp, Homo sapiens
aaatcacagattttttct

SEQ ID NO: 1944608 - DNA, 16 bp, Homo sapiens
aaatcagaatctttaa

SEQ ID NO: 1944609 - DNA, 17 bp, Homo sapiens
aaatcagaatctttaaa

SEQ ID NO: 1944610 - DNA, 22 bp, Homo sapiens
aaatcatgcttataagcaacat

SEQ ID NO: 1944611 - DNA, 16 bp, Homo sapiens
aaatcctttactgtta

SEQ ID NO: 1944612 - DNA, 22 bp, Homo sapiens
aaatcgcattaatgaaatacca

SEQ ID NO: 1944613 - DNA, 12 bp, Homo sapiens
aaatcttaagag

SEQ ID NO: 1944614 - DNA, 15 bp, Homo sapiens
aaatgaaaatgtctt

SEQ ID NO: 1944615 - DNA, 17 bp, Homo sapiens
aaatgaaaatgtcttgt

SEQ ID NO: 1944616 - DNA, 20 bp, Homo sapiens
aaatgagatgtatgcccaaa

SEQ ID NO: 1944617 - DNA, 17 bp, Homo sapiens
aaatgatttcaaaatga

SEQ ID NO: 1944618 - DNA, 15 bp, Homo sapiens
aaatggaacattaac

SEQ ID NO: 1944619 - DNA, 14 bp, Homo sapiens
aaatggaccacagt

SEQ ID NO: 1944620 - DNA, 22 bp, Homo sapiens
aaatggtcagtgtgcaaagaaa

SEQ ID NO: 1944621 - DNA, 18 bp, Homo sapiens
aaatggtgagaattaaaa

SEQ ID NO: 1944622 - DNA, 11 bp, Homo sapiens
aaatgtgcagt

SEQ ID NO: 1944623 - DNA, 13 bp, Homo sapiens
aaatgtttaatat

SEQ ID NO: 1944624 - DNA, 22 bp, Homo sapiens
aaatgtttaatatctgactgaa

SEQ ID NO: 1944625 - DNA, 15 bp, Homo sapiens
aaatgtttggaattt

SEQ ID NO: 1944626 - DNA, 13 bp, Homo sapiens
aaattacagaaga

SEQ ID NO: 1944627 - DNA, 14 bp, Homo sapiens
aaattagatgaact

SEQ ID NO: 1944628 - DNA, 22 bp, Homo sapiens
aaattataagtaacttgtcaag

SEQ ID NO: 1944629 - DNA, 20 bp, Homo sapiens
aaattattgtaaactttttc

SEQ ID NO: 1944630 - DNA, 19 bp, Homo sapiens
aaggcaaatctcctttgtc

SEQ ID NO: 1944631 - DNA, 18 bp, Homo sapiens
aaggcctgccccccttcc

SEQ ID NO: 1944632 - DNA, 19 bp, Homo sapiens
aaggcctgccccccttccc

SEQ ID NO: 1944633 - DNA, 18 bp, Homo sapiens
aaggcttctctctgtggg

SEQ ID NO: 1944634 - DNA, 23 bp, Homo sapiens
aaggcttctgggacttgaaatca

SEQ ID NO: 1944635 - DNA, 15 bp, Homo sapiens
aagggcagcccctcc

SEQ ID NO: 1944636 - DNA, 16 bp, Homo sapiens
aaggggatctaaaagg

SEQ ID NO: 1944637 - DNA, 18 bp, Homo sapiens
aaggtgcacctgccccag

SEQ ID NO: 1944638 - DNA, 23 bp, Homo sapiens
aaggttccgcttggagcagaggg

SEQ ID NO: 1944639 - DNA, 19 bp, Homo sapiens
aaggttggaactgctgcca

SEQ ID NO: 1944640 - DNA, 23 bp, Homo sapiens
aaggtttcagaaagaagtgggga

SEQ ID NO: 1944641 - DNA, 21 bp, Homo sapiens
aagtaacttgtcaaggaatgt

SEQ ID NO: 1944642 - DNA, 19 bp, Homo sapiens
aagtacctattgaacatgt

SEQ ID NO: 1944643 - DNA, 23 bp, Homo sapiens
aagtagacttcatttttcctaac

SEQ ID NO: 1944644 - DNA, 13 bp, Homo sapiens
aagtaggaagtaa

SEQ ID NO: 1944645 - DNA, 23 bp, Homo sapiens
aagtcaaagacattctgacatct

SEQ ID NO: 1944646 - DNA, 14 bp, Homo sapiens
aagtcactgcacag

SEQ ID NO: 1944647 - DNA, 11 bp, Homo sapiens
aagtcatgagc

SEQ ID NO: 1944648 - DNA, 21 bp, Homo sapiens
aagtcatgcgtttaatcacat

SEQ ID NO: 1944649 - DNA, 15 bp, Homo sapiens
aagtcattttaataa

SEQ ID NO: 1944650 - DNA, 16 bp, Homo sapiens
aagtcattttaataac

SEQ ID NO: 1944651 - DNA, 20 bp, Homo sapiens
aagtccatagctgagctgga

SEQ ID NO: 1944652 - DNA, 21 bp, Homo sapiens
aagtcccagggagctctgcat

SEQ ID NO: 1944653 - DNA, 20 bp, Homo sapiens
aagtcttccatcagcagtga

SEQ ID NO: 1944654 - DNA, 22 bp, Homo sapiens
aagtcttccatcagcagtgatt

SEQ ID NO: 1944655 - DNA, 11 bp, Homo sapiens
aagtcttcctg

SEQ ID NO: 1944656 - DNA, 20 bp, Homo sapiens
aagtgactaccacttatttc

SEQ ID NO: 1944657 - DNA, 19 bp, Homo sapiens
aagtgagaaattatgaaag

SEQ ID NO: 1944658 - DNA, 22 bp, Homo sapiens
aagtgcgtccacgagctgttta

SEQ ID NO: 1944659 - DNA, 16 bp, Homo sapiens
aagtggaaaaagaaat

SEQ ID NO: 1944660 - DNA, 21 bp, Homo sapiens
aagtggaaaaagaaattctgt

SEQ ID NO: 1944661 - DNA, 17 bp, Homo sapiens
aagtgggagtgggagag

SEQ ID NO: 1944662 - DNA, 20 bp, Homo sapiens
aagtgggagtgggagaggaa

SEQ ID NO: 1944663 - DNA, 15 bp, Homo sapiens
aagtggggacagagc

SEQ ID NO: 1944664 - DNA, 14 bp, Homo sapiens
aagtggggtgttga

SEQ ID NO: 1944665 - DNA, 15 bp, Homo sapiens
aagtgtggtgtcttt

SEQ ID NO: 1944666 - DNA, 16 bp, Homo sapiens
aagtgtggtgtctttt

SEQ ID NO: 1944667 - DNA, 11 bp, Homo sapiens
aagttaagaat

SEQ ID NO: 1944668 - DNA, 16 bp, Homo sapiens
aagttcatagtttctg

SEQ ID NO: 1944669 - DNA, 14 bp, Homo sapiens
accagcccagcctg

SEQ ID NO: 1944670 - DNA, 15 bp, Homo sapiens
accagcccagcctgc

SEQ ID NO: 1944671 - DNA, 16 bp, Homo sapiens
accagcccagcctgca

SEQ ID NO: 1944672 - DNA, 20 bp, Homo sapiens
accagcctccgtatttcaga

SEQ ID NO: 1944673 - DNA, 21 bp, Homo sapiens
accaggactccttgttctgct

SEQ ID NO: 1944674 - DNA, 16 bp, Homo sapiens
accaggaggcctggga

SEQ ID NO: 1944675 - DNA, 18 bp, Homo sapiens
accaggaggcctgggaga

SEQ ID NO: 1944676 - DNA, 19 bp, Homo sapiens
accaggcaacttgggaact

SEQ ID NO: 1944677 - DNA, 23 bp, Homo sapiens
accagggaccagcccagcctgca

SEQ ID NO: 1944678 - DNA, 13 bp, Homo sapiens
accagggctctgt

SEQ ID NO: 1944679 - DNA, 21 bp, Homo sapiens
accagtccacgccgggtcgcc

SEQ ID NO: 1944680 - DNA, 22 bp, Homo sapiens
accagtgttagggaagggcctg

SEQ ID NO: 1944681 - DNA, 19 bp, Homo sapiens
accagttctctttgtaagg

SEQ ID NO: 1944682 - DNA, 13 bp, Homo sapiens
accatctttctaa

SEQ ID NO: 1944683 - DNA, 17 bp, Homo sapiens
accatgaagatgccatt

SEQ ID NO: 1944684 - DNA, 11 bp, Homo sapiens
accatgtacat

SEQ ID NO: 1944685 - DNA, 18 bp, Homo sapiens
accattgaattcttggtt

SEQ ID NO: 1944686 - DNA, 18 bp, Homo sapiens
accattttgcgatgtgtt

SEQ ID NO: 1944687 - DNA, 18 bp, Homo sapiens
acccaaggtggtcttgga

SEQ ID NO: 1944688 - DNA, 19 bp, Homo sapiens
acccaaggtggtcttggag

SEQ ID NO: 1944689 - DNA, 20 bp, Homo sapiens
acccacaaaagtacaattta

SEQ ID NO: 1944690 - DNA, 21 bp, Homo sapiens
acccacagagtgccatccctg

SEQ ID NO: 1944691 - DNA, 22 bp, Homo sapiens
acccagaggaaggggccagagg

SEQ ID NO: 1944692 - DNA, 16 bp, Homo sapiens
acccagtccacaaaat

SEQ ID NO: 1944693 - DNA, 15 bp, Homo sapiens
acccagtgtctacct

SEQ ID NO: 1944694 - DNA, 13 bp, Homo sapiens
accccaccacaca

SEQ ID NO: 1944695 - DNA, 18 bp, Homo sapiens
acccccacctccctgcag

SEQ ID NO: 1944696 - DNA, 17 bp, Homo sapiens
accccgtccctttccct

SEQ ID NO: 1944697 - DNA, 18 bp, Homo sapiens
accccgtccctttccctg

SEQ ID NO: 1944698 - DNA, 23 bp, Homo sapiens
acccctcaagccaggagaccctg

SEQ ID NO: 1944699 - DNA, 13 bp, Homo sapiens
acccctcttcccc

SEQ ID NO: 1944700 - DNA, 19 bp, Homo sapiens
acccctgaactggccccag

SEQ ID NO: 1944701 - DNA, 17 bp, Homo sapiens
acccctggcttttcact

SEQ ID NO: 1944702 - DNA, 18 bp, Homo sapiens
acccctgtcctggggctg

SEQ ID NO: 1944703 - DNA, 17 bp, Homo sapiens
acccctttggcacaccc

SEQ ID NO: 1944704 - DNA, 15 bp, Homo sapiens
acccggaggggcctg

SEQ ID NO: 1944705 - DNA, 21 bp, Homo sapiens
acccggaggggcctggcagcc

SEQ ID NO: 1944706 - DNA, 18 bp, Homo sapiens
acccggcccccgccctct

SEQ ID NO: 1944707 - DNA, 19 bp, Homo sapiens
acccggcccccgccctctg

SEQ ID NO: 1944708 - DNA, 21 bp, Homo sapiens
acccggcccccgccctctgcc

SEQ ID NO: 1944709 - DNA, 13 bp, Homo sapiens
acccgtttccaag

SEQ ID NO: 1944710 - DNA, 19 bp, Homo sapiens
accctaggtctccacccct

SEQ ID NO: 1944711 - DNA, 11 bp, Homo sapiens
accctcagagc

SEQ ID NO: 1944712 - DNA, 18 bp, Homo sapiens
accctccctgtcccctga

SEQ ID NO: 1944713 - DNA, 19 bp, Homo sapiens
accctccctgtcccctgag

SEQ ID NO: 1944714 - DNA, 19 bp, Homo sapiens
accctctctgtccaatctg

SEQ ID NO: 1944715 - DNA, 22 bp, Homo sapiens
accctgagctgaggcagcagtg

SEQ ID NO: 1944716 - DNA, 19 bp, Homo sapiens
accctgcacctcattccaa

SEQ ID NO: 1944717 - DNA, 11 bp, Homo sapiens
accctgccagg

SEQ ID NO: 1944718 - DNA, 16 bp, Homo sapiens
accctgccagggggtt

SEQ ID NO: 1944719 - DNA, 17 bp, Homo sapiens
accctggaagcagggac

SEQ ID NO: 1944720 - DNA, 15 bp, Homo sapiens
accctgtctgcaggc

SEQ ID NO: 1944721 - DNA, 17 bp, Homo sapiens
accctgtctgcaggcca

SEQ ID NO: 1944722 - DNA, 16 bp, Homo sapiens
actagggccaagccca

SEQ ID NO: 1944723 - DNA, 19 bp, Homo sapiens
actaggtgcccagtcttga

SEQ ID NO: 1944724 - DNA, 13 bp, Homo sapiens
actataacaaaat

SEQ ID NO: 1944725 - DNA, 20 bp, Homo sapiens
actataggtaattaaggcag

SEQ ID NO: 1944726 - DNA, 22 bp, Homo sapiens
actatcatgtcaaacgtgaaaa

SEQ ID NO: 1944727 - DNA, 16 bp, Homo sapiens
actatgatttggaaaa

SEQ ID NO: 1944728 - DNA, 13 bp, Homo sapiens
actatgttgataa

SEQ ID NO: 1944729 - DNA, 16 bp, Homo sapiens
actattcttaagcact

SEQ ID NO: 1944730 - DNA, 17 bp, Homo sapiens
actattcttaagcactt

SEQ ID NO: 1944731 - DNA, 18 bp, Homo sapiens
actattcttaagcacttt

SEQ ID NO: 1944732 - DNA, 21 bp, Homo sapiens
actattcttaagcactttgaa

SEQ ID NO: 1944733 - DNA, 14 bp, Homo sapiens
actatttagagaat

SEQ ID NO: 1944734 - DNA, 13 bp, Homo sapiens
actattttttaaa

SEQ ID NO: 1944735 - DNA, 16 bp, Homo sapiens
actattttttaaaaat

SEQ ID NO: 1944736 - DNA, 14 bp, Homo sapiens
actcagtcagccca

SEQ ID NO: 1944737 - DNA, 15 bp, Homo sapiens
actcagtcagcccag

SEQ ID NO: 1944738 - DNA, 15 bp, Homo sapiens
actccactcccctca

SEQ ID NO: 1944739 - DNA, 13 bp, Homo sapiens
actccagacccct

SEQ ID NO: 1944740 - DNA, 20 bp, Homo sapiens
actccagccacccagccagg

SEQ ID NO: 1944741 - DNA, 21 bp, Homo sapiens
actccagccacccagccagga

SEQ ID NO: 1944742 - DNA, 20 bp, Homo sapiens
actccagctgggttggaaaa

SEQ ID NO: 1944743 - DNA, 18 bp, Homo sapiens
actccagttaaaaaaaat

SEQ ID NO: 1944744 - DNA, 20 bp, Homo sapiens
actccagttaaaaaaaattt

SEQ ID NO: 1944745 - DNA, 14 bp, Homo sapiens
actcccttgggctc

SEQ ID NO: 1944746 - DNA, 16 bp, Homo sapiens
actccttgttctgctc

SEQ ID NO: 1944747 - DNA, 14 bp, Homo sapiens
actctctcctctct

SEQ ID NO: 1944748 - DNA, 18 bp, Homo sapiens
actctctcctctctctcc

SEQ ID NO: 1944749 - DNA, 15 bp, Homo sapiens
actctctttcttcca

SEQ ID NO: 1944750 - DNA, 16 bp, Homo sapiens
actctgaccgggcttc

SEQ ID NO: 1944751 - DNA, 13 bp, Homo sapiens
actctttcaaaac

SEQ ID NO: 1944752 - DNA, 13 bp, Homo sapiens
actctttgagaaa

SEQ ID NO: 1944753 - DNA, 18 bp, Homo sapiens
actctttgagaaacaaca

SEQ ID NO: 1944754 - DNA, 13 bp, Homo sapiens
actctttgtaaga

SEQ ID NO: 1944755 - DNA, 16 bp, Homo sapiens
actgaaggcaaatctc

SEQ ID NO: 1944756 - DNA, 13 bp, Homo sapiens
actgaagtgaata

SEQ ID NO: 1944757 - DNA, 17 bp, Homo sapiens
actgaagtgaatacatg

SEQ ID NO: 1944758 - DNA, 18 bp, Homo sapiens
actgaagtgaatacatgg

SEQ ID NO: 1944759 - DNA, 23 bp, Homo sapiens
actgacacaaaggacaaaaatat

SEQ ID NO: 1944760 - DNA, 20 bp, Homo sapiens
actgacactgcgaactctca

SEQ ID NO: 1944761 - DNA, 16 bp, Homo sapiens
actgagaaggccccag

SEQ ID NO: 1944762 - DNA, 18 bp, Homo sapiens
actgagataccagcgagg

SEQ ID NO: 1944763 - DNA, 12 bp, Homo sapiens
actgagggcagt

SEQ ID NO: 1944764 - DNA, 23 bp, Homo sapiens
actgagggcagtcgatagagctg

SEQ ID NO: 1944765 - DNA, 20 bp, Homo sapiens
actgcaacttgtaaatgtgg

SEQ ID NO: 1944766 - DNA, 19 bp, Homo sapiens
actgcagtcacccctgtct

SEQ ID NO: 1944767 - DNA, 18 bp, Homo sapiens
actgccagaagtgtgttt

SEQ ID NO: 1944768 - DNA, 12 bp, Homo sapiens
actgctggctgc

SEQ ID NO: 1944769 - DNA, 13 bp, Homo sapiens
actgctggctgcc

SEQ ID NO: 1944770 - DNA, 14 bp, Homo sapiens
actgctggctgcct

SEQ ID NO: 1944771 - DNA, 16 bp, Homo sapiens
actgctgggaagtggc

SEQ ID NO: 1944772 - DNA, 15 bp, Homo sapiens
actgctgtccctcct

SEQ ID NO: 1944773 - DNA, 18 bp, Homo sapiens
actgctgtccctcctgag

SEQ ID NO: 1944774 - DNA, 18 bp, Homo sapiens
actgcttgaggaaaacaa

SEQ ID NO: 1944775 - DNA, 12 bp, Homo sapiens
actggaaaacat

SEQ ID NO: 1944776 - DNA, 16 bp, Homo sapiens
actggcccacccctct

SEQ ID NO: 1944777 - DNA, 24 bp, Homo sapiens
actggctttgggtagtgccatggc

SEQ ID NO: 1944778 - DNA, 18 bp, Homo sapiens
actgggccggcagcctgg

SEQ ID NO: 1944779 - DNA, 13 bp, Homo sapiens
actgggctgaggg

SEQ ID NO: 1944780 - DNA, 14 bp, Homo sapiens
actggtatatattt

SEQ ID NO: 1944781 - DNA, 18 bp, Homo sapiens
actggtcccccatgggct

SEQ ID NO: 1944782 - DNA, 20 bp, Homo sapiens
actggtcccccatgggctgc

SEQ ID NO: 1944783 - DNA, 12 bp, Homo sapiens
actggtggcccg

SEQ ID NO: 1944784 - DNA, 20 bp, Homo sapiens
actggtggcccgacagcctg

SEQ ID NO: 1944785 - DNA, 23 bp, Homo sapiens
actggtggcccgacagcctggca

SEQ ID NO: 1944786 - DNA, 21 bp, Homo sapiens
actggtgttatcaccgtgggc

SEQ ID NO: 1944787 - DNA, 20 bp, Homo sapiens
actggttgagggagtgggga

SEQ ID NO: 1944788 - DNA, 18 bp, Homo sapiens
actgtaacatatatgaaa

SEQ ID NO: 1944789 - DNA, 14 bp, Homo sapiens
actgtactcctccc

SEQ ID NO: 1944790 - DNA, 15 bp, Homo sapiens
actgtactcctccca

SEQ ID NO: 1944791 - DNA, 15 bp, Homo sapiens
actgtgcacatctgt

SEQ ID NO: 1944792 - DNA, 16 bp, Homo sapiens
actgttccccctgtgc

SEQ ID NO: 1944793 - DNA, 13 bp, Homo sapiens
acttaacctgctt

SEQ ID NO: 1944794 - DNA, 23 bp, Homo sapiens
acttaatatgtgggaaacccttt

SEQ ID NO: 1944795 - DNA, 16 bp, Homo sapiens
acttagaaattgcatt

SEQ ID NO: 1944796 - DNA, 17 bp, Homo sapiens
acttataattttcctaa

SEQ ID NO: 1944797 - DNA, 13 bp, Homo sapiens
acttatttctaaa

SEQ ID NO: 1944798 - DNA, 13 bp, Homo sapiens
acttcagactctc

SEQ ID NO: 1944799 - DNA, 20 bp, Homo sapiens
acttcaggctcttctccttt

SEQ ID NO: 1944800 - DNA, 12 bp, Homo sapiens
acttcccaggcc

SEQ ID NO: 1944801 - DNA, 14 bp, Homo sapiens
acttccctgcaagg

SEQ ID NO: 1944802 - DNA, 16 bp, Homo sapiens
acttcctcctcctcct

SEQ ID NO: 1944803 - DNA, 14 bp, Homo sapiens
acttctgaatattg

SEQ ID NO: 1944804 - DNA, 14 bp, Homo sapiens
acttgaaatcaaat

SEQ ID NO: 1944805 - DNA, 22 bp, Homo sapiens
acttgaccgtttttatattact

SEQ ID NO: 1944806 - DNA, 23 bp, Homo sapiens
acttggataggagcttccagatg

SEQ ID NO: 1944807 - DNA, 16 bp, Homo sapiens
acttggccaccaggac

SEQ ID NO: 1944808 - DNA, 18 bp, Homo sapiens
acttgtaaatgtggtaaa

SEQ ID NO: 1944809 - DNA, 20 bp, Homo sapiens
acttgtcaaggaatgttatc

SEQ ID NO: 1944810 - DNA, 17 bp, Homo sapiens
acttgtgtttgtatata

SEQ ID NO: 1944811 - DNA, 18 bp, Homo sapiens
acttgtgtttgtatataa

SEQ ID NO: 1944812 - DNA, 12 bp, Homo sapiens
actttaataata

SEQ ID NO: 1944813 - DNA, 23 bp, Homo sapiens
actttagggctaaccagttctct

SEQ ID NO: 1944814 - DNA, 18 bp, Homo sapiens
actttatttgaataacaa

SEQ ID NO: 1944815 - DNA, 13 bp, Homo sapiens
actttccagcagg

SEQ ID NO: 1944816 - DNA, 21 bp, Homo sapiens
actttccctagaaagccatat

SEQ ID NO: 1944817 - DNA, 21 bp, Homo sapiens
actttcctcttagtcgagcca

SEQ ID NO: 1944818 - DNA, 19 bp, Homo sapiens
actttcttttctggaatgt

SEQ ID NO: 1944819 - DNA, 17 bp, Homo sapiens
actttgaaaatatttct

SEQ ID NO: 1944820 - DNA, 18 bp, Homo sapiens
acttttgtaaatattctt

SEQ ID NO: 1944821 - DNA, 12 bp, Homo sapiens
actttttcaatg

SEQ ID NO: 1944822 - DNA, 23 bp, Homo sapiens
agaaaacccgacaacatttctgc

SEQ ID NO: 1944823 - DNA, 17 bp, Homo sapiens
agaaaagacatgaatat

SEQ ID NO: 1944824 - DNA, 20 bp, Homo sapiens
agaaacaactctttgagaaa

SEQ ID NO: 1944825 - DNA, 15 bp, Homo sapiens
agaaactgcagggaa

SEQ ID NO: 1944826 - DNA, 14 bp, Homo sapiens
agaaacttccaaat

SEQ ID NO: 1944827 - DNA, 19 bp, Homo sapiens
agaaacttccaaatcccct

SEQ ID NO: 1944828 - DNA, 21 bp, Homo sapiens
agaaagcatctattcccaaag

SEQ ID NO: 1944829 - DNA, 18 bp, Homo sapiens
agaaagccatattccagc

SEQ ID NO: 1944830 - DNA, 21 bp, Homo sapiens
agaaagcctcagagaattgct

SEQ ID NO: 1944831 - DNA, 13 bp, Homo sapiens
agaaaggcagaga

SEQ ID NO: 1944832 - DNA, 17 bp, Homo sapiens
agaaaggcagagattgg

SEQ ID NO: 1944833 - DNA, 21 bp, Homo sapiens
agaaagggcagcccctcccca

SEQ ID NO: 1944834 - DNA, 23 bp, Homo sapiens
agaaagtggaaaacaaggaagtc

SEQ ID NO: 1944835 - DNA, 18 bp, Homo sapiens
agaaatatgattgatttg

SEQ ID NO: 1944836 - DNA, 21 bp, Homo sapiens
agaaatatgcacaatagcagt

SEQ ID NO: 1944837 - DNA, 19 bp, Homo sapiens
agaaatgatttcaaaatga

SEQ ID NO: 1944838 - DNA, 18 bp, Homo sapiens
agaaattctgttaatgtt

SEQ ID NO: 1944839 - DNA, 16 bp, Homo sapiens
agaacaatcactattc

SEQ ID NO: 1944840 - DNA, 17 bp, Homo sapiens
agaacaatcactattct

SEQ ID NO: 1944841 - DNA, 14 bp, Homo sapiens
agaacccccctccc

SEQ ID NO: 1944842 - DNA, 22 bp, Homo sapiens
agaactactcagggaatgaagg

SEQ ID NO: 1944843 - DNA, 16 bp, Homo sapiens
agaactgcttgcattt

SEQ ID NO: 1944844 - DNA, 23 bp, Homo sapiens
agaacttggatgtacctgccccc

SEQ ID NO: 1944845 - DNA, 13 bp, Homo sapiens
agaagaaactcct

SEQ ID NO: 1944846 - DNA, 13 bp, Homo sapiens
agaagaagctcct

SEQ ID NO: 1944847 - DNA, 15 bp, Homo sapiens
agaagagaaagtaca

SEQ ID NO: 1944848 - DNA, 16 bp, Homo sapiens
agaagagggagaagga

SEQ ID NO: 1944849 - DNA, 18 bp, Homo sapiens
agaagagggagaaggaga

SEQ ID NO: 1944850 - DNA, 22 bp, Homo sapiens
agaagagggagaaggagaggct

SEQ ID NO: 1944851 - DNA, 23 bp, Homo sapiens
agaagctccctgaagtaagcaaa

SEQ ID NO: 1944852 - DNA, 16 bp, Homo sapiens
agaagctcctgaatcc

SEQ ID NO: 1944853 - DNA, 20 bp, Homo sapiens
agaaggagacagagctggtt

SEQ ID NO: 1944854 - DNA, 17 bp, Homo sapiens
agaaggcaagctggcag

SEQ ID NO: 1944855 - DNA, 13 bp, Homo sapiens
agaaggggcgagg

SEQ ID NO: 1944856 - DNA, 22 bp, Homo sapiens
agaagtgggagtgggagaggaa

SEQ ID NO: 1944857 - DNA, 17 bp, Homo sapiens
agaagtgggattcagga

SEQ ID NO: 1944858 - DNA, 13 bp, Homo sapiens
agaagtgtgtttt

SEQ ID NO: 1944859 - DNA, 20 bp, Homo sapiens
agaagttgttagtgatttgc

SEQ ID NO: 1944860 - DNA, 22 bp, Homo sapiens
agaatagtttggttcttcaaat

SEQ ID NO: 1944861 - DNA, 18 bp, Homo sapiens
agaatcagtagctggaga

SEQ ID NO: 1944862 - DNA, 16 bp, Homo sapiens
agaatgattttgacat

SEQ ID NO: 1944863 - DNA, 14 bp, Homo sapiens
agaatggctctggc

SEQ ID NO: 1944864 - DNA, 13 bp, Homo sapiens
agaatggtgggct

SEQ ID NO: 1944865 - DNA, 19 bp, Homo sapiens
agaatggtgggctccagag

SEQ ID NO: 1944866 - DNA, 13 bp, Homo sapiens
agaattaaaataa

SEQ ID NO: 1944867 - DNA, 15 bp, Homo sapiens
agaattttgagcagg

SEQ ID NO: 1944868 - DNA, 16 bp, Homo sapiens
agacaaaccagaagca

SEQ ID NO: 1944869 - DNA, 17 bp, Homo sapiens
agacaaaccagaagcaa

SEQ ID NO: 1944870 - DNA, 21 bp, Homo sapiens
agacacgcccgactctctcca

SEQ ID NO: 1944871 - DNA, 12 bp, Homo sapiens
agacagagtgga

SEQ ID NO: 1944872 - DNA, 19 bp, Homo sapiens
agacagagtggatctggag

SEQ ID NO: 1944873 - DNA, 15 bp, Homo sapiens
agacaggcagaatca

SEQ ID NO: 1944874 - DNA, 17 bp, Homo sapiens
agacagggtggggctta

SEQ ID NO: 1944875 - DNA, 20 bp, Homo sapiens
agacatcaagcacagaagga

SEQ ID NO: 1944876 - DNA, 14 bp, Homo sapiens
agacatgaatatga

SEQ ID NO: 1944877 - DNA, 13 bp, Homo sapiens
agaccataatgtt

SEQ ID NO: 1944878 - DNA, 18 bp, Homo sapiens
agacccagccctcatccc

SEQ ID NO: 1944879 - DNA, 14 bp, Homo sapiens
agacccctggcttt

SEQ ID NO: 1944880 - DNA, 12 bp, Homo sapiens
agaccctgccag

SEQ ID NO: 1944881 - DNA, 20 bp, Homo sapiens
agacctcggctgtgtgggga

SEQ ID NO: 1944882 - DNA, 21 bp, Homo sapiens
agacgtccacccgtttccaag

SEQ ID NO: 1944883 - DNA, 14 bp, Homo sapiens
agactactctgcct

SEQ ID NO: 1944884 - DNA, 15 bp, Homo sapiens
agactactctgcctg

SEQ ID NO: 1944885 - DNA, 16 bp, Homo sapiens
agactcccaagctgga

SEQ ID NO: 1944886 - DNA, 14 bp, Homo sapiens
agactctctcctct

SEQ ID NO: 1944887 - DNA, 21 bp, Homo sapiens
agactgtgggtccctgcgtct

SEQ ID NO: 1944888 - DNA, 21 bp, Homo sapiens
agagaacaatcactattctta

SEQ ID NO: 1944889 - DNA, 14 bp, Homo sapiens
agagaatgagagag

SEQ ID NO: 1944890 - DNA, 15 bp, Homo sapiens
agagaatgagagagt

SEQ ID NO: 1944891 - DNA, 13 bp, Homo sapiens
agagacagagagg

SEQ ID NO: 1944892 - DNA, 15 bp, Homo sapiens
agagaccttctctta

SEQ ID NO: 1944893 - DNA, 16 bp, Homo sapiens
agagactactctgcct

SEQ ID NO: 1944894 - DNA, 14 bp, Homo sapiens
agagagtggctcct

SEQ ID NO: 1944895 - DNA, 17 bp, Homo sapiens
agagagtggctcctccc

SEQ ID NO: 1944896 - DNA, 19 bp, Homo sapiens
agagattcttagctcttgg

SEQ ID NO: 1944897 - DNA, 23 bp, Homo sapiens
agagcagttaacatctgaagtgt

SEQ ID NO: 1944898 - DNA, 16 bp, Homo sapiens
agagcattctggggtg

SEQ ID NO: 1944899 - DNA, 16 bp, Homo sapiens
agagccaaggcctatg

SEQ ID NO: 1944900 - DNA, 19 bp, Homo sapiens
agagccaccaagagggacg

SEQ ID NO: 1944901 - DNA, 17 bp, Homo sapiens
agagcccaatcactgcc

SEQ ID NO: 1944902 - DNA, 14 bp, Homo sapiens
agagcctgagggat

SEQ ID NO: 1944903 - DNA, 14 bp, Homo sapiens
agagcgctggcctc

SEQ ID NO: 1944904 - DNA, 14 bp, Homo sapiens
agagctcaggagaa

SEQ ID NO: 1944905 - DNA, 21 bp, Homo sapiens
agagctcagtatactaatgcc

SEQ ID NO: 1944906 - DNA, 22 bp, Homo sapiens
agagctggttgggaagacatgg

SEQ ID NO: 1944907 - DNA, 17 bp, Homo sapiens
agagcttccctgactca

SEQ ID NO: 1944908 - DNA, 15 bp, Homo sapiens
agaggaaggggccag

SEQ ID NO: 1944909 - DNA, 16 bp, Homo sapiens
agaggacgtgggcggc

SEQ ID NO: 1944910 - DNA, 11 bp, Homo sapiens
agaggagagaa

SEQ ID NO: 1944911 - DNA, 18 bp, Homo sapiens
agaggagagaatgagaga

SEQ ID NO: 1944912 - DNA, 21 bp, Homo sapiens
agaggagagaatgagagagtg

SEQ ID NO: 1944913 - DNA, 22 bp, Homo sapiens
agaggagagaatgagagagtgt

SEQ ID NO: 1944914 - DNA, 14 bp, Homo sapiens
agaggagaggctgc

SEQ ID NO: 1944915 - DNA, 15 bp, Homo sapiens
agaggagaggctgct

SEQ ID NO: 1944916 - DNA, 21 bp, Homo sapiens
agaggagcctttccagaacta

SEQ ID NO: 1944917 - DNA, 12 bp, Homo sapiens
agaggaggatgg

SEQ ID NO: 1944918 - DNA, 14 bp, Homo sapiens
agaggaggtgtgga

SEQ ID NO: 1944919 - DNA, 17 bp, Homo sapiens
agaggaggtgtggagtg

SEQ ID NO: 1944920 - DNA, 20 bp, Homo sapiens
agaggaggtgtggagtggag

SEQ ID NO: 1944921 - DNA, 20 bp, Homo sapiens
gacatgcgggctgggcagct

SEQ ID NO: 1944922 - DNA, 15 bp, Homo sapiens
gacatggggaggaag

SEQ ID NO: 1944923 - DNA, 19 bp, Homo sapiens
gacatggtgtgccacaggc

SEQ ID NO: 1944924 - DNA, 20 bp, Homo sapiens
gacattttaaacacttacaa

SEQ ID NO: 1944925 - DNA, 16 bp, Homo sapiens
gaccacgtctccctgg

SEQ ID NO: 1944926 - DNA, 21 bp, Homo sapiens
gaccacgtctccctggcccca

SEQ ID NO: 1944927 - DNA, 18 bp, Homo sapiens
gaccagtcaacctgggca

SEQ ID NO: 1944928 - DNA, 20 bp, Homo sapiens
gaccataatgttacattatt

SEQ ID NO: 1944929 - DNA, 16 bp, Homo sapiens
gacccagccctcatcc

SEQ ID NO: 1944930 - DNA, 19 bp, Homo sapiens
gaccccaccctgtctgcag

SEQ ID NO: 1944931 - DNA, 16 bp, Homo sapiens
gacccctaccctttcc

SEQ ID NO: 1944932 - DNA, 17 bp, Homo sapiens
gacccggaggggcctgg

SEQ ID NO: 1944933 - DNA, 18 bp, Homo sapiens
gacccggaggggcctggc

SEQ ID NO: 1944934 - DNA, 19 bp, Homo sapiens
gacccggcccccgccctct

SEQ ID NO: 1944935 - DNA, 17 bp, Homo sapiens
gaccctaacccggaggg

SEQ ID NO: 1944936 - DNA, 13 bp, Homo sapiens
gaccctcccaggt

SEQ ID NO: 1944937 - DNA, 21 bp, Homo sapiens
gacctcagttttatcattttc

SEQ ID NO: 1944938 - DNA, 16 bp, Homo sapiens
gacctccttagaaaag

SEQ ID NO: 1944939 - DNA, 17 bp, Homo sapiens
gacctccttagaaaaga

SEQ ID NO: 1944940 - DNA, 18 bp, Homo sapiens
gacctgaccagactgtgg

SEQ ID NO: 1944941 - DNA, 17 bp, Homo sapiens
gacctggtgctgcctct

SEQ ID NO: 1944942 - DNA, 20 bp, Homo sapiens
gaccttgatgtcttgagagc

SEQ ID NO: 1944943 - DNA, 21 bp, Homo sapiens
gaccttgatgtcttgagagcg

SEQ ID NO: 1944944 - DNA, 13 bp, Homo sapiens
gacgcctgaggaa

SEQ ID NO: 1944945 - DNA, 21 bp, Homo sapiens
gacggaagtggcctgagaaga

SEQ ID NO: 1944946 - DNA, 19 bp, Homo sapiens
gacgggggttggggtgggg

SEQ ID NO: 1944947 - DNA, 14 bp, Homo sapiens
gactcagggctcct

SEQ ID NO: 1944948 - DNA, 17 bp, Homo sapiens
gactcagggctcctggg

SEQ ID NO: 1944949 - DNA, 15 bp, Homo sapiens
gactcaggttgtctg

SEQ ID NO: 1944950 - DNA, 13 bp, Homo sapiens
gactcattctgaa

SEQ ID NO: 1944951 - DNA, 18 bp, Homo sapiens
gactccttgttctgctct

SEQ ID NO: 1944952 - DNA, 14 bp, Homo sapiens
gactctcagtctct

SEQ ID NO: 1944953 - DNA, 14 bp, Homo sapiens
gactctctcctctc

SEQ ID NO: 1944954 - DNA, 20 bp, Homo sapiens
gactctctcctctctctccc

SEQ ID NO: 1944955 - DNA, 23 bp, Homo sapiens
gactctctcctctctctccctcc

SEQ ID NO: 1944956 - DNA, 12 bp, Homo sapiens
gactctctttct

SEQ ID NO: 1944957 - DNA, 14 bp, Homo sapiens
gactctggctgcca

SEQ ID NO: 1944958 - DNA, 15 bp, Homo sapiens
gactctggctgccaa

SEQ ID NO: 1944959 - DNA, 15 bp, Homo sapiens
gactggcccacccct

SEQ ID NO: 1944960 - DNA, 16 bp, Homo sapiens
gactggcccacccctc

SEQ ID NO: 1944961 - DNA, 17 bp, Homo sapiens
gactggcccacccctct

SEQ ID NO: 1944962 - DNA, 19 bp, Homo sapiens
gactggcccacccctcttc

SEQ ID NO: 1944963 - DNA, 22 bp, Homo sapiens
gactggcccacccctcttcccc

SEQ ID NO: 1944964 - DNA, 15 bp, Homo sapiens
gactgggctgaggga

SEQ ID NO: 1944965 - DNA, 21 bp, Homo sapiens
gactgggctgagggagcctgg

SEQ ID NO: 1944966 - DNA, 23 bp, Homo sapiens
gactgtactcctcccaggcgccc

SEQ ID NO: 1944967 - DNA, 15 bp, Homo sapiens
gacttcatttttcct

SEQ ID NO: 1944968 - DNA, 23 bp, Homo sapiens
gacttggataggagcttccagat

SEQ ID NO: 1944969 - DNA, 16 bp, Homo sapiens
gacttgtgcctcttgg

SEQ ID NO: 1944970 - DNA, 20 bp, Homo sapiens
gacttgtgcctcttgggaga

SEQ ID NO: 1944971 - DNA, 15 bp, Homo sapiens
gagaagcaccccacc

SEQ ID NO: 1944972 - DNA, 17 bp, Homo sapiens
gagaaggcaagctggca

SEQ ID NO: 1944973 - DNA, 18 bp, Homo sapiens
gagaaggcaagctggcag

SEQ ID NO: 1944974 - DNA, 17 bp, Homo sapiens
gagaaggccccagggca

SEQ ID NO: 1944975 - DNA, 19 bp, Homo sapiens
gagaaggccccagggcagc

SEQ ID NO: 1944976 - DNA, 20 bp, Homo sapiens
gagaaggccccagggcagcg

SEQ ID NO: 1944977 - DNA, 23 bp, Homo sapiens
gagaaggcctgccccccttccca

SEQ ID NO: 1944978 - DNA, 14 bp, Homo sapiens
gagaatggctctgg

SEQ ID NO: 1944979 - DNA, 12 bp, Homo sapiens
gagaattaaaat

SEQ ID NO: 1944980 - DNA, 16 bp, Homo sapiens
gagacggtcatgcaag

SEQ ID NO: 1944981 - DNA, 22 bp, Homo sapiens
gagacgtccacccgtttccaag

SEQ ID NO: 1944982 - DNA, 13 bp, Homo sapiens
gagactactctgc

SEQ ID NO: 1944983 - DNA, 15 bp, Homo sapiens
gagactgggctgagg

SEQ ID NO: 1944984 - DNA, 17 bp, Homo sapiens
gagactgggctgaggga

SEQ ID NO: 1944985 - DNA, 17 bp, Homo sapiens
gagactgttttgaattt

SEQ ID NO: 1944986 - DNA, 15 bp, Homo sapiens
gagagaagcacccca

SEQ ID NO: 1944987 - DNA, 21 bp, Homo sapiens
gagagaatgagagagtgtgga

SEQ ID NO: 1944988 - DNA, 15 bp, Homo sapiens
gagagaccttctctt

SEQ ID NO: 1944989 - DNA, 14 bp, Homo sapiens
gagagagtgtggaa

SEQ ID NO: 1944990 - DNA, 18 bp, Homo sapiens
gagagcccaatcactgcc

SEQ ID NO: 1944991 - DNA, 19 bp, Homo sapiens
gagagcccaatcactgcct

SEQ ID NO: 1944992 - DNA, 23 bp, Homo sapiens
gagagctggggaagcttcttaaa

SEQ ID NO: 1944993 - DNA, 14 bp, Homo sapiens
gagaggaaaagcca

SEQ ID NO: 1944994 - DNA, 16 bp, Homo sapiens
gagaggaaaagccagt

SEQ ID NO: 1944995 - DNA, 19 bp, Homo sapiens
gagaggaggtgtggagtgg

SEQ ID NO: 1944996 - DNA, 18 bp, Homo sapiens
gagagggggccacctccc

SEQ ID NO: 1944997 - DNA, 16 bp, Homo sapiens
gagagtggctcctccc

SEQ ID NO: 1944998 - DNA, 21 bp, Homo sapiens
gagagtggctcctcccggtgc

SEQ ID NO: 1944999 - DNA, 22 bp, Homo sapiens
gagagtgtggaaaaaaaaagaa

SEQ ID NO: 1945000 - DNA, 11 bp, Homo sapiens
gagatatttac

SEQ ID NO: 1945001 - DNA, 22 bp, Homo sapiens
gagatgcatctgtggcctgggg

SEQ ID NO: 1945002 - DNA, 22 bp, Homo sapiens
gagcaaatttcatctttccaaa

SEQ ID NO: 1945003 - DNA, 17 bp, Homo sapiens
gagcaaggcaagaagtg

SEQ ID NO: 1945004 - DNA, 18 bp, Homo sapiens
gagcagctgggcactggg

SEQ ID NO: 1945005 - DNA, 14 bp, Homo sapiens
gagcaggcaccagc

SEQ ID NO: 1945006 - DNA, 21 bp, Homo sapiens
gagcagtgaatgattcagtgt

SEQ ID NO: 1945007 - DNA, 19 bp, Homo sapiens
gagcattctggggtggggc

SEQ ID NO: 1945008 - DNA, 17 bp, Homo sapiens
gagcatttagggcaagg

SEQ ID NO: 1945009 - DNA, 14 bp, Homo sapiens
gagccactcctctg

SEQ ID NO: 1945010 - DNA, 19 bp, Homo sapiens
gagccagcagctgaagtct

SEQ ID NO: 1945011 - DNA, 14 bp, Homo sapiens
gagccaggagcctc

SEQ ID NO: 1945012 - DNA, 14 bp, Homo sapiens
gagcccagctctga

SEQ ID NO: 1945013 - DNA, 21 bp, Homo sapiens
gagcccagctctgaaaccagt

SEQ ID NO: 1945014 - DNA, 17 bp, Homo sapiens
gattcccggctggactt

SEQ ID NO: 1945015 - DNA, 12 bp, Homo sapiens
gattctcctctc

SEQ ID NO: 1945016 - DNA, 15 bp, Homo sapiens
gattctcctctccca

SEQ ID NO: 1945017 - DNA, 19 bp, Homo sapiens
gattgatttgaagtggaaa

SEQ ID NO: 1945018 - DNA, 16 bp, Homo sapiens
gattgccatttcttcc

SEQ ID NO: 1945019 - DNA, 16 bp, Homo sapiens
gattgctgccccatca

SEQ ID NO: 1945020 - DNA, 21 bp, Homo sapiens
gattgctgccccatcagtgct

SEQ ID NO: 1945021 - DNA, 16 bp, Homo sapiens
gattgggggggcttgg

SEQ ID NO: 1945022 - DNA, 17 bp, Homo sapiens
gatttagagactgtaaa

SEQ ID NO: 1945023 - DNA, 18 bp, Homo sapiens
gatttcagttcaatcaaa

SEQ ID NO: 1945024 - DNA, 20 bp, Homo sapiens
gatttccacctttatgtttt

SEQ ID NO: 1945025 - DNA, 21 bp, Homo sapiens
gatttccacctttatgtttta

SEQ ID NO: 1945026 - DNA, 16 bp, Homo sapiens
gatttgcaactttaga

SEQ ID NO: 1945027 - DNA, 19 bp, Homo sapiens
gatttgtgttttacagtat

SEQ ID NO: 1945028 - DNA, 20 bp, Homo sapiens
gatttgtgttttacagtata

SEQ ID NO: 1945029 - DNA, 18 bp, Homo sapiens
gattttcctgtgtccaca

SEQ ID NO: 1945030 - DNA, 15 bp, Homo sapiens
gatttttatgtttta

SEQ ID NO: 1945031 - DNA, 14 bp, Homo sapiens
gcaaaccaggctgc

SEQ ID NO: 1945032 - DNA, 17 bp, Homo sapiens
gcaaaccaggctgcagg

SEQ ID NO: 1945033 - DNA, 16 bp, Homo sapiens
gcaaagacagaagcct

SEQ ID NO: 1945034 - DNA, 12 bp, Homo sapiens
gcaaagcattga

SEQ ID NO: 1945035 - DNA, 19 bp, Homo sapiens
gcaaatctcctttgtccat

SEQ ID NO: 1945036 - DNA, 20 bp, Homo sapiens
gcaaatttcatctttccaaa

SEQ ID NO: 1945037 - DNA, 12 bp, Homo sapiens
gcaacagcctgt

SEQ ID NO: 1945038 - DNA, 17 bp, Homo sapiens
gcaacagggcttctctt

SEQ ID NO: 1945039 - DNA, 16 bp, Homo sapiens
gcaactggtatatatt

SEQ ID NO: 1945040 - DNA, 18 bp, Homo sapiens
gcaactggtatatattta

SEQ ID NO: 1945041 - DNA, 21 bp, Homo sapiens
gcaactggtatatatttagga

SEQ ID NO: 1945042 - DNA, 13 bp, Homo sapiens
gcaactttagaaa

SEQ ID NO: 1945043 - DNA, 15 bp, Homo sapiens
gcaactttagaaaga

SEQ ID NO: 1945044 - DNA, 21 bp, Homo sapiens
gcaagagactactctgcctga

SEQ ID NO: 1945045 - DNA, 17 bp, Homo sapiens
gcaagagctcaggagaa

SEQ ID NO: 1945046 - DNA, 17 bp, Homo sapiens
gcaagctggcaggaggg

SEQ ID NO: 1945047 - DNA, 21 bp, Homo sapiens
gcaagcttggctgtagaagga

SEQ ID NO: 1945048 - DNA, 22 bp, Homo sapiens
gcaagcttggctgtagaaggag

SEQ ID NO: 1945049 - DNA, 10 bp, Homo sapiens
gcaagggctt

SEQ ID NO: 1945050 - DNA, 14 bp, Homo sapiens
gcaagtcccaggga

SEQ ID NO: 1945051 - DNA, 20 bp, Homo sapiens
gcaagtcccagggagctctg

SEQ ID NO: 1945052 - DNA, 17 bp, Homo sapiens
gcacaagaagtgggagt

SEQ ID NO: 1945053 - DNA, 23 bp, Homo sapiens
gcacaagaagtgggagtgggaga

SEQ ID NO: 1945054 - DNA, 19 bp, Homo sapiens
gcacacacactcttcaagt

SEQ ID NO: 1945055 - DNA, 19 bp, Homo sapiens
gcacaccctctctgtccaa

SEQ ID NO: 1945056 - DNA, 12 bp, Homo sapiens
gcacagaaggag

SEQ ID NO: 1945057 - DNA, 15 bp, Homo sapiens
gcacagagagggggc

SEQ ID NO: 1945058 - DNA, 15 bp, Homo sapiens
gcacagtgcatctca

SEQ ID NO: 1945059 - DNA, 20 bp, Homo sapiens
gcacagtgcatctcagccca

SEQ ID NO: 1945060 - DNA, 23 bp, Homo sapiens
gcacatgcggcttccgagggcac

SEQ ID NO: 1945061 - DNA, 20 bp, Homo sapiens
gcaccctctgctatgtctgt

SEQ ID NO: 1945062 - DNA, 10 bp, Homo sapiens
cgtttccaag

SEQ ID NO: 1945063 - DNA, 15 bp, Homo sapiens
cgtttttatattact

SEQ ID NO: 1945064 - DNA, 12 bp, Homo sapiens
ctaaaaggagga

SEQ ID NO: 1945065 - DNA, 16 bp, Homo sapiens
ctaaaaggaggacagg

SEQ ID NO: 1945066 - DNA, 21 bp, Homo sapiens
ctaaaggactggttaaatcaa

SEQ ID NO: 1945067 - DNA, 15 bp, Homo sapiens
ctaaaggggacagat

SEQ ID NO: 1945068 - DNA, 21 bp, Homo sapiens
ctaaaggggacagatcttgag

SEQ ID NO: 1945069 - DNA, 22 bp, Homo sapiens
ctaaaggggacagatcttgagc

SEQ ID NO: 1945070 - DNA, 16 bp, Homo sapiens
catgtccctaccgagt

SEQ ID NO: 1945071 - DNA, 22 bp, Homo sapiens
catgtccctaccgagtctcttc

SEQ ID NO: 1945072 - DNA, 23 bp, Homo sapiens
catgtccctaccgagtctcttct

SEQ ID NO: 1945073 - DNA, 23 bp, Homo sapiens
catgtgactgtattacctattca

SEQ ID NO: 1945074 - DNA, 17 bp, Homo sapiens
cattaacaggtctttga

SEQ ID NO: 1945075 - DNA, 16 bp, Homo sapiens
cattaatgaaatacca

SEQ ID NO: 1945076 - DNA, 15 bp, Homo sapiens
cattaattcaattaa

SEQ ID NO: 1945077 - DNA, 17 bp, Homo sapiens
cattagcagtttgcttt

SEQ ID NO: 1945078 - DNA, 18 bp, Homo sapiens
cattattaaatcagaatc

SEQ ID NO: 1945079 - DNA, 20 bp, Homo sapiens
cattattgaggaaaattaat

SEQ ID NO: 1945080 - DNA, 23 bp, Homo sapiens
cattattgaggaaaattaatatc

SEQ ID NO: 1945081 - DNA, 23 bp, Homo sapiens
cattcaaaaacatggccacatcc

SEQ ID NO: 1945082 - DNA, 13 bp, Homo sapiens
cattccccatggg

SEQ ID NO: 1945083 - DNA, 16 bp, Homo sapiens
cattctacttcagctt

SEQ ID NO: 1945084 - DNA, 20 bp, Homo sapiens
cattctagagggatccaccg

SEQ ID NO: 1945085 - DNA, 19 bp, Homo sapiens
cattctctgtctcatccat

SEQ ID NO: 1945086 - DNA, 20 bp, Homo sapiens
cattgaagggggatgcaggc

SEQ ID NO: 1945087 - DNA, 23 bp, Homo sapiens
cattgacaaggtgtttctctgta

SEQ ID NO: 1945088 - DNA, 23 bp, Homo sapiens
cattgcctgatttgttccttctg

SEQ ID NO: 1945089 - DNA, 17 bp, Homo sapiens
cattggacccttccatg

SEQ ID NO: 1945090 - DNA, 17 bp, Homo sapiens
cattgtataggccatct

SEQ ID NO: 1945091 - DNA, 19 bp, Homo sapiens
cattgtataggccatctgt

SEQ ID NO: 1945092 - DNA, 20 bp, Homo sapiens
cattgtataggccatctgta

SEQ ID NO: 1945093 - DNA, 19 bp, Homo sapiens
cattgtccaatcctatgtt

SEQ ID NO: 1945094 - DNA, 19 bp, Homo sapiens
cattgtggctgtcagcagg

SEQ ID NO: 1945095 - DNA, 15 bp, Homo sapiens
cattgtgtttgtgtg

SEQ ID NO: 1945096 - DNA, 17 bp, Homo sapiens
catttaaatacagtctt

SEQ ID NO: 1945097 - DNA, 21 bp, Homo sapiens
catttcggtgcttccctttca

SEQ ID NO: 1945098 - DNA, 20 bp, Homo sapiens
catttctcaaagtttttaca

SEQ ID NO: 1945099 - DNA, 22 bp, Homo sapiens
catttgcaagggaaaagtctct

SEQ ID NO: 1945100 - DNA, 23 bp, Homo sapiens
catttggagtgttccccttccac

SEQ ID NO: 1945101 - DNA, 15 bp, Homo sapiens
catttgtgtctgcct

SEQ ID NO: 1945102 - DNA, 23 bp, Homo sapiens
cattttctaattctcttttcaaa

SEQ ID NO: 1945103 - DNA, 15 bp, Homo sapiens
cattttgcgatgtgt

SEQ ID NO: 1945104 - DNA, 15 bp, Homo sapiens
cattttgtctggctg

SEQ ID NO: 1945105 - DNA, 21 bp, Homo sapiens
cattttgtctggctgtggccc

SEQ ID NO: 1945106 - DNA, 18 bp, Homo sapiens
catttttcctaacaggat

SEQ ID NO: 1945107 - DNA, 17 bp, Homo sapiens
ccaaagaaccccaggca

SEQ ID NO: 1945108 - DNA, 17 bp, Homo sapiens
ccaaatatgcactttcc

SEQ ID NO: 1945109 - DNA, 16 bp, Homo sapiens
ccaaattgcagaagaa

SEQ ID NO: 1945110 - DNA, 19 bp, Homo sapiens
ccaaccacctctggccctg

SEQ ID NO: 1945111 - DNA, 12 bp, Homo sapiens
ccaactccaggg

SEQ ID NO: 1945112 - DNA, 12 bp, Homo sapiens
ccaactctggcc

SEQ ID NO: 1945113 - DNA, 19 bp, Homo sapiens
ccaagaatagatgctgact

SEQ ID NO: 1945114 - DNA, 18 bp, Homo sapiens
ccaagccagggttccaga

SEQ ID NO: 1945115 - DNA, 20 bp, Homo sapiens
ccaagccagggttccagaca

SEQ ID NO: 1945116 - DNA, 21 bp, Homo sapiens
ccaagccagggttccagacag

SEQ ID NO: 1945117 - DNA, 13 bp, Homo sapiens
ccaagccgtggct

SEQ ID NO: 1945118 - DNA, 21 bp, Homo sapiens
ccaagccgtggcttcccgctc

SEQ ID NO: 1945119 - DNA, 15 bp, Homo sapiens
ccaagcctgggccac

SEQ ID NO: 1945120 - DNA, 17 bp, Homo sapiens
ccaagcctgggccactg

SEQ ID NO: 1945121 - DNA, 21 bp, Homo sapiens
ccaaggcctatgccacctgca

SEQ ID NO: 1945122 - DNA, 13 bp, Homo sapiens
ccaataattctgt

SEQ ID NO: 1945123 - DNA, 14 bp, Homo sapiens
ccaatactctccta

SEQ ID NO: 1945124 - DNA, 20 bp, Homo sapiens
ccaatcacattcaggcatgc

SEQ ID NO: 1945125 - DNA, 12 bp, Homo sapiens
ccaatgtcttga

SEQ ID NO: 1945126 - DNA, 17 bp, Homo sapiens
ccacacaagacagcaga

SEQ ID NO: 1945127 - DNA, 12 bp, Homo sapiens
ccacacacccca

SEQ ID NO: 1945128 - DNA, 14 bp, Homo sapiens
ccacacctccaccc

SEQ ID NO: 1945129 - DNA, 18 bp, Homo sapiens
ccacactacgcagaagag

SEQ ID NO: 1945130 - DNA, 21 bp, Homo sapiens
ccacacttcaggctcttctcc

SEQ ID NO: 1945131 - DNA, 20 bp, Homo sapiens
ccacagagtgccatccctga

SEQ ID NO: 1945132 - DNA, 16 bp, Homo sapiens
ccacaggacatttctc

SEQ ID NO: 1945133 - DNA, 23 bp, Homo sapiens
ccacaggcccttcctctccactg

SEQ ID NO: 1945134 - DNA, 18 bp, Homo sapiens
ccacatccaacatttcct

SEQ ID NO: 1945135 - DNA, 18 bp, Homo sapiens
ccacatggccgctgccca

SEQ ID NO: 1945136 - DNA, 15 bp, Homo sapiens
ccaccaaccctcaga

SEQ ID NO: 1945137 - DNA, 21 bp, Homo sapiens
ccaccaagagggacgcctggg

SEQ ID NO: 1945138 - DNA, 19 bp, Homo sapiens
ccaccagggaccagcccag

SEQ ID NO: 1945139 - DNA, 14 bp, Homo sapiens
ccacccagccagga

SEQ ID NO: 1945140 - DNA, 18 bp, Homo sapiens
ccacccctcaagccagga

SEQ ID NO: 1945141 - DNA, 13 bp, Homo sapiens
ccacccctcttcc

SEQ ID NO: 1945142 - DNA, 21 bp, Homo sapiens
ccacccctcttcccccttccc

SEQ ID NO: 1945143 - DNA, 17 bp, Homo sapiens
ccacccgtttccaagcc

SEQ ID NO: 1945144 - DNA, 23 bp, Homo sapiens
ccacccgtttccaagcctgggcc

SEQ ID NO: 1945145 - DNA, 18 bp, Homo sapiens
ccaccctctgcagggcag

SEQ ID NO: 1945146 - DNA, 21 bp, Homo sapiens
ccaccctctgcagggcagcct

SEQ ID NO: 1945147 - DNA, 15 bp, Homo sapiens
ccaccgtgggagagg

SEQ ID NO: 1945148 - DNA, 14 bp, Homo sapiens
ccacctccctgcag

SEQ ID NO: 1945149 - DNA, 16 bp, Homo sapiens
ccacctccctgcagct

SEQ ID NO: 1945150 - DNA, 10 bp, Homo sapiens
ccagcttccc

SEQ ID NO: 1945151 - DNA, 13 bp, Homo sapiens
ccagcttgaggga

SEQ ID NO: 1945152 - DNA, 17 bp, Homo sapiens
ccagcttggagtgccac

SEQ ID NO: 1945153 - DNA, 23 bp, Homo sapiens
ccagcttggagtgccacgtggcc

SEQ ID NO: 1945154 - DNA, 23 bp, Homo sapiens
ccaggactccttgttctgctctg

SEQ ID NO: 1945155 - DNA, 16 bp, Homo sapiens
ccaggactctctttct

SEQ ID NO: 1945156 - DNA, 20 bp, Homo sapiens
ccaggactctctttcttcca

SEQ ID NO: 1945157 - DNA, 19 bp, Homo sapiens
ccaggagagaccttctctt

SEQ ID NO: 1945158 - DNA, 22 bp, Homo sapiens
ccaggagcctcctgaccctgtg

SEQ ID NO: 1945159 - DNA, 13 bp, Homo sapiens
ccaggaggacctg

SEQ ID NO: 1945160 - DNA, 19 bp, Homo sapiens
ccaggcatggcccagcctg

SEQ ID NO: 1945161 - DNA, 17 bp, Homo sapiens
ccaggccctctctgcag

SEQ ID NO: 1945162 - DNA, 18 bp, Homo sapiens
ccaggccgtggctgccca

SEQ ID NO: 1945163 - DNA, 17 bp, Homo sapiens
ccaggcggtcactgccc

SEQ ID NO: 1945164 - DNA, 19 bp, Homo sapiens
ccaggcggtcactgcccac

SEQ ID NO: 1945165 - DNA, 18 bp, Homo sapiens
ccaggctcaggctgccca

SEQ ID NO: 1945166 - DNA, 18 bp, Homo sapiens
ccaggctgcagggacagt

SEQ ID NO: 1945167 - DNA, 20 bp, Homo sapiens
ccagggaccagcccagcctg

SEQ ID NO: 1945168 - DNA, 20 bp, Homo sapiens
ccagggttaaagaaaggcag

SEQ ID NO: 1945169 - DNA, 16 bp, Homo sapiens
ccagggttgaccccag

SEQ ID NO: 1945170 - DNA, 18 bp, Homo sapiens
ccagggttgaccccagag

SEQ ID NO: 1945171 - DNA, 19 bp, Homo sapiens
ccaggtgcacagacgtccc

SEQ ID NO: 1945172 - DNA, 22 bp, Homo sapiens
ccaggtgctacacccttttcca

SEQ ID NO: 1945173 - DNA, 22 bp, Homo sapiens
ccagtgtctaccttcattttct

SEQ ID NO: 1945174 - DNA, 17 bp, Homo sapiens
ccagtgttagggaaggg

SEQ ID NO: 1945175 - DNA, 13 bp, Homo sapiens
ccagttctctttg

SEQ ID NO: 1945176 - DNA, 18 bp, Homo sapiens
ccatcaacaaaaattgtc

SEQ ID NO: 1945177 - DNA, 12 bp, Homo sapiens
ccatcagtgctc

SEQ ID NO: 1945178 - DNA, 19 bp, Homo sapiens
ccatctccgctgttttggg

SEQ ID NO: 1945179 - DNA, 15 bp, Homo sapiens
ccatctgtaaatatc

SEQ ID NO: 1945180 - DNA, 13 bp, Homo sapiens
ccatgaaaaacag

SEQ ID NO: 1945181 - DNA, 17 bp, Homo sapiens
ccatgaaaaacagcaga

SEQ ID NO: 1945182 - DNA, 23 bp, Homo sapiens
ccatgattttggccactttgcag

SEQ ID NO: 1945183 - DNA, 21 bp, Homo sapiens
ccatggatgtttcttctttga

SEQ ID NO: 1945184 - DNA, 21 bp, Homo sapiens
ccatgggaaatgtcaacaagt

SEQ ID NO: 1945185 - DNA, 14 bp, Homo sapiens
ccatgggcagagcc

SEQ ID NO: 1945186 - DNA, 14 bp, Homo sapiens
ccatgggctgctgg

SEQ ID NO: 1945187 - DNA, 14 bp, Homo sapiens
ccatggtgcagtga

SEQ ID NO: 1945188 - DNA, 21 bp, Homo sapiens
ccatggtggtttcagaaaggg

SEQ ID NO: 1945189 - DNA, 15 bp, Homo sapiens
ccatgtagaaaattt

SEQ ID NO: 1945190 - DNA, 19 bp, Homo sapiens
ccatgtagaagagggagaa

SEQ ID NO: 1945191 - DNA, 20 bp, Homo sapiens
ccatgtagaagagggagaag

SEQ ID NO: 1945192 - DNA, 21 bp, Homo sapiens
ccatgtagaagagggagaagg

SEQ ID NO: 1945193 - DNA, 17 bp, Homo sapiens
ccattcacaacacaatc

SEQ ID NO: 1945194 - DNA, 19 bp, Homo sapiens
ccattgacaaggtgtttct

SEQ ID NO: 1945195 - DNA, 20 bp, Homo sapiens
ccattggttaatctggactt

SEQ ID NO: 1945196 - DNA, 19 bp, Homo sapiens
ccattgtccaatcctatgt

SEQ ID NO: 1945197 - DNA, 21 bp, Homo sapiens
cccaaggaagaacaaatatga

SEQ ID NO: 1945198 - DNA, 21 bp, Homo sapiens
cccaaggtggtcttggagagg

SEQ ID NO: 1945199 - DNA, 23 bp, Homo sapiens
cccaaggtggtcttggagaggag

SEQ ID NO: 1945200 - DNA, 14 bp, Homo sapiens
cccacacaccccaa

SEQ ID NO: 1945201 - DNA, 23 bp, Homo sapiens
cccacagagtgccatccctgaga

SEQ ID NO: 1945202 - DNA, 16 bp, Homo sapiens
cccacaggcccttcct

SEQ ID NO: 1945203 - DNA, 19 bp, Homo sapiens
cccacatagtgatggttcc

SEQ ID NO: 1945204 - DNA, 17 bp, Homo sapiens
cccaccacacacaccct

SEQ ID NO: 1945205 - DNA, 13 bp, Homo sapiens
cccacggccactg

SEQ ID NO: 1945206 - DNA, 14 bp, Homo sapiens
cccacggccactgc

SEQ ID NO: 1945207 - DNA, 18 bp, Homo sapiens
cccacggccactgcagtc

SEQ ID NO: 1945208 - DNA, 20 bp, Homo sapiens
cccacggccactgcagtcac

SEQ ID NO: 1945209 - DNA, 14 bp, Homo sapiens
cccacgtcctgggt

SEQ ID NO: 1945210 - DNA, 14 bp, Homo sapiens
cccagccctcatcc

SEQ ID NO: 1945211 - DNA, 15 bp, Homo sapiens
cccagccctcatccc

SEQ ID NO: 1945212 - DNA, 16 bp, Homo sapiens
cccagccctcatcccg

SEQ ID NO: 1945213 - DNA, 13 bp, Homo sapiens
cccagcctggagc

SEQ ID NO: 1945214 - DNA, 14 bp, Homo sapiens
cccagcgccctcta

SEQ ID NO: 1945215 - DNA, 16 bp, Homo sapiens
cccagcggctcttcct

SEQ ID NO: 1945216 - DNA, 17 bp, Homo sapiens
cccagcggctcttcctg

SEQ ID NO: 1945217 - DNA, 19 bp, Homo sapiens
cccagctcctcttcctgcc

SEQ ID NO: 1945218 - DNA, 13 bp, Homo sapiens
cccagcttggagt

SEQ ID NO: 1945219 - DNA, 17 bp, Homo sapiens
cccagcttggagtgcca

SEQ ID NO: 1945220 - DNA, 17 bp, Homo sapiens
cccaggaattctcacag

SEQ ID NO: 1945221 - DNA, 19 bp, Homo sapiens
cccaggagaagtcccacca

SEQ ID NO: 1945222 - DNA, 19 bp, Homo sapiens
cccaggaggacctgggggg

SEQ ID NO: 1945223 - DNA, 21 bp, Homo sapiens
cccaggcattgccaagggctt

SEQ ID NO: 1945224 - DNA, 15 bp, Homo sapiens
cccaggccgaggaag

SEQ ID NO: 1945225 - DNA, 21 bp, Homo sapiens
cccaggctcaggctgcccagc

SEQ ID NO: 1945226 - DNA, 16 bp, Homo sapiens
cccagggagctctgca

SEQ ID NO: 1945227 - DNA, 21 bp, Homo sapiens
cccagtcatgacatttctcaa

SEQ ID NO: 1945228 - DNA, 17 bp, Homo sapiens
cccagtctgttccccat

SEQ ID NO: 1945229 - DNA, 15 bp, Homo sapiens
cccatcagcagcttg

SEQ ID NO: 1945230 - DNA, 12 bp, Homo sapiens
cccatctcactt

SEQ ID NO: 1945231 - DNA, 18 bp, Homo sapiens
cccatggatgtttcttct

SEQ ID NO: 1945232 - DNA, 21 bp, Homo sapiens
cccattactcaaaatgcagga

SEQ ID NO: 1945233 - DNA, 14 bp, Homo sapiens
cccattcctgggaa

SEQ ID NO: 1945234 - DNA, 16 bp, Homo sapiens
cccatttgtgtttcag

SEQ ID NO: 1945235 - DNA, 17 bp, Homo sapiens
ccccaccacacacaccc

SEQ ID NO: 1945236 - DNA, 18 bp, Homo sapiens
ccccaccacacacaccct

SEQ ID NO: 1945237 - DNA, 17 bp, Homo sapiens
ccccacctccctgcagc

SEQ ID NO: 1945238 - DNA, 19 bp, Homo sapiens
ccccagctcctcttcctgc

SEQ ID NO: 1945239 - DNA, 20 bp, Homo sapiens
ccccatcagtgctccctcac

SEQ ID NO: 1945240 - DNA, 19 bp, Homo sapiens
cccccacctccctgcagct

SEQ ID NO: 1945241 - DNA, 11 bp, Homo sapiens
cccccagccct

SEQ ID NO: 1945242 - DNA, 17 bp, Homo sapiens
cccccatgggctgctgg

SEQ ID NO: 1945243 - DNA, 13 bp, Homo sapiens
cccccctccccaa

SEQ ID NO: 1945244 - DNA, 12 bp, Homo sapiens
ccccccttccca

SEQ ID NO: 1945245 - DNA, 12 bp, Homo sapiens
ccccctccccaa

SEQ ID NO: 1945246 - DNA, 12 bp, Homo sapiens
ccccctctgtcc

SEQ ID NO: 1945247 - DNA, 21 bp, Homo sapiens
ccccctgtccttcccacggcc

SEQ ID NO: 1945248 - DNA, 12 bp, Homo sapiens
ccccctgtgcag

SEQ ID NO: 1945249 - DNA, 14 bp, Homo sapiens
ccccgtcggaatgg

SEQ ID NO: 1945250 - DNA, 23 bp, Homo sapiens
cccctccaatcccaccaaccctc

SEQ ID NO: 1945251 - DNA, 12 bp, Homo sapiens
cccctccagacc

SEQ ID NO: 1945252 - DNA, 14 bp, Homo sapiens
cccctccagacccc

SEQ ID NO: 1945253 - DNA, 20 bp, Homo sapiens
cccctccagacccctaccct

SEQ ID NO: 1945254 - DNA, 12 bp, Homo sapiens
cccctccccatg

SEQ ID NO: 1945255 - DNA, 15 bp, Homo sapiens
cccctcccttcaacc

SEQ ID NO: 1945256 - DNA, 21 bp, Homo sapiens
cccctcctccagagcctgggc

SEQ ID NO: 1945257 - DNA, 16 bp, Homo sapiens
cccctccttctcccct

SEQ ID NO: 1945258 - DNA, 21 bp, Homo sapiens
cccctccttgccgctgggaga

SEQ ID NO: 1945259 - DNA, 12 bp, Homo sapiens
cccctctgtcca

SEQ ID NO: 1945260 - DNA, 22 bp, Homo sapiens
cccctctgtccaggcactgaga

SEQ ID NO: 1945261 - DNA, 18 bp, Homo sapiens
cccctgaactggccccag

SEQ ID NO: 1945262 - DNA, 22 bp, Homo sapiens
cccctggcttttcactgctggc

SEQ ID NO: 1945263 - DNA, 20 bp, Homo sapiens
cccctgtccttcccacggcc

SEQ ID NO: 1945264 - DNA, 19 bp, Homo sapiens
cccctgtctgcgccgctgt

SEQ ID NO: 1945265 - DNA, 23 bp, Homo sapiens
cccctgtctgcgccgctgtgctg

SEQ ID NO: 1945266 - DNA, 14 bp, Homo sapiens
cccgaatcctgagg

SEQ ID NO: 1945267 - DNA, 14 bp, Homo sapiens
cccgacagcctggc

SEQ ID NO: 1945268 - DNA, 19 bp, Homo sapiens
cccgagccccctgtccttc

SEQ ID NO: 1945269 - DNA, 16 bp, Homo sapiens
cccgccatggccgtgt

SEQ ID NO: 1945270 - DNA, 18 bp, Homo sapiens
cccggaggggcctggcag

SEQ ID NO: 1945271 - DNA, 20 bp, Homo sapiens
cccgggcactgtcatgccca

SEQ ID NO: 1945272 - DNA, 22 bp, Homo sapiens
cccgggcactgtcatgcccagc

SEQ ID NO: 1945273 - DNA, 18 bp, Homo sapiens
cccgtccctttccctgca

SEQ ID NO: 1945274 - DNA, 17 bp, Homo sapiens
cccgtttccaagcctgg

SEQ ID NO: 1945275 - DNA, 15 bp, Homo sapiens
ccctacaactccagc

SEQ ID NO: 1945276 - DNA, 15 bp, Homo sapiens
cctccaaggactcta

SEQ ID NO: 1945277 - DNA, 14 bp, Homo sapiens
cctccacacctcca

SEQ ID NO: 1945278 - DNA, 15 bp, Homo sapiens
cctccacacctccac

SEQ ID NO: 1945279 - DNA, 13 bp, Homo sapiens
cctccactcctcc

SEQ ID NO: 1945280 - DNA, 14 bp, Homo sapiens
cctccactcctccc

SEQ ID NO: 1945281 - DNA, 15 bp, Homo sapiens
cctccagagcctggg

SEQ ID NO: 1945282 - DNA, 16 bp, Homo sapiens
cctcccaactctggcc

SEQ ID NO: 1945283 - DNA, 14 bp, Homo sapiens
cctcccaggcgccc

SEQ ID NO: 1945284 - DNA, 22 bp, Homo sapiens
cctccccatggtgcagtgaaga

SEQ ID NO: 1945285 - DNA, 17 bp, Homo sapiens
cctccctccctgcaggg

SEQ ID NO: 1945286 - DNA, 11 bp, Homo sapiens
cctccctgcag

SEQ ID NO: 1945287 - DNA, 14 bp, Homo sapiens
cctccctgcagctt

SEQ ID NO: 1945288 - DNA, 12 bp, Homo sapiens
cctccctgcagg

SEQ ID NO: 1945289 - DNA, 24 bp, Homo sapiens
cctccctgcccctcccttcaacca

SEQ ID NO: 1945290 - DNA, 11 bp, Homo sapiens
cctccctgtcc

SEQ ID NO: 1945291 - DNA, 15 bp, Homo sapiens
cctccctgtcccctg

SEQ ID NO: 1945292 - DNA, 13 bp, Homo sapiens
cctcctcctcctg

SEQ ID NO: 1945293 - DNA, 14 bp, Homo sapiens
cctcctcctcctgt

SEQ ID NO: 1945294 - DNA, 14 bp, Homo sapiens
cctcctcctgttcc

SEQ ID NO: 1945295 - DNA, 15 bp, Homo sapiens
cctcctcctgttcct

SEQ ID NO: 1945296 - DNA, 15 bp, Homo sapiens
cctcctctgtcctca

SEQ ID NO: 1945297 - DNA, 12 bp, Homo sapiens
cctcctgagaaa

SEQ ID NO: 1945298 - DNA, 18 bp, Homo sapiens
cctcctgttcctgccttc

SEQ ID NO: 1945299 - DNA, 15 bp, Homo sapiens
cctccttctcccctc

SEQ ID NO: 1945300 - DNA, 21 bp, Homo sapiens
cctccttctcccctccagacc

SEQ ID NO: 1945301 - DNA, 20 bp, Homo sapiens
cctccttgccgctgggagag

SEQ ID NO: 1945302 - DNA, 21 bp, Homo sapiens
cctcgcatccgcctctgagcc

SEQ ID NO: 1945303 - DNA, 17 bp, Homo sapiens
cctcgctggactctcag

SEQ ID NO: 1945304 - DNA, 13 bp, Homo sapiens
cctcggcagctcc

SEQ ID NO: 1945305 - DNA, 13 bp, Homo sapiens
cctcggctgtgtg

SEQ ID NO: 1945306 - DNA, 23 bp, Homo sapiens
cctcgtcccgagggcgcctgggt

SEQ ID NO: 1945307 - DNA, 12 bp, Homo sapiens
cctctaattaaa

SEQ ID NO: 1945308 - DNA, 21 bp, Homo sapiens
cctctaattaaaatgtgcagt

SEQ ID NO: 1945309 - DNA, 18 bp, Homo sapiens
cctctacagagcttccct

SEQ ID NO: 1945310 - DNA, 20 bp, Homo sapiens
cctctacagagcttccctga

SEQ ID NO: 1945311 - DNA, 23 bp, Homo sapiens
cctctcccaaataaactccttaa

SEQ ID NO: 1945312 - DNA, 16 bp, Homo sapiens
cctctcggctggaaga

SEQ ID NO: 1945313 - DNA, 10 bp, Homo sapiens
cctctctctc

SEQ ID NO: 1945314 - DNA, 15 bp, Homo sapiens
cctctctctccctcc

SEQ ID NO: 1945315 - DNA, 17 bp, Homo sapiens
cctctctctccctccac

SEQ ID NO: 1945316 - DNA, 21 bp, Homo sapiens
cctctctctccctccactcct

SEQ ID NO: 1945317 - DNA, 12 bp, Homo sapiens
cctctctgctct

SEQ ID NO: 1945318 - DNA, 13 bp, Homo sapiens
cctctctgtccaa

SEQ ID NO: 1945319 - DNA, 20 bp, Homo sapiens
cctctctgtttaccctccct

SEQ ID NO: 1945320 - DNA, 22 bp, Homo sapiens
cctctcttaccccgtccctttc

SEQ ID NO: 1945321 - DNA, 16 bp, Homo sapiens
cctctgactcagggct

SEQ ID NO: 1945322 - DNA, 21 bp, Homo sapiens
cctctgactcagggctcctgg

SEQ ID NO: 1945323 - DNA, 12 bp, Homo sapiens
cctctgccccca

SEQ ID NO: 1945324 - DNA, 17 bp, Homo sapiens
cctctgctatgtctgtg

SEQ ID NO: 1945325 - DNA, 17 bp, Homo sapiens
cctctggccctgttgtg

SEQ ID NO: 1945326 - DNA, 19 bp, Homo sapiens
cctctgtcctggcccggga

SEQ ID NO: 1945327 - DNA, 18 bp, Homo sapiens
cctctgtgaccaatgtct

SEQ ID NO: 1945328 - DNA, 20 bp, Homo sapiens
cctcttcccccttcccctgc

SEQ ID NO: 1945329 - DNA, 21 bp, Homo sapiens
cctcttcccccttcccctgcg

SEQ ID NO: 1945330 - DNA, 13 bp, Homo sapiens
cctcttctgggag

SEQ ID NO: 1945331 - DNA, 19 bp, Homo sapiens
cctctttcctgtgccagga

SEQ ID NO: 1945332 - DNA, 17 bp, Homo sapiens
cctgaaaacactgtgca

SEQ ID NO: 1945333 - DNA, 14 bp, Homo sapiens
cctgacaacttctg

SEQ ID NO: 1945334 - DNA, 19 bp, Homo sapiens
cctgacacaggggacactg

SEQ ID NO: 1945335 - DNA, 21 bp, Homo sapiens
cctgaccctgtgatgcctgac

SEQ ID NO: 1945336 - DNA, 16 bp, Homo sapiens
cctgaggttaagggga

SEQ ID NO: 1945337 - DNA, 19 bp, Homo sapiens
cctgcaaaaggactctcag

SEQ ID NO: 1945338 - DNA, 21 bp, Homo sapiens
cctgcaagtccatagctgagc

SEQ ID NO: 1945339 - DNA, 13 bp, Homo sapiens
cctgcaccctctg

SEQ ID NO: 1945340 - DNA, 17 bp, Homo sapiens
cctgcacctcattccaa

SEQ ID NO: 1945341 - DNA, 15 bp, Homo sapiens
cctgcagaccctgcc

SEQ ID NO: 1945342 - DNA, 16 bp, Homo sapiens
cctgcagaccctgcca

SEQ ID NO: 1945343 - DNA, 17 bp, Homo sapiens
cctgcagaccctgccag

SEQ ID NO: 1945344 - DNA, 19 bp, Homo sapiens
cctgcagaccctgccaggg

SEQ ID NO: 1945345 - DNA, 12 bp, Homo sapiens
cctgccacagcc

SEQ ID NO: 1945346 - DNA, 13 bp, Homo sapiens
cctgccaggctgc

SEQ ID NO: 1945347 - DNA, 14 bp, Homo sapiens
cctgccaggctgca

SEQ ID NO: 1945348 - DNA, 13 bp, Homo sapiens
cctgccccccttc

SEQ ID NO: 1945349 - DNA, 14 bp, Homo sapiens
cctgcccctccctt

SEQ ID NO: 1945350 - DNA, 14 bp, Homo sapiens
cctgcctcatgctc

SEQ ID NO: 1945351 - DNA, 15 bp, Homo sapiens
cctgcctcatgctct

SEQ ID NO: 1945352 - DNA, 14 bp, Homo sapiens
cctgccttcctcct

SEQ ID NO: 1945353 - DNA, 17 bp, Homo sapiens
cctgccttcctcctggg

SEQ ID NO: 1945354 - DNA, 22 bp, Homo sapiens
cctgccttcctcctgggccctc

SEQ ID NO: 1945355 - DNA, 14 bp, Homo sapiens
cctgccttctcttc

SEQ ID NO: 1945356 - DNA, 15 bp, Homo sapiens
cctgcgccctccctc

SEQ ID NO: 1945357 - DNA, 21 bp, Homo sapiens
cctgctgtcagaccttcttcc

SEQ ID NO: 1945358 - DNA, 16 bp, Homo sapiens
cctgctgtgggtcagt

SEQ ID NO: 1945359 - DNA, 19 bp, Homo sapiens
cctgctgtgggtcagtgtg

SEQ ID NO: 1945360 - DNA, 23 bp, Homo sapiens
cctggacagtgagagcagggctg

SEQ ID NO: 1945361 - DNA, 16 bp, Homo sapiens
cctggagaactagaga

SEQ ID NO: 1945362 - DNA, 12 bp, Homo sapiens
cctggatccagc

SEQ ID NO: 1945363 - DNA, 21 bp, Homo sapiens
cctggcagccgtgccttcagc

SEQ ID NO: 1945364 - DNA, 18 bp, Homo sapiens
cctggccccatggtcagc

SEQ ID NO: 1945365 - DNA, 19 bp, Homo sapiens
cctggcccgggagccgcag

SEQ ID NO: 1945366 - DNA, 16 bp, Homo sapiens
cctggcctggtccagg

SEQ ID NO: 1945367 - DNA, 23 bp, Homo sapiens
cctggcttttcactgctggctgc

SEQ ID NO: 1945368 - DNA, 17 bp, Homo sapiens
cctgggaaatattccct

SEQ ID NO: 1945369 - DNA, 17 bp, Homo sapiens
cctgggccactggcatc

SEQ ID NO: 1945370 - DNA, 19 bp, Homo sapiens
cctgggccactggcatctc

SEQ ID NO: 1945371 - DNA, 11 bp, Homo sapiens
cctgggccctc

SEQ ID NO: 1945372 - DNA, 16 bp, Homo sapiens
cctgggggtgccagga

SEQ ID NO: 1945373 - DNA, 20 bp, Homo sapiens
cctggggtggttggaggcct

SEQ ID NO: 1945374 - DNA, 21 bp, Homo sapiens
cctgggtggggcagggcctgg

SEQ ID NO: 1945375 - DNA, 20 bp, Homo sapiens
cctgggttttgtattctctg

SEQ ID NO: 1945376 - DNA, 21 bp, Homo sapiens
cctgggttttgtattctctga

SEQ ID NO: 1945377 - DNA, 21 bp, Homo sapiens
cctggtgctgccacacttcag

SEQ ID NO: 1945378 - DNA, 20 bp, Homo sapiens
cctgtaatcatataataaat

SEQ ID NO: 1945379 - DNA, 24 bp, Homo sapiens
cctgtacatacattgtataggcca

SEQ ID NO: 1945380 - DNA, 17 bp, Homo sapiens
cctgtcaatgtttgctt

SEQ ID NO: 1945381 - DNA, 15 bp, Homo sapiens
cctgtcctcagcttc

SEQ ID NO: 1945382 - DNA, 12 bp, Homo sapiens
cctgtctgcagg

SEQ ID NO: 1945383 - DNA, 15 bp, Homo sapiens
cctgtctgcaggcca

SEQ ID NO: 1945384 - DNA, 16 bp, Homo sapiens
cctgtctgcgccgctg

SEQ ID NO: 1945385 - DNA, 20 bp, Homo sapiens
cctgtctgcgccgctgtgct

SEQ ID NO: 1945386 - DNA, 14 bp, Homo sapiens
cctgtctttgctgt

SEQ ID NO: 1945387 - DNA, 15 bp, Homo sapiens
attcattttgcaact

SEQ ID NO: 1945388 - DNA, 17 bp, Homo sapiens
attcattttgcaacttg

SEQ ID NO: 1945389 - DNA, 20 bp, Homo sapiens
attcccatcactgctgtccc

SEQ ID NO: 1945390 - DNA, 21 bp, Homo sapiens
attccctgaattgtttgatat

SEQ ID NO: 1945391 - DNA, 22 bp, Homo sapiens
attcctgggaaatattccctag

SEQ ID NO: 1945392 - DNA, 14 bp, Homo sapiens
attctacttcagct

SEQ ID NO: 1945393 - DNA, 15 bp, Homo sapiens
attctacttcagctt

SEQ ID NO: 1945394 - DNA, 20 bp, Homo sapiens
attctcacaggttcacccag

SEQ ID NO: 1945395 - DNA, 11 bp, Homo sapiens
attctcctctc

SEQ ID NO: 1945396 - DNA, 13 bp, Homo sapiens
attctctgagctg

SEQ ID NO: 1945397 - DNA, 17 bp, Homo sapiens
attctctgtctcatcca

SEQ ID NO: 1945398 - DNA, 20 bp, Homo sapiens
attctcttttcaaacacaca

SEQ ID NO: 1945399 - DNA, 22 bp, Homo sapiens
attctcttttcaaacacacaca

SEQ ID NO: 1945400 - DNA, 23 bp, Homo sapiens
attctgaatttgtagacatactt

SEQ ID NO: 1945401 - DNA, 20 bp, Homo sapiens
attctgcaacagcctgtttg

SEQ ID NO: 1945402 - DNA, 17 bp, Homo sapiens
attcttaagcactttga

SEQ ID NO: 1945403 - DNA, 15 bp, Homo sapiens
attcttcttctcaag

SEQ ID NO: 1945404 - DNA, 18 bp, Homo sapiens
attcttggttgaggaaac

SEQ ID NO: 1945405 - DNA, 15 bp, Homo sapiens
attcttgtccacatt

SEQ ID NO: 1945406 - DNA, 20 bp, Homo sapiens
attcttgtccacattctact

SEQ ID NO: 1945407 - DNA, 21 bp, Homo sapiens
attctttcccaattcacatct

SEQ ID NO: 1945408 - DNA, 19 bp, Homo sapiens
attgaaaaaatagagcctg

SEQ ID NO: 1945409 - DNA, 22 bp, Homo sapiens
attgaaaaaatagagcctgagg

SEQ ID NO: 1945410 - DNA, 20 bp, Homo sapiens
attgaaagtggggtgttgaa

SEQ ID NO: 1945411 - DNA, 16 bp, Homo sapiens
attgagttttcagtgg

SEQ ID NO: 1945412 - DNA, 18 bp, Homo sapiens
attgatgggtgggctagt

SEQ ID NO: 1945413 - DNA, 15 bp, Homo sapiens
attgcagaagaaact

SEQ ID NO: 1945414 - DNA, 23 bp, Homo sapiens
attgcatctcccagataatgtga

SEQ ID NO: 1945415 - DNA, 14 bp, Homo sapiens
attgccaagggctt

SEQ ID NO: 1945416 - DNA, 14 bp, Homo sapiens
attgccacctctgg

SEQ ID NO: 1945417 - DNA, 19 bp, Homo sapiens
attgccatttcttcccaag

SEQ ID NO: 1945418 - DNA, 19 bp, Homo sapiens
attgctggcaaagacagaa

SEQ ID NO: 1945419 - DNA, 14 bp, Homo sapiens
attggacccttcca

SEQ ID NO: 1945420 - DNA, 18 bp, Homo sapiens
attggcttgcactttgtg

SEQ ID NO: 1945421 - DNA, 15 bp, Homo sapiens
attgggggggcttgg

SEQ ID NO: 1945422 - DNA, 15 bp, Homo sapiens
attggtaccagagcc

SEQ ID NO: 1945423 - DNA, 19 bp, Homo sapiens
attgtaactgttcttgaat

SEQ ID NO: 1945424 - DNA, 17 bp, Homo sapiens
attgtataggccatctg

SEQ ID NO: 1945425 - DNA, 14 bp, Homo sapiens
attgtgaaatttgt

SEQ ID NO: 1945426 - DNA, 17 bp, Homo sapiens
attgtgaaatttgttaa

SEQ ID NO: 1945427 - DNA, 17 bp, Homo sapiens
attgtggctgtcagcag

SEQ ID NO: 1945428 - DNA, 19 bp, Homo sapiens
attgtggctgtcagcagga

SEQ ID NO: 1945429 - DNA, 22 bp, Homo sapiens
attgttcaaagaacccccctcc

SEQ ID NO: 1945430 - DNA, 13 bp, Homo sapiens
attgtttcaattg

SEQ ID NO: 1945431 - DNA, 22 bp, Homo sapiens
attgtttcaattgcatctccca

SEQ ID NO: 1945432 - DNA, 14 bp, Homo sapiens
atttaaaatagttc

SEQ ID NO: 1945433 - DNA, 13 bp, Homo sapiens
atttaactgcctt

SEQ ID NO: 1945434 - DNA, 15 bp, Homo sapiens
atttaagataattat

SEQ ID NO: 1945435 - DNA, 22 bp, Homo sapiens
atttaatagataaagtgcctat

SEQ ID NO: 1945436 - DNA, 20 bp, Homo sapiens
atttacatgaattgcatttt

SEQ ID NO: 1945437 - DNA, 21 bp, Homo sapiens
atttacatgaattgcatttta

SEQ ID NO: 1945438 - DNA, 15 bp, Homo sapiens
atttagggcaaggag

SEQ ID NO: 1945439 - DNA, 15 bp, Homo sapiens
atttagtttgattat

SEQ ID NO: 1945440 - DNA, 15 bp, Homo sapiens
atttatatatgtatt

SEQ ID NO: 1945441 - DNA, 17 bp, Homo sapiens
atttatctgtctgagcc

SEQ ID NO: 1945442 - DNA, 16 bp, Homo sapiens
atttcatctttccaaa

SEQ ID NO: 1945443 - DNA, 24 bp, Homo sapiens
atttcctcaacgttgctccccatc

SEQ ID NO: 1945444 - DNA, 20 bp, Homo sapiens
atttctcctccatgggagaa

SEQ ID NO: 1945445 - DNA, 13 bp, Homo sapiens
atttctgtctcat

SEQ ID NO: 1945446 - DNA, 14 bp, Homo sapiens
atttgaattagtaa

SEQ ID NO: 1945447 - DNA, 23 bp, Homo sapiens
atttgaattagtaactgtatgaa

SEQ ID NO: 1945448 - DNA, 20 bp, Homo sapiens
atttgagcacacattttaat

SEQ ID NO: 1945449 - DNA, 18 bp, Homo sapiens
atttgcaactttagaaag

SEQ ID NO: 1945450 - DNA, 15 bp, Homo sapiens
atttgcaagggaaaa

SEQ ID NO: 1945451 - DNA, 22 bp, Homo sapiens
atttgcataacaattcctctac

SEQ ID NO: 1945452 - DNA, 13 bp, Homo sapiens
atttggaaaataa

SEQ ID NO: 1945453 - DNA, 21 bp, Homo sapiens
atttggagtgttccccttcca

SEQ ID NO: 1945454 - DNA, 15 bp, Homo sapiens
atttgtaactttgca

SEQ ID NO: 1945455 - DNA, 17 bp, Homo sapiens
atttgtaactttgcatg

SEQ ID NO: 1945456 - DNA, 21 bp, Homo sapiens
atttgtataacccatatctgt

SEQ ID NO: 1945457 - DNA, 17 bp, Homo sapiens
atttgtgtctgcctgcc

SEQ ID NO: 1945458 - DNA, 19 bp, Homo sapiens
atttgtgtctgcctgcctc

SEQ ID NO: 1945459 - DNA, 20 bp, Homo sapiens
atttgtgttttacagtatat

SEQ ID NO: 1945460 - DNA, 22 bp, Homo sapiens
atttgtttatccttaagaattc

SEQ ID NO: 1945461 - DNA, 13 bp, Homo sapiens
attttaattatta

SEQ ID NO: 1945462 - DNA, 13 bp, Homo sapiens
attttagaagagg

SEQ ID NO: 1945463 - DNA, 15 bp, Homo sapiens
attttagatgtttaa

SEQ ID NO: 1945464 - DNA, 18 bp, Homo sapiens
attttcaacgcagccctg

SEQ ID NO: 1945465 - DNA, 20 bp, Homo sapiens
attttcaacgcagccctgct

SEQ ID NO: 1945466 - DNA, 20 bp, Homo sapiens
attttcattggatgcagttg

SEQ ID NO: 1945467 - DNA, 17 bp, Homo sapiens
attttgcgatgtgtttt

SEQ ID NO: 1945468 - DNA, 18 bp, Homo sapiens
attttgtacgtatgaatg

SEQ ID NO: 1945469 - DNA, 17 bp, Homo sapiens
atttttaggtgtctttt

SEQ ID NO: 1945470 - DNA, 15 bp, Homo sapiens
attttttaattatta

SEQ ID NO: 1945471 - DNA, 13 bp, Homo sapiens
caaaaaatctata

SEQ ID NO: 1945472 - DNA, 19 bp, Homo sapiens
caaaaacatttgtttatcc

SEQ ID NO: 1945473 - DNA, 19 bp, Homo sapiens
caaaatatgttgatgaaaa

SEQ ID NO: 1945474 - DNA, 19 bp, Homo sapiens
caaaatgatattcaatctt

SEQ ID NO: 1945475 - DNA, 12 bp, Homo sapiens
caaacacaggca

SEQ ID NO: 1945476 - DNA, 21 bp, Homo sapiens
caaacatgaccctaaatcttg

SEQ ID NO: 1945477 - DNA, 17 bp, Homo sapiens
caaaccaggctgcaggt

SEQ ID NO: 1945478 - DNA, 15 bp, Homo sapiens
caaacctttcctgta

SEQ ID NO: 1945479 - DNA, 18 bp, Homo sapiens
caaactactgtacatttt

SEQ ID NO: 1945480 - DNA, 19 bp, Homo sapiens
caaactagggccaagccca

SEQ ID NO: 1945481 - DNA, 22 bp, Homo sapiens
caaagaaccaggaggcctggga

SEQ ID NO: 1945482 - DNA, 19 bp, Homo sapiens
caaagaacccccctcccca

SEQ ID NO: 1945483 - DNA, 16 bp, Homo sapiens
caaagatgagaagcca

SEQ ID NO: 1945484 - DNA, 13 bp, Homo sapiens
caaagcaaggaaa

SEQ ID NO: 1945485 - DNA, 22 bp, Homo sapiens
caaagcacgaaatgttattttt

SEQ ID NO: 1945486 - DNA, 15 bp, Homo sapiens
caaaggcaagcactt

SEQ ID NO: 1945487 - DNA, 18 bp, Homo sapiens
caaaggtgattttcctgt

SEQ ID NO: 1945488 - DNA, 20 bp, Homo sapiens
caaagtccaactacagccaa

SEQ ID NO: 1945489 - DNA, 15 bp, Homo sapiens
caaatagcataagtt

SEQ ID NO: 1945490 - DNA, 22 bp, Homo sapiens
caaatatgattctcctctccca

SEQ ID NO: 1945491 - DNA, 20 bp, Homo sapiens
caaatatgcactttccctag

SEQ ID NO: 1945492 - DNA, 22 bp, Homo sapiens
caaatatgcactttccctagaa

SEQ ID NO: 1945493 - DNA, 15 bp, Homo sapiens
caaatccgaaatcag

SEQ ID NO: 1945494 - DNA, 16 bp, Homo sapiens
caaattgcagaagaaa

SEQ ID NO: 1945495 - DNA, 19 bp, Homo sapiens
caaattgcttgaaagaaaa

SEQ ID NO: 1945496 - DNA, 18 bp, Homo sapiens
caacaatttctactttga

SEQ ID NO: 1945497 - DNA, 21 bp, Homo sapiens
caacactgaacctctggctag

SEQ ID NO: 1945498 - DNA, 22 bp, Homo sapiens
caacaggcgttctcagcctccg

SEQ ID NO: 1945499 - DNA, 17 bp, Homo sapiens
caacatgatacctggat

SEQ ID NO: 1945500 - DNA, 23 bp, Homo sapiens
caacatttcctcaggcaattcct

SEQ ID NO: 1945501 - DNA, 13 bp, Homo sapiens
caacatttctgcc

SEQ ID NO: 1945502 - DNA, 15 bp, Homo sapiens
caaccacctctggcc

SEQ ID NO: 1945503 - DNA, 18 bp, Homo sapiens
caaccatgagaccactgt

SEQ ID NO: 1945504 - DNA, 13 bp, Homo sapiens
caaccctcagagc

SEQ ID NO: 1945505 - DNA, 17 bp, Homo sapiens
caaccttagatgttcta

SEQ ID NO: 1945506 - DNA, 18 bp, Homo sapiens
caaccttagatgttctaa

SEQ ID NO: 1945507 - DNA, 17 bp, Homo sapiens
caaccttctgtggctca

SEQ ID NO: 1945508 - DNA, 19 bp, Homo sapiens
caaccttctgtggctcaca

SEQ ID NO: 1945509 - DNA, 20 bp, Homo sapiens
caaccttctgtggctcacag

SEQ ID NO: 1945510 - DNA, 15 bp, Homo sapiens
caacgcagccctgct

SEQ ID NO: 1945511 - DNA, 17 bp, Homo sapiens
caactacagccaaattg

SEQ ID NO: 1945512 - DNA, 19 bp, Homo sapiens
caactatgatttggaaaat

SEQ ID NO: 1945513 - DNA, 23 bp, Homo sapiens
caactccagccacccagccagga

SEQ ID NO: 1945514 - DNA, 15 bp, Homo sapiens
caactctggccttgg

SEQ ID NO: 1945515 - DNA, 14 bp, Homo sapiens
caactctttgagaa

SEQ ID NO: 1945516 - DNA, 13 bp, Homo sapiens
caacttcccaggc

SEQ ID NO: 1945517 - DNA, 15 bp, Homo sapiens
caacttcccaggccg

SEQ ID NO: 1945518 - DNA, 18 bp, Homo sapiens
caactttagaaagaaatt

SEQ ID NO: 1945519 - DNA, 23 bp, Homo sapiens
caagaagacggattatctagaga

SEQ ID NO: 1945520 - DNA, 22 bp, Homo sapiens
caagaagtgggagtgggagagg

SEQ ID NO: 1945521 - DNA, 16 bp, Homo sapiens
caagagctcaggagaa

SEQ ID NO: 1945522 - DNA, 15 bp, Homo sapiens
caagagggcactggt

SEQ ID NO: 1945523 - DNA, 16 bp, Homo sapiens
atcttgaattgtaact

SEQ ID NO: 1945524 - DNA, 17 bp, Homo sapiens
atgaataaagacaccta

SEQ ID NO: 1945525 - DNA, 17 bp, Homo sapiens
atgaatgatatctttga

SEQ ID NO: 1945526 - DNA, 18 bp, Homo sapiens
atgacatttatttttcat

SEQ ID NO: 1945527 - DNA, 17 bp, Homo sapiens
atgacatttctcaaagt

SEQ ID NO: 1945528 - DNA, 19 bp, Homo sapiens
atgacctccttagaaaaga

SEQ ID NO: 1945529 - DNA, 22 bp, Homo sapiens
atgagatctaggtgaggattga

SEQ ID NO: 1945530 - DNA, 20 bp, Homo sapiens
atgaggatgcagagtcagca

SEQ ID NO: 1945531 - DNA, 21 bp, Homo sapiens
atgaggatgcagagtcagcag

SEQ ID NO: 1945532 - DNA, 19 bp, Homo sapiens
atgatacttattcaaaaaa

SEQ ID NO: 1945533 - DNA, 20 bp, Homo sapiens
atgatattcaatcttaacaa

SEQ ID NO: 1945534 - DNA, 15 bp, Homo sapiens
atgatcctaatgaat

SEQ ID NO: 1945535 - DNA, 16 bp, Homo sapiens
atgattcagtgttaaa

SEQ ID NO: 1945536 - DNA, 22 bp, Homo sapiens
atgattccttgatggagatatt

SEQ ID NO: 1945537 - DNA, 16 bp, Homo sapiens
atgattctcctctccc

SEQ ID NO: 1945538 - DNA, 14 bp, Homo sapiens
atgatttcatttca

SEQ ID NO: 1945539 - DNA, 18 bp, Homo sapiens
atgatttgcaactttaga

SEQ ID NO: 1945540 - DNA, 19 bp, Homo sapiens
atgatttgcaactttagaa

SEQ ID NO: 1945541 - DNA, 15 bp, Homo sapiens
atgattttggccact

SEQ ID NO: 1945542 - DNA, 17 bp, Homo sapiens
atgcagagtcagcagaa

SEQ ID NO: 1945543 - DNA, 17 bp, Homo sapiens
atgcagcatctaagtaa

SEQ ID NO: 1945544 - DNA, 18 bp, Homo sapiens
atgcatctgtggcctggg

SEQ ID NO: 1945545 - DNA, 19 bp, Homo sapiens
atgcatctgtggcctgggg

SEQ ID NO: 1945546 - DNA, 13 bp, Homo sapiens
atgccacctgcag

SEQ ID NO: 1945547 - DNA, 16 bp, Homo sapiens
atgccatcatctcctg

SEQ ID NO: 1945548 - DNA, 23 bp, Homo sapiens
atgcccagcttggagtgccacgt

SEQ ID NO: 1945549 - DNA, 21 bp, Homo sapiens
atgcctgacacaggggacact

SEQ ID NO: 1945550 - DNA, 16 bp, Homo sapiens
atgcctgcggagttgt

SEQ ID NO: 1945551 - DNA, 18 bp, Homo sapiens
atgcgggctgggcagctg

SEQ ID NO: 1945552 - DNA, 19 bp, Homo sapiens
atgcgggctgggcagctgt

SEQ ID NO: 1945553 - DNA, 17 bp, Homo sapiens
atgcgtaaatcaacttg

SEQ ID NO: 1945554 - DNA, 15 bp, Homo sapiens
atgctccttgggccc

SEQ ID NO: 1945555 - DNA, 16 bp, Homo sapiens
atgctccttgggccct

SEQ ID NO: 1945556 - DNA, 23 bp, Homo sapiens
atgctggtcaagccccctttgat

SEQ ID NO: 1945557 - DNA, 15 bp, Homo sapiens
atgcttctgctcaca

SEQ ID NO: 1945558 - DNA, 17 bp, Homo sapiens
atgcttctgctcacatt

SEQ ID NO: 1945559 - DNA, 19 bp, Homo sapiens
atgcttctgctcacattcc

SEQ ID NO: 1945560 - DNA, 23 bp, Homo sapiens
atgcttctgctcacattccctct

SEQ ID NO: 1945561 - DNA, 15 bp, Homo sapiens
atggaaagggtgtgg

SEQ ID NO: 1945562 - DNA, 16 bp, Homo sapiens
atggaaagggtgtggc

SEQ ID NO: 1945563 - DNA, 20 bp, Homo sapiens
atggaaagggtgtggcttgg

SEQ ID NO: 1945564 - DNA, 21 bp, Homo sapiens
atggaaagggtgtggcttgga

SEQ ID NO: 1945565 - DNA, 19 bp, Homo sapiens
atggaggcacacagctgca

SEQ ID NO: 1945566 - DNA, 19 bp, Homo sapiens
atggcccagcctggagccg

SEQ ID NO: 1945567 - DNA, 21 bp, Homo sapiens
atggccgcaacttcccaggcc

SEQ ID NO: 1945568 - DNA, 18 bp, Homo sapiens
atggcttgtagggtgagg

SEQ ID NO: 1945569 - DNA, 19 bp, Homo sapiens
atgggaaggagggaggtat

SEQ ID NO: 1945570 - DNA, 17 bp, Homo sapiens
atgggagccgggtctgc

SEQ ID NO: 1945571 - DNA, 23 bp, Homo sapiens
atgggaggctcacccccttctcc

SEQ ID NO: 1945572 - DNA, 15 bp, Homo sapiens
atgggagtaagagca

SEQ ID NO: 1945573 - DNA, 18 bp, Homo sapiens
atgggatggtggagggcc

SEQ ID NO: 1945574 - DNA, 14 bp, Homo sapiens
atgggcagagccca

SEQ ID NO: 1945575 - DNA, 18 bp, Homo sapiens
atggtcagccctagggtg

SEQ ID NO: 1945576 - DNA, 19 bp, Homo sapiens
atggtccaggagaaggcca

SEQ ID NO: 1945577 - DNA, 17 bp, Homo sapiens
atggtgagaattaaaat

SEQ ID NO: 1945578 - DNA, 16 bp, Homo sapiens
atggtgatgaaatgta

SEQ ID NO: 1945579 - DNA, 13 bp, Homo sapiens
atggtgcagtgaa

SEQ ID NO: 1945580 - DNA, 19 bp, Homo sapiens
atggtgggctccagagtag

SEQ ID NO: 1945581 - DNA, 20 bp, Homo sapiens
atggtgtgccacaggctgca

SEQ ID NO: 1945582 - DNA, 18 bp, Homo sapiens
atggttgggacaatggca

SEQ ID NO: 1945583 - DNA, 20 bp, Homo sapiens
atgtaaattattgtaaactt

SEQ ID NO: 1945584 - DNA, 15 bp, Homo sapiens
atgtaatcaatgttt

SEQ ID NO: 1945585 - DNA, 21 bp, Homo sapiens
atgtaccatgtacatgaagaa

SEQ ID NO: 1945586 - DNA, 13 bp, Homo sapiens
atgtactttatat

SEQ ID NO: 1945587 - DNA, 14 bp, Homo sapiens
atgtagaagaggga

SEQ ID NO: 1945588 - DNA, 20 bp, Homo sapiens
atgtagaagagggagaagga

SEQ ID NO: 1945589 - DNA, 21 bp, Homo sapiens
atgtagaagagggagaaggag

SEQ ID NO: 1945590 - DNA, 23 bp, Homo sapiens
atgtcaaccttgtgtgagtgtga

SEQ ID NO: 1945591 - DNA, 16 bp, Homo sapiens
atgtcagtagtgcctg

SEQ ID NO: 1945592 - DNA, 17 bp, Homo sapiens
atgtcagtagtgcctgt

SEQ ID NO: 1945593 - DNA, 16 bp, Homo sapiens
atgtgagcatgaaact

SEQ ID NO: 1945594 - DNA, 17 bp, Homo sapiens
atgtgatgaatactgta

SEQ ID NO: 1945595 - DNA, 18 bp, Homo sapiens
atgtgcccagtcatgaca

SEQ ID NO: 1945596 - DNA, 14 bp, Homo sapiens
atgtgcccccagac

SEQ ID NO: 1945597 - DNA, 17 bp, Homo sapiens
atgtgtttataattgtt

SEQ ID NO: 1945598 - DNA, 21 bp, Homo sapiens
atgtgtttataattgttatac

SEQ ID NO: 1945599 - DNA, 19 bp, Homo sapiens
atgttattttttaattatt

SEQ ID NO: 1945600 - DNA, 22 bp, Homo sapiens
atgttcacttttgacaaaggca

SEQ ID NO: 1945601 - DNA, 18 bp, Homo sapiens
atgttccatcctgtacaa

SEQ ID NO: 1945602 - DNA, 19 bp, Homo sapiens
atgttcttgttttgttata

SEQ ID NO: 1945603 - DNA, 16 bp, Homo sapiens
atgttgaagtcaaatt

SEQ ID NO: 1945604 - DNA, 14 bp, Homo sapiens
atgttgaatgtttg

SEQ ID NO: 1945605 - DNA, 14 bp, Homo sapiens
atgttgacctttga

SEQ ID NO: 1945606 - DNA, 20 bp, Homo sapiens
atgtttaatatctgactgaa

SEQ ID NO: 1945607 - DNA, 18 bp, Homo sapiens
atgtttacactctttgta

SEQ ID NO: 1945608 - DNA, 19 bp, Homo sapiens
atgtttacactctttgtaa

SEQ ID NO: 1945609 - DNA, 13 bp, Homo sapiens
atgtttggaattt

SEQ ID NO: 1945610 - DNA, 18 bp, Homo sapiens
atgtttggaatttaagaa

SEQ ID NO: 1945611 - DNA, 16 bp, Homo sapiens
atgttttaatatccta

SEQ ID NO: 1945612 - DNA, 15 bp, Homo sapiens
attaaaaacacctaa

SEQ ID NO: 1945613 - DNA, 22 bp, Homo sapiens
attaacaggtctttgaaatatg

SEQ ID NO: 1945614 - DNA, 23 bp, Homo sapiens
attaagctaatggtcctgttatg

SEQ ID NO: 1945615 - DNA, 14 bp, Homo sapiens
attaattattgaaa

SEQ ID NO: 1945616 - DNA, 14 bp, Homo sapiens
attaattcaattaa

SEQ ID NO: 1945617 - DNA, 16 bp, Homo sapiens
attacaatttctttaa

SEQ ID NO: 1945618 - DNA, 20 bp, Homo sapiens
attacagaagaagctcctga

SEQ ID NO: 1945619 - DNA, 17 bp, Homo sapiens
attacagggaagaaatc

SEQ ID NO: 1945620 - DNA, 19 bp, Homo sapiens
attacagggaagaaatcaa

SEQ ID NO: 1945621 - DNA, 21 bp, Homo sapiens
attacagggaagaaatcaagt

SEQ ID NO: 1945622 - DNA, 13 bp, Homo sapiens
attacctcctgag

SEQ ID NO: 1945623 - DNA, 15 bp, Homo sapiens
attacttttctgcaa

SEQ ID NO: 1945624 - DNA, 13 bp, Homo sapiens
attacttttgtaa

SEQ ID NO: 1945625 - DNA, 16 bp, Homo sapiens
attacttttgtaaata

SEQ ID NO: 1945626 - DNA, 23 bp, Homo sapiens
attagagtgtctttccacggagc

SEQ ID NO: 1945627 - DNA, 18 bp, Homo sapiens
attattaaatcagaatct

SEQ ID NO: 1945628 - DNA, 15 bp, Homo sapiens
attattattcttcat

SEQ ID NO: 1945629 - DNA, 11 bp, Homo sapiens
attatttcaga

SEQ ID NO: 1945630 - DNA, 19 bp, Homo sapiens
attcaaaaacatggccaca

SEQ ID NO: 1945631 - DNA, 13 bp, Homo sapiens
attcaataagcat

SEQ ID NO: 1945632 - DNA, 17 bp, Homo sapiens
attcacttgtgtttgta

SEQ ID NO: 1945633 - DNA, 14 bp, Homo sapiens
attcaggaatgggc

SEQ ID NO: 1945634 - DNA, 14 bp, Homo sapiens
attcattttgcaac

SEQ ID NO: 1945635 - DNA, 22 bp, Homo sapiens
agaggaggtgtggagtggaggg

SEQ ID NO: 1945636 - DNA, 16 bp, Homo sapiens
agaggagtgcgctaga

SEQ ID NO: 1945637 - DNA, 17 bp, Homo sapiens
agaggcagtggcagcaa

SEQ ID NO: 1945638 - DNA, 22 bp, Homo sapiens
agaggctctgaaagctgcttct

SEQ ID NO: 1945639 - DNA, 23 bp, Homo sapiens
agaggctctgaaagctgcttctg

SEQ ID NO: 1945640 - DNA, 15 bp, Homo sapiens
agagggacgcctggg

SEQ ID NO: 1945641 - DNA, 19 bp, Homo sapiens
agagggagaaggagaggct

SEQ ID NO: 1945642 - DNA, 16 bp, Homo sapiens
agagggcactctgctt

SEQ ID NO: 1945643 - DNA, 22 bp, Homo sapiens
agaggggacttggataggagct

SEQ ID NO: 1945644 - DNA, 21 bp, Homo sapiens
agaggggctgaatagcagaag

SEQ ID NO: 1945645 - DNA, 12 bp, Homo sapiens
agaggtcttttt

SEQ ID NO: 1945646 - DNA, 14 bp, Homo sapiens
agaggtgagggaag

SEQ ID NO: 1945647 - DNA, 18 bp, Homo sapiens
agagtaaatattgtcaca

SEQ ID NO: 1945648 - DNA, 15 bp, Homo sapiens
agagtagacatcccc

SEQ ID NO: 1945649 - DNA, 13 bp, Homo sapiens
agagtgcaacagt

SEQ ID NO: 1945650 - DNA, 22 bp, Homo sapiens
agagtgcaacagtagcatagga

SEQ ID NO: 1945651 - DNA, 17 bp, Homo sapiens
agagtgccatccctgag

SEQ ID NO: 1945652 - DNA, 18 bp, Homo sapiens
agagtgccatccctgaga

SEQ ID NO: 1945653 - DNA, 22 bp, Homo sapiens
agagtggatctggagtctgaag

SEQ ID NO: 1945654 - DNA, 14 bp, Homo sapiens
agagtggctcctcc

SEQ ID NO: 1945655 - DNA, 23 bp, Homo sapiens
agagtggctcctcccggtgccca

SEQ ID NO: 1945656 - DNA, 18 bp, Homo sapiens
agataattctagctttga

SEQ ID NO: 1945657 - DNA, 18 bp, Homo sapiens
agatacagaactctttca

SEQ ID NO: 1945658 - DNA, 22 bp, Homo sapiens
agatatgtattacttttctgca

SEQ ID NO: 1945659 - DNA, 12 bp, Homo sapiens
agatcatgaaga

SEQ ID NO: 1945660 - DNA, 16 bp, Homo sapiens
agatcttgagcaaggc

SEQ ID NO: 1945661 - DNA, 17 bp, Homo sapiens
agatcttgagcaaggca

SEQ ID NO: 1945662 - DNA, 14 bp, Homo sapiens
agatgacccctccc

SEQ ID NO: 1945663 - DNA, 16 bp, Homo sapiens
agatgcagctggatgg

SEQ ID NO: 1945664 - DNA, 15 bp, Homo sapiens
agatgctccttgggc

SEQ ID NO: 1945665 - DNA, 23 bp, Homo sapiens
agatgctgactgtactcctccca

SEQ ID NO: 1945666 - DNA, 15 bp, Homo sapiens
agatgtatgcccaaa

SEQ ID NO: 1945667 - DNA, 18 bp, Homo sapiens
agatgttccatcctgtac

SEQ ID NO: 1945668 - DNA, 20 bp, Homo sapiens
agatgttctaagtctttcca

SEQ ID NO: 1945669 - DNA, 16 bp, Homo sapiens
agattagatcttttaa

SEQ ID NO: 1945670 - DNA, 19 bp, Homo sapiens
agattcatggctttaacag

SEQ ID NO: 1945671 - DNA, 21 bp, Homo sapiens
agattccagagagtggctcct

SEQ ID NO: 1945672 - DNA, 22 bp, Homo sapiens
agattccagagagtggctcctc

SEQ ID NO: 1945673 - DNA, 12 bp, Homo sapiens
agcaaatttcat

SEQ ID NO: 1945674 - DNA, 21 bp, Homo sapiens
agcaaatttcatctttccaaa

SEQ ID NO: 1945675 - DNA, 19 bp, Homo sapiens
agcaacatgaattaagaac

SEQ ID NO: 1945676 - DNA, 17 bp, Homo sapiens
agcaaggcaagaagtgg

SEQ ID NO: 1945677 - DNA, 15 bp, Homo sapiens
agcaattctcctaag

SEQ ID NO: 1945678 - DNA, 16 bp, Homo sapiens
agcacaagaagtggga

SEQ ID NO: 1945679 - DNA, 19 bp, Homo sapiens
agcacagagagggggccac

SEQ ID NO: 1945680 - DNA, 21 bp, Homo sapiens
agcaccccaccacacacaccc

SEQ ID NO: 1945681 - DNA, 12 bp, Homo sapiens
agcactgacact

SEQ ID NO: 1945682 - DNA, 21 bp, Homo sapiens
agcacttgtgggtttttgttt

SEQ ID NO: 1945683 - DNA, 19 bp, Homo sapiens
agcactttgaaaatatttc

SEQ ID NO: 1945684 - DNA, 21 bp, Homo sapiens
agcactttgaaaatatttcta

SEQ ID NO: 1945685 - DNA, 21 bp, Homo sapiens
agcagacagtgttttctggga

SEQ ID NO: 1945686 - DNA, 22 bp, Homo sapiens
agcagagtaaaattacagaaga

SEQ ID NO: 1945687 - DNA, 15 bp, Homo sapiens
agcagatatgtatta

SEQ ID NO: 1945688 - DNA, 17 bp, Homo sapiens
agcagatgacccctccc

SEQ ID NO: 1945689 - DNA, 20 bp, Homo sapiens
agcagattggagaaaccctt

SEQ ID NO: 1945690 - DNA, 16 bp, Homo sapiens
agcagctgggcactgg

SEQ ID NO: 1945691 - DNA, 23 bp, Homo sapiens
agcaggaaatgaaaatgtcttgt

SEQ ID NO: 1945692 - DNA, 15 bp, Homo sapiens
agcaggagcatggcc

SEQ ID NO: 1945693 - DNA, 14 bp, Homo sapiens
agcagggtctttgt

SEQ ID NO: 1945694 - DNA, 19 bp, Homo sapiens
agcagggtctttgtgtgct

SEQ ID NO: 1945695 - DNA, 22 bp, Homo sapiens
agcagtgaaacttgtgctatag

SEQ ID NO: 1945696 - DNA, 15 bp, Homo sapiens
agcagtgtgaggcca

SEQ ID NO: 1945697 - DNA, 21 bp, Homo sapiens
agcagtgtgaggccagggcag

SEQ ID NO: 1945698 - DNA, 14 bp, Homo sapiens
agcagtttgctttg

SEQ ID NO: 1945699 - DNA, 12 bp, Homo sapiens
agcatatgagga

SEQ ID NO: 1945700 - DNA, 18 bp, Homo sapiens
agcattcacaacttgttt

SEQ ID NO: 1945701 - DNA, 21 bp, Homo sapiens
agcattgtggctgtcagcagg

SEQ ID NO: 1945702 - DNA, 18 bp, Homo sapiens
agccaaacctttcctgta

SEQ ID NO: 1945703 - DNA, 17 bp, Homo sapiens
agccaaatcaaaatatg

SEQ ID NO: 1945704 - DNA, 18 bp, Homo sapiens
agccaaattgcagaagaa

SEQ ID NO: 1945705 - DNA, 19 bp, Homo sapiens
agccaaattgcagaagaaa

SEQ ID NO: 1945706 - DNA, 22 bp, Homo sapiens
agccaaggcctatgccacctgc

SEQ ID NO: 1945707 - DNA, 15 bp, Homo sapiens
agccacccagccagg

SEQ ID NO: 1945708 - DNA, 16 bp, Homo sapiens
agccacgtgctggaga

SEQ ID NO: 1945709 - DNA, 12 bp, Homo sapiens
agccactcctct

SEQ ID NO: 1945710 - DNA, 15 bp, Homo sapiens
agccactcctctgac

SEQ ID NO: 1945711 - DNA, 21 bp, Homo sapiens
agccactcctctgactcaggg

SEQ ID NO: 1945712 - DNA, 22 bp, Homo sapiens
agccactcctctgactcagggc

SEQ ID NO: 1945713 - DNA, 23 bp, Homo sapiens
agccagcagctgaagtctctttt

SEQ ID NO: 1945714 - DNA, 11 bp, Homo sapiens
agccaggagac

SEQ ID NO: 1945715 - DNA, 18 bp, Homo sapiens
agccaggagcctcctgac

SEQ ID NO: 1945716 - DNA, 19 bp, Homo sapiens
agccaggagcctcctgacc

SEQ ID NO: 1945717 - DNA, 19 bp, Homo sapiens
agccaggccctctctgcag

SEQ ID NO: 1945718 - DNA, 20 bp, Homo sapiens
agccaggccctctctgcagt

SEQ ID NO: 1945719 - DNA, 19 bp, Homo sapiens
agccagggttccagacagg

SEQ ID NO: 1945720 - DNA, 20 bp, Homo sapiens
agccagggttccagacaggg

SEQ ID NO: 1945721 - DNA, 12 bp, Homo sapiens
agccatattcca

SEQ ID NO: 1945722 - DNA, 14 bp, Homo sapiens
agccatattccagc

SEQ ID NO: 1945723 - DNA, 23 bp, Homo sapiens
agcccaccctgcacctcattcca

SEQ ID NO: 1945724 - DNA, 13 bp, Homo sapiens
agccccctgtcct

SEQ ID NO: 1945725 - DNA, 14 bp, Homo sapiens
agccccctgtcctt

SEQ ID NO: 1945726 - DNA, 15 bp, Homo sapiens
agccccctgtccttc

SEQ ID NO: 1945727 - DNA, 22 bp, Homo sapiens
agccccctgtccttcccacggc

SEQ ID NO: 1945728 - DNA, 23 bp, Homo sapiens
agccccctgtccttcccacggcc

SEQ ID NO: 1945729 - DNA, 19 bp, Homo sapiens
agcccctacaactccagcc

SEQ ID NO: 1945730 - DNA, 17 bp, Homo sapiens
agcccctatcctgcacc

SEQ ID NO: 1945731 - DNA, 20 bp, Homo sapiens
agcccctatcctgcaccctc

SEQ ID NO: 1945732 - DNA, 21 bp, Homo sapiens
agcccgctggagcatgagctc

SEQ ID NO: 1945733 - DNA, 16 bp, Homo sapiens
agccctagggtggaga

SEQ ID NO: 1945734 - DNA, 13 bp, Homo sapiens
agccctccctgcc

SEQ ID NO: 1945735 - DNA, 17 bp, Homo sapiens
agccctccctgcccctc

SEQ ID NO: 1945736 - DNA, 19 bp, Homo sapiens
agccctccctgcccctccc

SEQ ID NO: 1945737 - DNA, 17 bp, Homo sapiens
agccctgctttgggctg

SEQ ID NO: 1945738 - DNA, 22 bp, Homo sapiens
agccctgctttgggctgccctg

SEQ ID NO: 1945739 - DNA, 21 bp, Homo sapiens
agccgtggcttcccgctcagc

SEQ ID NO: 1945740 - DNA, 23 bp, Homo sapiens
agccgtggcttcccgctcagccc

SEQ ID NO: 1945741 - DNA, 22 bp, Homo sapiens
agcctaccggcaatttccggcc

SEQ ID NO: 1945742 - DNA, 20 bp, Homo sapiens
agcctagtgaaggcttctct

SEQ ID NO: 1945743 - DNA, 13 bp, Homo sapiens
agcctgggccact

SEQ ID NO: 1945744 - DNA, 16 bp, Homo sapiens
agcctgggccactggc

SEQ ID NO: 1945745 - DNA, 13 bp, Homo sapiens
agcctgtgggaga

SEQ ID NO: 1945746 - DNA, 15 bp, Homo sapiens
agcctgtgggagaag

SEQ ID NO: 1945747 - DNA, 23 bp, Homo sapiens
agcctgtttgggaggctggagtg

SEQ ID NO: 1945748 - DNA, 17 bp, Homo sapiens
agccttttattaacata

SEQ ID NO: 1945749 - DNA, 15 bp, Homo sapiens
agcgacacaggctgc

SEQ ID NO: 1945750 - DNA, 15 bp, Homo sapiens
agcgaggaggctcca

SEQ ID NO: 1945751 - DNA, 21 bp, Homo sapiens
agcgccaccgtgggagaggag

SEQ ID NO: 1945752 - DNA, 16 bp, Homo sapiens
agcgggtaaaaagaga

SEQ ID NO: 1945753 - DNA, 22 bp, Homo sapiens
agcgtctgagcggccgcctgtc

SEQ ID NO: 1945754 - DNA, 20 bp, Homo sapiens
agctaggttaataggaggac

SEQ ID NO: 1945755 - DNA, 20 bp, Homo sapiens
agctatgttatattgaaaaa

SEQ ID NO: 1945756 - DNA, 16 bp, Homo sapiens
agctcacacatgagat

SEQ ID NO: 1945757 - DNA, 19 bp, Homo sapiens
agctcaggagaaggcctgc

SEQ ID NO: 1945758 - DNA, 21 bp, Homo sapiens
agctcaggagaaggcctgccc

SEQ ID NO: 1945759 - DNA, 19 bp, Homo sapiens
agctcctgaatccctttca

SEQ ID NO: 1945760 - DNA, 19 bp, Homo sapiens
agctccttcctggagactg

SEQ ID NO: 1945761 - DNA, 13 bp, Homo sapiens
agctctgcattat

SEQ ID NO: 1945762 - DNA, 17 bp, Homo sapiens
agctgactggccccagg

SEQ ID NO: 1945763 - DNA, 18 bp, Homo sapiens
agctgactggccccaggg

SEQ ID NO: 1945764 - DNA, 15 bp, Homo sapiens
agctgagcagggaga

SEQ ID NO: 1945765 - DNA, 20 bp, Homo sapiens
agctgagcccctccctcctg

SEQ ID NO: 1945766 - DNA, 12 bp, Homo sapiens
agctgagctgga

SEQ ID NO: 1945767 - DNA, 18 bp, Homo sapiens
agctgcagagacagagag

SEQ ID NO: 1945768 - DNA, 19 bp, Homo sapiens
agctgcagagacagagagg

SEQ ID NO: 1945769 - DNA, 19 bp, Homo sapiens
agctgcagggaattttcat

SEQ ID NO: 1945770 - DNA, 17 bp, Homo sapiens
caagagggcactggtgg

SEQ ID NO: 1945771 - DNA, 14 bp, Homo sapiens
caagagtaaatatt

SEQ ID NO: 1945772 - DNA, 14 bp, Homo sapiens
caagatacctttgc

SEQ ID NO: 1945773 - DNA, 21 bp, Homo sapiens
caagatattttaaaatctgtc

SEQ ID NO: 1945774 - DNA, 23 bp, Homo sapiens
caagcaggaaatgaaaatgtctt

SEQ ID NO: 1945775 - DNA, 12 bp, Homo sapiens
caagccaggccc

SEQ ID NO: 1945776 - DNA, 18 bp, Homo sapiens
caagccagggttccagac

SEQ ID NO: 1945777 - DNA, 20 bp, Homo sapiens
caagccagggttccagacag

SEQ ID NO: 1945778 - DNA, 16 bp, Homo sapiens
caagccccctttgatt

SEQ ID NO: 1945779 - DNA, 14 bp, Homo sapiens
caagcctgggccac

SEQ ID NO: 1945780 - DNA, 20 bp, Homo sapiens
caagcctgggccactggcat

SEQ ID NO: 1945781 - DNA, 22 bp, Homo sapiens
caagcctgggccactggcatct

SEQ ID NO: 1945782 - DNA, 20 bp, Homo sapiens
caagcgacacaggctgccgc

SEQ ID NO: 1945783 - DNA, 13 bp, Homo sapiens
caagctgcaggga

SEQ ID NO: 1945784 - DNA, 17 bp, Homo sapiens
caagctggcaggagggt

SEQ ID NO: 1945785 - DNA, 20 bp, Homo sapiens
caagcttgtgtacttgaccg

SEQ ID NO: 1945786 - DNA, 14 bp, Homo sapiens
caaggcaagaagtg

SEQ ID NO: 1945787 - DNA, 21 bp, Homo sapiens
caaggccagtctgaacctgag

SEQ ID NO: 1945788 - DNA, 19 bp, Homo sapiens
caaggctagatcatgaaga

SEQ ID NO: 1945789 - DNA, 20 bp, Homo sapiens
caaggtgcacctgccccagg

SEQ ID NO: 1945790 - DNA, 17 bp, Homo sapiens
caaggtggtcttggaga

SEQ ID NO: 1945791 - DNA, 20 bp, Homo sapiens
caaggtggtcttggagagga

SEQ ID NO: 1945792 - DNA, 22 bp, Homo sapiens
caaggtggtcttggagaggagg

SEQ ID NO: 1945793 - DNA, 17 bp, Homo sapiens
caaggtgtttctctgta

SEQ ID NO: 1945794 - DNA, 19 bp, Homo sapiens
caagtatgaataaagacac

SEQ ID NO: 1945795 - DNA, 21 bp, Homo sapiens
caagtatgaataaagacacct

SEQ ID NO: 1945796 - DNA, 17 bp, Homo sapiens
caagtccatagctgagc

SEQ ID NO: 1945797 - DNA, 20 bp, Homo sapiens
caagtccatagctgagctgg

SEQ ID NO: 1945798 - DNA, 21 bp, Homo sapiens
caagtccatagctgagctgga

SEQ ID NO: 1945799 - DNA, 17 bp, Homo sapiens
caagtcgcggctgcagg

SEQ ID NO: 1945800 - DNA, 13 bp, Homo sapiens
caagtcttcctga

SEQ ID NO: 1945801 - DNA, 22 bp, Homo sapiens
caagttaatgtactttcattcc

SEQ ID NO: 1945802 - DNA, 18 bp, Homo sapiens
caataagcatcaaactct

SEQ ID NO: 1945803 - DNA, 19 bp, Homo sapiens
caataagcatcaaactctt

SEQ ID NO: 1945804 - DNA, 15 bp, Homo sapiens
caatactctcctaaa

SEQ ID NO: 1945805 - DNA, 19 bp, Homo sapiens
caatagcagacagtgtttt

SEQ ID NO: 1945806 - DNA, 12 bp, Homo sapiens
caatcacattca

SEQ ID NO: 1945807 - DNA, 13 bp, Homo sapiens
caatcactattct

SEQ ID NO: 1945808 - DNA, 21 bp, Homo sapiens
caatcactattcttaagcact

SEQ ID NO: 1945809 - DNA, 15 bp, Homo sapiens
caatcagctccttcc

SEQ ID NO: 1945810 - DNA, 22 bp, Homo sapiens
caatcccaccaaccctcagagc

SEQ ID NO: 1945811 - DNA, 14 bp, Homo sapiens
caatcctatgtttt

SEQ ID NO: 1945812 - DNA, 23 bp, Homo sapiens
caatctaaaaaatatcttaggtt

SEQ ID NO: 1945813 - DNA, 20 bp, Homo sapiens
caatctacgatgttaaaaca

SEQ ID NO: 1945814 - DNA, 20 bp, Homo sapiens
caatcttaacaaaagtgaac

SEQ ID NO: 1945815 - DNA, 14 bp, Homo sapiens
caatgcctgcctga

SEQ ID NO: 1945816 - DNA, 14 bp, Homo sapiens
caatggaatataaa

SEQ ID NO: 1945817 - DNA, 18 bp, Homo sapiens
caatggcaataggacaaa

SEQ ID NO: 1945818 - DNA, 21 bp, Homo sapiens
caatgtcttgatgcatgcact

SEQ ID NO: 1945819 - DNA, 17 bp, Homo sapiens
caatgtgcccagtcatg

SEQ ID NO: 1945820 - DNA, 13 bp, Homo sapiens
caatgtgccccca

SEQ ID NO: 1945821 - DNA, 21 bp, Homo sapiens
caatgttggctagtctgtgcc

SEQ ID NO: 1945822 - DNA, 22 bp, Homo sapiens
caatgttggctagtctgtgcct

SEQ ID NO: 1945823 - DNA, 13 bp, Homo sapiens
caattaaaaccat

SEQ ID NO: 1945824 - DNA, 14 bp, Homo sapiens
caattgcatctccc

SEQ ID NO: 1945825 - DNA, 17 bp, Homo sapiens
caattgcatctcccaga

SEQ ID NO: 1945826 - DNA, 14 bp, Homo sapiens
cacaaagttgttta

SEQ ID NO: 1945827 - DNA, 16 bp, Homo sapiens
cacaaataccagagca

SEQ ID NO: 1945828 - DNA, 19 bp, Homo sapiens
cacaaccttctgtggctca

SEQ ID NO: 1945829 - DNA, 23 bp, Homo sapiens
cacaaccttctgtggctcacaga

SEQ ID NO: 1945830 - DNA, 17 bp, Homo sapiens
cacaagaagtgggagtg

SEQ ID NO: 1945831 - DNA, 22 bp, Homo sapiens
cacaagaagtgggagtgggaga

SEQ ID NO: 1945832 - DNA, 23 bp, Homo sapiens
cacaagaagtgggagtgggagag

SEQ ID NO: 1945833 - DNA, 14 bp, Homo sapiens
cacacaagacagca

SEQ ID NO: 1945834 - DNA, 12 bp, Homo sapiens
cacacaagcagt

SEQ ID NO: 1945835 - DNA, 16 bp, Homo sapiens
cacacacactcttcaa

SEQ ID NO: 1945836 - DNA, 13 bp, Homo sapiens
cacacaccccaat

SEQ ID NO: 1945837 - DNA, 17 bp, Homo sapiens
cacacccttccccactc

SEQ ID NO: 1945838 - DNA, 15 bp, Homo sapiens
cacacctccacccgt

SEQ ID NO: 1945839 - DNA, 16 bp, Homo sapiens
cacactacgcagaaga

SEQ ID NO: 1945840 - DNA, 22 bp, Homo sapiens
cacactacgcagaagagaaagt

SEQ ID NO: 1945841 - DNA, 12 bp, Homo sapiens
cacactgctggg

SEQ ID NO: 1945842 - DNA, 14 bp, Homo sapiens
cacacttcaggctc

SEQ ID NO: 1945843 - DNA, 22 bp, Homo sapiens
cacacttcaggctcttctcctt

SEQ ID NO: 1945844 - DNA, 16 bp, Homo sapiens
cacagacgtccctcca

SEQ ID NO: 1945845 - DNA, 17 bp, Homo sapiens
cacagaggcagtggcag

SEQ ID NO: 1945846 - DNA, 19 bp, Homo sapiens
cacagaggcagtggcagca

SEQ ID NO: 1945847 - DNA, 21 bp, Homo sapiens
cacagagtgccatccctgaga

SEQ ID NO: 1945848 - DNA, 21 bp, Homo sapiens
cacagattttttctttaaata

SEQ ID NO: 1945849 - DNA, 21 bp, Homo sapiens
cacagccccaaacaagcgcca

SEQ ID NO: 1945850 - DNA, 15 bp, Homo sapiens
cacaggacatttctc

SEQ ID NO: 1945851 - DNA, 23 bp, Homo sapiens
cacaggacgatttcactgacact

SEQ ID NO: 1945852 - DNA, 14 bp, Homo sapiens
cacaggcagcattt

SEQ ID NO: 1945853 - DNA, 15 bp, Homo sapiens
cacaggcagcattta

SEQ ID NO: 1945854 - DNA, 22 bp, Homo sapiens
cacaggcccttcctctccactg

SEQ ID NO: 1945855 - DNA, 17 bp, Homo sapiens
cacagggacgacccggg

SEQ ID NO: 1945856 - DNA, 17 bp, Homo sapiens
cacaggggacactgaac

SEQ ID NO: 1945857 - DNA, 23 bp, Homo sapiens
cacagtgaacataactgtaacat

SEQ ID NO: 1945858 - DNA, 19 bp, Homo sapiens
cacagtgcatctcagccca

SEQ ID NO: 1945859 - DNA, 16 bp, Homo sapiens
cacatacttgagactg

SEQ ID NO: 1945860 - DNA, 21 bp, Homo sapiens
cacatagtgatggttcccctg

SEQ ID NO: 1945861 - DNA, 20 bp, Homo sapiens
cacatccaacatttcctcag

SEQ ID NO: 1945862 - DNA, 17 bp, Homo sapiens
cacatctgtgtcttgtt

SEQ ID NO: 1945863 - DNA, 12 bp, Homo sapiens
cacattctactt

SEQ ID NO: 1945864 - DNA, 19 bp, Homo sapiens
caccagggttgaccccaga

SEQ ID NO: 1945865 - DNA, 22 bp, Homo sapiens
caccagggttgaccccagagga

SEQ ID NO: 1945866 - DNA, 17 bp, Homo sapiens
caccatttggcaatgcc

SEQ ID NO: 1945867 - DNA, 17 bp, Homo sapiens
cacccagtctgttcccc

SEQ ID NO: 1945868 - DNA, 14 bp, Homo sapiens
cacccctcttcccc

SEQ ID NO: 1945869 - DNA, 20 bp, Homo sapiens
cacccctcttcccccttccc

SEQ ID NO: 1945870 - DNA, 18 bp, Homo sapiens
cacccctgaactggcccc

SEQ ID NO: 1945871 - DNA, 15 bp, Homo sapiens
caccctctgcagggc

SEQ ID NO: 1945872 - DNA, 17 bp, Homo sapiens
caccctctgcagggcag

SEQ ID NO: 1945873 - DNA, 18 bp, Homo sapiens
caccctctgcagggcagc

SEQ ID NO: 1945874 - DNA, 20 bp, Homo sapiens
caccctctgcagggcagcct

SEQ ID NO: 1945875 - DNA, 21 bp, Homo sapiens
caccctctgctatgtctgtga

SEQ ID NO: 1945876 - DNA, 11 bp, Homo sapiens
cacccttcccc

SEQ ID NO: 1945877 - DNA, 17 bp, Homo sapiens
ctccactcctcccaact

SEQ ID NO: 1945878 - DNA, 22 bp, Homo sapiens
ctcttaccccgtccctttccct

SEQ ID NO: 1945879 - DNA, 20 bp, Homo sapiens
ctcttcaagtttttttcaaa

SEQ ID NO: 1945880 - DNA, 19 bp, Homo sapiens
ctcttcaccgccgtggggt

SEQ ID NO: 1945881 - DNA, 22 bp, Homo sapiens
ttcccgctcagccctccctgcc

SEQ ID NO: 1945882 - DNA, 12 bp, Homo sapiens
ttcccgtataat

SEQ ID NO: 1945883 - DNA, 17 bp, Homo sapiens
ttcccgtataataaaac

SEQ ID NO: 1945884 - DNA, 13 bp, Homo sapiens
ttccctacgagga

SEQ ID NO: 1945885 - DNA, 22 bp, Homo sapiens
ttccctagaaagccatattcca

SEQ ID NO: 1945886 - DNA, 13 bp, Homo sapiens
ttccctctcatcc

SEQ ID NO: 1945887 - DNA, 14 bp, Homo sapiens
ttccctctgctcca

SEQ ID NO: 1945888 - DNA, 16 bp, Homo sapiens
ttccctgcatcccttg

SEQ ID NO: 1945889 - DNA, 15 bp, Homo sapiens
ttcccttgtgtctgt

SEQ ID NO: 1945890 - DNA, 17 bp, Homo sapiens
ttccctttgttgctgtc

SEQ ID NO: 1945891 - DNA, 13 bp, Homo sapiens
ttccgcttggagc

SEQ ID NO: 1945892 - DNA, 16 bp, Homo sapiens
ttccgtctcctctcca

SEQ ID NO: 1945893 - DNA, 16 bp, Homo sapiens
ttcctaataaagttct

SEQ ID NO: 1945894 - DNA, 17 bp, Homo sapiens
ttcctccctccctgcag

SEQ ID NO: 1945895 - DNA, 19 bp, Homo sapiens
ttcctcctcctcctcctgt

SEQ ID NO: 1945896 - DNA, 23 bp, Homo sapiens
ttcctcctcctcctcctgttcct

SEQ ID NO: 1945897 - DNA, 11 bp, Homo sapiens
ttcctcctggg

SEQ ID NO: 1945898 - DNA, 14 bp, Homo sapiens
ttcctctccactgc

SEQ ID NO: 1945899 - DNA, 15 bp, Homo sapiens
ttcctctccactgcc

SEQ ID NO: 1945900 - DNA, 19 bp, Homo sapiens
ttcctctccactgccttcg

SEQ ID NO: 1945901 - DNA, 12 bp, Homo sapiens
ttcctctctctc

SEQ ID NO: 1945902 - DNA, 14 bp, Homo sapiens
ttcctctctctcac

SEQ ID NO: 1945903 - DNA, 15 bp, Homo sapiens
ttcctctctctcacc

SEQ ID NO: 1945904 - DNA, 16 bp, Homo sapiens
ttcctgccttctcttc

SEQ ID NO: 1945905 - DNA, 21 bp, Homo sapiens
ttcctgggaaatattccctag

SEQ ID NO: 1945906 - DNA, 23 bp, Homo sapiens
ttcctgtccttctctcacctcct

SEQ ID NO: 1945907 - DNA, 24 bp, Homo sapiens
ttcctgtccttctctcacctccta

SEQ ID NO: 1945908 - DNA, 14 bp, Homo sapiens
ttcctgtgtccaca

SEQ ID NO: 1945909 - DNA, 23 bp, Homo sapiens
ttccttatgtatatttaaaagaa

SEQ ID NO: 1945910 - DNA, 14 bp, Homo sapiens
ttccttctcgtctt

SEQ ID NO: 1945911 - DNA, 13 bp, Homo sapiens
ttcggtgtgcacc

SEQ ID NO: 1945912 - DNA, 18 bp, Homo sapiens
ttctaaaaattgtgatca

SEQ ID NO: 1945913 - DNA, 21 bp, Homo sapiens
ttctaaatgaatgtttacact

SEQ ID NO: 1945914 - DNA, 17 bp, Homo sapiens
ttctaagtctttccatt

SEQ ID NO: 1945915 - DNA, 17 bp, Homo sapiens
ttctatatttgtaactt

SEQ ID NO: 1945916 - DNA, 22 bp, Homo sapiens
ttctatatttgtaactttgcat

SEQ ID NO: 1945917 - DNA, 23 bp, Homo sapiens
ttctatatttgtaactttgcatg

SEQ ID NO: 1945918 - DNA, 19 bp, Homo sapiens
ttctcaaagtttttacagt

SEQ ID NO: 1945919 - DNA, 20 bp, Homo sapiens
ttctcaaagtttttacagtg

SEQ ID NO: 1945920 - DNA, 23 bp, Homo sapiens
ttctcaaagtttttacagtgtat

SEQ ID NO: 1945921 - DNA, 18 bp, Homo sapiens
ttctcaagcactgacact

SEQ ID NO: 1945922 - DNA, 18 bp, Homo sapiens
ttctcactcctacctggt

SEQ ID NO: 1945923 - DNA, 13 bp, Homo sapiens
ttctcaggaagat

SEQ ID NO: 1945924 - DNA, 12 bp, Homo sapiens
ttctccactgga

SEQ ID NO: 1945925 - DNA, 16 bp, Homo sapiens
ttctcccctccagacc

SEQ ID NO: 1945926 - DNA, 19 bp, Homo sapiens
ttctcccctccagacccct

SEQ ID NO: 1945927 - DNA, 24 bp, Homo sapiens
ttctctaagagaacaatgtgctat

SEQ ID NO: 1945928 - DNA, 16 bp, Homo sapiens
ttctctgagctgtgca

SEQ ID NO: 1945929 - DNA, 13 bp, Homo sapiens
ttctcttctatcc

SEQ ID NO: 1945930 - DNA, 19 bp, Homo sapiens
ttctctttgtaaggacttg

SEQ ID NO: 1945931 - DNA, 23 bp, Homo sapiens
ttctgaaggttggaactgctgcc

SEQ ID NO: 1945932 - DNA, 23 bp, Homo sapiens
ttctgacatcttagtatttgcat

SEQ ID NO: 1945933 - DNA, 22 bp, Homo sapiens
ttctgcaatgttattattggct

SEQ ID NO: 1945934 - DNA, 20 bp, Homo sapiens
ttctgctcacattccctctc

SEQ ID NO: 1945935 - DNA, 21 bp, Homo sapiens
ttctgctcacattccctctca

SEQ ID NO: 1945936 - DNA, 19 bp, Homo sapiens
ttctgctcatcattctctg

SEQ ID NO: 1945937 - DNA, 20 bp, Homo sapiens
ttctgctcatcattctctgt

SEQ ID NO: 1945938 - DNA, 16 bp, Homo sapiens
ttctggaatgtaatca

SEQ ID NO: 1945939 - DNA, 20 bp, Homo sapiens
ttctggaatgtaatcaatgt

SEQ ID NO: 1945940 - DNA, 21 bp, Homo sapiens
ttctgggagggcagcagggct

SEQ ID NO: 1945941 - DNA, 22 bp, Homo sapiens
ttctggggtggggcttggaagg

SEQ ID NO: 1945942 - DNA, 21 bp, Homo sapiens
ttctgtaattggcttttgaat

SEQ ID NO: 1945943 - DNA, 18 bp, Homo sapiens
ttctgtactcaaatgtag

SEQ ID NO: 1945944 - DNA, 16 bp, Homo sapiens
ttctgtctcatatgat

SEQ ID NO: 1945945 - DNA, 21 bp, Homo sapiens
ttctgtgcatttgtgtctgcc

SEQ ID NO: 1945946 - DNA, 16 bp, Homo sapiens
ttctgtggctcacaga

SEQ ID NO: 1945947 - DNA, 14 bp, Homo sapiens
ttcttaagcacttt

SEQ ID NO: 1945948 - DNA, 18 bp, Homo sapiens
ttcttcataacaatttta

SEQ ID NO: 1945949 - DNA, 17 bp, Homo sapiens
ttcttgagatctgctga

SEQ ID NO: 1945950 - DNA, 23 bp, Homo sapiens
ttcttgtccacattctacttcag

SEQ ID NO: 1945951 - DNA, 23 bp, Homo sapiens
ttcttttcgccgtggctgcggca

SEQ ID NO: 1945952 - DNA, 14 bp, Homo sapiens
ttgaaaatatttct

SEQ ID NO: 1945953 - DNA, 17 bp, Homo sapiens
ttgaaaatatttctatg

SEQ ID NO: 1945954 - DNA, 21 bp, Homo sapiens
ttgaaaatatttctatgtaaa

SEQ ID NO: 1945955 - DNA, 23 bp, Homo sapiens
ttgaaagtggggtgttgaagacc

SEQ ID NO: 1945956 - DNA, 14 bp, Homo sapiens
ttgaaatatgcatg

SEQ ID NO: 1945957 - DNA, 15 bp, Homo sapiens
ttgaaatatgcatgt

SEQ ID NO: 1945958 - DNA, 14 bp, Homo sapiens
ttgaaatcaaatgt

SEQ ID NO: 1945959 - DNA, 22 bp, Homo sapiens
ttgaagaaggaggaattttaga

SEQ ID NO: 1945960 - DNA, 13 bp, Homo sapiens
ttgaagtggaaaa

SEQ ID NO: 1945961 - DNA, 21 bp, Homo sapiens
ttgacaaggtgtttctctgta

SEQ ID NO: 1945962 - DNA, 20 bp, Homo sapiens
ttgacctcaatggaggtttg

SEQ ID NO: 1945963 - DNA, 17 bp, Homo sapiens
ttgagagcgctggcctc

SEQ ID NO: 1945964 - DNA, 15 bp, Homo sapiens
ttgagcaaggcaaga

SEQ ID NO: 1945965 - DNA, 13 bp, Homo sapiens
ttgaggaaaacaa

SEQ ID NO: 1945966 - DNA, 15 bp, Homo sapiens
ttgaggacaggagag

SEQ ID NO: 1945967 - DNA, 15 bp, Homo sapiens
ttgagtgctctgatc

SEQ ID NO: 1945968 - DNA, 15 bp, Homo sapiens
ttgagtgggccccct

SEQ ID NO: 1945969 - DNA, 16 bp, Homo sapiens
ttgagtgggccccctc

SEQ ID NO: 1945970 - DNA, 17 bp, Homo sapiens
ttgagtgggccccctct

SEQ ID NO: 1945971 - DNA, 20 bp, Homo sapiens
ttaaagtcttctttcatgta

SEQ ID NO: 1945972 - DNA, 23 bp, Homo sapiens
ttaaatgagaaggaatttgagtt

SEQ ID NO: 1945973 - DNA, 23 bp, Homo sapiens
ttaagaaaacccgacaacatttc

SEQ ID NO: 1945974 - DNA, 23 bp, Homo sapiens
ttaagaaataacttgtgttacta

SEQ ID NO: 1945975 - DNA, 17 bp, Homo sapiens
ttaagagaatccacata

SEQ ID NO: 1945976 - DNA, 15 bp, Homo sapiens
ttaagataatattta

SEQ ID NO: 1945977 - DNA, 16 bp, Homo sapiens
ttaagataattataat

SEQ ID NO: 1945978 - DNA, 12 bp, Homo sapiens
ttaagcactttg

SEQ ID NO: 1945979 - DNA, 13 bp, Homo sapiens
ttaataataaaaa

SEQ ID NO: 1945980 - DNA, 13 bp, Homo sapiens
ttaatatatataa

SEQ ID NO: 1945981 - DNA, 22 bp, Homo sapiens
ttaatatatataatacttaaaa

SEQ ID NO: 1945982 - DNA, 18 bp, Homo sapiens
ttaatatcacagcataac

SEQ ID NO: 1945983 - DNA, 20 bp, Homo sapiens
ttaatgatactgtctaagaa

SEQ ID NO: 1945984 - DNA, 14 bp, Homo sapiens
ttaattattattct

SEQ ID NO: 1945985 - DNA, 17 bp, Homo sapiens
ttaattattattcttca

SEQ ID NO: 1945986 - DNA, 20 bp, Homo sapiens
ttacaaataaatccaagact

SEQ ID NO: 1945987 - DNA, 15 bp, Homo sapiens
ttacaatgtgcactg

SEQ ID NO: 1945988 - DNA, 20 bp, Homo sapiens
ttaccagcctccgtatttca

SEQ ID NO: 1945989 - DNA, 22 bp, Homo sapiens
ttaccccgtccctttccctgca

SEQ ID NO: 1945990 - DNA, 12 bp, Homo sapiens
ttaccctccctg

SEQ ID NO: 1945991 - DNA, 15 bp, Homo sapiens
ttaccctccctgtcc

SEQ ID NO: 1945992 - DNA, 17 bp, Homo sapiens
ttaccctccctgtcccc

SEQ ID NO: 1945993 - DNA, 19 bp, Homo sapiens
ttaccctccctgtcccctg

SEQ ID NO: 1945994 - DNA, 16 bp, Homo sapiens
ttacctggaaaccaga

SEQ ID NO: 1945995 - DNA, 19 bp, Homo sapiens
ttactaagatgaaattgcc

SEQ ID NO: 1945996 - DNA, 18 bp, Homo sapiens
ttactacatgtgggagct

SEQ ID NO: 1945997 - DNA, 20 bp, Homo sapiens
ttactagggatccctcatct

SEQ ID NO: 1945998 - DNA, 19 bp, Homo sapiens
ttactatcatgtcaaacgt

SEQ ID NO: 1945999 - DNA, 20 bp, Homo sapiens
ttactcaaaatgcaggacag

SEQ ID NO: 1946000 - DNA, 18 bp, Homo sapiens
ttactgttagtcatttgc

SEQ ID NO: 1946001 - DNA, 14 bp, Homo sapiens
ttacttgacctcct

SEQ ID NO: 1946002 - DNA, 14 bp, Homo sapiens
ttacttttgggagg

SEQ ID NO: 1946003 - DNA, 20 bp, Homo sapiens
ttagaaaatgtttggaattt

SEQ ID NO: 1946004 - DNA, 18 bp, Homo sapiens
ttagaaactgagtcctgt

SEQ ID NO: 1946005 - DNA, 19 bp, Homo sapiens
ttagaaactgagtcctgtt

SEQ ID NO: 1946006 - DNA, 13 bp, Homo sapiens
ttagaaagaaatt

SEQ ID NO: 1946007 - DNA, 23 bp, Homo sapiens
ttagacagtcaaggagtggctta

SEQ ID NO: 1946008 - DNA, 13 bp, Homo sapiens
ttagatgttctaa

SEQ ID NO: 1946009 - DNA, 20 bp, Homo sapiens
ttagatgttctaagtctttc

SEQ ID NO: 1946010 - DNA, 22 bp, Homo sapiens
ttagatgttctaagtctttcca

SEQ ID NO: 1946011 - DNA, 17 bp, Homo sapiens
ttaggcttacaatgtgc

SEQ ID NO: 1946012 - DNA, 16 bp, Homo sapiens
ttagggaaatccaact

SEQ ID NO: 1946013 - DNA, 13 bp, Homo sapiens
ttagggtctgtcc

SEQ ID NO: 1946014 - DNA, 13 bp, Homo sapiens
ttaggtcaagaag

SEQ ID NO: 1946015 - DNA, 15 bp, Homo sapiens
ttaggtgtcttttaa

SEQ ID NO: 1946016 - DNA, 15 bp, Homo sapiens
ttagtaaagaaatga

SEQ ID NO: 1946017 - DNA, 23 bp, Homo sapiens
ttagtaacatgtgttaagtattt

SEQ ID NO: 1946018 - DNA, 13 bp, Homo sapiens
ttagtgatttgct

SEQ ID NO: 1946019 - DNA, 21 bp, Homo sapiens
ttagtgtttgggtatattcat

SEQ ID NO: 1946020 - DNA, 23 bp, Homo sapiens
ttagttaaaatctattttgtctg

SEQ ID NO: 1946021 - DNA, 16 bp, Homo sapiens
ttataagcaacatgaa

SEQ ID NO: 1946022 - DNA, 21 bp, Homo sapiens
ttatagtgatgtaatcttgaa

SEQ ID NO: 1946023 - DNA, 13 bp, Homo sapiens
ttatatataaata

SEQ ID NO: 1946024 - DNA, 14 bp, Homo sapiens
ttatattacttttg

SEQ ID NO: 1946025 - DNA, 15 bp, Homo sapiens
ttatattacttttgt

SEQ ID NO: 1946026 - DNA, 16 bp, Homo sapiens
ttatatttgaattagt

SEQ ID NO: 1946027 - DNA, 16 bp, Homo sapiens
ttatcaaaactttctt

SEQ ID NO: 1946028 - DNA, 18 bp, Homo sapiens
ttatcaccgtgggctccc

SEQ ID NO: 1946029 - DNA, 21 bp, Homo sapiens
ttatcaccgtgggctccctga

SEQ ID NO: 1946030 - DNA, 23 bp, Homo sapiens
ttatcagtcataactaaataaag

SEQ ID NO: 1946031 - DNA, 22 bp, Homo sapiens
ttatctggatttttatgtttta

SEQ ID NO: 1946032 - DNA, 11 bp, Homo sapiens
ttatctgtctg

SEQ ID NO: 1946033 - DNA, 13 bp, Homo sapiens
ttattaaatcaga

SEQ ID NO: 1946034 - DNA, 17 bp, Homo sapiens
ttattagagtgtctttc

SEQ ID NO: 1946035 - DNA, 14 bp, Homo sapiens
ttattcagtgtcac

SEQ ID NO: 1946036 - DNA, 13 bp, Homo sapiens
ttattgcctttag

SEQ ID NO: 1946037 - DNA, 20 bp, Homo sapiens
ttatttatgcctctgtattt

SEQ ID NO: 1946038 - DNA, 11 bp, Homo sapiens
ttatttcagaa

SEQ ID NO: 1946039 - DNA, 15 bp, Homo sapiens
ttatttctaaatcct

SEQ ID NO: 1946040 - DNA, 12 bp, Homo sapiens
ttattttgcaac

SEQ ID NO: 1946041 - DNA, 15 bp, Homo sapiens
ttcaaaaaaatccta

SEQ ID NO: 1946042 - DNA, 14 bp, Homo sapiens
ttcaaacacacaca

SEQ ID NO: 1946043 - DNA, 18 bp, Homo sapiens
ttcaaactactgtacatt

SEQ ID NO: 1946044 - DNA, 20 bp, Homo sapiens
ttcaaactactgtacatttt

SEQ ID NO: 1946045 - DNA, 20 bp, Homo sapiens
ttcaaagaacccccctcccc

SEQ ID NO: 1946046 - DNA, 13 bp, Homo sapiens
ttcaaatcttaag

SEQ ID NO: 1946047 - DNA, 20 bp, Homo sapiens
ttcaagaagacggattatct

SEQ ID NO: 1946048 - DNA, 22 bp, Homo sapiens
ttcaatcctgtcaatgtttgct

SEQ ID NO: 1946049 - DNA, 12 bp, Homo sapiens
ttcaattaaaac

SEQ ID NO: 1946050 - DNA, 15 bp, Homo sapiens
ttcaattaaaaccat

SEQ ID NO: 1946051 - DNA, 16 bp, Homo sapiens
ttcaattaaaaccatt

SEQ ID NO: 1946052 - DNA, 15 bp, Homo sapiens
ttcaattgcatctcc

SEQ ID NO: 1946053 - DNA, 17 bp, Homo sapiens
ttcaattgcatctccca

SEQ ID NO: 1946054 - DNA, 21 bp, Homo sapiens
ttcacaaccttctgtggctca

SEQ ID NO: 1946055 - DNA, 16 bp, Homo sapiens
gcattgtggctgtcag

SEQ ID NO: 1946056 - DNA, 23 bp, Homo sapiens
gcatttctttatttctgtctcat

SEQ ID NO: 1946057 - DNA, 24 bp, Homo sapiens
gcatttctttatttctgtctcata

SEQ ID NO: 1946058 - DNA, 14 bp, Homo sapiens
gccaaatatgcact

SEQ ID NO: 1946059 - DNA, 15 bp, Homo sapiens
gccaaatatgcactt

SEQ ID NO: 1946060 - DNA, 16 bp, Homo sapiens
gccaaatatgcacttt

SEQ ID NO: 1946061 - DNA, 22 bp, Homo sapiens
gccaaatatgcactttccctag

SEQ ID NO: 1946062 - DNA, 24 bp, Homo sapiens
gccaaatatgcactttccctagaa

SEQ ID NO: 1946063 - DNA, 16 bp, Homo sapiens
gccaaattgcagaaga

SEQ ID NO: 1946064 - DNA, 18 bp, Homo sapiens
gccaaccacctctggccc

SEQ ID NO: 1946065 - DNA, 12 bp, Homo sapiens
gccaagccaggg

SEQ ID NO: 1946066 - DNA, 22 bp, Homo sapiens
gccaagccagggttccagacag

SEQ ID NO: 1946067 - DNA, 19 bp, Homo sapiens
gccaatggagactgtctca

SEQ ID NO: 1946068 - DNA, 21 bp, Homo sapiens
gccaatggagactgtctcaag

SEQ ID NO: 1946069 - DNA, 15 bp, Homo sapiens
gccacatgggaggct

SEQ ID NO: 1946070 - DNA, 13 bp, Homo sapiens
gccaccctctgca

SEQ ID NO: 1946071 - DNA, 16 bp, Homo sapiens
gccaccctctgcaggg

SEQ ID NO: 1946072 - DNA, 17 bp, Homo sapiens
gccaccctctgcagggc

SEQ ID NO: 1946073 - DNA, 19 bp, Homo sapiens
gccaccctctgcagggcag

SEQ ID NO: 1946074 - DNA, 21 bp, Homo sapiens
gccaccctctgcagggcagcc

SEQ ID NO: 1946075 - DNA, 12 bp, Homo sapiens
gccacctgcagc

SEQ ID NO: 1946076 - DNA, 13 bp, Homo sapiens
gccacggcagcct

SEQ ID NO: 1946077 - DNA, 23 bp, Homo sapiens
gccacgggggaggccgaggcagg

SEQ ID NO: 1946078 - DNA, 16 bp, Homo sapiens
gccacgtgctggagag

SEQ ID NO: 1946079 - DNA, 18 bp, Homo sapiens
gccacgtgctggagagta

SEQ ID NO: 1946080 - DNA, 23 bp, Homo sapiens
gccacgtgtttgtgctgtggtgt

SEQ ID NO: 1946081 - DNA, 19 bp, Homo sapiens
gccactccagacccctggc

SEQ ID NO: 1946082 - DNA, 20 bp, Homo sapiens
gccactccagacccctggct

SEQ ID NO: 1946083 - DNA, 22 bp, Homo sapiens
gccactccagacccctggcttt

SEQ ID NO: 1946084 - DNA, 13 bp, Homo sapiens
gccactcctctga

SEQ ID NO: 1946085 - DNA, 17 bp, Homo sapiens
gccactcctctgactca

SEQ ID NO: 1946086 - DNA, 15 bp, Homo sapiens
gccactgcagtcacc

SEQ ID NO: 1946087 - DNA, 22 bp, Homo sapiens
gccactgcagtcacccctgtct

SEQ ID NO: 1946088 - DNA, 17 bp, Homo sapiens
gccactggcatctctgg

SEQ ID NO: 1946089 - DNA, 22 bp, Homo sapiens
gccagaggctcgttgactggct

SEQ ID NO: 1946090 - DNA, 15 bp, Homo sapiens
gccagcagctgaagt

SEQ ID NO: 1946091 - DNA, 19 bp, Homo sapiens
gccagcgtcctcctctgtg

SEQ ID NO: 1946092 - DNA, 14 bp, Homo sapiens
gccaggactctctt

SEQ ID NO: 1946093 - DNA, 14 bp, Homo sapiens
gccaggagaccctg

SEQ ID NO: 1946094 - DNA, 16 bp, Homo sapiens
gccaggagaccctgtc

SEQ ID NO: 1946095 - DNA, 13 bp, Homo sapiens
gccaggagtgggt

SEQ ID NO: 1946096 - DNA, 23 bp, Homo sapiens
gccaggcatggcccagcctggag

SEQ ID NO: 1946097 - DNA, 18 bp, Homo sapiens
gccaggccctctctgcag

SEQ ID NO: 1946098 - DNA, 23 bp, Homo sapiens
gccaggccctctctgcagtcctc

SEQ ID NO: 1946099 - DNA, 12 bp, Homo sapiens
gccaggctgcag

SEQ ID NO: 1946100 - DNA, 17 bp, Homo sapiens
gccaggctgcagggaca

SEQ ID NO: 1946101 - DNA, 14 bp, Homo sapiens
gccagggcagggcc

SEQ ID NO: 1946102 - DNA, 19 bp, Homo sapiens
gccagggcagggccccagg

SEQ ID NO: 1946103 - DNA, 17 bp, Homo sapiens
gccagggttccagacag

SEQ ID NO: 1946104 - DNA, 15 bp, Homo sapiens
gccagtaaaagtata

SEQ ID NO: 1946105 - DNA, 13 bp, Homo sapiens
gccagtcctgcaa

SEQ ID NO: 1946106 - DNA, 23 bp, Homo sapiens
gccatcatctcctgccttcctcc

SEQ ID NO: 1946107 - DNA, 13 bp, Homo sapiens
gccatctgtaaat

SEQ ID NO: 1946108 - DNA, 14 bp, Homo sapiens
gccatctgtaaata

SEQ ID NO: 1946109 - DNA, 20 bp, Homo sapiens
gccatctgtaaatatcccag

SEQ ID NO: 1946110 - DNA, 19 bp, Homo sapiens
gccatgattttggccactt

SEQ ID NO: 1946111 - DNA, 15 bp, Homo sapiens
gccatggaggcacac

SEQ ID NO: 1946112 - DNA, 21 bp, Homo sapiens
gccatggaggcacacagctgc

SEQ ID NO: 1946113 - DNA, 14 bp, Homo sapiens
gccatttcttccca

SEQ ID NO: 1946114 - DNA, 14 bp, Homo sapiens
gcccaatcactgcc

SEQ ID NO: 1946115 - DNA, 20 bp, Homo sapiens
gcccacatagtgatggttcc

SEQ ID NO: 1946116 - DNA, 20 bp, Homo sapiens
tgcactgaatcgtttcatgt

SEQ ID NO: 1946117 - DNA, 12 bp, Homo sapiens
tgcactttccct

SEQ ID NO: 1946118 - DNA, 15 bp, Homo sapiens
tgcactttccctaga

SEQ ID NO: 1946119 - DNA, 12 bp, Homo sapiens
tgcagaccctgc

SEQ ID NO: 1946120 - DNA, 17 bp, Homo sapiens
tgcagacctgggacttt

SEQ ID NO: 1946121 - DNA, 20 bp, Homo sapiens
tgcagcatatgaggatgcag

SEQ ID NO: 1946122 - DNA, 14 bp, Homo sapiens
tgcagccgctgagc

SEQ ID NO: 1946123 - DNA, 19 bp, Homo sapiens
tgcagcctagtaggagctg

SEQ ID NO: 1946124 - DNA, 17 bp, Homo sapiens
tgcagctttgaggctgg

SEQ ID NO: 1946125 - DNA, 21 bp, Homo sapiens
tgcagggaaaattatttgcat

SEQ ID NO: 1946126 - DNA, 20 bp, Homo sapiens
tgcagggacagttgggtgtg

SEQ ID NO: 1946127 - DNA, 15 bp, Homo sapiens
tgcagggcagcctgt

SEQ ID NO: 1946128 - DNA, 22 bp, Homo sapiens
tgcagggtagggggcctgagtt

SEQ ID NO: 1946129 - DNA, 18 bp, Homo sapiens
tgcagtcacccctgtctg

SEQ ID NO: 1946130 - DNA, 20 bp, Homo sapiens
tgcagtcctcggcagctccg

SEQ ID NO: 1946131 - DNA, 22 bp, Homo sapiens
tgcagtcctgatcagagccgtg

SEQ ID NO: 1946132 - DNA, 17 bp, Homo sapiens
tgcagttgtgaaagcac

SEQ ID NO: 1946133 - DNA, 17 bp, Homo sapiens
tgcataacaattcctct

SEQ ID NO: 1946134 - DNA, 20 bp, Homo sapiens
tgcatagtaccaatcatttt

SEQ ID NO: 1946135 - DNA, 21 bp, Homo sapiens
tgcatagtaccaatcatttta

SEQ ID NO: 1946136 - DNA, 19 bp, Homo sapiens
tgcatcattctttctgcta

SEQ ID NO: 1946137 - DNA, 17 bp, Homo sapiens
tgcatcccttggcccct

SEQ ID NO: 1946138 - DNA, 18 bp, Homo sapiens
tgcatcccttggcccctc

SEQ ID NO: 1946139 - DNA, 20 bp, Homo sapiens
tgcatcccttggcccctctc

SEQ ID NO: 1946140 - DNA, 13 bp, Homo sapiens
tgcatctcccaga

SEQ ID NO: 1946141 - DNA, 13 bp, Homo sapiens
tgcatctgtggcc

SEQ ID NO: 1946142 - DNA, 19 bp, Homo sapiens
tgcatgcactgttccccct

SEQ ID NO: 1946143 - DNA, 22 bp, Homo sapiens
tgcatgcactgttccccctgtg

SEQ ID NO: 1946144 - DNA, 23 bp, Homo sapiens
tgcatgtactttatattttctat

SEQ ID NO: 1946145 - DNA, 17 bp, Homo sapiens
tgcattaacttttgtaa

SEQ ID NO: 1946146 - DNA, 12 bp, Homo sapiens
tgcattctagta

SEQ ID NO: 1946147 - DNA, 13 bp, Homo sapiens
tgcatttcctgac

SEQ ID NO: 1946148 - DNA, 15 bp, Homo sapiens
tgccaaccacctctg

SEQ ID NO: 1946149 - DNA, 16 bp, Homo sapiens
tgccacacttcaggct

SEQ ID NO: 1946150 - DNA, 15 bp, Homo sapiens
tgccacatggccgct

SEQ ID NO: 1946151 - DNA, 21 bp, Homo sapiens
tgccacatggccgctgcccac

SEQ ID NO: 1946152 - DNA, 14 bp, Homo sapiens
tgccaccctctgca

SEQ ID NO: 1946153 - DNA, 16 bp, Homo sapiens
tgccaccctctgcagg

SEQ ID NO: 1946154 - DNA, 17 bp, Homo sapiens
tgccaccctctgcaggg

SEQ ID NO: 1946155 - DNA, 21 bp, Homo sapiens
tgccacctctggccaaatatg

SEQ ID NO: 1946156 - DNA, 17 bp, Homo sapiens
tgccacgtggccgctgc

SEQ ID NO: 1946157 - DNA, 19 bp, Homo sapiens
tgccacttggccaccagga

SEQ ID NO: 1946158 - DNA, 18 bp, Homo sapiens
tgccagaagtgtgttttg

SEQ ID NO: 1946159 - DNA, 18 bp, Homo sapiens
tgccaggactctctttct

SEQ ID NO: 1946160 - DNA, 15 bp, Homo sapiens
tgccaggctgcaggg

SEQ ID NO: 1946161 - DNA, 14 bp, Homo sapiens
tgccagtcctgcaa

SEQ ID NO: 1946162 - DNA, 16 bp, Homo sapiens
tgccatggaggcacac

SEQ ID NO: 1946163 - DNA, 16 bp, Homo sapiens
tgccattttgtctggc

SEQ ID NO: 1946164 - DNA, 22 bp, Homo sapiens
tgcccaagaatagatgctgact

SEQ ID NO: 1946165 - DNA, 23 bp, Homo sapiens
tgcccaagaatagatgctgactg

SEQ ID NO: 1946166 - DNA, 19 bp, Homo sapiens
tgcccacctgccaggctgc

SEQ ID NO: 1946167 - DNA, 15 bp, Homo sapiens
tgcccactctgaccg

SEQ ID NO: 1946168 - DNA, 16 bp, Homo sapiens
tgcccagcttggagtg

SEQ ID NO: 1946169 - DNA, 19 bp, Homo sapiens
tgcccagcttggagtgcca

SEQ ID NO: 1946170 - DNA, 18 bp, Homo sapiens
tgcccagtcatgacattt

SEQ ID NO: 1946171 - DNA, 18 bp, Homo sapiens
tgccccaggctcaggctg

SEQ ID NO: 1946172 - DNA, 24 bp, Homo sapiens
tgccccaggctcaggctgcccagc

SEQ ID NO: 1946173 - DNA, 19 bp, Homo sapiens
tgccccatcagcagcttga

SEQ ID NO: 1946174 - DNA, 17 bp, Homo sapiens
tgcccccagctgctcct

SEQ ID NO: 1946175 - DNA, 13 bp, Homo sapiens
tgccccccttccc

SEQ ID NO: 1946176 - DNA, 18 bp, Homo sapiens
tgccccccttcccacccc

SEQ ID NO: 1946177 - DNA, 19 bp, Homo sapiens
tgccccccttcccacccct

SEQ ID NO: 1946178 - DNA, 13 bp, Homo sapiens
tgcccctcccttc

SEQ ID NO: 1946179 - DNA, 15 bp, Homo sapiens
tgcccctcccttcaa

SEQ ID NO: 1946180 - DNA, 16 bp, Homo sapiens
tgcccctcccttcaac

SEQ ID NO: 1946181 - DNA, 14 bp, Homo sapiens
tgccctggtgctgc

SEQ ID NO: 1946182 - DNA, 17 bp, Homo sapiens
tgccctggtgctgccac

SEQ ID NO: 1946183 - DNA, 20 bp, Homo sapiens
tgccctggtgctgccacact

SEQ ID NO: 1946184 - DNA, 13 bp, Homo sapiens
tgccgctgggaga

SEQ ID NO: 1946185 - DNA, 17 bp, Homo sapiens
tgcctataaaggaaaca

SEQ ID NO: 1946186 - DNA, 14 bp, Homo sapiens
tgcctcatgctctc

SEQ ID NO: 1946187 - DNA, 23 bp, Homo sapiens
tgcctctctcatggcttgggctg

SEQ ID NO: 1946188 - DNA, 13 bp, Homo sapiens
tgcctcttctggg

SEQ ID NO: 1946189 - DNA, 16 bp, Homo sapiens
tgcctcttctgggagg

SEQ ID NO: 1946190 - DNA, 19 bp, Homo sapiens
tgcctcttctgggagggca

SEQ ID NO: 1946191 - DNA, 20 bp, Homo sapiens
tgcctcttctgggagggcag

SEQ ID NO: 1946192 - DNA, 21 bp, Homo sapiens
tgcctcttctgggagggcagc

SEQ ID NO: 1946193 - DNA, 15 bp, Homo sapiens
tgcctgcctcatgct

SEQ ID NO: 1946194 - DNA, 23 bp, Homo sapiens
tgccttattagagtgtctttcca

SEQ ID NO: 1946195 - DNA, 13 bp, Homo sapiens
tgccttctcttct

SEQ ID NO: 1946196 - DNA, 14 bp, Homo sapiens
tgccttctcttcta

SEQ ID NO: 1946197 - DNA, 16 bp, Homo sapiens
tgccttctcttctatc

SEQ ID NO: 1946198 - DNA, 19 bp, Homo sapiens
tgcctttggcaattcttct

SEQ ID NO: 1946199 - DNA, 15 bp, Homo sapiens
tgcgaatgagctggg

SEQ ID NO: 1946200 - DNA, 20 bp, Homo sapiens
tgcgccctccctccctccac

SEQ ID NO: 1946201 - DNA, 18 bp, Homo sapiens
tgcgccgctgtgctgttg

SEQ ID NO: 1946202 - DNA, 12 bp, Homo sapiens
tgcgctagagca

SEQ ID NO: 1946203 - DNA, 21 bp, Homo sapiens
tgcgctagagcattctggggt

SEQ ID NO: 1946204 - DNA, 20 bp, Homo sapiens
tgcggcttccgagggcacta

SEQ ID NO: 1946205 - DNA, 15 bp, Homo sapiens
tgcgggctgggcagc

SEQ ID NO: 1946206 - DNA, 16 bp, Homo sapiens
tgcgggctgggcagct

SEQ ID NO: 1946207 - DNA, 16 bp, Homo sapiens
tgcgtctcctgcccac

SEQ ID NO: 1946208 - DNA, 20 bp, Homo sapiens
tgcgtggatcaagcttgtgt

SEQ ID NO: 1946209 - DNA, 22 bp, Homo sapiens
tgcgtggatcaagcttgtgtac

SEQ ID NO: 1946210 - DNA, 22 bp, Homo sapiens
tgctaatcagggaggtcatttt

SEQ ID NO: 1946211 - DNA, 21 bp, Homo sapiens
tgctataactatgttgataaa

SEQ ID NO: 1946212 - DNA, 23 bp, Homo sapiens
tgctatagtgtataccacctgta

SEQ ID NO: 1946213 - DNA, 22 bp, Homo sapiens
tgctatcgcaccactgtgtatt

SEQ ID NO: 1946214 - DNA, 17 bp, Homo sapiens
tgctatgtctgtgatgt

SEQ ID NO: 1946215 - DNA, 20 bp, Homo sapiens
tgctcagttccaatgtgccc

SEQ ID NO: 1946216 - DNA, 17 bp, Homo sapiens
tgctcccagtttcttga

SEQ ID NO: 1946217 - DNA, 23 bp, Homo sapiens
tgctcctacccctgtcctggggc

SEQ ID NO: 1946218 - DNA, 14 bp, Homo sapiens
tgctccttgggccc

SEQ ID NO: 1946219 - DNA, 19 bp, Homo sapiens
tgctccttgggccctttga

SEQ ID NO: 1946220 - DNA, 14 bp, Homo sapiens
tgctcgggagtggc

SEQ ID NO: 1946221 - DNA, 14 bp, Homo sapiens
tgctctgatccctc

SEQ ID NO: 1946222 - DNA, 16 bp, Homo sapiens
tgctctgatccctcta

SEQ ID NO: 1946223 - DNA, 16 bp, Homo sapiens
tgctgactgtactcct

SEQ ID NO: 1946224 - DNA, 19 bp, Homo sapiens
tgctgactgtactcctccc

SEQ ID NO: 1946225 - DNA, 22 bp, Homo sapiens
tgctgactgtactcctcccagg

SEQ ID NO: 1946226 - DNA, 13 bp, Homo sapiens
tgctgcagactca

SEQ ID NO: 1946227 - DNA, 15 bp, Homo sapiens
tgctgccacacttca

SEQ ID NO: 1946228 - DNA, 16 bp, Homo sapiens
tgctgccacacttcag

SEQ ID NO: 1946229 - DNA, 19 bp, Homo sapiens
tgctgccacacttcaggct

SEQ ID NO: 1946230 - DNA, 22 bp, Homo sapiens
tgctgccacacttcaggctctt

SEQ ID NO: 1946231 - DNA, 19 bp, Homo sapiens
tgctgccccatcagtgctc

SEQ ID NO: 1946232 - DNA, 21 bp, Homo sapiens
tgctgccccatcagtgctccc

SEQ ID NO: 1946233 - DNA, 22 bp, Homo sapiens
tgctggagagtagacatccccc

SEQ ID NO: 1946234 - DNA, 18 bp, Homo sapiens
tgctgtacctttctgaca

SEQ ID NO: 1946235 - DNA, 22 bp, Homo sapiens
tgctgtcagaccttcttccaca

SEQ ID NO: 1946236 - DNA, 16 bp, Homo sapiens
tgctgtccctcctgag

SEQ ID NO: 1946237 - DNA, 22 bp, Homo sapiens
tgctgtgacaggcagtgttctt

SEQ ID NO: 1946238 - DNA, 23 bp, Homo sapiens
tgctgtgggtcagtgtgccaccc

SEQ ID NO: 1946239 - DNA, 17 bp, Homo sapiens
tgctgttgttcagaagt

SEQ ID NO: 1946240 - DNA, 15 bp, Homo sapiens
tgctgtttatatata

SEQ ID NO: 1946241 - DNA, 23 bp, Homo sapiens
tgcttataagcaacatgaattaa

SEQ ID NO: 1946242 - DNA, 22 bp, Homo sapiens
tgcttccctttcactgaagtga

SEQ ID NO: 1946243 - DNA, 18 bp, Homo sapiens
tgcttcgggcccttccca

SEQ ID NO: 1946244 - DNA, 16 bp, Homo sapiens
tgcttgaggaaaacaa

SEQ ID NO: 1946245 - DNA, 14 bp, Homo sapiens
tgcttgcatttctt

SEQ ID NO: 1946246 - DNA, 18 bp, Homo sapiens
tgctttcgaactgctagt

SEQ ID NO: 1946247 - DNA, 17 bp, Homo sapiens
tggaaaaagaaattctg

SEQ ID NO: 1946248 - DNA, 20 bp, Homo sapiens
tggaaaaagaaattctgtta

SEQ ID NO: 1946249 - DNA, 11 bp, Homo sapiens
tggaaaataaa

SEQ ID NO: 1946250 - DNA, 16 bp, Homo sapiens
tggaaagggtgtggct

SEQ ID NO: 1946251 - DNA, 18 bp, Homo sapiens
tggaaagggtgtggcttg

SEQ ID NO: 1946252 - DNA, 18 bp, Homo sapiens
tggaagtgagggtcagag

SEQ ID NO: 1946253 - DNA, 18 bp, Homo sapiens
tggaatataaatatcaca

SEQ ID NO: 1946254 - DNA, 19 bp, Homo sapiens
tggaatataaatatcacaa

SEQ ID NO: 1946255 - DNA, 20 bp, Homo sapiens
tggaatattgtccattgtcc

SEQ ID NO: 1946256 - DNA, 14 bp, Homo sapiens
tggaatgtaatcaa

SEQ ID NO: 1946257 - DNA, 12 bp, Homo sapiens
tggacagtgaga

SEQ ID NO: 1946258 - DNA, 16 bp, Homo sapiens
tggacattttaaacac

SEQ ID NO: 1946259 - DNA, 14 bp, Homo sapiens
tggaccacagtgac

SEQ ID NO: 1946260 - DNA, 12 bp, Homo sapiens
tggactgtgtcc

SEQ ID NO: 1946261 - DNA, 14 bp, Homo sapiens
tggacttatttttg

SEQ ID NO: 1946262 - DNA, 17 bp, Homo sapiens
tggagaaacccttgaaa

SEQ ID NO: 1946263 - DNA, 16 bp, Homo sapiens
tggagaggaaaagcca

SEQ ID NO: 1946264 - DNA, 21 bp, Homo sapiens
tggagaggagagaatgagaga

SEQ ID NO: 1946265 - DNA, 20 bp, Homo sapiens
tggagaggaggtgtggagtg

SEQ ID NO: 1946266 - DNA, 17 bp, Homo sapiens
tggagaggggacttgga

SEQ ID NO: 1946267 - DNA, 20 bp, Homo sapiens
tggagagtgcaacagtagca

SEQ ID NO: 1946268 - DNA, 19 bp, Homo sapiens
tggagatgacagaaatatg

SEQ ID NO: 1946269 - DNA, 11 bp, Homo sapiens
tggagccacag

SEQ ID NO: 1946270 - DNA, 17 bp, Homo sapiens
tggagccacaggcagac

SEQ ID NO: 1946271 - DNA, 21 bp, Homo sapiens
tggagcttcatggcagaaggc

SEQ ID NO: 1946272 - DNA, 17 bp, Homo sapiens
tggaggcacacagctgc

SEQ ID NO: 1946273 - DNA, 18 bp, Homo sapiens
tggaggcctggtctggag

SEQ ID NO: 1946274 - DNA, 20 bp, Homo sapiens
tggaggcctggtctggagcc

SEQ ID NO: 1946275 - DNA, 13 bp, Homo sapiens
tggagtggagggg

SEQ ID NO: 1946276 - DNA, 18 bp, Homo sapiens
tggatcaagcttgtgtac

SEQ ID NO: 1946277 - DNA, 20 bp, Homo sapiens
tggatcaagcttgtgtactt

SEQ ID NO: 1946278 - DNA, 18 bp, Homo sapiens
tggatctcattggaccct

SEQ ID NO: 1946279 - DNA, 12 bp, Homo sapiens
tggatctggagt

SEQ ID NO: 1946280 - DNA, 14 bp, Homo sapiens
tggatgtttcttct

SEQ ID NO: 1946281 - DNA, 14 bp, Homo sapiens
tggattttgtggct

SEQ ID NO: 1946282 - DNA, 22 bp, Homo sapiens
tggcaataggacaaaacgggtt

SEQ ID NO: 1946283 - DNA, 15 bp, Homo sapiens
tggcacagggcagtg

SEQ ID NO: 1946284 - DNA, 18 bp, Homo sapiens
tggcagccgtgccttcag

SEQ ID NO: 1946285 - DNA, 19 bp, Homo sapiens
tggcaggagttggaagtgt

SEQ ID NO: 1946286 - DNA, 19 bp, Homo sapiens
tggcatctctggagtgtgt

SEQ ID NO: 1946287 - DNA, 21 bp, Homo sapiens
tggccacttgggtcttccctg

SEQ ID NO: 1946288 - DNA, 20 bp, Homo sapiens
tggccactttgcagacctgg

SEQ ID NO: 1946289 - DNA, 23 bp, Homo sapiens
tggccactttgcagacctgggac

SEQ ID NO: 1946290 - DNA, 15 bp, Homo sapiens
tggccaggtggccac

SEQ ID NO: 1946291 - DNA, 17 bp, Homo sapiens
tggccaggtggccactc

SEQ ID NO: 1946292 - DNA, 12 bp, Homo sapiens
tggcccacccct

SEQ ID NO: 1946293 - DNA, 14 bp, Homo sapiens
tggcccacccctct

SEQ ID NO: 1946294 - DNA, 17 bp, Homo sapiens
tggcccacccctcttcc

SEQ ID NO: 1946295 - DNA, 14 bp, Homo sapiens
tggcccctctctgt

SEQ ID NO: 1946296 - DNA, 15 bp, Homo sapiens
tggcccgacagcctg

SEQ ID NO: 1946297 - DNA, 16 bp, Homo sapiens
tggccctgcaagggcg

SEQ ID NO: 1946298 - DNA, 19 bp, Homo sapiens
tggccgcaacttcccaggc

SEQ ID NO: 1946299 - DNA, 21 bp, Homo sapiens
tggccgcaacttcccaggccg

SEQ ID NO: 1946300 - DNA, 20 bp, Homo sapiens
tggccgctgctgtgacaggc

SEQ ID NO: 1946301 - DNA, 15 bp, Homo sapiens
tggccgggggtgggg

SEQ ID NO: 1946302 - DNA, 23 bp, Homo sapiens
tggcctagtggggaggggcctgg

SEQ ID NO: 1946303 - DNA, 21 bp, Homo sapiens
tggcctcttcctccctccctg

SEQ ID NO: 1946304 - DNA, 14 bp, Homo sapiens
tggcctgagaagag

SEQ ID NO: 1946305 - DNA, 15 bp, Homo sapiens
tggcctgagaagagt

SEQ ID NO: 1946306 - DNA, 19 bp, Homo sapiens
tggcctgagaagagtcgag

SEQ ID NO: 1946307 - DNA, 17 bp, Homo sapiens
tggcctgggagagctgg

SEQ ID NO: 1946308 - DNA, 21 bp, Homo sapiens
tggcctgggtggggcagggcc

SEQ ID NO: 1946309 - DNA, 15 bp, Homo sapiens
tggctccactgtaaa

SEQ ID NO: 1946310 - DNA, 17 bp, Homo sapiens
tggctcccacaggccct

SEQ ID NO: 1946311 - DNA, 20 bp, Homo sapiens
tggctcccgctttggggagc

SEQ ID NO: 1946312 - DNA, 16 bp, Homo sapiens
tggctcctcccggtgc

SEQ ID NO: 1946313 - DNA, 13 bp, Homo sapiens
tggctgcccacac

SEQ ID NO: 1946314 - DNA, 19 bp, Homo sapiens
tggctgggtttgggcagtg

SEQ ID NO: 1946315 - DNA, 15 bp, Homo sapiens
tggcttcccgctcag

SEQ ID NO: 1946316 - DNA, 19 bp, Homo sapiens
tggcttcccgctcagccct

SEQ ID NO: 1946317 - DNA, 16 bp, Homo sapiens
tggcttttcactgctg

SEQ ID NO: 1946318 - DNA, 16 bp, Homo sapiens
tggcttttgaatcaaa

SEQ ID NO: 1946319 - DNA, 13 bp, Homo sapiens
tgggaactagact

SEQ ID NO: 1946320 - DNA, 23 bp, Homo sapiens
tgggacctcagttttatcatttt

SEQ ID NO: 1946321 - DNA, 18 bp, Homo sapiens
tgggacttgaaatcaaat

SEQ ID NO: 1946322 - DNA, 15 bp, Homo sapiens
tgggagaagggacag

SEQ ID NO: 1946323 - DNA, 18 bp, Homo sapiens
tgggagactgctgagtca

SEQ ID NO: 1946324 - DNA, 19 bp, Homo sapiens
tgggagaggagaggctgct

SEQ ID NO: 1946325 - DNA, 18 bp, Homo sapiens
tgggagccgggtctgcct

SEQ ID NO: 1946326 - DNA, 20 bp, Homo sapiens
tgggaggattctatgaggca

SEQ ID NO: 1946327 - DNA, 20 bp, Homo sapiens
tgggaggctcacccccttct

SEQ ID NO: 1946328 - DNA, 12 bp, Homo sapiens
tgggagtgggag

SEQ ID NO: 1946329 - DNA, 15 bp, Homo sapiens
tgggagtgggagagg

SEQ ID NO: 1946330 - DNA, 17 bp, Homo sapiens
tgggagtgggagaggaa

SEQ ID NO: 1946331 - DNA, 22 bp, Homo sapiens
tgggagttgatcgcctttccca

SEQ ID NO: 1946332 - DNA, 14 bp, Homo sapiens
tgggatccagagag

SEQ ID NO: 1946333 - DNA, 16 bp, Homo sapiens
tgggatccagagagaa

SEQ ID NO: 1946334 - DNA, 19 bp, Homo sapiens
tgggatccagagagaagca

SEQ ID NO: 1946335 - DNA, 19 bp, Homo sapiens
tgggattgagtctgtgcca

SEQ ID NO: 1946336 - DNA, 15 bp, Homo sapiens
tgggcaaagcctagt

SEQ ID NO: 1946337 - DNA, 13 bp, Homo sapiens
tgggcactggaaa

SEQ ID NO: 1946338 - DNA, 14 bp, Homo sapiens
tgggcagagcccaa

SEQ ID NO: 1946339 - DNA, 14 bp, Homo sapiens
tgggcagaggggag

SEQ ID NO: 1946340 - DNA, 17 bp, Homo sapiens
tgggcagaggggagagg

SEQ ID NO: 1946341 - DNA, 14 bp, Homo sapiens
tgggcagtggagag

SEQ ID NO: 1946342 - DNA, 15 bp, Homo sapiens
tgggcagtggagagg

SEQ ID NO: 1946343 - DNA, 17 bp, Homo sapiens
tgggcagtggagagggg

SEQ ID NO: 1946344 - DNA, 23 bp, Homo sapiens
tgggccaagccagggttccagac

SEQ ID NO: 1946345 - DNA, 13 bp, Homo sapiens
tgggccctttgag

SEQ ID NO: 1946346 - DNA, 14 bp, Homo sapiens
tgggccggcagcct

SEQ ID NO: 1946347 - DNA, 19 bp, Homo sapiens
tgggcgcctctgtcctggc

SEQ ID NO: 1946348 - DNA, 19 bp, Homo sapiens
tgggcggcagagaggactg

SEQ ID NO: 1946349 - DNA, 12 bp, Homo sapiens
tgggctccagag

SEQ ID NO: 1946350 - DNA, 13 bp, Homo sapiens
tgggctccagagt

SEQ ID NO: 1946351 - DNA, 15 bp, Homo sapiens
tgggctccagagtag

SEQ ID NO: 1946352 - DNA, 23 bp, Homo sapiens
tgggctctctggacctgaccaga

SEQ ID NO: 1946353 - DNA, 20 bp, Homo sapiens
tgggctgccctggtgctgcc

SEQ ID NO: 1946354 - DNA, 21 bp, Homo sapiens
tgggctgccctggtgctgcca

SEQ ID NO: 1946355 - DNA, 17 bp, Homo sapiens
tggggacagagcagaac

SEQ ID NO: 1946356 - DNA, 15 bp, Homo sapiens
tggggagcagctggg

SEQ ID NO: 1946357 - DNA, 21 bp, Homo sapiens
tggggaggggcctggcctggg

SEQ ID NO: 1946358 - DNA, 13 bp, Homo sapiens
tggggcagcacag

SEQ ID NO: 1946359 - DNA, 22 bp, Homo sapiens
tggggcagcacagagagggggc

SEQ ID NO: 1946360 - DNA, 21 bp, Homo sapiens
tggggcttagaatggggcttc

SEQ ID NO: 1946361 - DNA, 15 bp, Homo sapiens
tggggcttggaaggg

SEQ ID NO: 1946362 - DNA, 22 bp, Homo sapiens
tggggcttggaagggcgctgag

SEQ ID NO: 1946363 - DNA, 20 bp, Homo sapiens
tgggggtctgggaggcaggt

SEQ ID NO: 1946364 - DNA, 14 bp, Homo sapiens
tgggggtgccagga

SEQ ID NO: 1946365 - DNA, 21 bp, Homo sapiens
tgggggtgtcacagaggcagt

SEQ ID NO: 1946366 - DNA, 13 bp, Homo sapiens
tggggtgggagag

SEQ ID NO: 1946367 - DNA, 16 bp, Homo sapiens
tggggtggggcttgga

SEQ ID NO: 1946368 - DNA, 19 bp, Homo sapiens
tggggtggggcttggaagg

SEQ ID NO: 1946369 - DNA, 17 bp, Homo sapiens
tggggttttcacttcct

SEQ ID NO: 1946370 - DNA, 17 bp, Homo sapiens
tgggtcagtgtgccacc

SEQ ID NO: 1946371 - DNA, 22 bp, Homo sapiens
tgggtcagtgtgccaccctctg

SEQ ID NO: 1946372 - DNA, 14 bp, Homo sapiens
tgggtccatgggca

SEQ ID NO: 1946373 - DNA, 16 bp, Homo sapiens
tgggtcctcccagctg

SEQ ID NO: 1946374 - DNA, 21 bp, Homo sapiens
tgggtcctcccagctgacggc

SEQ ID NO: 1946375 - DNA, 22 bp, Homo sapiens
tgggtcttgttttttttttcca

SEQ ID NO: 1946376 - DNA, 16 bp, Homo sapiens
tgggtgctctggctgg

SEQ ID NO: 1946377 - DNA, 21 bp, Homo sapiens
tgggtgctctggctggagagg

SEQ ID NO: 1946378 - DNA, 19 bp, Homo sapiens
tgggtgctgtcatgcccag

SEQ ID NO: 1946379 - DNA, 18 bp, Homo sapiens
tgggtgtgtttcaggaca

SEQ ID NO: 1946380 - DNA, 20 bp, Homo sapiens
tgggtgtgtttcaggacagc

SEQ ID NO: 1946381 - DNA, 12 bp, Homo sapiens
tgggttccagac

SEQ ID NO: 1946382 - DNA, 19 bp, Homo sapiens
tgggttccagacagagtgg

SEQ ID NO: 1946383 - DNA, 20 bp, Homo sapiens
tgggttccagacagagtgga

SEQ ID NO: 1946384 - DNA, 14 bp, Homo sapiens
tgggtttccctgcg

SEQ ID NO: 1946385 - DNA, 20 bp, Homo sapiens
tgggtttgggcagtggagag

SEQ ID NO: 1946386 - DNA, 15 bp, Homo sapiens
tggtaccggatgcag

SEQ ID NO: 1946387 - DNA, 17 bp, Homo sapiens
tggtactcccccagccc

SEQ ID NO: 1946388 - DNA, 21 bp, Homo sapiens
tggtatgtgacatgcgggctg

SEQ ID NO: 1946389 - DNA, 14 bp, Homo sapiens
ctgttagtcatttg

SEQ ID NO: 1946390 - DNA, 15 bp, Homo sapiens
ctgttagtcatttgc

SEQ ID NO: 1946391 - DNA, 17 bp, Homo sapiens
ctgttcaacaagagtaa

SEQ ID NO: 1946392 - DNA, 15 bp, Homo sapiens
ctgttccccctgtgc

SEQ ID NO: 1946393 - DNA, 17 bp, Homo sapiens
ctgttcctgccttctct

SEQ ID NO: 1946394 - DNA, 23 bp, Homo sapiens
ctgttgacatccaagcttccttt

SEQ ID NO: 1946395 - DNA, 22 bp, Homo sapiens
ctgttgttcagaagttgttagt

SEQ ID NO: 1946396 - DNA, 16 bp, Homo sapiens
ctgttgtttaaaataa

SEQ ID NO: 1946397 - DNA, 16 bp, Homo sapiens
ctgtttaccctccctg

SEQ ID NO: 1946398 - DNA, 13 bp, Homo sapiens
cttaaacaaaaat

SEQ ID NO: 1946399 - DNA, 14 bp, Homo sapiens
cttaacctgctttt

SEQ ID NO: 1946400 - DNA, 15 bp, Homo sapiens
cttaacctgcttttg

SEQ ID NO: 1946401 - DNA, 16 bp, Homo sapiens
cttaagagaatccaca

SEQ ID NO: 1946402 - DNA, 23 bp, Homo sapiens
cttaagagaatccacataaaaga

SEQ ID NO: 1946403 - DNA, 16 bp, Homo sapiens
cttaagataatattta

SEQ ID NO: 1946404 - DNA, 23 bp, Homo sapiens
aatgctataactatgttgataaa

SEQ ID NO: 1946405 - DNA, 21 bp, Homo sapiens
aatggaatataaatatcacaa

SEQ ID NO: 1946406 - DNA, 16 bp, Homo sapiens
aatggctgggtttggg

SEQ ID NO: 1946407 - DNA, 17 bp, Homo sapiens
aatggtgagaattaaaa

SEQ ID NO: 1946408 - DNA, 14 bp, Homo sapiens
aatggttgggacaa

SEQ ID NO: 1946409 - DNA, 15 bp, Homo sapiens
aatgtacattaatta

SEQ ID NO: 1946410 - DNA, 21 bp, Homo sapiens
aatgtactttcattccctttc

SEQ ID NO: 1946411 - DNA, 14 bp, Homo sapiens
aatgtatatgcact

SEQ ID NO: 1946412 - DNA, 20 bp, Homo sapiens
aatgtgcccagtcatgacat

SEQ ID NO: 1946413 - DNA, 20 bp, Homo sapiens
aatgttattttttaattatt

SEQ ID NO: 1946414 - DNA, 20 bp, Homo sapiens
aatgttgacctttgaggtct

SEQ ID NO: 1946415 - DNA, 22 bp, Homo sapiens
aatgtttcttctaggttctaaa

SEQ ID NO: 1946416 - DNA, 18 bp, Homo sapiens
aatgtttggaatttaaga

SEQ ID NO: 1946417 - DNA, 18 bp, Homo sapiens
aattaaaaaatggtcagt

SEQ ID NO: 1946418 - DNA, 21 bp, Homo sapiens
aattaaaaacacctaagtgac

SEQ ID NO: 1946419 - DNA, 20 bp, Homo sapiens
aattacaatttctttaaatc

SEQ ID NO: 1946420 - DNA, 13 bp, Homo sapiens
aattaggtcaagt

SEQ ID NO: 1946421 - DNA, 18 bp, Homo sapiens
aattattatttatatatg

SEQ ID NO: 1946422 - DNA, 21 bp, Homo sapiens
aattattatttatatatgtat

SEQ ID NO: 1946423 - DNA, 17 bp, Homo sapiens
aattatttcagaaatgt

SEQ ID NO: 1946424 - DNA, 13 bp, Homo sapiens
aattcaattaaaa

SEQ ID NO: 1946425 - DNA, 14 bp, Homo sapiens
aattcaattaaaac

SEQ ID NO: 1946426 - DNA, 21 bp, Homo sapiens
aattcacatctaacctcatct

SEQ ID NO: 1946427 - DNA, 13 bp, Homo sapiens
aattctaaatgaa

SEQ ID NO: 1946428 - DNA, 23 bp, Homo sapiens
aattctcttttcaaacacacaca

SEQ ID NO: 1946429 - DNA, 18 bp, Homo sapiens
aattcttggttgaggaaa

SEQ ID NO: 1946430 - DNA, 20 bp, Homo sapiens
aattgcagaagaaactcctg

SEQ ID NO: 1946431 - DNA, 14 bp, Homo sapiens
aattgtaactgttc

SEQ ID NO: 1946432 - DNA, 18 bp, Homo sapiens
aattgtcccttaaacaaa

SEQ ID NO: 1946433 - DNA, 13 bp, Homo sapiens
aattgtggagagg

SEQ ID NO: 1946434 - DNA, 16 bp, Homo sapiens
aattgtggagaggaga

SEQ ID NO: 1946435 - DNA, 15 bp, Homo sapiens
aattgttatacattt

SEQ ID NO: 1946436 - DNA, 15 bp, Homo sapiens
aatttctactttgaa

SEQ ID NO: 1946437 - DNA, 17 bp, Homo sapiens
aatttctactttgaagt

SEQ ID NO: 1946438 - DNA, 23 bp, Homo sapiens
aatttgtataacccatatctgtg

SEQ ID NO: 1946439 - DNA, 19 bp, Homo sapiens
aattttcctctaattaaaa

SEQ ID NO: 1946440 - DNA, 22 bp, Homo sapiens
aattttcctctaattaaaatgt

SEQ ID NO: 1946441 - DNA, 18 bp, Homo sapiens
aattttttagttaaaatc

SEQ ID NO: 1946442 - DNA, 14 bp, Homo sapiens
acaaacatgaccct

SEQ ID NO: 1946443 - DNA, 19 bp, Homo sapiens
acaaaggtgattttcctgt

SEQ ID NO: 1946444 - DNA, 21 bp, Homo sapiens
acaaatatgattctcctctcc

SEQ ID NO: 1946445 - DNA, 14 bp, Homo sapiens
acaactccagccac

SEQ ID NO: 1946446 - DNA, 21 bp, Homo sapiens
acaagaagtgggagtgggaga

SEQ ID NO: 1946447 - DNA, 21 bp, Homo sapiens
acaagacagcagagccatctg

SEQ ID NO: 1946448 - DNA, 21 bp, Homo sapiens
acaaggaagtcaaagcaagga

SEQ ID NO: 1946449 - DNA, 21 bp, Homo sapiens
acaagtatgaataaagacacc

SEQ ID NO: 1946450 - DNA, 18 bp, Homo sapiens
acaagtgctcagttccaa

SEQ ID NO: 1946451 - DNA, 13 bp, Homo sapiens
acaatcactattc

SEQ ID NO: 1946452 - DNA, 22 bp, Homo sapiens
acaatcagctccttcctggaga

SEQ ID NO: 1946453 - DNA, 23 bp, Homo sapiens
acaattcctctactaacaatcag

SEQ ID NO: 1946454 - DNA, 20 bp, Homo sapiens
acacaaaggacaaaaatata

SEQ ID NO: 1946455 - DNA, 17 bp, Homo sapiens
acacaaataccagagca

SEQ ID NO: 1946456 - DNA, 22 bp, Homo sapiens
acacacacccttccccactccc

SEQ ID NO: 1946457 - DNA, 12 bp, Homo sapiens
acacacccttcc

SEQ ID NO: 1946458 - DNA, 13 bp, Homo sapiens
acacacccttccc

SEQ ID NO: 1946459 - DNA, 20 bp, Homo sapiens
acacacccttccccactccc

SEQ ID NO: 1946460 - DNA, 14 bp, Homo sapiens
acacactcttcaag

SEQ ID NO: 1946461 - DNA, 16 bp, Homo sapiens
acaccctctctgtcca

SEQ ID NO: 1946462 - DNA, 15 bp, Homo sapiens
acacccttccccact

SEQ ID NO: 1946463 - DNA, 19 bp, Homo sapiens
acacccttccccactcccg

SEQ ID NO: 1946464 - DNA, 16 bp, Homo sapiens
acacctaagtgactac

SEQ ID NO: 1946465 - DNA, 20 bp, Homo sapiens
acacctaagtgactaccact

SEQ ID NO: 1946466 - DNA, 13 bp, Homo sapiens
acacctccacccg

SEQ ID NO: 1946467 - DNA, 14 bp, Homo sapiens
acaccttcccagct

SEQ ID NO: 1946468 - DNA, 22 bp, Homo sapiens
acacgaggtatgaggtctagga

SEQ ID NO: 1946469 - DNA, 23 bp, Homo sapiens
acacgcgcgcgcgcgcacacaca

SEQ ID NO: 1946470 - DNA, 14 bp, Homo sapiens
acactacgcagaag

SEQ ID NO: 1946471 - DNA, 22 bp, Homo sapiens
acactacgcagaagagaaagta

SEQ ID NO: 1946472 - DNA, 16 bp, Homo sapiens
acactctttgtaagag

SEQ ID NO: 1946473 - DNA, 24 bp, Homo sapiens
acactgaaccttgttgatgccagc

SEQ ID NO: 1946474 - DNA, 21 bp, Homo sapiens
acactgctgggaagtggctta

SEQ ID NO: 1946475 - DNA, 15 bp, Homo sapiens
acactggccggccca

SEQ ID NO: 1946476 - DNA, 18 bp, Homo sapiens
acactggccggcccacgt

SEQ ID NO: 1946477 - DNA, 22 bp, Homo sapiens
acactggctttgggtagtgcca

SEQ ID NO: 1946478 - DNA, 18 bp, Homo sapiens
acactgtgcacatctgtg

SEQ ID NO: 1946479 - DNA, 19 bp, Homo sapiens
acactttgccatattttca

SEQ ID NO: 1946480 - DNA, 20 bp, Homo sapiens
acagaaaacggttaaaactg

SEQ ID NO: 1946481 - DNA, 21 bp, Homo sapiens
acagaaccaacgggtctgtgg

SEQ ID NO: 1946482 - DNA, 13 bp, Homo sapiens
acagacctcggct

SEQ ID NO: 1946483 - DNA, 21 bp, Homo sapiens
acagagagggggccacctccc

SEQ ID NO: 1946484 - DNA, 16 bp, Homo sapiens
acagagcttccctgac

SEQ ID NO: 1946485 - DNA, 15 bp, Homo sapiens
acagaggccaggcat

SEQ ID NO: 1946486 - DNA, 21 bp, Homo sapiens
acagagtgccatccctgagag

SEQ ID NO: 1946487 - DNA, 11 bp, Homo sapiens
acagagtggat

SEQ ID NO: 1946488 - DNA, 17 bp, Homo sapiens
acagagtggatctggag

SEQ ID NO: 1946489 - DNA, 12 bp, Homo sapiens
acagatcttgag

SEQ ID NO: 1946490 - DNA, 22 bp, Homo sapiens
acagatgttccatcctgtacaa

SEQ ID NO: 1946491 - DNA, 15 bp, Homo sapiens
acagcaaatgagatg

SEQ ID NO: 1946492 - DNA, 17 bp, Homo sapiens
acagcagagccatctgc

SEQ ID NO: 1946493 - DNA, 24 bp, Homo sapiens
acagcagctgttcaacaagagtaa

SEQ ID NO: 1946494 - DNA, 17 bp, Homo sapiens
acagcaggagcatggcc

SEQ ID NO: 1946495 - DNA, 17 bp, Homo sapiens
acagccagtaaggcagc

SEQ ID NO: 1946496 - DNA, 21 bp, Homo sapiens
acagcctcccctgccagggca

SEQ ID NO: 1946497 - DNA, 12 bp, Homo sapiens
acagcctggcac

SEQ ID NO: 1946498 - DNA, 21 bp, Homo sapiens
acagcctgtttgggaggctgg

SEQ ID NO: 1946499 - DNA, 20 bp, Homo sapiens
acagctaatcagcattctca

SEQ ID NO: 1946500 - DNA, 21 bp, Homo sapiens
acagctgcagagacagagagg

SEQ ID NO: 1946501 - DNA, 13 bp, Homo sapiens
acaggcagaatca

SEQ ID NO: 1946502 - DNA, 18 bp, Homo sapiens
acaggctgcaagctgcag

SEQ ID NO: 1946503 - DNA, 19 bp, Homo sapiens
acaggctgcaagctgcagg

SEQ ID NO: 1946504 - DNA, 18 bp, Homo sapiens
acagggcttctcttttta

SEQ ID NO: 1946505 - DNA, 15 bp, Homo sapiens
acaggggacactgaa

SEQ ID NO: 1946506 - DNA, 13 bp, Homo sapiens
acagggtggggct

SEQ ID NO: 1946507 - DNA, 13 bp, Homo sapiens
acaggtctttgaa

SEQ ID NO: 1946508 - DNA, 17 bp, Homo sapiens
acaggtctttgaaatat

SEQ ID NO: 1946509 - DNA, 13 bp, Homo sapiens
acagtaggagccc

SEQ ID NO: 1946510 - DNA, 14 bp, Homo sapiens
acagtaggagccca

SEQ ID NO: 1946511 - DNA, 15 bp, Homo sapiens
acagtgcatctcagc

SEQ ID NO: 1946512 - DNA, 13 bp, Homo sapiens
acataaaagaaga

SEQ ID NO: 1946513 - DNA, 16 bp, Homo sapiens
acatacaggagagctg

SEQ ID NO: 1946514 - DNA, 12 bp, Homo sapiens
acatacttcagc

SEQ ID NO: 1946515 - DNA, 22 bp, Homo sapiens
acatacttcatcgcagtggact

SEQ ID NO: 1946516 - DNA, 16 bp, Homo sapiens
acatagtgatggttcc

SEQ ID NO: 1946517 - DNA, 21 bp, Homo sapiens
acatagtgatggttcccctgt

SEQ ID NO: 1946518 - DNA, 23 bp, Homo sapiens
acatataatgttgttatttaaag

SEQ ID NO: 1946519 - DNA, 20 bp, Homo sapiens
acatattcatttggaaataa

SEQ ID NO: 1946520 - DNA, 14 bp, Homo sapiens
acatcaagcacaga

SEQ ID NO: 1946521 - DNA, 18 bp, Homo sapiens
acatcaagcacagaagga

SEQ ID NO: 1946522 - DNA, 13 bp, Homo sapiens
acatccaagcttc

SEQ ID NO: 1946523 - DNA, 17 bp, Homo sapiens
acatctaacctcatctt

SEQ ID NO: 1946524 - DNA, 16 bp, Homo sapiens
acatctgtgtcttgtt

SEQ ID NO: 1946525 - DNA, 18 bp, Homo sapiens
acatgaagattctttccc

SEQ ID NO: 1946526 - DNA, 13 bp, Homo sapiens
acatgaatatgat

SEQ ID NO: 1946527 - DNA, 19 bp, Homo sapiens
acatgaccctaaatcttga

SEQ ID NO: 1946528 - DNA, 14 bp, Homo sapiens
acatggcttagttt

SEQ ID NO: 1946529 - DNA, 19 bp, Homo sapiens
acatggcttagttttcata

SEQ ID NO: 1946530 - DNA, 14 bp, Homo sapiens
acatggtagcaggg

SEQ ID NO: 1946531 - DNA, 22 bp, Homo sapiens
acattagcagtttgctttgtat

SEQ ID NO: 1946532 - DNA, 18 bp, Homo sapiens
acattattatcaacaata

SEQ ID NO: 1946533 - DNA, 21 bp, Homo sapiens
acattcaaaaacatggccaca

SEQ ID NO: 1946534 - DNA, 15 bp, Homo sapiens
acattcaataagcat

SEQ ID NO: 1946535 - DNA, 12 bp, Homo sapiens
acattccctctc

SEQ ID NO: 1946536 - DNA, 16 bp, Homo sapiens
agccagctctgcatta

SEQ ID NO: 1946537 - DNA, 12 bp, Homo sapiens
agccaggagacc

SEQ ID NO: 1946538 - DNA, 15 bp, Homo sapiens
agccaggagaccctg

SEQ ID NO: 1946539 - DNA, 16 bp, Homo sapiens
agccaggagcctcctg

SEQ ID NO: 1946540 - DNA, 15 bp, Homo sapiens
agccagggttccaga

SEQ ID NO: 1946541 - DNA, 17 bp, Homo sapiens
agccagggttccagaca

SEQ ID NO: 1946542 - DNA, 19 bp, Homo sapiens
agccagtaaggcagctctg

SEQ ID NO: 1946543 - DNA, 19 bp, Homo sapiens
agccatattccagcagtga

SEQ ID NO: 1946544 - DNA, 14 bp, Homo sapiens
agccattcacaaca

SEQ ID NO: 1946545 - DNA, 13 bp, Homo sapiens
agcccaatcactg

SEQ ID NO: 1946546 - DNA, 16 bp, Homo sapiens
agcccaatcactgcct

SEQ ID NO: 1946547 - DNA, 12 bp, Homo sapiens
agcccaggagga

SEQ ID NO: 1946548 - DNA, 13 bp, Homo sapiens
agcccatcaatta

SEQ ID NO: 1946549 - DNA, 17 bp, Homo sapiens
agccctagggtggagag

SEQ ID NO: 1946550 - DNA, 14 bp, Homo sapiens
agccctgccctcac

SEQ ID NO: 1946551 - DNA, 16 bp, Homo sapiens
agccctgccctcactc

SEQ ID NO: 1946552 - DNA, 17 bp, Homo sapiens
agccctgccctcactcc

SEQ ID NO: 1946553 - DNA, 20 bp, Homo sapiens
agccctgccctcactccact

SEQ ID NO: 1946554 - DNA, 23 bp, Homo sapiens
agccctgccctcactccactccc

SEQ ID NO: 1946555 - DNA, 21 bp, Homo sapiens
agccctttacttgacctccta

SEQ ID NO: 1946556 - DNA, 20 bp, Homo sapiens
agccgcaggggcccctcctc

SEQ ID NO: 1946557 - DNA, 17 bp, Homo sapiens
agccgtgccttcagctc

SEQ ID NO: 1946558 - DNA, 14 bp, Homo sapiens
agccgtggcttccc

SEQ ID NO: 1946559 - DNA, 16 bp, Homo sapiens
agccgtggtcctttgg

SEQ ID NO: 1946560 - DNA, 16 bp, Homo sapiens
agcctagtaggagctg

SEQ ID NO: 1946561 - DNA, 21 bp, Homo sapiens
agcctagtaggagctgagctt

SEQ ID NO: 1946562 - DNA, 14 bp, Homo sapiens
agcctcccctgcca

SEQ ID NO: 1946563 - DNA, 18 bp, Homo sapiens
agcctcccctgccagggc

SEQ ID NO: 1946564 - DNA, 19 bp, Homo sapiens
agcctcccctgccagggca

SEQ ID NO: 1946565 - DNA, 20 bp, Homo sapiens
agcctcccctgccagggcag

SEQ ID NO: 1946566 - DNA, 22 bp, Homo sapiens
agcctcccctgccagggcaggg

SEQ ID NO: 1946567 - DNA, 17 bp, Homo sapiens
agcctccgtatttcaga

SEQ ID NO: 1946568 - DNA, 18 bp, Homo sapiens
agcctccgtatttcagac

SEQ ID NO: 1946569 - DNA, 13 bp, Homo sapiens
agcctcctctctc

SEQ ID NO: 1946570 - DNA, 15 bp, Homo sapiens
agcctcctgaccctg

SEQ ID NO: 1946571 - DNA, 13 bp, Homo sapiens
agcctggagccgt

SEQ ID NO: 1946572 - DNA, 14 bp, Homo sapiens
agcctggagccgtg

SEQ ID NO: 1946573 - DNA, 20 bp, Homo sapiens
agcctggcacagggcagtgg

SEQ ID NO: 1946574 - DNA, 14 bp, Homo sapiens
agcctggccccaag

SEQ ID NO: 1946575 - DNA, 14 bp, Homo sapiens
agcctgggccactg

SEQ ID NO: 1946576 - DNA, 15 bp, Homo sapiens
agcctgggccactgg

SEQ ID NO: 1946577 - DNA, 22 bp, Homo sapiens
agcctggttccctctttcctgt

SEQ ID NO: 1946578 - DNA, 20 bp, Homo sapiens
agcctgtttgggaggctgga

SEQ ID NO: 1946579 - DNA, 15 bp, Homo sapiens
agccttatccagcat

SEQ ID NO: 1946580 - DNA, 19 bp, Homo sapiens
agcgaggaggctccagagg

SEQ ID NO: 1946581 - DNA, 15 bp, Homo sapiens
agcgaggcagaatgg

SEQ ID NO: 1946582 - DNA, 19 bp, Homo sapiens
agcgaggcagaatggtggg

SEQ ID NO: 1946583 - DNA, 16 bp, Homo sapiens
agcgctggcctcttcc

SEQ ID NO: 1946584 - DNA, 18 bp, Homo sapiens
agcggccgcctgtccttg

SEQ ID NO: 1946585 - DNA, 15 bp, Homo sapiens
agcggctcttcctgg

SEQ ID NO: 1946586 - DNA, 15 bp, Homo sapiens
agcgggtaaaaagag

SEQ ID NO: 1946587 - DNA, 15 bp, Homo sapiens
agcgtcctcctctgt

SEQ ID NO: 1946588 - DNA, 17 bp, Homo sapiens
agcgtcctcctctgtga

SEQ ID NO: 1946589 - DNA, 19 bp, Homo sapiens
agcgtcctcctctgtgacc

SEQ ID NO: 1946590 - DNA, 20 bp, Homo sapiens
agcgtgcaccgtgcagcccg

SEQ ID NO: 1946591 - DNA, 17 bp, Homo sapiens
agcgtgctttaaaaaat

SEQ ID NO: 1946592 - DNA, 22 bp, Homo sapiens
agctaatggtcctgttatgtca

SEQ ID NO: 1946593 - DNA, 17 bp, Homo sapiens
agctaattaggaagctt

SEQ ID NO: 1946594 - DNA, 18 bp, Homo sapiens
agctatgttatattgaaa

SEQ ID NO: 1946595 - DNA, 22 bp, Homo sapiens
agctatgttatattgaaaaaat

SEQ ID NO: 1946596 - DNA, 15 bp, Homo sapiens
agctcaggagaaggc

SEQ ID NO: 1946597 - DNA, 15 bp, Homo sapiens
agctccttcctggag

SEQ ID NO: 1946598 - DNA, 18 bp, Homo sapiens
agctctgaaaccagtgtt

SEQ ID NO: 1946599 - DNA, 18 bp, Homo sapiens
agctctgggggctccagc

SEQ ID NO: 1946600 - DNA, 12 bp, Homo sapiens
agctctgtatca

SEQ ID NO: 1946601 - DNA, 23 bp, Homo sapiens
agctctgtatcaggacccagagg

SEQ ID NO: 1946602 - DNA, 21 bp, Homo sapiens
agctctgtcgtggtagcagat

SEQ ID NO: 1946603 - DNA, 12 bp, Homo sapiens
agctgaaatact

SEQ ID NO: 1946604 - DNA, 13 bp, Homo sapiens
agctgagcaggga

SEQ ID NO: 1946605 - DNA, 16 bp, Homo sapiens
agctgaggcagcagtg

SEQ ID NO: 1946606 - DNA, 15 bp, Homo sapiens
agctgcagagacaga

SEQ ID NO: 1946607 - DNA, 17 bp, Homo sapiens
agctgcagagacagaga

SEQ ID NO: 1946608 - DNA, 22 bp, Homo sapiens
agctgccttgagccttaaaacc

SEQ ID NO: 1946609 - DNA, 12 bp, Homo sapiens
agctgctcctag

SEQ ID NO: 1946610 - DNA, 15 bp, Homo sapiens
agctggcaggagggt

SEQ ID NO: 1946611 - DNA, 16 bp, Homo sapiens
agctggcaggagggtg

SEQ ID NO: 1946612 - DNA, 14 bp, Homo sapiens
agctgggttggaaa

SEQ ID NO: 1946613 - DNA, 21 bp, Homo sapiens
agcttcttaatataactgcct

SEQ ID NO: 1946614 - DNA, 23 bp, Homo sapiens
agcttcttaatataactgcctta

SEQ ID NO: 1946615 - DNA, 23 bp, Homo sapiens
agcttggctgtagaaggagacag

SEQ ID NO: 1946616 - DNA, 20 bp, Homo sapiens
agcttttttttcagccattc

SEQ ID NO: 1946617 - DNA, 19 bp, Homo sapiens
aggaagcaacgaagggaaa

SEQ ID NO: 1946618 - DNA, 12 bp, Homo sapiens
aggaagcacaag

SEQ ID NO: 1946619 - DNA, 18 bp, Homo sapiens
aggaagcacaagaagtgg

SEQ ID NO: 1946620 - DNA, 22 bp, Homo sapiens
aggaagcacaagaagtgggagt

SEQ ID NO: 1946621 - DNA, 18 bp, Homo sapiens
aggaaggggccagaggct

SEQ ID NO: 1946622 - DNA, 20 bp, Homo sapiens
aggaaggggccagaggctcg

SEQ ID NO: 1946623 - DNA, 19 bp, Homo sapiens
aggaatgggccaagccagg

SEQ ID NO: 1946624 - DNA, 15 bp, Homo sapiens
aggaattctcacagg

SEQ ID NO: 1946625 - DNA, 14 bp, Homo sapiens
aggaattttagaag

SEQ ID NO: 1946626 - DNA, 23 bp, Homo sapiens
aggacagaaccaacgggtctgtg

SEQ ID NO: 1946627 - DNA, 20 bp, Homo sapiens
aggaccagtcaacctgggca

SEQ ID NO: 1946628 - DNA, 13 bp, Homo sapiens
aggacccaaggtg

SEQ ID NO: 1946629 - DNA, 14 bp, Homo sapiens
aggaccctcccagg

SEQ ID NO: 1946630 - DNA, 20 bp, Homo sapiens
aggacgatttcactgacact

SEQ ID NO: 1946631 - DNA, 19 bp, Homo sapiens
aggactctctttcttccac

SEQ ID NO: 1946632 - DNA, 15 bp, Homo sapiens
aggacttgtgcctct

SEQ ID NO: 1946633 - DNA, 16 bp, Homo sapiens
aggacttgtgcctctt

SEQ ID NO: 1946634 - DNA, 21 bp, Homo sapiens
aggacttgtgcctcttgggag

SEQ ID NO: 1946635 - DNA, 22 bp, Homo sapiens
aggacttgtgcctcttgggaga

SEQ ID NO: 1946636 - DNA, 16 bp, Homo sapiens
aggagaaggcctgccc

SEQ ID NO: 1946637 - DNA, 20 bp, Homo sapiens
aggagaaggcctgcccccct

SEQ ID NO: 1946638 - DNA, 17 bp, Homo sapiens
aggagaccctgtctttg

SEQ ID NO: 1946639 - DNA, 14 bp, Homo sapiens
aggagaggctctga

SEQ ID NO: 1946640 - DNA, 12 bp, Homo sapiens
aggagaggctgc

SEQ ID NO: 1946641 - DNA, 16 bp, Homo sapiens
aggagccccattcctg

SEQ ID NO: 1946642 - DNA, 18 bp, Homo sapiens
aggagccccattcctggg

SEQ ID NO: 1946643 - DNA, 19 bp, Homo sapiens
aggagccccattcctggga

SEQ ID NO: 1946644 - DNA, 21 bp, Homo sapiens
aggagccccattcctgggaaa

SEQ ID NO: 1946645 - DNA, 20 bp, Homo sapiens
aggagcctcctgaccctgtg

SEQ ID NO: 1946646 - DNA, 16 bp, Homo sapiens
aggaggacctgggggg

SEQ ID NO: 1946647 - DNA, 17 bp, Homo sapiens
aggaggctccagagggc

SEQ ID NO: 1946648 - DNA, 18 bp, Homo sapiens
aggagggtcaggaaggat

SEQ ID NO: 1946649 - DNA, 23 bp, Homo sapiens
aggaggtgtggagtggaggggtc

SEQ ID NO: 1946650 - DNA, 18 bp, Homo sapiens
aggaggtttaggtcaaga

SEQ ID NO: 1946651 - DNA, 15 bp, Homo sapiens
aggagtgactctggc

SEQ ID NO: 1946652 - DNA, 22 bp, Homo sapiens
aggagtgggtttccctgcgtct

SEQ ID NO: 1946653 - DNA, 14 bp, Homo sapiens
aggatgatgtaatt

SEQ ID NO: 1946654 - DNA, 14 bp, Homo sapiens
aggatgcttctgct

SEQ ID NO: 1946655 - DNA, 17 bp, Homo sapiens
aggatgggaaggaggga

SEQ ID NO: 1946656 - DNA, 17 bp, Homo sapiens
aggcaagaagtgggatt

SEQ ID NO: 1946657 - DNA, 18 bp, Homo sapiens
aggcaagctggcaggagg

SEQ ID NO: 1946658 - DNA, 19 bp, Homo sapiens
aggcaagctggcaggaggg

SEQ ID NO: 1946659 - DNA, 15 bp, Homo sapiens
aggcaatagtcaaaa

SEQ ID NO: 1946660 - DNA, 23 bp, Homo sapiens
aggcactgagataccagcgagga

SEQ ID NO: 1946661 - DNA, 16 bp, Homo sapiens
aggcagacgatgtcaa

SEQ ID NO: 1946662 - DNA, 22 bp, Homo sapiens
aggcagcagtgtgaggccaggg

SEQ ID NO: 1946663 - DNA, 12 bp, Homo sapiens
aggcagcattta

SEQ ID NO: 1946664 - DNA, 19 bp, Homo sapiens
aggcagctgaaaagtaaat

SEQ ID NO: 1946665 - DNA, 12 bp, Homo sapiens
aggcaggggctg

SEQ ID NO: 1946666 - DNA, 21 bp, Homo sapiens
aggcaggggctgggcagaggg

SEQ ID NO: 1946667 - DNA, 23 bp, Homo sapiens
aggcaggggctgggcagagggga

SEQ ID NO: 1946668 - DNA, 21 bp, Homo sapiens
atagtgtataccacctgtaca

SEQ ID NO: 1946669 - DNA, 18 bp, Homo sapiens
atagttccagataaaaac

SEQ ID NO: 1946670 - DNA, 13 bp, Homo sapiens
atataaacacata

SEQ ID NO: 1946671 - DNA, 14 bp, Homo sapiens
atataaacacataa

SEQ ID NO: 1946672 - DNA, 23 bp, Homo sapiens
atataaatggtgagaattaaaat

SEQ ID NO: 1946673 - DNA, 22 bp, Homo sapiens
atataatgttgttatttaaaga

SEQ ID NO: 1946674 - DNA, 19 bp, Homo sapiens
atatatttaactatttaga

SEQ ID NO: 1946675 - DNA, 15 bp, Homo sapiens
atatatttaggattt

SEQ ID NO: 1946676 - DNA, 17 bp, Homo sapiens
atatccctatgtcccag

SEQ ID NO: 1946677 - DNA, 20 bp, Homo sapiens
atatctgtgcaatggaatat

SEQ ID NO: 1946678 - DNA, 13 bp, Homo sapiens
atatgcacttata

SEQ ID NO: 1946679 - DNA, 18 bp, Homo sapiens
atatgcactttccctaga

SEQ ID NO: 1946680 - DNA, 19 bp, Homo sapiens
atatgtaaattataagtaa

SEQ ID NO: 1946681 - DNA, 14 bp, Homo sapiens
atatgtaccatgta

SEQ ID NO: 1946682 - DNA, 15 bp, Homo sapiens
atatgtatataaaat

SEQ ID NO: 1946683 - DNA, 13 bp, Homo sapiens
atatgtattactt

SEQ ID NO: 1946684 - DNA, 22 bp, Homo sapiens
atatgttgatgaaaaatagcaa

SEQ ID NO: 1946685 - DNA, 14 bp, Homo sapiens
atattacttttgta

SEQ ID NO: 1946686 - DNA, 15 bp, Homo sapiens
atattacttttgtaa

SEQ ID NO: 1946687 - DNA, 12 bp, Homo sapiens
atattataagat

SEQ ID NO: 1946688 - DNA, 13 bp, Homo sapiens
atattcatttcaa

SEQ ID NO: 1946689 - DNA, 13 bp, Homo sapiens
atattcatttgga

SEQ ID NO: 1946690 - DNA, 15 bp, Homo sapiens
atattcatttggaaa

SEQ ID NO: 1946691 - DNA, 19 bp, Homo sapiens
atattccagcagtgaaact

SEQ ID NO: 1946692 - DNA, 19 bp, Homo sapiens
atattcttgtccacattct

SEQ ID NO: 1946693 - DNA, 22 bp, Homo sapiens
atattcttgtccacattctact

SEQ ID NO: 1946694 - DNA, 16 bp, Homo sapiens
atattgaaaaaataga

SEQ ID NO: 1946695 - DNA, 13 bp, Homo sapiens
atattggtgtgaa

SEQ ID NO: 1946696 - DNA, 14 bp, Homo sapiens
atattggtgtgaat

SEQ ID NO: 1946697 - DNA, 23 bp, Homo sapiens
atattggtgtgaatgctgtacct

SEQ ID NO: 1946698 - DNA, 15 bp, Homo sapiens
atatttctatgtaaa

SEQ ID NO: 1946699 - DNA, 15 bp, Homo sapiens
atattttatttttat

SEQ ID NO: 1946700 - DNA, 20 bp, Homo sapiens
atattttcaacgcagccctg

SEQ ID NO: 1946701 - DNA, 21 bp, Homo sapiens
atattttcaccatttgattat

SEQ ID NO: 1946702 - DNA, 22 bp, Homo sapiens
atattttctatatttgtaactt

SEQ ID NO: 1946703 - DNA, 20 bp, Homo sapiens
atcaaactttcagctttttt

SEQ ID NO: 1946704 - DNA, 16 bp, Homo sapiens
atcaacaaaaattgtc

SEQ ID NO: 1946705 - DNA, 16 bp, Homo sapiens
atcaacttgtcacaaa

SEQ ID NO: 1946706 - DNA, 13 bp, Homo sapiens
atcaagatacctt

SEQ ID NO: 1946707 - DNA, 15 bp, Homo sapiens
atcaagcttgtgtac

SEQ ID NO: 1946708 - DNA, 22 bp, Homo sapiens
atcaagttattgacaaactctc

SEQ ID NO: 1946709 - DNA, 23 bp, Homo sapiens
atcaagttggcttctaatcaaag

SEQ ID NO: 1946710 - DNA, 19 bp, Homo sapiens
atcaatgtttcttctaggt

SEQ ID NO: 1946711 - DNA, 15 bp, Homo sapiens
atcaattctctatca

SEQ ID NO: 1946712 - DNA, 20 bp, Homo sapiens
atcacagattttttctttaa

SEQ ID NO: 1946713 - DNA, 22 bp, Homo sapiens
atcaccgtgggctccctgactg

SEQ ID NO: 1946714 - DNA, 12 bp, Homo sapiens
atcactattctt

SEQ ID NO: 1946715 - DNA, 14 bp, Homo sapiens
atcactattcttaa

SEQ ID NO: 1946716 - DNA, 19 bp, Homo sapiens
atcactgctgtccctcctg

SEQ ID NO: 1946717 - DNA, 23 bp, Homo sapiens
atcagaatctttaaagaggagcc

SEQ ID NO: 1946718 - DNA, 20 bp, Homo sapiens
atcagaccataatgttacat

SEQ ID NO: 1946719 - DNA, 15 bp, Homo sapiens
atcagcagtgattga

SEQ ID NO: 1946720 - DNA, 15 bp, Homo sapiens
atcagctccttcctg

SEQ ID NO: 1946721 - DNA, 17 bp, Homo sapiens
atcagctccttcctgga

SEQ ID NO: 1946722 - DNA, 22 bp, Homo sapiens
atcatagaggatgatgtaatta

SEQ ID NO: 1946723 - DNA, 12 bp, Homo sapiens
atcatagtacag

SEQ ID NO: 1946724 - DNA, 21 bp, Homo sapiens
atcatctattgctggcaaaga

SEQ ID NO: 1946725 - DNA, 23 bp, Homo sapiens
atcatctcctgccttcctcctgg

SEQ ID NO: 1946726 - DNA, 16 bp, Homo sapiens
atcattctctgtctca

SEQ ID NO: 1946727 - DNA, 15 bp, Homo sapiens
atcattctttctgct

SEQ ID NO: 1946728 - DNA, 16 bp, Homo sapiens
atcattctttctgcta

SEQ ID NO: 1946729 - DNA, 19 bp, Homo sapiens
atccaagatattttaaaat

SEQ ID NO: 1946730 - DNA, 18 bp, Homo sapiens
atccacagaggccaggca

SEQ ID NO: 1946731 - DNA, 19 bp, Homo sapiens
atccactaggtgcccagtc

SEQ ID NO: 1946732 - DNA, 23 bp, Homo sapiens
atccactaggtgcccagtcttga

SEQ ID NO: 1946733 - DNA, 19 bp, Homo sapiens
atccagatgaactgagaag

SEQ ID NO: 1946734 - DNA, 14 bp, Homo sapiens
atccaggtaatcca

SEQ ID NO: 1946735 - DNA, 18 bp, Homo sapiens
atccaggtcctttccttc

SEQ ID NO: 1946736 - DNA, 19 bp, Homo sapiens
atccaggtcctttccttct

SEQ ID NO: 1946737 - DNA, 21 bp, Homo sapiens
atccaggtcctttccttctcg

SEQ ID NO: 1946738 - DNA, 14 bp, Homo sapiens
atccatcatcatgt

SEQ ID NO: 1946739 - DNA, 17 bp, Homo sapiens
atcccagagaacaatca

SEQ ID NO: 1946740 - DNA, 21 bp, Homo sapiens
atcccagagaacaatcactat

SEQ ID NO: 1946741 - DNA, 22 bp, Homo sapiens
atcccagagaacaatcactatt

SEQ ID NO: 1946742 - DNA, 19 bp, Homo sapiens
atccctagtcttcaagcag

SEQ ID NO: 1946743 - DNA, 19 bp, Homo sapiens
atccctatgtcccagcccc

SEQ ID NO: 1946744 - DNA, 21 bp, Homo sapiens
atccctatgtcccagcccctg

SEQ ID NO: 1946745 - DNA, 17 bp, Homo sapiens
atccctctacagagctt

SEQ ID NO: 1946746 - DNA, 21 bp, Homo sapiens
atccctctacagagcttccct

SEQ ID NO: 1946747 - DNA, 23 bp, Homo sapiens
atccctctacagagcttccctga

SEQ ID NO: 1946748 - DNA, 14 bp, Homo sapiens
atccctctcctccc

SEQ ID NO: 1946749 - DNA, 12 bp, Homo sapiens
atccctgagaga

SEQ ID NO: 1946750 - DNA, 18 bp, Homo sapiens
atccgcctctgagccagg

SEQ ID NO: 1946751 - DNA, 19 bp, Homo sapiens
atccgcctctgagccagga

SEQ ID NO: 1946752 - DNA, 21 bp, Homo sapiens
atcctcactgagaaggcccca

SEQ ID NO: 1946753 - DNA, 20 bp, Homo sapiens
atcctgtacaagtgctcagt

SEQ ID NO: 1946754 - DNA, 16 bp, Homo sapiens
atcctgtcaatgtttg

SEQ ID NO: 1946755 - DNA, 17 bp, Homo sapiens
atccttgcctccaacgt

SEQ ID NO: 1946756 - DNA, 20 bp, Homo sapiens
atcgcaccactgtgtattta

SEQ ID NO: 1946757 - DNA, 13 bp, Homo sapiens
atcgccctgagct

SEQ ID NO: 1946758 - DNA, 15 bp, Homo sapiens
atcggagcctcctct

SEQ ID NO: 1946759 - DNA, 14 bp, Homo sapiens
atcgtgacagcagc

SEQ ID NO: 1946760 - DNA, 15 bp, Homo sapiens
atcgtgacagcagca

SEQ ID NO: 1946761 - DNA, 14 bp, Homo sapiens
atctaacctcatct

SEQ ID NO: 1946762 - DNA, 18 bp, Homo sapiens
atctaacctcatcttctt

SEQ ID NO: 1946763 - DNA, 15 bp, Homo sapiens
atctacgatgttaaa

SEQ ID NO: 1946764 - DNA, 20 bp, Homo sapiens
atctaggtgaggattgatta

SEQ ID NO: 1946765 - DNA, 19 bp, Homo sapiens
atctatttatctgtctgag

SEQ ID NO: 1946766 - DNA, 20 bp, Homo sapiens
atctcactttaataataaaa

SEQ ID NO: 1946767 - DNA, 19 bp, Homo sapiens
atctcattaattcaattaa

SEQ ID NO: 1946768 - DNA, 22 bp, Homo sapiens
atctcattgcaaaaatatttta

SEQ ID NO: 1946769 - DNA, 19 bp, Homo sapiens
atctcattggacccttcca

SEQ ID NO: 1946770 - DNA, 19 bp, Homo sapiens
atctcccagataatgtgaa

SEQ ID NO: 1946771 - DNA, 20 bp, Homo sapiens
atctcctgccttcctcctgg

SEQ ID NO: 1946772 - DNA, 15 bp, Homo sapiens
atctctggagtgtgt

SEQ ID NO: 1946773 - DNA, 21 bp, Homo sapiens
atctgaagtgtctaatgcatt

SEQ ID NO: 1946774 - DNA, 20 bp, Homo sapiens
atctgctgacagatgttcca

SEQ ID NO: 1946775 - DNA, 21 bp, Homo sapiens
atctggagtctgaaggagagg

SEQ ID NO: 1946776 - DNA, 15 bp, Homo sapiens
atctgtctgagccct

SEQ ID NO: 1946777 - DNA, 18 bp, Homo sapiens
atctgtctgagccctgcc

SEQ ID NO: 1946778 - DNA, 22 bp, Homo sapiens
atctgtctgagccctgccctca

SEQ ID NO: 1946779 - DNA, 22 bp, Homo sapiens
atctgtgcaatggaatataaat

SEQ ID NO: 1946780 - DNA, 14 bp, Homo sapiens
atctgtggcctggg

SEQ ID NO: 1946781 - DNA, 15 bp, Homo sapiens
atcttaagataatat

SEQ ID NO: 1946782 - DNA, 19 bp, Homo sapiens
atcttaagataatatttaa

SEQ ID NO: 1946783 - DNA, 22 bp, Homo sapiens
atcttaagataatatttaaaat

SEQ ID NO: 1946784 - DNA, 16 bp, Homo sapiens
atcttagtatttgcat

SEQ ID NO: 1946785 - DNA, 14 bp, Homo sapiens
atcttcttcaccat

SEQ ID NO: 1946786 - DNA, 15 bp, Homo sapiens
atctttgctcccagt

SEQ ID NO: 1946787 - DNA, 17 bp, Homo sapiens
atgaaataccaactatg

SEQ ID NO: 1946788 - DNA, 12 bp, Homo sapiens
atgaaattgcca

SEQ ID NO: 1946789 - DNA, 22 bp, Homo sapiens
atgaaattttaccattttgcga

SEQ ID NO: 1946790 - DNA, 23 bp, Homo sapiens
atgaaattttaccattttgcgat

SEQ ID NO: 1946791 - DNA, 14 bp, Homo sapiens
atgaagaaagtgga

SEQ ID NO: 1946792 - DNA, 21 bp, Homo sapiens
atgaatactgtattttgtatt

SEQ ID NO: 1946793 - DNA, 13 bp, Homo sapiens
atgaatgatatct

SEQ ID NO: 1946794 - DNA, 11 bp, Homo sapiens
atgaatgttta

SEQ ID NO: 1946795 - DNA, 13 bp, Homo sapiens
atgaattgcattt

SEQ ID NO: 1946796 - DNA, 20 bp, Homo sapiens
atgacacaaataccagagca

SEQ ID NO: 1946797 - DNA, 19 bp, Homo sapiens
atgacgtattgtgaaattt

SEQ ID NO: 1946798 - DNA, 18 bp, Homo sapiens
atgagaccactgttatca

SEQ ID NO: 1946799 - DNA, 10 bp, Homo sapiens
atgagagagt

SEQ ID NO: 1946800 - DNA, 21 bp, Homo sapiens
cactgattacttttgggaggg

SEQ ID NO: 1946801 - DNA, 23 bp, Homo sapiens
cactgcacagtgcatctcagccc

SEQ ID NO: 1946802 - DNA, 22 bp, Homo sapiens
cactgcagtcacccctgtctgc

SEQ ID NO: 1946803 - DNA, 18 bp, Homo sapiens
cactgcccacctgccagg

SEQ ID NO: 1946804 - DNA, 22 bp, Homo sapiens
cactgccttcgatacaccgggc

SEQ ID NO: 1946805 - DNA, 16 bp, Homo sapiens
cactgcgaactctcag

SEQ ID NO: 1946806 - DNA, 19 bp, Homo sapiens
cactgcggaacaggagtga

SEQ ID NO: 1946807 - DNA, 15 bp, Homo sapiens
cactgctggctgcct

SEQ ID NO: 1946808 - DNA, 18 bp, Homo sapiens
cactgctgtccctcctga

SEQ ID NO: 1946809 - DNA, 18 bp, Homo sapiens
cactgggccggcagcctg

SEQ ID NO: 1946810 - DNA, 17 bp, Homo sapiens
cactgtcatgcccagct

SEQ ID NO: 1946811 - DNA, 22 bp, Homo sapiens
cactgtcatgcccagcttggag

SEQ ID NO: 1946812 - DNA, 15 bp, Homo sapiens
cactgttatcaaaac

SEQ ID NO: 1946813 - DNA, 23 bp, Homo sapiens
cacttacaaataaatccaagact

SEQ ID NO: 1946814 - DNA, 23 bp, Homo sapiens
cacttcaggctcttctcctttca

SEQ ID NO: 1946815 - DNA, 16 bp, Homo sapiens
cacttcccatttgtgt

SEQ ID NO: 1946816 - DNA, 16 bp, Homo sapiens
cacttgggtcttccct

SEQ ID NO: 1946817 - DNA, 22 bp, Homo sapiens
cacttgtgggtttttgttttgt

SEQ ID NO: 1946818 - DNA, 21 bp, Homo sapiens
cactttgaaaatatttctatg

SEQ ID NO: 1946819 - DNA, 18 bp, Homo sapiens
cagaaagggcagcccctc

SEQ ID NO: 1946820 - DNA, 20 bp, Homo sapiens
cagaaagggcagcccctccc

SEQ ID NO: 1946821 - DNA, 15 bp, Homo sapiens
cagaactctttcaaa

SEQ ID NO: 1946822 - DNA, 16 bp, Homo sapiens
cagaactctttcaaaa

SEQ ID NO: 1946823 - DNA, 12 bp, Homo sapiens
cagaagagaaag

SEQ ID NO: 1946824 - DNA, 16 bp, Homo sapiens
cagaagggtttatacc

SEQ ID NO: 1946825 - DNA, 23 bp, Homo sapiens
cagaataaatgggtaacactgat

SEQ ID NO: 1946826 - DNA, 20 bp, Homo sapiens
cagaatggtgggctccagag

SEQ ID NO: 1946827 - DNA, 17 bp, Homo sapiens
cagacaaaccagaagca

SEQ ID NO: 1946828 - DNA, 15 bp, Homo sapiens
cagacagggtggggc

SEQ ID NO: 1946829 - DNA, 16 bp, Homo sapiens
cagacagggtggggct

SEQ ID NO: 1946830 - DNA, 22 bp, Homo sapiens
cagaccccaccctgtctgcagg

SEQ ID NO: 1946831 - DNA, 23 bp, Homo sapiens
cagaccccaccctgtctgcaggc

SEQ ID NO: 1946832 - DNA, 13 bp, Homo sapiens
cagacccctggct

SEQ ID NO: 1946833 - DNA, 22 bp, Homo sapiens
cagacccctggcttttcactgc

SEQ ID NO: 1946834 - DNA, 14 bp, Homo sapiens
cagaccctgccagg

SEQ ID NO: 1946835 - DNA, 15 bp, Homo sapiens
cagaccctgccaggg

SEQ ID NO: 1946836 - DNA, 16 bp, Homo sapiens
cagacctgggacttta

SEQ ID NO: 1946837 - DNA, 17 bp, Homo sapiens
cagacgcacgtgggtct

SEQ ID NO: 1946838 - DNA, 17 bp, Homo sapiens
cagactctctcctctct

SEQ ID NO: 1946839 - DNA, 21 bp, Homo sapiens
cagactgtgggtccctgcgtc

SEQ ID NO: 1946840 - DNA, 21 bp, Homo sapiens
cagagaacaatcactattctt

SEQ ID NO: 1946841 - DNA, 17 bp, Homo sapiens
cagagaggagtcagaga

SEQ ID NO: 1946842 - DNA, 22 bp, Homo sapiens
cagagagggggccacctcccca

SEQ ID NO: 1946843 - DNA, 13 bp, Homo sapiens
cagagagtggctc

SEQ ID NO: 1946844 - DNA, 16 bp, Homo sapiens
cagagccatctgcgac

SEQ ID NO: 1946845 - DNA, 18 bp, Homo sapiens
cagagcctatggaaaggg

SEQ ID NO: 1946846 - DNA, 16 bp, Homo sapiens
cagaggcagtggcagc

SEQ ID NO: 1946847 - DNA, 13 bp, Homo sapiens
cagaggggagagg

SEQ ID NO: 1946848 - DNA, 15 bp, Homo sapiens
cagaggggagaggaa

SEQ ID NO: 1946849 - DNA, 18 bp, Homo sapiens
cagaggggagaggaagca

SEQ ID NO: 1946850 - DNA, 17 bp, Homo sapiens
cagagtaggtgggtctt

SEQ ID NO: 1946851 - DNA, 22 bp, Homo sapiens
cagagtcagaattaggcacttg

SEQ ID NO: 1946852 - DNA, 15 bp, Homo sapiens
cagagtggatctgga

SEQ ID NO: 1946853 - DNA, 19 bp, Homo sapiens
cagagtggatctggagtct

SEQ ID NO: 1946854 - DNA, 23 bp, Homo sapiens
cagagttgtgcacatggcttagt

SEQ ID NO: 1946855 - DNA, 13 bp, Homo sapiens
cagatatgtatta

SEQ ID NO: 1946856 - DNA, 16 bp, Homo sapiens
cagatatgtattactt

SEQ ID NO: 1946857 - DNA, 16 bp, Homo sapiens
cagatcttgagcaagg

SEQ ID NO: 1946858 - DNA, 18 bp, Homo sapiens
cagatgacccctccccta

SEQ ID NO: 1946859 - DNA, 16 bp, Homo sapiens
cagattttttctttaa

SEQ ID NO: 1946860 - DNA, 15 bp, Homo sapiens
cagcagagccatctg

SEQ ID NO: 1946861 - DNA, 15 bp, Homo sapiens
cagcattctcactcc

SEQ ID NO: 1946862 - DNA, 21 bp, Homo sapiens
cagcatttcggtgcttccctt

SEQ ID NO: 1946863 - DNA, 18 bp, Homo sapiens
cagccaaattgcagaaga

SEQ ID NO: 1946864 - DNA, 23 bp, Homo sapiens
cagccagtaaggcagctctgtcg

SEQ ID NO: 1946865 - DNA, 15 bp, Homo sapiens
cagccattcacaaca

SEQ ID NO: 1946866 - DNA, 21 bp, Homo sapiens
cagccattcacaacacaatca

SEQ ID NO: 1946867 - DNA, 22 bp, Homo sapiens
cagccattcacaacacaatcaa

SEQ ID NO: 1946868 - DNA, 19 bp, Homo sapiens
cagcccacatagtgatggt

SEQ ID NO: 1946869 - DNA, 12 bp, Homo sapiens
cagcccagcctg

SEQ ID NO: 1946870 - DNA, 15 bp, Homo sapiens
cagcccagcctgcat

SEQ ID NO: 1946871 - DNA, 13 bp, Homo sapiens
cagcccctcccca

SEQ ID NO: 1946872 - DNA, 19 bp, Homo sapiens
cagcccctggtactccccc

SEQ ID NO: 1946873 - DNA, 13 bp, Homo sapiens
cagccctcatccc

SEQ ID NO: 1946874 - DNA, 17 bp, Homo sapiens
cagccctcatcccgagc

SEQ ID NO: 1946875 - DNA, 15 bp, Homo sapiens
cagccctccctgccc

SEQ ID NO: 1946876 - DNA, 11 bp, Homo sapiens
cagccctgctt

SEQ ID NO: 1946877 - DNA, 18 bp, Homo sapiens
cagcctcccctgccaggg

SEQ ID NO: 1946878 - DNA, 22 bp, Homo sapiens
cagcctccggatgacacaaata

SEQ ID NO: 1946879 - DNA, 18 bp, Homo sapiens
cagcctccgtatttcaga

SEQ ID NO: 1946880 - DNA, 14 bp, Homo sapiens
cagcctggagccgt

SEQ ID NO: 1946881 - DNA, 19 bp, Homo sapiens
cagcctgtgggagaaggga

SEQ ID NO: 1946882 - DNA, 20 bp, Homo sapiens
cagcgcccagcctggcccca

SEQ ID NO: 1946883 - DNA, 19 bp, Homo sapiens
cagcgctggcagcgctcct

SEQ ID NO: 1946884 - DNA, 17 bp, Homo sapiens
cagcggctcttcctgga

SEQ ID NO: 1946885 - DNA, 16 bp, Homo sapiens
cagcgggtaaaaagag

SEQ ID NO: 1946886 - DNA, 16 bp, Homo sapiens
cagcgtcctcctctgt

SEQ ID NO: 1946887 - DNA, 16 bp, Homo sapiens
cagcgtctgagcggcc

SEQ ID NO: 1946888 - DNA, 15 bp, Homo sapiens
cagcgtgctttaaaa

SEQ ID NO: 1946889 - DNA, 14 bp, Homo sapiens
cagcgtggcctccg

SEQ ID NO: 1946890 - DNA, 20 bp, Homo sapiens
cagctatgttatattgaaaa

SEQ ID NO: 1946891 - DNA, 12 bp, Homo sapiens
cagctcaagtta

SEQ ID NO: 1946892 - DNA, 21 bp, Homo sapiens
cagctccggaaggacacagtc

SEQ ID NO: 1946893 - DNA, 21 bp, Homo sapiens
cagctcctcttcctgcctctc

SEQ ID NO: 1946894 - DNA, 16 bp, Homo sapiens
cagctgaaaagtaaat

SEQ ID NO: 1946895 - DNA, 14 bp, Homo sapiens
cagctgacggcagt

SEQ ID NO: 1946896 - DNA, 16 bp, Homo sapiens
cagctgcagagacaga

SEQ ID NO: 1946897 - DNA, 23 bp, Homo sapiens
cagctggatgagaatttgagtgc

SEQ ID NO: 1946898 - DNA, 22 bp, Homo sapiens
cagctggatggggcggcctgca

SEQ ID NO: 1946899 - DNA, 14 bp, Homo sapiens
cagctgtactgagt

SEQ ID NO: 1946900 - DNA, 22 bp, Homo sapiens
cagctgttagagtccaacgtgg

SEQ ID NO: 1946901 - DNA, 14 bp, Homo sapiens
cagcttggagtgcc

SEQ ID NO: 1946902 - DNA, 21 bp, Homo sapiens
cagcttttttttcagccattc

SEQ ID NO: 1946903 - DNA, 15 bp, Homo sapiens
caggaaaggaatcat

SEQ ID NO: 1946904 - DNA, 19 bp, Homo sapiens
caggaaaggaatcatttct

SEQ ID NO: 1946905 - DNA, 21 bp, Homo sapiens
caggaaatgaaaatgtcttgt

SEQ ID NO: 1946906 - DNA, 18 bp, Homo sapiens
caggaagcacagcaggtt

SEQ ID NO: 1946907 - DNA, 19 bp, Homo sapiens
caggacagctgcttctgtg

SEQ ID NO: 1946908 - DNA, 21 bp, Homo sapiens
caggaccagtcaacctgggca

SEQ ID NO: 1946909 - DNA, 19 bp, Homo sapiens
caggacgatttcactgaca

SEQ ID NO: 1946910 - DNA, 20 bp, Homo sapiens
caggactccttgttctgctc

SEQ ID NO: 1946911 - DNA, 14 bp, Homo sapiens
caggactctctttc

SEQ ID NO: 1946912 - DNA, 13 bp, Homo sapiens
caggaggacctgg

SEQ ID NO: 1946913 - DNA, 23 bp, Homo sapiens
caggaggagactagatttatgaa

SEQ ID NO: 1946914 - DNA, 23 bp, Homo sapiens
caggaggcctgggagatgcagct

SEQ ID NO: 1946915 - DNA, 22 bp, Homo sapiens
caggagtgactctggctgccaa

SEQ ID NO: 1946916 - DNA, 22 bp, Homo sapiens
caggagtgggtttccctgcgtc

SEQ ID NO: 1946917 - DNA, 21 bp, Homo sapiens
caggcatgcgaatgagctggg

SEQ ID NO: 1946918 - DNA, 19 bp, Homo sapiens
caggcattgccaagggctt

SEQ ID NO: 1946919 - DNA, 17 bp, Homo sapiens
caggccctctctgcagt

SEQ ID NO: 1946920 - DNA, 17 bp, Homo sapiens
caggcccttcctctcca

SEQ ID NO: 1946921 - DNA, 23 bp, Homo sapiens
caggcccttcctctccactgcct

SEQ ID NO: 1946922 - DNA, 15 bp, Homo sapiens
caggcgccccttccc

SEQ ID NO: 1946923 - DNA, 14 bp, Homo sapiens
caggcgttctcagc

SEQ ID NO: 1946924 - DNA, 18 bp, Homo sapiens
caggctcaggctgcccag

SEQ ID NO: 1946925 - DNA, 22 bp, Homo sapiens
caggctcttctcctttcacaac

SEQ ID NO: 1946926 - DNA, 19 bp, Homo sapiens
caggctgcaagctgcaggg

SEQ ID NO: 1946927 - DNA, 20 bp, Homo sapiens
caggctgcaagctgcaggga

SEQ ID NO: 1946928 - DNA, 12 bp, Homo sapiens
caggctgcccag

SEQ ID NO: 1946929 - DNA, 16 bp, Homo sapiens
caggctgcccagcggc

SEQ ID NO: 1946930 - DNA, 13 bp, Homo sapiens
cagggaagaaatc

SEQ ID NO: 1946931 - DNA, 14 bp, Homo sapiens
cctagtagtcattt

SEQ ID NO: 1946932 - DNA, 19 bp, Homo sapiens
cctagtgaaggcttctctc

SEQ ID NO: 1946933 - DNA, 21 bp, Homo sapiens
cctagtgaaggcttctctctg

SEQ ID NO: 1946934 - DNA, 12 bp, Homo sapiens
cctagtggggag

SEQ ID NO: 1946935 - DNA, 18 bp, Homo sapiens
cctataaaggaaacacgt

SEQ ID NO: 1946936 - DNA, 20 bp, Homo sapiens
cctataccctaggtctccac

SEQ ID NO: 1946937 - DNA, 22 bp, Homo sapiens
cctataccctaggtctccaccc

SEQ ID NO: 1946938 - DNA, 17 bp, Homo sapiens
cctatcctgcaccctct

SEQ ID NO: 1946939 - DNA, 18 bp, Homo sapiens
cctatcctgcaccctctg

SEQ ID NO: 1946940 - DNA, 19 bp, Homo sapiens
cctatgccacctgcagcgt

SEQ ID NO: 1946941 - DNA, 18 bp, Homo sapiens
cctatggaaagggtgtgg

SEQ ID NO: 1946942 - DNA, 21 bp, Homo sapiens
cctatggaaagggtgtggctt

SEQ ID NO: 1946943 - DNA, 20 bp, Homo sapiens
cctcaagccaggagaccctg

SEQ ID NO: 1946944 - DNA, 16 bp, Homo sapiens
cctcaatggaggtttg

SEQ ID NO: 1946945 - DNA, 15 bp, Homo sapiens
cctcactccactccc

SEQ ID NO: 1946946 - DNA, 19 bp, Homo sapiens
cctcactccactcccctca

SEQ ID NO: 1946947 - DNA, 22 bp, Homo sapiens
cctcactccactcccctcatcc

SEQ ID NO: 1946948 - DNA, 23 bp, Homo sapiens
cctcactgagaaggccccagggc

SEQ ID NO: 1946949 - DNA, 15 bp, Homo sapiens
cctcaggttccaaat

SEQ ID NO: 1946950 - DNA, 23 bp, Homo sapiens
cctcagtgagatcagtcagctcc

SEQ ID NO: 1946951 - DNA, 23 bp, Homo sapiens
cctcatcacacgtcacaatgtcc

SEQ ID NO: 1946952 - DNA, 15 bp, Homo sapiens
cctcatccatgcaga

SEQ ID NO: 1946953 - DNA, 20 bp, Homo sapiens
cctcatcccgagcacctcca

SEQ ID NO: 1946954 - DNA, 17 bp, Homo sapiens
cctcatctgtccctccg

SEQ ID NO: 1946955 - DNA, 14 bp, Homo sapiens
cctcatgctctcta

SEQ ID NO: 1946956 - DNA, 22 bp, Homo sapiens
cctccaatcccaccaaccctca

SEQ ID NO: 1946957 - DNA, 23 bp, Homo sapiens
cctccaatcccaccaaccctcag

SEQ ID NO: 1946958 - DNA, 14 bp, Homo sapiens
cctccacatcctcc

SEQ ID NO: 1946959 - DNA, 15 bp, Homo sapiens
cctccacccgtcctg

SEQ ID NO: 1946960 - DNA, 12 bp, Homo sapiens
cctccactcctc

SEQ ID NO: 1946961 - DNA, 15 bp, Homo sapiens
cctccactcctccca

SEQ ID NO: 1946962 - DNA, 9 bp, Homo sapiens
cctccagac

SEQ ID NO: 1946963 - DNA, 10 bp, Homo sapiens
cctccagacc

SEQ ID NO: 1946964 - DNA, 15 bp, Homo sapiens
cctccagacccctac

SEQ ID NO: 1946965 - DNA, 22 bp, Homo sapiens
cctccagcaatgcctgcctgaa

SEQ ID NO: 1946966 - DNA, 17 bp, Homo sapiens
cctcccaactctggcct

SEQ ID NO: 1946967 - DNA, 15 bp, Homo sapiens
cctccccaaggaaga

SEQ ID NO: 1946968 - DNA, 13 bp, Homo sapiens
cctccccaggccg

SEQ ID NO: 1946969 - DNA, 16 bp, Homo sapiens
cctcccctgccagggc

SEQ ID NO: 1946970 - DNA, 13 bp, Homo sapiens
cctcccggtgccc

SEQ ID NO: 1946971 - DNA, 16 bp, Homo sapiens
cctcccggtgcccaag

SEQ ID NO: 1946972 - DNA, 15 bp, Homo sapiens
cctccctccacacct

SEQ ID NO: 1946973 - DNA, 14 bp, Homo sapiens
cctccctccctcca

SEQ ID NO: 1946974 - DNA, 15 bp, Homo sapiens
cctccctccctccac

SEQ ID NO: 1946975 - DNA, 15 bp, Homo sapiens
cctccctccctgcag

SEQ ID NO: 1946976 - DNA, 16 bp, Homo sapiens
cctccctccctgcagg

SEQ ID NO: 1946977 - DNA, 14 bp, Homo sapiens
cctccctcctgtgt

SEQ ID NO: 1946978 - DNA, 13 bp, Homo sapiens
cctccctgcaggg

SEQ ID NO: 1946979 - DNA, 14 bp, Homo sapiens
cctccctgcagggt

SEQ ID NO: 1946980 - DNA, 13 bp, Homo sapiens
cctccctgcccct

SEQ ID NO: 1946981 - DNA, 22 bp, Homo sapiens
cctccctgcccctcccttcaac

SEQ ID NO: 1946982 - DNA, 20 bp, Homo sapiens
cctccctgtcccctgaggtt

SEQ ID NO: 1946983 - DNA, 15 bp, Homo sapiens
cctccgtatttcaga

SEQ ID NO: 1946984 - DNA, 20 bp, Homo sapiens
cctcctgaccctgtgatgcc

SEQ ID NO: 1946985 - DNA, 21 bp, Homo sapiens
cctcctgggccctctctgctc

SEQ ID NO: 1946986 - DNA, 15 bp, Homo sapiens
cctcctgttcctgcc

SEQ ID NO: 1946987 - DNA, 21 bp, Homo sapiens
cctcctgttcctgccttctct

SEQ ID NO: 1946988 - DNA, 16 bp, Homo sapiens
cctccttagaaaagac

SEQ ID NO: 1946989 - DNA, 17 bp, Homo sapiens
cctccttctcccctcca

SEQ ID NO: 1946990 - DNA, 18 bp, Homo sapiens
cctccttctcccctccag

SEQ ID NO: 1946991 - DNA, 21 bp, Homo sapiens
cctccttgccgctgggagagc

SEQ ID NO: 1946992 - DNA, 14 bp, Homo sapiens
cctcgctgccagct

SEQ ID NO: 1946993 - DNA, 20 bp, Homo sapiens
cctcgctgccagctctgtat

SEQ ID NO: 1946994 - DNA, 18 bp, Homo sapiens
cctcgctggactctcagt

SEQ ID NO: 1946995 - DNA, 22 bp, Homo sapiens
cctctcatccaggtcctttcct

SEQ ID NO: 1946996 - DNA, 14 bp, Homo sapiens
cctctccactgcct

SEQ ID NO: 1946997 - DNA, 13 bp, Homo sapiens
cctctccagccct

SEQ ID NO: 1946998 - DNA, 21 bp, Homo sapiens
cctctcggctggaagaacatc

SEQ ID NO: 1946999 - DNA, 13 bp, Homo sapiens
cctctctctccct

SEQ ID NO: 1947000 - DNA, 16 bp, Homo sapiens
cctctctctccctcca

SEQ ID NO: 1947001 - DNA, 12 bp, Homo sapiens
cctctctgcagt

SEQ ID NO: 1947002 - DNA, 13 bp, Homo sapiens
cctctctgcagtc

SEQ ID NO: 1947003 - DNA, 15 bp, Homo sapiens
cctctctgctctgcg

SEQ ID NO: 1947004 - DNA, 16 bp, Homo sapiens
cctctctgctctgcgt

SEQ ID NO: 1947005 - DNA, 13 bp, Homo sapiens
cctctctgtttac

SEQ ID NO: 1947006 - DNA, 21 bp, Homo sapiens
cctctctgtttaccctccctg

SEQ ID NO: 1947007 - DNA, 16 bp, Homo sapiens
cctctcttaccccgtc

SEQ ID NO: 1947008 - DNA, 22 bp, Homo sapiens
cctctgactcagggctcctggg

SEQ ID NO: 1947009 - DNA, 14 bp, Homo sapiens
cctctgagccagga

SEQ ID NO: 1947010 - DNA, 15 bp, Homo sapiens
cctctgcagggcagc

SEQ ID NO: 1947011 - DNA, 19 bp, Homo sapiens
cctctgcagggcagcctgt

SEQ ID NO: 1947012 - DNA, 19 bp, Homo sapiens
cctctgctatgtctgtgat

SEQ ID NO: 1947013 - DNA, 20 bp, Homo sapiens
cctctggccaaatatgcact

SEQ ID NO: 1947014 - DNA, 19 bp, Homo sapiens
cctctgtccaggcactgag

SEQ ID NO: 1947015 - DNA, 13 bp, Homo sapiens
cctctgtcctggc

SEQ ID NO: 1947016 - DNA, 13 bp, Homo sapiens
cctcttcagaggc

SEQ ID NO: 1947017 - DNA, 14 bp, Homo sapiens
cctcttcagaggcc

SEQ ID NO: 1947018 - DNA, 16 bp, Homo sapiens
cctcttcagaggccct

SEQ ID NO: 1947019 - DNA, 12 bp, Homo sapiens
cctcttccccct

SEQ ID NO: 1947020 - DNA, 14 bp, Homo sapiens
cctcttcccccttc

SEQ ID NO: 1947021 - DNA, 17 bp, Homo sapiens
cctcttctgggagggca

SEQ ID NO: 1947022 - DNA, 13 bp, Homo sapiens
cctcttgggagac

SEQ ID NO: 1947023 - DNA, 21 bp, Homo sapiens
cctctttcctgtgccaggact

SEQ ID NO: 1947024 - DNA, 18 bp, Homo sapiens
cctgaaaacactgtgcac

SEQ ID NO: 1947025 - DNA, 16 bp, Homo sapiens
cctgaacactgcttct

SEQ ID NO: 1947026 - DNA, 14 bp, Homo sapiens
cctgaatccctttc

SEQ ID NO: 1947027 - DNA, 13 bp, Homo sapiens
cctgacactccct

SEQ ID NO: 1947028 - DNA, 16 bp, Homo sapiens
cctgagctgaggcagc

SEQ ID NO: 1947029 - DNA, 18 bp, Homo sapiens
cctgagctgaggcagcag

SEQ ID NO: 1947030 - DNA, 21 bp, Homo sapiens
cctgaggggatatccctatgt

SEQ ID NO: 1947031 - DNA, 13 bp, Homo sapiens
cctgatcagagcc

SEQ ID NO: 1947032 - DNA, 17 bp, Homo sapiens
cctgcaaggtgcacctg

SEQ ID NO: 1947033 - DNA, 18 bp, Homo sapiens
cctgcagaccctgccagg

SEQ ID NO: 1947034 - DNA, 20 bp, Homo sapiens
cctgcagctttgaggctggc

SEQ ID NO: 1947035 - DNA, 22 bp, Homo sapiens
cctgcagctttgaggctggcgg

SEQ ID NO: 1947036 - DNA, 14 bp, Homo sapiens
cctgcagggtaggg

SEQ ID NO: 1947037 - DNA, 16 bp, Homo sapiens
cctgcagggtaggggg

SEQ ID NO: 1947038 - DNA, 23 bp, Homo sapiens
cctgcagggtagggggcctgagt

SEQ ID NO: 1947039 - DNA, 18 bp, Homo sapiens
cctgcatcccttggcccc

SEQ ID NO: 1947040 - DNA, 21 bp, Homo sapiens
cctgcatcccttggcccctct

SEQ ID NO: 1947041 - DNA, 21 bp, Homo sapiens
cctgccaggctgcagggacag

SEQ ID NO: 1947042 - DNA, 16 bp, Homo sapiens
cctgcccactctgacc

SEQ ID NO: 1947043 - DNA, 19 bp, Homo sapiens
cctgccccccttcccaccc

SEQ ID NO: 1947044 - DNA, 20 bp, Homo sapiens
cctgccccccttcccacccc

SEQ ID NO: 1947045 - DNA, 16 bp, Homo sapiens
cctgcccctcccttca

SEQ ID NO: 1947046 - DNA, 15 bp, Homo sapiens
cctgccctcactcca

SEQ ID NO: 1947047 - DNA, 16 bp, Homo sapiens
cctgccctcactccac

SEQ ID NO: 1947048 - DNA, 18 bp, Homo sapiens
cctgccctcactccactc

SEQ ID NO: 1947049 - DNA, 17 bp, Homo sapiens
cctgcctctctcatggc

SEQ ID NO: 1947050 - DNA, 20 bp, Homo sapiens
cctgccttctcttctatcct

SEQ ID NO: 1947051 - DNA, 22 bp, Homo sapiens
cctgcgccctccctccctccac

SEQ ID NO: 1947052 - DNA, 23 bp, Homo sapiens
cctgcgccctccctccctccaca

SEQ ID NO: 1947053 - DNA, 13 bp, Homo sapiens
cctgcttcccggg

SEQ ID NO: 1947054 - DNA, 20 bp, Homo sapiens
cctgctttgggctgccctgg

SEQ ID NO: 1947055 - DNA, 21 bp, Homo sapiens
cctgctttgggctgccctggt

SEQ ID NO: 1947056 - DNA, 21 bp, Homo sapiens
cctggacatgaagattctttc

SEQ ID NO: 1947057 - DNA, 13 bp, Homo sapiens
cctggaccctgga

SEQ ID NO: 1947058 - DNA, 18 bp, Homo sapiens
cctggagactgcccagct

SEQ ID NO: 1947059 - DNA, 16 bp, Homo sapiens
cctggcacagggcagt

SEQ ID NO: 1947060 - DNA, 12 bp, Homo sapiens
cctggcagccgt

SEQ ID NO: 1947061 - DNA, 19 bp, Homo sapiens
cctggcagccgtgccttca

SEQ ID NO: 1947062 - DNA, 22 bp, Homo sapiens
cctggcagccgtgccttcagct

SEQ ID NO: 1947063 - DNA, 19 bp, Homo sapiens
cctggccccagtgaccggg

SEQ ID NO: 1947064 - DNA, 13 bp, Homo sapiens
ctcttctccactg

SEQ ID NO: 1947065 - DNA, 15 bp, Homo sapiens
ctcttctccactgga

SEQ ID NO: 1947066 - DNA, 21 bp, Homo sapiens
ctcttctgggagggcagcagg

SEQ ID NO: 1947067 - DNA, 22 bp, Homo sapiens
ctcttctgggagggcagcaggg

SEQ ID NO: 1947068 - DNA, 20 bp, Homo sapiens
ctcttgggagacgtccaccc

SEQ ID NO: 1947069 - DNA, 10 bp, Homo sapiens
ctctttcctg

SEQ ID NO: 1947070 - DNA, 13 bp, Homo sapiens
ctctttcttccac

SEQ ID NO: 1947071 - DNA, 12 bp, Homo sapiens
ctctttgtaaga

SEQ ID NO: 1947072 - DNA, 21 bp, Homo sapiens
ctctttgtcccggataggcta

SEQ ID NO: 1947073 - DNA, 15 bp, Homo sapiens
ctgaaaagtaaattg

SEQ ID NO: 1947074 - DNA, 14 bp, Homo sapiens
ctgaaaccagtgtt

SEQ ID NO: 1947075 - DNA, 18 bp, Homo sapiens
ctgaaatacctttgcctg

SEQ ID NO: 1947076 - DNA, 19 bp, Homo sapiens
ctgaaatacctttgcctgg

SEQ ID NO: 1947077 - DNA, 19 bp, Homo sapiens
ctgaactggccccagctcc

SEQ ID NO: 1947078 - DNA, 15 bp, Homo sapiens
ctgaacttttcagga

SEQ ID NO: 1947079 - DNA, 13 bp, Homo sapiens
ctgaaggagagga

SEQ ID NO: 1947080 - DNA, 13 bp, Homo sapiens
ctgaaggagcccc

SEQ ID NO: 1947081 - DNA, 21 bp, Homo sapiens
ctgaaggagccccattcctgg

SEQ ID NO: 1947082 - DNA, 14 bp, Homo sapiens
ctgaagtcactgca

SEQ ID NO: 1947083 - DNA, 13 bp, Homo sapiens
ctgaagtctcttt

SEQ ID NO: 1947084 - DNA, 18 bp, Homo sapiens
ctgaagtgaatacatggt

SEQ ID NO: 1947085 - DNA, 23 bp, Homo sapiens
ctgaagtgtctaatgcattaact

SEQ ID NO: 1947086 - DNA, 23 bp, Homo sapiens
ctgaatacttaatatgtgggaaa

SEQ ID NO: 1947087 - DNA, 15 bp, Homo sapiens
ctgaatagcagaagg

SEQ ID NO: 1947088 - DNA, 16 bp, Homo sapiens
ctgaatccctttcagt

SEQ ID NO: 1947089 - DNA, 15 bp, Homo sapiens
ctgaatcgtttcatg

SEQ ID NO: 1947090 - DNA, 14 bp, Homo sapiens
ctgacaacttctga

SEQ ID NO: 1947091 - DNA, 19 bp, Homo sapiens
ctgacacaggggacactga

SEQ ID NO: 1947092 - DNA, 20 bp, Homo sapiens
ctgacacaggggacactgaa

SEQ ID NO: 1947093 - DNA, 19 bp, Homo sapiens
ctgacactgcgaactctca

SEQ ID NO: 1947094 - DNA, 21 bp, Homo sapiens
ctgacatcttagtatttgcat

SEQ ID NO: 1947095 - DNA, 18 bp, Homo sapiens
ctgacatttggagtgttc

SEQ ID NO: 1947096 - DNA, 18 bp, Homo sapiens
ctgaccctgtgatgcctg

SEQ ID NO: 1947097 - DNA, 19 bp, Homo sapiens
ctgactcagggctcctggg

SEQ ID NO: 1947098 - DNA, 20 bp, Homo sapiens
ctgactggccccagggactc

SEQ ID NO: 1947099 - DNA, 17 bp, Homo sapiens
ctgactgtactcctccc

SEQ ID NO: 1947100 - DNA, 13 bp, Homo sapiens
ctgacttctcagg

SEQ ID NO: 1947101 - DNA, 12 bp, Homo sapiens
ctgacttgcaga

SEQ ID NO: 1947102 - DNA, 15 bp, Homo sapiens
ctgagaaggccccag

SEQ ID NO: 1947103 - DNA, 17 bp, Homo sapiens
ctgagaaggccccaggg

SEQ ID NO: 1947104 - DNA, 19 bp, Homo sapiens
ctgagaaggccccagggca

SEQ ID NO: 1947105 - DNA, 14 bp, Homo sapiens
ctgagagaccagac

SEQ ID NO: 1947106 - DNA, 12 bp, Homo sapiens
ctgagcaaagca

SEQ ID NO: 1947107 - DNA, 13 bp, Homo sapiens
ctgagcagggaga

SEQ ID NO: 1947108 - DNA, 20 bp, Homo sapiens
ctgagcagtgaatgattcag

SEQ ID NO: 1947109 - DNA, 14 bp, Homo sapiens
ctgagccaggagcc

SEQ ID NO: 1947110 - DNA, 20 bp, Homo sapiens
ctgagccaggagcctcctga

SEQ ID NO: 1947111 - DNA, 16 bp, Homo sapiens
ctgagccttgtaattc

SEQ ID NO: 1947112 - DNA, 21 bp, Homo sapiens
ctgagcggccgcctgtccttg

SEQ ID NO: 1947113 - DNA, 15 bp, Homo sapiens
ctgagctgaggcagc

SEQ ID NO: 1947114 - DNA, 18 bp, Homo sapiens
ctgagctgaggcagcagt

SEQ ID NO: 1947115 - DNA, 13 bp, Homo sapiens
ctgagctggaaag

SEQ ID NO: 1947116 - DNA, 16 bp, Homo sapiens
ctgaggttaaggggat

SEQ ID NO: 1947117 - DNA, 15 bp, Homo sapiens
ctgagtcctgttctt

SEQ ID NO: 1947118 - DNA, 21 bp, Homo sapiens
ctgagttctcatccacagagg

SEQ ID NO: 1947119 - DNA, 22 bp, Homo sapiens
ctgagttctcatccacagaggc

SEQ ID NO: 1947120 - DNA, 21 bp, Homo sapiens
ctgatacagccttacaataca

SEQ ID NO: 1947121 - DNA, 17 bp, Homo sapiens
ctgatgggcactggaaa

SEQ ID NO: 1947122 - DNA, 23 bp, Homo sapiens
ctgatgtcttcttgggggcagac

SEQ ID NO: 1947123 - DNA, 18 bp, Homo sapiens
ctgcaacttgtaaatgtg

SEQ ID NO: 1947124 - DNA, 22 bp, Homo sapiens
ctgcaagtccatagctgagctg

SEQ ID NO: 1947125 - DNA, 16 bp, Homo sapiens
ctgcaagtcccaggga

SEQ ID NO: 1947126 - DNA, 14 bp, Homo sapiens
ctgcaccctctgct

SEQ ID NO: 1947127 - DNA, 12 bp, Homo sapiens
ctgcagggaaaa

SEQ ID NO: 1947128 - DNA, 20 bp, Homo sapiens
ctgcagggacagttgggtgt

SEQ ID NO: 1947129 - DNA, 20 bp, Homo sapiens
ctgcagggcagcctgtggga

SEQ ID NO: 1947130 - DNA, 22 bp, Homo sapiens
ctgcagggcagcctgtgggaga

SEQ ID NO: 1947131 - DNA, 23 bp, Homo sapiens
ctgcagggcagcctgtgggagaa

SEQ ID NO: 1947132 - DNA, 16 bp, Homo sapiens
ctgcagggtagggggc

SEQ ID NO: 1947133 - DNA, 17 bp, Homo sapiens
ctgcagtcacccctgtc

SEQ ID NO: 1947134 - DNA, 21 bp, Homo sapiens
ctgcagtcacccctgtctgcg

SEQ ID NO: 1947135 - DNA, 22 bp, Homo sapiens
ctgcagtcctcggcagctccgg

SEQ ID NO: 1947136 - DNA, 20 bp, Homo sapiens
ctgcagtgggttctccaaac

SEQ ID NO: 1947137 - DNA, 14 bp, Homo sapiens
ctgcatccaaggct

SEQ ID NO: 1947138 - DNA, 20 bp, Homo sapiens
ctgcatcccttggcccctct

SEQ ID NO: 1947139 - DNA, 23 bp, Homo sapiens
ctgcatcccttggcccctctctg

SEQ ID NO: 1947140 - DNA, 22 bp, Homo sapiens
ctgccaagataccttcatggtg

SEQ ID NO: 1947141 - DNA, 22 bp, Homo sapiens
ctgccacagcctcccctgccag

SEQ ID NO: 1947142 - DNA, 23 bp, Homo sapiens
ctgccacagcctcccctgccagg

SEQ ID NO: 1947143 - DNA, 13 bp, Homo sapiens
ctgccaggctgca

SEQ ID NO: 1947144 - DNA, 16 bp, Homo sapiens
ctgccagggcagggcc

SEQ ID NO: 1947145 - DNA, 21 bp, Homo sapiens
ctgccatggaggcacacagct

SEQ ID NO: 1947146 - DNA, 17 bp, Homo sapiens
ctgcccacctgccaggc

SEQ ID NO: 1947147 - DNA, 19 bp, Homo sapiens
ctgcccacctgccaggctg

SEQ ID NO: 1947148 - DNA, 22 bp, Homo sapiens
ctgcccactctgaccgggcttc

SEQ ID NO: 1947149 - DNA, 20 bp, Homo sapiens
ctgcccagcggctcttcctg

SEQ ID NO: 1947150 - DNA, 12 bp, Homo sapiens
ctgccccaggct

SEQ ID NO: 1947151 - DNA, 18 bp, Homo sapiens
ctgccccaggctcaggct

SEQ ID NO: 1947152 - DNA, 23 bp, Homo sapiens
ctgcccccagctgctcctcgcag

SEQ ID NO: 1947153 - DNA, 13 bp, Homo sapiens
ctgccccccttcc

SEQ ID NO: 1947154 - DNA, 14 bp, Homo sapiens
ctgccccccttccc

SEQ ID NO: 1947155 - DNA, 20 bp, Homo sapiens
ctgccccccttcccacccct

SEQ ID NO: 1947156 - DNA, 12 bp, Homo sapiens
ctgccctggtgc

SEQ ID NO: 1947157 - DNA, 13 bp, Homo sapiens
ctgccctggtgct

SEQ ID NO: 1947158 - DNA, 14 bp, Homo sapiens
ctgccctggtgctg

SEQ ID NO: 1947159 - DNA, 19 bp, Homo sapiens
ctgccctggtgctgccaca

SEQ ID NO: 1947160 - DNA, 17 bp, Homo sapiens
ctgccgcaacagttttt

SEQ ID NO: 1947161 - DNA, 15 bp, Homo sapiens
ctgccgtgagagccc

SEQ ID NO: 1947162 - DNA, 16 bp, Homo sapiens
ctgccgtgagagccca

SEQ ID NO: 1947163 - DNA, 18 bp, Homo sapiens
ctgccgtgagagcccaat

SEQ ID NO: 1947164 - DNA, 16 bp, Homo sapiens
ctgcctgaacactgct

SEQ ID NO: 1947165 - DNA, 16 bp, Homo sapiens
ctgccttcctcctggg

SEQ ID NO: 1947166 - DNA, 18 bp, Homo sapiens
ctgccttcctcctgggcc

SEQ ID NO: 1947167 - DNA, 12 bp, Homo sapiens
ctgccttctctt

SEQ ID NO: 1947168 - DNA, 14 bp, Homo sapiens
ctgccttgtgtaca

SEQ ID NO: 1947169 - DNA, 16 bp, Homo sapiens
ctgcgaactctcagga

SEQ ID NO: 1947170 - DNA, 12 bp, Homo sapiens
ctgcgccctccc

SEQ ID NO: 1947171 - DNA, 16 bp, Homo sapiens
ctgcgccctccctccc

SEQ ID NO: 1947172 - DNA, 21 bp, Homo sapiens
ctgcggcacccttgcgctttt

SEQ ID NO: 1947173 - DNA, 13 bp, Homo sapiens
ctgcgtctcctgc

SEQ ID NO: 1947174 - DNA, 18 bp, Homo sapiens
ctgcgtgttgtttttccc

SEQ ID NO: 1947175 - DNA, 14 bp, Homo sapiens
ctgctatgtctgtg

SEQ ID NO: 1947176 - DNA, 16 bp, Homo sapiens
ctgctcacattccctc

SEQ ID NO: 1947177 - DNA, 17 bp, Homo sapiens
ctgctcacattccctct

SEQ ID NO: 1947178 - DNA, 18 bp, Homo sapiens
ctgctcacattccctctc

SEQ ID NO: 1947179 - DNA, 17 bp, Homo sapiens
ctgctcctcgcagttcg

SEQ ID NO: 1947180 - DNA, 20 bp, Homo sapiens
ctgctctgcgtgtcacctgt

SEQ ID NO: 1947181 - DNA, 22 bp, Homo sapiens
ctgctctgcgtgtcacctgtgc

SEQ ID NO: 1947182 - DNA, 19 bp, Homo sapiens
ctgctgacagatgttccat

SEQ ID NO: 1947183 - DNA, 21 bp, Homo sapiens
ctgctgccatgattttggcca

SEQ ID NO: 1947184 - DNA, 13 bp, Homo sapiens
ctgctggctgcct

SEQ ID NO: 1947185 - DNA, 12 bp, Homo sapiens
ctgctgggaagt

SEQ ID NO: 1947186 - DNA, 15 bp, Homo sapiens
ctgctgggaagtggc

SEQ ID NO: 1947187 - DNA, 23 bp, Homo sapiens
ctgctgggaagtggcttaatagt

SEQ ID NO: 1947188 - DNA, 14 bp, Homo sapiens
ctgctgtccctcct

SEQ ID NO: 1947189 - DNA, 16 bp, Homo sapiens
ctgctgtccctcctga

SEQ ID NO: 1947190 - DNA, 17 bp, Homo sapiens
ctgctgtccctcctgag

SEQ ID NO: 1947191 - DNA, 18 bp, Homo sapiens
ctgctgtccctcctgagg

SEQ ID NO: 1947192 - DNA, 15 bp, Homo sapiens
ctgcttctcctggac

SEQ ID NO: 1947193 - DNA, 12 bp, Homo sapiens
ctgcttctgggg

SEQ ID NO: 1947194 - DNA, 14 bp, Homo sapiens
ctgcttctggggga

SEQ ID NO: 1947195 - DNA, 13 bp, Homo sapiens
ctgcttctgtgca

SEQ ID NO: 1947196 - DNA, 16 bp, Homo sapiens
ctgcttctgtgcattt

SEQ ID NO: 1947197 - DNA, 20 bp, Homo sapiens
gccctcactccactcccctc

SEQ ID NO: 1947198 - DNA, 22 bp, Homo sapiens
gccctcaggtcagggtgaggat

SEQ ID NO: 1947199 - DNA, 12 bp, Homo sapiens
gccctccctccc

SEQ ID NO: 1947200 - DNA, 19 bp, Homo sapiens
gccctccctccctccacac

SEQ ID NO: 1947201 - DNA, 17 bp, Homo sapiens
gccctcgctgccagctc

SEQ ID NO: 1947202 - DNA, 16 bp, Homo sapiens
gccctctctgctctgc

SEQ ID NO: 1947203 - DNA, 22 bp, Homo sapiens
gccctctgcccccagctgctcc

SEQ ID NO: 1947204 - DNA, 14 bp, Homo sapiens
gccctgccctcact

SEQ ID NO: 1947205 - DNA, 15 bp, Homo sapiens
gccctgccctcactc

SEQ ID NO: 1947206 - DNA, 22 bp, Homo sapiens
gccctgctttgggctgccctgg

SEQ ID NO: 1947207 - DNA, 20 bp, Homo sapiens
gccctggctcccacaggccc

SEQ ID NO: 1947208 - DNA, 17 bp, Homo sapiens
gccctggtgctgccaca

SEQ ID NO: 1947209 - DNA, 21 bp, Homo sapiens
gccctggtgctgccacacttc

SEQ ID NO: 1947210 - DNA, 15 bp, Homo sapiens
gccctgtctccctac

SEQ ID NO: 1947211 - DNA, 14 bp, Homo sapiens
gcccttcctctcca

SEQ ID NO: 1947212 - DNA, 17 bp, Homo sapiens
gcccttcctctccactg

SEQ ID NO: 1947213 - DNA, 21 bp, Homo sapiens
gcccttcctctccactgcctt

SEQ ID NO: 1947214 - DNA, 18 bp, Homo sapiens
gccgaggcaggggctggg

SEQ ID NO: 1947215 - DNA, 14 bp, Homo sapiens
gccgcctgtccttg

SEQ ID NO: 1947216 - DNA, 12 bp, Homo sapiens
gccgctgcccac

SEQ ID NO: 1947217 - DNA, 14 bp, Homo sapiens
gccgctgcccacgt

SEQ ID NO: 1947218 - DNA, 14 bp, Homo sapiens
gccgctgggagagc

SEQ ID NO: 1947219 - DNA, 13 bp, Homo sapiens
gccggcagcctgg

SEQ ID NO: 1947220 - DNA, 15 bp, Homo sapiens
gccggcccacgtcct

SEQ ID NO: 1947221 - DNA, 20 bp, Homo sapiens
gccggcccacgtcctgggtg

SEQ ID NO: 1947222 - DNA, 21 bp, Homo sapiens
gccgggtctgcctcttctggg

SEQ ID NO: 1947223 - DNA, 23 bp, Homo sapiens
gccgtgagagcccaatcactgcc

SEQ ID NO: 1947224 - DNA, 15 bp, Homo sapiens
gccgtgccttcagct

SEQ ID NO: 1947225 - DNA, 14 bp, Homo sapiens
gccgtggctgcggc

SEQ ID NO: 1947226 - DNA, 15 bp, Homo sapiens
gccgtggcttcccgc

SEQ ID NO: 1947227 - DNA, 21 bp, Homo sapiens
gccgtggcttcccgctcagcc

SEQ ID NO: 1947228 - DNA, 16 bp, Homo sapiens
gccgtggtcctttggg

SEQ ID NO: 1947229 - DNA, 22 bp, Homo sapiens
gcctaccggcaatttccggcca

SEQ ID NO: 1947230 - DNA, 20 bp, Homo sapiens
gcctagtaggagctgagctt

SEQ ID NO: 1947231 - DNA, 18 bp, Homo sapiens
gcctatgccacctgcagc

SEQ ID NO: 1947232 - DNA, 17 bp, Homo sapiens
gcctcccctgccagggc

SEQ ID NO: 1947233 - DNA, 22 bp, Homo sapiens
gcctctctcatggcttgggctg

SEQ ID NO: 1947234 - DNA, 14 bp, Homo sapiens
gcctctgagccagg

SEQ ID NO: 1947235 - DNA, 19 bp, Homo sapiens
gcctctgagccaggagcct

SEQ ID NO: 1947236 - DNA, 15 bp, Homo sapiens
gcctctgtcctggcc

SEQ ID NO: 1947237 - DNA, 23 bp, Homo sapiens
gcctcttcctccctccctgcagg

SEQ ID NO: 1947238 - DNA, 14 bp, Homo sapiens
gcctcttctgggag

SEQ ID NO: 1947239 - DNA, 14 bp, Homo sapiens
gcctcttgggagac

SEQ ID NO: 1947240 - DNA, 21 bp, Homo sapiens
gcctgacacaggggacactga

SEQ ID NO: 1947241 - DNA, 22 bp, Homo sapiens
gcctgacacaggggacactgaa

SEQ ID NO: 1947242 - DNA, 22 bp, Homo sapiens
gcctgacatttggagtgttccc

SEQ ID NO: 1947243 - DNA, 15 bp, Homo sapiens
gcctgagttgagggg

SEQ ID NO: 1947244 - DNA, 22 bp, Homo sapiens
gcctgcatcattctttctgcta

SEQ ID NO: 1947245 - DNA, 16 bp, Homo sapiens
gcctgccccccttccc

SEQ ID NO: 1947246 - DNA, 22 bp, Homo sapiens
gcctgccccccttcccacccct

SEQ ID NO: 1947247 - DNA, 13 bp, Homo sapiens
gcctggcacaggg

SEQ ID NO: 1947248 - DNA, 12 bp, Homo sapiens
gcctggcagccg

SEQ ID NO: 1947249 - DNA, 11 bp, Homo sapiens
gcctggcccca

SEQ ID NO: 1947250 - DNA, 16 bp, Homo sapiens
gcctggccccatggtc

SEQ ID NO: 1947251 - DNA, 20 bp, Homo sapiens
gcctgggagatgcagctgga

SEQ ID NO: 1947252 - DNA, 13 bp, Homo sapiens
gcctgggccactg

SEQ ID NO: 1947253 - DNA, 16 bp, Homo sapiens
gcctgggccactggca

SEQ ID NO: 1947254 - DNA, 19 bp, Homo sapiens
gcctgggtcctcccagctg

SEQ ID NO: 1947255 - DNA, 20 bp, Homo sapiens
gcctgggtggggcagggcct

SEQ ID NO: 1947256 - DNA, 22 bp, Homo sapiens
gcctgggtggggcagggcctgg

SEQ ID NO: 1947257 - DNA, 12 bp, Homo sapiens
gcctggtctgga

SEQ ID NO: 1947258 - DNA, 13 bp, Homo sapiens
gcctggtctggag

SEQ ID NO: 1947259 - DNA, 16 bp, Homo sapiens
gcctggtctggagccc

SEQ ID NO: 1947260 - DNA, 17 bp, Homo sapiens
gcctggtctggagcccc

SEQ ID NO: 1947261 - DNA, 19 bp, Homo sapiens
gcctggtctggagccccta

SEQ ID NO: 1947262 - DNA, 24 bp, Homo sapiens
gcctggttccctctttcctgtgcc

SEQ ID NO: 1947263 - DNA, 21 bp, Homo sapiens
gcctgtttgggaggctggagt

SEQ ID NO: 1947264 - DNA, 16 bp, Homo sapiens
gccttaaaactttaat

SEQ ID NO: 1947265 - DNA, 16 bp, Homo sapiens
gccttagaacctttct

SEQ ID NO: 1947266 - DNA, 17 bp, Homo sapiens
gccttagaacctttctt

SEQ ID NO: 1947267 - DNA, 19 bp, Homo sapiens
gccttattagagtgtcttt

SEQ ID NO: 1947268 - DNA, 14 bp, Homo sapiens
gccttcctcctggg

SEQ ID NO: 1947269 - DNA, 22 bp, Homo sapiens
gccttcgatacaccgggcctgg

SEQ ID NO: 1947270 - DNA, 16 bp, Homo sapiens
gccttggttcctccag

SEQ ID NO: 1947271 - DNA, 12 bp, Homo sapiens
gccttgtgtaca

SEQ ID NO: 1947272 - DNA, 19 bp, Homo sapiens
gcgaggagatgctccttgg

SEQ ID NO: 1947273 - DNA, 20 bp, Homo sapiens
gcgaggagatgctccttggg

SEQ ID NO: 1947274 - DNA, 14 bp, Homo sapiens
gcgaggcagaatgg

SEQ ID NO: 1947275 - DNA, 13 bp, Homo sapiens
gcgagggcctgcg

SEQ ID NO: 1947276 - DNA, 13 bp, Homo sapiens
gcgatgtgtttta

SEQ ID NO: 1947277 - DNA, 20 bp, Homo sapiens
gcgccctccctccctccaca

SEQ ID NO: 1947278 - DNA, 13 bp, Homo sapiens
gcgcgcacacaca

SEQ ID NO: 1947279 - DNA, 23 bp, Homo sapiens
gcgctagagcattctggggtggg

SEQ ID NO: 1947280 - DNA, 14 bp, Homo sapiens
gcgctgagggcagg

SEQ ID NO: 1947281 - DNA, 17 bp, Homo sapiens
gcggaacaggagtgact

SEQ ID NO: 1947282 - DNA, 23 bp, Homo sapiens
gcggaacaggagtgactctggct

SEQ ID NO: 1947283 - DNA, 13 bp, Homo sapiens
gcggcctgcagac

SEQ ID NO: 1947284 - DNA, 14 bp, Homo sapiens
gcggcctgcagacc

SEQ ID NO: 1947285 - DNA, 15 bp, Homo sapiens
gcggctcttcctgga

SEQ ID NO: 1947286 - DNA, 23 bp, Homo sapiens
gcgggtaaaaagagaaggcaagc

SEQ ID NO: 1947287 - DNA, 15 bp, Homo sapiens
gcggtcactgcccac

SEQ ID NO: 1947288 - DNA, 15 bp, Homo sapiens
gcgtcctcctctgtg

SEQ ID NO: 1947289 - DNA, 21 bp, Homo sapiens
gcgtctgagcggccgcctgtc

SEQ ID NO: 1947290 - DNA, 23 bp, Homo sapiens
gcgtctgagcggccgcctgtcct

SEQ ID NO: 1947291 - DNA, 22 bp, Homo sapiens
gcgtgggatccagagagaagca

SEQ ID NO: 1947292 - DNA, 17 bp, Homo sapiens
gcgtgtcacctgtgctt

SEQ ID NO: 1947293 - DNA, 12 bp, Homo sapiens
gctaccctgagc

SEQ ID NO: 1947294 - DNA, 20 bp, Homo sapiens
gctaccctgagctgaggcag

SEQ ID NO: 1947295 - DNA, 19 bp, Homo sapiens
gctagagcattctggggtg

SEQ ID NO: 1947296 - DNA, 20 bp, Homo sapiens
gctagagcattctggggtgg

SEQ ID NO: 1947297 - DNA, 20 bp, Homo sapiens
gctataactatgttgataaa

SEQ ID NO: 1947298 - DNA, 13 bp, Homo sapiens
gctatgtctgtga

SEQ ID NO: 1947299 - DNA, 15 bp, Homo sapiens
gctatgtctgtgatg

SEQ ID NO: 1947300 - DNA, 14 bp, Homo sapiens
gctattccctggag

SEQ ID NO: 1947301 - DNA, 22 bp, Homo sapiens
gctatttagagatattttccat

SEQ ID NO: 1947302 - DNA, 22 bp, Homo sapiens
gctcacagaacccttggagcca

SEQ ID NO: 1947303 - DNA, 16 bp, Homo sapiens
gctcacattccctctc

SEQ ID NO: 1947304 - DNA, 15 bp, Homo sapiens
gctcagccctccctg

SEQ ID NO: 1947305 - DNA, 15 bp, Homo sapiens
gctcagcgctggcag

SEQ ID NO: 1947306 - DNA, 12 bp, Homo sapiens
gctcaggctgcc

SEQ ID NO: 1947307 - DNA, 16 bp, Homo sapiens
gctcaggctgcccagc

SEQ ID NO: 1947308 - DNA, 19 bp, Homo sapiens
gctcatcattctctgtctc

SEQ ID NO: 1947309 - DNA, 21 bp, Homo sapiens
gctccagagggcactctgctt

SEQ ID NO: 1947310 - DNA, 20 bp, Homo sapiens
gctccagcgtggcctccgtg

SEQ ID NO: 1947311 - DNA, 14 bp, Homo sapiens
gctccagggccagg

SEQ ID NO: 1947312 - DNA, 15 bp, Homo sapiens
gctccattcccatca

SEQ ID NO: 1947313 - DNA, 20 bp, Homo sapiens
gctcccacaggcccttcctc

SEQ ID NO: 1947314 - DNA, 19 bp, Homo sapiens
gctccttcagcagctagag

SEQ ID NO: 1947315 - DNA, 23 bp, Homo sapiens
gctccttcctggagactgcccag

SEQ ID NO: 1947316 - DNA, 13 bp, Homo sapiens
gctcggcctcttg

SEQ ID NO: 1947317 - DNA, 20 bp, Homo sapiens
gctctacagctaatcagcat

SEQ ID NO: 1947318 - DNA, 18 bp, Homo sapiens
gctctctggacctgacca

SEQ ID NO: 1947319 - DNA, 20 bp, Homo sapiens
gctctctggacctgaccaga

SEQ ID NO: 1947320 - DNA, 22 bp, Homo sapiens
gctctgcgtgtcacctgtgctt

SEQ ID NO: 1947321 - DNA, 15 bp, Homo sapiens
gctctgtattctgca

SEQ ID NO: 1947322 - DNA, 20 bp, Homo sapiens
gctctgtcgtggtagcagat

SEQ ID NO: 1947323 - DNA, 13 bp, Homo sapiens
gctcttctccttt

SEQ ID NO: 1947324 - DNA, 23 bp, Homo sapiens
gctcttctcctttcacaaccttc

SEQ ID NO: 1947325 - DNA, 16 bp, Homo sapiens
gctgaaaagtaaattg

SEQ ID NO: 1947326 - DNA, 12 bp, Homo sapiens
gctgaaatactg

SEQ ID NO: 1947327 - DNA, 20 bp, Homo sapiens
gctgaaatactgaggggtct

SEQ ID NO: 1947328 - DNA, 16 bp, Homo sapiens
gctgacagatgttcca

SEQ ID NO: 1947329 - DNA, 23 bp, Homo sapiens
ggtgtggccctgcaagggcgtgg

SEQ ID NO: 1947330 - DNA, 21 bp, Homo sapiens
ggtgttatcaccgtgggctcc

SEQ ID NO: 1947331 - DNA, 11 bp, Homo sapiens
ggttaaaactg

SEQ ID NO: 1947332 - DNA, 18 bp, Homo sapiens
ggttaaggggatctaaaa

SEQ ID NO: 1947333 - DNA, 11 bp, Homo sapiens
ggttccagaca

SEQ ID NO: 1947334 - DNA, 19 bp, Homo sapiens
ggttccagacagagtggat

SEQ ID NO: 1947335 - DNA, 22 bp, Homo sapiens
ggttccgcttggagcagagggg

SEQ ID NO: 1947336 - DNA, 12 bp, Homo sapiens
ggttcctccagc

SEQ ID NO: 1947337 - DNA, 16 bp, Homo sapiens
ggttgaggacaggaga

SEQ ID NO: 1947338 - DNA, 15 bp, Homo sapiens
ggttgccagtcctgc

SEQ ID NO: 1947339 - DNA, 18 bp, Homo sapiens
ggttggaactgctgccat

SEQ ID NO: 1947340 - DNA, 13 bp, Homo sapiens
ggttggggtgggg

SEQ ID NO: 1947341 - DNA, 23 bp, Homo sapiens
ggttgggttccagacagagtgga

SEQ ID NO: 1947342 - DNA, 14 bp, Homo sapiens
ggtttcagaaaggg

SEQ ID NO: 1947343 - DNA, 21 bp, Homo sapiens
ggtttgaggaccctcccaggt

SEQ ID NO: 1947344 - DNA, 19 bp, Homo sapiens
ggtttgggcagtggagagg

SEQ ID NO: 1947345 - DNA, 20 bp, Homo sapiens
ggtttgggcagtggagaggg

SEQ ID NO: 1947346 - DNA, 17 bp, Homo sapiens
ggttttgtattctctga

SEQ ID NO: 1947347 - DNA, 19 bp, Homo sapiens
ggttttgtattctctgagc

SEQ ID NO: 1947348 - DNA, 21 bp, Homo sapiens
ggttttgtttctttccttctg

SEQ ID NO: 1947349 - DNA, 14 bp, Homo sapiens
gtaaaatcacagat

SEQ ID NO: 1947350 - DNA, 15 bp, Homo sapiens
gtaaaattacagaag

SEQ ID NO: 1947351 - DNA, 21 bp, Homo sapiens
gtaaatatcccagagaacaat

SEQ ID NO: 1947352 - DNA, 12 bp, Homo sapiens
gtaaatattctt

SEQ ID NO: 1947353 - DNA, 17 bp, Homo sapiens
gtaaatattcttgtcca

SEQ ID NO: 1947354 - DNA, 21 bp, Homo sapiens
gtaaatttaatagataaagtg

SEQ ID NO: 1947355 - DNA, 21 bp, Homo sapiens
gtaacagcaggagcatggccg

SEQ ID NO: 1947356 - DNA, 23 bp, Homo sapiens
gtaacatgtgttaagtattttca

SEQ ID NO: 1947357 - DNA, 19 bp, Homo sapiens
gtaaccgagccagcagctg

SEQ ID NO: 1947358 - DNA, 12 bp, Homo sapiens
gtaactttgcat

SEQ ID NO: 1947359 - DNA, 14 bp, Homo sapiens
gtaactttgcatgt

SEQ ID NO: 1947360 - DNA, 12 bp, Homo sapiens
gtaagctgactg

SEQ ID NO: 1947361 - DNA, 14 bp, Homo sapiens
gtaaggacttgtgc

SEQ ID NO: 1947362 - DNA, 15 bp, Homo sapiens
gtaaggacttgtgcc

SEQ ID NO: 1947363 - DNA, 16 bp, Homo sapiens
gtaaggcagctctgtc

SEQ ID NO: 1947364 - DNA, 16 bp, Homo sapiens
gtaataatattttaga

SEQ ID NO: 1947365 - DNA, 23 bp, Homo sapiens
gtaattagtaacatgtgttaagt

SEQ ID NO: 1947366 - DNA, 14 bp, Homo sapiens
gtaattctaaatga

SEQ ID NO: 1947367 - DNA, 18 bp, Homo sapiens
gtaattctaaatgaatgt

SEQ ID NO: 1947368 - DNA, 14 bp, Homo sapiens
gtacagcccaggcg

SEQ ID NO: 1947369 - DNA, 15 bp, Homo sapiens
gtacaggtaaggtga

SEQ ID NO: 1947370 - DNA, 21 bp, Homo sapiens
gtaccagagcctatggaaagg

SEQ ID NO: 1947371 - DNA, 19 bp, Homo sapiens
gtacctgcccccactcagc

SEQ ID NO: 1947372 - DNA, 20 bp, Homo sapiens
gtacctgcccccactcagca

SEQ ID NO: 1947373 - DNA, 14 bp, Homo sapiens
gtacctttctgaca

SEQ ID NO: 1947374 - DNA, 18 bp, Homo sapiens
gtactcagtcagcccagt

SEQ ID NO: 1947375 - DNA, 24 bp, Homo sapiens
gtacttgaccgtttttatattact

SEQ ID NO: 1947376 - DNA, 22 bp, Homo sapiens
gtacttgccttattagagtgtc

SEQ ID NO: 1947377 - DNA, 21 bp, Homo sapiens
gtagaagagggagaaggagag

SEQ ID NO: 1947378 - DNA, 18 bp, Homo sapiens
gtaggagcccagctctga

SEQ ID NO: 1947379 - DNA, 16 bp, Homo sapiens
gtaggttgaggacagg

SEQ ID NO: 1947380 - DNA, 16 bp, Homo sapiens
gtataacagcaaataa

SEQ ID NO: 1947381 - DNA, 16 bp, Homo sapiens
gtataccacctgtaca

SEQ ID NO: 1947382 - DNA, 17 bp, Homo sapiens
gtataccacctgtacat

SEQ ID NO: 1947383 - DNA, 17 bp, Homo sapiens
gtataggccatctgtaa

SEQ ID NO: 1947384 - DNA, 22 bp, Homo sapiens
gtataggccatctgtaaatatc

SEQ ID NO: 1947385 - DNA, 14 bp, Homo sapiens
gtatagttttacac

SEQ ID NO: 1947386 - DNA, 15 bp, Homo sapiens
gtatataaatggtga

SEQ ID NO: 1947387 - DNA, 17 bp, Homo sapiens
gtatatttaaaagaaag

SEQ ID NO: 1947388 - DNA, 14 bp, Homo sapiens
gtatcaggacccag

SEQ ID NO: 1947389 - DNA, 18 bp, Homo sapiens
gtatcaggacccagagga

SEQ ID NO: 1947390 - DNA, 13 bp, Homo sapiens
gtatctgtaaccc

SEQ ID NO: 1947391 - DNA, 19 bp, Homo sapiens
gtatgaataaagacaccta

SEQ ID NO: 1947392 - DNA, 17 bp, Homo sapiens
gtattacttttctgcaa

SEQ ID NO: 1947393 - DNA, 12 bp, Homo sapiens
gtattctctgag

SEQ ID NO: 1947394 - DNA, 19 bp, Homo sapiens
gtattctgcaacagcctgt

SEQ ID NO: 1947395 - DNA, 15 bp, Homo sapiens
gtattgtgaaatttg

SEQ ID NO: 1947396 - DNA, 18 bp, Homo sapiens
gtattttgtattgtttca

SEQ ID NO: 1947397 - DNA, 14 bp, Homo sapiens
gtcaacctgggcaa

SEQ ID NO: 1947398 - DNA, 15 bp, Homo sapiens
gtcaaggagtggctt

SEQ ID NO: 1947399 - DNA, 22 bp, Homo sapiens
gtcaagttccgtctcctctcca

SEQ ID NO: 1947400 - DNA, 20 bp, Homo sapiens
gtcaataattgtggagagga

SEQ ID NO: 1947401 - DNA, 16 bp, Homo sapiens
gtcaatgtttgcttta

SEQ ID NO: 1947402 - DNA, 14 bp, Homo sapiens
gtcacactgctggg

SEQ ID NO: 1947403 - DNA, 20 bp, Homo sapiens
gtcacagaggcagtggcagc

SEQ ID NO: 1947404 - DNA, 21 bp, Homo sapiens
gtcacagaggcagtggcagca

SEQ ID NO: 1947405 - DNA, 12 bp, Homo sapiens
gtcactgcccac

SEQ ID NO: 1947406 - DNA, 20 bp, Homo sapiens
gtcactgcccacctgccagg

SEQ ID NO: 1947407 - DNA, 21 bp, Homo sapiens
gtcactgcccacctgccaggc

SEQ ID NO: 1947408 - DNA, 20 bp, Homo sapiens
gtcagaataataagaggtgc

SEQ ID NO: 1947409 - DNA, 19 bp, Homo sapiens
gtcagaccttcttccacag

SEQ ID NO: 1947410 - DNA, 18 bp, Homo sapiens
gtcagacgcctgaggaac

SEQ ID NO: 1947411 - DNA, 12 bp, Homo sapiens
gtcagagagaat

SEQ ID NO: 1947412 - DNA, 18 bp, Homo sapiens
gtcaggaaggatgagcat

SEQ ID NO: 1947413 - DNA, 18 bp, Homo sapiens
gtcaggccacggcagcct

SEQ ID NO: 1947414 - DNA, 22 bp, Homo sapiens
gtcagtaccttcaaactagggc

SEQ ID NO: 1947415 - DNA, 23 bp, Homo sapiens
gtcagtgaagcccaggaggacct

SEQ ID NO: 1947416 - DNA, 20 bp, Homo sapiens
gtcagtgtgcaaagaaaaga

SEQ ID NO: 1947417 - DNA, 21 bp, Homo sapiens
gtcagtgtgccaccctctgca

SEQ ID NO: 1947418 - DNA, 17 bp, Homo sapiens
gtcatgacatttctcaa

SEQ ID NO: 1947419 - DNA, 12 bp, Homo sapiens
gtcatgcccagc

SEQ ID NO: 1947420 - DNA, 16 bp, Homo sapiens
gtcatgcccagcttgg

SEQ ID NO: 1947421 - DNA, 20 bp, Homo sapiens
gtccacaaaataaccaatcc

SEQ ID NO: 1947422 - DNA, 15 bp, Homo sapiens
gtccacgactgtctc

SEQ ID NO: 1947423 - DNA, 18 bp, Homo sapiens
gtccacgactgtctccat

SEQ ID NO: 1947424 - DNA, 13 bp, Homo sapiens
gtccatgggcaga

SEQ ID NO: 1947425 - DNA, 18 bp, Homo sapiens
gtccatgggcagagccca

SEQ ID NO: 1947426 - DNA, 21 bp, Homo sapiens
gtccattgtccaatcctatgt

SEQ ID NO: 1947427 - DNA, 19 bp, Homo sapiens
gtcccagggagctctgcat

SEQ ID NO: 1947428 - DNA, 14 bp, Homo sapiens
gtcccgagccccct

SEQ ID NO: 1947429 - DNA, 17 bp, Homo sapiens
gtcccgagccccctgtc

SEQ ID NO: 1947430 - DNA, 19 bp, Homo sapiens
gtcccgagccccctgtcct

SEQ ID NO: 1947431 - DNA, 16 bp, Homo sapiens
gtcccgggcactgtca

SEQ ID NO: 1947432 - DNA, 19 bp, Homo sapiens
gtcccgggtactcagtcag

SEQ ID NO: 1947433 - DNA, 21 bp, Homo sapiens
gtccctaccgagtctcttctc

SEQ ID NO: 1947434 - DNA, 21 bp, Homo sapiens
gtccctccacgttcacccctc

SEQ ID NO: 1947435 - DNA, 23 bp, Homo sapiens
gtccctccgggacctggtgctgc

SEQ ID NO: 1947436 - DNA, 13 bp, Homo sapiens
gtccctcctgagg

SEQ ID NO: 1947437 - DNA, 16 bp, Homo sapiens
gtccctttccctgcat

SEQ ID NO: 1947438 - DNA, 13 bp, Homo sapiens
gtcctcagcttct

SEQ ID NO: 1947439 - DNA, 17 bp, Homo sapiens
gtcctcagcttcttaat

SEQ ID NO: 1947440 - DNA, 14 bp, Homo sapiens
gtcctcccagctga

SEQ ID NO: 1947441 - DNA, 15 bp, Homo sapiens
gtcctcccagctgac

SEQ ID NO: 1947442 - DNA, 13 bp, Homo sapiens
gtcctcctctgtg

SEQ ID NO: 1947443 - DNA, 15 bp, Homo sapiens
gtcctcggcagctcc

SEQ ID NO: 1947444 - DNA, 15 bp, Homo sapiens
gtcctgatcagagcc

SEQ ID NO: 1947445 - DNA, 21 bp, Homo sapiens
gtcctgcaagtccatagctga

SEQ ID NO: 1947446 - DNA, 10 bp, Homo sapiens
gtcctgggtg

SEQ ID NO: 1947447 - DNA, 17 bp, Homo sapiens
gtccttctctcacctcc

SEQ ID NO: 1947448 - DNA, 18 bp, Homo sapiens
gtcgagtgatatggcttg

SEQ ID NO: 1947449 - DNA, 14 bp, Homo sapiens
gtcgcggctgcagg

SEQ ID NO: 1947450 - DNA, 23 bp, Homo sapiens
gtcgttcccttgtgtctgttgct

SEQ ID NO: 1947451 - DNA, 15 bp, Homo sapiens
gtctcaagagggcac

SEQ ID NO: 1947452 - DNA, 22 bp, Homo sapiens
gtctcacttgtgcagtgttgac

SEQ ID NO: 1947453 - DNA, 15 bp, Homo sapiens
gtctcatccatcatc

SEQ ID NO: 1947454 - DNA, 16 bp, Homo sapiens
gtctccacccctcaag

SEQ ID NO: 1947455 - DNA, 16 bp, Homo sapiens
gtctccctggccccag

SEQ ID NO: 1947456 - DNA, 17 bp, Homo sapiens
gtctccctggccccagt

SEQ ID NO: 1947457 - DNA, 18 bp, Homo sapiens
gtctcttctccactggat

SEQ ID NO: 1947458 - DNA, 15 bp, Homo sapiens
gtctgaaggagagga

SEQ ID NO: 1947459 - DNA, 17 bp, Homo sapiens
gtctgaaggagaggagt

SEQ ID NO: 1947460 - DNA, 19 bp, Homo sapiens
gtctgaagtcactgcacag

SEQ ID NO: 1947461 - DNA, 15 bp, Homo sapiens
gtctgagccctgccc

SEQ ID NO: 1947462 - DNA, 17 bp, Homo sapiens
tgggctgccctggtgct

SEQ ID NO: 1947463 - DNA, 23 bp, Homo sapiens
tgggctgctggaaaggcccggag

SEQ ID NO: 1947464 - DNA, 18 bp, Homo sapiens
tggggaagcttcttaaat

SEQ ID NO: 1947465 - DNA, 22 bp, Homo sapiens
tggggaggggcctggcctgggt

SEQ ID NO: 1947466 - DNA, 14 bp, Homo sapiens
tggggagggtgggc

SEQ ID NO: 1947467 - DNA, 15 bp, Homo sapiens
tggggagggtgggcg

SEQ ID NO: 1947468 - DNA, 19 bp, Homo sapiens
tggggatggggacaaagaa

SEQ ID NO: 1947469 - DNA, 14 bp, Homo sapiens
tggggcagggcctg

SEQ ID NO: 1947470 - DNA, 19 bp, Homo sapiens
tggggcagggcctggcctg

SEQ ID NO: 1947471 - DNA, 13 bp, Homo sapiens
tggggcggcctgc

SEQ ID NO: 1947472 - DNA, 16 bp, Homo sapiens
tggggcgggaggccac

SEQ ID NO: 1947473 - DNA, 22 bp, Homo sapiens
tggggcggtcaataattgtgga

SEQ ID NO: 1947474 - DNA, 20 bp, Homo sapiens
tggggcttagaatggggctt

SEQ ID NO: 1947475 - DNA, 15 bp, Homo sapiens
tgggggcctgctgtg

SEQ ID NO: 1947476 - DNA, 17 bp, Homo sapiens
tgggggcctgctgtggg

SEQ ID NO: 1947477 - DNA, 20 bp, Homo sapiens
tgggggggcttggggtagag

SEQ ID NO: 1947478 - DNA, 13 bp, Homo sapiens
tgggggtctggga

SEQ ID NO: 1947479 - DNA, 15 bp, Homo sapiens
tgggggtctgggagg

SEQ ID NO: 1947480 - DNA, 20 bp, Homo sapiens
tgggggtgtcacagaggcag

SEQ ID NO: 1947481 - DNA, 16 bp, Homo sapiens
tggggtagagaggaca

SEQ ID NO: 1947482 - DNA, 15 bp, Homo sapiens
tggggtggggcggga

SEQ ID NO: 1947483 - DNA, 14 bp, Homo sapiens
tggggttttcactt

SEQ ID NO: 1947484 - DNA, 20 bp, Homo sapiens
tggggttttcacttcctagg

SEQ ID NO: 1947485 - DNA, 18 bp, Homo sapiens
tgggtagtgccatggcca

SEQ ID NO: 1947486 - DNA, 15 bp, Homo sapiens
tgggtcagtgtgcca

SEQ ID NO: 1947487 - DNA, 18 bp, Homo sapiens
tgggtccatgggcagagc

SEQ ID NO: 1947488 - DNA, 12 bp, Homo sapiens
tgggtccctgcg

SEQ ID NO: 1947489 - DNA, 13 bp, Homo sapiens
tgggtcctcccag

SEQ ID NO: 1947490 - DNA, 21 bp, Homo sapiens
tgggtggggcagggcctggcc

SEQ ID NO: 1947491 - DNA, 14 bp, Homo sapiens
tgggtgtgtttcag

SEQ ID NO: 1947492 - DNA, 22 bp, Homo sapiens
tgggtgtgtttcaggacagctg

SEQ ID NO: 1947493 - DNA, 13 bp, Homo sapiens
tgggttccagaca

SEQ ID NO: 1947494 - DNA, 14 bp, Homo sapiens
tgggttccagacag

SEQ ID NO: 1947495 - DNA, 12 bp, Homo sapiens
tgggtttccctg

SEQ ID NO: 1947496 - DNA, 19 bp, Homo sapiens
tgggttttgtattctctga

SEQ ID NO: 1947497 - DNA, 21 bp, Homo sapiens
tgggttttgtattctctgagc

SEQ ID NO: 1947498 - DNA, 22 bp, Homo sapiens
tggtaatttaagattccagaga

SEQ ID NO: 1947499 - DNA, 19 bp, Homo sapiens
tggtactcccccagccctc

SEQ ID NO: 1947500 - DNA, 18 bp, Homo sapiens
tggtcatcgtgacagcag

SEQ ID NO: 1947501 - DNA, 17 bp, Homo sapiens
tggtcccccatgggctg

SEQ ID NO: 1947502 - DNA, 15 bp, Homo sapiens
tggtctggagcccct

SEQ ID NO: 1947503 - DNA, 16 bp, Homo sapiens
tggtctggagccccta

SEQ ID NO: 1947504 - DNA, 20 bp, Homo sapiens
tggtctggagcccctatcct

SEQ ID NO: 1947505 - DNA, 14 bp, Homo sapiens
tggtcttggagagg

SEQ ID NO: 1947506 - DNA, 18 bp, Homo sapiens
tggtcttggagaggaggt

SEQ ID NO: 1947507 - DNA, 17 bp, Homo sapiens
tggtgacccagtcagag

SEQ ID NO: 1947508 - DNA, 14 bp, Homo sapiens
tggtgagaattaaa

SEQ ID NO: 1947509 - DNA, 22 bp, Homo sapiens
tggtgagaattaaaataaaacg

SEQ ID NO: 1947510 - DNA, 14 bp, Homo sapiens
tggtgcagtgaaga

SEQ ID NO: 1947511 - DNA, 13 bp, Homo sapiens
tggtgcccttgga

SEQ ID NO: 1947512 - DNA, 16 bp, Homo sapiens
tggtgggctccagagt

SEQ ID NO: 1947513 - DNA, 16 bp, Homo sapiens
tggtggtttcagaaag

SEQ ID NO: 1947514 - DNA, 17 bp, Homo sapiens
tggtggtttcagaaagg

SEQ ID NO: 1947515 - DNA, 21 bp, Homo sapiens
tggtgtcttttatatttgaat

SEQ ID NO: 1947516 - DNA, 19 bp, Homo sapiens
tggtgtgaatgctgtacct

SEQ ID NO: 1947517 - DNA, 20 bp, Homo sapiens
tggtgtgccacaggctgcaa

SEQ ID NO: 1947518 - DNA, 13 bp, Homo sapiens
tggttaatcactt

SEQ ID NO: 1947519 - DNA, 19 bp, Homo sapiens
tggttaccgagtatctgta

SEQ ID NO: 1947520 - DNA, 11 bp, Homo sapiens
tggttcccctg

SEQ ID NO: 1947521 - DNA, 18 bp, Homo sapiens
tggttcccctgttcactc

SEQ ID NO: 1947522 - DNA, 19 bp, Homo sapiens
tggttcccctgttcactct

SEQ ID NO: 1947523 - DNA, 14 bp, Homo sapiens
tggttcctccagca

SEQ ID NO: 1947524 - DNA, 12 bp, Homo sapiens
tggttgaggaaa

SEQ ID NO: 1947525 - DNA, 14 bp, Homo sapiens
tggttggaggcctg

SEQ ID NO: 1947526 - DNA, 15 bp, Homo sapiens
tggttggaggcctgg

SEQ ID NO: 1947527 - DNA, 14 bp, Homo sapiens
tggtttcagaaagg

SEQ ID NO: 1947528 - DNA, 14 bp, Homo sapiens
tgtaaactgtgcac

SEQ ID NO: 1947529 - DNA, 14 bp, Homo sapiens
tgtaaatatcccag

SEQ ID NO: 1947530 - DNA, 20 bp, Homo sapiens
tgtaaatattcttgtccaca

SEQ ID NO: 1947531 - DNA, 16 bp, Homo sapiens
tgtaaattattgtaaa

SEQ ID NO: 1947532 - DNA, 23 bp, Homo sapiens
tgtaacccttgaatttctagaca

SEQ ID NO: 1947533 - DNA, 15 bp, Homo sapiens
tgtaactttgcatgt

SEQ ID NO: 1947534 - DNA, 17 bp, Homo sapiens
tgtaaggacttgtgcct

SEQ ID NO: 1947535 - DNA, 16 bp, Homo sapiens
tgtaagtagcaaacag

SEQ ID NO: 1947536 - DNA, 19 bp, Homo sapiens
tgtaagtagcaaacagggc

SEQ ID NO: 1947537 - DNA, 20 bp, Homo sapiens
tgtaatcaatgtttcttcta

SEQ ID NO: 1947538 - DNA, 17 bp, Homo sapiens
tgtaatcatataataaa

SEQ ID NO: 1947539 - DNA, 14 bp, Homo sapiens
tgtaattctaaatg

SEQ ID NO: 1947540 - DNA, 19 bp, Homo sapiens
tgtaattggcttttgaatc

SEQ ID NO: 1947541 - DNA, 22 bp, Homo sapiens
tgtaattggcttttgaatcaaa

SEQ ID NO: 1947542 - DNA, 17 bp, Homo sapiens
tgtacaagtgctcagtt

SEQ ID NO: 1947543 - DNA, 22 bp, Homo sapiens
tgtacaagtgctcagttccaat

SEQ ID NO: 1947544 - DNA, 13 bp, Homo sapiens
tgtacatacattg

SEQ ID NO: 1947545 - DNA, 14 bp, Homo sapiens
tgtacatacattgt

SEQ ID NO: 1947546 - DNA, 15 bp, Homo sapiens
tgtacatacattgta

SEQ ID NO: 1947547 - DNA, 16 bp, Homo sapiens
tgtacatacattgtat

SEQ ID NO: 1947548 - DNA, 18 bp, Homo sapiens
tgtacatacattgtatag

SEQ ID NO: 1947549 - DNA, 15 bp, Homo sapiens
tgtaccagggctctg

SEQ ID NO: 1947550 - DNA, 12 bp, Homo sapiens
tgtaccatgtac

SEQ ID NO: 1947551 - DNA, 17 bp, Homo sapiens
tgtaccatgtacatgaa

SEQ ID NO: 1947552 - DNA, 23 bp, Homo sapiens
tgtactttcattccctttcatga

SEQ ID NO: 1947553 - DNA, 13 bp, Homo sapiens
tgtagaagaggga

SEQ ID NO: 1947554 - DNA, 14 bp, Homo sapiens
tgtagaagagggag

SEQ ID NO: 1947555 - DNA, 15 bp, Homo sapiens
tgtagaagagggaga

SEQ ID NO: 1947556 - DNA, 21 bp, Homo sapiens
tgtagagtggtctatttctcc

SEQ ID NO: 1947557 - DNA, 22 bp, Homo sapiens
tgtagctaattaggaagcttga

SEQ ID NO: 1947558 - DNA, 15 bp, Homo sapiens
tgtaggtatcatttt

SEQ ID NO: 1947559 - DNA, 22 bp, Homo sapiens
tgtataacccatatctgtgcaa

SEQ ID NO: 1947560 - DNA, 15 bp, Homo sapiens
tgtataccacctgta

SEQ ID NO: 1947561 - DNA, 17 bp, Homo sapiens
tgtataccacctgtaca

SEQ ID NO: 1947562 - DNA, 18 bp, Homo sapiens
tgtataccacctgtacat

SEQ ID NO: 1947563 - DNA, 18 bp, Homo sapiens
tgtataggccatctgtaa

SEQ ID NO: 1947564 - DNA, 22 bp, Homo sapiens
tgtataggccatctgtaaatat

SEQ ID NO: 1947565 - DNA, 23 bp, Homo sapiens
tgtataggccatctgtaaatatc

SEQ ID NO: 1947566 - DNA, 12 bp, Homo sapiens
tgtatataaaat

SEQ ID NO: 1947567 - DNA, 12 bp, Homo sapiens
tgtatataaatg

SEQ ID NO: 1947568 - DNA, 14 bp, Homo sapiens
tgtatgcactttgt

SEQ ID NO: 1947569 - DNA, 20 bp, Homo sapiens
tgtatgtgtttataattgtt

SEQ ID NO: 1947570 - DNA, 14 bp, Homo sapiens
tgtattaagccact

SEQ ID NO: 1947571 - DNA, 13 bp, Homo sapiens
tgtattctctgag

SEQ ID NO: 1947572 - DNA, 14 bp, Homo sapiens
tgtattttgtattg

SEQ ID NO: 1947573 - DNA, 22 bp, Homo sapiens
tgtcaaccttgtgtgagtgtga

SEQ ID NO: 1947574 - DNA, 15 bp, Homo sapiens
tgtcacagaggcagt

SEQ ID NO: 1947575 - DNA, 20 bp, Homo sapiens
tgtcagaccttcttccacag

SEQ ID NO: 1947576 - DNA, 13 bp, Homo sapiens
tgtcagcaggaag

SEQ ID NO: 1947577 - DNA, 17 bp, Homo sapiens
tgtcagtagtgcctgtg

SEQ ID NO: 1947578 - DNA, 13 bp, Homo sapiens
tgtcatgcccagc

SEQ ID NO: 1947579 - DNA, 21 bp, Homo sapiens
tgtccacatctaacaaagtca

SEQ ID NO: 1947580 - DNA, 16 bp, Homo sapiens
tgtccacgactgtctc

SEQ ID NO: 1947581 - DNA, 16 bp, Homo sapiens
tgtcccagcccctggt

SEQ ID NO: 1947582 - DNA, 14 bp, Homo sapiens
tgtcctcagcttct

SEQ ID NO: 1947583 - DNA, 16 bp, Homo sapiens
tgtccttcccacggcc

SEQ ID NO: 1947584 - DNA, 22 bp, Homo sapiens
tgtcgtagttactctcaggcat

SEQ ID NO: 1947585 - DNA, 21 bp, Homo sapiens
tgtcgttcccttgtgtctgtt

SEQ ID NO: 1947586 - DNA, 17 bp, Homo sapiens
tgtctcaagagggcact

SEQ ID NO: 1947587 - DNA, 23 bp, Homo sapiens
tgtctcaagagggcactggtggc

SEQ ID NO: 1947588 - DNA, 20 bp, Homo sapiens
tgtctgacttctcaggaaga

SEQ ID NO: 1947589 - DNA, 13 bp, Homo sapiens
tgtctgagccctg

SEQ ID NO: 1947590 - DNA, 13 bp, Homo sapiens
tgtctgcctgcct

SEQ ID NO: 1947591 - DNA, 19 bp, Homo sapiens
tgtctgcgccgctgtgctg

SEQ ID NO: 1947592 - DNA, 18 bp, Homo sapiens
tgtctggctgtggcccct

SEQ ID NO: 1947593 - DNA, 21 bp, Homo sapiens
tgtctgttgcttattgggagt

SEQ ID NO: 1947594 - DNA, 21 bp, Homo sapiens
tgtcttcttgggggcagacca

SEQ ID NO: 1947595 - DNA, 22 bp, Homo sapiens
tttcaattccacctgcaatcaa

SEQ ID NO: 1947596 - DNA, 16 bp, Homo sapiens
tttcacaaccttctgt

SEQ ID NO: 1947597 - DNA, 22 bp, Homo sapiens
tttcactgacactgcgaactct

SEQ ID NO: 1947598 - DNA, 11 bp, Homo sapiens
tttcacttcct

SEQ ID NO: 1947599 - DNA, 23 bp, Homo sapiens
tttcagaaagggcagcccctccc

SEQ ID NO: 1947600 - DNA, 20 bp, Homo sapiens
tttcagccattcacaacaca

SEQ ID NO: 1947601 - DNA, 19 bp, Homo sapiens
tttcatgtaaactgtgcac

SEQ ID NO: 1947602 - DNA, 21 bp, Homo sapiens
tttcattaatacagggcattt

SEQ ID NO: 1947603 - DNA, 17 bp, Homo sapiens
tttccaagcctgggcca

SEQ ID NO: 1947604 - DNA, 15 bp, Homo sapiens
tttccaccaaattct

SEQ ID NO: 1947605 - DNA, 23 bp, Homo sapiens
tttccacggagccactcctctga

SEQ ID NO: 1947606 - DNA, 21 bp, Homo sapiens
tttcccgtataataaaaccaa

SEQ ID NO: 1947607 - DNA, 23 bp, Homo sapiens
tttccctagaaagccatattcca

SEQ ID NO: 1947608 - DNA, 22 bp, Homo sapiens
tttcctcttagtcgagccaagt

SEQ ID NO: 1947609 - DNA, 22 bp, Homo sapiens
tttcctgtgtccacatctaaca

SEQ ID NO: 1947610 - DNA, 18 bp, Homo sapiens
tttccttctgatctgaga

SEQ ID NO: 1947611 - DNA, 18 bp, Homo sapiens
tttctatgtaaattattg

SEQ ID NO: 1947612 - DNA, 18 bp, Homo sapiens
tttctggaatgtaatcaa

SEQ ID NO: 1947613 - DNA, 20 bp, Homo sapiens
tttcttccactaccctccct

SEQ ID NO: 1947614 - DNA, 14 bp, Homo sapiens
tttctttaaactat

SEQ ID NO: 1947615 - DNA, 22 bp, Homo sapiens
tttcttttctggaatgtaatca

SEQ ID NO: 1947616 - DNA, 15 bp, Homo sapiens
tttgaaaatatttct

SEQ ID NO: 1947617 - DNA, 17 bp, Homo sapiens
tttgaaatatgcatgta

SEQ ID NO: 1947618 - DNA, 18 bp, Homo sapiens
tttgaaattaacctctca

SEQ ID NO: 1947619 - DNA, 12 bp, Homo sapiens
tttgactctttt

SEQ ID NO: 1947620 - DNA, 18 bp, Homo sapiens
tttgaggaccctcccagg

SEQ ID NO: 1947621 - DNA, 14 bp, Homo sapiens
tttgagtgctctga

SEQ ID NO: 1947622 - DNA, 14 bp, Homo sapiens
tttgatttcattaa

SEQ ID NO: 1947623 - DNA, 14 bp, Homo sapiens
tttgcaacctcgct

SEQ ID NO: 1947624 - DNA, 19 bp, Homo sapiens
tttgcagacctgggacttt

SEQ ID NO: 1947625 - DNA, 17 bp, Homo sapiens
tttgcataacaattcct

SEQ ID NO: 1947626 - DNA, 20 bp, Homo sapiens
tttgcataacaattcctcta

SEQ ID NO: 1947627 - DNA, 21 bp, Homo sapiens
tttgcctggatacctctggct

SEQ ID NO: 1947628 - DNA, 23 bp, Homo sapiens
tttgcgtggatcaagcttgtgta

SEQ ID NO: 1947629 - DNA, 13 bp, Homo sapiens
tttgctcccagtt

SEQ ID NO: 1947630 - DNA, 20 bp, Homo sapiens
tttggcatctgtttaaagta

SEQ ID NO: 1947631 - DNA, 14 bp, Homo sapiens
tttgggctgccctg

SEQ ID NO: 1947632 - DNA, 12 bp, Homo sapiens
tttgtaaatatt

SEQ ID NO: 1947633 - DNA, 13 bp, Homo sapiens
tttgtgtttcaga

SEQ ID NO: 1947634 - DNA, 17 bp, Homo sapiens
tttgttgctgttgttca

SEQ ID NO: 1947635 - DNA, 20 bp, Homo sapiens
ttttaaaccctattggtaaa

SEQ ID NO: 1947636 - DNA, 22 bp, Homo sapiens
ttttacagtatatcttaagata

SEQ ID NO: 1947637 - DNA, 13 bp, Homo sapiens
ttttacagtgtat

SEQ ID NO: 1947638 - DNA, 19 bp, Homo sapiens
ttttacagtgtatctcgaa

SEQ ID NO: 1947639 - DNA, 17 bp, Homo sapiens
ttttatattacttttgt

SEQ ID NO: 1947640 - DNA, 22 bp, Homo sapiens
ttttatattacttttgtaaata

SEQ ID NO: 1947641 - DNA, 23 bp, Homo sapiens
ttttatctccccttcacatgcat

SEQ ID NO: 1947642 - DNA, 22 bp, Homo sapiens
ttttcaacgcagccctgctttg

SEQ ID NO: 1947643 - DNA, 18 bp, Homo sapiens
ttttcaccatctttctaa

SEQ ID NO: 1947644 - DNA, 14 bp, Homo sapiens
ttttcagaaagcat

SEQ ID NO: 1947645 - DNA, 13 bp, Homo sapiens
ttttcatctcatt

SEQ ID NO: 1947646 - DNA, 22 bp, Homo sapiens
ttttcccgtataataaaaccaa

SEQ ID NO: 1947647 - DNA, 23 bp, Homo sapiens
ttttctacagccagtaaggcagc

SEQ ID NO: 1947648 - DNA, 14 bp, Homo sapiens
ttttctatatttgt

SEQ ID NO: 1947649 - DNA, 16 bp, Homo sapiens
ttttctatatttgtaa

SEQ ID NO: 1947650 - DNA, 15 bp, Homo sapiens
ttttgccattaaact

SEQ ID NO: 1947651 - DNA, 14 bp, Homo sapiens
ttttgcgatgtgtt

SEQ ID NO: 1947652 - DNA, 21 bp, Homo sapiens
ttttgctggcttgcactttct

SEQ ID NO: 1947653 - DNA, 23 bp, Homo sapiens
ttttggatttagagactgtaaat

SEQ ID NO: 1947654 - DNA, 17 bp, Homo sapiens
ttttgtattctctgagc

SEQ ID NO: 1947655 - DNA, 15 bp, Homo sapiens
ttttgtctcgaaata

SEQ ID NO: 1947656 - DNA, 11 bp, Homo sapiens
ttttgtgcagt

SEQ ID NO: 1947657 - DNA, 17 bp, Homo sapiens
ttttgtttttcattcag

SEQ ID NO: 1947658 - DNA, 13 bp, Homo sapiens
tttttaagacttt

SEQ ID NO: 1947659 - DNA, 12 bp, Homo sapiens
tttttaattatt

SEQ ID NO: 1947660 - DNA, 14 bp, Homo sapiens
tttttacagtgtat

SEQ ID NO: 1947661 - DNA, 17 bp, Homo sapiens
tttttagatgtagcact

SEQ ID NO: 1947662 - DNA, 13 bp, Homo sapiens
tttttatattact

SEQ ID NO: 1947663 - DNA, 13 bp, Homo sapiens
tttttgtctcgaa

SEQ ID NO: 1947664 - DNA, 13 bp, Homo sapiens
ttttttatgctaa

SEQ ID NO: 1947665 - DNA, 16 bp, Homo sapiens
ttttttatgctaatca

SEQ ID NO: 1947666 - DNA, 13 bp, Homo sapiens
ttttttccactta

SEQ ID NO: 1947667 - DNA, 12 bp, Homo sapiens
acgggagagcgc

SEQ ID NO: 1947668 - DNA, 22 bp, Homo sapiens
acgggcccgctcaacctctcag

SEQ ID NO: 1947669 - DNA, 12 bp, Homo sapiens
acggggcagagc

SEQ ID NO: 1947670 - DNA, 13 bp, Homo sapiens
acggggcagagct

SEQ ID NO: 1947671 - DNA, 15 bp, Homo sapiens
acggggcagagctga

SEQ ID NO: 1947672 - DNA, 21 bp, Homo sapiens
acggggtcgggggaggagcac

SEQ ID NO: 1947673 - DNA, 21 bp, Homo sapiens
acgtctaaactgtttactcac

SEQ ID NO: 1947674 - DNA, 16 bp, Homo sapiens
acgtctgtgagtctgt

SEQ ID NO: 1947675 - DNA, 20 bp, Homo sapiens
acgtctgtgagtctgtcctt

SEQ ID NO: 1947676 - DNA, 16 bp, Homo sapiens
acgtgaactaagattt

SEQ ID NO: 1947677 - DNA, 17 bp, Homo sapiens
acgtgaagataccataa

SEQ ID NO: 1947678 - DNA, 12 bp, Homo sapiens
acgtgtgaggat

SEQ ID NO: 1947679 - DNA, 13 bp, Homo sapiens
actaaaagtgatg

SEQ ID NO: 1947680 - DNA, 21 bp, Homo sapiens
actaaaagtgatgtgatttat

SEQ ID NO: 1947681 - DNA, 18 bp, Homo sapiens
actaaatagatttttaga

SEQ ID NO: 1947682 - DNA, 21 bp, Homo sapiens
actaagatttcctttggcaat

SEQ ID NO: 1947683 - DNA, 13 bp, Homo sapiens
actaatgaaattt

SEQ ID NO: 1947684 - DNA, 17 bp, Homo sapiens
actaatgaaatttacag

SEQ ID NO: 1947685 - DNA, 15 bp, Homo sapiens
actacaacattagaa

SEQ ID NO: 1947686 - DNA, 19 bp, Homo sapiens
actacctttggcttaattc

SEQ ID NO: 1947687 - DNA, 15 bp, Homo sapiens
actagccctctttct

SEQ ID NO: 1947688 - DNA, 18 bp, Homo sapiens
actagccctctttctctc

SEQ ID NO: 1947689 - DNA, 20 bp, Homo sapiens
actagccctctttctctctg

SEQ ID NO: 1947690 - DNA, 23 bp, Homo sapiens
actagccctctttctctctgtgt

SEQ ID NO: 1947691 - DNA, 13 bp, Homo sapiens
actcaaggcctcc

SEQ ID NO: 1947692 - DNA, 21 bp, Homo sapiens
actcacatgccttctaaacgt

SEQ ID NO: 1947693 - DNA, 17 bp, Homo sapiens
actccatggtgaactga

SEQ ID NO: 1947694 - DNA, 11 bp, Homo sapiens
actcccagggc

SEQ ID NO: 1947695 - DNA, 12 bp, Homo sapiens
actcccagggcc

SEQ ID NO: 1947696 - DNA, 14 bp, Homo sapiens
actcccagggcccg

SEQ ID NO: 1947697 - DNA, 19 bp, Homo sapiens
actcccagggcccgagcgc

SEQ ID NO: 1947698 - DNA, 20 bp, Homo sapiens
actccccgcccgccctcctc

SEQ ID NO: 1947699 - DNA, 19 bp, Homo sapiens
actcctcaattccagggaa

SEQ ID NO: 1947700 - DNA, 16 bp, Homo sapiens
actcgagagggctgag

SEQ ID NO: 1947701 - DNA, 17 bp, Homo sapiens
actctgagtcctcattg

SEQ ID NO: 1947702 - DNA, 18 bp, Homo sapiens
actcttttgagcagtaaa

SEQ ID NO: 1947703 - DNA, 17 bp, Homo sapiens
actgaggaaagggagga

SEQ ID NO: 1947704 - DNA, 19 bp, Homo sapiens
actgagttagaatgttgaa

SEQ ID NO: 1947705 - DNA, 18 bp, Homo sapiens
actgatatcacgggcccg

SEQ ID NO: 1947706 - DNA, 18 bp, Homo sapiens
actgatccatcctgtttt

SEQ ID NO: 1947707 - DNA, 14 bp, Homo sapiens
actgatgagacaac

SEQ ID NO: 1947708 - DNA, 19 bp, Homo sapiens
actgatgagacaacacaca

SEQ ID NO: 1947709 - DNA, 20 bp, Homo sapiens
actgatgagacaacacacac

SEQ ID NO: 1947710 - DNA, 21 bp, Homo sapiens
actgatgagacaacacacaca

SEQ ID NO: 1947711 - DNA, 12 bp, Homo sapiens
actgcaacactg

SEQ ID NO: 1947712 - DNA, 19 bp, Homo sapiens
actgccatttcctcctggg

SEQ ID NO: 1947713 - DNA, 11 bp, Homo sapiens
actgcccaccc

SEQ ID NO: 1947714 - DNA, 18 bp, Homo sapiens
actgcccaccctgggcct

SEQ ID NO: 1947715 - DNA, 17 bp, Homo sapiens
actgctatcagtctctt

SEQ ID NO: 1947716 - DNA, 15 bp, Homo sapiens
actgctttattttag

SEQ ID NO: 1947717 - DNA, 14 bp, Homo sapiens
actgctttgagaaa

SEQ ID NO: 1947718 - DNA, 21 bp, Homo sapiens
actggaggtacaaataattta

SEQ ID NO: 1947719 - DNA, 14 bp, Homo sapiens
actggccccaggcg

SEQ ID NO: 1947720 - DNA, 16 bp, Homo sapiens
actggccccaggcgga

SEQ ID NO: 1947721 - DNA, 17 bp, Homo sapiens
actgtgacacagctgag

SEQ ID NO: 1947722 - DNA, 17 bp, Homo sapiens
actgtgacattccacag

SEQ ID NO: 1947723 - DNA, 20 bp, Homo sapiens
actgttcatgaatacgtaaa

SEQ ID NO: 1947724 - DNA, 19 bp, Homo sapiens
actgttcttcgcagctcat

SEQ ID NO: 1947725 - DNA, 13 bp, Homo sapiens
acttaaacaaaaa

SEQ ID NO: 1947726 - DNA, 18 bp, Homo sapiens
acttaaacaaaaactttc

SEQ ID NO: 1947727 - DNA, 21 bp, Homo sapiens
acttaaacaaaaactttccat

SEQ ID NO: 1947728 - DNA, 20 bp, Homo sapiens
acttacccttctacaaaaga

SEQ ID NO: 1947729 - DNA, 20 bp, Homo sapiens
acttctctgtcctctgcttt

SEQ ID NO: 1947730 - DNA, 16 bp, Homo sapiens
acttcttgtgctttac

SEQ ID NO: 1947731 - DNA, 16 bp, Homo sapiens
acttgctgtgaaatga

SEQ ID NO: 1947732 - DNA, 15 bp, Homo sapiens
acttggaatttgctt

SEQ ID NO: 1947733 - DNA, 23 bp, Homo sapiens
acttggaatttgcttagccttta

SEQ ID NO: 1947734 - DNA, 15 bp, Homo sapiens
actttccatgacagt

SEQ ID NO: 1947735 - DNA, 21 bp, Homo sapiens
actttccatgacagtagcata

SEQ ID NO: 1947736 - DNA, 14 bp, Homo sapiens
actttcctatgaca

SEQ ID NO: 1947737 - DNA, 18 bp, Homo sapiens
actttgaacattaatgtt

SEQ ID NO: 1947738 - DNA, 20 bp, Homo sapiens
actttgaacattaatgttga

SEQ ID NO: 1947739 - DNA, 16 bp, Homo sapiens
actttggatcaggaaa

SEQ ID NO: 1947740 - DNA, 14 bp, Homo sapiens
actttgggaggctg

SEQ ID NO: 1947741 - DNA, 20 bp, Homo sapiens
actttgtgtcttttgttctc

SEQ ID NO: 1947742 - DNA, 21 bp, Homo sapiens
actttgtgtcttttgttctct

SEQ ID NO: 1947743 - DNA, 22 bp, Homo sapiens
acttttattgtataattatgaa

SEQ ID NO: 1947744 - DNA, 15 bp, Homo sapiens
actttttaacattct

SEQ ID NO: 1947745 - DNA, 17 bp, Homo sapiens
actttttaacattctca

SEQ ID NO: 1947746 - DNA, 19 bp, Homo sapiens
actttttaacattctcaat

SEQ ID NO: 1947747 - DNA, 17 bp, Homo sapiens
acttttttcctgtcaat

SEQ ID NO: 1947748 - DNA, 22 bp, Homo sapiens
agaaaacaaccaaagaaaattg

SEQ ID NO: 1947749 - DNA, 15 bp, Homo sapiens
agaaagaggaataaa

SEQ ID NO: 1947750 - DNA, 16 bp, Homo sapiens
agaaagcaaaacattt

SEQ ID NO: 1947751 - DNA, 17 bp, Homo sapiens
agaaatataaaaataat

SEQ ID NO: 1947752 - DNA, 19 bp, Homo sapiens
agaaattagggctctaatt

SEQ ID NO: 1947753 - DNA, 23 bp, Homo sapiens
agaaattagggctctaatttcct

SEQ ID NO: 1947754 - DNA, 22 bp, Homo sapiens
agaacaacaacaaagcatgctc

SEQ ID NO: 1947755 - DNA, 18 bp, Homo sapiens
agaaccagcactcccagg

SEQ ID NO: 1947756 - DNA, 17 bp, Homo sapiens
agaacgggcctccccgg

SEQ ID NO: 1947757 - DNA, 19 bp, Homo sapiens
agaacgggcctccccgggg

SEQ ID NO: 1947758 - DNA, 20 bp, Homo sapiens
agaactaaatagatttttag

SEQ ID NO: 1947759 - DNA, 20 bp, Homo sapiens
agaagcagcagctagaaaga

SEQ ID NO: 1947760 - DNA, 22 bp, Homo sapiens
agaagcagcagctagaaagaga

SEQ ID NO: 1947761 - DNA, 14 bp, Homo sapiens
agaaggaggaaccc

SEQ ID NO: 1947762 - DNA, 16 bp, Homo sapiens
agaatatattgccaaa

SEQ ID NO: 1947763 - DNA, 22 bp, Homo sapiens
agaatcacctaattaatttcag

SEQ ID NO: 1947764 - DNA, 23 bp, Homo sapiens
agaatgttgaaactgacttgctg

SEQ ID NO: 1947765 - DNA, 15 bp, Homo sapiens
aaatctatagcattt

SEQ ID NO: 1947766 - DNA, 14 bp, Homo sapiens
aaatctcatcccta

SEQ ID NO: 1947767 - DNA, 12 bp, Homo sapiens
aaatgaaatact

SEQ ID NO: 1947768 - DNA, 20 bp, Homo sapiens
aaatgagttcccttgattca

SEQ ID NO: 1947769 - DNA, 22 bp, Homo sapiens
aaatgattcacttttattgtat

SEQ ID NO: 1947770 - DNA, 13 bp, Homo sapiens
aaatgattcaggg

SEQ ID NO: 1947771 - DNA, 17 bp, Homo sapiens
aaatgcaaagcacacct

SEQ ID NO: 1947772 - DNA, 21 bp, Homo sapiens
aaatgctgatttaaacttctt

SEQ ID NO: 1947773 - DNA, 17 bp, Homo sapiens
aaatggatagattgttt

SEQ ID NO: 1947774 - DNA, 16 bp, Homo sapiens
aaattaacttctattt

SEQ ID NO: 1947775 - DNA, 17 bp, Homo sapiens
aaattaacttctatttt

SEQ ID NO: 1947776 - DNA, 18 bp, Homo sapiens
aaattagggctctaattt

SEQ ID NO: 1947777 - DNA, 20 bp, Homo sapiens
aaattagggctctaatttcc

SEQ ID NO: 1947778 - DNA, 23 bp, Homo sapiens
aaattagggctctaatttcctta

SEQ ID NO: 1947779 - DNA, 18 bp, Homo sapiens
aaattattgatacaacag

SEQ ID NO: 1947780 - DNA, 23 bp, Homo sapiens
aaattattgatacaacaggattt

SEQ ID NO: 1947781 - DNA, 16 bp, Homo sapiens
aaattgacctcaaaag

SEQ ID NO: 1947782 - DNA, 19 bp, Homo sapiens
aaattgacctcaaaagaaa

SEQ ID NO: 1947783 - DNA, 11 bp, Homo sapiens
aaattgctgag

SEQ ID NO: 1947784 - DNA, 16 bp, Homo sapiens
aaattgctgagatgtt

SEQ ID NO: 1947785 - DNA, 18 bp, Homo sapiens
aacaaaaactttccatga

SEQ ID NO: 1947786 - DNA, 21 bp, Homo sapiens
aacaaaatccttgccttcaaa

SEQ ID NO: 1947787 - DNA, 15 bp, Homo sapiens
aacaaactcaaaatg

SEQ ID NO: 1947788 - DNA, 22 bp, Homo sapiens
aacaaagcatgctcagtattga

SEQ ID NO: 1947789 - DNA, 13 bp, Homo sapiens
aatataaactgtg

SEQ ID NO: 1947790 - DNA, 17 bp, Homo sapiens
aatataaactgtgagat

SEQ ID NO: 1947791 - DNA, 21 bp, Homo sapiens
aatataaactgtgagataaat

SEQ ID NO: 1947792 - DNA, 22 bp, Homo sapiens
aatatatgtttggctgaaatta

SEQ ID NO: 1947793 - DNA, 22 bp, Homo sapiens
aatatggcaatagcattgttct

SEQ ID NO: 1947794 - DNA, 22 bp, Homo sapiens
aatatttgctcaatatgatctt

SEQ ID NO: 1947795 - DNA, 13 bp, Homo sapiens
aatcaaaaaatta

SEQ ID NO: 1947796 - DNA, 22 bp, Homo sapiens
aatcaaaattgacctcaaaaga

SEQ ID NO: 1947797 - DNA, 20 bp, Homo sapiens
aatcaagtctgtgaaagtct

SEQ ID NO: 1947798 - DNA, 18 bp, Homo sapiens
aatcagcatttttcttta

SEQ ID NO: 1947799 - DNA, 19 bp, Homo sapiens
aatcatccttttttaaaaa

SEQ ID NO: 1947800 - DNA, 18 bp, Homo sapiens
aatcatgggaattttaac

SEQ ID NO: 1947801 - DNA, 19 bp, Homo sapiens
aatccccataatgcttctt

SEQ ID NO: 1947802 - DNA, 12 bp, Homo sapiens
aatctaaattaa

SEQ ID NO: 1947803 - DNA, 14 bp, Homo sapiens
aatctaaattaact

SEQ ID NO: 1947804 - DNA, 12 bp, Homo sapiens
aatctagagcta

SEQ ID NO: 1947805 - DNA, 15 bp, Homo sapiens
aatctagagctatgc

SEQ ID NO: 1947806 - DNA, 23 bp, Homo sapiens
aatctcaaaagatctcctgtgca

SEQ ID NO: 1947807 - DNA, 15 bp, Homo sapiens
aatcttgctgtgaaa

SEQ ID NO: 1947808 - DNA, 16 bp, Homo sapiens
aatgaaatacttgaca

SEQ ID NO: 1947809 - DNA, 22 bp, Homo sapiens
aatgaaatacttgacaacattt

SEQ ID NO: 1947810 - DNA, 21 bp, Homo sapiens
aatgaaatataaactgtgaga

SEQ ID NO: 1947811 - DNA, 22 bp, Homo sapiens
aatgaaatataaactgtgagat

SEQ ID NO: 1947812 - DNA, 21 bp, Homo sapiens
aatgaagattcagcagtgtct

SEQ ID NO: 1947813 - DNA, 15 bp, Homo sapiens
aatgaatgaaatata

SEQ ID NO: 1947814 - DNA, 18 bp, Homo sapiens
aatgatatgtctttaaaa

SEQ ID NO: 1947815 - DNA, 20 bp, Homo sapiens
aatgatgattcaatcatttt

SEQ ID NO: 1947816 - DNA, 12 bp, Homo sapiens
aatgattcaggg

SEQ ID NO: 1947817 - DNA, 20 bp, Homo sapiens
aatgattcagggttatttga

SEQ ID NO: 1947818 - DNA, 21 bp, Homo sapiens
aatgctaagccagttcttaag

SEQ ID NO: 1947819 - DNA, 17 bp, Homo sapiens
aatgctcaatgtgctgt

SEQ ID NO: 1947820 - DNA, 18 bp, Homo sapiens
aatgctcaatgtgctgtt

SEQ ID NO: 1947821 - DNA, 13 bp, Homo sapiens
aatgctgatttaa

SEQ ID NO: 1947822 - DNA, 19 bp, Homo sapiens
aatgcttctttcctcttaa

SEQ ID NO: 1947823 - DNA, 12 bp, Homo sapiens
aatgcttctttt

SEQ ID NO: 1947824 - DNA, 22 bp, Homo sapiens
aatggattttttttttcaggtt

SEQ ID NO: 1947825 - DNA, 15 bp, Homo sapiens
aatggcctcttaaaa

SEQ ID NO: 1947826 - DNA, 13 bp, Homo sapiens
aatggttttcaac

SEQ ID NO: 1947827 - DNA, 17 bp, Homo sapiens
aatgtccaggtcacagg

SEQ ID NO: 1947828 - DNA, 20 bp, Homo sapiens
aatgtccaggtcacaggcat

SEQ ID NO: 1947829 - DNA, 22 bp, Homo sapiens
aatgtgccgtctttggttcctc

SEQ ID NO: 1947830 - DNA, 14 bp, Homo sapiens
aatgtgctgttgat

SEQ ID NO: 1947831 - DNA, 21 bp, Homo sapiens
aatgtgctgttgattctttca

SEQ ID NO: 1947832 - DNA, 21 bp, Homo sapiens
aatgttccgttcatctgagga

SEQ ID NO: 1947833 - DNA, 16 bp, Homo sapiens
aatgttgaaaaagaaa

SEQ ID NO: 1947834 - DNA, 18 bp, Homo sapiens
aatgttgtcctgtgtcat

SEQ ID NO: 1947835 - DNA, 17 bp, Homo sapiens
aattaaaacaaaatcct

SEQ ID NO: 1947836 - DNA, 14 bp, Homo sapiens
aattaaatgaaata

SEQ ID NO: 1947837 - DNA, 16 bp, Homo sapiens
aattaaatgaaatact

SEQ ID NO: 1947838 - DNA, 14 bp, Homo sapiens
aattaacatatcaa

SEQ ID NO: 1947839 - DNA, 12 bp, Homo sapiens
aattaatttcag

SEQ ID NO: 1947840 - DNA, 19 bp, Homo sapiens
aattacataacaggcattg

SEQ ID NO: 1947841 - DNA, 13 bp, Homo sapiens
aattagattttaa

SEQ ID NO: 1947842 - DNA, 14 bp, Homo sapiens
aattatgtcaaatg

SEQ ID NO: 1947843 - DNA, 18 bp, Homo sapiens
aattatgtcaaatggatg

SEQ ID NO: 1947844 - DNA, 13 bp, Homo sapiens
aattattaaaaat

SEQ ID NO: 1947845 - DNA, 15 bp, Homo sapiens
aattattaaaaatta

SEQ ID NO: 1947846 - DNA, 17 bp, Homo sapiens
aattattaaaaattata

SEQ ID NO: 1947847 - DNA, 17 bp, Homo sapiens
aattattgatacaacag

SEQ ID NO: 1947848 - DNA, 13 bp, Homo sapiens
aattcaaacctaa

SEQ ID NO: 1947849 - DNA, 14 bp, Homo sapiens
aattcaaagaatca

SEQ ID NO: 1947850 - DNA, 14 bp, Homo sapiens
aattcctcctgtct

SEQ ID NO: 1947851 - DNA, 22 bp, Homo sapiens
aattcttgcactgtatccaagt

SEQ ID NO: 1947852 - DNA, 23 bp, Homo sapiens
aattctttgttgcttaatctaga

SEQ ID NO: 1947853 - DNA, 20 bp, Homo sapiens
aattgacctcaaaagaaaat

SEQ ID NO: 1947854 - DNA, 21 bp, Homo sapiens
aattgacctcaaaagaaaatg

SEQ ID NO: 1947855 - DNA, 21 bp, Homo sapiens
aattgcttctctaaaacagca

SEQ ID NO: 1947856 - DNA, 23 bp, Homo sapiens
aattgtttcctaaatcagcattt

SEQ ID NO: 1947857 - DNA, 13 bp, Homo sapiens
aatttagaaataa

SEQ ID NO: 1947858 - DNA, 20 bp, Homo sapiens
aatttagaaataaaagatga

SEQ ID NO: 1947859 - DNA, 16 bp, Homo sapiens
aatttaggaatgctca

SEQ ID NO: 1947860 - DNA, 17 bp, Homo sapiens
aatttaggaatgctcaa

SEQ ID NO: 1947861 - DNA, 14 bp, Homo sapiens
aatttcaagaatgt

SEQ ID NO: 1947862 - DNA, 19 bp, Homo sapiens
aatttgggttgcaaagcta

SEQ ID NO: 1947863 - DNA, 12 bp, Homo sapiens
aatttgttctgt

SEQ ID NO: 1947864 - DNA, 16 bp, Homo sapiens
aatttgttctgtgcaa

SEQ ID NO: 1947865 - DNA, 12 bp, Homo sapiens
aattttccttta

SEQ ID NO: 1947866 - DNA, 15 bp, Homo sapiens
acaaaaactttccat

SEQ ID NO: 1947867 - DNA, 19 bp, Homo sapiens
acaaaaactttccatgaca

SEQ ID NO: 1947868 - DNA, 12 bp, Homo sapiens
acaaaacaacag

SEQ ID NO: 1947869 - DNA, 14 bp, Homo sapiens
acaaaagatatgaa

SEQ ID NO: 1947870 - DNA, 21 bp, Homo sapiens
acaaaatgtgtgcttggaaaa

SEQ ID NO: 1947871 - DNA, 16 bp, Homo sapiens
acaaagcatgctcagt

SEQ ID NO: 1947872 - DNA, 18 bp, Homo sapiens
acaaataatttagaaata

SEQ ID NO: 1947873 - DNA, 19 bp, Homo sapiens
acaaataatttagaaataa

SEQ ID NO: 1947874 - DNA, 23 bp, Homo sapiens
acaaatgatttcgtgactgtagt

SEQ ID NO: 1947875 - DNA, 14 bp, Homo sapiens
acaacaacaaagca

SEQ ID NO: 1947876 - DNA, 20 bp, Homo sapiens
acaacacagtagtgttctgt

SEQ ID NO: 1947877 - DNA, 17 bp, Homo sapiens
acaagtttttttgttca

SEQ ID NO: 1947878 - DNA, 18 bp, Homo sapiens
acaatactttgtgtcttt

SEQ ID NO: 1947879 - DNA, 22 bp, Homo sapiens
acaatactttgtgtcttttgtt

SEQ ID NO: 1947880 - DNA, 15 bp, Homo sapiens
acaatcatctattga

SEQ ID NO: 1947881 - DNA, 23 bp, Homo sapiens
agctaacaaaagatatgaagaac

SEQ ID NO: 1947882 - DNA, 18 bp, Homo sapiens
agctacaggggaggctga

SEQ ID NO: 1947883 - DNA, 13 bp, Homo sapiens
agctagaaagaga

SEQ ID NO: 1947884 - DNA, 21 bp, Homo sapiens
agctagaaagagaaaaagccc

SEQ ID NO: 1947885 - DNA, 15 bp, Homo sapiens
agctagctgcttttc

SEQ ID NO: 1947886 - DNA, 19 bp, Homo sapiens
agctagtttaaaattatta

SEQ ID NO: 1947887 - DNA, 22 bp, Homo sapiens
agctatgcacaccaaattgctg

SEQ ID NO: 1947888 - DNA, 15 bp, Homo sapiens
agctcaaggctgcag

SEQ ID NO: 1947889 - DNA, 17 bp, Homo sapiens
agctcagaggagaggag

SEQ ID NO: 1947890 - DNA, 15 bp, Homo sapiens
agctccaccctcccc

SEQ ID NO: 1947891 - DNA, 15 bp, Homo sapiens
agctccttcatgctt

SEQ ID NO: 1947892 - DNA, 17 bp, Homo sapiens
agctgagtcggctgggc

SEQ ID NO: 1947893 - DNA, 19 bp, Homo sapiens
agctgataaagaaaccttt

SEQ ID NO: 1947894 - DNA, 18 bp, Homo sapiens
agctgcctctttgctgct

SEQ ID NO: 1947895 - DNA, 22 bp, Homo sapiens
agctgcctctttgctgctttgt

SEQ ID NO: 1947896 - DNA, 13 bp, Homo sapiens
agctggcagcgcc

SEQ ID NO: 1947897 - DNA, 16 bp, Homo sapiens
agctggcagcgcctcc

SEQ ID NO: 1947898 - DNA, 21 bp, Homo sapiens
agctggctgggtcgcccctcc

SEQ ID NO: 1947899 - DNA, 15 bp, Homo sapiens
agctgttagttaaaa

SEQ ID NO: 1947900 - DNA, 15 bp, Homo sapiens
agcttcccaacaata

SEQ ID NO: 1947901 - DNA, 16 bp, Homo sapiens
aggaaagatcccaagt

SEQ ID NO: 1947902 - DNA, 18 bp, Homo sapiens
aggaatgctcaatgtgct

SEQ ID NO: 1947903 - DNA, 16 bp, Homo sapiens
aggacaagtgtaataa

SEQ ID NO: 1947904 - DNA, 14 bp, Homo sapiens
aggacggggcagag

SEQ ID NO: 1947905 - DNA, 13 bp, Homo sapiens
aggagagaaagca

SEQ ID NO: 1947906 - DNA, 23 bp, Homo sapiens
aggagagaaagcaaaacattttg

SEQ ID NO: 1947907 - DNA, 13 bp, Homo sapiens
aggagcaccccca

SEQ ID NO: 1947908 - DNA, 14 bp, Homo sapiens
aggagcacccccag

SEQ ID NO: 1947909 - DNA, 15 bp, Homo sapiens
aggagcacccccagc

SEQ ID NO: 1947910 - DNA, 21 bp, Homo sapiens
aggagcacccccagcctcccc

SEQ ID NO: 1947911 - DNA, 23 bp, Homo sapiens
aggagggaaagttccagcagttt

SEQ ID NO: 1947912 - DNA, 19 bp, Homo sapiens
aggatcacttgagcccaga

SEQ ID NO: 1947913 - DNA, 12 bp, Homo sapiens
aggattttcaag

SEQ ID NO: 1947914 - DNA, 13 bp, Homo sapiens
aggattttcaagt

SEQ ID NO: 1947915 - DNA, 15 bp, Homo sapiens
aggattttcaagtta

SEQ ID NO: 1947916 - DNA, 21 bp, Homo sapiens
aggcactttttaacattctca

SEQ ID NO: 1947917 - DNA, 13 bp, Homo sapiens
aggcagggccctg

SEQ ID NO: 1947918 - DNA, 17 bp, Homo sapiens
aggcattgcactaaaag

SEQ ID NO: 1947919 - DNA, 19 bp, Homo sapiens
aggccaaatgagttccctt

SEQ ID NO: 1947920 - DNA, 22 bp, Homo sapiens
aggcccccggaggcgcccacct

SEQ ID NO: 1947921 - DNA, 19 bp, Homo sapiens
aggcctgagggaagcccac

SEQ ID NO: 1947922 - DNA, 22 bp, Homo sapiens
aggcctgagggaagcccacccg

SEQ ID NO: 1947923 - DNA, 15 bp, Homo sapiens
aggcgcccacctgcc

SEQ ID NO: 1947924 - DNA, 19 bp, Homo sapiens
aggcgcccacctgcccagt

SEQ ID NO: 1947925 - DNA, 21 bp, Homo sapiens
aggcgcccacctgcccagtta

SEQ ID NO: 1947926 - DNA, 14 bp, Homo sapiens
aggcgcgcaccgcc

SEQ ID NO: 1947927 - DNA, 19 bp, Homo sapiens
aggcgcgcaccgcccaacc

SEQ ID NO: 1947928 - DNA, 23 bp, Homo sapiens
aggcggaggggcttggagcagag

SEQ ID NO: 1947929 - DNA, 19 bp, Homo sapiens
aggctctgaatctctcaaa

SEQ ID NO: 1947930 - DNA, 19 bp, Homo sapiens
aggctgagacgcaaggatc

SEQ ID NO: 1947931 - DNA, 16 bp, Homo sapiens
aggctggataggagag

SEQ ID NO: 1947932 - DNA, 17 bp, Homo sapiens
aggctggataggagagg

SEQ ID NO: 1947933 - DNA, 15 bp, Homo sapiens
agggaaccagagcga

SEQ ID NO: 1947934 - DNA, 16 bp, Homo sapiens
agggaagcccacccgc

SEQ ID NO: 1947935 - DNA, 23 bp, Homo sapiens
agggaagcccacccgccccagag

SEQ ID NO: 1947936 - DNA, 14 bp, Homo sapiens
agggaatcagaaag

SEQ ID NO: 1947937 - DNA, 21 bp, Homo sapiens
agggactccagaagcagcagc

SEQ ID NO: 1947938 - DNA, 14 bp, Homo sapiens
agggagaaaggcaa

SEQ ID NO: 1947939 - DNA, 23 bp, Homo sapiens
agggatgctatctcgctagccat

SEQ ID NO: 1947940 - DNA, 15 bp, Homo sapiens
agggcagccctgcct

SEQ ID NO: 1947941 - DNA, 19 bp, Homo sapiens
agggcccgagcgcgtgcct

SEQ ID NO: 1947942 - DNA, 23 bp, Homo sapiens
agggcgctccggcagaggcaggg

SEQ ID NO: 1947943 - DNA, 19 bp, Homo sapiens
aggggcttggagcagagac

SEQ ID NO: 1947944 - DNA, 16 bp, Homo sapiens
aggtaaactgatgctt

SEQ ID NO: 1947945 - DNA, 19 bp, Homo sapiens
aggtagtaagcaccagctg

SEQ ID NO: 1947946 - DNA, 15 bp, Homo sapiens
aggtatgatgtgctg

SEQ ID NO: 1947947 - DNA, 20 bp, Homo sapiens
aggtcagtgttataaaatct

SEQ ID NO: 1947948 - DNA, 22 bp, Homo sapiens
aggtctgcacacataacacaca

SEQ ID NO: 1947949 - DNA, 18 bp, Homo sapiens
aggtcttgagtttcattt

SEQ ID NO: 1947950 - DNA, 21 bp, Homo sapiens
aggtgcggaccggagcggctg

SEQ ID NO: 1947951 - DNA, 15 bp, Homo sapiens
aggttaaattattga

SEQ ID NO: 1947952 - DNA, 17 bp, Homo sapiens
aggttggagtgcattca

SEQ ID NO: 1947953 - DNA, 16 bp, Homo sapiens
aggtttcactgttcat

SEQ ID NO: 1947954 - DNA, 17 bp, Homo sapiens
aggtttcactgttcatg

SEQ ID NO: 1947955 - DNA, 19 bp, Homo sapiens
aggtttcactgttcatgaa

SEQ ID NO: 1947956 - DNA, 22 bp, Homo sapiens
agtaagcaccagctgcctcttt

SEQ ID NO: 1947957 - DNA, 16 bp, Homo sapiens
agtaattaacatatca

SEQ ID NO: 1947958 - DNA, 14 bp, Homo sapiens
agtaattactttca

SEQ ID NO: 1947959 - DNA, 19 bp, Homo sapiens
agtaatttcaagaatgttt

SEQ ID NO: 1947960 - DNA, 15 bp, Homo sapiens
agtacaattctttgt

SEQ ID NO: 1947961 - DNA, 23 bp, Homo sapiens
agtacaattctttgttgcttaat

SEQ ID NO: 1947962 - DNA, 18 bp, Homo sapiens
agtaccatcccactgata

SEQ ID NO: 1947963 - DNA, 12 bp, Homo sapiens
agtagaaaatac

SEQ ID NO: 1947964 - DNA, 23 bp, Homo sapiens
agtagaaaatacattattagaat

SEQ ID NO: 1947965 - DNA, 17 bp, Homo sapiens
agtagagtcaggagaaa

SEQ ID NO: 1947966 - DNA, 15 bp, Homo sapiens
agtaggtctgcacac

SEQ ID NO: 1947967 - DNA, 14 bp, Homo sapiens
agtattgagacact

SEQ ID NO: 1947968 - DNA, 11 bp, Homo sapiens
agtcagaaatg

SEQ ID NO: 1947969 - DNA, 16 bp, Homo sapiens
agtcagaaatgattca

SEQ ID NO: 1947970 - DNA, 21 bp, Homo sapiens
agtcagtgtactctgagtcct

SEQ ID NO: 1947971 - DNA, 14 bp, Homo sapiens
agtcatttaagaat

SEQ ID NO: 1947972 - DNA, 16 bp, Homo sapiens
agtcatttaagaattt

SEQ ID NO: 1947973 - DNA, 14 bp, Homo sapiens
agtccactttcctc

SEQ ID NO: 1947974 - DNA, 15 bp, Homo sapiens
agtccactttcctct

SEQ ID NO: 1947975 - DNA, 16 bp, Homo sapiens
agtccactttcctctc

SEQ ID NO: 1947976 - DNA, 17 bp, Homo sapiens
agtccactttcctctct

SEQ ID NO: 1947977 - DNA, 22 bp, Homo sapiens
agtcccttcctgtcctgctcac

SEQ ID NO: 1947978 - DNA, 14 bp, Homo sapiens
agtcggctgggcag

SEQ ID NO: 1947979 - DNA, 18 bp, Homo sapiens
agtcggctgggcagggcc

SEQ ID NO: 1947980 - DNA, 19 bp, Homo sapiens
agtcggctgggcagggccg

SEQ ID NO: 1947981 - DNA, 22 bp, Homo sapiens
agtcgggggaaaaaattaaaat

SEQ ID NO: 1947982 - DNA, 16 bp, Homo sapiens
agtctcctgtatcatt

SEQ ID NO: 1947983 - DNA, 18 bp, Homo sapiens
agtctggataatttgtat

SEQ ID NO: 1947984 - DNA, 21 bp, Homo sapiens
agtgaaaacctctttcggaaa

SEQ ID NO: 1947985 - DNA, 20 bp, Homo sapiens
agtgatgtgatttatgcatt

SEQ ID NO: 1947986 - DNA, 21 bp, Homo sapiens
agtgatgtgatttatgcattt

SEQ ID NO: 1947987 - DNA, 23 bp, Homo sapiens
agtgccttgattttaattcaggt

SEQ ID NO: 1947988 - DNA, 19 bp, Homo sapiens
agtgctacagatgtacatt

SEQ ID NO: 1947989 - DNA, 21 bp, Homo sapiens
agtgcttgaggccaaatgagt

SEQ ID NO: 1947990 - DNA, 12 bp, Homo sapiens
agactgcccacc

SEQ ID NO: 1947991 - DNA, 13 bp, Homo sapiens
agactgcccaccc

SEQ ID NO: 1947992 - DNA, 14 bp, Homo sapiens
agactgcccaccct

SEQ ID NO: 1947993 - DNA, 18 bp, Homo sapiens
agactgcccaccctgggc

SEQ ID NO: 1947994 - DNA, 12 bp, Homo sapiens
agagaaatgaaa

SEQ ID NO: 1947995 - DNA, 14 bp, Homo sapiens
agagacggcagccc

SEQ ID NO: 1947996 - DNA, 16 bp, Homo sapiens
agagacggcagcccca

SEQ ID NO: 1947997 - DNA, 15 bp, Homo sapiens
agagactgcccaccc

SEQ ID NO: 1947998 - DNA, 19 bp, Homo sapiens
agagactgcccaccctggg

SEQ ID NO: 1947999 - DNA, 20 bp, Homo sapiens
agagactgcccaccctgggc

SEQ ID NO: 1948000 - DNA, 21 bp, Homo sapiens
agagactgcccaccctgggcc

SEQ ID NO: 1948001 - DNA, 16 bp, Homo sapiens
agagagcaatcttgct

SEQ ID NO: 1948002 - DNA, 22 bp, Homo sapiens
agagagcaatcttgctgtgaaa

SEQ ID NO: 1948003 - DNA, 16 bp, Homo sapiens
agagcaatcttgctgt

SEQ ID NO: 1948004 - DNA, 19 bp, Homo sapiens
agagcaatcttgctgtgaa

SEQ ID NO: 1948005 - DNA, 12 bp, Homo sapiens
agagccccggag

SEQ ID NO: 1948006 - DNA, 17 bp, Homo sapiens
agagccccggagcacca

SEQ ID NO: 1948007 - DNA, 15 bp, Homo sapiens
agagcgccacccgcc

SEQ ID NO: 1948008 - DNA, 13 bp, Homo sapiens
agagctatgcaca

SEQ ID NO: 1948009 - DNA, 14 bp, Homo sapiens
agagctatgcacac

SEQ ID NO: 1948010 - DNA, 18 bp, Homo sapiens
agagctgagtcggctggg

SEQ ID NO: 1948011 - DNA, 16 bp, Homo sapiens
agaggaataaaatgat

SEQ ID NO: 1948012 - DNA, 11 bp, Homo sapiens
agaggcagggc

SEQ ID NO: 1948013 - DNA, 12 bp, Homo sapiens
agaggcagggcc

SEQ ID NO: 1948014 - DNA, 14 bp, Homo sapiens
agaggcagggccct

SEQ ID NO: 1948015 - DNA, 18 bp, Homo sapiens
agagggctgagcccctcc

SEQ ID NO: 1948016 - DNA, 19 bp, Homo sapiens
agagggctgagcccctcct

SEQ ID NO: 1948017 - DNA, 15 bp, Homo sapiens
agagtatggattgaa

SEQ ID NO: 1948018 - DNA, 19 bp, Homo sapiens
agataatgatggaacagta

SEQ ID NO: 1948019 - DNA, 20 bp, Homo sapiens
agataccattttgaaatatt

SEQ ID NO: 1948020 - DNA, 16 bp, Homo sapiens
agatatcaatcagtaa

SEQ ID NO: 1948021 - DNA, 15 bp, Homo sapiens
agatcaactcatgtt

SEQ ID NO: 1948022 - DNA, 20 bp, Homo sapiens
agatcccaagtcaaacagtg

SEQ ID NO: 1948023 - DNA, 22 bp, Homo sapiens
agatccctcggtcagcaccgtg

SEQ ID NO: 1948024 - DNA, 18 bp, Homo sapiens
agatggatttgacacact

SEQ ID NO: 1948025 - DNA, 17 bp, Homo sapiens
agatgtaagaagctaaa

SEQ ID NO: 1948026 - DNA, 21 bp, Homo sapiens
agatgtttagtagctgataaa

SEQ ID NO: 1948027 - DNA, 19 bp, Homo sapiens
agattaacctaatgcagaa

SEQ ID NO: 1948028 - DNA, 22 bp, Homo sapiens
agattaacctaatgcagaattg

SEQ ID NO: 1948029 - DNA, 22 bp, Homo sapiens
agattaagttataccagcaaaa

SEQ ID NO: 1948030 - DNA, 23 bp, Homo sapiens
agattaagttataccagcaaaag

SEQ ID NO: 1948031 - DNA, 13 bp, Homo sapiens
agattcagcagtg

SEQ ID NO: 1948032 - DNA, 22 bp, Homo sapiens
agattcagcagtgtctgttctt

SEQ ID NO: 1948033 - DNA, 15 bp, Homo sapiens
agattcctacttaaa

SEQ ID NO: 1948034 - DNA, 17 bp, Homo sapiens
agattcctacttaaaca

SEQ ID NO: 1948035 - DNA, 18 bp, Homo sapiens
agattcctacttaaacaa

SEQ ID NO: 1948036 - DNA, 19 bp, Homo sapiens
agattcctacttaaacaaa

SEQ ID NO: 1948037 - DNA, 22 bp, Homo sapiens
agattttatggtactaatgaaa

SEQ ID NO: 1948038 - DNA, 16 bp, Homo sapiens
agatttttagattcct

SEQ ID NO: 1948039 - DNA, 16 bp, Homo sapiens
agcaaaacattttgta

SEQ ID NO: 1948040 - DNA, 13 bp, Homo sapiens
agcaaaaggatga

SEQ ID NO: 1948041 - DNA, 21 bp, Homo sapiens
agcaaatttctagatatgaga

SEQ ID NO: 1948042 - DNA, 23 bp, Homo sapiens
agcacacctcggccgaggcctgc

SEQ ID NO: 1948043 - DNA, 22 bp, Homo sapiens
agcaccacggggtcgggggagg

SEQ ID NO: 1948044 - DNA, 13 bp, Homo sapiens
agcaccagcctga

SEQ ID NO: 1948045 - DNA, 16 bp, Homo sapiens
agcaccagcctgagcc

SEQ ID NO: 1948046 - DNA, 13 bp, Homo sapiens
agcacccccagcc

SEQ ID NO: 1948047 - DNA, 15 bp, Homo sapiens
agcacccccagcctc

SEQ ID NO: 1948048 - DNA, 21 bp, Homo sapiens
agcacccccagcctcccccag

SEQ ID NO: 1948049 - DNA, 20 bp, Homo sapiens
agcaccgtggtgtgaggccc

SEQ ID NO: 1948050 - DNA, 15 bp, Homo sapiens
agcactcccagggcc

SEQ ID NO: 1948051 - DNA, 20 bp, Homo sapiens
agcagcagtttgtgatctgt

SEQ ID NO: 1948052 - DNA, 19 bp, Homo sapiens
agcagtaccatcccactga

SEQ ID NO: 1948053 - DNA, 12 bp, Homo sapiens
agcatactgatg

SEQ ID NO: 1948054 - DNA, 11 bp, Homo sapiens
agcatatataa

SEQ ID NO: 1948055 - DNA, 11 bp, Homo sapiens
agcatgctcag

SEQ ID NO: 1948056 - DNA, 17 bp, Homo sapiens
agcatgtaatattaaat

SEQ ID NO: 1948057 - DNA, 20 bp, Homo sapiens
agcattcaaatgaagattca

SEQ ID NO: 1948058 - DNA, 14 bp, Homo sapiens
agccagttcttaag

SEQ ID NO: 1948059 - DNA, 18 bp, Homo sapiens
agcccacccgccccagag

SEQ ID NO: 1948060 - DNA, 20 bp, Homo sapiens
agcccacccgccccagagac

SEQ ID NO: 1948061 - DNA, 23 bp, Homo sapiens
agcccacccgccccagagactgc

SEQ ID NO: 1948062 - DNA, 17 bp, Homo sapiens
agcccagaacgggcctc

SEQ ID NO: 1948063 - DNA, 19 bp, Homo sapiens
agcccagaacgggcctccc

SEQ ID NO: 1948064 - DNA, 20 bp, Homo sapiens
agcccagaacgggcctcccc

SEQ ID NO: 1948065 - DNA, 22 bp, Homo sapiens
agcccagcctatctctcttctg

SEQ ID NO: 1948066 - DNA, 19 bp, Homo sapiens
agccccatccttcccgcag

SEQ ID NO: 1948067 - DNA, 14 bp, Homo sapiens
agccccggagcacc

SEQ ID NO: 1948068 - DNA, 17 bp, Homo sapiens
agcccctcctctcctcg

SEQ ID NO: 1948069 - DNA, 18 bp, Homo sapiens
agcccctcctctcctcgt

SEQ ID NO: 1948070 - DNA, 12 bp, Homo sapiens
agcccctgctgg

SEQ ID NO: 1948071 - DNA, 16 bp, Homo sapiens
agcccctgctggacca

SEQ ID NO: 1948072 - DNA, 14 bp, Homo sapiens
agcccggccaagga

SEQ ID NO: 1948073 - DNA, 15 bp, Homo sapiens
agccctctttctctc

SEQ ID NO: 1948074 - DNA, 22 bp, Homo sapiens
agccctctttctctctgtgtgg

SEQ ID NO: 1948075 - DNA, 24 bp, Homo sapiens
agccctctttctctctgtgtggca

SEQ ID NO: 1948076 - DNA, 20 bp, Homo sapiens
agccgcgctctgcccctccg

SEQ ID NO: 1948077 - DNA, 18 bp, Homo sapiens
agcctatctctcttctgc

SEQ ID NO: 1948078 - DNA, 11 bp, Homo sapiens
agcctccccca

SEQ ID NO: 1948079 - DNA, 15 bp, Homo sapiens
agcctcccccaggct

SEQ ID NO: 1948080 - DNA, 21 bp, Homo sapiens
agcctcccccaggctgcgcct

SEQ ID NO: 1948081 - DNA, 23 bp, Homo sapiens
agcctgaaagtaatttcaagaat

SEQ ID NO: 1948082 - DNA, 13 bp, Homo sapiens
agcctgagccaca

SEQ ID NO: 1948083 - DNA, 16 bp, Homo sapiens
agcctgagccacagtg

SEQ ID NO: 1948084 - DNA, 19 bp, Homo sapiens
agcctgagccacagtgggg

SEQ ID NO: 1948085 - DNA, 17 bp, Homo sapiens
agcctgagctccaccct

SEQ ID NO: 1948086 - DNA, 17 bp, Homo sapiens
agcctgatgatggaagg

SEQ ID NO: 1948087 - DNA, 13 bp, Homo sapiens
agcctgtctctcc

SEQ ID NO: 1948088 - DNA, 14 bp, Homo sapiens
agcctgtctctccc

SEQ ID NO: 1948089 - DNA, 12 bp, Homo sapiens
agcgcctcccgc

SEQ ID NO: 1948090 - DNA, 15 bp, Homo sapiens
agcgcctcccgccgc

SEQ ID NO: 1948091 - DNA, 17 bp, Homo sapiens
agcgcctcccgccgcct

SEQ ID NO: 1948092 - DNA, 18 bp, Homo sapiens
agcgcctcccgccgcctc

SEQ ID NO: 1948093 - DNA, 15 bp, Homo sapiens
agcggcccggcccac

SEQ ID NO: 1948094 - DNA, 17 bp, Homo sapiens
agcggcccggcccacgc

SEQ ID NO: 1948095 - DNA, 20 bp, Homo sapiens
agcggctgaggacggggcag

SEQ ID NO: 1948096 - DNA, 19 bp, Homo sapiens
attagacaatgtggaatta

SEQ ID NO: 1948097 - DNA, 20 bp, Homo sapiens
attagattttaaaacttcat

SEQ ID NO: 1948098 - DNA, 17 bp, Homo sapiens
attagggctctaatttc

SEQ ID NO: 1948099 - DNA, 14 bp, Homo sapiens
attagtagaaaata

SEQ ID NO: 1948100 - DNA, 19 bp, Homo sapiens
attagtagaaaatacatta

SEQ ID NO: 1948101 - DNA, 23 bp, Homo sapiens
attagttggcagagaaaatgctg

SEQ ID NO: 1948102 - DNA, 15 bp, Homo sapiens
attatagcatgtaat

SEQ ID NO: 1948103 - DNA, 23 bp, Homo sapiens
attatattcccaaatctcaaaag

SEQ ID NO: 1948104 - DNA, 20 bp, Homo sapiens
attatccttcacaatttcaa

SEQ ID NO: 1948105 - DNA, 17 bp, Homo sapiens
attatgtttgaaaatag

SEQ ID NO: 1948106 - DNA, 15 bp, Homo sapiens
attattaaaaattat

SEQ ID NO: 1948107 - DNA, 18 bp, Homo sapiens
attattaaaaattataga

SEQ ID NO: 1948108 - DNA, 22 bp, Homo sapiens
attattagaatataaaaaatgt

SEQ ID NO: 1948109 - DNA, 16 bp, Homo sapiens
attattgatacaacag

SEQ ID NO: 1948110 - DNA, 14 bp, Homo sapiens
gctcaacctctcag

SEQ ID NO: 1948111 - DNA, 21 bp, Homo sapiens
gctcaacctctcagatccctc

SEQ ID NO: 1948112 - DNA, 13 bp, Homo sapiens
gctcagaggagag

SEQ ID NO: 1948113 - DNA, 14 bp, Homo sapiens
gctcagaggagagg

SEQ ID NO: 1948114 - DNA, 21 bp, Homo sapiens
gctcagtaacacagtgcagtg

SEQ ID NO: 1948115 - DNA, 11 bp, Homo sapiens
gctcagtattg

SEQ ID NO: 1948116 - DNA, 22 bp, Homo sapiens
gctcagtattgagacactgtca

SEQ ID NO: 1948117 - DNA, 23 bp, Homo sapiens
gctcagtattgagacactgtcaa

SEQ ID NO: 1948118 - DNA, 15 bp, Homo sapiens
gctcatcagaaacaa

SEQ ID NO: 1948119 - DNA, 22 bp, Homo sapiens
gctcatcagaaacaatttctgt

SEQ ID NO: 1948120 - DNA, 17 bp, Homo sapiens
gctccaccctcccctct

SEQ ID NO: 1948121 - DNA, 13 bp, Homo sapiens
gctccactctgaa

SEQ ID NO: 1948122 - DNA, 21 bp, Homo sapiens
gctccactctgaagtcccttc

SEQ ID NO: 1948123 - DNA, 23 bp, Homo sapiens
gctccactctgaagtcccttcct

SEQ ID NO: 1948124 - DNA, 17 bp, Homo sapiens
gctcctccagtacaata

SEQ ID NO: 1948125 - DNA, 16 bp, Homo sapiens
gctcctctgcagcctg

SEQ ID NO: 1948126 - DNA, 17 bp, Homo sapiens
gctcgggaaggcctgag

SEQ ID NO: 1948127 - DNA, 18 bp, Homo sapiens
gctcgggaaggcctgagg

SEQ ID NO: 1948128 - DNA, 14 bp, Homo sapiens
gctcgggactgtct

SEQ ID NO: 1948129 - DNA, 14 bp, Homo sapiens
gctcgtgcatgtaa

SEQ ID NO: 1948130 - DNA, 23 bp, Homo sapiens
gctctgaatctctcaaaatgtgc

SEQ ID NO: 1948131 - DNA, 23 bp, Homo sapiens
gctctgcccctccgtccccaggg

SEQ ID NO: 1948132 - DNA, 17 bp, Homo sapiens
gctgaaattatgtcaaa

SEQ ID NO: 1948133 - DNA, 23 bp, Homo sapiens
gctgagacgcaaggatcacttga

SEQ ID NO: 1948134 - DNA, 19 bp, Homo sapiens
gctgagatgggaggatcac

SEQ ID NO: 1948135 - DNA, 14 bp, Homo sapiens
gctgagcacatctc

SEQ ID NO: 1948136 - DNA, 19 bp, Homo sapiens
gctgaggacggggcagagc

SEQ ID NO: 1948137 - DNA, 18 bp, Homo sapiens
gctgagtcggctgggcag

SEQ ID NO: 1948138 - DNA, 23 bp, Homo sapiens
gctgagtcggctgggcagggccg

SEQ ID NO: 1948139 - DNA, 19 bp, Homo sapiens
gctgcctctttgctgcttt

SEQ ID NO: 1948140 - DNA, 20 bp, Homo sapiens
gctgcctctttgctgctttg

SEQ ID NO: 1948141 - DNA, 23 bp, Homo sapiens
gctgcctggcgggcagcccctgc

SEQ ID NO: 1948142 - DNA, 15 bp, Homo sapiens
gctgcgcctgcccgc

SEQ ID NO: 1948143 - DNA, 16 bp, Homo sapiens
gctgcgcctgcccgcc

SEQ ID NO: 1948144 - DNA, 17 bp, Homo sapiens
gctgcgcctgcccgccc

SEQ ID NO: 1948145 - DNA, 17 bp, Homo sapiens
gctgcgctcccacctcg

SEQ ID NO: 1948146 - DNA, 23 bp, Homo sapiens
gctgcgctcccacctcggacacc

SEQ ID NO: 1948147 - DNA, 14 bp, Homo sapiens
gctgctatgctgtt

SEQ ID NO: 1948148 - DNA, 19 bp, Homo sapiens
gctgctcgggaaggcctga

SEQ ID NO: 1948149 - DNA, 22 bp, Homo sapiens
gctgctgagcacatctcttcat

SEQ ID NO: 1948150 - DNA, 23 bp, Homo sapiens
gctgctgagcacatctcttcatg

SEQ ID NO: 1948151 - DNA, 15 bp, Homo sapiens
gctggaccaaggtgc

SEQ ID NO: 1948152 - DNA, 14 bp, Homo sapiens
gctggataggagag

SEQ ID NO: 1948153 - DNA, 13 bp, Homo sapiens
gctggcagcgcct

SEQ ID NO: 1948154 - DNA, 14 bp, Homo sapiens
gctggcagcgcctc

SEQ ID NO: 1948155 - DNA, 16 bp, Homo sapiens
gctggcagcgcctccc

SEQ ID NO: 1948156 - DNA, 23 bp, Homo sapiens
gctggcagcgcctcccgccgcct

SEQ ID NO: 1948157 - DNA, 13 bp, Homo sapiens
gctggccctgccc

SEQ ID NO: 1948158 - DNA, 15 bp, Homo sapiens
gctggccctgccctc

SEQ ID NO: 1948159 - DNA, 18 bp, Homo sapiens
gctggccctgccctcccc

SEQ ID NO: 1948160 - DNA, 20 bp, Homo sapiens
gctggccctgccctccccca

SEQ ID NO: 1948161 - DNA, 21 bp, Homo sapiens
gctggccctgccctcccccac

SEQ ID NO: 1948162 - DNA, 21 bp, Homo sapiens
gctgggcagggccgcagggcg

SEQ ID NO: 1948163 - DNA, 12 bp, Homo sapiens
gctgggtcgccc

SEQ ID NO: 1948164 - DNA, 19 bp, Homo sapiens
gctgtaaataaaaatagct

SEQ ID NO: 1948165 - DNA, 14 bp, Homo sapiens
gctgtgatgtcaca

SEQ ID NO: 1948166 - DNA, 19 bp, Homo sapiens
gctgtggcatcaggaaagg

SEQ ID NO: 1948167 - DNA, 14 bp, Homo sapiens
gctgttatctgtct

SEQ ID NO: 1948168 - DNA, 15 bp, Homo sapiens
gctgttgattctttc

SEQ ID NO: 1948169 - DNA, 13 bp, Homo sapiens
gcttcctctcttg

SEQ ID NO: 1948170 - DNA, 23 bp, Homo sapiens
gcttggaaaatgttctgacagca

SEQ ID NO: 1948171 - DNA, 16 bp, Homo sapiens
gcttggagcagagacg

SEQ ID NO: 1948172 - DNA, 21 bp, Homo sapiens
gcttggagcagagacggcagc

SEQ ID NO: 1948173 - DNA, 23 bp, Homo sapiens
gcttggagcagagacggcagccc

SEQ ID NO: 1948174 - DNA, 14 bp, Homo sapiens
gcttttctcatggt

SEQ ID NO: 1948175 - DNA, 13 bp, Homo sapiens
ggaaaaaattaaa

SEQ ID NO: 1948176 - DNA, 13 bp, Homo sapiens
ggaaaaaggcttc

SEQ ID NO: 1948177 - DNA, 23 bp, Homo sapiens
ggaaccagagcgatgtgttcttt

SEQ ID NO: 1948178 - DNA, 16 bp, Homo sapiens
ggaagcccacccgccc

SEQ ID NO: 1948179 - DNA, 17 bp, Homo sapiens
ggaagcccacccgcccc

SEQ ID NO: 1948180 - DNA, 21 bp, Homo sapiens
ggaagcccacccgccccagag

SEQ ID NO: 1948181 - DNA, 23 bp, Homo sapiens
ggaagcccacccgccccagagac

SEQ ID NO: 1948182 - DNA, 13 bp, Homo sapiens
ggaaggcctgagg

SEQ ID NO: 1948183 - DNA, 16 bp, Homo sapiens
ggaaggcctgagggaa

SEQ ID NO: 1948184 - DNA, 22 bp, Homo sapiens
ggaaggcctgagggaagcccac

SEQ ID NO: 1948185 - DNA, 12 bp, Homo sapiens
ggaatgctcaat

SEQ ID NO: 1948186 - DNA, 21 bp, Homo sapiens
ggaattacataacaggcattg

SEQ ID NO: 1948187 - DNA, 15 bp, Homo sapiens
ggacagcggcccggc

SEQ ID NO: 1948188 - DNA, 23 bp, Homo sapiens
ggacgggacagcggcccggccca

SEQ ID NO: 1948189 - DNA, 18 bp, Homo sapiens
ggagagcgccacccgccc

SEQ ID NO: 1948190 - DNA, 14 bp, Homo sapiens
ggagatgaggctgg

SEQ ID NO: 1948191 - DNA, 12 bp, Homo sapiens
ggagcaccccca

SEQ ID NO: 1948192 - DNA, 13 bp, Homo sapiens
ggagcacccccag

SEQ ID NO: 1948193 - DNA, 19 bp, Homo sapiens
ggagcacccccagcctccc

SEQ ID NO: 1948194 - DNA, 16 bp, Homo sapiens
ggagcagagacggcag

SEQ ID NO: 1948195 - DNA, 19 bp, Homo sapiens
ggagcagagacggcagccc

SEQ ID NO: 1948196 - DNA, 21 bp, Homo sapiens
ggagcgggggctaactggccc

SEQ ID NO: 1948197 - DNA, 15 bp, Homo sapiens
ggaggagcaccccca

SEQ ID NO: 1948198 - DNA, 19 bp, Homo sapiens
ggaggagcacccccagcct

SEQ ID NO: 1948199 - DNA, 20 bp, Homo sapiens
ggaggagcacccccagcctc

SEQ ID NO: 1948200 - DNA, 19 bp, Homo sapiens
ggaggcgcccacctgccca

SEQ ID NO: 1948201 - DNA, 13 bp, Homo sapiens
ggaggggcttgga

SEQ ID NO: 1948202 - DNA, 15 bp, Homo sapiens
ggagtagagtcagga

SEQ ID NO: 1948203 - DNA, 18 bp, Homo sapiens
ggagtccactttcctctc

SEQ ID NO: 1948204 - DNA, 17 bp, Homo sapiens
ggatcacttgagcccag

SEQ ID NO: 1948205 - DNA, 12 bp, Homo sapiens
ggatgtcccttc

SEQ ID NO: 1948206 - DNA, 15 bp, Homo sapiens
ggattagtagaaaat

SEQ ID NO: 1948207 - DNA, 20 bp, Homo sapiens
ggattttcaagttattcaga

SEQ ID NO: 1948208 - DNA, 19 bp, Homo sapiens
ggattttttttttcaggtt

SEQ ID NO: 1948209 - DNA, 11 bp, Homo sapiens
ggcaaacattt

SEQ ID NO: 1948210 - DNA, 12 bp, Homo sapiens
ggcaaacattta

SEQ ID NO: 1948211 - DNA, 16 bp, Homo sapiens
ggcaccgcccacccac

SEQ ID NO: 1948212 - DNA, 22 bp, Homo sapiens
ggcacgggagagcgccacccgc

SEQ ID NO: 1948213 - DNA, 16 bp, Homo sapiens
ggcagagacctcctga

SEQ ID NO: 1948214 - DNA, 23 bp, Homo sapiens
ggcagagctgagtcggctgggca

SEQ ID NO: 1948215 - DNA, 13 bp, Homo sapiens
ggcagaggcaggg

SEQ ID NO: 1948216 - DNA, 15 bp, Homo sapiens
ggcagaggcagggcc

SEQ ID NO: 1948217 - DNA, 17 bp, Homo sapiens
ggcagaggcagggccct

SEQ ID NO: 1948218 - DNA, 11 bp, Homo sapiens
ggcagccccat

SEQ ID NO: 1948219 - DNA, 13 bp, Homo sapiens
ggcagccccatcc

SEQ ID NO: 1948220 - DNA, 19 bp, Homo sapiens
ggcagccccatccttcccg

SEQ ID NO: 1948221 - DNA, 22 bp, Homo sapiens
ggcagcgcctcccgccgcctcg

SEQ ID NO: 1948222 - DNA, 15 bp, Homo sapiens
ggcatcaggaaagga

SEQ ID NO: 1948223 - DNA, 22 bp, Homo sapiens
gccccagctggctgggtcgccc

SEQ ID NO: 1948224 - DNA, 16 bp, Homo sapiens
gccccaggcggagggg

SEQ ID NO: 1948225 - DNA, 19 bp, Homo sapiens
gccccaggcggaggggctt

SEQ ID NO: 1948226 - DNA, 22 bp, Homo sapiens
gccccaggcggaggggcttgga

SEQ ID NO: 1948227 - DNA, 15 bp, Homo sapiens
gccccatccttcccg

SEQ ID NO: 1948228 - DNA, 22 bp, Homo sapiens
gccccatccttcccgcagcacc

SEQ ID NO: 1948229 - DNA, 19 bp, Homo sapiens
gcccccgccctcgctccgg

SEQ ID NO: 1948230 - DNA, 20 bp, Homo sapiens
gcccccgccctcgctccggg

SEQ ID NO: 1948231 - DNA, 20 bp, Homo sapiens
gcccccggaggcgcccacct

SEQ ID NO: 1948232 - DNA, 13 bp, Homo sapiens
gccccctcccccg

SEQ ID NO: 1948233 - DNA, 15 bp, Homo sapiens
gccccctcccccgca

SEQ ID NO: 1948234 - DNA, 16 bp, Homo sapiens
gccccctcccccgcag

SEQ ID NO: 1948235 - DNA, 20 bp, Homo sapiens
gccccctcccccgcagacag

SEQ ID NO: 1948236 - DNA, 21 bp, Homo sapiens
gccccgcgcgtgcccccagcg

SEQ ID NO: 1948237 - DNA, 17 bp, Homo sapiens
gcccctccgtccccagg

SEQ ID NO: 1948238 - DNA, 13 bp, Homo sapiens
gcccctcctctcc

SEQ ID NO: 1948239 - DNA, 15 bp, Homo sapiens
gcccctcctctcctc

SEQ ID NO: 1948240 - DNA, 17 bp, Homo sapiens
gcccctcctctcctcgt

SEQ ID NO: 1948241 - DNA, 19 bp, Homo sapiens
gcccctcctctcctcgtcc

SEQ ID NO: 1948242 - DNA, 23 bp, Homo sapiens
gcccctcctctcctcgtccggcc

SEQ ID NO: 1948243 - DNA, 14 bp, Homo sapiens
gccccttccccatg

SEQ ID NO: 1948244 - DNA, 17 bp, Homo sapiens
gccccttgaccccacac

SEQ ID NO: 1948245 - DNA, 19 bp, Homo sapiens
gccccttgaccccacacgc

SEQ ID NO: 1948246 - DNA, 20 bp, Homo sapiens
gcccgagcgcgtgccttccc

SEQ ID NO: 1948247 - DNA, 21 bp, Homo sapiens
gcccgagcgcgtgccttcccc

SEQ ID NO: 1948248 - DNA, 23 bp, Homo sapiens
gcccgccaccttgtacagaacca

SEQ ID NO: 1948249 - DNA, 12 bp, Homo sapiens
gcccgcccccgc

SEQ ID NO: 1948250 - DNA, 16 bp, Homo sapiens
gcccgccctcctctgc

SEQ ID NO: 1948251 - DNA, 19 bp, Homo sapiens
gcccgccctcctctgcccc

SEQ ID NO: 1948252 - DNA, 20 bp, Homo sapiens
gcccgccggttggccggctg

SEQ ID NO: 1948253 - DNA, 19 bp, Homo sapiens
gcccgctcaacctctcaga

SEQ ID NO: 1948254 - DNA, 20 bp, Homo sapiens
gcccggcccacgcagagccc

SEQ ID NO: 1948255 - DNA, 21 bp, Homo sapiens
gcccgtgcgcagccgcgctct

SEQ ID NO: 1948256 - DNA, 24 bp, Homo sapiens
gcccgtgcgcagccgcgctctgcc

SEQ ID NO: 1948257 - DNA, 13 bp, Homo sapiens
gccctcccccacg

SEQ ID NO: 1948258 - DNA, 11 bp, Homo sapiens
gccctcctctg

SEQ ID NO: 1948259 - DNA, 12 bp, Homo sapiens
gccctcctctgc

SEQ ID NO: 1948260 - DNA, 15 bp, Homo sapiens
gccctcctctgcccc

SEQ ID NO: 1948261 - DNA, 22 bp, Homo sapiens
gccctcctctgccccctccccc

SEQ ID NO: 1948262 - DNA, 23 bp, Homo sapiens
gccctcctctgccccctcccccg

SEQ ID NO: 1948263 - DNA, 21 bp, Homo sapiens
gccctgacatgctaacctctc

SEQ ID NO: 1948264 - DNA, 10 bp, Homo sapiens
gccctgccct

SEQ ID NO: 1948265 - DNA, 16 bp, Homo sapiens
gccctgccctccccca

SEQ ID NO: 1948266 - DNA, 20 bp, Homo sapiens
gccctggggtctctgagcag

SEQ ID NO: 1948267 - DNA, 21 bp, Homo sapiens
gccctgtgggagtccactttc

SEQ ID NO: 1948268 - DNA, 13 bp, Homo sapiens
gccgcagggcgct

SEQ ID NO: 1948269 - DNA, 18 bp, Homo sapiens
gccgcagggcgctccggc

SEQ ID NO: 1948270 - DNA, 12 bp, Homo sapiens
gccgcctcctcc

SEQ ID NO: 1948271 - DNA, 20 bp, Homo sapiens
gccgcctcgggccgcctcct

SEQ ID NO: 1948272 - DNA, 16 bp, Homo sapiens
gccggggctggccctg

SEQ ID NO: 1948273 - DNA, 14 bp, Homo sapiens
gccggtccaccccg

SEQ ID NO: 1948274 - DNA, 19 bp, Homo sapiens
gccgtctttggttcctcat

SEQ ID NO: 1948275 - DNA, 16 bp, Homo sapiens
gcctcccccaggctgc

SEQ ID NO: 1948276 - DNA, 19 bp, Homo sapiens
gcctcccccaggctgcgcc

SEQ ID NO: 1948277 - DNA, 18 bp, Homo sapiens
gcctccccgggggtcccc

SEQ ID NO: 1948278 - DNA, 13 bp, Homo sapiens
gcctcccgccgcc

SEQ ID NO: 1948279 - DNA, 13 bp, Homo sapiens
gcctcctccagac

SEQ ID NO: 1948280 - DNA, 14 bp, Homo sapiens
gcctctttgctgct

SEQ ID NO: 1948281 - DNA, 17 bp, Homo sapiens
gcctctttgctgctttg

SEQ ID NO: 1948282 - DNA, 12 bp, Homo sapiens
gcctgagccaca

SEQ ID NO: 1948283 - DNA, 14 bp, Homo sapiens
gcctgagccacagt

SEQ ID NO: 1948284 - DNA, 17 bp, Homo sapiens
gcctgagccacagtggg

SEQ ID NO: 1948285 - DNA, 15 bp, Homo sapiens
gcctgagctccaccc

SEQ ID NO: 1948286 - DNA, 20 bp, Homo sapiens
gcctgagctccaccctcccc

SEQ ID NO: 1948287 - DNA, 19 bp, Homo sapiens
gcctgagggaagcccaccc

SEQ ID NO: 1948288 - DNA, 13 bp, Homo sapiens
gcctgcagcccag

SEQ ID NO: 1948289 - DNA, 15 bp, Homo sapiens
gcctgcccgcccgcc

SEQ ID NO: 1948290 - DNA, 16 bp, Homo sapiens
gcctgcccgcccgccg

SEQ ID NO: 1948291 - DNA, 15 bp, Homo sapiens
gcctgcgctcctctg

SEQ ID NO: 1948292 - DNA, 23 bp, Homo sapiens
gcctgcgctcctctgcagcctga

SEQ ID NO: 1948293 - DNA, 14 bp, Homo sapiens
gcctggcgggcagc

SEQ ID NO: 1948294 - DNA, 23 bp, Homo sapiens
gcctggcgggcagcccctgctgg

SEQ ID NO: 1948295 - DNA, 22 bp, Homo sapiens
gccttccccgtgcggcccgtgc

SEQ ID NO: 1948296 - DNA, 13 bp, Homo sapiens
gccttctcccctc

SEQ ID NO: 1948297 - DNA, 14 bp, Homo sapiens
gccttctcccctcc

SEQ ID NO: 1948298 - DNA, 17 bp, Homo sapiens
gccttgattttaattca

SEQ ID NO: 1948299 - DNA, 14 bp, Homo sapiens
gcgcaccgcccaac

SEQ ID NO: 1948300 - DNA, 17 bp, Homo sapiens
gcgcaccgcccaacccc

SEQ ID NO: 1948301 - DNA, 23 bp, Homo sapiens
gcgcaccgcccaacccccacctc

SEQ ID NO: 1948302 - DNA, 13 bp, Homo sapiens
gcgcagtccccag

SEQ ID NO: 1948303 - DNA, 13 bp, Homo sapiens
gcgccacccgccc

SEQ ID NO: 1948304 - DNA, 14 bp, Homo sapiens
gcgccacccgcccg

SEQ ID NO: 1948305 - DNA, 21 bp, Homo sapiens
gcgcctcccgccgcctcgggc

SEQ ID NO: 1948306 - DNA, 14 bp, Homo sapiens
gcgcctgcccgccc

SEQ ID NO: 1948307 - DNA, 17 bp, Homo sapiens
gcgcctgcgctcctctg

SEQ ID NO: 1948308 - DNA, 17 bp, Homo sapiens
gcgcgcaccgcccaacc

SEQ ID NO: 1948309 - DNA, 15 bp, Homo sapiens
gcgctccggcagagg

SEQ ID NO: 1948310 - DNA, 23 bp, Homo sapiens
gcgctccggcagaggcagggccc

SEQ ID NO: 1948311 - DNA, 19 bp, Homo sapiens
gcgctcctctgcagcctga

SEQ ID NO: 1948312 - DNA, 18 bp, Homo sapiens
gcgctctgcccctccgtc

SEQ ID NO: 1948313 - DNA, 16 bp, Homo sapiens
gcggaggggcttggag

SEQ ID NO: 1948314 - DNA, 16 bp, Homo sapiens
gcggcaccgcccaccc

SEQ ID NO: 1948315 - DNA, 21 bp, Homo sapiens
gcggcccggcccacgcagagc

SEQ ID NO: 1948316 - DNA, 15 bp, Homo sapiens
gcggcccgtgcgcag

SEQ ID NO: 1948317 - DNA, 14 bp, Homo sapiens
gcggctgaggacgg

SEQ ID NO: 1948318 - DNA, 20 bp, Homo sapiens
gcggctgaggacggggcaga

SEQ ID NO: 1948319 - DNA, 13 bp, Homo sapiens
gcgggcagcccct

SEQ ID NO: 1948320 - DNA, 14 bp, Homo sapiens
gcgggcagcccctg

SEQ ID NO: 1948321 - DNA, 16 bp, Homo sapiens
gcgggcagcccctgct

SEQ ID NO: 1948322 - DNA, 21 bp, Homo sapiens
gcgggcagcccctgctggacc

SEQ ID NO: 1948323 - DNA, 19 bp, Homo sapiens
gcgtaaatggttttcaaca

SEQ ID NO: 1948324 - DNA, 20 bp, Homo sapiens
gcgtgaccggcccgccacct

SEQ ID NO: 1948325 - DNA, 22 bp, Homo sapiens
gcgtgccttccccgtgcggccc

SEQ ID NO: 1948326 - DNA, 15 bp, Homo sapiens
gcgtgtggccctgtg

SEQ ID NO: 1948327 - DNA, 14 bp, Homo sapiens
gctaacctctctga

SEQ ID NO: 1948328 - DNA, 16 bp, Homo sapiens
gctaactggccccagg

SEQ ID NO: 1948329 - DNA, 17 bp, Homo sapiens
gctaactggccccaggc

SEQ ID NO: 1948330 - DNA, 23 bp, Homo sapiens
gctaagataattaaatgaaatac

SEQ ID NO: 1948331 - DNA, 12 bp, Homo sapiens
gctaatttaaag

SEQ ID NO: 1948332 - DNA, 12 bp, Homo sapiens
gctagctgcttt

SEQ ID NO: 1948333 - DNA, 13 bp, Homo sapiens
gctagctgctttt

SEQ ID NO: 1948334 - DNA, 17 bp, Homo sapiens
gctagtttaaaattatt

SEQ ID NO: 1948335 - DNA, 23 bp, Homo sapiens
gctatgttttggagagagcaatc

SEQ ID NO: 1948336 - DNA, 19 bp, Homo sapiens
gacatgctaacctctctga

SEQ ID NO: 1948337 - DNA, 18 bp, Homo sapiens
gacattttgtagctagtt

SEQ ID NO: 1948338 - DNA, 16 bp, Homo sapiens
gaccggcccgccacct

SEQ ID NO: 1948339 - DNA, 20 bp, Homo sapiens
gacctccctgtctctacaaa

SEQ ID NO: 1948340 - DNA, 12 bp, Homo sapiens
gacgggacagcg

SEQ ID NO: 1948341 - DNA, 21 bp, Homo sapiens
gacgggacagcggcccggccc

SEQ ID NO: 1948342 - DNA, 22 bp, Homo sapiens
gacgggacagcggcccggccca

SEQ ID NO: 1948343 - DNA, 22 bp, Homo sapiens
gacggggcagagctgagtcggc

SEQ ID NO: 1948344 - DNA, 18 bp, Homo sapiens
gactccagaagcagcagc

SEQ ID NO: 1948345 - DNA, 20 bp, Homo sapiens
gactcctcaattccagggaa

SEQ ID NO: 1948346 - DNA, 16 bp, Homo sapiens
gactcgagagggctga

SEQ ID NO: 1948347 - DNA, 18 bp, Homo sapiens
gactcgagagggctgagc

SEQ ID NO: 1948348 - DNA, 19 bp, Homo sapiens
gactcgagagggctgagcc

SEQ ID NO: 1948349 - DNA, 24 bp, Homo sapiens
gactcgagagggctgagcccctcc

SEQ ID NO: 1948350 - DNA, 21 bp, Homo sapiens
gactctaaaactatcagcagc

SEQ ID NO: 1948351 - DNA, 12 bp, Homo sapiens
gactgcccaccc

SEQ ID NO: 1948352 - DNA, 15 bp, Homo sapiens
gactgcccaccctgg

SEQ ID NO: 1948353 - DNA, 18 bp, Homo sapiens
gactgcccaccctgggcc

SEQ ID NO: 1948354 - DNA, 17 bp, Homo sapiens
gactgctatcagtctct

SEQ ID NO: 1948355 - DNA, 17 bp, Homo sapiens
gactgtcttcaaccctg

SEQ ID NO: 1948356 - DNA, 20 bp, Homo sapiens
gactgtcttcaaccctgccc

SEQ ID NO: 1948357 - DNA, 22 bp, Homo sapiens
gactgtcttcaaccctgccctg

SEQ ID NO: 1948358 - DNA, 13 bp, Homo sapiens
gacttcccagctg

SEQ ID NO: 1948359 - DNA, 15 bp, Homo sapiens
gacttcccagctggc

SEQ ID NO: 1948360 - DNA, 21 bp, Homo sapiens
gacttctaaatcataatcatc

SEQ ID NO: 1948361 - DNA, 23 bp, Homo sapiens
gacttctctgtcctctgctttgc

SEQ ID NO: 1948362 - DNA, 18 bp, Homo sapiens
gacttctttactaacact

SEQ ID NO: 1948363 - DNA, 24 bp, Homo sapiens
gagaaaaaaaaagccactaaggtc

SEQ ID NO: 1948364 - DNA, 13 bp, Homo sapiens
gagaaaaagccct

SEQ ID NO: 1948365 - DNA, 15 bp, Homo sapiens
gagacaacacacaca

SEQ ID NO: 1948366 - DNA, 14 bp, Homo sapiens
gagacactgtcaag

SEQ ID NO: 1948367 - DNA, 13 bp, Homo sapiens
gagacggcagccc

SEQ ID NO: 1948368 - DNA, 14 bp, Homo sapiens
gagactgcccaccc

SEQ ID NO: 1948369 - DNA, 15 bp, Homo sapiens
gagagaacagggatg

SEQ ID NO: 1948370 - DNA, 19 bp, Homo sapiens
gagagagcaatcttgctgt

SEQ ID NO: 1948371 - DNA, 14 bp, Homo sapiens
gagagcgccacccg

SEQ ID NO: 1948372 - DNA, 18 bp, Homo sapiens
gagagcgccacccgcccg

SEQ ID NO: 1948373 - DNA, 11 bp, Homo sapiens
gagagggctga

SEQ ID NO: 1948374 - DNA, 13 bp, Homo sapiens
gagagggctgagc

SEQ ID NO: 1948375 - DNA, 14 bp, Homo sapiens
gagagggctgagcc

SEQ ID NO: 1948376 - DNA, 14 bp, Homo sapiens
gagatgaggctgga

SEQ ID NO: 1948377 - DNA, 15 bp, Homo sapiens
gagcaccacggggtc

SEQ ID NO: 1948378 - DNA, 18 bp, Homo sapiens
gagcacccccagcctccc

SEQ ID NO: 1948379 - DNA, 20 bp, Homo sapiens
gagcacccccagcctccccc

SEQ ID NO: 1948380 - DNA, 21 bp, Homo sapiens
gagcacccccagcctccccca

SEQ ID NO: 1948381 - DNA, 18 bp, Homo sapiens
gagcagagacggcagccc

SEQ ID NO: 1948382 - DNA, 19 bp, Homo sapiens
gagcagagacggcagcccc

SEQ ID NO: 1948383 - DNA, 15 bp, Homo sapiens
gagcagctagctgct

SEQ ID NO: 1948384 - DNA, 12 bp, Homo sapiens
gagcagtgggga

SEQ ID NO: 1948385 - DNA, 14 bp, Homo sapiens
gagccacagtgggg

SEQ ID NO: 1948386 - DNA, 19 bp, Homo sapiens
gagccacagtggggcccat

SEQ ID NO: 1948387 - DNA, 23 bp, Homo sapiens
gagccacagtggggcccatggcc

SEQ ID NO: 1948388 - DNA, 22 bp, Homo sapiens
gagcccctcctctcctcgtccg

SEQ ID NO: 1948389 - DNA, 15 bp, Homo sapiens
gagcctgtctctccc

SEQ ID NO: 1948390 - DNA, 16 bp, Homo sapiens
gagcgccacccgcccg

SEQ ID NO: 1948391 - DNA, 15 bp, Homo sapiens
gagcgcgtgccttcc

SEQ ID NO: 1948392 - DNA, 17 bp, Homo sapiens
gagcgcgtgccttcccc

SEQ ID NO: 1948393 - DNA, 23 bp, Homo sapiens
gagcggctgaggacggggcagag

SEQ ID NO: 1948394 - DNA, 17 bp, Homo sapiens
gagctatgcacaccaaa

SEQ ID NO: 1948395 - DNA, 20 bp, Homo sapiens
gagctgagtcggctgggcag

SEQ ID NO: 1948396 - DNA, 16 bp, Homo sapiens
gaggacggggcagagc

SEQ ID NO: 1948397 - DNA, 17 bp, Homo sapiens
gaggacggggcagagct

SEQ ID NO: 1948398 - DNA, 18 bp, Homo sapiens
gaggacggggcagagctg

SEQ ID NO: 1948399 - DNA, 14 bp, Homo sapiens
gaggagaaggagga

SEQ ID NO: 1948400 - DNA, 17 bp, Homo sapiens
gaggagcacccccagcc

SEQ ID NO: 1948401 - DNA, 11 bp, Homo sapiens
gaggagtccaa

SEQ ID NO: 1948402 - DNA, 17 bp, Homo sapiens
gaggcccccggaggcgc

SEQ ID NO: 1948403 - DNA, 14 bp, Homo sapiens
gaggcgcccacctg

SEQ ID NO: 1948404 - DNA, 17 bp, Homo sapiens
gaggcgcccacctgccc

SEQ ID NO: 1948405 - DNA, 18 bp, Homo sapiens
gaggcgcccacctgccca

SEQ ID NO: 1948406 - DNA, 20 bp, Homo sapiens
gagggaagcccacccgcccc

SEQ ID NO: 1948407 - DNA, 22 bp, Homo sapiens
gagggaagcccacccgccccag

SEQ ID NO: 1948408 - DNA, 23 bp, Homo sapiens
gagggaagcccacccgccccaga

SEQ ID NO: 1948409 - DNA, 17 bp, Homo sapiens
gagggctgagcccctcc

SEQ ID NO: 1948410 - DNA, 17 bp, Homo sapiens
gaggggcttggagcaga

SEQ ID NO: 1948411 - DNA, 15 bp, Homo sapiens
gaggtcaggggaatg

SEQ ID NO: 1948412 - DNA, 18 bp, Homo sapiens
gagtcaagctgatgaagt

SEQ ID NO: 1948413 - DNA, 12 bp, Homo sapiens
gagtcaggagaa

SEQ ID NO: 1948414 - DNA, 17 bp, Homo sapiens
gagtccactttcctctc

SEQ ID NO: 1948415 - DNA, 21 bp, Homo sapiens
gagtccactttcctctctctc

SEQ ID NO: 1948416 - DNA, 14 bp, Homo sapiens
gagtcggctgggca

SEQ ID NO: 1948417 - DNA, 15 bp, Homo sapiens
gagtcggctgggcag

SEQ ID NO: 1948418 - DNA, 17 bp, Homo sapiens
gagtctgtcctttccca

SEQ ID NO: 1948419 - DNA, 13 bp, Homo sapiens
gagtgtcaggctc

SEQ ID NO: 1948420 - DNA, 14 bp, Homo sapiens
gagtgtcaggctct

SEQ ID NO: 1948421 - DNA, 19 bp, Homo sapiens
gagtgttctagttcctgga

SEQ ID NO: 1948422 - DNA, 15 bp, Homo sapiens
gagttgaggttgtta

SEQ ID NO: 1948423 - DNA, 20 bp, Homo sapiens
gataaagaaaccttttaaaa

SEQ ID NO: 1948424 - DNA, 22 bp, Homo sapiens
gataaatatcattatagcatgt

SEQ ID NO: 1948425 - DNA, 22 bp, Homo sapiens
gatacggatttagctaacaaaa

SEQ ID NO: 1948426 - DNA, 13 bp, Homo sapiens
gataggagaggaa

SEQ ID NO: 1948427 - DNA, 14 bp, Homo sapiens
gataggagaggaaa

SEQ ID NO: 1948428 - DNA, 20 bp, Homo sapiens
gatatgagaaatataaaaat

SEQ ID NO: 1948429 - DNA, 22 bp, Homo sapiens
gatatgagaaatataaaaataa

SEQ ID NO: 1948430 - DNA, 13 bp, Homo sapiens
gatatgtctttaa

SEQ ID NO: 1948431 - DNA, 18 bp, Homo sapiens
gatatgtctttaaaatga

SEQ ID NO: 1948432 - DNA, 15 bp, Homo sapiens
gatcacatgcccctc

SEQ ID NO: 1948433 - DNA, 21 bp, Homo sapiens
gatcacatgcccctcttagaa

SEQ ID NO: 1948434 - DNA, 20 bp, Homo sapiens
gatccatcctgtttttcctt

SEQ ID NO: 1948435 - DNA, 22 bp, Homo sapiens
gatccatcctgtttttcctttt

SEQ ID NO: 1948436 - DNA, 12 bp, Homo sapiens
gatctcctgtgc

SEQ ID NO: 1948437 - DNA, 14 bp, Homo sapiens
gatctgtccttcca

SEQ ID NO: 1948438 - DNA, 22 bp, Homo sapiens
gatctgtccttccaacctgttc

SEQ ID NO: 1948439 - DNA, 20 bp, Homo sapiens
gatgcagtattgagtgttct

SEQ ID NO: 1948440 - DNA, 14 bp, Homo sapiens
gatggaaaaagaat

SEQ ID NO: 1948441 - DNA, 14 bp, Homo sapiens
gatggatttgacac

SEQ ID NO: 1948442 - DNA, 21 bp, Homo sapiens
gatgtgctgctgggaatggat

SEQ ID NO: 1948443 - DNA, 12 bp, Homo sapiens
gatgtgttcttt

SEQ ID NO: 1948444 - DNA, 20 bp, Homo sapiens
gatgtttagtagctgataaa

SEQ ID NO: 1948445 - DNA, 18 bp, Homo sapiens
gattaagttataccagca

SEQ ID NO: 1948446 - DNA, 18 bp, Homo sapiens
gattagtagaaaatacat

SEQ ID NO: 1948447 - DNA, 20 bp, Homo sapiens
gattagtagaaaatacatta

SEQ ID NO: 1948448 - DNA, 12 bp, Homo sapiens
gattcagcagtg

SEQ ID NO: 1948449 - DNA, 15 bp, Homo sapiens
cccaacccccacctc

SEQ ID NO: 1948450 - DNA, 17 bp, Homo sapiens
cccacaccccgtctgcc

SEQ ID NO: 1948451 - DNA, 19 bp, Homo sapiens
cccacaccccgtctgcccc

SEQ ID NO: 1948452 - DNA, 13 bp, Homo sapiens
cccacccacaccc

SEQ ID NO: 1948453 - DNA, 16 bp, Homo sapiens
cccaccccgctgcctg

SEQ ID NO: 1948454 - DNA, 18 bp, Homo sapiens
cccacccgccccagagac

SEQ ID NO: 1948455 - DNA, 20 bp, Homo sapiens
cccacccgtgttctcctcca

SEQ ID NO: 1948456 - DNA, 20 bp, Homo sapiens
cccaccctcccctctcctga

SEQ ID NO: 1948457 - DNA, 13 bp, Homo sapiens
cccaccctgggcc

SEQ ID NO: 1948458 - DNA, 14 bp, Homo sapiens
cccaccctgggcct

SEQ ID NO: 1948459 - DNA, 14 bp, Homo sapiens
cccacctcccggtg

SEQ ID NO: 1948460 - DNA, 12 bp, Homo sapiens
cccacctgccca

SEQ ID NO: 1948461 - DNA, 13 bp, Homo sapiens
cccacctgcccag

SEQ ID NO: 1948462 - DNA, 12 bp, Homo sapiens
cccacgcagagc

SEQ ID NO: 1948463 - DNA, 18 bp, Homo sapiens
cccacgcagagccccgga

SEQ ID NO: 1948464 - DNA, 22 bp, Homo sapiens
cccacgcagagccccggagcac

SEQ ID NO: 1948465 - DNA, 13 bp, Homo sapiens
cccacggccgtcc

SEQ ID NO: 1948466 - DNA, 18 bp, Homo sapiens
cccactagccctctttct

SEQ ID NO: 1948467 - DNA, 19 bp, Homo sapiens
cccactagccctctttctc

SEQ ID NO: 1948468 - DNA, 18 bp, Homo sapiens
cccagaacgggcctcccc

SEQ ID NO: 1948469 - DNA, 20 bp, Homo sapiens
cccagaagctcaaggctgca

SEQ ID NO: 1948470 - DNA, 15 bp, Homo sapiens
cccagagactgccca

SEQ ID NO: 1948471 - DNA, 17 bp, Homo sapiens
cccagagactgcccacc

SEQ ID NO: 1948472 - DNA, 18 bp, Homo sapiens
cccagcctcccccaggct

SEQ ID NO: 1948473 - DNA, 20 bp, Homo sapiens
cccagctggcagcgcctccc

SEQ ID NO: 1948474 - DNA, 23 bp, Homo sapiens
cccagctggctgggtcgcccctc

SEQ ID NO: 1948475 - DNA, 13 bp, Homo sapiens
cccaggcactctc

SEQ ID NO: 1948476 - DNA, 16 bp, Homo sapiens
cccaggcggaggggct

SEQ ID NO: 1948477 - DNA, 17 bp, Homo sapiens
cccaggctgcgcctgcc

SEQ ID NO: 1948478 - DNA, 20 bp, Homo sapiens
cccaggctgcgcctgcccgc

SEQ ID NO: 1948479 - DNA, 13 bp, Homo sapiens
cccagggtgcagg

SEQ ID NO: 1948480 - DNA, 17 bp, Homo sapiens
cccagttagcccggcca

SEQ ID NO: 1948481 - DNA, 19 bp, Homo sapiens
cccagttagcccggccaag

SEQ ID NO: 1948482 - DNA, 21 bp, Homo sapiens
cccatccttcccgcagcacca

SEQ ID NO: 1948483 - DNA, 16 bp, Homo sapiens
cccatgccaatgtcca

SEQ ID NO: 1948484 - DNA, 12 bp, Homo sapiens
cccatggcccca

SEQ ID NO: 1948485 - DNA, 16 bp, Homo sapiens
ccccaccctcccctct

SEQ ID NO: 1948486 - DNA, 16 bp, Homo sapiens
ccccagagactgccca

SEQ ID NO: 1948487 - DNA, 17 bp, Homo sapiens
ccccagagactgcccac

SEQ ID NO: 1948488 - DNA, 12 bp, Homo sapiens
ccccagcctccc

SEQ ID NO: 1948489 - DNA, 23 bp, Homo sapiens
ccccagcctcccccaggctgcgc

SEQ ID NO: 1948490 - DNA, 19 bp, Homo sapiens
ccccaggctgcgcctgccc

SEQ ID NO: 1948491 - DNA, 20 bp, Homo sapiens
ccccaggctgcgcctgcccg

SEQ ID NO: 1948492 - DNA, 15 bp, Homo sapiens
ccccagggtgcaggc

SEQ ID NO: 1948493 - DNA, 22 bp, Homo sapiens
ccccagggtgcaggcgcgcacc

SEQ ID NO: 1948494 - DNA, 15 bp, Homo sapiens
ccccataatgcttct

SEQ ID NO: 1948495 - DNA, 23 bp, Homo sapiens
ccccataatgcttctttcctctt

SEQ ID NO: 1948496 - DNA, 18 bp, Homo sapiens
ccccattgtgaatgttgt

SEQ ID NO: 1948497 - DNA, 15 bp, Homo sapiens
cccccacggccgtcc

SEQ ID NO: 1948498 - DNA, 19 bp, Homo sapiens
cccccacggccgtccctga

SEQ ID NO: 1948499 - DNA, 22 bp, Homo sapiens
cccccagcctcccccaggctgc

SEQ ID NO: 1948500 - DNA, 12 bp, Homo sapiens
cccccaggctgc

SEQ ID NO: 1948501 - DNA, 18 bp, Homo sapiens
cccccaggctgcgcctgc

SEQ ID NO: 1948502 - DNA, 19 bp, Homo sapiens
cccccaggctgcgcctgcc

SEQ ID NO: 1948503 - DNA, 16 bp, Homo sapiens
cccccgccctcgctcc

SEQ ID NO: 1948504 - DNA, 18 bp, Homo sapiens
cccccgccctcgctccgg

SEQ ID NO: 1948505 - DNA, 15 bp, Homo sapiens
cccccggaggcgccc

SEQ ID NO: 1948506 - DNA, 18 bp, Homo sapiens
cccccggaggcgcccacc

SEQ ID NO: 1948507 - DNA, 13 bp, Homo sapiens
ccccctctcgggc

SEQ ID NO: 1948508 - DNA, 16 bp, Homo sapiens
ccccgcgcgtgccccc

SEQ ID NO: 1948509 - DNA, 17 bp, Homo sapiens
ccccggacgctggctcg

SEQ ID NO: 1948510 - DNA, 17 bp, Homo sapiens
ccccggaggcgcccacc

SEQ ID NO: 1948511 - DNA, 15 bp, Homo sapiens
cccctcccccgcaga

SEQ ID NO: 1948512 - DNA, 16 bp, Homo sapiens
cccctcccccgcagac

SEQ ID NO: 1948513 - DNA, 18 bp, Homo sapiens
cccctccgtccccagggt

SEQ ID NO: 1948514 - DNA, 20 bp, Homo sapiens
cccctccgtccccagggtgc

SEQ ID NO: 1948515 - DNA, 21 bp, Homo sapiens
cccctcctcgggcgcctgcgc

SEQ ID NO: 1948516 - DNA, 22 bp, Homo sapiens
cccctcctcgggcgcctgcgct

SEQ ID NO: 1948517 - DNA, 16 bp, Homo sapiens
cccctcttagaagaaa

SEQ ID NO: 1948518 - DNA, 15 bp, Homo sapiens
ccccttgaccccaca

SEQ ID NO: 1948519 - DNA, 17 bp, Homo sapiens
ccccttgaccccacacg

SEQ ID NO: 1948520 - DNA, 19 bp, Homo sapiens
cccgagcgcgtgccttccc

SEQ ID NO: 1948521 - DNA, 23 bp, Homo sapiens
ctgctgctcgggaaggcctgagg

SEQ ID NO: 1948522 - DNA, 22 bp, Homo sapiens
ctgctggaccaaggtgcggacc

SEQ ID NO: 1948523 - DNA, 23 bp, Homo sapiens
ctgctgtggcatcaggaaaggaa

SEQ ID NO: 1948524 - DNA, 21 bp, Homo sapiens
ctgcttttgatggctatgttt

SEQ ID NO: 1948525 - DNA, 18 bp, Homo sapiens
ctggaaaaaaaaaaatat

SEQ ID NO: 1948526 - DNA, 16 bp, Homo sapiens
ctggaagttgtccttt

SEQ ID NO: 1948527 - DNA, 22 bp, Homo sapiens
ctggaattagttggcagagaaa

SEQ ID NO: 1948528 - DNA, 15 bp, Homo sapiens
ctggacagtgcctaa

SEQ ID NO: 1948529 - DNA, 14 bp, Homo sapiens
ctggacatattccc

SEQ ID NO: 1948530 - DNA, 19 bp, Homo sapiens
ctggaggagaaggaggaac

SEQ ID NO: 1948531 - DNA, 22 bp, Homo sapiens
ctggatattttttgatggaaaa

SEQ ID NO: 1948532 - DNA, 12 bp, Homo sapiens
ctggatttaact

SEQ ID NO: 1948533 - DNA, 14 bp, Homo sapiens
ctggcagcgcctcc

SEQ ID NO: 1948534 - DNA, 13 bp, Homo sapiens
ctggccccaggcg

SEQ ID NO: 1948535 - DNA, 19 bp, Homo sapiens
ctggccccaggcggagggg

SEQ ID NO: 1948536 - DNA, 21 bp, Homo sapiens
ctggccccaggcggaggggct

SEQ ID NO: 1948537 - DNA, 13 bp, Homo sapiens
ctggccctgccct

SEQ ID NO: 1948538 - DNA, 14 bp, Homo sapiens
ctggccctgccctc

SEQ ID NO: 1948539 - DNA, 19 bp, Homo sapiens
ctggccctgccctccccca

SEQ ID NO: 1948540 - DNA, 15 bp, Homo sapiens
ctggccggtccaccc

SEQ ID NO: 1948541 - DNA, 14 bp, Homo sapiens
ctggcctgggggct

SEQ ID NO: 1948542 - DNA, 15 bp, Homo sapiens
ctggcgggcagcccc

SEQ ID NO: 1948543 - DNA, 21 bp, Homo sapiens
ctggctgggtcgcccctcctc

SEQ ID NO: 1948544 - DNA, 19 bp, Homo sapiens
ctgggcagggccgcagggc

SEQ ID NO: 1948545 - DNA, 12 bp, Homo sapiens
ctgggcctcccg

SEQ ID NO: 1948546 - DNA, 14 bp, Homo sapiens
ctgggcctcccgtc

SEQ ID NO: 1948547 - DNA, 21 bp, Homo sapiens
ctgggcctcccgtccgtccgc

SEQ ID NO: 1948548 - DNA, 18 bp, Homo sapiens
ctggggtctctgagcagt

SEQ ID NO: 1948549 - DNA, 21 bp, Homo sapiens
ctggggtctctgagcagtggg

SEQ ID NO: 1948550 - DNA, 22 bp, Homo sapiens
ctgggtcgcccctcctcgggcg

SEQ ID NO: 1948551 - DNA, 20 bp, Homo sapiens
ctggtgcgtgtggccctgtg

SEQ ID NO: 1948552 - DNA, 16 bp, Homo sapiens
ctgtaaataaaaatag

SEQ ID NO: 1948553 - DNA, 12 bp, Homo sapiens
ctgtaactgtcc

SEQ ID NO: 1948554 - DNA, 20 bp, Homo sapiens
ctgtagtttttgttcacctt

SEQ ID NO: 1948555 - DNA, 23 bp, Homo sapiens
ctgtatccaagttatttgatctg

SEQ ID NO: 1948556 - DNA, 11 bp, Homo sapiens
ctgtattgcta

SEQ ID NO: 1948557 - DNA, 20 bp, Homo sapiens
ctgtcagcttcccaacaata

SEQ ID NO: 1948558 - DNA, 14 bp, Homo sapiens
ctgtcagtttgtga

SEQ ID NO: 1948559 - DNA, 16 bp, Homo sapiens
ctgtcagtttgtgaag

SEQ ID NO: 1948560 - DNA, 20 bp, Homo sapiens
ctgtcagtttgtgaagtgat

SEQ ID NO: 1948561 - DNA, 21 bp, Homo sapiens
ctgtcagtttgtgaagtgatt

SEQ ID NO: 1948562 - DNA, 12 bp, Homo sapiens
ctgtctcctctg

SEQ ID NO: 1948563 - DNA, 22 bp, Homo sapiens
ctgtctctacaaaaaaaatcaa

SEQ ID NO: 1948564 - DNA, 17 bp, Homo sapiens
ctgtctctccctaccct

SEQ ID NO: 1948565 - DNA, 21 bp, Homo sapiens
ctgtctctccctaccctcttc

SEQ ID NO: 1948566 - DNA, 19 bp, Homo sapiens
ctgtctgtcccagttaact

SEQ ID NO: 1948567 - DNA, 16 bp, Homo sapiens
ctgtcttcaaccctgc

SEQ ID NO: 1948568 - DNA, 18 bp, Homo sapiens
ctgtcttcaaccctgccc

SEQ ID NO: 1948569 - DNA, 20 bp, Homo sapiens
ctgtcttcaaccctgccctg

SEQ ID NO: 1948570 - DNA, 15 bp, Homo sapiens
ctgtctttatgattt

SEQ ID NO: 1948571 - DNA, 17 bp, Homo sapiens
ctgtctttatgatttca

SEQ ID NO: 1948572 - DNA, 18 bp, Homo sapiens
ctgtgacacagctgagct

SEQ ID NO: 1948573 - DNA, 16 bp, Homo sapiens
ctgtgacattccacag

SEQ ID NO: 1948574 - DNA, 15 bp, Homo sapiens
ctgtgagataaatat

SEQ ID NO: 1948575 - DNA, 16 bp, Homo sapiens
ctgtgagtctgtcctt

SEQ ID NO: 1948576 - DNA, 19 bp, Homo sapiens
ctgtgatgtcacagtttgt

SEQ ID NO: 1948577 - DNA, 21 bp, Homo sapiens
ctgtgatgtcacagtttgttc

SEQ ID NO: 1948578 - DNA, 23 bp, Homo sapiens
ctgtgatgtcacagtttgttcag

SEQ ID NO: 1948579 - DNA, 15 bp, Homo sapiens
ctgtgcatctggcct

SEQ ID NO: 1948580 - DNA, 17 bp, Homo sapiens
ctgtgcatctggcctgg

SEQ ID NO: 1948581 - DNA, 15 bp, Homo sapiens
ctgtgggagtccact

SEQ ID NO: 1948582 - DNA, 21 bp, Homo sapiens
ctgtgggagtccactttcctc

SEQ ID NO: 1948583 - DNA, 17 bp, Homo sapiens
ctgtggtttgttatcag

SEQ ID NO: 1948584 - DNA, 16 bp, Homo sapiens
ctgtgtcatctgtcag

SEQ ID NO: 1948585 - DNA, 17 bp, Homo sapiens
ctgtgtggcaaacattt

SEQ ID NO: 1948586 - DNA, 21 bp, Homo sapiens
ctgtgtggcaaacatttaaaa

SEQ ID NO: 1948587 - DNA, 20 bp, Homo sapiens
ctgttatctgtctttatgat

SEQ ID NO: 1948588 - DNA, 21 bp, Homo sapiens
ctgttcacgtgactcctcaat

SEQ ID NO: 1948589 - DNA, 12 bp, Homo sapiens
ctgttcactttt

SEQ ID NO: 1948590 - DNA, 16 bp, Homo sapiens
ctgttcttcatttcta

SEQ ID NO: 1948591 - DNA, 23 bp, Homo sapiens
ctgttgattctttcaatccacag

SEQ ID NO: 1948592 - DNA, 13 bp, Homo sapiens
ctgtttgcttcta

SEQ ID NO: 1948593 - DNA, 21 bp, Homo sapiens
ctgtttttccttttgtttaca

SEQ ID NO: 1948594 - DNA, 15 bp, Homo sapiens
cttaaacaaaaactt

SEQ ID NO: 1948595 - DNA, 20 bp, Homo sapiens
cttaaacaaaaactttccat

SEQ ID NO: 1948596 - DNA, 22 bp, Homo sapiens
cttaaacaaaaactttccatga

SEQ ID NO: 1948597 - DNA, 23 bp, Homo sapiens
cttaaacaaaaactttccatgac

SEQ ID NO: 1948598 - DNA, 16 bp, Homo sapiens
cttaaacattttttgt

SEQ ID NO: 1948599 - DNA, 19 bp, Homo sapiens
cttagcctttaataggctt

SEQ ID NO: 1948600 - DNA, 18 bp, Homo sapiens
cttaggcactttttaaca

SEQ ID NO: 1948601 - DNA, 18 bp, Homo sapiens
cttagtacctttttaaca

SEQ ID NO: 1948602 - DNA, 16 bp, Homo sapiens
cttatcaagtgttaca

SEQ ID NO: 1948603 - DNA, 16 bp, Homo sapiens
cttcaaacgaaatggc

SEQ ID NO: 1948604 - DNA, 14 bp, Homo sapiens
cttcaaccctgccc

SEQ ID NO: 1948605 - DNA, 14 bp, Homo sapiens
cttcactacaacat

SEQ ID NO: 1948606 - DNA, 16 bp, Homo sapiens
cttcatgcttttctca

SEQ ID NO: 1948607 - DNA, 18 bp, Homo sapiens
cttcccagctggcagcgc

SEQ ID NO: 1948608 - DNA, 22 bp, Homo sapiens
cttcccagctggcagcgcctcc

SEQ ID NO: 1948609 - DNA, 18 bp, Homo sapiens
cttccccacaataggctt

SEQ ID NO: 1948610 - DNA, 16 bp, Homo sapiens
cttccccgtgcggccc

SEQ ID NO: 1948611 - DNA, 23 bp, Homo sapiens
cgggactgtcttcaaccctgccc

SEQ ID NO: 1948612 - DNA, 14 bp, Homo sapiens
cgggagagcgccac

SEQ ID NO: 1948613 - DNA, 15 bp, Homo sapiens
cgggagagcgccacc

SEQ ID NO: 1948614 - DNA, 16 bp, Homo sapiens
cgggagagcgccaccc

SEQ ID NO: 1948615 - DNA, 19 bp, Homo sapiens
cgggagagcgccacccgcc

SEQ ID NO: 1948616 - DNA, 15 bp, Homo sapiens
cgggcagcccctgct

SEQ ID NO: 1948617 - DNA, 17 bp, Homo sapiens
cgggcccgctcaacctc

SEQ ID NO: 1948618 - DNA, 12 bp, Homo sapiens
cgggccgcctcc

SEQ ID NO: 1948619 - DNA, 14 bp, Homo sapiens
cgggcgcctgcgct

SEQ ID NO: 1948620 - DNA, 16 bp, Homo sapiens
cgggcgcctgcgctcc

SEQ ID NO: 1948621 - DNA, 11 bp, Homo sapiens
cggggctggcc

SEQ ID NO: 1948622 - DNA, 16 bp, Homo sapiens
cggggctggccctgcc

SEQ ID NO: 1948623 - DNA, 23 bp, Homo sapiens
cggggctggccctgccctccccc

SEQ ID NO: 1948624 - DNA, 16 bp, Homo sapiens
cgggggaggagcaccc

SEQ ID NO: 1948625 - DNA, 22 bp, Homo sapiens
cgggggaggagcacccccagcc

SEQ ID NO: 1948626 - DNA, 24 bp, Homo sapiens
cgggggaggagcacccccagcctc

SEQ ID NO: 1948627 - DNA, 22 bp, Homo sapiens
cgggggtccccggacgctggct

SEQ ID NO: 1948628 - DNA, 18 bp, Homo sapiens
cgggtgcgtgaccggccc

SEQ ID NO: 1948629 - DNA, 20 bp, Homo sapiens
cggtccaccccgtcccggcc

SEQ ID NO: 1948630 - DNA, 18 bp, Homo sapiens
cggtggcatttgctgaat

SEQ ID NO: 1948631 - DNA, 16 bp, Homo sapiens
cggtgtatgcagtggt

SEQ ID NO: 1948632 - DNA, 18 bp, Homo sapiens
cggttggccggctggccg

SEQ ID NO: 1948633 - DNA, 12 bp, Homo sapiens
cgtcccggcccc

SEQ ID NO: 1948634 - DNA, 18 bp, Homo sapiens
cgtccctgacttcccagc

SEQ ID NO: 1948635 - DNA, 10 bp, Homo sapiens
cgtccggcct

SEQ ID NO: 1948636 - DNA, 14 bp, Homo sapiens
cgtccggcctgcag

SEQ ID NO: 1948637 - DNA, 16 bp, Homo sapiens
cgtccggcctgcagcc

SEQ ID NO: 1948638 - DNA, 11 bp, Homo sapiens
cgtctgcccct

SEQ ID NO: 1948639 - DNA, 12 bp, Homo sapiens
cgtctgcccctt

SEQ ID NO: 1948640 - DNA, 19 bp, Homo sapiens
cgtctgccccttgacccca

SEQ ID NO: 1948641 - DNA, 21 bp, Homo sapiens
cgtctttggttcctcatggct

SEQ ID NO: 1948642 - DNA, 15 bp, Homo sapiens
cgtgaccggcccgcc

SEQ ID NO: 1948643 - DNA, 22 bp, Homo sapiens
cgtgccttccccgtgcggcccg

SEQ ID NO: 1948644 - DNA, 21 bp, Homo sapiens
cgtgcgcagccgcgctctgcc

SEQ ID NO: 1948645 - DNA, 22 bp, Homo sapiens
cgtgcgcagccgcgctctgccc

SEQ ID NO: 1948646 - DNA, 15 bp, Homo sapiens
cgtggtgtgaggccc

SEQ ID NO: 1948647 - DNA, 19 bp, Homo sapiens
cgtgtggccctgtgggagt

SEQ ID NO: 1948648 - DNA, 12 bp, Homo sapiens
ctaaaagtgatg

SEQ ID NO: 1948649 - DNA, 18 bp, Homo sapiens
ctaaaagtgatgtgattt

SEQ ID NO: 1948650 - DNA, 16 bp, Homo sapiens
ctaaatcagcattttt

SEQ ID NO: 1948651 - DNA, 18 bp, Homo sapiens
ctaaattaacttctattt

SEQ ID NO: 1948652 - DNA, 11 bp, Homo sapiens
ctaacactggc

SEQ ID NO: 1948653 - DNA, 13 bp, Homo sapiens
ctaacgggcgcct

SEQ ID NO: 1948654 - DNA, 12 bp, Homo sapiens
ctaactggcccc

SEQ ID NO: 1948655 - DNA, 17 bp, Homo sapiens
ctaagataattaaatga

SEQ ID NO: 1948656 - DNA, 19 bp, Homo sapiens
ctaatgatgttagtaactt

SEQ ID NO: 1948657 - DNA, 18 bp, Homo sapiens
ctaatgcagaattgctag

SEQ ID NO: 1948658 - DNA, 13 bp, Homo sapiens
ctaattaaactga

SEQ ID NO: 1948659 - DNA, 15 bp, Homo sapiens
ctacaaaagaagtgt

SEQ ID NO: 1948660 - DNA, 14 bp, Homo sapiens
ctacaacattagaa

SEQ ID NO: 1948661 - DNA, 22 bp, Homo sapiens
ctacataccacacttaaaagat

SEQ ID NO: 1948662 - DNA, 16 bp, Homo sapiens
ctaccctcttctcagc

SEQ ID NO: 1948663 - DNA, 14 bp, Homo sapiens
ctacttaaacaaaa

SEQ ID NO: 1948664 - DNA, 16 bp, Homo sapiens
ctacttaaacaaaaac

SEQ ID NO: 1948665 - DNA, 19 bp, Homo sapiens
ctacttaaacaaaaacttt

SEQ ID NO: 1948666 - DNA, 22 bp, Homo sapiens
ctagaaagagaaaaagccctct

SEQ ID NO: 1948667 - DNA, 20 bp, Homo sapiens
ctagcactttgggaggctga

SEQ ID NO: 1948668 - DNA, 17 bp, Homo sapiens
ctagccatatattttct

SEQ ID NO: 1948669 - DNA, 18 bp, Homo sapiens
ctagccctctttctctct

SEQ ID NO: 1948670 - DNA, 15 bp, Homo sapiens
ctagtgctacagatg

SEQ ID NO: 1948671 - DNA, 19 bp, Homo sapiens
ctataaatagtgaaaattt

SEQ ID NO: 1948672 - DNA, 14 bp, Homo sapiens
ctatctctcttctg

SEQ ID NO: 1948673 - DNA, 14 bp, Homo sapiens
ctatctggaaaaaa

SEQ ID NO: 1948674 - DNA, 17 bp, Homo sapiens
ctatgcacaccaaattg

SEQ ID NO: 1948675 - DNA, 18 bp, Homo sapiens
ctatgcacaccaaattgc

SEQ ID NO: 1948676 - DNA, 21 bp, Homo sapiens
ctatgcacaccaaattgctga

SEQ ID NO: 1948677 - DNA, 15 bp, Homo sapiens
ctattgctgtaaata

SEQ ID NO: 1948678 - DNA, 22 bp, Homo sapiens
ctattgctgtaaataaaaatag

SEQ ID NO: 1948679 - DNA, 15 bp, Homo sapiens
ctcaaaagaaaatgt

SEQ ID NO: 1948680 - DNA, 14 bp, Homo sapiens
ctcaaggcctccag

SEQ ID NO: 1948681 - DNA, 12 bp, Homo sapiens
ctcaaggctgca

SEQ ID NO: 1948682 - DNA, 18 bp, Homo sapiens
ctcaataaggcagtgcag

SEQ ID NO: 1948683 - DNA, 11 bp, Homo sapiens
ctcaatgtgct

SEQ ID NO: 1948684 - DNA, 13 bp, Homo sapiens
ctcaatgtgctgt

SEQ ID NO: 1948685 - DNA, 15 bp, Homo sapiens
ctcaattccagggaa

SEQ ID NO: 1948686 - DNA, 20 bp, Homo sapiens
ctcaattccagggaaccaga

SEQ ID NO: 1948687 - DNA, 17 bp, Homo sapiens
ctcaccatttaatcatt

SEQ ID NO: 1948688 - DNA, 22 bp, Homo sapiens
ctcaccatttaatcatttccag

SEQ ID NO: 1948689 - DNA, 14 bp, Homo sapiens
ctcacccagcctgg

SEQ ID NO: 1948690 - DNA, 15 bp, Homo sapiens
ctcagaagtgaaaaa

SEQ ID NO: 1948691 - DNA, 14 bp, Homo sapiens
ctcaggcagtgcag

SEQ ID NO: 1948692 - DNA, 18 bp, Homo sapiens
ctcagtaacacagtgcag

SEQ ID NO: 1948693 - DNA, 18 bp, Homo sapiens
ctcagtaatacagtacag

SEQ ID NO: 1948694 - DNA, 21 bp, Homo sapiens
ctcatcaggtaaactgatgct

SEQ ID NO: 1948695 - DNA, 14 bp, Homo sapiens
ctcatgtgatttac

SEQ ID NO: 1948696 - DNA, 13 bp, Homo sapiens
ctccaaatgctgt

SEQ ID NO: 1948697 - DNA, 17 bp, Homo sapiens
ctccagaagcagcagct

SEQ ID NO: 1948698 - DNA, 15 bp, Homo sapiens
ctccagtacaataaa

SEQ ID NO: 1948699 - DNA, 18 bp, Homo sapiens
ctccatggtgaactgaag

SEQ ID NO: 1948700 - DNA, 23 bp, Homo sapiens
ctccatggtgaactgaagcagag

SEQ ID NO: 1948701 - DNA, 18 bp, Homo sapiens
ctcccacctcggacacca

SEQ ID NO: 1948702 - DNA, 14 bp, Homo sapiens
ctcccagtcatgtt

SEQ ID NO: 1948703 - DNA, 22 bp, Homo sapiens
ctcccccacggccgtccctgac

SEQ ID NO: 1948704 - DNA, 13 bp, Homo sapiens
ctcccccaggctg

SEQ ID NO: 1948705 - DNA, 21 bp, Homo sapiens
ctccccgcccgccctcctctg

SEQ ID NO: 1948706 - DNA, 13 bp, Homo sapiens
ctcccgccgcctc

SEQ ID NO: 1948707 - DNA, 22 bp, Homo sapiens
ctcccgccgcctcgggccgcct

SEQ ID NO: 1948708 - DNA, 13 bp, Homo sapiens
ctccctaccctct

SEQ ID NO: 1948709 - DNA, 16 bp, Homo sapiens
ctccctaccctcttct

SEQ ID NO: 1948710 - DNA, 14 bp, Homo sapiens
ctccggcagaggca

SEQ ID NO: 1948711 - DNA, 15 bp, Homo sapiens
ctccggcagaggcag

SEQ ID NO: 1948712 - DNA, 22 bp, Homo sapiens
ctccgggtgcgtgaccggcccg

SEQ ID NO: 1948713 - DNA, 15 bp, Homo sapiens
ctcctccaaatgctg

SEQ ID NO: 1948714 - DNA, 20 bp, Homo sapiens
ctcctcgggcgcctgcgctc

SEQ ID NO: 1948715 - DNA, 16 bp, Homo sapiens
ctcctcggtggcattt

SEQ ID NO: 1948716 - DNA, 18 bp, Homo sapiens
ctcctcgtccggcctgca

SEQ ID NO: 1948717 - DNA, 22 bp, Homo sapiens
ctcctcgtccggcctgcagccc

SEQ ID NO: 1948718 - DNA, 13 bp, Homo sapiens
ctcctctgcagcc

SEQ ID NO: 1948719 - DNA, 11 bp, Homo sapiens
ctcctctgccc

SEQ ID NO: 1948720 - DNA, 15 bp, Homo sapiens
ctcctctgccccctc

SEQ ID NO: 1948721 - DNA, 22 bp, Homo sapiens
ctcctctgccccctcccccgca

SEQ ID NO: 1948722 - DNA, 12 bp, Homo sapiens
ctcctctgtcag

SEQ ID NO: 1948723 - DNA, 14 bp, Homo sapiens
ctcctgagcctgtc

SEQ ID NO: 1948724 - DNA, 17 bp, Homo sapiens
ctcctgagcctgtctct

SEQ ID NO: 1948725 - DNA, 15 bp, Homo sapiens
attcaaacctaagtt

SEQ ID NO: 1948726 - DNA, 14 bp, Homo sapiens
attcaaagaatcac

SEQ ID NO: 1948727 - DNA, 22 bp, Homo sapiens
attcaataactattgctgcttt

SEQ ID NO: 1948728 - DNA, 18 bp, Homo sapiens
attcaatcattttgggaa

SEQ ID NO: 1948729 - DNA, 21 bp, Homo sapiens
attcaggtgataactcaccat

SEQ ID NO: 1948730 - DNA, 21 bp, Homo sapiens
attccacagagttactgccac

SEQ ID NO: 1948731 - DNA, 17 bp, Homo sapiens
attccagggaaccagag

SEQ ID NO: 1948732 - DNA, 17 bp, Homo sapiens
attccatatatatctga

SEQ ID NO: 1948733 - DNA, 17 bp, Homo sapiens
attcccaaatctcaaaa

SEQ ID NO: 1948734 - DNA, 16 bp, Homo sapiens
attcccaggcactctc

SEQ ID NO: 1948735 - DNA, 15 bp, Homo sapiens
attcctacttaaaca

SEQ ID NO: 1948736 - DNA, 13 bp, Homo sapiens
attcctcccctgg

SEQ ID NO: 1948737 - DNA, 23 bp, Homo sapiens
attctaaaagtaataaattccaa

SEQ ID NO: 1948738 - DNA, 20 bp, Homo sapiens
attctacctggctacaatta

SEQ ID NO: 1948739 - DNA, 23 bp, Homo sapiens
attctttcaatccacagtattgt

SEQ ID NO: 1948740 - DNA, 14 bp, Homo sapiens
attctttgttgctt

SEQ ID NO: 1948741 - DNA, 23 bp, Homo sapiens
attgacctcaaaagaaaatgtgt

SEQ ID NO: 1948742 - DNA, 17 bp, Homo sapiens
attgagacactgtcaag

SEQ ID NO: 1948743 - DNA, 13 bp, Homo sapiens
attgagtgtacat

SEQ ID NO: 1948744 - DNA, 18 bp, Homo sapiens
attgcactaaaagtgatg

SEQ ID NO: 1948745 - DNA, 16 bp, Homo sapiens
attgctaggtaaagag

SEQ ID NO: 1948746 - DNA, 22 bp, Homo sapiens
attgctgagatgtttagtagct

SEQ ID NO: 1948747 - DNA, 18 bp, Homo sapiens
attgctgtaaataaaaat

SEQ ID NO: 1948748 - DNA, 22 bp, Homo sapiens
attgctgtaaataaaaatagct

SEQ ID NO: 1948749 - DNA, 18 bp, Homo sapiens
attgtaactcacatgcct

SEQ ID NO: 1948750 - DNA, 21 bp, Homo sapiens
attgttcttgtaaaactgtga

SEQ ID NO: 1948751 - DNA, 21 bp, Homo sapiens
atttaatcatttccagcaaaa

SEQ ID NO: 1948752 - DNA, 18 bp, Homo sapiens
atttagctaacaaaagat

SEQ ID NO: 1948753 - DNA, 16 bp, Homo sapiens
atttaggaatgctcaa

SEQ ID NO: 1948754 - DNA, 13 bp, Homo sapiens
atttatgcatgag

SEQ ID NO: 1948755 - DNA, 12 bp, Homo sapiens
atttatgcattt

SEQ ID NO: 1948756 - DNA, 12 bp, Homo sapiens
atttatgtgtga

SEQ ID NO: 1948757 - DNA, 14 bp, Homo sapiens
atttattggcaata

SEQ ID NO: 1948758 - DNA, 15 bp, Homo sapiens
atttcaagaatgttt

SEQ ID NO: 1948759 - DNA, 15 bp, Homo sapiens
atttcaatgcttctt

SEQ ID NO: 1948760 - DNA, 21 bp, Homo sapiens
atttcagtaagatcaagctcc

SEQ ID NO: 1948761 - DNA, 13 bp, Homo sapiens
atttccagcaaaa

SEQ ID NO: 1948762 - DNA, 21 bp, Homo sapiens
atttccatggattcccctgga

SEQ ID NO: 1948763 - DNA, 15 bp, Homo sapiens
atttcctgctcctcc

SEQ ID NO: 1948764 - DNA, 16 bp, Homo sapiens
atttcctttggcaata

SEQ ID NO: 1948765 - DNA, 15 bp, Homo sapiens
atttctatagccaaa

SEQ ID NO: 1948766 - DNA, 15 bp, Homo sapiens
atttctcttaagtac

SEQ ID NO: 1948767 - DNA, 18 bp, Homo sapiens
atttctgtgtcctgtttt

SEQ ID NO: 1948768 - DNA, 13 bp, Homo sapiens
atttgacacactc

SEQ ID NO: 1948769 - DNA, 20 bp, Homo sapiens
atttgacacactcaccattt

SEQ ID NO: 1948770 - DNA, 15 bp, Homo sapiens
atttgactgttattt

SEQ ID NO: 1948771 - DNA, 20 bp, Homo sapiens
atttgatctggtgcgtgtgg

SEQ ID NO: 1948772 - DNA, 15 bp, Homo sapiens
atttgcacacaaaac

SEQ ID NO: 1948773 - DNA, 21 bp, Homo sapiens
atttgcacacaaaacatctta

SEQ ID NO: 1948774 - DNA, 10 bp, Homo sapiens
atttgctgaa

SEQ ID NO: 1948775 - DNA, 15 bp, Homo sapiens
atttggctatgcctt

SEQ ID NO: 1948776 - DNA, 18 bp, Homo sapiens
atttgggttgcaaagcta

SEQ ID NO: 1948777 - DNA, 14 bp, Homo sapiens
atttggtggctcta

SEQ ID NO: 1948778 - DNA, 16 bp, Homo sapiens
atttgttgaaatcttt

SEQ ID NO: 1948779 - DNA, 20 bp, Homo sapiens
attttaaaaaagatggattt

SEQ ID NO: 1948780 - DNA, 15 bp, Homo sapiens
attttagctaattta

SEQ ID NO: 1948781 - DNA, 18 bp, Homo sapiens
attttatggtactaatga

SEQ ID NO: 1948782 - DNA, 19 bp, Homo sapiens
attttatggtactaatgaa

SEQ ID NO: 1948783 - DNA, 16 bp, Homo sapiens
attttattgaatataa

SEQ ID NO: 1948784 - DNA, 18 bp, Homo sapiens
attttctctcctcggtgg

SEQ ID NO: 1948785 - DNA, 17 bp, Homo sapiens
attttctgagtagcata

SEQ ID NO: 1948786 - DNA, 22 bp, Homo sapiens
attttgggaaattcttgcactg

SEQ ID NO: 1948787 - DNA, 23 bp, Homo sapiens
attttgggaaattcttgcactgt

SEQ ID NO: 1948788 - DNA, 15 bp, Homo sapiens
atttttcattttctc

SEQ ID NO: 1948789 - DNA, 14 bp, Homo sapiens
caaaaactttccat

SEQ ID NO: 1948790 - DNA, 16 bp, Homo sapiens
caaaaactttccatga

SEQ ID NO: 1948791 - DNA, 23 bp, Homo sapiens
caaaacattttgtatgctgcatg

SEQ ID NO: 1948792 - DNA, 23 bp, Homo sapiens
caaaagaaaatgtgtaacagagt

SEQ ID NO: 1948793 - DNA, 20 bp, Homo sapiens
caaaataaaaccagaaagag

SEQ ID NO: 1948794 - DNA, 19 bp, Homo sapiens
caaaatgtgtgcttggaaa

SEQ ID NO: 1948795 - DNA, 15 bp, Homo sapiens
caaacaggaaaatga

SEQ ID NO: 1948796 - DNA, 18 bp, Homo sapiens
caaagcatgctcagtatt

SEQ ID NO: 1948797 - DNA, 19 bp, Homo sapiens
caaagcatgctcagtattg

SEQ ID NO: 1948798 - DNA, 11 bp, Homo sapiens
caaagccctcc

SEQ ID NO: 1948799 - DNA, 21 bp, Homo sapiens
caaagttaaacgtgatgtgct

SEQ ID NO: 1948800 - DNA, 12 bp, Homo sapiens
caaatattaaga

SEQ ID NO: 1948801 - DNA, 22 bp, Homo sapiens
caaatctcaaaagatctcctgt

SEQ ID NO: 1948802 - DNA, 14 bp, Homo sapiens
caaatggatgtaat

SEQ ID NO: 1948803 - DNA, 15 bp, Homo sapiens
caaatggatgtaata

SEQ ID NO: 1948804 - DNA, 16 bp, Homo sapiens
caaatggatgtaatat

SEQ ID NO: 1948805 - DNA, 19 bp, Homo sapiens
caacaaactcaaaatgtgg

SEQ ID NO: 1948806 - DNA, 14 bp, Homo sapiens
caacaaagcatgct

SEQ ID NO: 1948807 - DNA, 15 bp, Homo sapiens
caacaaagcatgctc

SEQ ID NO: 1948808 - DNA, 13 bp, Homo sapiens
caacaacaaagca

SEQ ID NO: 1948809 - DNA, 15 bp, Homo sapiens
caacaacagaacaac

SEQ ID NO: 1948810 - DNA, 21 bp, Homo sapiens
caacaagcctgaaagtaattt

SEQ ID NO: 1948811 - DNA, 18 bp, Homo sapiens
caacaatactttgtgtct

SEQ ID NO: 1948812 - DNA, 12 bp, Homo sapiens
caacagaacaac

SEQ ID NO: 1948813 - DNA, 16 bp, Homo sapiens
caacagcaacaacaac

SEQ ID NO: 1948814 - DNA, 14 bp, Homo sapiens
caacattagaatat

SEQ ID NO: 1948815 - DNA, 15 bp, Homo sapiens
caacattagaatatt

SEQ ID NO: 1948816 - DNA, 14 bp, Homo sapiens
caaccaaagaaaat

SEQ ID NO: 1948817 - DNA, 12 bp, Homo sapiens
caaccctgccct

SEQ ID NO: 1948818 - DNA, 14 bp, Homo sapiens
caaccctgccctgc

SEQ ID NO: 1948819 - DNA, 16 bp, Homo sapiens
caaccctgccctgcac

SEQ ID NO: 1948820 - DNA, 13 bp, Homo sapiens
cttcccgcagcac

SEQ ID NO: 1948821 - DNA, 17 bp, Homo sapiens
cttcccgcagcaccagc

SEQ ID NO: 1948822 - DNA, 17 bp, Homo sapiens
cttcctgtcctgctcac

SEQ ID NO: 1948823 - DNA, 20 bp, Homo sapiens
cttctaaatcataatcatcc

SEQ ID NO: 1948824 - DNA, 18 bp, Homo sapiens
cttctacaaaagaagtgt

SEQ ID NO: 1948825 - DNA, 22 bp, Homo sapiens
cttctactccatggtgaactga

SEQ ID NO: 1948826 - DNA, 23 bp, Homo sapiens
cttctactccatggtgaactgaa

SEQ ID NO: 1948827 - DNA, 13 bp, Homo sapiens
cttctattttcaa

SEQ ID NO: 1948828 - DNA, 16 bp, Homo sapiens
cttctcagctccactc

SEQ ID NO: 1948829 - DNA, 20 bp, Homo sapiens
cttctcagctccactctgaa

SEQ ID NO: 1948830 - DNA, 22 bp, Homo sapiens
cttctcagctccactctgaagt

SEQ ID NO: 1948831 - DNA, 17 bp, Homo sapiens
cttctcccctttcaaat

SEQ ID NO: 1948832 - DNA, 23 bp, Homo sapiens
cttctcccctttcaaattgcctt

SEQ ID NO: 1948833 - DNA, 16 bp, Homo sapiens
cttctctaaaacagca

SEQ ID NO: 1948834 - DNA, 20 bp, Homo sapiens
cttctctgtcctctgctttg

SEQ ID NO: 1948835 - DNA, 14 bp, Homo sapiens
cttcttgcggcacc

SEQ ID NO: 1948836 - DNA, 18 bp, Homo sapiens
cttctttactaacactgg

SEQ ID NO: 1948837 - DNA, 19 bp, Homo sapiens
cttctttactaacactggc

SEQ ID NO: 1948838 - DNA, 14 bp, Homo sapiens
cttcttttagtcag

SEQ ID NO: 1948839 - DNA, 19 bp, Homo sapiens
cttcttttagtcagaaatg

SEQ ID NO: 1948840 - DNA, 14 bp, Homo sapiens
cttgaagaactgac

SEQ ID NO: 1948841 - DNA, 13 bp, Homo sapiens
cttgaatgcttaa

SEQ ID NO: 1948842 - DNA, 19 bp, Homo sapiens
cttgaatgcttaaatgatc

SEQ ID NO: 1948843 - DNA, 20 bp, Homo sapiens
cttgacatcaagggaggaag

SEQ ID NO: 1948844 - DNA, 16 bp, Homo sapiens
cttgagcattcaaatg

SEQ ID NO: 1948845 - DNA, 16 bp, Homo sapiens
cttgaggccaaatgag

SEQ ID NO: 1948846 - DNA, 19 bp, Homo sapiens
cttgattttaattcaggtg

SEQ ID NO: 1948847 - DNA, 22 bp, Homo sapiens
cttgcggcaccgcccacccaca

SEQ ID NO: 1948848 - DNA, 18 bp, Homo sapiens
cttgctgtgaaacagtgt

SEQ ID NO: 1948849 - DNA, 15 bp, Homo sapiens
cttgctgtgacttat

SEQ ID NO: 1948850 - DNA, 23 bp, Homo sapiens
cttggagcagagacggcagcccc

SEQ ID NO: 1948851 - DNA, 16 bp, Homo sapiens
cttggctcagacacct

SEQ ID NO: 1948852 - DNA, 21 bp, Homo sapiens
cttgggattcctcccctggaa

SEQ ID NO: 1948853 - DNA, 19 bp, Homo sapiens
cttgggcacgggagagcgc

SEQ ID NO: 1948854 - DNA, 21 bp, Homo sapiens
cttgggcacgggagagcgcca

SEQ ID NO: 1948855 - DNA, 12 bp, Homo sapiens
cttggtctcttt

SEQ ID NO: 1948856 - DNA, 22 bp, Homo sapiens
cttggtttccatcaaagccctc

SEQ ID NO: 1948857 - DNA, 14 bp, Homo sapiens
cttgtaaaactgtg

SEQ ID NO: 1948858 - DNA, 14 bp, Homo sapiens
cttgtacagaacca

SEQ ID NO: 1948859 - DNA, 21 bp, Homo sapiens
cttgtgtaatttcctgctcct

SEQ ID NO: 1948860 - DNA, 19 bp, Homo sapiens
ctttaggtaaaaagcttaa

SEQ ID NO: 1948861 - DNA, 20 bp, Homo sapiens
ctttatgattcttactgttc

SEQ ID NO: 1948862 - DNA, 15 bp, Homo sapiens
ctttatgatttcatg

SEQ ID NO: 1948863 - DNA, 16 bp, Homo sapiens
ctttatgatttcatga

SEQ ID NO: 1948864 - DNA, 14 bp, Homo sapiens
ctttcaatccacag

SEQ ID NO: 1948865 - DNA, 12 bp, Homo sapiens
ctttcctctctc

SEQ ID NO: 1948866 - DNA, 12 bp, Homo sapiens
ctttctctctgt

SEQ ID NO: 1948867 - DNA, 16 bp, Homo sapiens
ctttctctctgtgtgg

SEQ ID NO: 1948868 - DNA, 20 bp, Homo sapiens
ctttctctctgtgtggcaaa

SEQ ID NO: 1948869 - DNA, 14 bp, Homo sapiens
ctttgctgctttgt

SEQ ID NO: 1948870 - DNA, 15 bp, Homo sapiens
ctttgtgtcttttgt

SEQ ID NO: 1948871 - DNA, 22 bp, Homo sapiens
ctttgttgcttaatctagagct

SEQ ID NO: 1948872 - DNA, 18 bp, Homo sapiens
cttttaaaaaaataatat

SEQ ID NO: 1948873 - DNA, 15 bp, Homo sapiens
cttttagtcagaaat

SEQ ID NO: 1948874 - DNA, 21 bp, Homo sapiens
cttttagtcagaaatgattca

SEQ ID NO: 1948875 - DNA, 21 bp, Homo sapiens
cttttagtggttctgtgcctc

SEQ ID NO: 1948876 - DNA, 11 bp, Homo sapiens
cttttcagata

SEQ ID NO: 1948877 - DNA, 13 bp, Homo sapiens
cttttgatggcta

SEQ ID NO: 1948878 - DNA, 20 bp, Homo sapiens
cttttgctctctcattccca

SEQ ID NO: 1948879 - DNA, 19 bp, Homo sapiens
cttttgggatttgttgaaa

SEQ ID NO: 1948880 - DNA, 23 bp, Homo sapiens
cttttgttctctcttggtctctt

SEQ ID NO: 1948881 - DNA, 14 bp, Homo sapiens
cttttttaaaaaaa

SEQ ID NO: 1948882 - DNA, 12 bp, Homo sapiens
cttttttcctgt

SEQ ID NO: 1948883 - DNA, 19 bp, Homo sapiens
gaaaacaaccaaagaaaat

SEQ ID NO: 1948884 - DNA, 21 bp, Homo sapiens
gaaaaggttctgaataatgaa

SEQ ID NO: 1948885 - DNA, 19 bp, Homo sapiens
gaaaattttattgaatata

SEQ ID NO: 1948886 - DNA, 20 bp, Homo sapiens
gaaaccttttaaaaaaataa

SEQ ID NO: 1948887 - DNA, 15 bp, Homo sapiens
gaaagtaatttcaag

SEQ ID NO: 1948888 - DNA, 16 bp, Homo sapiens
gaaagtaatttcaaga

SEQ ID NO: 1948889 - DNA, 20 bp, Homo sapiens
gaaagtaatttcaagaatgt

SEQ ID NO: 1948890 - DNA, 22 bp, Homo sapiens
gaaagtaatttcaagaatgttt

SEQ ID NO: 1948891 - DNA, 17 bp, Homo sapiens
gaaatataaactgtgag

SEQ ID NO: 1948892 - DNA, 22 bp, Homo sapiens
gaaatataaactgtgagataaa

SEQ ID NO: 1948893 - DNA, 14 bp, Homo sapiens
gaaatgattcaggg

SEQ ID NO: 1948894 - DNA, 14 bp, Homo sapiens
gaaccagcactccc

SEQ ID NO: 1948895 - DNA, 17 bp, Homo sapiens
gaaccagcactcccagg

SEQ ID NO: 1948896 - DNA, 19 bp, Homo sapiens
gaaccagcactcccagggc

SEQ ID NO: 1948897 - DNA, 23 bp, Homo sapiens
gaaccagcactcccagggcccga

SEQ ID NO: 1948898 - DNA, 15 bp, Homo sapiens
gaacgggcctccccg

SEQ ID NO: 1948899 - DNA, 19 bp, Homo sapiens
gaacttggtgcctaatgtt

SEQ ID NO: 1948900 - DNA, 14 bp, Homo sapiens
gaactttaaaagaa

SEQ ID NO: 1948901 - DNA, 17 bp, Homo sapiens
gaagaactcatgtgatt

SEQ ID NO: 1948902 - DNA, 13 bp, Homo sapiens
gaagactgctatc

SEQ ID NO: 1948903 - DNA, 14 bp, Homo sapiens
gaagagtatggatt

SEQ ID NO: 1948904 - DNA, 18 bp, Homo sapiens
gaagattcagcagtgtct

SEQ ID NO: 1948905 - DNA, 18 bp, Homo sapiens
gaagcccacccgccccag

SEQ ID NO: 1948906 - DNA, 22 bp, Homo sapiens
gaagcccacccgccccagagac

SEQ ID NO: 1948907 - DNA, 23 bp, Homo sapiens
gaagcccacccgccccagagact

SEQ ID NO: 1948908 - DNA, 15 bp, Homo sapiens
gaagctcaaggctgc

SEQ ID NO: 1948909 - DNA, 12 bp, Homo sapiens
gaaggcctgagg

SEQ ID NO: 1948910 - DNA, 13 bp, Homo sapiens
gaaggcctgaggg

SEQ ID NO: 1948911 - DNA, 19 bp, Homo sapiens
gaaggcctgagggaagccc

SEQ ID NO: 1948912 - DNA, 21 bp, Homo sapiens
gaatagttgtcagaatatgta

SEQ ID NO: 1948913 - DNA, 21 bp, Homo sapiens
gaatatattgccaaatattaa

SEQ ID NO: 1948914 - DNA, 21 bp, Homo sapiens
gaatatcaagaatagttgtca

SEQ ID NO: 1948915 - DNA, 13 bp, Homo sapiens
gaatgaaatataa

SEQ ID NO: 1948916 - DNA, 19 bp, Homo sapiens
gaatgaaatataaactgtg

SEQ ID NO: 1948917 - DNA, 20 bp, Homo sapiens
gaatgaaatataaactgtga

SEQ ID NO: 1948918 - DNA, 15 bp, Homo sapiens
gaatgcttaaatgat

SEQ ID NO: 1948919 - DNA, 20 bp, Homo sapiens
gaatggattttttttttcag

SEQ ID NO: 1948920 - DNA, 23 bp, Homo sapiens
gaatggattttttttttcaggtt

SEQ ID NO: 1948921 - DNA, 15 bp, Homo sapiens
gaatttaccagaaat

SEQ ID NO: 1948922 - DNA, 17 bp, Homo sapiens
gaatttaccagaaatat

SEQ ID NO: 1948923 - DNA, 20 bp, Homo sapiens
gaatttaccagaaatatttg

SEQ ID NO: 1948924 - DNA, 22 bp, Homo sapiens
gaatttaccagaaatatttgct

SEQ ID NO: 1948925 - DNA, 12 bp, Homo sapiens
gacaacacacac

SEQ ID NO: 1948926 - DNA, 18 bp, Homo sapiens
gacactgatgggtcctgc

SEQ ID NO: 1948927 - DNA, 20 bp, Homo sapiens
gacactgatgggtcctgctg

SEQ ID NO: 1948928 - DNA, 22 bp, Homo sapiens
gacactgatgggtcctgctgct

SEQ ID NO: 1948929 - DNA, 18 bp, Homo sapiens
gacagacggacgggacag

SEQ ID NO: 1948930 - DNA, 19 bp, Homo sapiens
gacagacggacgggacagc

SEQ ID NO: 1948931 - DNA, 13 bp, Homo sapiens
gacagcggcccgg

SEQ ID NO: 1948932 - DNA, 15 bp, Homo sapiens
ttatgtcaaatggat

SEQ ID NO: 1948933 - DNA, 13 bp, Homo sapiens
ttattagaatata

SEQ ID NO: 1948934 - DNA, 12 bp, Homo sapiens
ttattcagaaat

SEQ ID NO: 1948935 - DNA, 13 bp, Homo sapiens
ttattcagaaata

SEQ ID NO: 1948936 - DNA, 20 bp, Homo sapiens
ttattgatacaacaggattt

SEQ ID NO: 1948937 - DNA, 15 bp, Homo sapiens
ttatttataacattg

SEQ ID NO: 1948938 - DNA, 13 bp, Homo sapiens
ttatttttcaatt

SEQ ID NO: 1948939 - DNA, 21 bp, Homo sapiens
ttcaaatgaagattcagcagt

SEQ ID NO: 1948940 - DNA, 14 bp, Homo sapiens
ttcaaattctctat

SEQ ID NO: 1948941 - DNA, 17 bp, Homo sapiens
ttcaacaagcctgaaag

SEQ ID NO: 1948942 - DNA, 14 bp, Homo sapiens
ttcaaccctgccct

SEQ ID NO: 1948943 - DNA, 17 bp, Homo sapiens
ttcaaccctgccctgca

SEQ ID NO: 1948944 - DNA, 20 bp, Homo sapiens
ttcaagttattcagaaatat

SEQ ID NO: 1948945 - DNA, 13 bp, Homo sapiens
ttcaatccccata

SEQ ID NO: 1948946 - DNA, 15 bp, Homo sapiens
ttcaattatgtttga

SEQ ID NO: 1948947 - DNA, 19 bp, Homo sapiens
ttcaattatgtttgaaaat

SEQ ID NO: 1948948 - DNA, 16 bp, Homo sapiens
ttcaccttctgtgcat

SEQ ID NO: 1948949 - DNA, 13 bp, Homo sapiens
ttcagaatgttgt

SEQ ID NO: 1948950 - DNA, 17 bp, Homo sapiens
ttcagataatgatggaa

SEQ ID NO: 1948951 - DNA, 19 bp, Homo sapiens
ttcaggtgataactcacca

SEQ ID NO: 1948952 - DNA, 18 bp, Homo sapiens
ttcagttatagaggtaaa

SEQ ID NO: 1948953 - DNA, 15 bp, Homo sapiens
ttcatctgaggagtc

SEQ ID NO: 1948954 - DNA, 18 bp, Homo sapiens
ttcatctgaggagtccaa

SEQ ID NO: 1948955 - DNA, 14 bp, Homo sapiens
ttcatgattagaca

SEQ ID NO: 1948956 - DNA, 16 bp, Homo sapiens
ttcatgattagacaat

SEQ ID NO: 1948957 - DNA, 18 bp, Homo sapiens
ttcatgattagacaatgt

SEQ ID NO: 1948958 - DNA, 19 bp, Homo sapiens
ttcatgcgcagtccccagg

SEQ ID NO: 1948959 - DNA, 13 bp, Homo sapiens
ttcatgcttttct

SEQ ID NO: 1948960 - DNA, 15 bp, Homo sapiens
ttcatgcttttctca

SEQ ID NO: 1948961 - DNA, 16 bp, Homo sapiens
ttcatgcttttctcat

SEQ ID NO: 1948962 - DNA, 19 bp, Homo sapiens
ttcatgcttttctcatggt

SEQ ID NO: 1948963 - DNA, 14 bp, Homo sapiens
ttcattatttttca

SEQ ID NO: 1948964 - DNA, 18 bp, Homo sapiens
ttcatttctatagccaaa

SEQ ID NO: 1948965 - DNA, 12 bp, Homo sapiens
ttcattttctct

SEQ ID NO: 1948966 - DNA, 17 bp, Homo sapiens
ttccaacctgttcacgt

SEQ ID NO: 1948967 - DNA, 19 bp, Homo sapiens
ttccaacctgttcacgtga

SEQ ID NO: 1948968 - DNA, 12 bp, Homo sapiens
ttccaagtgtgt

SEQ ID NO: 1948969 - DNA, 24 bp, Homo sapiens
ttccagcaaaatatatgtttggct

SEQ ID NO: 1948970 - DNA, 16 bp, Homo sapiens
ttccagggaaccagag

SEQ ID NO: 1948971 - DNA, 13 bp, Homo sapiens
ttcccagctggca

SEQ ID NO: 1948972 - DNA, 19 bp, Homo sapiens
ttcccatggtagactgtga

SEQ ID NO: 1948973 - DNA, 20 bp, Homo sapiens
ttcccatggtagactgtgac

SEQ ID NO: 1948974 - DNA, 19 bp, Homo sapiens
ttcccgcagcaccagcctg

SEQ ID NO: 1948975 - DNA, 16 bp, Homo sapiens
ttccgttcatctgagg

SEQ ID NO: 1948976 - DNA, 16 bp, Homo sapiens
ttcctaaatcagcatt

SEQ ID NO: 1948977 - DNA, 20 bp, Homo sapiens
ttcctaaatcagcatttttc

SEQ ID NO: 1948978 - DNA, 16 bp, Homo sapiens
ttcctacttaaacaaa

SEQ ID NO: 1948979 - DNA, 23 bp, Homo sapiens
ttcctcccctggaagttgtcctt

SEQ ID NO: 1948980 - DNA, 14 bp, Homo sapiens
ttcctcctgtctcc

SEQ ID NO: 1948981 - DNA, 12 bp, Homo sapiens
ttcctctctctc

SEQ ID NO: 1948982 - DNA, 14 bp, Homo sapiens
ttcctctctctctc

SEQ ID NO: 1948983 - DNA, 15 bp, Homo sapiens
ttcctctcttgacat

SEQ ID NO: 1948984 - DNA, 14 bp, Homo sapiens
ttcctctgaagact

SEQ ID NO: 1948985 - DNA, 19 bp, Homo sapiens
ttcctcttaatgtctcaaa

SEQ ID NO: 1948986 - DNA, 16 bp, Homo sapiens
ttcctgctcctccagt

SEQ ID NO: 1948987 - DNA, 22 bp, Homo sapiens
ttcctgctcctccagtacaata

SEQ ID NO: 1948988 - DNA, 17 bp, Homo sapiens
ttcctgcttagaattaa

SEQ ID NO: 1948989 - DNA, 15 bp, Homo sapiens
ttcctttatgattct

SEQ ID NO: 1948990 - DNA, 14 bp, Homo sapiens
ttcctttggcaata

SEQ ID NO: 1948991 - DNA, 18 bp, Homo sapiens
ttcgcagctcatcttttc

SEQ ID NO: 1948992 - DNA, 18 bp, Homo sapiens
ttctaaatcataatcatc

SEQ ID NO: 1948993 - DNA, 16 bp, Homo sapiens
ttctatagccaaagct

SEQ ID NO: 1948994 - DNA, 19 bp, Homo sapiens
ttctatagccaaagctgtt

SEQ ID NO: 1948995 - DNA, 16 bp, Homo sapiens
ttctcagctccactct

SEQ ID NO: 1948996 - DNA, 21 bp, Homo sapiens
ttctcagctccactctgaagt

SEQ ID NO: 1948997 - DNA, 18 bp, Homo sapiens
ttctcatggtattatcta

SEQ ID NO: 1948998 - DNA, 18 bp, Homo sapiens
ttctctatgtacagatga

SEQ ID NO: 1948999 - DNA, 12 bp, Homo sapiens
ttctctctgtgt

SEQ ID NO: 1949000 - DNA, 13 bp, Homo sapiens
ttctctctgtgtg

SEQ ID NO: 1949001 - DNA, 23 bp, Homo sapiens
ttctctctgtgtggcaaacattt

SEQ ID NO: 1949002 - DNA, 20 bp, Homo sapiens
ttctctgtcctctgctttgc

SEQ ID NO: 1949003 - DNA, 18 bp, Homo sapiens
ttctcttctacttcttgt

SEQ ID NO: 1949004 - DNA, 17 bp, Homo sapiens
ttctgaataatgaagat

SEQ ID NO: 1949005 - DNA, 13 bp, Homo sapiens
ttctgacagtgtt

SEQ ID NO: 1949006 - DNA, 14 bp, Homo sapiens
ttctgtcaatgaaa

SEQ ID NO: 1949007 - DNA, 18 bp, Homo sapiens
ttctgtgcatctggcctg

SEQ ID NO: 1949008 - DNA, 13 bp, Homo sapiens
ttctgtgcctctt

SEQ ID NO: 1949009 - DNA, 11 bp, Homo sapiens
ttcttcatttc

SEQ ID NO: 1949010 - DNA, 16 bp, Homo sapiens
ttcttctcccctttca

SEQ ID NO: 1949011 - DNA, 20 bp, Homo sapiens
ttcttgcactgtatccaagt

SEQ ID NO: 1949012 - DNA, 19 bp, Homo sapiens
ttcttgtaaaactgtgaca

SEQ ID NO: 1949013 - DNA, 21 bp, Homo sapiens
ttcttgtaaaactgtgacatt

SEQ ID NO: 1949014 - DNA, 19 bp, Homo sapiens
ttctttagtcatttaagaa

SEQ ID NO: 1949015 - DNA, 14 bp, Homo sapiens
ttctttccaaaggt

SEQ ID NO: 1949016 - DNA, 13 bp, Homo sapiens
ttcttttaatttt

SEQ ID NO: 1949017 - DNA, 17 bp, Homo sapiens
ttcttttagtcagaaat

SEQ ID NO: 1949018 - DNA, 19 bp, Homo sapiens
ttcttttagtcagaaatga

SEQ ID NO: 1949019 - DNA, 22 bp, Homo sapiens
ttcttttagtcagaaatgattc

SEQ ID NO: 1949020 - DNA, 17 bp, Homo sapiens
ttgacctcaaaagaaaa

SEQ ID NO: 1949021 - DNA, 16 bp, Homo sapiens
ttgagacactgtcaag

SEQ ID NO: 1949022 - DNA, 21 bp, Homo sapiens
ttgagacactgtcaagattaa

SEQ ID NO: 1949023 - DNA, 15 bp, Homo sapiens
ttgagagcagcctct

SEQ ID NO: 1949024 - DNA, 15 bp, Homo sapiens
ttgaggccaaatgag

SEQ ID NO: 1949025 - DNA, 17 bp, Homo sapiens
ttgagtttcatttttca

SEQ ID NO: 1949026 - DNA, 12 bp, Homo sapiens
ttgattgcatat

SEQ ID NO: 1949027 - DNA, 14 bp, Homo sapiens
ttgattttaattca

SEQ ID NO: 1949028 - DNA, 15 bp, Homo sapiens
ttgcactaaaagtga

SEQ ID NO: 1949029 - DNA, 19 bp, Homo sapiens
ttgcgtaaatggttttcaa

SEQ ID NO: 1949030 - DNA, 14 bp, Homo sapiens
ttgctgaataacaa

SEQ ID NO: 1949031 - DNA, 19 bp, Homo sapiens
ttgctgaataacaacaatt

SEQ ID NO: 1949032 - DNA, 21 bp, Homo sapiens
ttgctgaataacaacaattta

SEQ ID NO: 1949033 - DNA, 12 bp, Homo sapiens
ttgctgctttgt

SEQ ID NO: 1949034 - DNA, 19 bp, Homo sapiens
ttgctggaatctactagaa

SEQ ID NO: 1949035 - DNA, 15 bp, Homo sapiens
ttgctggcatttgct

SEQ ID NO: 1949036 - DNA, 17 bp, Homo sapiens
ttgctgtgaaatgactg

SEQ ID NO: 1949037 - DNA, 17 bp, Homo sapiens
ttgcttaatctagagct

SEQ ID NO: 1949038 - DNA, 21 bp, Homo sapiens
ttggagagagcaatcttgctg

SEQ ID NO: 1949039 - DNA, 19 bp, Homo sapiens
ttggagcagagacggcagc

SEQ ID NO: 1949040 - DNA, 22 bp, Homo sapiens
ttggagcagagacggcagcccc

SEQ ID NO: 1949041 - DNA, 13 bp, Homo sapiens
ttggcagagaaaa

SEQ ID NO: 1949042 - DNA, 16 bp, Homo sapiens
ttggctgccaagagtc

SEQ ID NO: 1949043 - DNA, 16 bp, Homo sapiens
ttgggaaattcttgca

SEQ ID NO: 1949044 - DNA, 20 bp, Homo sapiens
ttgggaaattcttgcactgt

SEQ ID NO: 1949045 - DNA, 17 bp, Homo sapiens
ttggtaacttgctgtga

SEQ ID NO: 1949046 - DNA, 13 bp, Homo sapiens
tgtcatctgtcag

SEQ ID NO: 1949047 - DNA, 18 bp, Homo sapiens
tgtcatctgtcagcttcc

SEQ ID NO: 1949048 - DNA, 18 bp, Homo sapiens
tgtccaggtcacaggcat

SEQ ID NO: 1949049 - DNA, 21 bp, Homo sapiens
tgtcctgctcacgtctgtgag

SEQ ID NO: 1949050 - DNA, 12 bp, Homo sapiens
tgtcctgtgtca

SEQ ID NO: 1949051 - DNA, 17 bp, Homo sapiens
tgtcctgtgtcatctgt

SEQ ID NO: 1949052 - DNA, 21 bp, Homo sapiens
tgtcgggcaagatagctcctt

SEQ ID NO: 1949053 - DNA, 19 bp, Homo sapiens
tgtctcaaaataaaaccag

SEQ ID NO: 1949054 - DNA, 16 bp, Homo sapiens
tgtctcctctgtcagt

SEQ ID NO: 1949055 - DNA, 19 bp, Homo sapiens
tgtctgttcttcatttcta

SEQ ID NO: 1949056 - DNA, 22 bp, Homo sapiens
tgtctgttcttcatttctatag

SEQ ID NO: 1949057 - DNA, 20 bp, Homo sapiens
tgtcttcaaccctgccctgc

SEQ ID NO: 1949058 - DNA, 11 bp, Homo sapiens
tgtctttaaaa

SEQ ID NO: 1949059 - DNA, 15 bp, Homo sapiens
tgtcttttgttctct

SEQ ID NO: 1949060 - DNA, 18 bp, Homo sapiens
tgtgaaacagtgtggatg

SEQ ID NO: 1949061 - DNA, 15 bp, Homo sapiens
tgtgaaagtctcctg

SEQ ID NO: 1949062 - DNA, 15 bp, Homo sapiens
tgtgacattccacag

SEQ ID NO: 1949063 - DNA, 13 bp, Homo sapiens
tgtgagataaata

SEQ ID NO: 1949064 - DNA, 22 bp, Homo sapiens
tgtgagataaatatcattatag

SEQ ID NO: 1949065 - DNA, 20 bp, Homo sapiens
tgtgagcacctttcctgaaa

SEQ ID NO: 1949066 - DNA, 15 bp, Homo sapiens
tgtgagtctgtcctt

SEQ ID NO: 1949067 - DNA, 21 bp, Homo sapiens
tgtgagtctgtcctttcccac

SEQ ID NO: 1949068 - DNA, 16 bp, Homo sapiens
tgtgatctgtccttcc

SEQ ID NO: 1949069 - DNA, 16 bp, Homo sapiens
tgtgatgtcacagttt

SEQ ID NO: 1949070 - DNA, 15 bp, Homo sapiens
tgtgatttatgcatt

SEQ ID NO: 1949071 - DNA, 21 bp, Homo sapiens
tgtgcatctggcctgggggct

SEQ ID NO: 1949072 - DNA, 21 bp, Homo sapiens
tgtgcccacccgtgttctcct

SEQ ID NO: 1949073 - DNA, 16 bp, Homo sapiens
tgtgctcatcagaaac

SEQ ID NO: 1949074 - DNA, 15 bp, Homo sapiens
tgtgctgctgggaat

SEQ ID NO: 1949075 - DNA, 18 bp, Homo sapiens
tgtgctgctgggaatgga

SEQ ID NO: 1949076 - DNA, 17 bp, Homo sapiens
tgtgctgttgattcttt

SEQ ID NO: 1949077 - DNA, 23 bp, Homo sapiens
tgtggatggaggtgatgaaaacc

SEQ ID NO: 1949078 - DNA, 16 bp, Homo sapiens
tgtggccctgtgggag

SEQ ID NO: 1949079 - DNA, 16 bp, Homo sapiens
tgtggcttaaacattt

SEQ ID NO: 1949080 - DNA, 17 bp, Homo sapiens
tgtggcttaaacatttt

SEQ ID NO: 1949081 - DNA, 14 bp, Homo sapiens
tgtgggagtccact

SEQ ID NO: 1949082 - DNA, 21 bp, Homo sapiens
tgtgtaatttcctgctcctcc

SEQ ID NO: 1949083 - DNA, 13 bp, Homo sapiens
tgtgtacaaaata

SEQ ID NO: 1949084 - DNA, 15 bp, Homo sapiens
tgtgtcatctgtcag

SEQ ID NO: 1949085 - DNA, 16 bp, Homo sapiens
tgtgtcatctgtcagc

SEQ ID NO: 1949086 - DNA, 16 bp, Homo sapiens
tgtgtcctttaaaaaa

SEQ ID NO: 1949087 - DNA, 17 bp, Homo sapiens
tgtgtcttttgttctct

SEQ ID NO: 1949088 - DNA, 15 bp, Homo sapiens
tgtgtggcaaacatt

SEQ ID NO: 1949089 - DNA, 15 bp, Homo sapiens
tgtgtgtgcaatgtt

SEQ ID NO: 1949090 - DNA, 15 bp, Homo sapiens
tgttaaataaggcct

SEQ ID NO: 1949091 - DNA, 24 bp, Homo sapiens
tgttagctcagaggagaggagcaa

SEQ ID NO: 1949092 - DNA, 17 bp, Homo sapiens
tgttataaaatctgtat

SEQ ID NO: 1949093 - DNA, 22 bp, Homo sapiens
tgttatcagtacaattctttgt

SEQ ID NO: 1949094 - DNA, 12 bp, Homo sapiens
tgttatctgtct

SEQ ID NO: 1949095 - DNA, 16 bp, Homo sapiens
tgttatctgtctttat

SEQ ID NO: 1949096 - DNA, 21 bp, Homo sapiens
tgttattcaataactattgct

SEQ ID NO: 1949097 - DNA, 15 bp, Homo sapiens
tgttcacgtgactcc

SEQ ID NO: 1949098 - DNA, 19 bp, Homo sapiens
tgttcacgtgactcctcaa

SEQ ID NO: 1949099 - DNA, 16 bp, Homo sapiens
tgttcatactttggct

SEQ ID NO: 1949100 - DNA, 10 bp, Homo sapiens
tgttccaagt

SEQ ID NO: 1949101 - DNA, 14 bp, Homo sapiens
tgttccaagtgtgt

SEQ ID NO: 1949102 - DNA, 20 bp, Homo sapiens
tgttccgttcatctgaggag

SEQ ID NO: 1949103 - DNA, 12 bp, Homo sapiens
tgttctctcttg

SEQ ID NO: 1949104 - DNA, 20 bp, Homo sapiens
tgttctctcttggtctcttt

SEQ ID NO: 1949105 - DNA, 12 bp, Homo sapiens
tgttctgtgcaa

SEQ ID NO: 1949106 - DNA, 14 bp, Homo sapiens
tgttcttcatttct

SEQ ID NO: 1949107 - DNA, 14 bp, Homo sapiens
tgttcttgagcagc

SEQ ID NO: 1949108 - DNA, 20 bp, Homo sapiens
tgttcttgtaaaactgtgac

SEQ ID NO: 1949109 - DNA, 22 bp, Homo sapiens
tgttcttgtaaaactgtgacat

SEQ ID NO: 1949110 - DNA, 23 bp, Homo sapiens
tgttcttgtaaaactgtgacatt

SEQ ID NO: 1949111 - DNA, 14 bp, Homo sapiens
tgttgattctttca

SEQ ID NO: 1949112 - DNA, 14 bp, Homo sapiens
tgtttactcacatt

SEQ ID NO: 1949113 - DNA, 20 bp, Homo sapiens
tgtttagtagctgataaaga

SEQ ID NO: 1949114 - DNA, 22 bp, Homo sapiens
tgtttagtagctgataaagaaa

SEQ ID NO: 1949115 - DNA, 22 bp, Homo sapiens
tgtttgaaaataggatttgcac

SEQ ID NO: 1949116 - DNA, 15 bp, Homo sapiens
tgtttgctgcttttg

SEQ ID NO: 1949117 - DNA, 23 bp, Homo sapiens
ttaaaaaaatcccatttatgcaa

SEQ ID NO: 1949118 - DNA, 17 bp, Homo sapiens
ttaaaaaacattttaca

SEQ ID NO: 1949119 - DNA, 20 bp, Homo sapiens
ttaaaaaagatggatttgac

SEQ ID NO: 1949120 - DNA, 24 bp, Homo sapiens
ttaaaagatggtgaactgtgagta

SEQ ID NO: 1949121 - DNA, 16 bp, Homo sapiens
ttaaaatcccaaatct

SEQ ID NO: 1949122 - DNA, 23 bp, Homo sapiens
ttaaaatcccaaatctatagcat

SEQ ID NO: 1949123 - DNA, 12 bp, Homo sapiens
ttaaatgaaata

SEQ ID NO: 1949124 - DNA, 15 bp, Homo sapiens
ttaaatgaaatactt

SEQ ID NO: 1949125 - DNA, 13 bp, Homo sapiens
ttaacattctcaa

SEQ ID NO: 1949126 - DNA, 14 bp, Homo sapiens
ttaacattctcaat

SEQ ID NO: 1949127 - DNA, 15 bp, Homo sapiens
ttaagaatttaccag

SEQ ID NO: 1949128 - DNA, 19 bp, Homo sapiens
ttaagagttactcagatga

SEQ ID NO: 1949129 - DNA, 14 bp, Homo sapiens
ttaatcatttccag

SEQ ID NO: 1949130 - DNA, 22 bp, Homo sapiens
ttaatctagagctatgcacacc

SEQ ID NO: 1949131 - DNA, 17 bp, Homo sapiens
ttaattgatagaataaa

SEQ ID NO: 1949132 - DNA, 19 bp, Homo sapiens
ttacaacacagtagtgttc

SEQ ID NO: 1949133 - DNA, 11 bp, Homo sapiens
ttacataacag

SEQ ID NO: 1949134 - DNA, 17 bp, Homo sapiens
ttacataacaggcattg

SEQ ID NO: 1949135 - DNA, 21 bp, Homo sapiens
ttacataacaggcattgcact

SEQ ID NO: 1949136 - DNA, 15 bp, Homo sapiens
ttacatacatttaaa

SEQ ID NO: 1949137 - DNA, 13 bp, Homo sapiens
ttaccagaaatat

SEQ ID NO: 1949138 - DNA, 14 bp, Homo sapiens
ttactaacactggc

SEQ ID NO: 1949139 - DNA, 13 bp, Homo sapiens
ttactgaggaaag

SEQ ID NO: 1949140 - DNA, 19 bp, Homo sapiens
ttactgaggaaagggagga

SEQ ID NO: 1949141 - DNA, 17 bp, Homo sapiens
ttagaagaaatatgagc

SEQ ID NO: 1949142 - DNA, 18 bp, Homo sapiens
ttagaatataaaaaatgt

SEQ ID NO: 1949143 - DNA, 14 bp, Homo sapiens
ttagaatattgtaa

SEQ ID NO: 1949144 - DNA, 18 bp, Homo sapiens
ttagaatcaagtctgtga

SEQ ID NO: 1949145 - DNA, 23 bp, Homo sapiens
ttagacaatgtggaattacataa

SEQ ID NO: 1949146 - DNA, 20 bp, Homo sapiens
ttagagttattttgtgtcct

SEQ ID NO: 1949147 - DNA, 23 bp, Homo sapiens
ttagcccggccaaggacactgat

SEQ ID NO: 1949148 - DNA, 14 bp, Homo sapiens
ttaggaatgctcaa

SEQ ID NO: 1949149 - DNA, 17 bp, Homo sapiens
ttaggaatgctcaatgt

SEQ ID NO: 1949150 - DNA, 18 bp, Homo sapiens
ttaggaatgctcaatgtg

SEQ ID NO: 1949151 - DNA, 21 bp, Homo sapiens
ttaggtggctgggagttttga

SEQ ID NO: 1949152 - DNA, 18 bp, Homo sapiens
ttagtacctttttaacag

SEQ ID NO: 1949153 - DNA, 19 bp, Homo sapiens
ttagtcatttaagaattta

SEQ ID NO: 1949154 - DNA, 12 bp, Homo sapiens
ttataaaatctg

SEQ ID NO: 1949155 - DNA, 17 bp, Homo sapiens
ttataaggctgactctt

SEQ ID NO: 1949156 - DNA, 21 bp, Homo sapiens
ttataaggctgactcttacta

SEQ ID NO: 1949157 - DNA, 17 bp, Homo sapiens
ttatatcagactgcttt

SEQ ID NO: 1949158 - DNA, 23 bp, Homo sapiens
ttatgcatgagaactaaatagat

SEQ ID NO: 1949159 - DNA, 13 bp, Homo sapiens
gccccagagactg

SEQ ID NO: 1949160 - DNA, 16 bp, Homo sapiens
gccccagagactgccc

SEQ ID NO: 1949161 - DNA, 19 bp, Homo sapiens
gccccagagactgcccacc

SEQ ID NO: 1949162 - DNA, 21 bp, Homo sapiens
gccccagagactgcccaccct

SEQ ID NO: 1949163 - DNA, 18 bp, Homo sapiens
gccccagctggctgggtc

SEQ ID NO: 1949164 - DNA, 14 bp, Homo sapiens
ggcccacgcagagc

SEQ ID NO: 1949165 - DNA, 18 bp, Homo sapiens
ggcccacgcagagccccg

SEQ ID NO: 1949166 - DNA, 23 bp, Homo sapiens
ggcccacgcagagccccggagca

SEQ ID NO: 1949167 - DNA, 14 bp, Homo sapiens
ggcccatggcccca

SEQ ID NO: 1949168 - DNA, 17 bp, Homo sapiens
ggcccatggccccagct

SEQ ID NO: 1949169 - DNA, 18 bp, Homo sapiens
ggcccatggccccagctg

SEQ ID NO: 1949170 - DNA, 12 bp, Homo sapiens
ggccccagctgg

SEQ ID NO: 1949171 - DNA, 14 bp, Homo sapiens
ggcccgccaccttg

SEQ ID NO: 1949172 - DNA, 18 bp, Homo sapiens
ggcccgctcaacctctca

SEQ ID NO: 1949173 - DNA, 22 bp, Homo sapiens
ggcccgctcaacctctcagatc

SEQ ID NO: 1949174 - DNA, 16 bp, Homo sapiens
ggcccggcccacgcag

SEQ ID NO: 1949175 - DNA, 20 bp, Homo sapiens
ggcccggcccacgcagagcc

SEQ ID NO: 1949176 - DNA, 18 bp, Homo sapiens
ggcccgtgcgcagccgcg

SEQ ID NO: 1949177 - DNA, 15 bp, Homo sapiens
ggccctgccctcccc

SEQ ID NO: 1949178 - DNA, 16 bp, Homo sapiens
ggccctgccctccccc

SEQ ID NO: 1949179 - DNA, 12 bp, Homo sapiens
ggccctggggtc

SEQ ID NO: 1949180 - DNA, 17 bp, Homo sapiens
ggccctgtgggagtcca

SEQ ID NO: 1949181 - DNA, 16 bp, Homo sapiens
ggccgcagggcgctcc

SEQ ID NO: 1949182 - DNA, 19 bp, Homo sapiens
ggccgcagggcgctccggc

SEQ ID NO: 1949183 - DNA, 20 bp, Homo sapiens
ggccgcagggcgctccggca

SEQ ID NO: 1949184 - DNA, 22 bp, Homo sapiens
ggccgcagggcgctccggcaga

SEQ ID NO: 1949185 - DNA, 20 bp, Homo sapiens
ggccgcctcctccagactcg

SEQ ID NO: 1949186 - DNA, 21 bp, Homo sapiens
ggccgtccctgacttcccagc

SEQ ID NO: 1949187 - DNA, 21 bp, Homo sapiens
ggcctcccgtccgtccgcccg

SEQ ID NO: 1949188 - DNA, 15 bp, Homo sapiens
ggcctgagggaagcc

SEQ ID NO: 1949189 - DNA, 18 bp, Homo sapiens
ggcctgagggaagcccac

SEQ ID NO: 1949190 - DNA, 20 bp, Homo sapiens
ggcctgagggaagcccaccc

SEQ ID NO: 1949191 - DNA, 12 bp, Homo sapiens
ggcctgcagccc

SEQ ID NO: 1949192 - DNA, 13 bp, Homo sapiens
ggcgcccacctgc

SEQ ID NO: 1949193 - DNA, 18 bp, Homo sapiens
ggcgcctgcgctcctctg

SEQ ID NO: 1949194 - DNA, 19 bp, Homo sapiens
ggcgcctgcgctcctctgc

SEQ ID NO: 1949195 - DNA, 21 bp, Homo sapiens
ggcgcctgcgctcctctgcag

SEQ ID NO: 1949196 - DNA, 23 bp, Homo sapiens
ggcgcctgcgctcctctgcagcc

SEQ ID NO: 1949197 - DNA, 16 bp, Homo sapiens
ggcgctccggcagagg

SEQ ID NO: 1949198 - DNA, 18 bp, Homo sapiens
ggcgctccggcagaggca

SEQ ID NO: 1949199 - DNA, 19 bp, Homo sapiens
ggcgctccggcagaggcag

SEQ ID NO: 1949200 - DNA, 16 bp, Homo sapiens
ggcggaggggcttgga

SEQ ID NO: 1949201 - DNA, 15 bp, Homo sapiens
ggcgggcagcccctg

SEQ ID NO: 1949202 - DNA, 14 bp, Homo sapiens
ggctaacgggcgcc

SEQ ID NO: 1949203 - DNA, 14 bp, Homo sapiens
ggctaactggcccc

SEQ ID NO: 1949204 - DNA, 18 bp, Homo sapiens
ggctaactggccccaggc

SEQ ID NO: 1949205 - DNA, 18 bp, Homo sapiens
ggctccgggctgtgtcct

SEQ ID NO: 1949206 - DNA, 17 bp, Homo sapiens
ggctctgaatctctcaa

SEQ ID NO: 1949207 - DNA, 21 bp, Homo sapiens
ggctctgaatctctcaaaatg

SEQ ID NO: 1949208 - DNA, 11 bp, Homo sapiens
ggctgagcccc

SEQ ID NO: 1949209 - DNA, 15 bp, Homo sapiens
ggctgagcccctcct

SEQ ID NO: 1949210 - DNA, 19 bp, Homo sapiens
ggctgagcccctcctctcc

SEQ ID NO: 1949211 - DNA, 20 bp, Homo sapiens
ggctgaggacggggcagagc

SEQ ID NO: 1949212 - DNA, 19 bp, Homo sapiens
ggctgcgcctgcccgcccg

SEQ ID NO: 1949213 - DNA, 14 bp, Homo sapiens
ggctggataggaga

SEQ ID NO: 1949214 - DNA, 15 bp, Homo sapiens
ggctggccctgccct

SEQ ID NO: 1949215 - DNA, 16 bp, Homo sapiens
ggctggccggtccacc

SEQ ID NO: 1949216 - DNA, 14 bp, Homo sapiens
ggctgggcagggcc

SEQ ID NO: 1949217 - DNA, 14 bp, Homo sapiens
ggcttaaacatttt

SEQ ID NO: 1949218 - DNA, 15 bp, Homo sapiens
ggcttgagtctggat

SEQ ID NO: 1949219 - DNA, 12 bp, Homo sapiens
gggaaggcctga

SEQ ID NO: 1949220 - DNA, 14 bp, Homo sapiens
gggaaggcctgagg

SEQ ID NO: 1949221 - DNA, 21 bp, Homo sapiens
gggaaggcctgagggaagccc

SEQ ID NO: 1949222 - DNA, 13 bp, Homo sapiens
gggaatcagaaag

SEQ ID NO: 1949223 - DNA, 22 bp, Homo sapiens
gggacagcggcccggcccacgc

SEQ ID NO: 1949224 - DNA, 22 bp, Homo sapiens
gggagagcgccacccgcccgcc

SEQ ID NO: 1949225 - DNA, 11 bp, Homo sapiens
gggaggctgag

SEQ ID NO: 1949226 - DNA, 21 bp, Homo sapiens
gggatgctatctcgctagcca

SEQ ID NO: 1949227 - DNA, 14 bp, Homo sapiens
gggcacaagttttt

SEQ ID NO: 1949228 - DNA, 20 bp, Homo sapiens
gggcacgggagagcgccacc

SEQ ID NO: 1949229 - DNA, 21 bp, Homo sapiens
gggcagagctgagtcggctgg

SEQ ID NO: 1949230 - DNA, 15 bp, Homo sapiens
gggcagcccctgctg

SEQ ID NO: 1949231 - DNA, 11 bp, Homo sapiens
gggcagggccg

SEQ ID NO: 1949232 - DNA, 14 bp, Homo sapiens
gggcagggccgcag

SEQ ID NO: 1949233 - DNA, 15 bp, Homo sapiens
gggcagggccgcagg

SEQ ID NO: 1949234 - DNA, 18 bp, Homo sapiens
gggcagggccgcagggcg

SEQ ID NO: 1949235 - DNA, 20 bp, Homo sapiens
gggcagggccgcagggcgct

SEQ ID NO: 1949236 - DNA, 16 bp, Homo sapiens
gggcccatggccccag

SEQ ID NO: 1949237 - DNA, 21 bp, Homo sapiens
gggcccatggccccagctggc

SEQ ID NO: 1949238 - DNA, 23 bp, Homo sapiens
gggcccgagcgcgtgccttcccc

SEQ ID NO: 1949239 - DNA, 21 bp, Homo sapiens
gggcccgctcaacctctcaga

SEQ ID NO: 1949240 - DNA, 21 bp, Homo sapiens
gggccctggggtctctgagca

SEQ ID NO: 1949241 - DNA, 15 bp, Homo sapiens
gggcgcctgcgctcc

SEQ ID NO: 1949242 - DNA, 20 bp, Homo sapiens
gggcgctccggcagaggcag

SEQ ID NO: 1949243 - DNA, 13 bp, Homo sapiens
gggctaactggcc

SEQ ID NO: 1949244 - DNA, 14 bp, Homo sapiens
gggctaactggccc

SEQ ID NO: 1949245 - DNA, 15 bp, Homo sapiens
gggctaactggcccc

SEQ ID NO: 1949246 - DNA, 17 bp, Homo sapiens
gggctaactggccccag

SEQ ID NO: 1949247 - DNA, 19 bp, Homo sapiens
gggctaactggccccaggc

SEQ ID NO: 1949248 - DNA, 12 bp, Homo sapiens
gggctgagcccc

SEQ ID NO: 1949249 - DNA, 15 bp, Homo sapiens
gggctgagcccctcc

SEQ ID NO: 1949250 - DNA, 19 bp, Homo sapiens
gggctgagcccctcctctc

SEQ ID NO: 1949251 - DNA, 20 bp, Homo sapiens
gggctgagcccctcctctcc

SEQ ID NO: 1949252 - DNA, 13 bp, Homo sapiens
gggctggccctgc

SEQ ID NO: 1949253 - DNA, 23 bp, Homo sapiens
gggctggccctgccctcccccac

SEQ ID NO: 1949254 - DNA, 17 bp, Homo sapiens
gggctgttagctcagag

SEQ ID NO: 1949255 - DNA, 15 bp, Homo sapiens
tgccctcccccacgg

SEQ ID NO: 1949256 - DNA, 12 bp, Homo sapiens
tgccctgcacct

SEQ ID NO: 1949257 - DNA, 15 bp, Homo sapiens
tgcctagtgctacag

SEQ ID NO: 1949258 - DNA, 15 bp, Homo sapiens
tgcctggcgggcagc

SEQ ID NO: 1949259 - DNA, 14 bp, Homo sapiens
tgccttgattttaa

SEQ ID NO: 1949260 - DNA, 19 bp, Homo sapiens
tgcgcagccgcgctctgcc

SEQ ID NO: 1949261 - DNA, 20 bp, Homo sapiens
tgcgcagccgcgctctgccc

SEQ ID NO: 1949262 - DNA, 19 bp, Homo sapiens
tgcgccctgacatgctaac

SEQ ID NO: 1949263 - DNA, 13 bp, Homo sapiens
tgcgctcctctgc

SEQ ID NO: 1949264 - DNA, 23 bp, Homo sapiens
tgcggaccggagcggctgaggac

SEQ ID NO: 1949265 - DNA, 18 bp, Homo sapiens
tgcggcccgtgcgcagcc

SEQ ID NO: 1949266 - DNA, 16 bp, Homo sapiens
tgctacaaaatgtgtg

SEQ ID NO: 1949267 - DNA, 19 bp, Homo sapiens
tgctaggtaaagaggtcag

SEQ ID NO: 1949268 - DNA, 13 bp, Homo sapiens
tgctatcagtctc

SEQ ID NO: 1949269 - DNA, 20 bp, Homo sapiens
tgctcaatatgatcttgata

SEQ ID NO: 1949270 - DNA, 13 bp, Homo sapiens
tgctcaatgtgct

SEQ ID NO: 1949271 - DNA, 20 bp, Homo sapiens
tgctcaatgtgctgttgatt

SEQ ID NO: 1949272 - DNA, 16 bp, Homo sapiens
tgctcacgtctgtgag

SEQ ID NO: 1949273 - DNA, 12 bp, Homo sapiens
tgctcagtattg

SEQ ID NO: 1949274 - DNA, 13 bp, Homo sapiens
tgctcagtattga

SEQ ID NO: 1949275 - DNA, 16 bp, Homo sapiens
tgctctctcattccca

SEQ ID NO: 1949276 - DNA, 19 bp, Homo sapiens
tgctgagatgtttagtagc

SEQ ID NO: 1949277 - DNA, 22 bp, Homo sapiens
tgctgagatgtttagtagctga

SEQ ID NO: 1949278 - DNA, 13 bp, Homo sapiens
tgctgctgggaat

SEQ ID NO: 1949279 - DNA, 21 bp, Homo sapiens
tgctggaccaaggtgcggacc

SEQ ID NO: 1949280 - DNA, 23 bp, Homo sapiens
tgctgtcgggcaagatagctcct

SEQ ID NO: 1949281 - DNA, 16 bp, Homo sapiens
tgctgtgaaacagtgt

SEQ ID NO: 1949282 - DNA, 13 bp, Homo sapiens
tgctgtggcatca

SEQ ID NO: 1949283 - DNA, 16 bp, Homo sapiens
tgcttaatctagagct

SEQ ID NO: 1949284 - DNA, 19 bp, Homo sapiens
tgcttaatctagagctatg

SEQ ID NO: 1949285 - DNA, 15 bp, Homo sapiens
tgcttctactccatg

SEQ ID NO: 1949286 - DNA, 18 bp, Homo sapiens
tgcttgaggccaaatgag

SEQ ID NO: 1949287 - DNA, 21 bp, Homo sapiens
tggaaaatgttctgacagcat

SEQ ID NO: 1949288 - DNA, 14 bp, Homo sapiens
tggaagttgtcctt

SEQ ID NO: 1949289 - DNA, 22 bp, Homo sapiens
tggacagtgcctaactccttac

SEQ ID NO: 1949290 - DNA, 22 bp, Homo sapiens
tggaccagttccctcagccctc

SEQ ID NO: 1949291 - DNA, 17 bp, Homo sapiens
tggagcagagacggcag

SEQ ID NO: 1949292 - DNA, 21 bp, Homo sapiens
tggagcagagacggcagcccc

SEQ ID NO: 1949293 - DNA, 12 bp, Homo sapiens
tggaggtgatga

SEQ ID NO: 1949294 - DNA, 18 bp, Homo sapiens
tggagtagagtcaggaga

SEQ ID NO: 1949295 - DNA, 12 bp, Homo sapiens
tggatcaggaaa

SEQ ID NO: 1949296 - DNA, 20 bp, Homo sapiens
tggatcaggaacccttacag

SEQ ID NO: 1949297 - DNA, 22 bp, Homo sapiens
tggatcaggaacccttacagta

SEQ ID NO: 1949298 - DNA, 17 bp, Homo sapiens
tggatggaggtgatgaa

SEQ ID NO: 1949299 - DNA, 17 bp, Homo sapiens
tggattttttttttcag

SEQ ID NO: 1949300 - DNA, 20 bp, Homo sapiens
tggattttttttttcaggtt

SEQ ID NO: 1949301 - DNA, 13 bp, Homo sapiens
tggcaaacattta

SEQ ID NO: 1949302 - DNA, 14 bp, Homo sapiens
tggcaactgtggaa

SEQ ID NO: 1949303 - DNA, 18 bp, Homo sapiens
tggcaatacctagtgata

SEQ ID NO: 1949304 - DNA, 16 bp, Homo sapiens
tggccccagctggctg

SEQ ID NO: 1949305 - DNA, 22 bp, Homo sapiens
tggccctgccctcccccacggc

SEQ ID NO: 1949306 - DNA, 16 bp, Homo sapiens
tggccctgtgggagtc

SEQ ID NO: 1949307 - DNA, 19 bp, Homo sapiens
tggccctgtgggagtccac

SEQ ID NO: 1949308 - DNA, 14 bp, Homo sapiens
tggccggctggccg

SEQ ID NO: 1949309 - DNA, 15 bp, Homo sapiens
tggccggtccacccc

SEQ ID NO: 1949310 - DNA, 20 bp, Homo sapiens
tggcgggcagcccctgctgg

SEQ ID NO: 1949311 - DNA, 14 bp, Homo sapiens
tggctacaattact

SEQ ID NO: 1949312 - DNA, 17 bp, Homo sapiens
tggctatgccttcacta

SEQ ID NO: 1949313 - DNA, 22 bp, Homo sapiens
tggctatgttttggagagagca

SEQ ID NO: 1949314 - DNA, 17 bp, Homo sapiens
tggctctaactccttga

SEQ ID NO: 1949315 - DNA, 12 bp, Homo sapiens
tggctgaaatta

SEQ ID NO: 1949316 - DNA, 14 bp, Homo sapiens
tggctgaaattatg

SEQ ID NO: 1949317 - DNA, 19 bp, Homo sapiens
tggctgaaattatgtcaaa

SEQ ID NO: 1949318 - DNA, 20 bp, Homo sapiens
tggctgtgatgtcacagttt

SEQ ID NO: 1949319 - DNA, 11 bp, Homo sapiens
tggcttaattc

SEQ ID NO: 1949320 - DNA, 13 bp, Homo sapiens
tgggaattttaac

SEQ ID NO: 1949321 - DNA, 15 bp, Homo sapiens
tgggaattttaactt

SEQ ID NO: 1949322 - DNA, 19 bp, Homo sapiens
tgggagtccactttcctct

SEQ ID NO: 1949323 - DNA, 23 bp, Homo sapiens
tgggagtccactttcctctctct

SEQ ID NO: 1949324 - DNA, 21 bp, Homo sapiens
tgggattcctcccctggaagt

SEQ ID NO: 1949325 - DNA, 18 bp, Homo sapiens
tgggcacgggagagcgcc

SEQ ID NO: 1949326 - DNA, 20 bp, Homo sapiens
tgggcagggccgcagggcgc

SEQ ID NO: 1949327 - DNA, 19 bp, Homo sapiens
tggggcccatggccccagc

SEQ ID NO: 1949328 - DNA, 23 bp, Homo sapiens
tggggcccatggccccagctggc

SEQ ID NO: 1949329 - DNA, 22 bp, Homo sapiens
tgggggctgttagctcagagga

SEQ ID NO: 1949330 - DNA, 15 bp, Homo sapiens
tggggtctctgagca

SEQ ID NO: 1949331 - DNA, 22 bp, Homo sapiens
tggggtctctgagcagtgggga

SEQ ID NO: 1949332 - DNA, 20 bp, Homo sapiens
tgggtaagggactccagaag

SEQ ID NO: 1949333 - DNA, 14 bp, Homo sapiens
tgggtcgcccctcc

SEQ ID NO: 1949334 - DNA, 15 bp, Homo sapiens
tgggttgcaaagcta

SEQ ID NO: 1949335 - DNA, 20 bp, Homo sapiens
tggtacttacccttctacaa

SEQ ID NO: 1949336 - DNA, 19 bp, Homo sapiens
tggtcatttggtggctcta

SEQ ID NO: 1949337 - DNA, 21 bp, Homo sapiens
tggtcatttggtggctctaac

SEQ ID NO: 1949338 - DNA, 20 bp, Homo sapiens
tggtctctttctttccaaag

SEQ ID NO: 1949339 - DNA, 16 bp, Homo sapiens
tggtgaactgaagcag

SEQ ID NO: 1949340 - DNA, 17 bp, Homo sapiens
tggtgcgtgtggccctg

SEQ ID NO: 1949341 - DNA, 21 bp, Homo sapiens
tggtgcgtgtggccctgtggg

SEQ ID NO: 1949342 - DNA, 15 bp, Homo sapiens
tggttacctattgct

SEQ ID NO: 1949343 - DNA, 22 bp, Homo sapiens
tggttccacaatcatctattga

SEQ ID NO: 1949344 - DNA, 16 bp, Homo sapiens
tggttcctcatggctg

SEQ ID NO: 1949345 - DNA, 14 bp, Homo sapiens
tggttctgtgcctc

SEQ ID NO: 1949346 - DNA, 13 bp, Homo sapiens
tgtaaaactgtga

SEQ ID NO: 1949347 - DNA, 22 bp, Homo sapiens
tgtaaaactgtgacattccaca

SEQ ID NO: 1949348 - DNA, 20 bp, Homo sapiens
tgtaaattttataaggctga

SEQ ID NO: 1949349 - DNA, 17 bp, Homo sapiens
tgtaactcacatgcctt

SEQ ID NO: 1949350 - DNA, 22 bp, Homo sapiens
tgtaactcacatgccttctaaa

SEQ ID NO: 1949351 - DNA, 18 bp, Homo sapiens
tgtacaaaatatccaagc

SEQ ID NO: 1949352 - DNA, 18 bp, Homo sapiens
tgtacagatgatgtaaaa

SEQ ID NO: 1949353 - DNA, 22 bp, Homo sapiens
tgtacattaaataccagccagc

SEQ ID NO: 1949354 - DNA, 17 bp, Homo sapiens
tgtacatttatgtgtga

SEQ ID NO: 1949355 - DNA, 21 bp, Homo sapiens
tgtacctgagcatatgtacac

SEQ ID NO: 1949356 - DNA, 21 bp, Homo sapiens
tgtagctagtttaaaattatt

SEQ ID NO: 1949357 - DNA, 21 bp, Homo sapiens
tgtatccaagttatttgatct

SEQ ID NO: 1949358 - DNA, 15 bp, Homo sapiens
tgtcaatatatagag

SEQ ID NO: 1949359 - DNA, 17 bp, Homo sapiens
tgtcacagtttgttcag

SEQ ID NO: 1949360 - DNA, 18 bp, Homo sapiens
tgtcacagtttgttcagt

SEQ ID NO: 1949361 - DNA, 17 bp, Homo sapiens
tgtcagaatatgtatgt

SEQ ID NO: 1949362 - DNA, 14 bp, Homo sapiens
tgtcagcttcccaa

SEQ ID NO: 1949363 - DNA, 23 bp, Homo sapiens
tgtcaggctctgaatctctcaaa

SEQ ID NO: 1949364 - DNA, 20 bp, Homo sapiens
tgtcaggggtttgcttacag

SEQ ID NO: 1949365 - DNA, 15 bp, Homo sapiens
tgtcagtttgtgaag

SEQ ID NO: 1949366 - DNA, 18 bp, Homo sapiens
tgtcagtttgtgaagtga

SEQ ID NO: 1949367 - DNA, 14 bp, Homo sapiens
ttggtctctttctt

SEQ ID NO: 1949368 - DNA, 17 bp, Homo sapiens
ttgtaaaactgtgacat

SEQ ID NO: 1949369 - DNA, 23 bp, Homo sapiens
ttgtaaaactgtgacattccaca

SEQ ID NO: 1949370 - DNA, 12 bp, Homo sapiens
ttgtaactcaca

SEQ ID NO: 1949371 - DNA, 20 bp, Homo sapiens
ttgtaactcacatgccttct

SEQ ID NO: 1949372 - DNA, 15 bp, Homo sapiens
ttgtagctagtttaa

SEQ ID NO: 1949373 - DNA, 18 bp, Homo sapiens
ttgtataagatgctgctg

SEQ ID NO: 1949374 - DNA, 17 bp, Homo sapiens
ttgtgaagtgattgaca

SEQ ID NO: 1949375 - DNA, 19 bp, Homo sapiens
ttgtgaagtgattgacatt

SEQ ID NO: 1949376 - DNA, 19 bp, Homo sapiens
ttgtgcctcatttatttat

SEQ ID NO: 1949377 - DNA, 20 bp, Homo sapiens
ttgtgtaatttcctgctcct

SEQ ID NO: 1949378 - DNA, 14 bp, Homo sapiens
ttgtgtcttttgtt

SEQ ID NO: 1949379 - DNA, 15 bp, Homo sapiens
ttgttcaccttctgt

SEQ ID NO: 1949380 - DNA, 14 bp, Homo sapiens
ttgttctctcttgg

SEQ ID NO: 1949381 - DNA, 12 bp, Homo sapiens
ttgttctgtgca

SEQ ID NO: 1949382 - DNA, 14 bp, Homo sapiens
ttgttgaaatcttt

SEQ ID NO: 1949383 - DNA, 19 bp, Homo sapiens
ttgttgaaatcttttttat

SEQ ID NO: 1949384 - DNA, 11 bp, Homo sapiens
ttgtttgctgc

SEQ ID NO: 1949385 - DNA, 14 bp, Homo sapiens
tttaaaaaaataat

SEQ ID NO: 1949386 - DNA, 19 bp, Homo sapiens
tttaaaaaaataatataaa

SEQ ID NO: 1949387 - DNA, 18 bp, Homo sapiens
tttaaaaaagatggattt

SEQ ID NO: 1949388 - DNA, 14 bp, Homo sapiens
tttaaaattattaa

SEQ ID NO: 1949389 - DNA, 23 bp, Homo sapiens
tttaaaattattaaaaattatag

SEQ ID NO: 1949390 - DNA, 16 bp, Homo sapiens
tttaacattctcaatc

SEQ ID NO: 1949391 - DNA, 21 bp, Homo sapiens
tttaagaatttaccagaaata

SEQ ID NO: 1949392 - DNA, 12 bp, Homo sapiens
tttaattcaggt

SEQ ID NO: 1949393 - DNA, 16 bp, Homo sapiens
tttactaacactggct

SEQ ID NO: 1949394 - DNA, 11 bp, Homo sapiens
tttagaaataa

SEQ ID NO: 1949395 - DNA, 21 bp, Homo sapiens
tttagattcctacttaaacaa

SEQ ID NO: 1949396 - DNA, 18 bp, Homo sapiens
tttagctaacaaaagata

SEQ ID NO: 1949397 - DNA, 21 bp, Homo sapiens
tttagtagctgataaagaaac

SEQ ID NO: 1949398 - DNA, 22 bp, Homo sapiens
tttagtcagaaatgattcaggg

SEQ ID NO: 1949399 - DNA, 10 bp, Homo sapiens
tttatgcatt

SEQ ID NO: 1949400 - DNA, 11 bp, Homo sapiens
tttatgcattt

SEQ ID NO: 1949401 - DNA, 19 bp, Homo sapiens
tttatgcatttatgcatga

SEQ ID NO: 1949402 - DNA, 17 bp, Homo sapiens
tttattaaaaccattct

SEQ ID NO: 1949403 - DNA, 20 bp, Homo sapiens
tttattatccttcacaattt

SEQ ID NO: 1949404 - DNA, 21 bp, Homo sapiens
tttcaagaatgtttcagttat

SEQ ID NO: 1949405 - DNA, 15 bp, Homo sapiens
tttcaagttattcag

SEQ ID NO: 1949406 - DNA, 23 bp, Homo sapiens
tttcaatccacagtattgttctt

SEQ ID NO: 1949407 - DNA, 12 bp, Homo sapiens
tttcaattatgt

SEQ ID NO: 1949408 - DNA, 16 bp, Homo sapiens
tttcacctatctggaa

SEQ ID NO: 1949409 - DNA, 14 bp, Homo sapiens
tttcagaatgttgt

SEQ ID NO: 1949410 - DNA, 17 bp, Homo sapiens
tttcagataatgatgga

SEQ ID NO: 1949411 - DNA, 21 bp, Homo sapiens
tttcatagataccattttgaa

SEQ ID NO: 1949412 - DNA, 19 bp, Homo sapiens
tttcatgagatgcagtatt

SEQ ID NO: 1949413 - DNA, 18 bp, Homo sapiens
tttcatgattagacaatg

SEQ ID NO: 1949414 - DNA, 21 bp, Homo sapiens
tttcatgattagacaatgtgg

SEQ ID NO: 1949415 - DNA, 18 bp, Homo sapiens
tttcatggagtagagtca

SEQ ID NO: 1949416 - DNA, 17 bp, Homo sapiens
tttcattatttttcaat

SEQ ID NO: 1949417 - DNA, 19 bp, Homo sapiens
tttcattatttttcaatta

SEQ ID NO: 1949418 - DNA, 20 bp, Homo sapiens
tttcattatttttcaattat

SEQ ID NO: 1949419 - DNA, 18 bp, Homo sapiens
tttcattttctctcctcg

SEQ ID NO: 1949420 - DNA, 16 bp, Homo sapiens
tttcatttttcatttt

SEQ ID NO: 1949421 - DNA, 13 bp, Homo sapiens
tttccaaaggttg

SEQ ID NO: 1949422 - DNA, 20 bp, Homo sapiens
tttccagctaagcctgatga

SEQ ID NO: 1949423 - DNA, 22 bp, Homo sapiens
tttcccacccactagccctctt

SEQ ID NO: 1949424 - DNA, 23 bp, Homo sapiens
tttccgtagcagttttgaaacct

SEQ ID NO: 1949425 - DNA, 16 bp, Homo sapiens
tttcctaaatcagcat

SEQ ID NO: 1949426 - DNA, 12 bp, Homo sapiens
tttcctctctct

SEQ ID NO: 1949427 - DNA, 13 bp, Homo sapiens
tttcctctctctc

SEQ ID NO: 1949428 - DNA, 23 bp, Homo sapiens
tttcctcttaatgtctcaaaata

SEQ ID NO: 1949429 - DNA, 22 bp, Homo sapiens
tttcctgctcctccagtacaat

SEQ ID NO: 1949430 - DNA, 17 bp, Homo sapiens
tttcctgcttagaatta

SEQ ID NO: 1949431 - DNA, 16 bp, Homo sapiens
tttctagcaattgctt

SEQ ID NO: 1949432 - DNA, 20 bp, Homo sapiens
tttctatagccaaagctgtt

SEQ ID NO: 1949433 - DNA, 21 bp, Homo sapiens
tttctgagtagcatatataat

SEQ ID NO: 1949434 - DNA, 22 bp, Homo sapiens
tttctgagtagcatatataatt

SEQ ID NO: 1949435 - DNA, 17 bp, Homo sapiens
tttctttagtcatttaa

SEQ ID NO: 1949436 - DNA, 15 bp, Homo sapiens
tttgaacattaatgt

SEQ ID NO: 1949437 - DNA, 13 bp, Homo sapiens
tttgacacactca

SEQ ID NO: 1949438 - DNA, 19 bp, Homo sapiens
tttgagtgtcaggctctga

SEQ ID NO: 1949439 - DNA, 22 bp, Homo sapiens
tttgattgcatattttgttata

SEQ ID NO: 1949440 - DNA, 13 bp, Homo sapiens
tttgcgtaaatgg

SEQ ID NO: 1949441 - DNA, 15 bp, Homo sapiens
tttgctcaatatgat

SEQ ID NO: 1949442 - DNA, 12 bp, Homo sapiens
tttgctgctttg

SEQ ID NO: 1949443 - DNA, 14 bp, Homo sapiens
tttgcttacagtga

SEQ ID NO: 1949444 - DNA, 21 bp, Homo sapiens
tttggaaaacgatttaattta

SEQ ID NO: 1949445 - DNA, 16 bp, Homo sapiens
tttggacgtgtgagga

SEQ ID NO: 1949446 - DNA, 21 bp, Homo sapiens
tttggcaatatcatattctaa

SEQ ID NO: 1949447 - DNA, 24 bp, Homo sapiens
tttggctatgccttcactacaaca

SEQ ID NO: 1949448 - DNA, 14 bp, Homo sapiens
tttggctgaaatta

SEQ ID NO: 1949449 - DNA, 21 bp, Homo sapiens
tttggttcctcatggctgtta

SEQ ID NO: 1949450 - DNA, 23 bp, Homo sapiens
tttgtcagtgtagatcaactcat

SEQ ID NO: 1949451 - DNA, 19 bp, Homo sapiens
tttgtgaagtgattgacat

SEQ ID NO: 1949452 - DNA, 15 bp, Homo sapiens
tttgttatagttcat

SEQ ID NO: 1949453 - DNA, 15 bp, Homo sapiens
tttgttcaccttctg

SEQ ID NO: 1949454 - DNA, 10 bp, Homo sapiens
tttgttctgt

SEQ ID NO: 1949455 - DNA, 13 bp, Homo sapiens
tttgtttgctgct

SEQ ID NO: 1949456 - DNA, 15 bp, Homo sapiens
ttttaacagcatgtg

SEQ ID NO: 1949457 - DNA, 15 bp, Homo sapiens
ttttaacttttggga

SEQ ID NO: 1949458 - DNA, 21 bp, Homo sapiens
ttttatggtactaatgaaatt

SEQ ID NO: 1949459 - DNA, 13 bp, Homo sapiens
ttttattgctgga

SEQ ID NO: 1949460 - DNA, 19 bp, Homo sapiens
ttttgattgcatattttgt

SEQ ID NO: 1949461 - DNA, 21 bp, Homo sapiens
ttttgggaaatgctgatttaa

SEQ ID NO: 1949462 - DNA, 17 bp, Homo sapiens
ttttgttcaccttctgt

SEQ ID NO: 1949463 - DNA, 22 bp, Homo sapiens
ttttgtttacaacacagtagtg

SEQ ID NO: 1949464 - DNA, 15 bp, Homo sapiens
ttttgtttcttggtg

SEQ ID NO: 1949465 - DNA, 23 bp, Homo sapiens
tttttgttcaccttctgtgcatc

SEQ ID NO: 1949466 - DNA, 12 bp, Homo sapiens
ttttttgttcat

SEQ ID NO: 1949467 - DNA, 11 bp, Homo sapiens
ttttttttcag

SEQ ID NO: 1949468 - DNA, 13 bp, Homo sapiens
ttttttttttcag

SEQ ID NO: 1949469 - DNA, 20 bp, Homo sapiens
aaaataggatttgcactgct

SEQ ID NO: 1949470 - DNA, 23 bp, Homo sapiens
aaaataggatttgcactgcttta

SEQ ID NO: 1949471 - DNA, 21 bp, Homo sapiens
aaaatatccaagcccagccta

SEQ ID NO: 1949472 - DNA, 18 bp, Homo sapiens
aaaatgtgtgcttggaaa

SEQ ID NO: 1949473 - DNA, 14 bp, Homo sapiens
aaaatgttctgaca

SEQ ID NO: 1949474 - DNA, 13 bp, Homo sapiens
aaaattaaaattt

SEQ ID NO: 1949475 - DNA, 14 bp, Homo sapiens
aaaattatctttaa

SEQ ID NO: 1949476 - DNA, 20 bp, Homo sapiens
acctccagggaatcagaaag

SEQ ID NO: 1949477 - DNA, 16 bp, Homo sapiens
acctcggacaccatct

SEQ ID NO: 1949478 - DNA, 17 bp, Homo sapiens
acctctttcggaaatga

SEQ ID NO: 1949479 - DNA, 16 bp, Homo sapiens
acctgtaggtctatga

SEQ ID NO: 1949480 - DNA, 23 bp, Homo sapiens
accttctaatccatgtgctgctg

SEQ ID NO: 1949481 - DNA, 21 bp, Homo sapiens
accttgcattttagctaattt

SEQ ID NO: 1949482 - DNA, 22 bp, Homo sapiens
accttgtacagaaccagcactc

SEQ ID NO: 1949483 - DNA, 11 bp, Homo sapiens
acctttcctga

SEQ ID NO: 1949484 - DNA, 15 bp, Homo sapiens
acctttggcttaatt

SEQ ID NO: 1949485 - DNA, 19 bp, Homo sapiens
accttttaaaaaaataata

SEQ ID NO: 1949486 - DNA, 21 bp, Homo sapiens
acgccggggctggccctgccc

SEQ ID NO: 1949487 - DNA, 23 bp, Homo sapiens
acgccggggctggccctgccctc

SEQ ID NO: 1949488 - DNA, 12 bp, Homo sapiens
acggcagcccca

SEQ ID NO: 1949489 - DNA, 14 bp, Homo sapiens
acggccgtccctga

SEQ ID NO: 1949490 - DNA, 23 bp, Homo sapiens
acggccgtccctgacttcccagc

SEQ ID NO: 1949491 - DNA, 21 bp, Homo sapiens
acgggacagcggcccggccca

SEQ ID NO: 1949492 - DNA, 21 bp, Homo sapiens
acgggagagcgccacccgccc

SEQ ID NO: 1949493 - DNA, 14 bp, Homo sapiens
acggggcagagctg

SEQ ID NO: 1949494 - DNA, 13 bp, Homo sapiens
acgtctaaactgt

SEQ ID NO: 1949495 - DNA, 12 bp, Homo sapiens
acgtctgtgagt

SEQ ID NO: 1949496 - DNA, 18 bp, Homo sapiens
acgtctgtgagtctgtcc

SEQ ID NO: 1949497 - DNA, 14 bp, Homo sapiens
actaaatagatttt

SEQ ID NO: 1949498 - DNA, 17 bp, Homo sapiens
actaaatagatttttag

SEQ ID NO: 1949499 - DNA, 12 bp, Homo sapiens
actaacactggc

SEQ ID NO: 1949500 - DNA, 14 bp, Homo sapiens
actaaccaccattt

SEQ ID NO: 1949501 - DNA, 15 bp, Homo sapiens
actaattaaactgat

SEQ ID NO: 1949502 - DNA, 23 bp, Homo sapiens
actatcagcagcggcagcagcag

SEQ ID NO: 1949503 - DNA, 22 bp, Homo sapiens
actatggtatatattttgaaag

SEQ ID NO: 1949504 - DNA, 18 bp, Homo sapiens
actatttattaaaaccat

SEQ ID NO: 1949505 - DNA, 17 bp, Homo sapiens
actcaccatttaatcat

SEQ ID NO: 1949506 - DNA, 22 bp, Homo sapiens
actcaccatttaatcatttcca

SEQ ID NO: 1949507 - DNA, 23 bp, Homo sapiens
actcaggtttccggctactgaca

SEQ ID NO: 1949508 - DNA, 20 bp, Homo sapiens
actcagtaaatcagtgcagt

SEQ ID NO: 1949509 - DNA, 13 bp, Homo sapiens
actccagaagcag

SEQ ID NO: 1949510 - DNA, 14 bp, Homo sapiens
actccagaagcagc

SEQ ID NO: 1949511 - DNA, 19 bp, Homo sapiens
actccagccccttcaatta

SEQ ID NO: 1949512 - DNA, 19 bp, Homo sapiens
actccatggtgaactgaag

SEQ ID NO: 1949513 - DNA, 16 bp, Homo sapiens
actcccagggcccgag

SEQ ID NO: 1949514 - DNA, 21 bp, Homo sapiens
actccccgcccgccctcctct

SEQ ID NO: 1949515 - DNA, 23 bp, Homo sapiens
actccccgcccgccctcctctgc

SEQ ID NO: 1949516 - DNA, 18 bp, Homo sapiens
actcgagagggctgagcc

SEQ ID NO: 1949517 - DNA, 19 bp, Homo sapiens
actcgagagggctgagccc

SEQ ID NO: 1949518 - DNA, 22 bp, Homo sapiens
actcgagagggctgagcccctc

SEQ ID NO: 1949519 - DNA, 23 bp, Homo sapiens
actcgagagggctgagcccctcc

SEQ ID NO: 1949520 - DNA, 22 bp, Homo sapiens
actctaagaaatggctttccac

SEQ ID NO: 1949521 - DNA, 14 bp, Homo sapiens
actctgagtcctca

SEQ ID NO: 1949522 - DNA, 23 bp, Homo sapiens
actcttttgagcagtaaatgtat

SEQ ID NO: 1949523 - DNA, 12 bp, Homo sapiens
actgaagcagag

SEQ ID NO: 1949524 - DNA, 16 bp, Homo sapiens
actgaagcagagtcaa

SEQ ID NO: 1949525 - DNA, 20 bp, Homo sapiens
actgatatcacgggcccgct

SEQ ID NO: 1949526 - DNA, 21 bp, Homo sapiens
actgatatcacgggcccgctc

SEQ ID NO: 1949527 - DNA, 15 bp, Homo sapiens
actgatgggtcctgc

SEQ ID NO: 1949528 - DNA, 12 bp, Homo sapiens
actgcccaccct

SEQ ID NO: 1949529 - DNA, 13 bp, Homo sapiens
actgcccaccctg

SEQ ID NO: 1949530 - DNA, 17 bp, Homo sapiens
actgcccaccctgggcc

SEQ ID NO: 1949531 - DNA, 21 bp, Homo sapiens
actgcccaccctgggcctccc

SEQ ID NO: 1949532 - DNA, 18 bp, Homo sapiens
actgctatcagtctcttg

SEQ ID NO: 1949533 - DNA, 16 bp, Homo sapiens
actgctttattttagg

SEQ ID NO: 1949534 - DNA, 13 bp, Homo sapiens
actggccccaggc

SEQ ID NO: 1949535 - DNA, 17 bp, Homo sapiens
actggctagctatatta

SEQ ID NO: 1949536 - DNA, 17 bp, Homo sapiens
actgtaaaatacttctt

SEQ ID NO: 1949537 - DNA, 22 bp, Homo sapiens
actgtagtttttgttcaccttc

SEQ ID NO: 1949538 - DNA, 23 bp, Homo sapiens
actgtagtttttgttcaccttct

SEQ ID NO: 1949539 - DNA, 17 bp, Homo sapiens
actgtcttcaaccctgc

SEQ ID NO: 1949540 - DNA, 20 bp, Homo sapiens
actgtcttcaaccctgccct

SEQ ID NO: 1949541 - DNA, 22 bp, Homo sapiens
actgtcttcaaccctgccctgc

SEQ ID NO: 1949542 - DNA, 20 bp, Homo sapiens
actgtgacacagctgagctg

SEQ ID NO: 1949543 - DNA, 14 bp, Homo sapiens
actgtgacattcca

SEQ ID NO: 1949544 - DNA, 17 bp, Homo sapiens
actgtgagataaatatc

SEQ ID NO: 1949545 - DNA, 19 bp, Homo sapiens
actgtgagataaatatcat

SEQ ID NO: 1949546 - DNA, 15 bp, Homo sapiens
actgtttactcacat

SEQ ID NO: 1949547 - DNA, 16 bp, Homo sapiens
actgtttactcacatt

SEQ ID NO: 1949548 - DNA, 21 bp, Homo sapiens
acttaaaagatggtgaactgt

SEQ ID NO: 1949549 - DNA, 17 bp, Homo sapiens
acttaaacaaaaacttt

SEQ ID NO: 1949550 - DNA, 20 bp, Homo sapiens
acttaaacaaaaactttcca

SEQ ID NO: 1949551 - DNA, 23 bp, Homo sapiens
acttaaacaaaaactttccatga

SEQ ID NO: 1949552 - DNA, 14 bp, Homo sapiens
acttaacagatcac

SEQ ID NO: 1949553 - DNA, 21 bp, Homo sapiens
acttacccttctacaaaagaa

SEQ ID NO: 1949554 - DNA, 23 bp, Homo sapiens
acttatttataacattgtaaatg

SEQ ID NO: 1949555 - DNA, 12 bp, Homo sapiens
acttcccagctg

SEQ ID NO: 1949556 - DNA, 16 bp, Homo sapiens
acttcccagctggcag

SEQ ID NO: 1949557 - DNA, 20 bp, Homo sapiens
acttcccagctggcagcgcc

SEQ ID NO: 1949558 - DNA, 22 bp, Homo sapiens
acttctattttcaagtggaaac

SEQ ID NO: 1949559 - DNA, 21 bp, Homo sapiens
acttctctgtcctctgctttg

SEQ ID NO: 1949560 - DNA, 17 bp, Homo sapiens
actttcagaatgttgtg

SEQ ID NO: 1949561 - DNA, 13 bp, Homo sapiens
actttccatgaca

SEQ ID NO: 1949562 - DNA, 17 bp, Homo sapiens
actttccatgacagtag

SEQ ID NO: 1949563 - DNA, 19 bp, Homo sapiens
actttccatgacagtagca

SEQ ID NO: 1949564 - DNA, 12 bp, Homo sapiens
actttcctctct

SEQ ID NO: 1949565 - DNA, 15 bp, Homo sapiens
actttcctctctctc

SEQ ID NO: 1949566 - DNA, 19 bp, Homo sapiens
actttctgaaattcacaaa

SEQ ID NO: 1949567 - DNA, 22 bp, Homo sapiens
actttgaacattaatgttgaaa

SEQ ID NO: 1949568 - DNA, 14 bp, Homo sapiens
actttgtgtctttt

SEQ ID NO: 1949569 - DNA, 19 bp, Homo sapiens
actttgtgtcttttgttct

SEQ ID NO: 1949570 - DNA, 14 bp, Homo sapiens
acttttagtggttc

SEQ ID NO: 1949571 - DNA, 16 bp, Homo sapiens
acttttgggatttgtt

SEQ ID NO: 1949572 - DNA, 21 bp, Homo sapiens
acttttgggatttgttgaaat

SEQ ID NO: 1949573 - DNA, 21 bp, Homo sapiens
acttttttcctgtcaatatat

SEQ ID NO: 1949574 - DNA, 13 bp, Homo sapiens
agaaaaagccctc

SEQ ID NO: 1949575 - DNA, 13 bp, Homo sapiens
agaaaagcacctc

SEQ ID NO: 1949576 - DNA, 13 bp, Homo sapiens
agaaaatacatta

SEQ ID NO: 1949577 - DNA, 18 bp, Homo sapiens
agaaaatacattattaga

SEQ ID NO: 1949578 - DNA, 17 bp, Homo sapiens
agaaaatgtgtaacaga

SEQ ID NO: 1949579 - DNA, 13 bp, Homo sapiens
agaaacaatttct

SEQ ID NO: 1949580 - DNA, 20 bp, Homo sapiens
agaaatatccctcatttcat

SEQ ID NO: 1949581 - DNA, 15 bp, Homo sapiens
agaaatggctttcca

SEQ ID NO: 1949582 - DNA, 21 bp, Homo sapiens
agaaattagggctctaatttc

SEQ ID NO: 1949583 - DNA, 22 bp, Homo sapiens
agaaattagggctctaatttcc

SEQ ID NO: 1949584 - DNA, 14 bp, Homo sapiens
agaacaacaacaaa

SEQ ID NO: 1949585 - DNA, 13 bp, Homo sapiens
agaacagggatgc

SEQ ID NO: 1949586 - DNA, 17 bp, Homo sapiens
agaaccagcactcccag

SEQ ID NO: 1949587 - DNA, 16 bp, Homo sapiens
agaacgggcctccccg

SEQ ID NO: 1949588 - DNA, 13 bp, Homo sapiens
aaaaaaaatatga

SEQ ID NO: 1949589 - DNA, 14 bp, Homo sapiens
aaaaaaatatgaga

SEQ ID NO: 1949590 - DNA, 11 bp, Homo sapiens
aaaaaaatcaa

SEQ ID NO: 1949591 - DNA, 13 bp, Homo sapiens
aaaaactttccat

SEQ ID NO: 1949592 - DNA, 22 bp, Homo sapiens
aaaaactttccatgacagtagc

SEQ ID NO: 1949593 - DNA, 23 bp, Homo sapiens
aaaaactttccatgacagtagca

SEQ ID NO: 1949594 - DNA, 16 bp, Homo sapiens
aaaaattaaaattttc

SEQ ID NO: 1949595 - DNA, 13 bp, Homo sapiens
aaaactaagttct

SEQ ID NO: 1949596 - DNA, 21 bp, Homo sapiens
aaaactgtgacattccacaga

SEQ ID NO: 1949597 - DNA, 12 bp, Homo sapiens
aaaactttccat

SEQ ID NO: 1949598 - DNA, 17 bp, Homo sapiens
aaaactttccatgacag

SEQ ID NO: 1949599 - DNA, 11 bp, Homo sapiens
aaaagaaaaca

SEQ ID NO: 1949600 - DNA, 20 bp, Homo sapiens
aaaaggttctgaataatgaa

SEQ ID NO: 1949601 - DNA, 12 bp, Homo sapiens
aaaagtgatgtg

SEQ ID NO: 1949602 - DNA, 21 bp, Homo sapiens
aaaagtgatgtgatttatgca

SEQ ID NO: 1949603 - DNA, 19 bp, Homo sapiens
aaaataaaaccagaaagag

SEQ ID NO: 1949604 - DNA, 15 bp, Homo sapiens
aaaataatataaatg

SEQ ID NO: 1949605 - DNA, 21 bp, Homo sapiens
cactgatatcacgggcccgct

SEQ ID NO: 1949606 - DNA, 20 bp, Homo sapiens
cactgatgggtcctgctgct

SEQ ID NO: 1949607 - DNA, 13 bp, Homo sapiens
cacttatttccat

SEQ ID NO: 1949608 - DNA, 19 bp, Homo sapiens
cacttttattgtataatta

SEQ ID NO: 1949609 - DNA, 16 bp, Homo sapiens
cactttttaacattct

SEQ ID NO: 1949610 - DNA, 18 bp, Homo sapiens
cacttttttcctgtcaat

SEQ ID NO: 1949611 - DNA, 13 bp, Homo sapiens
cagaaagaggaat

SEQ ID NO: 1949612 - DNA, 16 bp, Homo sapiens
cagaaatgattcaggg

SEQ ID NO: 1949613 - DNA, 14 bp, Homo sapiens
cagaacaacaacaa

SEQ ID NO: 1949614 - DNA, 15 bp, Homo sapiens
cagaacaacaacaaa

SEQ ID NO: 1949615 - DNA, 19 bp, Homo sapiens
cagaaccagcactcccagg

SEQ ID NO: 1949616 - DNA, 23 bp, Homo sapiens
cagaaccagcactcccagggccc

SEQ ID NO: 1949617 - DNA, 14 bp, Homo sapiens
cagaacgggcctcc

SEQ ID NO: 1949618 - DNA, 18 bp, Homo sapiens
cagaacgggcctccccgg

SEQ ID NO: 1949619 - DNA, 20 bp, Homo sapiens
cagactcgagagggctgagc

SEQ ID NO: 1949620 - DNA, 21 bp, Homo sapiens
cagactcgagagggctgagcc

SEQ ID NO: 1949621 - DNA, 15 bp, Homo sapiens
cagagactgcccacc

SEQ ID NO: 1949622 - DNA, 16 bp, Homo sapiens
cagagactgcccaccc

SEQ ID NO: 1949623 - DNA, 19 bp, Homo sapiens
cagagactgcccaccctgg

SEQ ID NO: 1949624 - DNA, 20 bp, Homo sapiens
cagagactgcccaccctggg

SEQ ID NO: 1949625 - DNA, 22 bp, Homo sapiens
cagagactgcccaccctgggcc

SEQ ID NO: 1949626 - DNA, 19 bp, Homo sapiens
cagagccccggagcaccac

SEQ ID NO: 1949627 - DNA, 16 bp, Homo sapiens
attactttcagaatgt

SEQ ID NO: 1949628 - DNA, 20 bp, Homo sapiens
attactttgaacattaatgt

SEQ ID NO: 1949629 - DNA, 20 bp, Homo sapiens
attagaatataaaaaatgtt

SEQ ID NO: 1949630 - DNA, 14 bp, Homo sapiens
attagacaatgtgg

SEQ ID NO: 1949631 - DNA, 12 bp, Homo sapiens
attagtagaaaa

SEQ ID NO: 1949632 - DNA, 18 bp, Homo sapiens
attagtagaaaatacatt

SEQ ID NO: 1949633 - DNA, 20 bp, Homo sapiens
attagttggcagagaaaatg

SEQ ID NO: 1949634 - DNA, 13 bp, Homo sapiens
attatagcatgta

SEQ ID NO: 1949635 - DNA, 15 bp, Homo sapiens
attatgtttgaaaat

SEQ ID NO: 1949636 - DNA, 17 bp, Homo sapiens
attattaaaaattatag

SEQ ID NO: 1949637 - DNA, 21 bp, Homo sapiens
attcaaagaatcacctaatta

SEQ ID NO: 1949638 - DNA, 23 bp, Homo sapiens
attcaaataaccctgaatcagag

SEQ ID NO: 1949639 - DNA, 14 bp, Homo sapiens
attcaaatgaagat

SEQ ID NO: 1949640 - DNA, 23 bp, Homo sapiens
attcagaaatatccctcatttca

SEQ ID NO: 1949641 - DNA, 17 bp, Homo sapiens
attcccatgaatatcaa

SEQ ID NO: 1949642 - DNA, 22 bp, Homo sapiens
agttaagcacaaccatgttctt

SEQ ID NO: 1949643 - DNA, 19 bp, Homo sapiens
agttacatacatttaaaaa

SEQ ID NO: 1949644 - DNA, 21 bp, Homo sapiens
agttagcccggccaaggacac

SEQ ID NO: 1949645 - DNA, 16 bp, Homo sapiens
agttataccagcaaaa

SEQ ID NO: 1949646 - DNA, 13 bp, Homo sapiens
agttattcagaaa

SEQ ID NO: 1949647 - DNA, 18 bp, Homo sapiens
agttatttgatctggtgc

SEQ ID NO: 1949648 - DNA, 17 bp, Homo sapiens
agttattttgtgtcctt

SEQ ID NO: 1949649 - DNA, 20 bp, Homo sapiens
agttcatagttggaaatatt

SEQ ID NO: 1949650 - DNA, 17 bp, Homo sapiens
acaaaacaacagcaaca

SEQ ID NO: 1949651 - DNA, 22 bp, Homo sapiens
acaaaatgtgtgcttggaaaat

SEQ ID NO: 1949652 - DNA, 21 bp, Homo sapiens
ccagagcgatgtgttctttgt

SEQ ID NO: 1949653 - DNA, 14 bp, Homo sapiens
ccagcaaaatatat

SEQ ID NO: 1949654 - DNA, 14 bp, Homo sapiens
ccagcactcccagg

SEQ ID NO: 1949655 - DNA, 18 bp, Homo sapiens
ccagcactcccagggccc

SEQ ID NO: 1949656 - DNA, 13 bp, Homo sapiens
ccagccagcagga

SEQ ID NO: 1949657 - DNA, 19 bp, Homo sapiens
ccagccccttcaattattt

SEQ ID NO: 1949658 - DNA, 18 bp, Homo sapiens
ccagcctcccccaggctg

SEQ ID NO: 1949659 - DNA, 16 bp, Homo sapiens
ccagcctgagccacag

SEQ ID NO: 1949660 - DNA, 18 bp, Homo sapiens
ccagcctgagccacagtg

SEQ ID NO: 1949661 - DNA, 20 bp, Homo sapiens
ccagctacaggggaggctga

SEQ ID NO: 1949662 - DNA, 20 bp, Homo sapiens
ccagctggctgggtcgcccc

SEQ ID NO: 1949663 - DNA, 22 bp, Homo sapiens
ccaggcggaggggcttggagca

SEQ ID NO: 1949664 - DNA, 23 bp, Homo sapiens
ccaggcggaggggcttggagcag

SEQ ID NO: 1949665 - DNA, 20 bp, Homo sapiens
ccaggctgcgcctgcccgcc

SEQ ID NO: 1949666 - DNA, 16 bp, Homo sapiens
ccagggaaccagagcg

SEQ ID NO: 1949667 - DNA, 17 bp, Homo sapiens
ccagggtgcaggcgcgc

SEQ ID NO: 1949668 - DNA, 23 bp, Homo sapiens
ccaggtatctgatgatgttctga

SEQ ID NO: 1949669 - DNA, 13 bp, Homo sapiens
ccagttctgatga

SEQ ID NO: 1949670 - DNA, 13 bp, Homo sapiens
ccatcccactgat

SEQ ID NO: 1949671 - DNA, 12 bp, Homo sapiens
ccatccttcccg

SEQ ID NO: 1949672 - DNA, 17 bp, Homo sapiens
ccatccttcccgcagca

SEQ ID NO: 1949673 - DNA, 15 bp, Homo sapiens
ccatggccccagctg

SEQ ID NO: 1949674 - DNA, 16 bp, Homo sapiens
ccatggtgaactgaag

SEQ ID NO: 1949675 - DNA, 23 bp, Homo sapiens
cccaacaatactttgtgtctttt

SEQ ID NO: 1949676 - DNA, 21 bp, Homo sapiens
cccaagtcaaacagtgtggct

SEQ ID NO: 1949677 - DNA, 20 bp, Homo sapiens
cccacaccccgtctgcccct

SEQ ID NO: 1949678 - DNA, 19 bp, Homo sapiens
cccacacgccggggctggc

SEQ ID NO: 1949679 - DNA, 14 bp, Homo sapiens
ctgtcagcttccca

SEQ ID NO: 1949680 - DNA, 15 bp, Homo sapiens
ctgtcagcttcccaa

SEQ ID NO: 1949681 - DNA, 15 bp, Homo sapiens
ctgtcagtctgaagc

SEQ ID NO: 1949682 - DNA, 12 bp, Homo sapiens
ctgtcctgctca

SEQ ID NO: 1949683 - DNA, 13 bp, Homo sapiens
ctgtcctttccca

SEQ ID NO: 1949684 - DNA, 16 bp, Homo sapiens
ctgtctcctctgtcag

SEQ ID NO: 1949685 - DNA, 11 bp, Homo sapiens
ctgtctctctt

SEQ ID NO: 1949686 - DNA, 13 bp, Homo sapiens
ctgtctgtctctc

SEQ ID NO: 1949687 - DNA, 16 bp, Homo sapiens
ctgtctgtctctcttt

SEQ ID NO: 1949688 - DNA, 16 bp, Homo sapiens
ctgtgaaatgactgca

SEQ ID NO: 1949689 - DNA, 16 bp, Homo sapiens
ctgtgacacagctgag

SEQ ID NO: 1949690 - DNA, 18 bp, Homo sapiens
ctgtgagtctgtcctttc

SEQ ID NO: 1949691 - DNA, 16 bp, Homo sapiens
ctgtgcatctggcctg

SEQ ID NO: 1949692 - DNA, 18 bp, Homo sapiens
ctgtgcctcttatcaagt

SEQ ID NO: 1949693 - DNA, 20 bp, Homo sapiens
ctgtgggagtccactttcct

SEQ ID NO: 1949694 - DNA, 23 bp, Homo sapiens
ctgtgggagtccactttcctctc

SEQ ID NO: 1949695 - DNA, 12 bp, Homo sapiens
ctgtgtcatctg

SEQ ID NO: 1949696 - DNA, 19 bp, Homo sapiens
ctgtgtcctaaatgcaaag

SEQ ID NO: 1949697 - DNA, 16 bp, Homo sapiens
ctgtgtggcaaacatt

SEQ ID NO: 1949698 - DNA, 19 bp, Homo sapiens
ctgttatccttaaggcata

SEQ ID NO: 1949699 - DNA, 22 bp, Homo sapiens
ctgttatctgtctttatgattt

SEQ ID NO: 1949700 - DNA, 10 bp, Homo sapiens
ctgttccaag

SEQ ID NO: 1949701 - DNA, 13 bp, Homo sapiens
ctgttccaagtgt

SEQ ID NO: 1949702 - DNA, 17 bp, Homo sapiens
ctgttccaagtgtgtgt

SEQ ID NO: 1949703 - DNA, 19 bp, Homo sapiens
ctgttccaagtgtgtgtgc

SEQ ID NO: 1949704 - DNA, 20 bp, Homo sapiens
cttaaaaattatctttaaaa

SEQ ID NO: 1949705 - DNA, 14 bp, Homo sapiens
cttaaacaaaaact

SEQ ID NO: 1949706 - DNA, 21 bp, Homo sapiens
cttaaacaaaaactttccatg

SEQ ID NO: 1949707 - DNA, 12 bp, Homo sapiens
cttaaacatttt

SEQ ID NO: 1949708 - DNA, 23 bp, Homo sapiens
cttaaacattttttgtttcttgg

SEQ ID NO: 1949709 - DNA, 16 bp, Homo sapiens
cttaacagatcacatg

SEQ ID NO: 1949710 - DNA, 19 bp, Homo sapiens
cttacccttctacaaaaga

SEQ ID NO: 1949711 - DNA, 20 bp, Homo sapiens
cttactaaccaccatttccc

SEQ ID NO: 1949712 - DNA, 18 bp, Homo sapiens
cttatttgtatttttcct

SEQ ID NO: 1949713 - DNA, 23 bp, Homo sapiens
cttcaatccccataatgcttctt

SEQ ID NO: 1949714 - DNA, 17 bp, Homo sapiens
cttcatgcgcagtcccc

SEQ ID NO: 1949715 - DNA, 22 bp, Homo sapiens
cttcatgcgcagtccccaggta

SEQ ID NO: 1949716 - DNA, 23 bp, Homo sapiens
cttcatttctatagccaaagctg

SEQ ID NO: 1949717 - DNA, 19 bp, Homo sapiens
cttcccaacaatactttgt

SEQ ID NO: 1949718 - DNA, 16 bp, Homo sapiens
cttcccagctggcagc

SEQ ID NO: 1949719 - DNA, 19 bp, Homo sapiens
cttcccagctggcagcgcc

SEQ ID NO: 1949720 - DNA, 20 bp, Homo sapiens
cttcccagctggcagcgcct

SEQ ID NO: 1949721 - DNA, 13 bp, Homo sapiens
cttccccacaata

SEQ ID NO: 1949722 - DNA, 18 bp, Homo sapiens
cttccccgtgcggcccgt

SEQ ID NO: 1949723 - DNA, 19 bp, Homo sapiens
cttccccgtgcggcccgtg

SEQ ID NO: 1949724 - DNA, 14 bp, Homo sapiens
cttcccgcagcacc

SEQ ID NO: 1949725 - DNA, 16 bp, Homo sapiens
cttcccgcagcaccag

SEQ ID NO: 1949726 - DNA, 21 bp, Homo sapiens
cttcccgcagcaccagcctga

SEQ ID NO: 1949727 - DNA, 14 bp, Homo sapiens
cttcctgtcctgct

SEQ ID NO: 1949728 - DNA, 13 bp, Homo sapiens
cttctcagctcca

SEQ ID NO: 1949729 - DNA, 15 bp, Homo sapiens
cttctcagctccact

SEQ ID NO: 1949730 - DNA, 18 bp, Homo sapiens
cttctcccctttcaaatt

SEQ ID NO: 1949731 - DNA, 14 bp, Homo sapiens
cttctgtgcatctg

SEQ ID NO: 1949732 - DNA, 18 bp, Homo sapiens
cttcttgcggcaccgccc

SEQ ID NO: 1949733 - DNA, 22 bp, Homo sapiens
cttcttttagtcagaaatgatt

SEQ ID NO: 1949734 - DNA, 14 bp, Homo sapiens
cttcttttcccatt

SEQ ID NO: 1949735 - DNA, 14 bp, Homo sapiens
cttgaccccacacg

SEQ ID NO: 1949736 - DNA, 14 bp, Homo sapiens
cttgagcagctgaa

SEQ ID NO: 1949737 - DNA, 17 bp, Homo sapiens
cttgaggccaaatgagt

SEQ ID NO: 1949738 - DNA, 15 bp, Homo sapiens
cttgcggcaccgccc

SEQ ID NO: 1949739 - DNA, 18 bp, Homo sapiens
cttgcggcaccgcccacc

SEQ ID NO: 1949740 - DNA, 17 bp, Homo sapiens
cttgctgtgaaacagtg

SEQ ID NO: 1949741 - DNA, 15 bp, Homo sapiens
cttggagcagagacg

SEQ ID NO: 1949742 - DNA, 21 bp, Homo sapiens
cttggagcagagacggcagcc

SEQ ID NO: 1949743 - DNA, 16 bp, Homo sapiens
cttgggattcctcccc

SEQ ID NO: 1949744 - DNA, 17 bp, Homo sapiens
cttgggcacgggagagc

SEQ ID NO: 1949745 - DNA, 20 bp, Homo sapiens
cttgggcacgggagagcgcc

SEQ ID NO: 1949746 - DNA, 22 bp, Homo sapiens
cttgggcacgggagagcgccac

SEQ ID NO: 1949747 - DNA, 16 bp, Homo sapiens
cttggtttccatcaaa

SEQ ID NO: 1949748 - DNA, 21 bp, Homo sapiens
cttggtttccatcaaagccct

SEQ ID NO: 1949749 - DNA, 16 bp, Homo sapiens
cttgtaaaactgtgac

SEQ ID NO: 1949750 - DNA, 19 bp, Homo sapiens
cttgtaaaactgtgacatt

SEQ ID NO: 1949751 - DNA, 16 bp, Homo sapiens
ctttaaaacttactat

SEQ ID NO: 1949752 - DNA, 23 bp, Homo sapiens
ctttaaaatgattcacttttatt

SEQ ID NO: 1949753 - DNA, 14 bp, Homo sapiens
ctttactaacactg

SEQ ID NO: 1949754 - DNA, 16 bp, Homo sapiens
ctttagtcatttaaga

SEQ ID NO: 1949755 - DNA, 21 bp, Homo sapiens
ctttatgattcttactgttct

SEQ ID NO: 1949756 - DNA, 15 bp, Homo sapiens
ctttcaatccacagt

SEQ ID NO: 1949757 - DNA, 14 bp, Homo sapiens
ctttcagaatgttg

SEQ ID NO: 1949758 - DNA, 15 bp, Homo sapiens
ctttcagaatgttgt

SEQ ID NO: 1949759 - DNA, 19 bp, Homo sapiens
ctttccatgacagtagcat

SEQ ID NO: 1949760 - DNA, 14 bp, Homo sapiens
ctttcctctctctc

SEQ ID NO: 1949761 - DNA, 14 bp, Homo sapiens
ctttcggaaatgat

SEQ ID NO: 1949762 - DNA, 18 bp, Homo sapiens
ctttctgcagaaaattct

SEQ ID NO: 1949763 - DNA, 14 bp, Homo sapiens
ctttctttccaaag

SEQ ID NO: 1949764 - DNA, 19 bp, Homo sapiens
ctttgtctttctgcagaaa

SEQ ID NO: 1949765 - DNA, 13 bp, Homo sapiens
ctttgtgtctttt

SEQ ID NO: 1949766 - DNA, 19 bp, Homo sapiens
ctttgtgtcttttgttctc

SEQ ID NO: 1949767 - DNA, 21 bp, Homo sapiens
ctttgttgcttaatctagagc

SEQ ID NO: 1949768 - DNA, 16 bp, Homo sapiens
cttttagtcagaaatg

SEQ ID NO: 1949769 - DNA, 17 bp, Homo sapiens
cttttagtcagaaatga

SEQ ID NO: 1949770 - DNA, 20 bp, Homo sapiens
cttttagtcagaaatgattc

SEQ ID NO: 1949771 - DNA, 22 bp, Homo sapiens
cttttagtcagaaatgattcag

SEQ ID NO: 1949772 - DNA, 23 bp, Homo sapiens
cttttagtggttctgtgcctctt

SEQ ID NO: 1949773 - DNA, 15 bp, Homo sapiens
cttttcagataatga

SEQ ID NO: 1949774 - DNA, 17 bp, Homo sapiens
cttttcagataatgatg

SEQ ID NO: 1949775 - DNA, 18 bp, Homo sapiens
cttttcctgcttagaatt

SEQ ID NO: 1949776 - DNA, 15 bp, Homo sapiens
cttttgagcagtaaa

SEQ ID NO: 1949777 - DNA, 14 bp, Homo sapiens
cttttgctctctca

SEQ ID NO: 1949778 - DNA, 16 bp, Homo sapiens
cttttttcctgtcaat

SEQ ID NO: 1949779 - DNA, 17 bp, Homo sapiens
cttttttcctgtcaata

SEQ ID NO: 1949780 - DNA, 19 bp, Homo sapiens
cttttttcctgtcaatata

SEQ ID NO: 1949781 - DNA, 20 bp, Homo sapiens
gaaaacaaccaaagaaaatt

SEQ ID NO: 1949782 - DNA, 18 bp, Homo sapiens
gaaaacgatttaatttat

SEQ ID NO: 1949783 - DNA, 17 bp, Homo sapiens
gaaaagcacctcttgaa

SEQ ID NO: 1949784 - DNA, 19 bp, Homo sapiens
gaaaaggcttgagtctgga

SEQ ID NO: 1949785 - DNA, 20 bp, Homo sapiens
gaaaaggcttgagtctggat

SEQ ID NO: 1949786 - DNA, 14 bp, Homo sapiens
gaaaataggatttg

SEQ ID NO: 1949787 - DNA, 15 bp, Homo sapiens
gaaaataggatttgc

SEQ ID NO: 1949788 - DNA, 14 bp, Homo sapiens
gaaaatgctgccta

SEQ ID NO: 1949789 - DNA, 15 bp, Homo sapiens
taaatgaaatacttg

SEQ ID NO: 1949790 - DNA, 22 bp, Homo sapiens
taaatgaaatacttgacaacat

SEQ ID NO: 1949791 - DNA, 15 bp, Homo sapiens
taaatgaatgaaata

SEQ ID NO: 1949792 - DNA, 21 bp, Homo sapiens
taaatgaccatccagtagaga

SEQ ID NO: 1949793 - DNA, 19 bp, Homo sapiens
taaatgtatattgatgtaa

SEQ ID NO: 1949794 - DNA, 21 bp, Homo sapiens
taaattccaatacaagttaca

SEQ ID NO: 1949795 - DNA, 17 bp, Homo sapiens
taacaacaatttaggaa

SEQ ID NO: 1949796 - DNA, 23 bp, Homo sapiens
taacaacaatttaggaatgctca

SEQ ID NO: 1949797 - DNA, 15 bp, Homo sapiens
taacactatcatagt

SEQ ID NO: 1949798 - DNA, 22 bp, Homo sapiens
taacagagttgaggttgttaaa

SEQ ID NO: 1949799 - DNA, 12 bp, Homo sapiens
taacattgtaaa

SEQ ID NO: 1949800 - DNA, 19 bp, Homo sapiens
taaccctgaatcagaggca

SEQ ID NO: 1949801 - DNA, 17 bp, Homo sapiens
taaccttatcataaatt

SEQ ID NO: 1949802 - DNA, 22 bp, Homo sapiens
taactacctttggcttaattcc

SEQ ID NO: 1949803 - DNA, 15 bp, Homo sapiens
taactccttacagaa

SEQ ID NO: 1949804 - DNA, 12 bp, Homo sapiens
taactggcccca

SEQ ID NO: 1949805 - DNA, 14 bp, Homo sapiens
taactggccccagg

SEQ ID NO: 1949806 - DNA, 14 bp, Homo sapiens
taacttgctgtgaa

SEQ ID NO: 1949807 - DNA, 14 bp, Homo sapiens
taacttttgggatt

SEQ ID NO: 1949808 - DNA, 17 bp, Homo sapiens
taacttttgggatttgt

SEQ ID NO: 1949809 - DNA, 23 bp, Homo sapiens
taagaatttaccagaaatatttg

SEQ ID NO: 1949810 - DNA, 17 bp, Homo sapiens
taagataattaaatgaa

SEQ ID NO: 1949811 - DNA, 18 bp, Homo sapiens
taagataattaaatgaaa

SEQ ID NO: 1949812 - DNA, 20 bp, Homo sapiens
taagcacaaccatgttcttg

SEQ ID NO: 1949813 - DNA, 21 bp, Homo sapiens
taagcacaaccatgttcttga

SEQ ID NO: 1949814 - DNA, 19 bp, Homo sapiens
taagggactccagaagcag

SEQ ID NO: 1949815 - DNA, 20 bp, Homo sapiens
taagggactccagaagcagc

SEQ ID NO: 1949816 - DNA, 22 bp, Homo sapiens
taagggactccagaagcagcag

SEQ ID NO: 1949817 - DNA, 22 bp, Homo sapiens
taaggggaattaacaattgcca

SEQ ID NO: 1949818 - DNA, 16 bp, Homo sapiens
taatatagggtttgtt

SEQ ID NO: 1949819 - DNA, 23 bp, Homo sapiens
taatatagggtttgtttgctgct

SEQ ID NO: 1949820 - DNA, 20 bp, Homo sapiens
taatcatccttttttaaaaa

SEQ ID NO: 1949821 - DNA, 15 bp, Homo sapiens
taatcatttccagca

SEQ ID NO: 1949822 - DNA, 22 bp, Homo sapiens
taatcatttccagcaaaatata

SEQ ID NO: 1949823 - DNA, 22 bp, Homo sapiens
taatccatgtgctgctgtggca

SEQ ID NO: 1949824 - DNA, 16 bp, Homo sapiens
taatctagagctatgc

SEQ ID NO: 1949825 - DNA, 20 bp, Homo sapiens
taatgaaatttacagtgata

SEQ ID NO: 1949826 - DNA, 13 bp, Homo sapiens
taatgcagaattg

SEQ ID NO: 1949827 - DNA, 17 bp, Homo sapiens
taatgtctcaaaataaa

SEQ ID NO: 1949828 - DNA, 14 bp, Homo sapiens
taattaacatatca

SEQ ID NO: 1949829 - DNA, 20 bp, Homo sapiens
taattcaggtgataactcac

SEQ ID NO: 1949830 - DNA, 20 bp, Homo sapiens
taatttaggagttttgagaa

SEQ ID NO: 1949831 - DNA, 14 bp, Homo sapiens
tacaaaagaagtgt

SEQ ID NO: 1949832 - DNA, 23 bp, Homo sapiens
tacaaaagaagtgtgactagata

SEQ ID NO: 1949833 - DNA, 14 bp, Homo sapiens
tacaaaatgtgtgc

SEQ ID NO: 1949834 - DNA, 13 bp, Homo sapiens
tacaacacagtag

SEQ ID NO: 1949835 - DNA, 19 bp, Homo sapiens
tacaacacagtagtgttct

SEQ ID NO: 1949836 - DNA, 23 bp, Homo sapiens
tacaacaggattttcaagttatt

SEQ ID NO: 1949837 - DNA, 19 bp, Homo sapiens
tacaattctttgttgctta

SEQ ID NO: 1949838 - DNA, 21 bp, Homo sapiens
tacagaaccagcactcccagg

SEQ ID NO: 1949839 - DNA, 20 bp, Homo sapiens
tacagattttatggtactaa

SEQ ID NO: 1949840 - DNA, 20 bp, Homo sapiens
tacataacaggcattgcact

SEQ ID NO: 1949841 - DNA, 21 bp, Homo sapiens
tacataacaggcattgcacta

SEQ ID NO: 1949842 - DNA, 15 bp, Homo sapiens
tacatacatttaaaa

SEQ ID NO: 1949843 - DNA, 22 bp, Homo sapiens
tacataccacacttaaaagatg

SEQ ID NO: 1949844 - DNA, 22 bp, Homo sapiens
tacatgatgatttcagaaacaa

SEQ ID NO: 1949845 - DNA, 15 bp, Homo sapiens
tacattattagaata

SEQ ID NO: 1949846 - DNA, 20 bp, Homo sapiens
tacatttatgtgtgaagcaa

SEQ ID NO: 1949847 - DNA, 12 bp, Homo sapiens
taccagaaatat

SEQ ID NO: 1949848 - DNA, 21 bp, Homo sapiens
taccagaaatatttgctcaat

SEQ ID NO: 1949849 - DNA, 18 bp, Homo sapiens
tacctctgcataaatatt

SEQ ID NO: 1949850 - DNA, 14 bp, Homo sapiens
tacctttttaacag

SEQ ID NO: 1949851 - DNA, 22 bp, Homo sapiens
tacggatttagctaacaaaaga

SEQ ID NO: 1949852 - DNA, 21 bp, Homo sapiens
tactgatgagacaacacacac

SEQ ID NO: 1949853 - DNA, 21 bp, Homo sapiens
tactgccacggtcctttgagt

SEQ ID NO: 1949854 - DNA, 14 bp, Homo sapiens
tacttaaacaaaaa

SEQ ID NO: 1949855 - DNA, 18 bp, Homo sapiens
tacttaaacaaaaacttt

SEQ ID NO: 1949856 - DNA, 19 bp, Homo sapiens
tacttaaacaaaaactttc

SEQ ID NO: 1949857 - DNA, 21 bp, Homo sapiens
tacttaaacaaaaactttcca

SEQ ID NO: 1949858 - DNA, 18 bp, Homo sapiens
tacttacccttctacaaa

SEQ ID NO: 1949859 - DNA, 23 bp, Homo sapiens
tacttacccttctacaaaagaag

SEQ ID NO: 1949860 - DNA, 17 bp, Homo sapiens
tacttatttataacatt

SEQ ID NO: 1949861 - DNA, 16 bp, Homo sapiens
tactttcagaatgttg

SEQ ID NO: 1949862 - DNA, 19 bp, Homo sapiens
tactttgaacattaatgtt

SEQ ID NO: 1949863 - DNA, 13 bp, Homo sapiens
tactttgtgtctt

SEQ ID NO: 1949864 - DNA, 15 bp, Homo sapiens
tactttgtgtctttt

SEQ ID NO: 1949865 - DNA, 18 bp, Homo sapiens
tagaaaatacattattag

SEQ ID NO: 1949866 - DNA, 20 bp, Homo sapiens
tagaaaatacattattagaa

SEQ ID NO: 1949867 - DNA, 19 bp, Homo sapiens
tagaacaaaagaggattag

SEQ ID NO: 1949868 - DNA, 16 bp, Homo sapiens
tagaactttaaaagaa

SEQ ID NO: 1949869 - DNA, 13 bp, Homo sapiens
tagaatattgtaa

SEQ ID NO: 1949870 - DNA, 18 bp, Homo sapiens
tagaatcaagtctgtgaa

SEQ ID NO: 1949871 - DNA, 20 bp, Homo sapiens
tagacaatgtggaattacat

SEQ ID NO: 1949872 - DNA, 21 bp, Homo sapiens
tagacaatgtggaattacata

SEQ ID NO: 1949873 - DNA, 13 bp, Homo sapiens
tagagatttccca

SEQ ID NO: 1949874 - DNA, 17 bp, Homo sapiens
tagagctatgcacacca

SEQ ID NO: 1949875 - DNA, 17 bp, Homo sapiens
tagagggtccagtcttc

SEQ ID NO: 1949876 - DNA, 19 bp, Homo sapiens
tagattcctacttaaacaa

SEQ ID NO: 1949877 - DNA, 23 bp, Homo sapiens
tagattcctacttaaacaaaaac

SEQ ID NO: 1949878 - DNA, 13 bp, Homo sapiens
tagcagttttgaa

SEQ ID NO: 1949879 - DNA, 16 bp, Homo sapiens
tagcatactgatgaga

SEQ ID NO: 1949880 - DNA, 18 bp, Homo sapiens
tagcatatataattttat

SEQ ID NO: 1949881 - DNA, 20 bp, Homo sapiens
tagcatttaaagataccaaa

SEQ ID NO: 1949882 - DNA, 17 bp, Homo sapiens
tagccagaggctctaat

SEQ ID NO: 1949883 - DNA, 19 bp, Homo sapiens
tagccctctttctctctgt

SEQ ID NO: 1949884 - DNA, 20 bp, Homo sapiens
tagccctctttctctctgtg

SEQ ID NO: 1949885 - DNA, 21 bp, Homo sapiens
tagccctctttctctctgtgt

SEQ ID NO: 1949886 - DNA, 14 bp, Homo sapiens
tagctaacaaaaga

SEQ ID NO: 1949887 - DNA, 18 bp, Homo sapiens
tagctcagaggagaggag

SEQ ID NO: 1949888 - DNA, 14 bp, Homo sapiens
tagctccttcatgc

SEQ ID NO: 1949889 - DNA, 14 bp, Homo sapiens
tagctgataaagaa

SEQ ID NO: 1949890 - DNA, 13 bp, Homo sapiens
taggaatgctcaa

SEQ ID NO: 1949891 - DNA, 16 bp, Homo sapiens
taggaatgctcaatgt

SEQ ID NO: 1949892 - DNA, 12 bp, Homo sapiens
taggagaggaaa

SEQ ID NO: 1949893 - DNA, 16 bp, Homo sapiens
tagggctctaatttcc

SEQ ID NO: 1949894 - DNA, 19 bp, Homo sapiens
taggtctgcacacataaca

SEQ ID NO: 1949895 - DNA, 21 bp, Homo sapiens
tagtaagcaccagctgcctct

SEQ ID NO: 1949896 - DNA, 15 bp, Homo sapiens
tagtagctgataaag

SEQ ID NO: 1949897 - DNA, 13 bp, Homo sapiens
tagtcagaaatga

SEQ ID NO: 1949898 - DNA, 20 bp, Homo sapiens
tagtcagaaatgattcaggg

SEQ ID NO: 1949899 - DNA, 17 bp, Homo sapiens
tagtcatttaagaattt

SEQ ID NO: 1949900 - DNA, 23 bp, Homo sapiens
tagtgtcacttttttcctgtcaa

SEQ ID NO: 1949901 - DNA, 17 bp, Homo sapiens
ggattcctcccctggaa

SEQ ID NO: 1949902 - DNA, 14 bp, Homo sapiens
ggattgaggatgaa

SEQ ID NO: 1949903 - DNA, 18 bp, Homo sapiens
ggattttcaagttattca

SEQ ID NO: 1949904 - DNA, 20 bp, Homo sapiens
ggcaaaccaatttgttctgt

SEQ ID NO: 1949905 - DNA, 17 bp, Homo sapiens
ggcaagatagctccttc

SEQ ID NO: 1949906 - DNA, 20 bp, Homo sapiens
ggcaatatcatattctaaaa

SEQ ID NO: 1949907 - DNA, 13 bp, Homo sapiens
ggcaccgcccacc

SEQ ID NO: 1949908 - DNA, 17 bp, Homo sapiens
ggcaccgcccacccaca

SEQ ID NO: 1949909 - DNA, 19 bp, Homo sapiens
ggcacgggagagcgccacc

SEQ ID NO: 1949910 - DNA, 20 bp, Homo sapiens
ggcagagctgagtcggctgg

SEQ ID NO: 1949911 - DNA, 12 bp, Homo sapiens
ggcagaggcagg

SEQ ID NO: 1949912 - DNA, 16 bp, Homo sapiens
ggcagaggcagggccc

SEQ ID NO: 1949913 - DNA, 14 bp, Homo sapiens
ggcagcagcagcag

SEQ ID NO: 1949914 - DNA, 22 bp, Homo sapiens
ggcagccccatccttcccgcag

SEQ ID NO: 1949915 - DNA, 23 bp, Homo sapiens
ggcagccccatccttcccgcagc

SEQ ID NO: 1949916 - DNA, 18 bp, Homo sapiens
ggcagcccctgctggacc

SEQ ID NO: 1949917 - DNA, 19 bp, Homo sapiens
ggcagcccctgctggacca

SEQ ID NO: 1949918 - DNA, 17 bp, Homo sapiens
ggcagcgcctcccgccg

SEQ ID NO: 1949919 - DNA, 20 bp, Homo sapiens
ggcagcgcctcccgccgcct

SEQ ID NO: 1949920 - DNA, 23 bp, Homo sapiens
ggcagggccctggggtctctgag

SEQ ID NO: 1949921 - DNA, 16 bp, Homo sapiens
ggcagggccgcagggc

SEQ ID NO: 1949922 - DNA, 14 bp, Homo sapiens
ggcatttgctgaat

SEQ ID NO: 1949923 - DNA, 15 bp, Homo sapiens
ggcccacgcagagcc

SEQ ID NO: 1949924 - DNA, 17 bp, Homo sapiens
ggcccacgcagagcccc

SEQ ID NO: 1949925 - DNA, 15 bp, Homo sapiens
ggcccatggccccag

SEQ ID NO: 1949926 - DNA, 21 bp, Homo sapiens
ggcccatggccccagctggct

SEQ ID NO: 1949927 - DNA, 14 bp, Homo sapiens
ggccccagctggct

SEQ ID NO: 1949928 - DNA, 14 bp, Homo sapiens
ggcccccctctcgg

SEQ ID NO: 1949929 - DNA, 18 bp, Homo sapiens
ggcccccggaggcgccca

SEQ ID NO: 1949930 - DNA, 20 bp, Homo sapiens
ggcccccggaggcgcccacc

SEQ ID NO: 1949931 - DNA, 22 bp, Homo sapiens
ggcccccggaggcgcccacctg

SEQ ID NO: 1949932 - DNA, 18 bp, Homo sapiens
ggccccgcgcgtgccccc

SEQ ID NO: 1949933 - DNA, 22 bp, Homo sapiens
gtgcgcagccgcgctctgcccc

SEQ ID NO: 1949934 - DNA, 22 bp, Homo sapiens
gtgcgtgaccggcccgccacct

SEQ ID NO: 1949935 - DNA, 21 bp, Homo sapiens
gtgcgtgtggccctgtgggag

SEQ ID NO: 1949936 - DNA, 22 bp, Homo sapiens
gtggaattacataacaggcatt

SEQ ID NO: 1949937 - DNA, 21 bp, Homo sapiens
gtgggagtccactttcctctc

SEQ ID NO: 1949938 - DNA, 19 bp, Homo sapiens
gtggggcccatggccccag

SEQ ID NO: 1949939 - DNA, 19 bp, Homo sapiens
gtgtaacagagttgaggtt

SEQ ID NO: 1949940 - DNA, 18 bp, Homo sapiens
gtgtacatttatgtgtga

SEQ ID NO: 1949941 - DNA, 23 bp, Homo sapiens
gtgtatttctattttgcagcagt

SEQ ID NO: 1949942 - DNA, 13 bp, Homo sapiens
gtgtcatctgtca

SEQ ID NO: 1949943 - DNA, 18 bp, Homo sapiens
gtgtctgttcttcatttc

SEQ ID NO: 1949944 - DNA, 17 bp, Homo sapiens
gtgtgaggcccccggag

SEQ ID NO: 1949945 - DNA, 20 bp, Homo sapiens
gtgtgcccacccgtgttctc

SEQ ID NO: 1949946 - DNA, 23 bp, Homo sapiens
gtgtggccctgtgggagtccact

SEQ ID NO: 1949947 - DNA, 17 bp, Homo sapiens
gtgtggcttaaacattt

SEQ ID NO: 1949948 - DNA, 13 bp, Homo sapiens
gtgtgtgcaatgt

SEQ ID NO: 1949949 - DNA, 13 bp, Homo sapiens
gtgttctcctcca

SEQ ID NO: 1949950 - DNA, 14 bp, Homo sapiens
gtgttctgttcact

SEQ ID NO: 1949951 - DNA, 18 bp, Homo sapiens
gttaaaatcccaaatcta

SEQ ID NO: 1949952 - DNA, 20 bp, Homo sapiens
gttaattctcagaagtgaaa

SEQ ID NO: 1949953 - DNA, 17 bp, Homo sapiens
gttaattgatagaataa

SEQ ID NO: 1949954 - DNA, 14 bp, Homo sapiens
gttacatacattta

SEQ ID NO: 1949955 - DNA, 18 bp, Homo sapiens
gttagcccggccaaggac

SEQ ID NO: 1949956 - DNA, 11 bp, Homo sapiens
gttagctcaga

SEQ ID NO: 1949957 - DNA, 13 bp, Homo sapiens
gttagctcagagg

SEQ ID NO: 1949958 - DNA, 22 bp, Homo sapiens
gttaggattaggtttagaatca

SEQ ID NO: 1949959 - DNA, 14 bp, Homo sapiens
gttagtaactttta

SEQ ID NO: 1949960 - DNA, 17 bp, Homo sapiens
gttagtaacttttagtg

SEQ ID NO: 1949961 - DNA, 16 bp, Homo sapiens
gttattactgaggaaa

SEQ ID NO: 1949962 - DNA, 13 bp, Homo sapiens
gttattcagaaat

SEQ ID NO: 1949963 - DNA, 15 bp, Homo sapiens
gttattcagaaatat

SEQ ID NO: 1949964 - DNA, 18 bp, Homo sapiens
gttcaatgctacaaaatg

SEQ ID NO: 1949965 - DNA, 24 bp, Homo sapiens
gttcaatgctacaaaatgtgtgct

SEQ ID NO: 1949966 - DNA, 20 bp, Homo sapiens
gttcaccttctgtgcatctg

SEQ ID NO: 1949967 - DNA, 20 bp, Homo sapiens
gttcacgtgactcctcaatt

SEQ ID NO: 1949968 - DNA, 19 bp, Homo sapiens
gttcatagttggaaatatt

SEQ ID NO: 1949969 - DNA, 18 bp, Homo sapiens
gttcatctgaggagtcca

SEQ ID NO: 1949970 - DNA, 12 bp, Homo sapiens
gttccagcagtt

SEQ ID NO: 1949971 - DNA, 18 bp, Homo sapiens
gttccgttcatctgagga

SEQ ID NO: 1949972 - DNA, 18 bp, Homo sapiens
gttctcctccaaatgctg

SEQ ID NO: 1949973 - DNA, 13 bp, Homo sapiens
gttctgaaatgga

SEQ ID NO: 1949974 - DNA, 16 bp, Homo sapiens
gttcttgagcagctga

SEQ ID NO: 1949975 - DNA, 14 bp, Homo sapiens
gttgaaatcttttt

SEQ ID NO: 1949976 - DNA, 17 bp, Homo sapiens
gttgacagcaacaaagc

SEQ ID NO: 1949977 - DNA, 13 bp, Homo sapiens
gttgattctttca

SEQ ID NO: 1949978 - DNA, 15 bp, Homo sapiens
gttgattctttcaat

SEQ ID NO: 1949979 - DNA, 21 bp, Homo sapiens
gtttagaatcaagtctgtgaa

SEQ ID NO: 1949980 - DNA, 18 bp, Homo sapiens
gtttagtagctgataaag

SEQ ID NO: 1949981 - DNA, 19 bp, Homo sapiens
gtttccagctaagcctgat

SEQ ID NO: 1949982 - DNA, 17 bp, Homo sapiens
gtttgctgcttttgatg

SEQ ID NO: 1949983 - DNA, 14 bp, Homo sapiens
gtttgcttacagtg

SEQ ID NO: 1949984 - DNA, 13 bp, Homo sapiens
gtttgcttctaaa

SEQ ID NO: 1949985 - DNA, 17 bp, Homo sapiens
gtttggctgaaattatg

SEQ ID NO: 1949986 - DNA, 17 bp, Homo sapiens
gtttgtgaagtgattga

SEQ ID NO: 1949987 - DNA, 20 bp, Homo sapiens
gtttgtttgctgcttttgat

SEQ ID NO: 1949988 - DNA, 23 bp, Homo sapiens
gttttcctcctgattctcttaaa

SEQ ID NO: 1949989 - DNA, 13 bp, Homo sapiens
gttttgattgcat

SEQ ID NO: 1949990 - DNA, 19 bp, Homo sapiens
gttttgattgcatattttg

SEQ ID NO: 1949991 - DNA, 22 bp, Homo sapiens
gtttttgttcaccttctgtgca

SEQ ID NO: 1949992 - DNA, 23 bp, Homo sapiens
gtttttgttcaccttctgtgcat

SEQ ID NO: 1949993 - DNA, 13 bp, Homo sapiens
gtttttttgttca

SEQ ID NO: 1949994 - DNA, 21 bp, Homo sapiens
taaaaaagatggatttgacac

SEQ ID NO: 1949995 - DNA, 21 bp, Homo sapiens
taaaaatagctataaatagtg

SEQ ID NO: 1949996 - DNA, 16 bp, Homo sapiens
taaaacagaaaaggtt

SEQ ID NO: 1949997 - DNA, 16 bp, Homo sapiens
taaaaccagaaagagg

SEQ ID NO: 1949998 - DNA, 17 bp, Homo sapiens
taaaacttactatggta

SEQ ID NO: 1949999 - DNA, 22 bp, Homo sapiens
taaaatacttctttttacaatg

SEQ ID NO: 1950000 - DNA, 13 bp, Homo sapiens
taaaattattaaa

SEQ ID NO: 1950001 - DNA, 19 bp, Homo sapiens
taaaattattaaaaattat

SEQ ID NO: 1950002 - DNA, 22 bp, Homo sapiens
taaaattattaaaaattataga

SEQ ID NO: 1950003 - DNA, 14 bp, Homo sapiens
taaacaaaaacttt

SEQ ID NO: 1950004 - DNA, 15 bp, Homo sapiens
taaacaaaaactttc

SEQ ID NO: 1950005 - DNA, 17 bp, Homo sapiens
taaacaaaaactttcca

SEQ ID NO: 1950006 - DNA, 18 bp, Homo sapiens
taaacaaaaactttccat

SEQ ID NO: 1950007 - DNA, 19 bp, Homo sapiens
taaacaaaaactttccatg

SEQ ID NO: 1950008 - DNA, 19 bp, Homo sapiens
taaacgtgaactaagattt

SEQ ID NO: 1950009 - DNA, 12 bp, Homo sapiens
taaactagcaaa

SEQ ID NO: 1950010 - DNA, 13 bp, Homo sapiens
taaactgtgagat

SEQ ID NO: 1950011 - DNA, 17 bp, Homo sapiens
taaactgtgagataaat

SEQ ID NO: 1950012 - DNA, 20 bp, Homo sapiens
taaactgtgagataaatatc

SEQ ID NO: 1950013 - DNA, 23 bp, Homo sapiens
taaaggagcagctagctgctttt

SEQ ID NO: 1950014 - DNA, 21 bp, Homo sapiens
taaaggtttcactgttcatga

SEQ ID NO: 1950015 - DNA, 19 bp, Homo sapiens
taaataatcatacacagaa

SEQ ID NO: 1950016 - DNA, 22 bp, Homo sapiens
taaatagatttttagattccta

SEQ ID NO: 1950017 - DNA, 14 bp, Homo sapiens
taaatagtgaaaat

SEQ ID NO: 1950018 - DNA, 16 bp, Homo sapiens
tagtgttctgttcact

SEQ ID NO: 1950019 - DNA, 23 bp, Homo sapiens
tagttattaatgtgatcctaaaa

SEQ ID NO: 1950020 - DNA, 16 bp, Homo sapiens
tagttggaaatatttg

SEQ ID NO: 1950021 - DNA, 15 bp, Homo sapiens
tagttggcagagaaa

SEQ ID NO: 1950022 - DNA, 14 bp, Homo sapiens
tagttgtcagaata

SEQ ID NO: 1950023 - DNA, 20 bp, Homo sapiens
tagtttaaaattattaaaaa

SEQ ID NO: 1950024 - DNA, 22 bp, Homo sapiens
tagtttttgttcaccttctgtg

SEQ ID NO: 1950025 - DNA, 20 bp, Homo sapiens
tataaaaataattaaaacaa

SEQ ID NO: 1950026 - DNA, 14 bp, Homo sapiens
tataaaatctgtat

SEQ ID NO: 1950027 - DNA, 13 bp, Homo sapiens
tataaactgtgag

SEQ ID NO: 1950028 - DNA, 14 bp, Homo sapiens
tataaactgtgaga

SEQ ID NO: 1950029 - DNA, 16 bp, Homo sapiens
tataaactgtgagata

SEQ ID NO: 1950030 - DNA, 20 bp, Homo sapiens
tataaatgaatgaaatataa

SEQ ID NO: 1950031 - DNA, 22 bp, Homo sapiens
tataaatgaatgaaatataaac

SEQ ID NO: 1950032 - DNA, 17 bp, Homo sapiens
tataatggcctcttaaa

SEQ ID NO: 1950033 - DNA, 22 bp, Homo sapiens
tataatggcctcttaaaaatta

SEQ ID NO: 1950034 - DNA, 16 bp, Homo sapiens
tatacacatcataaac

SEQ ID NO: 1950035 - DNA, 16 bp, Homo sapiens
tataccagcaaaagtg

SEQ ID NO: 1950036 - DNA, 16 bp, Homo sapiens
tatagagacttctaaa

SEQ ID NO: 1950037 - DNA, 20 bp, Homo sapiens
tatagaggtaaaatttgcac

SEQ ID NO: 1950038 - DNA, 15 bp, Homo sapiens
tatagcatgtaatat

SEQ ID NO: 1950039 - DNA, 13 bp, Homo sapiens
tatagggtttgtt

SEQ ID NO: 1950040 - DNA, 15 bp, Homo sapiens
tatatcagactgctt

SEQ ID NO: 1950041 - DNA, 15 bp, Homo sapiens
tatatctgagttgtg

SEQ ID NO: 1950042 - DNA, 14 bp, Homo sapiens
tatatgaaaactaa

SEQ ID NO: 1950043 - DNA, 14 bp, Homo sapiens
tatatgtctagata

SEQ ID NO: 1950044 - DNA, 16 bp, Homo sapiens
tatattgccaaatatt

SEQ ID NO: 1950045 - DNA, 16 bp, Homo sapiens
tatcagtacaattctt

SEQ ID NO: 1950046 - DNA, 19 bp, Homo sapiens
tatcagtacaattctttgt

SEQ ID NO: 1950047 - DNA, 21 bp, Homo sapiens
tatcattatagcatgtaatat

SEQ ID NO: 1950048 - DNA, 22 bp, Homo sapiens
tatccttaaggcatatactttg

SEQ ID NO: 1950049 - DNA, 17 bp, Homo sapiens
tatctcgctagccatat

SEQ ID NO: 1950050 - DNA, 14 bp, Homo sapiens
tatctgagttgtgc

SEQ ID NO: 1950051 - DNA, 22 bp, Homo sapiens
tatctgagttgtgcctcattta

SEQ ID NO: 1950052 - DNA, 12 bp, Homo sapiens
tatctgtcttta

SEQ ID NO: 1950053 - DNA, 17 bp, Homo sapiens
tatctgtttgcttctaa

SEQ ID NO: 1950054 - DNA, 15 bp, Homo sapiens
tatctttaaaactta

SEQ ID NO: 1950055 - DNA, 22 bp, Homo sapiens
tatgagattggaaaaaattaga

SEQ ID NO: 1950056 - DNA, 23 bp, Homo sapiens
tatgagattggaaaaaattagac

SEQ ID NO: 1950057 - DNA, 20 bp, Homo sapiens
tatgagcatgctccctcatg

SEQ ID NO: 1950058 - DNA, 20 bp, Homo sapiens
tatgatgtgctgctgggaat

SEQ ID NO: 1950059 - DNA, 12 bp, Homo sapiens
tatgatttcatg

SEQ ID NO: 1950060 - DNA, 21 bp, Homo sapiens
tatgcacaccaaattgctgag

SEQ ID NO: 1950061 - DNA, 21 bp, Homo sapiens
tatgcatgagaactaaataga

SEQ ID NO: 1950062 - DNA, 22 bp, Homo sapiens
tatgcatttatgcatgagaact

SEQ ID NO: 1950063 - DNA, 23 bp, Homo sapiens
tatggaggagagtgtttaactga

SEQ ID NO: 1950064 - DNA, 14 bp, Homo sapiens
tatggtatatattt

SEQ ID NO: 1950065 - DNA, 13 bp, Homo sapiens
tatgtacagatga

SEQ ID NO: 1950066 - DNA, 15 bp, Homo sapiens
tatgtatatgtctag

SEQ ID NO: 1950067 - DNA, 16 bp, Homo sapiens
tatgtctagataaaag

SEQ ID NO: 1950068 - DNA, 16 bp, Homo sapiens
tatgtttggctgaaat

SEQ ID NO: 1950069 - DNA, 17 bp, Homo sapiens
tatgtttggctgaaatt

SEQ ID NO: 1950070 - DNA, 11 bp, Homo sapiens
tatgttttgga

SEQ ID NO: 1950071 - DNA, 14 bp, Homo sapiens
tattaatgtgatcc

SEQ ID NO: 1950072 - DNA, 15 bp, Homo sapiens
tattactgaggaaag

SEQ ID NO: 1950073 - DNA, 16 bp, Homo sapiens
tattatccttcacaat

SEQ ID NO: 1950074 - DNA, 15 bp, Homo sapiens
tattgagacactgtc

SEQ ID NO: 1950075 - DNA, 16 bp, Homo sapiens
tattgaggcctgtcct

SEQ ID NO: 1950076 - DNA, 18 bp, Homo sapiens
tattgatacaacaggatt

SEQ ID NO: 1950077 - DNA, 19 bp, Homo sapiens
tattgatacaacaggattt

SEQ ID NO: 1950078 - DNA, 18 bp, Homo sapiens
tattgctggaatctacta

SEQ ID NO: 1950079 - DNA, 14 bp, Homo sapiens
tattgctgtaaata

SEQ ID NO: 1950080 - DNA, 21 bp, Homo sapiens
tattgttcttgtaaaactgtg

SEQ ID NO: 1950081 - DNA, 15 bp, Homo sapiens
tatttataacattgt

SEQ ID NO: 1950082 - DNA, 17 bp, Homo sapiens
tatttataacattgtaa

SEQ ID NO: 1950083 - DNA, 21 bp, Homo sapiens
tatttcccatctccacaaata

SEQ ID NO: 1950084 - DNA, 22 bp, Homo sapiens
tatttggtaacttgctgtgaaa

SEQ ID NO: 1950085 - DNA, 20 bp, Homo sapiens
tatttgtcagtgtagatcaa

SEQ ID NO: 1950086 - DNA, 22 bp, Homo sapiens
tattttctgagtagcatatata

SEQ ID NO: 1950087 - DNA, 15 bp, Homo sapiens
tattttgtgtccttt

SEQ ID NO: 1950088 - DNA, 15 bp, Homo sapiens
tcaaacgaaatggct

SEQ ID NO: 1950089 - DNA, 15 bp, Homo sapiens
tcaaataaccctgaa

SEQ ID NO: 1950090 - DNA, 16 bp, Homo sapiens
tcaaatggatgtaata

SEQ ID NO: 1950091 - DNA, 18 bp, Homo sapiens
tcaaatggatgtaatata

SEQ ID NO: 1950092 - DNA, 20 bp, Homo sapiens
tcaaattctctatgtacaga

SEQ ID NO: 1950093 - DNA, 14 bp, Homo sapiens
tcaaccctgccctg

SEQ ID NO: 1950094 - DNA, 14 bp, Homo sapiens
tcaacttcaggaaa

SEQ ID NO: 1950095 - DNA, 18 bp, Homo sapiens
tcaagaatagttgtcaga

SEQ ID NO: 1950096 - DNA, 17 bp, Homo sapiens
tcaagaatgtttcagtt

SEQ ID NO: 1950097 - DNA, 20 bp, Homo sapiens
tcaaggagggagaaaggcaa

SEQ ID NO: 1950098 - DNA, 11 bp, Homo sapiens
tcaagtctgtg

SEQ ID NO: 1950099 - DNA, 14 bp, Homo sapiens
tcaagttattcaga

SEQ ID NO: 1950100 - DNA, 16 bp, Homo sapiens
tcaagttattcagaaa

SEQ ID NO: 1950101 - DNA, 21 bp, Homo sapiens
tcaatatatagagacttctaa

SEQ ID NO: 1950102 - DNA, 18 bp, Homo sapiens
tcaatcatgggaatttta

SEQ ID NO: 1950103 - DNA, 16 bp, Homo sapiens
tcaatccacagtattg

SEQ ID NO: 1950104 - DNA, 21 bp, Homo sapiens
tcaatccacagtattgttctt

SEQ ID NO: 1950105 - DNA, 12 bp, Homo sapiens
tcaatccccata

SEQ ID NO: 1950106 - DNA, 13 bp, Homo sapiens
tcaatgcttcttt

SEQ ID NO: 1950107 - DNA, 15 bp, Homo sapiens
tcaattatgtttgaa

SEQ ID NO: 1950108 - DNA, 20 bp, Homo sapiens
tcaattatgtttgaaaatag

SEQ ID NO: 1950109 - DNA, 13 bp, Homo sapiens
tcacaatttcaat

SEQ ID NO: 1950110 - DNA, 17 bp, Homo sapiens
tcacagtttgttcagtg

SEQ ID NO: 1950111 - DNA, 13 bp, Homo sapiens
tcaccatcttgaa

SEQ ID NO: 1950112 - DNA, 15 bp, Homo sapiens
tcaccatttaatcat

SEQ ID NO: 1950113 - DNA, 14 bp, Homo sapiens
tcacgtctgtgagt

SEQ ID NO: 1950114 - DNA, 16 bp, Homo sapiens
tcacgtctgtgagtct

SEQ ID NO: 1950115 - DNA, 21 bp, Homo sapiens
tcactacaacattagaatatt

SEQ ID NO: 1950116 - DNA, 16 bp, Homo sapiens
tcacttttattgtata

SEQ ID NO: 1950117 - DNA, 18 bp, Homo sapiens
tcacttttccggggcaca

SEQ ID NO: 1950118 - DNA, 22 bp, Homo sapiens
tcagaaatatccctcatttcat

SEQ ID NO: 1950119 - DNA, 20 bp, Homo sapiens
tcagacacctagactctaaa

SEQ ID NO: 1950120 - DNA, 16 bp, Homo sapiens
tcagataatgatggaa

SEQ ID NO: 1950121 - DNA, 22 bp, Homo sapiens
tcagatccctcggtcagcaccg

SEQ ID NO: 1950122 - DNA, 21 bp, Homo sapiens
tcagcaccgtggtgtgaggcc

SEQ ID NO: 1950123 - DNA, 12 bp, Homo sapiens
tcagcagtgtct

SEQ ID NO: 1950124 - DNA, 22 bp, Homo sapiens
tcagctcagcattgtgtacaaa

SEQ ID NO: 1950125 - DNA, 13 bp, Homo sapiens
tcagctccactct

SEQ ID NO: 1950126 - DNA, 17 bp, Homo sapiens
tcagcttcccaacaata

SEQ ID NO: 1950127 - DNA, 15 bp, Homo sapiens
tcaggagaaacccct

SEQ ID NO: 1950128 - DNA, 23 bp, Homo sapiens
tcaggattgaggatgaactcagg

SEQ ID NO: 1950129 - DNA, 15 bp, Homo sapiens
tcaggttaaattatt

SEQ ID NO: 1950130 - DNA, 21 bp, Homo sapiens
tcagtattgagacactgtcaa

SEQ ID NO: 1950131 - DNA, 18 bp, Homo sapiens
tcagtgttataaaatctg

SEQ ID NO: 1950132 - DNA, 12 bp, Homo sapiens
tcagtttgtgaa

SEQ ID NO: 1950133 - DNA, 20 bp, Homo sapiens
tcagtttgtgaagtgattga

SEQ ID NO: 1950134 - DNA, 14 bp, Homo sapiens
tcatacacagaaat

SEQ ID NO: 1950135 - DNA, 12 bp, Homo sapiens
tcatatctgtat

SEQ ID NO: 1950136 - DNA, 18 bp, Homo sapiens
tcatcttttcctgcttag

SEQ ID NO: 1950137 - DNA, 19 bp, Homo sapiens
tcatgattagacaatgtgg

SEQ ID NO: 1950138 - DNA, 15 bp, Homo sapiens
tcatggctgttatct

SEQ ID NO: 1950139 - DNA, 19 bp, Homo sapiens
tcatggctgttatctgtct

SEQ ID NO: 1950140 - DNA, 18 bp, Homo sapiens
tcatgggaattttaactt

SEQ ID NO: 1950141 - DNA, 14 bp, Homo sapiens
tcattatagcatgt

SEQ ID NO: 1950142 - DNA, 19 bp, Homo sapiens
tcattatttttcaattatg

SEQ ID NO: 1950143 - DNA, 21 bp, Homo sapiens
tcattatttttcaattatgtt

SEQ ID NO: 1950144 - DNA, 21 bp, Homo sapiens
tcatttaagaatttaccagaa

SEQ ID NO: 1950145 - DNA, 14 bp, Homo sapiens
tcatttcattattt

SEQ ID NO: 1950146 - DNA, 15 bp, Homo sapiens
tcatttcattatttt

SEQ ID NO: 1950147 - DNA, 15 bp, Homo sapiens
tcatttccagcaaaa

SEQ ID NO: 1950148 - DNA, 21 bp, Homo sapiens
tcatttccagcaaaatatatg

SEQ ID NO: 1950149 - DNA, 21 bp, Homo sapiens
tcatttctatagccaaagctg

SEQ ID NO: 1950150 - DNA, 11 bp, Homo sapiens
tcattttctct

SEQ ID NO: 1950151 - DNA, 16 bp, Homo sapiens
tcattttctctcctcg

SEQ ID NO: 1950152 - DNA, 18 bp, Homo sapiens
tcatttttcattttctct

SEQ ID NO: 1950153 - DNA, 16 bp, Homo sapiens
tccaaacttaacagat

SEQ ID NO: 1950154 - DNA, 16 bp, Homo sapiens
tccaaaggtttcaact

SEQ ID NO: 1950155 - DNA, 23 bp, Homo sapiens
tccaaatgctgtcgggcaagata

SEQ ID NO: 1950156 - DNA, 17 bp, Homo sapiens
tccaagtgtgtgtgcaa

SEQ ID NO: 1950157 - DNA, 20 bp, Homo sapiens
tccaagtgtgtgtgcaatgt

SEQ ID NO: 1950158 - DNA, 17 bp, Homo sapiens
tccacaacctcctcctc

SEQ ID NO: 1950159 - DNA, 21 bp, Homo sapiens
tccacagggacacagtctggt

SEQ ID NO: 1950160 - DNA, 21 bp, Homo sapiens
tccacagtattgttcttgtaa

SEQ ID NO: 1950161 - DNA, 22 bp, Homo sapiens
tccacagtattgttcttgtaaa

SEQ ID NO: 1950162 - DNA, 23 bp, Homo sapiens
tccacagtattgttcttgtaaaa

SEQ ID NO: 1950163 - DNA, 17 bp, Homo sapiens
tccacccccattgtgaa

SEQ ID NO: 1950164 - DNA, 23 bp, Homo sapiens
tccacccccattgtgaatgttgt

SEQ ID NO: 1950165 - DNA, 14 bp, Homo sapiens
tccaccctcccctc

SEQ ID NO: 1950166 - DNA, 17 bp, Homo sapiens
tccaccctcccctcttc

SEQ ID NO: 1950167 - DNA, 13 bp, Homo sapiens
tccactttcctct

SEQ ID NO: 1950168 - DNA, 14 bp, Homo sapiens
tccactttcctctc

SEQ ID NO: 1950169 - DNA, 15 bp, Homo sapiens
tccactttcctctct

SEQ ID NO: 1950170 - DNA, 17 bp, Homo sapiens
tccactttcctctctct

SEQ ID NO: 1950171 - DNA, 14 bp, Homo sapiens
tccagaagcagcag

SEQ ID NO: 1950172 - DNA, 15 bp, Homo sapiens
tccagaagcagcagc

SEQ ID NO: 1950173 - DNA, 16 bp, Homo sapiens
tccagaagcagcagct

SEQ ID NO: 1950174 - DNA, 11 bp, Homo sapiens
tccagcaaaat

SEQ ID NO: 1950175 - DNA, 20 bp, Homo sapiens
tccagccccttcaattattt

SEQ ID NO: 1950176 - DNA, 10 bp, Homo sapiens
tccaggagat

SEQ ID NO: 1950177 - DNA, 18 bp, Homo sapiens
tccagggaatcagaaagg

SEQ ID NO: 1950178 - DNA, 16 bp, Homo sapiens
tccaggtcacaggcat

SEQ ID NO: 1950179 - DNA, 22 bp, Homo sapiens
tccaggtcacaggcatccgctg

SEQ ID NO: 1950180 - DNA, 18 bp, Homo sapiens
tccagtagagatttccca

SEQ ID NO: 1950181 - DNA, 17 bp, Homo sapiens
tccagttctgatgaggc

SEQ ID NO: 1950182 - DNA, 16 bp, Homo sapiens
tccatcaaagccctcc

SEQ ID NO: 1950183 - DNA, 19 bp, Homo sapiens
tccatcaaagccctccctg

SEQ ID NO: 1950184 - DNA, 23 bp, Homo sapiens
tccatgacagtagcatactgatg

SEQ ID NO: 1950185 - DNA, 21 bp, Homo sapiens
tccatggtgaactgaagcaga

SEQ ID NO: 1950186 - DNA, 17 bp, Homo sapiens
tccatgtgctgctgtgg

SEQ ID NO: 1950187 - DNA, 14 bp, Homo sapiens
tcccaaatctcaaa

SEQ ID NO: 1950188 - DNA, 18 bp, Homo sapiens
tcccaagtcaaacagtgt

SEQ ID NO: 1950189 - DNA, 21 bp, Homo sapiens
tcccaagtcaaacagtgtggc

SEQ ID NO: 1950190 - DNA, 23 bp, Homo sapiens
tcccacattcccatgaatatcaa

SEQ ID NO: 1950191 - DNA, 20 bp, Homo sapiens
tcccacccactagccctctt

SEQ ID NO: 1950192 - DNA, 19 bp, Homo sapiens
tcccactgatatcacgggc

SEQ ID NO: 1950193 - DNA, 22 bp, Homo sapiens
tcccagctacaggggaggctga

SEQ ID NO: 1950194 - DNA, 20 bp, Homo sapiens
tcccagctggcagcgcctcc

SEQ ID NO: 1950195 - DNA, 22 bp, Homo sapiens
tcccatgaatatcaagaatagt

SEQ ID NO: 1950196 - DNA, 17 bp, Homo sapiens
tcccatggtagactgtg

SEQ ID NO: 1950197 - DNA, 20 bp, Homo sapiens
tcccatggtagactgtgaca

SEQ ID NO: 1950198 - DNA, 23 bp, Homo sapiens
tcccatggtagactgtgacacag

SEQ ID NO: 1950199 - DNA, 15 bp, Homo sapiens
tccccaccctcccct

SEQ ID NO: 1950200 - DNA, 18 bp, Homo sapiens
tccccaccctcccctctc

SEQ ID NO: 1950201 - DNA, 16 bp, Homo sapiens
tcccccaggctgcgcc

SEQ ID NO: 1950202 - DNA, 18 bp, Homo sapiens
tcccccaggctgcgcctg

SEQ ID NO: 1950203 - DNA, 19 bp, Homo sapiens
tcccccaggctgcgcctgc

SEQ ID NO: 1950204 - DNA, 16 bp, Homo sapiens
tccccgcccgccctcc

SEQ ID NO: 1950205 - DNA, 18 bp, Homo sapiens
tccccgcccgccctcctc

SEQ ID NO: 1950206 - DNA, 13 bp, Homo sapiens
tcccctctcctga

SEQ ID NO: 1950207 - DNA, 17 bp, Homo sapiens
tcccctgtggtttgtta

SEQ ID NO: 1950208 - DNA, 19 bp, Homo sapiens
tcccctttcaaattgcctt

SEQ ID NO: 1950209 - DNA, 15 bp, Homo sapiens
tcccgccgcctcggg

SEQ ID NO: 1950210 - DNA, 17 bp, Homo sapiens
tcccggtgtatgcagtg

SEQ ID NO: 1950211 - DNA, 15 bp, Homo sapiens
tccctcatttcatta

SEQ ID NO: 1950212 - DNA, 18 bp, Homo sapiens
tccctcatttcattattt

SEQ ID NO: 1950213 - DNA, 20 bp, Homo sapiens
tccctcatttcattattttt

SEQ ID NO: 1950214 - DNA, 15 bp, Homo sapiens
tccctgacttcccag

SEQ ID NO: 1950215 - DNA, 19 bp, Homo sapiens
tccctgacttcccagctgg

SEQ ID NO: 1950216 - DNA, 22 bp, Homo sapiens
tccctgtctgtctgtctctctt

SEQ ID NO: 1950217 - DNA, 19 bp, Homo sapiens
tcccttcctgtcctgctca

SEQ ID NO: 1950218 - DNA, 17 bp, Homo sapiens
tccgcccgcccaccccg

SEQ ID NO: 1950219 - DNA, 21 bp, Homo sapiens
tccgcccgcccaccccgctgc

SEQ ID NO: 1950220 - DNA, 17 bp, Homo sapiens
tccggcagaggcagggc

SEQ ID NO: 1950221 - DNA, 21 bp, Homo sapiens
tccgtccccagggtgcaggcg

SEQ ID NO: 1950222 - DNA, 13 bp, Homo sapiens
tccgtccgcccgc

SEQ ID NO: 1950223 - DNA, 15 bp, Homo sapiens
tccgtccgcccgccc

SEQ ID NO: 1950224 - DNA, 16 bp, Homo sapiens
tccgttcatctgagga

SEQ ID NO: 1950225 - DNA, 19 bp, Homo sapiens
tcctaacattatattccca

SEQ ID NO: 1950226 - DNA, 18 bp, Homo sapiens
tcctacaaagaaaaaaga

SEQ ID NO: 1950227 - DNA, 22 bp, Homo sapiens
tcctactccagccccttcaatt

SEQ ID NO: 1950228 - DNA, 17 bp, Homo sapiens
tcctcaattccagggaa

SEQ ID NO: 1950229 - DNA, 23 bp, Homo sapiens
tcctcatggctgttatctgtctt

SEQ ID NO: 1950230 - DNA, 15 bp, Homo sapiens
tcctcccctggaagt

SEQ ID NO: 1950231 - DNA, 15 bp, Homo sapiens
tcctcgggcgcctgc

SEQ ID NO: 1950232 - DNA, 21 bp, Homo sapiens
tcctcggtggcatttgctgaa

SEQ ID NO: 1950233 - DNA, 22 bp, Homo sapiens
tcctcgtccggcctgcagccca

SEQ ID NO: 1950234 - DNA, 23 bp, Homo sapiens
tcctctcctcgtccggcctgcag

SEQ ID NO: 1950235 - DNA, 22 bp, Homo sapiens
tcctctctctctctctctctgt

SEQ ID NO: 1950236 - DNA, 18 bp, Homo sapiens
tcctctgcagcctgagct

SEQ ID NO: 1950237 - DNA, 11 bp, Homo sapiens
tcctctgcccc

SEQ ID NO: 1950238 - DNA, 22 bp, Homo sapiens
tcctctgccccctcccccgcag

SEQ ID NO: 1950239 - DNA, 18 bp, Homo sapiens
tcctctgtcagtttgtga

SEQ ID NO: 1950240 - DNA, 18 bp, Homo sapiens
tcctcttaatgtctcaaa

SEQ ID NO: 1950241 - DNA, 20 bp, Homo sapiens
tcctcttatatgtgcccctt

SEQ ID NO: 1950242 - DNA, 17 bp, Homo sapiens
tcctgagcctgtctctc

SEQ ID NO: 1950243 - DNA, 20 bp, Homo sapiens
tcctgctcacgtctgtgagt

SEQ ID NO: 1950244 - DNA, 19 bp, Homo sapiens
tcctgctgctcgggaaggc

SEQ ID NO: 1950245 - DNA, 21 bp, Homo sapiens
tcctgctgctcgggaaggcct

SEQ ID NO: 1950246 - DNA, 22 bp, Homo sapiens
tcctgctgctcgggaaggcctg

SEQ ID NO: 1950247 - DNA, 16 bp, Homo sapiens
tcctgcttagaattaa

SEQ ID NO: 1950248 - DNA, 21 bp, Homo sapiens
tcctgggcaacagagtgagac

SEQ ID NO: 1950249 - DNA, 12 bp, Homo sapiens
tcctgtctcctc

SEQ ID NO: 1950250 - DNA, 20 bp, Homo sapiens
tcctgtctcctctgtcagtt

SEQ ID NO: 1950251 - DNA, 14 bp, Homo sapiens
tcctgtgtcatctg

SEQ ID NO: 1950252 - DNA, 16 bp, Homo sapiens
tccttcacaatttcaa

SEQ ID NO: 1950253 - DNA, 21 bp, Homo sapiens
tccttcatgcttttctcatgg

SEQ ID NO: 1950254 - DNA, 14 bp, Homo sapiens
tccttcccgcagca

SEQ ID NO: 1950255 - DNA, 13 bp, Homo sapiens
tcgagagggctga

SEQ ID NO: 1950256 - DNA, 19 bp, Homo sapiens
tcgagagggctgagcccct

SEQ ID NO: 1950257 - DNA, 13 bp, Homo sapiens
tcggccgaggcct

SEQ ID NO: 1950258 - DNA, 14 bp, Homo sapiens
tctttggttcctca

SEQ ID NO: 1950259 - DNA, 15 bp, Homo sapiens
tcttttagtcagaaa

SEQ ID NO: 1950260 - DNA, 16 bp, Homo sapiens
tcttttgttctctctt

SEQ ID NO: 1950261 - DNA, 11 bp, Homo sapiens
tgaaaaagaaa

SEQ ID NO: 1950262 - DNA, 20 bp, Homo sapiens
tgaaaaatagtgtgtccatg

SEQ ID NO: 1950263 - DNA, 16 bp, Homo sapiens
tgaaaactaagttctc

SEQ ID NO: 1950264 - DNA, 18 bp, Homo sapiens
tgaaaattttattgaata

SEQ ID NO: 1950265 - DNA, 20 bp, Homo sapiens
tgaaacagtgtggatgtaaa

SEQ ID NO: 1950266 - DNA, 23 bp, Homo sapiens
tgaaacttgagcattcaaatgaa

SEQ ID NO: 1950267 - DNA, 12 bp, Homo sapiens
tgaaagtaattt

SEQ ID NO: 1950268 - DNA, 16 bp, Homo sapiens
tgaaagtaatttcaag

SEQ ID NO: 1950269 - DNA, 14 bp, Homo sapiens
ttagtagaaaatac

SEQ ID NO: 1950270 - DNA, 15 bp, Homo sapiens
ttagtagctgataaa

SEQ ID NO: 1950271 - DNA, 14 bp, Homo sapiens
ttagtcagaaatga

SEQ ID NO: 1950272 - DNA, 23 bp, Homo sapiens
ttagtcagtgtactctgagtcct

SEQ ID NO: 1950273 - DNA, 13 bp, Homo sapiens
ttagtcatttaag

SEQ ID NO: 1950274 - DNA, 19 bp, Homo sapiens
ttagttggcagagaaaatg

SEQ ID NO: 1950275 - DNA, 14 bp, Homo sapiens
ttataacattgtaa

SEQ ID NO: 1950276 - DNA, 19 bp, Homo sapiens
ttatagaggtaaaatttgc

SEQ ID NO: 1950277 - DNA, 20 bp, Homo sapiens
ttatagaggtaaaatttgca

SEQ ID NO: 1950278 - DNA, 18 bp, Homo sapiens
ttatattcccaaatctca

SEQ ID NO: 1950279 - DNA, 20 bp, Homo sapiens
ttatcagtacaattctttgt

SEQ ID NO: 1950280 - DNA, 23 bp, Homo sapiens
ttatctagtaggtctgcacacat

SEQ ID NO: 1950281 - DNA, 13 bp, Homo sapiens
ttatctgtcttta

SEQ ID NO: 1950282 - DNA, 20 bp, Homo sapiens
ttatctgtctttatgatttc

SEQ ID NO: 1950283 - DNA, 11 bp, Homo sapiens
ttatgcatgag

SEQ ID NO: 1950284 - DNA, 18 bp, Homo sapiens
ttatgcatttatgcatga

SEQ ID NO: 1950285 - DNA, 14 bp, Homo sapiens
ttatgtttgaaaat

SEQ ID NO: 1950286 - DNA, 14 bp, Homo sapiens
ttattcagaaatat

SEQ ID NO: 1950287 - DNA, 12 bp, Homo sapiens
ttattctaatta

SEQ ID NO: 1950288 - DNA, 23 bp, Homo sapiens
ttattgatacaacaggattttca

SEQ ID NO: 1950289 - DNA, 15 bp, Homo sapiens
ttcaaataaccctga

SEQ ID NO: 1950290 - DNA, 13 bp, Homo sapiens
ttcaaattgcctt

SEQ ID NO: 1950291 - DNA, 22 bp, Homo sapiens
ttcaacaagcctgaaagtaatt

SEQ ID NO: 1950292 - DNA, 13 bp, Homo sapiens
ttcaagaatgttt

SEQ ID NO: 1950293 - DNA, 19 bp, Homo sapiens
ttcaagttattcagaaata

SEQ ID NO: 1950294 - DNA, 14 bp, Homo sapiens
ttcaattatgtttg

SEQ ID NO: 1950295 - DNA, 17 bp, Homo sapiens
ttcaattatgtttgaaa

SEQ ID NO: 1950296 - DNA, 13 bp, Homo sapiens
ttcacaatttcaa

SEQ ID NO: 1950297 - DNA, 15 bp, Homo sapiens
ttcacaatttcaatg

SEQ ID NO: 1950298 - DNA, 17 bp, Homo sapiens
ttcaccttctgtgcatc

SEQ ID NO: 1950299 - DNA, 20 bp, Homo sapiens
ttcactacaacattagaata

SEQ ID NO: 1950300 - DNA, 24 bp, Homo sapiens
ttcacttttccggggcacaagttt

SEQ ID NO: 1950301 - DNA, 11 bp, Homo sapiens
ttcagaaatat

SEQ ID NO: 1950302 - DNA, 15 bp, Homo sapiens
ttcagggttatttga

SEQ ID NO: 1950303 - DNA, 20 bp, Homo sapiens
ttcatagttggaaatatttg

SEQ ID NO: 1950304 - DNA, 12 bp, Homo sapiens
ttcatcctctta

SEQ ID NO: 1950305 - DNA, 21 bp, Homo sapiens
ttcatctgaggagtccaaaat

SEQ ID NO: 1950306 - DNA, 15 bp, Homo sapiens
ttcatgattagacaa

SEQ ID NO: 1950307 - DNA, 17 bp, Homo sapiens
ttcatgcttttctcatg

SEQ ID NO: 1950308 - DNA, 15 bp, Homo sapiens
ttcattatttttcaa

SEQ ID NO: 1950309 - DNA, 19 bp, Homo sapiens
ttccagctaagcctgatga

SEQ ID NO: 1950310 - DNA, 21 bp, Homo sapiens
ttccagctaagcctgatgatg

SEQ ID NO: 1950311 - DNA, 15 bp, Homo sapiens
ttccagggaaccaga

SEQ ID NO: 1950312 - DNA, 16 bp, Homo sapiens
ttccatgacagtagca

SEQ ID NO: 1950313 - DNA, 19 bp, Homo sapiens
ttcccacccactagccctc

SEQ ID NO: 1950314 - DNA, 17 bp, Homo sapiens
ttcccttgattcaaata

SEQ ID NO: 1950315 - DNA, 18 bp, Homo sapiens
ttccgttcatctgaggag

SEQ ID NO: 1950316 - DNA, 15 bp, Homo sapiens
ttcctacttaaacaa

SEQ ID NO: 1950317 - DNA, 11 bp, Homo sapiens
ttcctcatggc

SEQ ID NO: 1950318 - DNA, 12 bp, Homo sapiens
ttcctcccctgg

SEQ ID NO: 1950319 - DNA, 17 bp, Homo sapiens
ttcctcctgtctcctct

SEQ ID NO: 1950320 - DNA, 22 bp, Homo sapiens
ttcctctctctctctctctctg

SEQ ID NO: 1950321 - DNA, 22 bp, Homo sapiens
ttcctctgaagactgctatcag

SEQ ID NO: 1950322 - DNA, 20 bp, Homo sapiens
ttcctcttaatgtctcaaaa

SEQ ID NO: 1950323 - DNA, 13 bp, Homo sapiens
ttcctgtcctgct

SEQ ID NO: 1950324 - DNA, 15 bp, Homo sapiens
ttcctgtcctgctca

SEQ ID NO: 1950325 - DNA, 15 bp, Homo sapiens
ttccttacaggtgtg

SEQ ID NO: 1950326 - DNA, 23 bp, Homo sapiens
ttcgcagctcatcttttcctgct

SEQ ID NO: 1950327 - DNA, 16 bp, Homo sapiens
ttctaattagattaac

SEQ ID NO: 1950328 - DNA, 20 bp, Homo sapiens
ttctacttcttgtgctttac

SEQ ID NO: 1950329 - DNA, 16 bp, Homo sapiens
ttctagatatgagaaa

SEQ ID NO: 1950330 - DNA, 17 bp, Homo sapiens
ttctcaatcatgggaat

SEQ ID NO: 1950331 - DNA, 15 bp, Homo sapiens
ttctcagaagtgaaa

SEQ ID NO: 1950332 - DNA, 21 bp, Homo sapiens
ttctcagaagtgaaaaagact

SEQ ID NO: 1950333 - DNA, 17 bp, Homo sapiens
ttctcagctccactctg

SEQ ID NO: 1950334 - DNA, 12 bp, Homo sapiens
ttctctaaaaca

SEQ ID NO: 1950335 - DNA, 14 bp, Homo sapiens
ttctctctgtgtgg

SEQ ID NO: 1950336 - DNA, 19 bp, Homo sapiens
ttctctgtcctctgctttg

SEQ ID NO: 1950337 - DNA, 15 bp, Homo sapiens
ttctgatcctctctt

SEQ ID NO: 1950338 - DNA, 17 bp, Homo sapiens
ttctgtgcatctggcct

SEQ ID NO: 1950339 - DNA, 23 bp, Homo sapiens
ttctgtgcctcttatcaagtgtt

SEQ ID NO: 1950340 - DNA, 12 bp, Homo sapiens
ttctgttcactt

SEQ ID NO: 1950341 - DNA, 13 bp, Homo sapiens
ttctgttcacttt

SEQ ID NO: 1950342 - DNA, 22 bp, Homo sapiens
ttcttgaccttatgccattcca

SEQ ID NO: 1950343 - DNA, 14 bp, Homo sapiens
ttcttgtaaaactg

SEQ ID NO: 1950344 - DNA, 22 bp, Homo sapiens
ttcttgtaaaactgtgacattc

SEQ ID NO: 1950345 - DNA, 21 bp, Homo sapiens
ttctttagtcatttaagaatt

SEQ ID NO: 1950346 - DNA, 13 bp, Homo sapiens
ttctttcctctta

SEQ ID NO: 1950347 - DNA, 15 bp, Homo sapiens
ttctttgttgcttaa

SEQ ID NO: 1950348 - DNA, 13 bp, Homo sapiens
ttcttttcccatt

SEQ ID NO: 1950349 - DNA, 23 bp, Homo sapiens
ttgaaaaagaaaacaaccaaaga

SEQ ID NO: 1950350 - DNA, 20 bp, Homo sapiens
ttgaaaataggatttgcact

SEQ ID NO: 1950351 - DNA, 15 bp, Homo sapiens
ttgaagtcattgtcc

SEQ ID NO: 1950352 - DNA, 18 bp, Homo sapiens
ttgaatgcttaaatgatc

SEQ ID NO: 1950353 - DNA, 16 bp, Homo sapiens
ttgacagcaacaaagc

SEQ ID NO: 1950354 - DNA, 20 bp, Homo sapiens
ttgactgttatttgttgaga

SEQ ID NO: 1950355 - DNA, 13 bp, Homo sapiens
ttgagacactgtc

SEQ ID NO: 1950356 - DNA, 23 bp, Homo sapiens
ttgagacactgtcaagattaagt

SEQ ID NO: 1950357 - DNA, 12 bp, Homo sapiens
ttgagcagctga

SEQ ID NO: 1950358 - DNA, 16 bp, Homo sapiens
ttgagtgtcaggctct

SEQ ID NO: 1950359 - DNA, 21 bp, Homo sapiens
ttgatacaacaggattttcaa

SEQ ID NO: 1950360 - DNA, 21 bp, Homo sapiens
ttgatattcctacaaagaaaa

SEQ ID NO: 1950361 - DNA, 22 bp, Homo sapiens
ttgatattcctacaaagaaaaa

SEQ ID NO: 1950362 - DNA, 12 bp, Homo sapiens
ttgatctggtgc

SEQ ID NO: 1950363 - DNA, 20 bp, Homo sapiens
ttgatctggtgcgtgtggcc

SEQ ID NO: 1950364 - DNA, 19 bp, Homo sapiens
ttgatggctatgttttgga

SEQ ID NO: 1950365 - DNA, 17 bp, Homo sapiens
ttgattgcatattttgt

SEQ ID NO: 1950366 - DNA, 17 bp, Homo sapiens
ttgattttaattcaggt

SEQ ID NO: 1950367 - DNA, 16 bp, Homo sapiens
ttgcacacaaaacatc

SEQ ID NO: 1950368 - DNA, 13 bp, Homo sapiens
ttgcactgcttta

SEQ ID NO: 1950369 - DNA, 15 bp, Homo sapiens
ttgcactgtatccaa

SEQ ID NO: 1950370 - DNA, 21 bp, Homo sapiens
ttgcggcaccgcccacccaca

SEQ ID NO: 1950371 - DNA, 11 bp, Homo sapiens
ttgctctctca

SEQ ID NO: 1950372 - DNA, 19 bp, Homo sapiens
ttgctctctcattcccagg

SEQ ID NO: 1950373 - DNA, 16 bp, Homo sapiens
ttgctgagatgtttag

SEQ ID NO: 1950374 - DNA, 12 bp, Homo sapiens
ttgctgtgaaat

SEQ ID NO: 1950375 - DNA, 19 bp, Homo sapiens
ttggaacagtaatcagttt

SEQ ID NO: 1950376 - DNA, 16 bp, Homo sapiens
ttgggttgcaaagcta

SEQ ID NO: 1950377 - DNA, 19 bp, Homo sapiens
ttggtaacttgctgtgaaa

SEQ ID NO: 1950378 - DNA, 16 bp, Homo sapiens
ttggtctctttctttc

SEQ ID NO: 1950379 - DNA, 19 bp, Homo sapiens
ttggtctctttctttccaa

SEQ ID NO: 1950380 - DNA, 14 bp, Homo sapiens
ttgtaaaactgtga

SEQ ID NO: 1950381 - DNA, 18 bp, Homo sapiens
ttgtaaaactgtgacatt

SEQ ID NO: 1950382 - DNA, 19 bp, Homo sapiens
ttgtaaaactgtgacattc

SEQ ID NO: 1950383 - DNA, 21 bp, Homo sapiens
ttgtaacattctatttcaact

SEQ ID NO: 1950384 - DNA, 20 bp, Homo sapiens
ttgtcctgtgtcatctgtca

SEQ ID NO: 1950385 - DNA, 14 bp, Homo sapiens
ttgtgatctgtcct

SEQ ID NO: 1950386 - DNA, 18 bp, Homo sapiens
ttgtgcctcatttattta

SEQ ID NO: 1950387 - DNA, 17 bp, Homo sapiens
ttgtgtgggttcaaatt

SEQ ID NO: 1950388 - DNA, 22 bp, Homo sapiens
ttgttatcagtacaattctttg

SEQ ID NO: 1950389 - DNA, 18 bp, Homo sapiens
ttgttcaccttctgtgca

SEQ ID NO: 1950390 - DNA, 16 bp, Homo sapiens
ttgttcagtgaggtat

SEQ ID NO: 1950391 - DNA, 19 bp, Homo sapiens
ttgttcttgtaaaactgtg

SEQ ID NO: 1950392 - DNA, 20 bp, Homo sapiens
ttgttcttgtaaaactgtga

SEQ ID NO: 1950393 - DNA, 13 bp, Homo sapiens
ttgttgaaatctt

SEQ ID NO: 1950394 - DNA, 20 bp, Homo sapiens
ttgtttacaacacagtagtg

SEQ ID NO: 1950395 - DNA, 22 bp, Homo sapiens
tttaaaaaaataatataaatga

SEQ ID NO: 1950396 - DNA, 20 bp, Homo sapiens
tttaaaagaaggtaaataat

SEQ ID NO: 1950397 - DNA, 19 bp, Homo sapiens
tttaaaagccctttccaaa

SEQ ID NO: 1950398 - DNA, 20 bp, Homo sapiens
tttaaaagccctttccaaag

SEQ ID NO: 1950399 - DNA, 18 bp, Homo sapiens
tttaaacttcttaactgg

SEQ ID NO: 1950400 - DNA, 21 bp, Homo sapiens
tttaaaggagcagctagctgc

SEQ ID NO: 1950401 - DNA, 15 bp, Homo sapiens
tttaacattctcaat

SEQ ID NO: 1950402 - DNA, 15 bp, Homo sapiens
tttaatcatttccag

SEQ ID NO: 1950403 - DNA, 22 bp, Homo sapiens
tttacagtgatagaacaaaaga

SEQ ID NO: 1950404 - DNA, 13 bp, Homo sapiens
tttaccagaaata

SEQ ID NO: 1950405 - DNA, 14 bp, Homo sapiens
tttaccagaaatat

SEQ ID NO: 1950406 - DNA, 15 bp, Homo sapiens
tttaccagaaatatt

SEQ ID NO: 1950407 - DNA, 13 bp, Homo sapiens
tttactcacattg

SEQ ID NO: 1950408 - DNA, 17 bp, Homo sapiens
tttagaaataaaagatg

SEQ ID NO: 1950409 - DNA, 19 bp, Homo sapiens
tttagtagctgataaagaa

SEQ ID NO: 1950410 - DNA, 23 bp, Homo sapiens
tttagtcagaaatgattcagggt

SEQ ID NO: 1950411 - DNA, 15 bp, Homo sapiens
tttataacattgtaa

SEQ ID NO: 1950412 - DNA, 20 bp, Homo sapiens
tttatgcatgagaactaaat

SEQ ID NO: 1950413 - DNA, 23 bp, Homo sapiens
tttatgcatgagaactaaataga

SEQ ID NO: 1950414 - DNA, 16 bp, Homo sapiens
tttatgcatttatgca

SEQ ID NO: 1950415 - DNA, 21 bp, Homo sapiens
tttattctgtcaatgaaaagc

SEQ ID NO: 1950416 - DNA, 14 bp, Homo sapiens
tttcaaattgcctt

SEQ ID NO: 1950417 - DNA, 13 bp, Homo sapiens
tttcaagaatgtt

SEQ ID NO: 1950418 - DNA, 17 bp, Homo sapiens
tttcaagaatgtttcag

SEQ ID NO: 1950419 - DNA, 20 bp, Homo sapiens
tttcaagttattcagaaata

SEQ ID NO: 1950420 - DNA, 17 bp, Homo sapiens
tttcaatgcttctttta

SEQ ID NO: 1950421 - DNA, 20 bp, Homo sapiens
tttcaatgcttcttttagtc

SEQ ID NO: 1950422 - DNA, 21 bp, Homo sapiens
tttcaattatgtttgaaaata

SEQ ID NO: 1950423 - DNA, 16 bp, Homo sapiens
tttcagtaagatcaag

SEQ ID NO: 1950424 - DNA, 15 bp, Homo sapiens
tttcatgattagaca

SEQ ID NO: 1950425 - DNA, 18 bp, Homo sapiens
tttccaaaggttgtacat

SEQ ID NO: 1950426 - DNA, 19 bp, Homo sapiens
tttccacatccccaccctc

SEQ ID NO: 1950427 - DNA, 14 bp, Homo sapiens
tttccatgacagta

SEQ ID NO: 1950428 - DNA, 18 bp, Homo sapiens
tttcctaaatcagcattt

SEQ ID NO: 1950429 - DNA, 11 bp, Homo sapiens
tttcctgaaat

SEQ ID NO: 1950430 - DNA, 15 bp, Homo sapiens
tttcctgctcctcca

SEQ ID NO: 1950431 - DNA, 12 bp, Homo sapiens
tttcctttggca

SEQ ID NO: 1950432 - DNA, 13 bp, Homo sapiens
tttctatagccaa

SEQ ID NO: 1950433 - DNA, 23 bp, Homo sapiens
tttctctctgtgtggcaaacatt

SEQ ID NO: 1950434 - DNA, 17 bp, Homo sapiens
tttcttggtatgatcat

SEQ ID NO: 1950435 - DNA, 16 bp, Homo sapiens
tttgaaaataggattt

SEQ ID NO: 1950436 - DNA, 15 bp, Homo sapiens
tttgagtgtcaggct

SEQ ID NO: 1950437 - DNA, 13 bp, Homo sapiens
tttgatctggtgc

SEQ ID NO: 1950438 - DNA, 21 bp, Homo sapiens
tttgatctggtgcgtgtggcc

SEQ ID NO: 1950439 - DNA, 16 bp, Homo sapiens
tttgatggaaaaagaa

SEQ ID NO: 1950440 - DNA, 19 bp, Homo sapiens
tttgatggaaaaagaatat

SEQ ID NO: 1950441 - DNA, 12 bp, Homo sapiens
tttgattgcata

SEQ ID NO: 1950442 - DNA, 20 bp, Homo sapiens
tttgcactgctttattttag

SEQ ID NO: 1950443 - DNA, 20 bp, Homo sapiens
tttgctgaataacaacaatt

SEQ ID NO: 1950444 - DNA, 17 bp, Homo sapiens
tttgctgcttttgatgg

SEQ ID NO: 1950445 - DNA, 13 bp, Homo sapiens
tttgggatttgtt

SEQ ID NO: 1950446 - DNA, 19 bp, Homo sapiens
tttggttcctcatggctgt

SEQ ID NO: 1950447 - DNA, 22 bp, Homo sapiens
tttgtagctagtttaaaattat

SEQ ID NO: 1950448 - DNA, 18 bp, Homo sapiens
tttgttatcagtacaatt

SEQ ID NO: 1950449 - DNA, 17 bp, Homo sapiens
tttgttcaccttctgtg

SEQ ID NO: 1950450 - DNA, 19 bp, Homo sapiens
tttgttcaccttctgtgca

SEQ ID NO: 1950451 - DNA, 18 bp, Homo sapiens
tttgtttacaacacagta

SEQ ID NO: 1950452 - DNA, 12 bp, Homo sapiens
tttgtttgctgc

SEQ ID NO: 1950453 - DNA, 13 bp, Homo sapiens
ttttagattccta

SEQ ID NO: 1950454 - DNA, 23 bp, Homo sapiens
ttttagattcctacttaaacaaa

SEQ ID NO: 1950455 - DNA, 18 bp, Homo sapiens
ttttagtcagaaatgatt

SEQ ID NO: 1950456 - DNA, 19 bp, Homo sapiens
ttttagtggttctgtgcct

SEQ ID NO: 1950457 - DNA, 12 bp, Homo sapiens
ttttcaacaagc

SEQ ID NO: 1950458 - DNA, 19 bp, Homo sapiens
ttttcaagttattcagaaa

SEQ ID NO: 1950459 - DNA, 18 bp, Homo sapiens
ttttcaggttaaattatt

SEQ ID NO: 1950460 - DNA, 15 bp, Homo sapiens
ttttcattttctctc

SEQ ID NO: 1950461 - DNA, 19 bp, Homo sapiens
ttttccggggcacaagttt

SEQ ID NO: 1950462 - DNA, 12 bp, Homo sapiens
ttttcctgtcaa

SEQ ID NO: 1950463 - DNA, 13 bp, Homo sapiens
ttttcctgtcaat

SEQ ID NO: 1950464 - DNA, 15 bp, Homo sapiens
ttttcttttaatttt

SEQ ID NO: 1950465 - DNA, 14 bp, Homo sapiens
ttttgattgcatat

SEQ ID NO: 1950466 - DNA, 22 bp, Homo sapiens
ttttgattgcatattttgttat

SEQ ID NO: 1950467 - DNA, 18 bp, Homo sapiens
ttttgtttacaacacagt

SEQ ID NO: 1950468 - DNA, 15 bp, Homo sapiens
tttttaacagcatgt

SEQ ID NO: 1950469 - DNA, 22 bp, Homo sapiens
tttttcaattatgtttgaaaat

SEQ ID NO: 1950470 - DNA, 13 bp, Homo sapiens
tttttcctgtcaa

SEQ ID NO: 1950471 - DNA, 14 bp, Homo sapiens
tttttcctgtcaat

SEQ ID NO: 1950472 - DNA, 11 bp, Homo sapiens
tttttgttcat

SEQ ID NO: 1950473 - DNA, 14 bp, Homo sapiens
ttttttcctgtcaa

SEQ ID NO: 1950474 - DNA, 21 bp, Homo sapiens
tgcagcctgagctccaccctc

SEQ ID NO: 1950475 - DNA, 21 bp, Homo sapiens
tgcagtattgagtgttctagt

SEQ ID NO: 1950476 - DNA, 15 bp, Homo sapiens
tgccaatgtccaggt

SEQ ID NO: 1950477 - DNA, 19 bp, Homo sapiens
cgctccggcagaggcaggg

SEQ ID NO: 1950478 - DNA, 13 bp, Homo sapiens
cgctcctctgcag

SEQ ID NO: 1950479 - DNA, 14 bp, Homo sapiens
cgctcctctgcagc

SEQ ID NO: 1950480 - DNA, 16 bp, Homo sapiens
cgctcctctgcagcct

SEQ ID NO: 1950481 - DNA, 12 bp, Homo sapiens
cgctctgcccct

SEQ ID NO: 1950482 - DNA, 13 bp, Homo sapiens
cgctctgcccctc

SEQ ID NO: 1950483 - DNA, 23 bp, Homo sapiens
cgctctgcccctccgtccccagg

SEQ ID NO: 1950484 - DNA, 18 bp, Homo sapiens
cgctgcctggcgggcagc

SEQ ID NO: 1950485 - DNA, 21 bp, Homo sapiens
cgctgcctggcgggcagcccc

SEQ ID NO: 1950486 - DNA, 20 bp, Homo sapiens
cggaccggagcggctgagga

SEQ ID NO: 1950487 - DNA, 14 bp, Homo sapiens
cggacgctggctcg

SEQ ID NO: 1950488 - DNA, 13 bp, Homo sapiens
cggacgggacagc

SEQ ID NO: 1950489 - DNA, 17 bp, Homo sapiens
cggacgggacagcggcc

SEQ ID NO: 1950490 - DNA, 15 bp, Homo sapiens
cggagcggctgagga

SEQ ID NO: 1950491 - DNA, 12 bp, Homo sapiens
cggaggcgccca

SEQ ID NO: 1950492 - DNA, 21 bp, Homo sapiens
cggaggcgcccacctgcccag

SEQ ID NO: 1950493 - DNA, 22 bp, Homo sapiens
cggaggcgcccacctgcccagt

SEQ ID NO: 1950494 - DNA, 18 bp, Homo sapiens
cggaggggcttggagcag

SEQ ID NO: 1950495 - DNA, 20 bp, Homo sapiens
cggaggggcttggagcagag

SEQ ID NO: 1950496 - DNA, 16 bp, Homo sapiens
cggcaccgcccaccca

SEQ ID NO: 1950497 - DNA, 15 bp, Homo sapiens
cggcagaggcagggc

SEQ ID NO: 1950498 - DNA, 18 bp, Homo sapiens
cggcagaggcagggccct

SEQ ID NO: 1950499 - DNA, 11 bp, Homo sapiens
cggcagcccca

SEQ ID NO: 1950500 - DNA, 15 bp, Homo sapiens
cggcagccccatcct

SEQ ID NO: 1950501 - DNA, 16 bp, Homo sapiens
cggccaaggacactga

SEQ ID NO: 1950502 - DNA, 18 bp, Homo sapiens
cggcccacgcagagcccc

SEQ ID NO: 1950503 - DNA, 21 bp, Homo sapiens
cggcccacgcagagccccgga

SEQ ID NO: 1950504 - DNA, 23 bp, Homo sapiens
cggcccacgcagagccccggagc

SEQ ID NO: 1950505 - DNA, 16 bp, Homo sapiens
cggcccggcccacgca

SEQ ID NO: 1950506 - DNA, 16 bp, Homo sapiens
cggcccgtgcgcagcc

SEQ ID NO: 1950507 - DNA, 13 bp, Homo sapiens
cggccgtccctga

SEQ ID NO: 1950508 - DNA, 21 bp, Homo sapiens
cggctgaggacggggcagagc

SEQ ID NO: 1950509 - DNA, 23 bp, Homo sapiens
cggctgggcagggccgcagggcg

SEQ ID NO: 1950510 - DNA, 14 bp, Homo sapiens
cgggaaggcctgag

SEQ ID NO: 1950511 - DNA, 13 bp, Homo sapiens
cgggacagcggcc

SEQ ID NO: 1950512 - DNA, 21 bp, Homo sapiens
ctcctcgtccggcctgcagcc

SEQ ID NO: 1950513 - DNA, 21 bp, Homo sapiens
ctcctctcctcgtccggcctg

SEQ ID NO: 1950514 - DNA, 14 bp, Homo sapiens
ctcctctgcagcct

SEQ ID NO: 1950515 - DNA, 15 bp, Homo sapiens
ctcctctgcagcctg

SEQ ID NO: 1950516 - DNA, 16 bp, Homo sapiens
ctcctctgccccctcc

SEQ ID NO: 1950517 - DNA, 18 bp, Homo sapiens
ctcctctgccccctcccc

SEQ ID NO: 1950518 - DNA, 13 bp, Homo sapiens
ctcctctgtcagt

SEQ ID NO: 1950519 - DNA, 21 bp, Homo sapiens
ctcctctgtcagtttgtgaag

SEQ ID NO: 1950520 - DNA, 15 bp, Homo sapiens
ctcctgagcctgtct

SEQ ID NO: 1950521 - DNA, 12 bp, Homo sapiens
ctccttacagaa

SEQ ID NO: 1950522 - DNA, 16 bp, Homo sapiens
ctccttcatgcttttc

SEQ ID NO: 1950523 - DNA, 17 bp, Homo sapiens
ctcgagagggctgagcc

SEQ ID NO: 1950524 - DNA, 19 bp, Homo sapiens
ctcgagagggctgagcccc

SEQ ID NO: 1950525 - DNA, 22 bp, Homo sapiens
ctcgagagggctgagcccctcc

SEQ ID NO: 1950526 - DNA, 23 bp, Homo sapiens
ctcgagagggctgagcccctcct

SEQ ID NO: 1950527 - DNA, 19 bp, Homo sapiens
ctcgggccgcctcctccag

SEQ ID NO: 1950528 - DNA, 20 bp, Homo sapiens
ctcgggccgcctcctccaga

SEQ ID NO: 1950529 - DNA, 14 bp, Homo sapiens
ctcgggcgcctgcg

SEQ ID NO: 1950530 - DNA, 17 bp, Homo sapiens
ctcgggctctctcaccc

SEQ ID NO: 1950531 - DNA, 18 bp, Homo sapiens
ctcggtggcatttgctga

SEQ ID NO: 1950532 - DNA, 20 bp, Homo sapiens
ctcgtccggcctgcagccca

SEQ ID NO: 1950533 - DNA, 22 bp, Homo sapiens
ctcgtccggcctgcagcccaga

SEQ ID NO: 1950534 - DNA, 20 bp, Homo sapiens
ctctaaaactatcagcagcg

SEQ ID NO: 1950535 - DNA, 20 bp, Homo sapiens
ctctaagaaatggctttcca

SEQ ID NO: 1950536 - DNA, 11 bp, Homo sapiens
ctctaatttcc

SEQ ID NO: 1950537 - DNA, 17 bp, Homo sapiens
ctctaggtaaactagca

SEQ ID NO: 1950538 - DNA, 12 bp, Homo sapiens
ctctatgtacag

SEQ ID NO: 1950539 - DNA, 14 bp, Homo sapiens
ctctcaaaatgtgc

SEQ ID NO: 1950540 - DNA, 15 bp, Homo sapiens
ctctcaaaatgtgcc

SEQ ID NO: 1950541 - DNA, 16 bp, Homo sapiens
ctctcaaaatgtgccg

SEQ ID NO: 1950542 - DNA, 15 bp, Homo sapiens
ctctccctaccctct

SEQ ID NO: 1950543 - DNA, 17 bp, Homo sapiens
ctctcctcggtggcatt

SEQ ID NO: 1950544 - DNA, 23 bp, Homo sapiens
ctctcctcggtggcatttgctga

SEQ ID NO: 1950545 - DNA, 19 bp, Homo sapiens
ctctcctgagcctgtctct

SEQ ID NO: 1950546 - DNA, 17 bp, Homo sapiens
ctctcgggctctctcac

SEQ ID NO: 1950547 - DNA, 13 bp, Homo sapiens
ctctctcacccag

SEQ ID NO: 1950548 - DNA, 13 bp, Homo sapiens
ctctctctctctc

SEQ ID NO: 1950549 - DNA, 16 bp, Homo sapiens
ctctctctctctgttc

SEQ ID NO: 1950550 - DNA, 11 bp, Homo sapiens
ctctctctctg

SEQ ID NO: 1950551 - DNA, 12 bp, Homo sapiens
ctctctctctgt

SEQ ID NO: 1950552 - DNA, 13 bp, Homo sapiens
ctctctctctgtt

SEQ ID NO: 1950553 - DNA, 11 bp, Homo sapiens
ctctctctgtt

SEQ ID NO: 1950554 - DNA, 13 bp, Homo sapiens
ctctctgtgtggc

SEQ ID NO: 1950555 - DNA, 16 bp, Homo sapiens
ctctctgtgtggcaaa

SEQ ID NO: 1950556 - DNA, 22 bp, Homo sapiens
ctctctgtgtggcaaacattta

SEQ ID NO: 1950557 - DNA, 13 bp, Homo sapiens
ctctctgttccaa

SEQ ID NO: 1950558 - DNA, 15 bp, Homo sapiens
ctctctgttccaagt

SEQ ID NO: 1950559 - DNA, 19 bp, Homo sapiens
ctctctgttccaagtgtgt

SEQ ID NO: 1950560 - DNA, 22 bp, Homo sapiens
ctctctgttccaagtgtgtgtg

SEQ ID NO: 1950561 - DNA, 19 bp, Homo sapiens
ctctcttggtctctttctt

SEQ ID NO: 1950562 - DNA, 23 bp, Homo sapiens
ctctcttggtctctttctttcca

SEQ ID NO: 1950563 - DNA, 15 bp, Homo sapiens
ctctgaactgcaaca

SEQ ID NO: 1950564 - DNA, 15 bp, Homo sapiens
ctctgaagtcccttc

SEQ ID NO: 1950565 - DNA, 16 bp, Homo sapiens
ctctgaatctctcaaa

SEQ ID NO: 1950566 - DNA, 19 bp, Homo sapiens
ctctgaatctctcaaaatg

SEQ ID NO: 1950567 - DNA, 15 bp, Homo sapiens
ctctgagcagtgggg

SEQ ID NO: 1950568 - DNA, 13 bp, Homo sapiens
ctctgagtcctca

SEQ ID NO: 1950569 - DNA, 12 bp, Homo sapiens
ctctgcagcctg

SEQ ID NO: 1950570 - DNA, 13 bp, Homo sapiens
ctctgcagcctga

SEQ ID NO: 1950571 - DNA, 16 bp, Homo sapiens
ctctgcagcctgagct

SEQ ID NO: 1950572 - DNA, 17 bp, Homo sapiens
ctctgcagcctgagctc

SEQ ID NO: 1950573 - DNA, 23 bp, Homo sapiens
ctctgcagcctgagctccaccct

SEQ ID NO: 1950574 - DNA, 20 bp, Homo sapiens
ctctgccccctcccccgcag

SEQ ID NO: 1950575 - DNA, 18 bp, Homo sapiens
ctctgcccctccgtcccc

SEQ ID NO: 1950576 - DNA, 13 bp, Homo sapiens
ctctgtgtggcaa

SEQ ID NO: 1950577 - DNA, 15 bp, Homo sapiens
ctctgtgtggcaaac

SEQ ID NO: 1950578 - DNA, 16 bp, Homo sapiens
ctctgttccaagtgtg

SEQ ID NO: 1950579 - DNA, 21 bp, Homo sapiens
ctctgttccaagtgtgtgtgc

SEQ ID NO: 1950580 - DNA, 22 bp, Homo sapiens
ctctgttccaagtgtgtgtgca

SEQ ID NO: 1950581 - DNA, 22 bp, Homo sapiens
ctcttcatgcgcagtccccagg

SEQ ID NO: 1950582 - DNA, 15 bp, Homo sapiens
ctcttctcagctcca

SEQ ID NO: 1950583 - DNA, 22 bp, Homo sapiens
ctcttcttgcggcaccgcccac

SEQ ID NO: 1950584 - DNA, 12 bp, Homo sapiens
aaaaaaatatga

SEQ ID NO: 1950585 - DNA, 13 bp, Homo sapiens
aaaaaacatttta

SEQ ID NO: 1950586 - DNA, 12 bp, Homo sapiens
aaaaaattaaaa

SEQ ID NO: 1950587 - DNA, 24 bp, Homo sapiens
aaaaactttccatgacagtagcat

SEQ ID NO: 1950588 - DNA, 21 bp, Homo sapiens
aaaaagatggatttgacacac

SEQ ID NO: 1950589 - DNA, 22 bp, Homo sapiens
aaaaagatggatttgacacact

SEQ ID NO: 1950590 - DNA, 18 bp, Homo sapiens
aaaaatagctataaatag

SEQ ID NO: 1950591 - DNA, 12 bp, Homo sapiens
aaaaatatgtat

SEQ ID NO: 1950592 - DNA, 16 bp, Homo sapiens
aaaaattatctttaaa

SEQ ID NO: 1950593 - DNA, 23 bp, Homo sapiens
aaaacaaaatccttgccttcaaa

SEQ ID NO: 1950594 - DNA, 22 bp, Homo sapiens
aaaacaacagcaacaacaacag

SEQ ID NO: 1950595 - DNA, 18 bp, Homo sapiens
aaaacaaccaaagaaaat

SEQ ID NO: 1950596 - DNA, 17 bp, Homo sapiens
aaaaccccatagtgcct

SEQ ID NO: 1950597 - DNA, 15 bp, Homo sapiens
aaaacgatttaattt

SEQ ID NO: 1950598 - DNA, 10 bp, Homo sapiens
aaaactgtga

SEQ ID NO: 1950599 - DNA, 15 bp, Homo sapiens
aaaactgtgacattc

SEQ ID NO: 1950600 - DNA, 21 bp, Homo sapiens
aaaactttccatgacagtagc

SEQ ID NO: 1950601 - DNA, 23 bp, Homo sapiens
aaaactttccatgacagtagcat

SEQ ID NO: 1950602 - DNA, 22 bp, Homo sapiens
aaaagaaaatgtgtaacagagt

SEQ ID NO: 1950603 - DNA, 13 bp, Homo sapiens
aaaagaagtgtga

SEQ ID NO: 1950604 - DNA, 13 bp, Homo sapiens
aaaagaatatatt

SEQ ID NO: 1950605 - DNA, 14 bp, Homo sapiens
aaaagccctcttca

SEQ ID NO: 1950606 - DNA, 19 bp, Homo sapiens
aaaagcggggttcaatgct

SEQ ID NO: 1950607 - DNA, 22 bp, Homo sapiens
aaaagtgatgtgatttatgcat

SEQ ID NO: 1950608 - DNA, 15 bp, Homo sapiens
aaaatagctataaat

SEQ ID NO: 1950609 - DNA, 16 bp, Homo sapiens
aaaatatatgtttggc

SEQ ID NO: 1950610 - DNA, 23 bp, Homo sapiens
aaaatgctgcctagtgctacaga

SEQ ID NO: 1950611 - DNA, 14 bp, Homo sapiens
aaaattaaaatttt

SEQ ID NO: 1950612 - DNA, 18 bp, Homo sapiens
aaaattattaaaaattat

SEQ ID NO: 1950613 - DNA, 20 bp, Homo sapiens
aaaattattaaaaattatag

SEQ ID NO: 1950614 - DNA, 21 bp, Homo sapiens
aaaattattaaaaattataga

SEQ ID NO: 1950615 - DNA, 15 bp, Homo sapiens
aaacaaaaactttcc

SEQ ID NO: 1950616 - DNA, 19 bp, Homo sapiens
aaacagtgtggcttaaaca

SEQ ID NO: 1950617 - DNA, 23 bp, Homo sapiens
aaacagtgtggcttaaacatttt

SEQ ID NO: 1950618 - DNA, 16 bp, Homo sapiens
aaaccaatttgttctg

SEQ ID NO: 1950619 - DNA, 12 bp, Homo sapiens
aaaccagaaaga

SEQ ID NO: 1950620 - DNA, 17 bp, Homo sapiens
aaaccagaaagaggaat

SEQ ID NO: 1950621 - DNA, 18 bp, Homo sapiens
aaaccttagtaccttttt

SEQ ID NO: 1950622 - DNA, 14 bp, Homo sapiens
aaaccttttaaaaa

SEQ ID NO: 1950623 - DNA, 18 bp, Homo sapiens
aaactgcgtaggagagaa

SEQ ID NO: 1950624 - DNA, 17 bp, Homo sapiens
aaactgtgagataaata

SEQ ID NO: 1950625 - DNA, 15 bp, Homo sapiens
aaactttccatgaca

SEQ ID NO: 1950626 - DNA, 12 bp, Homo sapiens
aaagaagtgtga

SEQ ID NO: 1950627 - DNA, 14 bp, Homo sapiens
aaagacatgaaatt

SEQ ID NO: 1950628 - DNA, 20 bp, Homo sapiens
aaagataccaaatagaaaca

SEQ ID NO: 1950629 - DNA, 17 bp, Homo sapiens
aaagatatgaagaacta

SEQ ID NO: 1950630 - DNA, 13 bp, Homo sapiens
aaagcaaaacatt

SEQ ID NO: 1950631 - DNA, 20 bp, Homo sapiens
aaagcaggaaagatcccaag

SEQ ID NO: 1950632 - DNA, 21 bp, Homo sapiens
aaagcaggaaagatcccaagt

SEQ ID NO: 1950633 - DNA, 13 bp, Homo sapiens
aaagcatgctcag

SEQ ID NO: 1950634 - DNA, 15 bp, Homo sapiens
aaagccctccctgtc

SEQ ID NO: 1950635 - DNA, 17 bp, Homo sapiens
accgcccaacccccacc

SEQ ID NO: 1950636 - DNA, 19 bp, Homo sapiens
accgcccaacccccacctc

SEQ ID NO: 1950637 - DNA, 21 bp, Homo sapiens
accgcccaacccccacctccc

SEQ ID NO: 1950638 - DNA, 14 bp, Homo sapiens
acctaattaatttc

SEQ ID NO: 1950639 - DNA, 13 bp, Homo sapiens
acctcaaaagaaa

SEQ ID NO: 1950640 - DNA, 20 bp, Homo sapiens
acctccctgtctctacaaaa

SEQ ID NO: 1950641 - DNA, 14 bp, Homo sapiens
acctctcagatccc

SEQ ID NO: 1950642 - DNA, 17 bp, Homo sapiens
acctctcagatccctcg

SEQ ID NO: 1950643 - DNA, 20 bp, Homo sapiens
acctgcccagttagcccggc

SEQ ID NO: 1950644 - DNA, 20 bp, Homo sapiens
accttctaatccatgtgctg

SEQ ID NO: 1950645 - DNA, 23 bp, Homo sapiens
accttctgtgcatctggcctggg

SEQ ID NO: 1950646 - DNA, 14 bp, Homo sapiens
acctttcctgaaat

SEQ ID NO: 1950647 - DNA, 18 bp, Homo sapiens
acctttggcttaattcca

SEQ ID NO: 1950648 - DNA, 16 bp, Homo sapiens
accttttaaaaaaata

SEQ ID NO: 1950649 - DNA, 17 bp, Homo sapiens
accttttaaaaaaataa

SEQ ID NO: 1950650 - DNA, 15 bp, Homo sapiens
acgcagagccccgga

SEQ ID NO: 1950651 - DNA, 17 bp, Homo sapiens
acgcagagccccggagc

SEQ ID NO: 1950652 - DNA, 18 bp, Homo sapiens
acgcagagccccggagca

SEQ ID NO: 1950653 - DNA, 15 bp, Homo sapiens
acgccggggctggcc

SEQ ID NO: 1950654 - DNA, 18 bp, Homo sapiens
acggacgggacagcggcc

SEQ ID NO: 1950655 - DNA, 22 bp, Homo sapiens
acggatttagctaacaaaagat

SEQ ID NO: 1950656 - DNA, 14 bp, Homo sapiens
acggcagccccatc

SEQ ID NO: 1950657 - DNA, 15 bp, Homo sapiens
acggcagccccatcc

SEQ ID NO: 1950658 - DNA, 21 bp, Homo sapiens
acggccgtccctgacttccca

SEQ ID NO: 1950659 - DNA, 13 bp, Homo sapiens
acgggagagcgcc

SEQ ID NO: 1950660 - DNA, 19 bp, Homo sapiens
acgggagagcgccacccgc

SEQ ID NO: 1950661 - DNA, 12 bp, Homo sapiens
acgggcctcccc

SEQ ID NO: 1950662 - DNA, 19 bp, Homo sapiens
actaaatagatttttagat

SEQ ID NO: 1950663 - DNA, 18 bp, Homo sapiens
actaatgaaatttacagt

SEQ ID NO: 1950664 - DNA, 13 bp, Homo sapiens
actacaacattag

SEQ ID NO: 1950665 - DNA, 18 bp, Homo sapiens
actacaacattagaatat

SEQ ID NO: 1950666 - DNA, 19 bp, Homo sapiens
actacaacattagaatatt

SEQ ID NO: 1950667 - DNA, 22 bp, Homo sapiens
actacaacattagaatattgta

SEQ ID NO: 1950668 - DNA, 21 bp, Homo sapiens
actagccctctttctctctgt

SEQ ID NO: 1950669 - DNA, 13 bp, Homo sapiens
actatcagcagcg

SEQ ID NO: 1950670 - DNA, 16 bp, Homo sapiens
actatcagcagcggca

SEQ ID NO: 1950671 - DNA, 20 bp, Homo sapiens
actatggtatatattttgaa

SEQ ID NO: 1950672 - DNA, 18 bp, Homo sapiens
actcaccatttaatcatt

SEQ ID NO: 1950673 - DNA, 16 bp, Homo sapiens
actcaggcagtgcagt

SEQ ID NO: 1950674 - DNA, 20 bp, Homo sapiens
actcagtaaggcagtgcagt

SEQ ID NO: 1950675 - DNA, 20 bp, Homo sapiens
actcagttaggcagtgcagt

SEQ ID NO: 1950676 - DNA, 13 bp, Homo sapiens
actcatgtgattt

SEQ ID NO: 1950677 - DNA, 17 bp, Homo sapiens
actcccagggcccgagc

SEQ ID NO: 1950678 - DNA, 22 bp, Homo sapiens
actccccgcccgccctcctctg

SEQ ID NO: 1950679 - DNA, 23 bp, Homo sapiens
actctaagaaatggctttccaca

SEQ ID NO: 1950680 - DNA, 21 bp, Homo sapiens
actctgaagtcccttcctgtc

SEQ ID NO: 1950681 - DNA, 22 bp, Homo sapiens
actctgaagtcccttcctgtcc

SEQ ID NO: 1950682 - DNA, 23 bp, Homo sapiens
actctgaagtcccttcctgtcct

SEQ ID NO: 1950683 - DNA, 13 bp, Homo sapiens
actgaagcagagt

SEQ ID NO: 1950684 - DNA, 15 bp, Homo sapiens
actgaagcagagtca

SEQ ID NO: 1950685 - DNA, 16 bp, Homo sapiens
actgatatcacgggcc

SEQ ID NO: 1950686 - DNA, 19 bp, Homo sapiens
actgatatcacgggcccgc

SEQ ID NO: 1950687 - DNA, 22 bp, Homo sapiens
actgatatcacgggcccgctca

SEQ ID NO: 1950688 - DNA, 22 bp, Homo sapiens
actgatgggtatcatgcttcta

SEQ ID NO: 1950689 - DNA, 18 bp, Homo sapiens
actgatgggtcctgctgc

SEQ ID NO: 1950690 - DNA, 21 bp, Homo sapiens
actgatgggtcctgctgctcg

SEQ ID NO: 1950691 - DNA, 16 bp, Homo sapiens
actgctatcagtctct

SEQ ID NO: 1950692 - DNA, 20 bp, Homo sapiens
actggaggtacaaataattt

SEQ ID NO: 1950693 - DNA, 22 bp, Homo sapiens
actggccccaggcggaggggct

SEQ ID NO: 1950694 - DNA, 16 bp, Homo sapiens
actgtcttcaaccctg

SEQ ID NO: 1950695 - DNA, 12 bp, Homo sapiens
actgtgacattc

SEQ ID NO: 1950696 - DNA, 19 bp, Homo sapiens
actgtgacattccacagag

SEQ ID NO: 1950697 - DNA, 15 bp, Homo sapiens
actgtgagataaata

SEQ ID NO: 1950698 - DNA, 16 bp, Homo sapiens
actgtgagataaatat

SEQ ID NO: 1950699 - DNA, 14 bp, Homo sapiens
acttaaacaaaaac

SEQ ID NO: 1950700 - DNA, 14 bp, Homo sapiens
acttactatggtat

SEQ ID NO: 1950701 - DNA, 17 bp, Homo sapiens
acttatttataacattg

SEQ ID NO: 1950702 - DNA, 13 bp, Homo sapiens
acttcccagctgg

SEQ ID NO: 1950703 - DNA, 14 bp, Homo sapiens
acttcccagctggc

SEQ ID NO: 1950704 - DNA, 20 bp, Homo sapiens
acttctttactaacactggc

SEQ ID NO: 1950705 - DNA, 12 bp, Homo sapiens
acttgctgtgaa

SEQ ID NO: 1950706 - DNA, 14 bp, Homo sapiens
acttgctgtgactt

SEQ ID NO: 1950707 - DNA, 13 bp, Homo sapiens
actttcagaatgt

SEQ ID NO: 1950708 - DNA, 14 bp, Homo sapiens
actttccatgacag

SEQ ID NO: 1950709 - DNA, 20 bp, Homo sapiens
actttccatgacagtagcat

SEQ ID NO: 1950710 - DNA, 20 bp, Homo sapiens
actttgtctttctgcagaaa

SEQ ID NO: 1950711 - DNA, 22 bp, Homo sapiens
actttgtctttctgcagaaaat

SEQ ID NO: 1950712 - DNA, 23 bp, Homo sapiens
actttgtgtcttttgttctctct

SEQ ID NO: 1950713 - DNA, 18 bp, Homo sapiens
acttttagtggttctgtg

SEQ ID NO: 1950714 - DNA, 22 bp, Homo sapiens
acttttagtggttctgtgcctc

SEQ ID NO: 1950715 - DNA, 19 bp, Homo sapiens
acttttgggatttgttgaa

SEQ ID NO: 1950716 - DNA, 20 bp, Homo sapiens
acttttgggatttgttgaaa

SEQ ID NO: 1950717 - DNA, 15 bp, Homo sapiens
acttttttcctgtca

SEQ ID NO: 1950718 - DNA, 18 bp, Homo sapiens
acttttttcctgtcaata

SEQ ID NO: 1950719 - DNA, 14 bp, Homo sapiens
agaaacccctgaca

SEQ ID NO: 1950720 - DNA, 22 bp, Homo sapiens
agaaaccttttaaaaaaataat

SEQ ID NO: 1950721 - DNA, 23 bp, Homo sapiens
agaaaccttttaaaaaaataata

SEQ ID NO: 1950722 - DNA, 14 bp, Homo sapiens
agaaataaaagatg

SEQ ID NO: 1950723 - DNA, 19 bp, Homo sapiens
agaaatatccctcatttca

SEQ ID NO: 1950724 - DNA, 21 bp, Homo sapiens
agaaatatccctcatttcatt

SEQ ID NO: 1950725 - DNA, 12 bp, Homo sapiens
agaacaacaaca

SEQ ID NO: 1950726 - DNA, 13 bp, Homo sapiens
agaaccttctaat

SEQ ID NO: 1950727 - DNA, 18 bp, Homo sapiens
agaactcatgtgatttac

SEQ ID NO: 1950728 - DNA, 18 bp, Homo sapiens
agaactgacttcctgaac

SEQ ID NO: 1950729 - DNA, 23 bp, Homo sapiens
agaagcagcagctagaaagagaa

SEQ ID NO: 1950730 - DNA, 13 bp, Homo sapiens
agaagggagtgaa

SEQ ID NO: 1950731 - DNA, 21 bp, Homo sapiens
agaagtgaaaaagacttcaaa

SEQ ID NO: 1950732 - DNA, 20 bp, Homo sapiens
agaatatattgccaaatatt

SEQ ID NO: 1950733 - DNA, 16 bp, Homo sapiens
agaatcaagtctgtga

SEQ ID NO: 1950734 - DNA, 17 bp, Homo sapiens
agaatttaccagaaata

SEQ ID NO: 1950735 - DNA, 13 bp, Homo sapiens
agaattttaaaaa

SEQ ID NO: 1950736 - DNA, 13 bp, Homo sapiens
agacaacacacac

SEQ ID NO: 1950737 - DNA, 14 bp, Homo sapiens
agacaacacacaca

SEQ ID NO: 1950738 - DNA, 13 bp, Homo sapiens
agacactgtcaag

SEQ ID NO: 1950739 - DNA, 19 bp, Homo sapiens
agactcgagagggctgagc

SEQ ID NO: 1950740 - DNA, 16 bp, Homo sapiens
agactgcccaccctgg

SEQ ID NO: 1950741 - DNA, 19 bp, Homo sapiens
agactgcccaccctgggcc

SEQ ID NO: 1950742 - DNA, 14 bp, Homo sapiens
agactgctatcagt

SEQ ID NO: 1950743 - DNA, 16 bp, Homo sapiens
agacttctaaatcata

SEQ ID NO: 1950744 - DNA, 16 bp, Homo sapiens
agagaaaatgctgcct

SEQ ID NO: 1950745 - DNA, 13 bp, Homo sapiens
agagacggcagcc

SEQ ID NO: 1950746 - DNA, 18 bp, Homo sapiens
agctcatcttttcctgct

SEQ ID NO: 1950747 - DNA, 17 bp, Homo sapiens
agctccaccctcccctc

SEQ ID NO: 1950748 - DNA, 16 bp, Homo sapiens
agctccactctgaagt

SEQ ID NO: 1950749 - DNA, 13 bp, Homo sapiens
agctccttcatgc

SEQ ID NO: 1950750 - DNA, 17 bp, Homo sapiens
agctccttcatgctttt

SEQ ID NO: 1950751 - DNA, 14 bp, Homo sapiens
agctgcctctttgc

SEQ ID NO: 1950752 - DNA, 19 bp, Homo sapiens
agctgcctctttgctgctt

SEQ ID NO: 1950753 - DNA, 20 bp, Homo sapiens
agctgcctctttgctgcttt

SEQ ID NO: 1950754 - DNA, 17 bp, Homo sapiens
agctggcagcgcctccc

SEQ ID NO: 1950755 - DNA, 20 bp, Homo sapiens
agctggcagcgcctcccgcc

SEQ ID NO: 1950756 - DNA, 19 bp, Homo sapiens
agctggctgggtcgcccct

SEQ ID NO: 1950757 - DNA, 20 bp, Homo sapiens
agcttcttgctgccaggccc

SEQ ID NO: 1950758 - DNA, 16 bp, Homo sapiens
agctttctgatactta

SEQ ID NO: 1950759 - DNA, 17 bp, Homo sapiens
aggaaagatcccaagtc

SEQ ID NO: 1950760 - DNA, 15 bp, Homo sapiens
aggaatgctcaatgt

SEQ ID NO: 1950761 - DNA, 21 bp, Homo sapiens
aggaatgctcaatgtgctgtt

SEQ ID NO: 1950762 - DNA, 15 bp, Homo sapiens
aggacaagtgtaata

SEQ ID NO: 1950763 - DNA, 12 bp, Homo sapiens
aggacactgatg

SEQ ID NO: 1950764 - DNA, 18 bp, Homo sapiens
aggacactgatgggtcct

SEQ ID NO: 1950765 - DNA, 23 bp, Homo sapiens
aggacactgatgggtcctgctgc

SEQ ID NO: 1950766 - DNA, 16 bp, Homo sapiens
aggacatctctgtaaa

SEQ ID NO: 1950767 - DNA, 16 bp, Homo sapiens
aggacggggcagagct

SEQ ID NO: 1950768 - DNA, 17 bp, Homo sapiens
aggacggggcagagctg

SEQ ID NO: 1950769 - DNA, 14 bp, Homo sapiens
aggagaaggaggaa

SEQ ID NO: 1950770 - DNA, 17 bp, Homo sapiens
aggagatgaggctggat

SEQ ID NO: 1950771 - DNA, 9 bp, Homo sapiens
aggagcacc

SEQ ID NO: 1950772 - DNA, 10 bp, Homo sapiens
aggagcaccc

SEQ ID NO: 1950773 - DNA, 16 bp, Homo sapiens
aggagcacccccagcc

SEQ ID NO: 1950774 - DNA, 22 bp, Homo sapiens
aggagcacccccagcctccccc

SEQ ID NO: 1950775 - DNA, 21 bp, Homo sapiens
aggagggaaagttccagcagt

SEQ ID NO: 1950776 - DNA, 20 bp, Homo sapiens
aggcaaaccaatttgttctg

SEQ ID NO: 1950777 - DNA, 15 bp, Homo sapiens
aggcactttttaaca

SEQ ID NO: 1950778 - DNA, 23 bp, Homo sapiens
aggcactttttaacattctcaat

SEQ ID NO: 1950779 - DNA, 19 bp, Homo sapiens
aggcatatactttgtcttt

SEQ ID NO: 1950780 - DNA, 22 bp, Homo sapiens
aggcatatactttgtctttctg

SEQ ID NO: 1950781 - DNA, 19 bp, Homo sapiens
aggcattgcactaaaagtg

SEQ ID NO: 1950782 - DNA, 22 bp, Homo sapiens
aggcattgcactaaaagtgatg

SEQ ID NO: 1950783 - DNA, 18 bp, Homo sapiens
aggcctgagggaagccca

SEQ ID NO: 1950784 - DNA, 20 bp, Homo sapiens
aggcctgagggaagcccacc

SEQ ID NO: 1950785 - DNA, 23 bp, Homo sapiens
aggcctgagggaagcccacccgc

SEQ ID NO: 1950786 - DNA, 21 bp, Homo sapiens
aggcctgtcctctacatacca

SEQ ID NO: 1950787 - DNA, 17 bp, Homo sapiens
aggcgcccacctgccca

SEQ ID NO: 1950788 - DNA, 16 bp, Homo sapiens
aggcgcgcaccgccca

SEQ ID NO: 1950789 - DNA, 21 bp, Homo sapiens
aggcgcgcaccgcccaacccc

SEQ ID NO: 1950790 - DNA, 21 bp, Homo sapiens
aggcggaggggcttggagcag

SEQ ID NO: 1950791 - DNA, 15 bp, Homo sapiens
aggctgcgcctgccc

SEQ ID NO: 1950792 - DNA, 23 bp, Homo sapiens
aggcttgtgtaatttcctgctcc

SEQ ID NO: 1950793 - DNA, 17 bp, Homo sapiens
agggaagcccacccgcc

SEQ ID NO: 1950794 - DNA, 19 bp, Homo sapiens
agggaagcccacccgcccc

SEQ ID NO: 1950795 - DNA, 19 bp, Homo sapiens
agggactccagaagcagca

SEQ ID NO: 1950796 - DNA, 22 bp, Homo sapiens
agggatgctatctcgctagcca

SEQ ID NO: 1950797 - DNA, 22 bp, Homo sapiens
agggccctggggtctctgagca

SEQ ID NO: 1950798 - DNA, 23 bp, Homo sapiens
agggccctggggtctctgagcag

SEQ ID NO: 1950799 - DNA, 18 bp, Homo sapiens
agggccgcagggcgctcc

SEQ ID NO: 1950800 - DNA, 16 bp, Homo sapiens
agggcgctccggcaga

SEQ ID NO: 1950801 - DNA, 18 bp, Homo sapiens
agggcgctccggcagagg

SEQ ID NO: 1950802 - DNA, 12 bp, Homo sapiens
agggctgagccc

SEQ ID NO: 1950803 - DNA, 13 bp, Homo sapiens
agggctgagcccc

SEQ ID NO: 1950804 - DNA, 15 bp, Homo sapiens
agggctgagcccctc

SEQ ID NO: 1950805 - DNA, 18 bp, Homo sapiens
agggctgagcccctcctc

SEQ ID NO: 1950806 - DNA, 20 bp, Homo sapiens
aggggatggcccattaagag

SEQ ID NO: 1950807 - DNA, 15 bp, Homo sapiens
aggggcttggagcag

SEQ ID NO: 1950808 - DNA, 20 bp, Homo sapiens
aggggcttggagcagagacg

SEQ ID NO: 1950809 - DNA, 19 bp, Homo sapiens
aggtaaactgatgctttca

SEQ ID NO: 1950810 - DNA, 19 bp, Homo sapiens
aggtacaaataatttagaa

SEQ ID NO: 1950811 - DNA, 21 bp, Homo sapiens
aggtacaaataatttagaaat

SEQ ID NO: 1950812 - DNA, 21 bp, Homo sapiens
aggtatctgatgatgttctga

SEQ ID NO: 1950813 - DNA, 18 bp, Homo sapiens
aggtgcggaccggagcgg

SEQ ID NO: 1950814 - DNA, 18 bp, Homo sapiens
aggttgctggcatttgct

SEQ ID NO: 1950815 - DNA, 19 bp, Homo sapiens
aggttgttaaaacagaaaa

SEQ ID NO: 1950816 - DNA, 20 bp, Homo sapiens
aggtttagaatcaagtctgt

SEQ ID NO: 1950817 - DNA, 17 bp, Homo sapiens
agtaaatctaaattaac

SEQ ID NO: 1950818 - DNA, 16 bp, Homo sapiens
agtaaatgtatattga

SEQ ID NO: 1950819 - DNA, 17 bp, Homo sapiens
agtaagcaccagctgcc

SEQ ID NO: 1950820 - DNA, 17 bp, Homo sapiens
agtaattactttcagaa

SEQ ID NO: 1950821 - DNA, 20 bp, Homo sapiens
agtaattactttcagaatgt

SEQ ID NO: 1950822 - DNA, 23 bp, Homo sapiens
agtaattactttcagaatgttgt

SEQ ID NO: 1950823 - DNA, 19 bp, Homo sapiens
agtacaattctttgttgct

SEQ ID NO: 1950824 - DNA, 14 bp, Homo sapiens
agtaccatcccact

SEQ ID NO: 1950825 - DNA, 15 bp, Homo sapiens
agtacctttttaaca

SEQ ID NO: 1950826 - DNA, 13 bp, Homo sapiens
agtagaaaataca

SEQ ID NO: 1950827 - DNA, 17 bp, Homo sapiens
agtattgagacactgtc

SEQ ID NO: 1950828 - DNA, 19 bp, Homo sapiens
agtattgagacactgtcaa

SEQ ID NO: 1950829 - DNA, 20 bp, Homo sapiens
agtattgagacactgtcaag

SEQ ID NO: 1950830 - DNA, 18 bp, Homo sapiens
agtattgagtgttctagt

SEQ ID NO: 1950831 - DNA, 23 bp, Homo sapiens
agtattgttcttgtaaaactgtg

SEQ ID NO: 1950832 - DNA, 19 bp, Homo sapiens
agtcagaaatgattcaggg

SEQ ID NO: 1950833 - DNA, 15 bp, Homo sapiens
agtcatttaagaatt

SEQ ID NO: 1950834 - DNA, 19 bp, Homo sapiens
agtccacccccattgtgaa

SEQ ID NO: 1950835 - DNA, 21 bp, Homo sapiens
agtccacccccattgtgaatg

SEQ ID NO: 1950836 - DNA, 20 bp, Homo sapiens
agtccactttcctctctctc

SEQ ID NO: 1950837 - DNA, 20 bp, Homo sapiens
agtcccttcctgtcctgctc

SEQ ID NO: 1950838 - DNA, 13 bp, Homo sapiens
agtcggctgggca

SEQ ID NO: 1950839 - DNA, 15 bp, Homo sapiens
agtcggctgggcagg

SEQ ID NO: 1950840 - DNA, 17 bp, Homo sapiens
agtcggctgggcagggc

SEQ ID NO: 1950841 - DNA, 20 bp, Homo sapiens
agtcggctgggcagggccgc

SEQ ID NO: 1950842 - DNA, 16 bp, Homo sapiens
agtcgggggaaaaaat

SEQ ID NO: 1950843 - DNA, 16 bp, Homo sapiens
agtctcctaataagtt

SEQ ID NO: 1950844 - DNA, 14 bp, Homo sapiens
agtctcctgtatca

SEQ ID NO: 1950845 - DNA, 11 bp, Homo sapiens
agtctgtcctt

SEQ ID NO: 1950846 - DNA, 20 bp, Homo sapiens
agtgaaaaagacttcaaatg

SEQ ID NO: 1950847 - DNA, 19 bp, Homo sapiens
agtgaaaacctctttcgga

SEQ ID NO: 1950848 - DNA, 23 bp, Homo sapiens
agtgagacctccctgtctctaca

SEQ ID NO: 1950849 - DNA, 21 bp, Homo sapiens
agtgaggtatgatgtgctgct

SEQ ID NO: 1950850 - DNA, 19 bp, Homo sapiens
agtgatacggatttagcta

SEQ ID NO: 1950851 - DNA, 17 bp, Homo sapiens
agtgatagaacaaaaga

SEQ ID NO: 1950852 - DNA, 16 bp, Homo sapiens
agtgatgtgatttatg

SEQ ID NO: 1950853 - DNA, 22 bp, Homo sapiens
agtgattgacattttgtagcta

SEQ ID NO: 1950854 - DNA, 20 bp, Homo sapiens
agtgccttgattttaattca

SEQ ID NO: 1950855 - DNA, 15 bp, Homo sapiens
agtgctacagatgta

SEQ ID NO: 1950856 - DNA, 19 bp, Homo sapiens
cagactcgagagggctgag

SEQ ID NO: 1950857 - DNA, 22 bp, Homo sapiens
cagactcgagagggctgagccc

SEQ ID NO: 1950858 - DNA, 16 bp, Homo sapiens
cagagacggcagcccc

SEQ ID NO: 1950859 - DNA, 18 bp, Homo sapiens
cagagacggcagccccat

SEQ ID NO: 1950860 - DNA, 21 bp, Homo sapiens
cagagacggcagccccatcct

SEQ ID NO: 1950861 - DNA, 10 bp, Homo sapiens
cagagactgc

SEQ ID NO: 1950862 - DNA, 17 bp, Homo sapiens
cagagactgcccaccct

SEQ ID NO: 1950863 - DNA, 23 bp, Homo sapiens
cagagactgcccaccctgggcct

SEQ ID NO: 1950864 - DNA, 24 bp, Homo sapiens
cagagactgcccaccctgggcctc

SEQ ID NO: 1950865 - DNA, 21 bp, Homo sapiens
cagagcgatgtgttctttgta

SEQ ID NO: 1950866 - DNA, 22 bp, Homo sapiens
cagagcgatgtgttctttgtac

SEQ ID NO: 1950867 - DNA, 13 bp, Homo sapiens
cagaggagaggag

SEQ ID NO: 1950868 - DNA, 22 bp, Homo sapiens
cagaggagaggagcaaacagga

SEQ ID NO: 1950869 - DNA, 12 bp, Homo sapiens
cagaggcagggc

SEQ ID NO: 1950870 - DNA, 14 bp, Homo sapiens
cagaggcagggccc

SEQ ID NO: 1950871 - DNA, 17 bp, Homo sapiens
cagaggcagggccctgg

SEQ ID NO: 1950872 - DNA, 18 bp, Homo sapiens
cagaggcagggccctggg

SEQ ID NO: 1950873 - DNA, 22 bp, Homo sapiens
cagatagtatacacatcataaa

SEQ ID NO: 1950874 - DNA, 21 bp, Homo sapiens
cagatcacatgcccctcttag

SEQ ID NO: 1950875 - DNA, 18 bp, Homo sapiens
cagatgacctgaggaaag

SEQ ID NO: 1950876 - DNA, 13 bp, Homo sapiens
cagcaaaatatat

SEQ ID NO: 1950877 - DNA, 13 bp, Homo sapiens
cagcaacaacaac

SEQ ID NO: 1950878 - DNA, 17 bp, Homo sapiens
cagcaccagcctgagcc

SEQ ID NO: 1950879 - DNA, 18 bp, Homo sapiens
cagcaccagcctgagcca

SEQ ID NO: 1950880 - DNA, 12 bp, Homo sapiens
cagcactcccag

SEQ ID NO: 1950881 - DNA, 13 bp, Homo sapiens
cagcactcccagg

SEQ ID NO: 1950882 - DNA, 15 bp, Homo sapiens
cagcactcccagggc

SEQ ID NO: 1950883 - DNA, 12 bp, Homo sapiens
cagcagcagcag

SEQ ID NO: 1950884 - DNA, 19 bp, Homo sapiens
cagcagcagtttgtgatct

SEQ ID NO: 1950885 - DNA, 19 bp, Homo sapiens
cagcagcggcagcagcagc

SEQ ID NO: 1950886 - DNA, 16 bp, Homo sapiens
cagcagtaccatccca

SEQ ID NO: 1950887 - DNA, 18 bp, Homo sapiens
cagcagtttcatgagatg

SEQ ID NO: 1950888 - DNA, 17 bp, Homo sapiens
cagcccagaacgggcct

SEQ ID NO: 1950889 - DNA, 21 bp, Homo sapiens
cagccccatccttcccgcagc

SEQ ID NO: 1950890 - DNA, 13 bp, Homo sapiens
cagcccctgctgg

SEQ ID NO: 1950891 - DNA, 18 bp, Homo sapiens
cagccgcgctctgcccct

SEQ ID NO: 1950892 - DNA, 18 bp, Homo sapiens
cagcctcccccaggctgc

SEQ ID NO: 1950893 - DNA, 11 bp, Homo sapiens
cagcctgagct

SEQ ID NO: 1950894 - DNA, 21 bp, Homo sapiens
cagcgcctcccgccgcctcgg

SEQ ID NO: 1950895 - DNA, 15 bp, Homo sapiens
cagctaagcctgatg

SEQ ID NO: 1950896 - DNA, 19 bp, Homo sapiens
cagctaagcctgatgatgg

SEQ ID NO: 1950897 - DNA, 14 bp, Homo sapiens
cagctagaaagaga

SEQ ID NO: 1950898 - DNA, 14 bp, Homo sapiens
cagctccactctga

SEQ ID NO: 1950899 - DNA, 21 bp, Homo sapiens
cagctgcctctttgctgcttt

SEQ ID NO: 1950900 - DNA, 23 bp, Homo sapiens
cagctggcagcgcctcccgccgc

SEQ ID NO: 1950901 - DNA, 23 bp, Homo sapiens
cagctggctgggtcgcccctcct

SEQ ID NO: 1950902 - DNA, 19 bp, Homo sapiens
caggaacccttacagtaga

SEQ ID NO: 1950903 - DNA, 17 bp, Homo sapiens
caggagatgaggctgga

SEQ ID NO: 1950904 - DNA, 20 bp, Homo sapiens
caggcatccgctgcgctccc

SEQ ID NO: 1950905 - DNA, 21 bp, Homo sapiens
caggcattgcactaaaagtga

SEQ ID NO: 1950906 - DNA, 15 bp, Homo sapiens
caggcgcgcaccgcc

SEQ ID NO: 1950907 - DNA, 21 bp, Homo sapiens
caggcgcgcaccgcccaaccc

SEQ ID NO: 1950908 - DNA, 22 bp, Homo sapiens
caggcgcgcaccgcccaacccc

SEQ ID NO: 1950909 - DNA, 22 bp, Homo sapiens
caggcggaggggcttggagcag

SEQ ID NO: 1950910 - DNA, 14 bp, Homo sapiens
caggctgcgcctgc

SEQ ID NO: 1950911 - DNA, 15 bp, Homo sapiens
caggctgcgcctgcc

SEQ ID NO: 1950912 - DNA, 16 bp, Homo sapiens
caggctgcgcctgccc

SEQ ID NO: 1950913 - DNA, 21 bp, Homo sapiens
caggctgcgcctgcccgcccg

SEQ ID NO: 1950914 - DNA, 19 bp, Homo sapiens
cagggatgctatctcgcta

SEQ ID NO: 1950915 - DNA, 12 bp, Homo sapiens
cagggcccgagc

SEQ ID NO: 1950916 - DNA, 24 bp, Homo sapiens
cagggccctggggtctctgagcag

SEQ ID NO: 1950917 - DNA, 13 bp, Homo sapiens
cagggcgctccgg

SEQ ID NO: 1950918 - DNA, 14 bp, Homo sapiens
cagggcgctccggc

SEQ ID NO: 1950919 - DNA, 14 bp, Homo sapiens
caggggaggctgag

SEQ ID NO: 1950920 - DNA, 16 bp, Homo sapiens
caggggaggctgagac

SEQ ID NO: 1950921 - DNA, 23 bp, Homo sapiens
cagggtgcaggcgcgcaccgccc

SEQ ID NO: 1950922 - DNA, 14 bp, Homo sapiens
cagtaaatgtatat

SEQ ID NO: 1950923 - DNA, 13 bp, Homo sapiens
cagtaattacttt

SEQ ID NO: 1950924 - DNA, 20 bp, Homo sapiens
cagtacaataaataaaagaa

SEQ ID NO: 1950925 - DNA, 17 bp, Homo sapiens
cagtacaattctttgtt

SEQ ID NO: 1950926 - DNA, 21 bp, Homo sapiens
cagtacaattctttgttgctt

SEQ ID NO: 1950927 - DNA, 17 bp, Homo sapiens
cagtaccatcccactga

SEQ ID NO: 1950928 - DNA, 21 bp, Homo sapiens
cagtagcatactgatgagaca

SEQ ID NO: 1950929 - DNA, 13 bp, Homo sapiens
cagtattgagaca

SEQ ID NO: 1950930 - DNA, 17 bp, Homo sapiens
cagtattgagacactgt

SEQ ID NO: 1950931 - DNA, 21 bp, Homo sapiens
cagtattgagacactgtcaag

SEQ ID NO: 1950932 - DNA, 18 bp, Homo sapiens
cagtattgttcttgtaaa

SEQ ID NO: 1950933 - DNA, 23 bp, Homo sapiens
cagtattgttcttgtaaaactgt

SEQ ID NO: 1950934 - DNA, 21 bp, Homo sapiens
cagtccacccccattgtgaat

SEQ ID NO: 1950935 - DNA, 14 bp, Homo sapiens
cagtgatagaacaa

SEQ ID NO: 1950936 - DNA, 20 bp, Homo sapiens
cagtgatgccatgaagacag

SEQ ID NO: 1950937 - DNA, 14 bp, Homo sapiens
cagtggggcccatg

SEQ ID NO: 1950938 - DNA, 19 bp, Homo sapiens
cagtggggcccatggcccc

SEQ ID NO: 1950939 - DNA, 21 bp, Homo sapiens
cagtggggcccatggccccag

SEQ ID NO: 1950940 - DNA, 16 bp, Homo sapiens
cagtgtggatgtaaat

SEQ ID NO: 1950941 - DNA, 11 bp, Homo sapiens
cagtgtggctt

SEQ ID NO: 1950942 - DNA, 18 bp, Homo sapiens
cagtgtggcttaaacatt

SEQ ID NO: 1950943 - DNA, 19 bp, Homo sapiens
cagttagcccggccaagga

SEQ ID NO: 1950944 - DNA, 18 bp, Homo sapiens
cagttccctcagccctca

SEQ ID NO: 1950945 - DNA, 19 bp, Homo sapiens
cagttccctcagccctcat

SEQ ID NO: 1950946 - DNA, 13 bp, Homo sapiens
cagttctgatgag

SEQ ID NO: 1950947 - DNA, 14 bp, Homo sapiens
cagttcttaagact

SEQ ID NO: 1950948 - DNA, 22 bp, Homo sapiens
cagttgtaacattctatttcaa

SEQ ID NO: 1950949 - DNA, 13 bp, Homo sapiens
cagtttgtgaagt

SEQ ID NO: 1950950 - DNA, 12 bp, Homo sapiens
cagtttgtgatc

SEQ ID NO: 1950951 - DNA, 12 bp, Homo sapiens
cagtttgttcag

SEQ ID NO: 1950952 - DNA, 18 bp, Homo sapiens
cagtttgttcagtgaggt

SEQ ID NO: 1950953 - DNA, 14 bp, Homo sapiens
cataaacaaagagt

SEQ ID NO: 1950954 - DNA, 15 bp, Homo sapiens
cataaacaaagagta

SEQ ID NO: 1950955 - DNA, 12 bp, Homo sapiens
cataacacacat

SEQ ID NO: 1950956 - DNA, 22 bp, Homo sapiens
cataacaggcattgcactaaaa

SEQ ID NO: 1950957 - DNA, 12 bp, Homo sapiens
catacatttaaa

SEQ ID NO: 1950958 - DNA, 22 bp, Homo sapiens
catacatttaaaaaacatttta

SEQ ID NO: 1950959 - DNA, 23 bp, Homo sapiens
catactgatgagacaacacacac

SEQ ID NO: 1950960 - DNA, 12 bp, Homo sapiens
catagataccat

SEQ ID NO: 1950961 - DNA, 16 bp, Homo sapiens
catattatatcagact

SEQ ID NO: 1950962 - DNA, 16 bp, Homo sapiens
catattctaaaagtaa

SEQ ID NO: 1950963 - DNA, 23 bp, Homo sapiens
catattttgttatagttcatagt

SEQ ID NO: 1950964 - DNA, 14 bp, Homo sapiens
catcaaagccctcc

SEQ ID NO: 1950965 - DNA, 21 bp, Homo sapiens
catcataaacaaagagtagaa

SEQ ID NO: 1950966 - DNA, 24 bp, Homo sapiens
catccccaccctcccctctcctga

SEQ ID NO: 1950967 - DNA, 23 bp, Homo sapiens
ccctcttctcagctccactctga

SEQ ID NO: 1950968 - DNA, 15 bp, Homo sapiens
ccctctttctctctg

SEQ ID NO: 1950969 - DNA, 18 bp, Homo sapiens
ccctctttctctctgtgt

SEQ ID NO: 1950970 - DNA, 17 bp, Homo sapiens
ccctgaatcagaggcag

SEQ ID NO: 1950971 - DNA, 13 bp, Homo sapiens
ccctgacttccca

SEQ ID NO: 1950972 - DNA, 20 bp, Homo sapiens
ccctgacttcccagctggca

SEQ ID NO: 1950973 - DNA, 17 bp, Homo sapiens
ccctgccctcccccacg

SEQ ID NO: 1950974 - DNA, 14 bp, Homo sapiens
ccctgccctgcacc

SEQ ID NO: 1950975 - DNA, 12 bp, Homo sapiens
ccctgctggacc

SEQ ID NO: 1950976 - DNA, 18 bp, Homo sapiens
ccctggaagttgtccttt

SEQ ID NO: 1950977 - DNA, 13 bp, Homo sapiens
ccctgggcctccc

SEQ ID NO: 1950978 - DNA, 23 bp, Homo sapiens
ccctggggtctctgagcagtggg

SEQ ID NO: 1950979 - DNA, 17 bp, Homo sapiens
ccctgtgggagtccact

SEQ ID NO: 1950980 - DNA, 15 bp, Homo sapiens
ccgaggcctgcgccc

SEQ ID NO: 1950981 - DNA, 14 bp, Homo sapiens
ccgcagcaccagcc

SEQ ID NO: 1950982 - DNA, 17 bp, Homo sapiens
ccgcagggcgctccggc

SEQ ID NO: 1950983 - DNA, 19 bp, Homo sapiens
ccgcagggcgctccggcag

SEQ ID NO: 1950984 - DNA, 21 bp, Homo sapiens
ccgcagggcgctccggcagag

SEQ ID NO: 1950985 - DNA, 18 bp, Homo sapiens
ccgcccaccccgctgcct

SEQ ID NO: 1950986 - DNA, 13 bp, Homo sapiens
ccgccccagagac

SEQ ID NO: 1950987 - DNA, 20 bp, Homo sapiens
ccgccccagagactgcccac

SEQ ID NO: 1950988 - DNA, 13 bp, Homo sapiens
ccgcccgcccacc

SEQ ID NO: 1950989 - DNA, 12 bp, Homo sapiens
ccgcccgccccc

SEQ ID NO: 1950990 - DNA, 13 bp, Homo sapiens
ccgccctcctctg

SEQ ID NO: 1950991 - DNA, 21 bp, Homo sapiens
ccgccggttggccggctggcc

SEQ ID NO: 1950992 - DNA, 16 bp, Homo sapiens
ccgcctcctccagact

SEQ ID NO: 1950993 - DNA, 15 bp, Homo sapiens
ccgcctcgggccgcc

SEQ ID NO: 1950994 - DNA, 17 bp, Homo sapiens
ccgcctcgggccgcctc

SEQ ID NO: 1950995 - DNA, 18 bp, Homo sapiens
ccgcgcgtgcccccagcg

SEQ ID NO: 1950996 - DNA, 15 bp, Homo sapiens
ccgctcaacctctca

SEQ ID NO: 1950997 - DNA, 16 bp, Homo sapiens
ccgctcaacctctcag

SEQ ID NO: 1950998 - DNA, 22 bp, Homo sapiens
ccgctgcctggcgggcagcccc

SEQ ID NO: 1950999 - DNA, 18 bp, Homo sapiens
ccggacgctggctcggga

SEQ ID NO: 1951000 - DNA, 15 bp, Homo sapiens
ccggaggcgcccacc

SEQ ID NO: 1951001 - DNA, 21 bp, Homo sapiens
ccggaggcgcccacctgccca

SEQ ID NO: 1951002 - DNA, 14 bp, Homo sapiens
ccggcagaggcagg

SEQ ID NO: 1951003 - DNA, 23 bp, Homo sapiens
ccggcagaggcagggccctgggg

SEQ ID NO: 1951004 - DNA, 15 bp, Homo sapiens
ccggccaaggacact

SEQ ID NO: 1951005 - DNA, 16 bp, Homo sapiens
ccggccaaggacactg

SEQ ID NO: 1951006 - DNA, 16 bp, Homo sapiens
ccggcccacgcagagc

SEQ ID NO: 1951007 - DNA, 17 bp, Homo sapiens
ccggcccacgcagagcc

SEQ ID NO: 1951008 - DNA, 22 bp, Homo sapiens
ccggcccacgcagagccccgga

SEQ ID NO: 1951009 - DNA, 13 bp, Homo sapiens
ccggcccccctct

SEQ ID NO: 1951010 - DNA, 19 bp, Homo sapiens
ccggcccccctctcgggct

SEQ ID NO: 1951011 - DNA, 20 bp, Homo sapiens
ccggccccgcgcgtgccccc

SEQ ID NO: 1951012 - DNA, 15 bp, Homo sapiens
ccggcccgccacctt

SEQ ID NO: 1951013 - DNA, 16 bp, Homo sapiens
ccggcctgcagcccag

SEQ ID NO: 1951014 - DNA, 18 bp, Homo sapiens
ccggctggccggtccacc

SEQ ID NO: 1951015 - DNA, 12 bp, Homo sapiens
ccggggctggcc

SEQ ID NO: 1951016 - DNA, 16 bp, Homo sapiens
ccggggctggccctgc

SEQ ID NO: 1951017 - DNA, 19 bp, Homo sapiens
ccggttggccggctggccg

SEQ ID NO: 1951018 - DNA, 13 bp, Homo sapiens
ccgtccgcccgcc

SEQ ID NO: 1951019 - DNA, 18 bp, Homo sapiens
ccgtccgcccgcccaccc

SEQ ID NO: 1951020 - DNA, 23 bp, Homo sapiens
ccgtctttggttcctcatggctg

SEQ ID NO: 1951021 - DNA, 19 bp, Homo sapiens
ccgtgcggcccgtgcgcag

SEQ ID NO: 1951022 - DNA, 20 bp, Homo sapiens
ccgtgcggcccgtgcgcagc

SEQ ID NO: 1951023 - DNA, 21 bp, Homo sapiens
ccgtgcggcccgtgcgcagcc

SEQ ID NO: 1951024 - DNA, 18 bp, Homo sapiens
ccgtggtgtgaggccccc

SEQ ID NO: 1951025 - DNA, 11 bp, Homo sapiens
ccgtgttctcc

SEQ ID NO: 1951026 - DNA, 12 bp, Homo sapiens
ccgttcatctga

SEQ ID NO: 1951027 - DNA, 15 bp, Homo sapiens
cctaaaattgtttcc

SEQ ID NO: 1951028 - DNA, 17 bp, Homo sapiens
cctaaaattgtttccta

SEQ ID NO: 1951029 - DNA, 12 bp, Homo sapiens
cctaacagtcag

SEQ ID NO: 1951030 - DNA, 14 bp, Homo sapiens
cctaatgcagaatt

SEQ ID NO: 1951031 - DNA, 14 bp, Homo sapiens
cctaattaatttca

SEQ ID NO: 1951032 - DNA, 16 bp, Homo sapiens
cctaccctcttctcag

SEQ ID NO: 1951033 - DNA, 20 bp, Homo sapiens
cctacttaaacaaaaacttt

SEQ ID NO: 1951034 - DNA, 15 bp, Homo sapiens
cctatcatcagttag

SEQ ID NO: 1951035 - DNA, 23 bp, Homo sapiens
cctatcatcagttaggattaggt

SEQ ID NO: 1951036 - DNA, 12 bp, Homo sapiens
cctcagccctca

SEQ ID NO: 1951037 - DNA, 16 bp, Homo sapiens
cctcatttcattattt

SEQ ID NO: 1951038 - DNA, 13 bp, Homo sapiens
cctccaaatgctg

SEQ ID NO: 1951039 - DNA, 16 bp, Homo sapiens
cctccagttctgatga

SEQ ID NO: 1951040 - DNA, 13 bp, Homo sapiens
cctcccgccgcct

SEQ ID NO: 1951041 - DNA, 23 bp, Homo sapiens
cctcccgccgcctcgggccgcct

SEQ ID NO: 1951042 - DNA, 16 bp, Homo sapiens
cctccctgtctgtctg

SEQ ID NO: 1951043 - DNA, 13 bp, Homo sapiens
cctccgtccccag

SEQ ID NO: 1951044 - DNA, 11 bp, Homo sapiens
cctcctccaga

SEQ ID NO: 1951045 - DNA, 13 bp, Homo sapiens
cctcctccagact

SEQ ID NO: 1951046 - DNA, 15 bp, Homo sapiens
cctcctcgggcgcct

SEQ ID NO: 1951047 - DNA, 19 bp, Homo sapiens
cctcctcgggcgcctgcgc

SEQ ID NO: 1951048 - DNA, 12 bp, Homo sapiens
cctcctctgccc

SEQ ID NO: 1951049 - DNA, 17 bp, Homo sapiens
cctcctctgccccctcc

SEQ ID NO: 1951050 - DNA, 15 bp, Homo sapiens
cctcctgatgtcttg

SEQ ID NO: 1951051 - DNA, 17 bp, Homo sapiens
cctcctgtctcctctgt

SEQ ID NO: 1951052 - DNA, 17 bp, Homo sapiens
cctcgggccgcctcctc

SEQ ID NO: 1951053 - DNA, 21 bp, Homo sapiens
cctcgggccgcctcctccaga

SEQ ID NO: 1951054 - DNA, 22 bp, Homo sapiens
cctcgggccgcctcctccagac

SEQ ID NO: 1951055 - DNA, 20 bp, Homo sapiens
cctcggtggcatttgctgaa

SEQ ID NO: 1951056 - DNA, 21 bp, Homo sapiens
cctcgtccggcctgcagccca

SEQ ID NO: 1951057 - DNA, 16 bp, Homo sapiens
cctctcctgagcctgt

SEQ ID NO: 1951058 - DNA, 19 bp, Homo sapiens
cctctcctgagcctgtctc

SEQ ID NO: 1951059 - DNA, 19 bp, Homo sapiens
cctctcgggctctctcacc

SEQ ID NO: 1951060 - DNA, 20 bp, Homo sapiens
cctctctctctctctctctg

SEQ ID NO: 1951061 - DNA, 21 bp, Homo sapiens
cctctctgaactgcaacactg

SEQ ID NO: 1951062 - DNA, 14 bp, Homo sapiens
cctctgcagcctga

SEQ ID NO: 1951063 - DNA, 16 bp, Homo sapiens
cctctgcagcctgagc

SEQ ID NO: 1951064 - DNA, 17 bp, Homo sapiens
cctctgcagcctgagct

SEQ ID NO: 1951065 - DNA, 18 bp, Homo sapiens
cctctgcagcctgagctc

SEQ ID NO: 1951066 - DNA, 22 bp, Homo sapiens
cctctgcagcctgagctccacc

SEQ ID NO: 1951067 - DNA, 23 bp, Homo sapiens
cctctgcagcctgagctccaccc

SEQ ID NO: 1951068 - DNA, 11 bp, Homo sapiens
cctctgccccc

SEQ ID NO: 1951069 - DNA, 16 bp, Homo sapiens
cctctgccccctcccc

SEQ ID NO: 1951070 - DNA, 22 bp, Homo sapiens
cctctgtcagtttgtgaagtga

SEQ ID NO: 1951071 - DNA, 13 bp, Homo sapiens
cctcttctcagct

SEQ ID NO: 1951072 - DNA, 21 bp, Homo sapiens
cctcttcttgcggcaccgccc

SEQ ID NO: 1951073 - DNA, 21 bp, Homo sapiens
cctcttgaatgcttaaatgat

SEQ ID NO: 1951074 - DNA, 19 bp, Homo sapiens
cctctttctctctgtgtgg

SEQ ID NO: 1951075 - DNA, 15 bp, Homo sapiens
cctgaaattctgaca

SEQ ID NO: 1951076 - DNA, 15 bp, Homo sapiens
cctgacatgctaacc

SEQ ID NO: 1951077 - DNA, 23 bp, Homo sapiens
cctgagccacagtggggcccatg

SEQ ID NO: 1951078 - DNA, 12 bp, Homo sapiens
cctgagcctgtc

SEQ ID NO: 1951079 - DNA, 15 bp, Homo sapiens
ctgaataatgaagat

SEQ ID NO: 1951080 - DNA, 17 bp, Homo sapiens
ctgaatcagaggcagag

SEQ ID NO: 1951081 - DNA, 19 bp, Homo sapiens
ctgaatctctcaaaatgtg

SEQ ID NO: 1951082 - DNA, 21 bp, Homo sapiens
ctgaatctctcaaaatgtgcc

SEQ ID NO: 1951083 - DNA, 15 bp, Homo sapiens
ctgacaccttttcag

SEQ ID NO: 1951084 - DNA, 21 bp, Homo sapiens
ctgacatgctaacctctctga

SEQ ID NO: 1951085 - DNA, 21 bp, Homo sapiens
ctgactttggagacgatgctt

SEQ ID NO: 1951086 - DNA, 16 bp, Homo sapiens
ctgagcagtggggagc

SEQ ID NO: 1951087 - DNA, 20 bp, Homo sapiens
ctgagccacagtggggccca

SEQ ID NO: 1951088 - DNA, 21 bp, Homo sapiens
ctgagccacagtggggcccat

SEQ ID NO: 1951089 - DNA, 14 bp, Homo sapiens
ctgagcccctcctc

SEQ ID NO: 1951090 - DNA, 15 bp, Homo sapiens
ctgagcccctcctct

SEQ ID NO: 1951091 - DNA, 14 bp, Homo sapiens
ctgagcctgtctct

SEQ ID NO: 1951092 - DNA, 20 bp, Homo sapiens
ctgaggaagtcccagtccaa

SEQ ID NO: 1951093 - DNA, 15 bp, Homo sapiens
ctgaggacggggcag

SEQ ID NO: 1951094 - DNA, 13 bp, Homo sapiens
ctgaggagtccaa

SEQ ID NO: 1951095 - DNA, 19 bp, Homo sapiens
ctgagggaagcccacccgc

SEQ ID NO: 1951096 - DNA, 20 bp, Homo sapiens
ctgagtcctcattgttcaga

SEQ ID NO: 1951097 - DNA, 15 bp, Homo sapiens
ctgagtcggctgggc

SEQ ID NO: 1951098 - DNA, 19 bp, Homo sapiens
ctgagtcggctgggcaggg

SEQ ID NO: 1951099 - DNA, 23 bp, Homo sapiens
ctgagtcggctgggcagggccgc

SEQ ID NO: 1951100 - DNA, 21 bp, Homo sapiens
ctgatacttatttataacatt

SEQ ID NO: 1951101 - DNA, 19 bp, Homo sapiens
ctgatgaagttaagcacaa

SEQ ID NO: 1951102 - DNA, 16 bp, Homo sapiens
ctgatgagacaacaca

SEQ ID NO: 1951103 - DNA, 18 bp, Homo sapiens
ctgatgggtatcatgctt

SEQ ID NO: 1951104 - DNA, 15 bp, Homo sapiens
ctgatgggtcctgct

SEQ ID NO: 1951105 - DNA, 15 bp, Homo sapiens
ctgcacacataacac

SEQ ID NO: 1951106 - DNA, 23 bp, Homo sapiens
ctgcaccttgggcacgggagagc

SEQ ID NO: 1951107 - DNA, 22 bp, Homo sapiens
ctgcagcccagaacgggcctcc

SEQ ID NO: 1951108 - DNA, 14 bp, Homo sapiens
ctgcagcctgagct

SEQ ID NO: 1951109 - DNA, 16 bp, Homo sapiens
ctgccccctcccccgc

SEQ ID NO: 1951110 - DNA, 18 bp, Homo sapiens
ctgcccctccgtccccag

SEQ ID NO: 1951111 - DNA, 20 bp, Homo sapiens
ctgccctgcaccttgggcac

SEQ ID NO: 1951112 - DNA, 19 bp, Homo sapiens
ctgcctctttgctgctttg

SEQ ID NO: 1951113 - DNA, 14 bp, Homo sapiens
ctgcctggcgggca

SEQ ID NO: 1951114 - DNA, 17 bp, Homo sapiens
ctgcctggcgggcagcc

SEQ ID NO: 1951115 - DNA, 15 bp, Homo sapiens
ctgcgctcctctgca

SEQ ID NO: 1951116 - DNA, 23 bp, Homo sapiens
ctgcgctcctctgcagcctgagc

SEQ ID NO: 1951117 - DNA, 14 bp, Homo sapiens
ctgctcgggaaggc

SEQ ID NO: 1951118 - DNA, 20 bp, Homo sapiens
ctgctcgggaaggcctgagg

SEQ ID NO: 1951119 - DNA, 16 bp, Homo sapiens
ctgctgcctcaggaat

SEQ ID NO: 1951120 - DNA, 18 bp, Homo sapiens
ctgctgctcgggaaggcc

SEQ ID NO: 1951121 - DNA, 15 bp, Homo sapiens
ctgcttagaattaac

SEQ ID NO: 1951122 - DNA, 13 bp, Homo sapiens
ctgcttttgatgg

SEQ ID NO: 1951123 - DNA, 16 bp, Homo sapiens
ctggaccaaggtgcgg

SEQ ID NO: 1951124 - DNA, 17 bp, Homo sapiens
ctggcagcgcctcccgc

SEQ ID NO: 1951125 - DNA, 22 bp, Homo sapiens
ctggcagcgcctcccgccgcct

SEQ ID NO: 1951126 - DNA, 15 bp, Homo sapiens
ctggccctgccctcc

SEQ ID NO: 1951127 - DNA, 17 bp, Homo sapiens
ctggccggtccaccccg

SEQ ID NO: 1951128 - DNA, 13 bp, Homo sapiens
ctggcgggcagcc

SEQ ID NO: 1951129 - DNA, 16 bp, Homo sapiens
ctggcgggcagcccct

SEQ ID NO: 1951130 - DNA, 22 bp, Homo sapiens
ctggcgggcagcccctgctgga

SEQ ID NO: 1951131 - DNA, 18 bp, Homo sapiens
ctggctgggtcgcccctc

SEQ ID NO: 1951132 - DNA, 19 bp, Homo sapiens
ctggctgggtcgcccctcc

SEQ ID NO: 1951133 - DNA, 15 bp, Homo sapiens
ctgggcagggccgca

SEQ ID NO: 1951134 - DNA, 17 bp, Homo sapiens
ctggggtctctgagcag

SEQ ID NO: 1951135 - DNA, 19 bp, Homo sapiens
ctggggtctctgagcagtg

SEQ ID NO: 1951136 - DNA, 20 bp, Homo sapiens
ctggggtctctgagcagtgg

SEQ ID NO: 1951137 - DNA, 23 bp, Homo sapiens
ctggggtctctgagcagtgggga

SEQ ID NO: 1951138 - DNA, 13 bp, Homo sapiens
ctggggtctgtga

SEQ ID NO: 1951139 - DNA, 14 bp, Homo sapiens
ctgggtcgcccctc

SEQ ID NO: 1951140 - DNA, 15 bp, Homo sapiens
ctgggtcgcccctcc

SEQ ID NO: 1951141 - DNA, 16 bp, Homo sapiens
ctggtgcgtgtggccc

SEQ ID NO: 1951142 - DNA, 21 bp, Homo sapiens
ctggtgcgtgtggccctgtgg

SEQ ID NO: 1951143 - DNA, 18 bp, Homo sapiens
ctgtaaataaaaatagct

SEQ ID NO: 1951144 - DNA, 22 bp, Homo sapiens
ctgtagtttttgttcaccttct

SEQ ID NO: 1951145 - DNA, 16 bp, Homo sapiens
ctgtcagcttcccaac

SEQ ID NO: 1951146 - DNA, 19 bp, Homo sapiens
ctgtcagcttcccaacaat

SEQ ID NO: 1951147 - DNA, 17 bp, Homo sapiens
ctgtcagtttgtgaagt

SEQ ID NO: 1951148 - DNA, 16 bp, Homo sapiens
ctgtcctctgctttgc

SEQ ID NO: 1951149 - DNA, 15 bp, Homo sapiens
ctgtcctgctcacgt

SEQ ID NO: 1951150 - DNA, 18 bp, Homo sapiens
ctgtcctgctcacgtctg

SEQ ID NO: 1951151 - DNA, 15 bp, Homo sapiens
ctgtccttccaacct

SEQ ID NO: 1951152 - DNA, 16 bp, Homo sapiens
ctgtccttccaacctg

SEQ ID NO: 1951153 - DNA, 22 bp, Homo sapiens
ctgtcttcaaccctgccctgca

SEQ ID NO: 1951154 - DNA, 12 bp, Homo sapiens
ctgtgaaacagt

SEQ ID NO: 1951155 - DNA, 21 bp, Homo sapiens
ctgtgaaagtctcctgtatca

SEQ ID NO: 1951156 - DNA, 22 bp, Homo sapiens
ctgtgaaagtctcctgtatcat

SEQ ID NO: 1951157 - DNA, 16 bp, Homo sapiens
ctgtgagataaatatc

SEQ ID NO: 1951158 - DNA, 19 bp, Homo sapiens
ctgtgagataaatatcatt

SEQ ID NO: 1951159 - DNA, 16 bp, Homo sapiens
ctgtgatgtcacagtt

SEQ ID NO: 1951160 - DNA, 13 bp, Homo sapiens
ctgtgggagtcca

SEQ ID NO: 1951161 - DNA, 14 bp, Homo sapiens
ctgtgggagtccac

SEQ ID NO: 1951162 - DNA, 22 bp, Homo sapiens
ctgtgggagtccactttcctct

SEQ ID NO: 1951163 - DNA, 14 bp, Homo sapiens
ctgtggtttgttat

SEQ ID NO: 1951164 - DNA, 15 bp, Homo sapiens
ctgtgtcatctgtca

SEQ ID NO: 1951165 - DNA, 13 bp, Homo sapiens
ctgtgtggcaaac

SEQ ID NO: 1951166 - DNA, 21 bp, Homo sapiens
ctgttaaggcatccacttcac

SEQ ID NO: 1951167 - DNA, 17 bp, Homo sapiens
ctgttagctcagaggag

SEQ ID NO: 1951168 - DNA, 14 bp, Homo sapiens
ctgttatctgtctt

SEQ ID NO: 1951169 - DNA, 15 bp, Homo sapiens
ctgttcacgtgactc

SEQ ID NO: 1951170 - DNA, 20 bp, Homo sapiens
ctgttcacgtgactcctcaa

SEQ ID NO: 1951171 - DNA, 14 bp, Homo sapiens
ctgttccaagtgtg

SEQ ID NO: 1951172 - DNA, 15 bp, Homo sapiens
ctgttccaagtgtgt

SEQ ID NO: 1951173 - DNA, 16 bp, Homo sapiens
ctgttccaagtgtgtg

SEQ ID NO: 1951174 - DNA, 21 bp, Homo sapiens
ctgttccaagtgtgtgtgcaa

SEQ ID NO: 1951175 - DNA, 15 bp, Homo sapiens
ctgttgattctttca

SEQ ID NO: 1951176 - DNA, 18 bp, Homo sapiens
cttacagaagggagtgaa

SEQ ID NO: 1951177 - DNA, 18 bp, Homo sapiens
cttacagtgatgccatga

SEQ ID NO: 1951178 - DNA, 22 bp, Homo sapiens
cttacagtgatgccatgaagac

SEQ ID NO: 1951179 - DNA, 21 bp, Homo sapiens
cttagaattaaccattgctaa

SEQ ID NO: 1951180 - DNA, 23 bp, Homo sapiens
cttaggcaatggtgaactgtcat

SEQ ID NO: 1951181 - DNA, 16 bp, Homo sapiens
cttatatgtgcccctt

SEQ ID NO: 1951182 - DNA, 15 bp, Homo sapiens
cttcaaccctgccct

SEQ ID NO: 1951183 - DNA, 22 bp, Homo sapiens
cttcaaccctgccctgcacctt

SEQ ID NO: 1951184 - DNA, 15 bp, Homo sapiens
cttcaattatttccc

SEQ ID NO: 1951185 - DNA, 20 bp, Homo sapiens
cttcacaatttcaatgcttc

SEQ ID NO: 1951186 - DNA, 23 bp, Homo sapiens
cttcactacaacattagaatatt

SEQ ID NO: 1951187 - DNA, 18 bp, Homo sapiens
cttcatgcttttctcatg

SEQ ID NO: 1951188 - DNA, 20 bp, Homo sapiens
cttcatgcttttctcatggt

SEQ ID NO: 1951189 - DNA, 18 bp, Homo sapiens
cttcatttctatagccaa

SEQ ID NO: 1951190 - DNA, 21 bp, Homo sapiens
gcatactgatgagacaacaca

SEQ ID NO: 1951191 - DNA, 15 bp, Homo sapiens
gcatatgtacacaga

SEQ ID NO: 1951192 - DNA, 16 bp, Homo sapiens
gcatctggcctggggg

SEQ ID NO: 1951193 - DNA, 17 bp, Homo sapiens
gcatctggcctgggggc

SEQ ID NO: 1951194 - DNA, 17 bp, Homo sapiens
gcatgagaactaaatag

SEQ ID NO: 1951195 - DNA, 14 bp, Homo sapiens
gcattgcactaaaa

SEQ ID NO: 1951196 - DNA, 12 bp, Homo sapiens
gcattgttcttc

SEQ ID NO: 1951197 - DNA, 24 bp, Homo sapiens
gcatttatgcatgagaactaaata

SEQ ID NO: 1951198 - DNA, 15 bp, Homo sapiens
gcatttgctgaataa

SEQ ID NO: 1951199 - DNA, 20 bp, Homo sapiens
gcatttgctgaataacaaca

SEQ ID NO: 1951200 - DNA, 15 bp, Homo sapiens
gccaagaattagatt

SEQ ID NO: 1951201 - DNA, 14 bp, Homo sapiens
gccaaggacactga

SEQ ID NO: 1951202 - DNA, 16 bp, Homo sapiens
gccaaggacactgatg

SEQ ID NO: 1951203 - DNA, 14 bp, Homo sapiens
gccaatgtccaggt

SEQ ID NO: 1951204 - DNA, 21 bp, Homo sapiens
gccaatgtccaggtcacaggc

SEQ ID NO: 1951205 - DNA, 13 bp, Homo sapiens
gccacagtggggc

SEQ ID NO: 1951206 - DNA, 15 bp, Homo sapiens
gccacccgcccgccc

SEQ ID NO: 1951207 - DNA, 18 bp, Homo sapiens
gccaccttgtacagaacc

SEQ ID NO: 1951208 - DNA, 19 bp, Homo sapiens
gccaccttgtacagaacca

SEQ ID NO: 1951209 - DNA, 14 bp, Homo sapiens
gccactaaggtcag

SEQ ID NO: 1951210 - DNA, 19 bp, Homo sapiens
gccatatattttctgagta

SEQ ID NO: 1951211 - DNA, 19 bp, Homo sapiens
gcccaacccccacctcccg

SEQ ID NO: 1951212 - DNA, 17 bp, Homo sapiens
gcccaccccgctgcctg

SEQ ID NO: 1951213 - DNA, 19 bp, Homo sapiens
gcccaccccgctgcctggc

SEQ ID NO: 1951214 - DNA, 20 bp, Homo sapiens
gcccaccccgctgcctggcg

SEQ ID NO: 1951215 - DNA, 13 bp, Homo sapiens
gcccacccgcccc

SEQ ID NO: 1951216 - DNA, 14 bp, Homo sapiens
gcccacccgcccca

SEQ ID NO: 1951217 - DNA, 16 bp, Homo sapiens
gcccacccgccccaga

SEQ ID NO: 1951218 - DNA, 19 bp, Homo sapiens
gcccacccgccccagagac

SEQ ID NO: 1951219 - DNA, 13 bp, Homo sapiens
gcccaccctgggc

SEQ ID NO: 1951220 - DNA, 14 bp, Homo sapiens
gcccaccctgggcc

SEQ ID NO: 1951221 - DNA, 17 bp, Homo sapiens
gcccaccctgggcctcc

SEQ ID NO: 1951222 - DNA, 21 bp, Homo sapiens
gcccaccctgggcctcccgtc

SEQ ID NO: 1951223 - DNA, 14 bp, Homo sapiens
gcccacctgcccag

SEQ ID NO: 1951224 - DNA, 16 bp, Homo sapiens
gcccacgcagagcccc

SEQ ID NO: 1951225 - DNA, 19 bp, Homo sapiens
gcccagaacgggcctcccc

SEQ ID NO: 1951226 - DNA, 21 bp, Homo sapiens
gcccagcctatctctcttctg

SEQ ID NO: 1951227 - DNA, 15 bp, Homo sapiens
gcccagttagcccgg

SEQ ID NO: 1951228 - DNA, 23 bp, Homo sapiens
gcccagttagcccggccaaggac

SEQ ID NO: 1951229 - DNA, 16 bp, Homo sapiens
gcccatggccccagct

SEQ ID NO: 1951230 - DNA, 12 bp, Homo sapiens
gccccagagact

SEQ ID NO: 1951231 - DNA, 14 bp, Homo sapiens
gccccagagactgc

SEQ ID NO: 1951232 - DNA, 15 bp, Homo sapiens
gccccagctggctgg

SEQ ID NO: 1951233 - DNA, 17 bp, Homo sapiens
gccccaggcggaggggc

SEQ ID NO: 1951234 - DNA, 11 bp, Homo sapiens
gccccatcctt

SEQ ID NO: 1951235 - DNA, 24 bp, Homo sapiens
gccccatccttcccgcagcaccag

SEQ ID NO: 1951236 - DNA, 14 bp, Homo sapiens
gcccccgccctcgc

SEQ ID NO: 1951237 - DNA, 18 bp, Homo sapiens
gcccccgccctcgctccg

SEQ ID NO: 1951238 - DNA, 22 bp, Homo sapiens
gcccccggaggcgcccacctgc

SEQ ID NO: 1951239 - DNA, 23 bp, Homo sapiens
gcccccggaggcgcccacctgcc

SEQ ID NO: 1951240 - DNA, 17 bp, Homo sapiens
gccccctcccccgcaga

SEQ ID NO: 1951241 - DNA, 18 bp, Homo sapiens
gccccctcccccgcagac

SEQ ID NO: 1951242 - DNA, 16 bp, Homo sapiens
gccccggagcaccacg

SEQ ID NO: 1951243 - DNA, 13 bp, Homo sapiens
gcccctccgtccc

SEQ ID NO: 1951244 - DNA, 14 bp, Homo sapiens
gcccctccgtcccc

SEQ ID NO: 1951245 - DNA, 18 bp, Homo sapiens
gcccctccgtccccaggg

SEQ ID NO: 1951246 - DNA, 20 bp, Homo sapiens
gcccctccgtccccagggtg

SEQ ID NO: 1951247 - DNA, 20 bp, Homo sapiens
gcccctcctcgggcgcctgc

SEQ ID NO: 1951248 - DNA, 14 bp, Homo sapiens
gcccctgctggacc

SEQ ID NO: 1951249 - DNA, 15 bp, Homo sapiens
gcccctgctggacca

SEQ ID NO: 1951250 - DNA, 23 bp, Homo sapiens
gcccgagcgcgtgccttccccgt

SEQ ID NO: 1951251 - DNA, 12 bp, Homo sapiens
gcccgccacctt

SEQ ID NO: 1951252 - DNA, 14 bp, Homo sapiens
gcccgcccaccccg

SEQ ID NO: 1951253 - DNA, 17 bp, Homo sapiens
gcccgcccaccccgctg

SEQ ID NO: 1951254 - DNA, 19 bp, Homo sapiens
gcccgcccaccccgctgcc

SEQ ID NO: 1951255 - DNA, 15 bp, Homo sapiens
gcccgccctcctctg

SEQ ID NO: 1951256 - DNA, 18 bp, Homo sapiens
gcccgccctcctctgccc

SEQ ID NO: 1951257 - DNA, 17 bp, Homo sapiens
gcccgccggttggccgg

SEQ ID NO: 1951258 - DNA, 18 bp, Homo sapiens
gcccgccggttggccggc

SEQ ID NO: 1951259 - DNA, 17 bp, Homo sapiens
gcccgctcaacctctca

SEQ ID NO: 1951260 - DNA, 23 bp, Homo sapiens
gcccgctcaacctctcagatccc

SEQ ID NO: 1951261 - DNA, 22 bp, Homo sapiens
gcccggccaaggacactgatgg

SEQ ID NO: 1951262 - DNA, 13 bp, Homo sapiens
gcccggcccacgc

SEQ ID NO: 1951263 - DNA, 16 bp, Homo sapiens
gcccgtgcgcagccgc

SEQ ID NO: 1951264 - DNA, 23 bp, Homo sapiens
gcccgtgcgcagccgcgctctgc

SEQ ID NO: 1951265 - DNA, 20 bp, Homo sapiens
gccctcctctgccccctccc

SEQ ID NO: 1951266 - DNA, 19 bp, Homo sapiens
gccctctttctctctgtgt

SEQ ID NO: 1951267 - DNA, 23 bp, Homo sapiens
gccctctttctctctgtgtggca

SEQ ID NO: 1951268 - DNA, 16 bp, Homo sapiens
gccctgacatgctaac

SEQ ID NO: 1951269 - DNA, 22 bp, Homo sapiens
gccctgcaccttgggcacggga

SEQ ID NO: 1951270 - DNA, 17 bp, Homo sapiens
gccctgccctcccccac

SEQ ID NO: 1951271 - DNA, 15 bp, Homo sapiens
gccctggggtctctg

SEQ ID NO: 1951272 - DNA, 16 bp, Homo sapiens
gccctggggtctctga

SEQ ID NO: 1951273 - DNA, 19 bp, Homo sapiens
gccctggggtctctgagca

SEQ ID NO: 1951274 - DNA, 22 bp, Homo sapiens
gccctggggtctctgagcagtg

SEQ ID NO: 1951275 - DNA, 23 bp, Homo sapiens
gccctggggtctctgagcagtgg

SEQ ID NO: 1951276 - DNA, 11 bp, Homo sapiens
gccctgtggga

SEQ ID NO: 1951277 - DNA, 18 bp, Homo sapiens
gccctgtgggagtccact

SEQ ID NO: 1951278 - DNA, 19 bp, Homo sapiens
gccgcagggcgctccggca

SEQ ID NO: 1951279 - DNA, 14 bp, Homo sapiens
gccgcctcctccag

SEQ ID NO: 1951280 - DNA, 15 bp, Homo sapiens
gccgcctcctccaga

SEQ ID NO: 1951281 - DNA, 17 bp, Homo sapiens
gccgcctcctccagact

SEQ ID NO: 1951282 - DNA, 16 bp, Homo sapiens
gccgcctcgggccgcc

SEQ ID NO: 1951283 - DNA, 22 bp, Homo sapiens
gccgcctcgggccgcctcctcc

SEQ ID NO: 1951284 - DNA, 13 bp, Homo sapiens
gccgcgctctgcc

SEQ ID NO: 1951285 - DNA, 14 bp, Homo sapiens
gccgcgctctgccc

SEQ ID NO: 1951286 - DNA, 16 bp, Homo sapiens
gccgcgctctgcccct

SEQ ID NO: 1951287 - DNA, 19 bp, Homo sapiens
gccgcgctctgcccctccg

SEQ ID NO: 1951288 - DNA, 14 bp, Homo sapiens
gccggggctggccc

SEQ ID NO: 1951289 - DNA, 21 bp, Homo sapiens
gccggggctggccctgccctc

SEQ ID NO: 1951290 - DNA, 13 bp, Homo sapiens
gcctcccccaggc

SEQ ID NO: 1951291 - DNA, 20 bp, Homo sapiens
gcctcccccaggctgcgcct

SEQ ID NO: 1951292 - DNA, 23 bp, Homo sapiens
gcctcccccaggctgcgcctgcc

SEQ ID NO: 1951293 - DNA, 16 bp, Homo sapiens
gcctcccgtccgtccg

SEQ ID NO: 1951294 - DNA, 21 bp, Homo sapiens
gcctcccgtccgtccgcccgc

SEQ ID NO: 1951295 - DNA, 14 bp, Homo sapiens
gcctcctccagact

SEQ ID NO: 1951296 - DNA, 15 bp, Homo sapiens
gcctcctccagactc

SEQ ID NO: 1951297 - DNA, 14 bp, Homo sapiens
gcctcgggccgcct

SEQ ID NO: 1951298 - DNA, 18 bp, Homo sapiens
gcctcgggccgcctcctc

SEQ ID NO: 1951299 - DNA, 21 bp, Homo sapiens
gcctcgggccgcctcctccag

SEQ ID NO: 1951300 - DNA, 15 bp, Homo sapiens
gcctctttgctgctt

SEQ ID NO: 1951301 - DNA, 21 bp, Homo sapiens
gcctgagccacagtggggccc

SEQ ID NO: 1951302 - DNA, 17 bp, Homo sapiens
gtcatttggtggctcta

SEQ ID NO: 1951303 - DNA, 19 bp, Homo sapiens
gtccacccccattgtgaat

SEQ ID NO: 1951304 - DNA, 18 bp, Homo sapiens
gtccactttcctctctct

SEQ ID NO: 1951305 - DNA, 19 bp, Homo sapiens
gtccccagggtgcaggcgc

SEQ ID NO: 1951306 - DNA, 17 bp, Homo sapiens
gtccccggacgctggct

SEQ ID NO: 1951307 - DNA, 18 bp, Homo sapiens
gtccctgacttcccagct

SEQ ID NO: 1951308 - DNA, 16 bp, Homo sapiens
gtcccttcctgtcctg

SEQ ID NO: 1951309 - DNA, 13 bp, Homo sapiens
gtccgcccgccca

SEQ ID NO: 1951310 - DNA, 13 bp, Homo sapiens
gtccggcctgcag

SEQ ID NO: 1951311 - DNA, 14 bp, Homo sapiens
gtccggcctgcagc

SEQ ID NO: 1951312 - DNA, 17 bp, Homo sapiens
gtccggcctgcagccca

SEQ ID NO: 1951313 - DNA, 18 bp, Homo sapiens
gtccggcctgcagcccag

SEQ ID NO: 1951314 - DNA, 15 bp, Homo sapiens
gtcctaaatgcaaag

SEQ ID NO: 1951315 - DNA, 19 bp, Homo sapiens
gtcctcattgttcagaaaa

SEQ ID NO: 1951316 - DNA, 21 bp, Homo sapiens
gtcctcattgttcagaaaagc

SEQ ID NO: 1951317 - DNA, 11 bp, Homo sapiens
gtcctgctgct

SEQ ID NO: 1951318 - DNA, 12 bp, Homo sapiens
gtcctgctgctc

SEQ ID NO: 1951319 - DNA, 12 bp, Homo sapiens
gtcctgtgtcat

SEQ ID NO: 1951320 - DNA, 11 bp, Homo sapiens
gtcgcccctcc

SEQ ID NO: 1951321 - DNA, 14 bp, Homo sapiens
gtcgcccctcctcg

SEQ ID NO: 1951322 - DNA, 16 bp, Homo sapiens
gtcgcccctcctcggg

SEQ ID NO: 1951323 - DNA, 12 bp, Homo sapiens
gtcggctgggca

SEQ ID NO: 1951324 - DNA, 12 bp, Homo sapiens
gtcgggggagga

SEQ ID NO: 1951325 - DNA, 14 bp, Homo sapiens
gtcgggggaggagc

SEQ ID NO: 1951326 - DNA, 21 bp, Homo sapiens
gtcgggggaggagcaccccca

SEQ ID NO: 1951327 - DNA, 21 bp, Homo sapiens
gtctagataaaaggagagaaa

SEQ ID NO: 1951328 - DNA, 20 bp, Homo sapiens
gtctcaaaataaaaccagaa

SEQ ID NO: 1951329 - DNA, 18 bp, Homo sapiens
gtctcctaataagttcct

SEQ ID NO: 1951330 - DNA, 20 bp, Homo sapiens
gtctctccctaccctcttct

SEQ ID NO: 1951331 - DNA, 17 bp, Homo sapiens
gtctctcttttgctctc

SEQ ID NO: 1951332 - DNA, 17 bp, Homo sapiens
gtctctgagcagtgggg

SEQ ID NO: 1951333 - DNA, 14 bp, Homo sapiens
gtctctttctttcc

SEQ ID NO: 1951334 - DNA, 16 bp, Homo sapiens
gtctctttctttccaa

SEQ ID NO: 1951335 - DNA, 10 bp, Homo sapiens
gtctgcccct

SEQ ID NO: 1951336 - DNA, 21 bp, Homo sapiens
gtctgccccttgaccccacac

SEQ ID NO: 1951337 - DNA, 24 bp, Homo sapiens
gtctgtctctcttttgctctctca

SEQ ID NO: 1951338 - DNA, 15 bp, Homo sapiens
gtctgtgagtctgtc

SEQ ID NO: 1951339 - DNA, 18 bp, Homo sapiens
gtctgtgagtctgtcctt

SEQ ID NO: 1951340 - DNA, 13 bp, Homo sapiens
gtctgttcttcat

SEQ ID NO: 1951341 - DNA, 23 bp, Homo sapiens
gtcttcaaccctgccctgcacct

SEQ ID NO: 1951342 - DNA, 18 bp, Homo sapiens
gtcttgtttaatatttgt

SEQ ID NO: 1951343 - DNA, 13 bp, Homo sapiens
gtctttatgattt

SEQ ID NO: 1951344 - DNA, 17 bp, Homo sapiens
gtctttggttcctcatg

SEQ ID NO: 1951345 - DNA, 23 bp, Homo sapiens
gtctttggttcctcatggctgtt

SEQ ID NO: 1951346 - DNA, 14 bp, Homo sapiens
gtcttttgttctct

SEQ ID NO: 1951347 - DNA, 14 bp, Homo sapiens
gtgaccggcccgcc

SEQ ID NO: 1951348 - DNA, 16 bp, Homo sapiens
gtgaccggcccgccac

SEQ ID NO: 1951349 - DNA, 20 bp, Homo sapiens
gtgaccggcccgccaccttg

SEQ ID NO: 1951350 - DNA, 20 bp, Homo sapiens
gtgaggcccccggaggcgcc

SEQ ID NO: 1951351 - DNA, 21 bp, Homo sapiens
gtgaggcccccggaggcgccc

SEQ ID NO: 1951352 - DNA, 22 bp, Homo sapiens
gtgaggcccccggaggcgccca

SEQ ID NO: 1951353 - DNA, 18 bp, Homo sapiens
gtgagtctgtcctttccc

SEQ ID NO: 1951354 - DNA, 14 bp, Homo sapiens
gtgatcactttctg

SEQ ID NO: 1951355 - DNA, 13 bp, Homo sapiens
gtgatctgtcctt

SEQ ID NO: 1951356 - DNA, 20 bp, Homo sapiens
gtgatgtgatttatgcattt

SEQ ID NO: 1951357 - DNA, 20 bp, Homo sapiens
gtgattgacattttgtagct

SEQ ID NO: 1951358 - DNA, 17 bp, Homo sapiens
gtgatttatgcatttat

SEQ ID NO: 1951359 - DNA, 14 bp, Homo sapiens
gtgcatctggcctg

SEQ ID NO: 1951360 - DNA, 16 bp, Homo sapiens
gtgcatctggcctggg

SEQ ID NO: 1951361 - DNA, 19 bp, Homo sapiens
gtgcatctggcctgggggc

SEQ ID NO: 1951362 - DNA, 19 bp, Homo sapiens
gtgcccacccgtgttctcc

SEQ ID NO: 1951363 - DNA, 20 bp, Homo sapiens
gtgcccacccgtgttctcct

SEQ ID NO: 1951364 - DNA, 24 bp, Homo sapiens
gtgcctcttatcaagtgttacaga

SEQ ID NO: 1951365 - DNA, 13 bp, Homo sapiens
gtgccttgatttt

SEQ ID NO: 1951366 - DNA, 23 bp, Homo sapiens
gtgccttgattttaattcaggtg

SEQ ID NO: 1951367 - DNA, 23 bp, Homo sapiens
gtgcgcagccgcgctctgcccct

SEQ ID NO: 1951368 - DNA, 17 bp, Homo sapiens
gtgcggaccggagcggc

SEQ ID NO: 1951369 - DNA, 13 bp, Homo sapiens
gtgcgtgtggccc

SEQ ID NO: 1951370 - DNA, 15 bp, Homo sapiens
gtgctcatcagaaac

SEQ ID NO: 1951371 - DNA, 15 bp, Homo sapiens
gtgctgttgattctt

SEQ ID NO: 1951372 - DNA, 20 bp, Homo sapiens
gtgcttgaggccaaatgagt

SEQ ID NO: 1951373 - DNA, 21 bp, Homo sapiens
gtggaccagttccctcagccc

SEQ ID NO: 1951374 - DNA, 14 bp, Homo sapiens
gtggatgtcccttc

SEQ ID NO: 1951375 - DNA, 13 bp, Homo sapiens
gtggcaaacattt

SEQ ID NO: 1951376 - DNA, 13 bp, Homo sapiens
gtggccctgtggg

SEQ ID NO: 1951377 - DNA, 15 bp, Homo sapiens
gtggcttaaacattt

SEQ ID NO: 1951378 - DNA, 15 bp, Homo sapiens
gtggggagcgggggc

SEQ ID NO: 1951379 - DNA, 17 bp, Homo sapiens
gtggggcccatggcccc

SEQ ID NO: 1951380 - DNA, 20 bp, Homo sapiens
gtggggcccatggccccagc

SEQ ID NO: 1951381 - DNA, 23 bp, Homo sapiens
gtggggcccatggccccagctgg

SEQ ID NO: 1951382 - DNA, 16 bp, Homo sapiens
gtggtgtgaggccccc

SEQ ID NO: 1951383 - DNA, 15 bp, Homo sapiens
gtggttctgtgcctc

SEQ ID NO: 1951384 - DNA, 16 bp, Homo sapiens
gtgtcacttttttcct

SEQ ID NO: 1951385 - DNA, 14 bp, Homo sapiens
gtgtcatctgtcag

SEQ ID NO: 1951386 - DNA, 15 bp, Homo sapiens
gtgtcctaaatgcaa

SEQ ID NO: 1951387 - DNA, 23 bp, Homo sapiens
gtgtcttttgttctctcttggtc

SEQ ID NO: 1951388 - DNA, 12 bp, Homo sapiens
gtgtgaggcccc

SEQ ID NO: 1951389 - DNA, 14 bp, Homo sapiens
gtgtggcaaacatt

SEQ ID NO: 1951390 - DNA, 16 bp, Homo sapiens
gtgtggcaaacattta

SEQ ID NO: 1951391 - DNA, 20 bp, Homo sapiens
gtgttacagaggacatacca

SEQ ID NO: 1951392 - DNA, 14 bp, Homo sapiens
gtgttctagttcct

SEQ ID NO: 1951393 - DNA, 12 bp, Homo sapiens
gtgttctcctcc

SEQ ID NO: 1951394 - DNA, 16 bp, Homo sapiens
gtgttttaggtgcctg

SEQ ID NO: 1951395 - DNA, 17 bp, Homo sapiens
gttacatacatttaaaa

SEQ ID NO: 1951396 - DNA, 23 bp, Homo sapiens
gttacatacatttaaaaaacatt

SEQ ID NO: 1951397 - DNA, 22 bp, Homo sapiens
gttagtaacttttagtggttct

SEQ ID NO: 1951398 - DNA, 16 bp, Homo sapiens
gttataccagcaaaag

SEQ ID NO: 1951399 - DNA, 22 bp, Homo sapiens
gttatagaggtaaaatttgcac

SEQ ID NO: 1951400 - DNA, 13 bp, Homo sapiens
gttatagttcata

SEQ ID NO: 1951401 - DNA, 18 bp, Homo sapiens
gttatctgtctttatgat

SEQ ID NO: 1951402 - DNA, 15 bp, Homo sapiens
gttattttgtgtcct

SEQ ID NO: 1951403 - DNA, 21 bp, Homo sapiens
gttcaatgctacaaaatgtgt

SEQ ID NO: 1951404 - DNA, 14 bp, Homo sapiens
gttcaccttctgtg

SEQ ID NO: 1951405 - DNA, 17 bp, Homo sapiens
gttcaccttctgtgcat

SEQ ID NO: 1951406 - DNA, 18 bp, Homo sapiens
gttcacgtgactcctcaa

SEQ ID NO: 1951407 - DNA, 17 bp, Homo sapiens
gttcagaaaagcacctc

SEQ ID NO: 1951408 - DNA, 14 bp, Homo sapiens
gttcatctgaggag

SEQ ID NO: 1951409 - DNA, 19 bp, Homo sapiens
gttcatctgaggagtccaa

SEQ ID NO: 1951410 - DNA, 14 bp, Homo sapiens
gttccaagtgtgtg

SEQ ID NO: 1951411 - DNA, 17 bp, Homo sapiens
gttccaagtgtgtgtgc

SEQ ID NO: 1951412 - DNA, 18 bp, Homo sapiens
gttccaagtgtgtgtgca

SEQ ID NO: 1951413 - DNA, 19 bp, Homo sapiens
gttccaagtgtgtgtgcaa

SEQ ID NO: 1951414 - DNA, 17 bp, Homo sapiens
tccggcctgcagcccag

SEQ ID NO: 1951415 - DNA, 18 bp, Homo sapiens
tccggcctgcagcccaga

SEQ ID NO: 1951416 - DNA, 20 bp, Homo sapiens
tccggcctgcagcccagaac

SEQ ID NO: 1951417 - DNA, 14 bp, Homo sapiens
tccgtccccagggt

SEQ ID NO: 1951418 - DNA, 20 bp, Homo sapiens
tcctacaaagaaaaaagaag

SEQ ID NO: 1951419 - DNA, 15 bp, Homo sapiens
tcctacttaaacaaa

SEQ ID NO: 1951420 - DNA, 19 bp, Homo sapiens
tcctaggacatctctgtaa

SEQ ID NO: 1951421 - DNA, 17 bp, Homo sapiens
tcctcattgttcagaaa

SEQ ID NO: 1951422 - DNA, 14 bp, Homo sapiens
tcctccaaatgctg

SEQ ID NO: 1951423 - DNA, 19 bp, Homo sapiens
tcctcctgtctcctctgtc

SEQ ID NO: 1951424 - DNA, 16 bp, Homo sapiens
tcctcgtccggcctgc

SEQ ID NO: 1951425 - DNA, 23 bp, Homo sapiens
tcctcgtccggcctgcagcccag

SEQ ID NO: 1951426 - DNA, 15 bp, Homo sapiens
tcctctgcagcctga

SEQ ID NO: 1951427 - DNA, 16 bp, Homo sapiens
tcctctgccccctccc

SEQ ID NO: 1951428 - DNA, 18 bp, Homo sapiens
tcctctgccccctccccc

SEQ ID NO: 1951429 - DNA, 19 bp, Homo sapiens
tcctctgccccctcccccg

SEQ ID NO: 1951430 - DNA, 20 bp, Homo sapiens
tcctctgccccctcccccgc

SEQ ID NO: 1951431 - DNA, 13 bp, Homo sapiens
tcctctgctttgc

SEQ ID NO: 1951432 - DNA, 12 bp, Homo sapiens
tcctctgtcagt

SEQ ID NO: 1951433 - DNA, 19 bp, Homo sapiens
tcctctgtcagtttgtgaa

SEQ ID NO: 1951434 - DNA, 19 bp, Homo sapiens
tcctcttatatgtgcccct

SEQ ID NO: 1951435 - DNA, 12 bp, Homo sapiens
tcctgctgctcg

SEQ ID NO: 1951436 - DNA, 14 bp, Homo sapiens
tcctgtcctgctca

SEQ ID NO: 1951437 - DNA, 16 bp, Homo sapiens
tcctgtcctgctcacg

SEQ ID NO: 1951438 - DNA, 17 bp, Homo sapiens
tcctgtcctgctcacgt

SEQ ID NO: 1951439 - DNA, 16 bp, Homo sapiens
tcctgtctcctctgtc

SEQ ID NO: 1951440 - DNA, 18 bp, Homo sapiens
tcctgtctcctctgtcag

SEQ ID NO: 1951441 - DNA, 17 bp, Homo sapiens
tcctgtgtcatctgtca

SEQ ID NO: 1951442 - DNA, 19 bp, Homo sapiens
tcctgtgtcatctgtcagc

SEQ ID NO: 1951443 - DNA, 13 bp, Homo sapiens
tccttacaggtgt

SEQ ID NO: 1951444 - DNA, 19 bp, Homo sapiens
tccttcacaatttcaatgc

SEQ ID NO: 1951445 - DNA, 18 bp, Homo sapiens
tccttcatgcttttctca

SEQ ID NO: 1951446 - DNA, 12 bp, Homo sapiens
tccttcccgcag

SEQ ID NO: 1951447 - DNA, 18 bp, Homo sapiens
tccttcccgcagcaccag

SEQ ID NO: 1951448 - DNA, 23 bp, Homo sapiens
tccttcccgcagcaccagcctga

SEQ ID NO: 1951449 - DNA, 17 bp, Homo sapiens
tcctttctgatcctctc

SEQ ID NO: 1951450 - DNA, 17 bp, Homo sapiens
tcctttggcaatatcat

SEQ ID NO: 1951451 - DNA, 15 bp, Homo sapiens
tcgagagggctgagc

SEQ ID NO: 1951452 - DNA, 17 bp, Homo sapiens
tcgagagggctgagccc

SEQ ID NO: 1951453 - DNA, 19 bp, Homo sapiens
tcggacaccatcttgggat

SEQ ID NO: 1951454 - DNA, 14 bp, Homo sapiens
tcggctgggcaggg

SEQ ID NO: 1951455 - DNA, 15 bp, Homo sapiens
tcggctgggcagggc

SEQ ID NO: 1951456 - DNA, 19 bp, Homo sapiens
tcggctgggcagggccgca

SEQ ID NO: 1951457 - DNA, 20 bp, Homo sapiens
tcgggaaggcctgagggaag

SEQ ID NO: 1951458 - DNA, 16 bp, Homo sapiens
tcgggccgcctcctcc

SEQ ID NO: 1951459 - DNA, 20 bp, Homo sapiens
tcgggccgcctcctccagac

SEQ ID NO: 1951460 - DNA, 16 bp, Homo sapiens
tcgggggaggagcacc

SEQ ID NO: 1951461 - DNA, 19 bp, Homo sapiens
tcgggggaggagcaccccc

SEQ ID NO: 1951462 - DNA, 21 bp, Homo sapiens
tcgggggaggagcacccccag

SEQ ID NO: 1951463 - DNA, 23 bp, Homo sapiens
tcgggggaggagcacccccagcc

SEQ ID NO: 1951464 - DNA, 19 bp, Homo sapiens
tcgtccggcctgcagccca

SEQ ID NO: 1951465 - DNA, 22 bp, Homo sapiens
tctaaaagtaataaattccaat

SEQ ID NO: 1951466 - DNA, 20 bp, Homo sapiens
tctacaaaaaaaatcaaaaa

SEQ ID NO: 1951467 - DNA, 20 bp, Homo sapiens
tctactccatggtgaactga

SEQ ID NO: 1951468 - DNA, 17 bp, Homo sapiens
tctagatatgagaaata

SEQ ID NO: 1951469 - DNA, 16 bp, Homo sapiens
tctagtaggtctgcac

SEQ ID NO: 1951470 - DNA, 19 bp, Homo sapiens
tctatagcatttaaagata

SEQ ID NO: 1951471 - DNA, 13 bp, Homo sapiens
tctatgtacagat

SEQ ID NO: 1951472 - DNA, 20 bp, Homo sapiens
tctatgtacagatgatgtaa

SEQ ID NO: 1951473 - DNA, 14 bp, Homo sapiens
tctcaaaatgtgcc

SEQ ID NO: 1951474 - DNA, 18 bp, Homo sapiens
tctcaaaatgtgccgtct

SEQ ID NO: 1951475 - DNA, 21 bp, Homo sapiens
tctcaatcatgggaattttaa

SEQ ID NO: 1951476 - DNA, 16 bp, Homo sapiens
tctcagatccctcggt

SEQ ID NO: 1951477 - DNA, 13 bp, Homo sapiens
tctcagctccact

SEQ ID NO: 1951478 - DNA, 17 bp, Homo sapiens
tctcagctccactctga

SEQ ID NO: 1951479 - DNA, 14 bp, Homo sapiens
tctcccttttcaga

SEQ ID NO: 1951480 - DNA, 15 bp, Homo sapiens
tctcccttttcagat

SEQ ID NO: 1951481 - DNA, 16 bp, Homo sapiens
tctcctccaaatgctg

SEQ ID NO: 1951482 - DNA, 18 bp, Homo sapiens
tctcctccaaatgctgtc

SEQ ID NO: 1951483 - DNA, 21 bp, Homo sapiens
tctcctcgtccggcctgcagc

SEQ ID NO: 1951484 - DNA, 22 bp, Homo sapiens
tctcctctgtcagtttgtgaag

SEQ ID NO: 1951485 - DNA, 15 bp, Homo sapiens
tctcctgagcctgtc

SEQ ID NO: 1951486 - DNA, 12 bp, Homo sapiens
tctcctgtgcac

SEQ ID NO: 1951487 - DNA, 14 bp, Homo sapiens
tctctaaaacagca

SEQ ID NO: 1951488 - DNA, 13 bp, Homo sapiens
tctctcaaaatgt

SEQ ID NO: 1951489 - DNA, 16 bp, Homo sapiens
tctctcaaaatgtgcc

SEQ ID NO: 1951490 - DNA, 12 bp, Homo sapiens
tctctcacccag

SEQ ID NO: 1951491 - DNA, 18 bp, Homo sapiens
tctctccctaccctcttc

SEQ ID NO: 1951492 - DNA, 16 bp, Homo sapiens
tctctctctctctgtt

SEQ ID NO: 1951493 - DNA, 14 bp, Homo sapiens
tctctctctctgtt

SEQ ID NO: 1951494 - DNA, 10 bp, Homo sapiens
tctctctctg

SEQ ID NO: 1951495 - DNA, 13 bp, Homo sapiens
tctctctgtgtgg

SEQ ID NO: 1951496 - DNA, 12 bp, Homo sapiens
tctctctgttcc

SEQ ID NO: 1951497 - DNA, 14 bp, Homo sapiens
tctctcttggtctc

SEQ ID NO: 1951498 - DNA, 17 bp, Homo sapiens
tctctcttggtctcttt

SEQ ID NO: 1951499 - DNA, 22 bp, Homo sapiens
tctctcttggtctctttctttc

SEQ ID NO: 1951500 - DNA, 21 bp, Homo sapiens
tctctgaactgcaacactgga

SEQ ID NO: 1951501 - DNA, 15 bp, Homo sapiens
tctctgagcagtggg

SEQ ID NO: 1951502 - DNA, 19 bp, Homo sapiens
tctctgagcagtggggagc

SEQ ID NO: 1951503 - DNA, 18 bp, Homo sapiens
tctctgtcctctgctttg

SEQ ID NO: 1951504 - DNA, 21 bp, Homo sapiens
tctctgtgtggcaaacattta

SEQ ID NO: 1951505 - DNA, 16 bp, Homo sapiens
tctctgttccaagtgt

SEQ ID NO: 1951506 - DNA, 18 bp, Homo sapiens
tctctgttccaagtgtgt

SEQ ID NO: 1951507 - DNA, 23 bp, Homo sapiens
tctctgttccaagtgtgtgtgca

SEQ ID NO: 1951508 - DNA, 18 bp, Homo sapiens
tctcttccttacaggtgt

SEQ ID NO: 1951509 - DNA, 16 bp, Homo sapiens
tctcttggtctctttc

SEQ ID NO: 1951510 - DNA, 15 bp, Homo sapiens
tctctttctttccaa

SEQ ID NO: 1951511 - DNA, 17 bp, Homo sapiens
tctgaagtcccttcctg

SEQ ID NO: 1951512 - DNA, 22 bp, Homo sapiens
tctgaagtcccttcctgtcctg

SEQ ID NO: 1951513 - DNA, 18 bp, Homo sapiens
tctgaatctctcaaaatg

SEQ ID NO: 1951514 - DNA, 13 bp, Homo sapiens
tctgacagtgttt

SEQ ID NO: 1951515 - DNA, 14 bp, Homo sapiens
tctgaggagtccaa

SEQ ID NO: 1951516 - DNA, 16 bp, Homo sapiens
tctgatgatgttctga

SEQ ID NO: 1951517 - DNA, 20 bp, Homo sapiens
tctgcacacataacacacat

SEQ ID NO: 1951518 - DNA, 15 bp, Homo sapiens
tctggtgcgtgtggc

SEQ ID NO: 1951519 - DNA, 17 bp, Homo sapiens
tctggtgcgtgtggccc

SEQ ID NO: 1951520 - DNA, 21 bp, Homo sapiens
tctggtgcgtgtggccctgtg

SEQ ID NO: 1951521 - DNA, 16 bp, Homo sapiens
tctgtctttatgattt

SEQ ID NO: 1951522 - DNA, 19 bp, Homo sapiens
tctgtgcatctggcctggg

SEQ ID NO: 1951523 - DNA, 16 bp, Homo sapiens
tctgtgtggcaaacat

SEQ ID NO: 1951524 - DNA, 10 bp, Homo sapiens
tctgttccaa

SEQ ID NO: 1951525 - DNA, 18 bp, Homo sapiens
tctgttccaagtgtgtgt

SEQ ID NO: 1951526 - DNA, 21 bp, Homo sapiens
tgttcttgagcagctgaattg

SEQ ID NO: 1951527 - DNA, 19 bp, Homo sapiens
tgttcttgtaaaactgtga

SEQ ID NO: 1951528 - DNA, 13 bp, Homo sapiens
tgttgaaatcttt

SEQ ID NO: 1951529 - DNA, 22 bp, Homo sapiens
tgttgattctttcaatccacag

SEQ ID NO: 1951530 - DNA, 21 bp, Homo sapiens
tgttgtcctgtgtcatctgtc

SEQ ID NO: 1951531 - DNA, 18 bp, Homo sapiens
tgtttacaacacagtagt

SEQ ID NO: 1951532 - DNA, 15 bp, Homo sapiens
tgtttagtagctgat

SEQ ID NO: 1951533 - DNA, 20 bp, Homo sapiens
ttaaaaattatctttaaaac

SEQ ID NO: 1951534 - DNA, 13 bp, Homo sapiens
ttaaaacaaaatc

SEQ ID NO: 1951535 - DNA, 23 bp, Homo sapiens
ttaaaattttcctttatgattct

SEQ ID NO: 1951536 - DNA, 19 bp, Homo sapiens
ttaaacaaaaactttccat

SEQ ID NO: 1951537 - DNA, 19 bp, Homo sapiens
ttaaataccagccagcagg

SEQ ID NO: 1951538 - DNA, 11 bp, Homo sapiens
ttaaattattg

SEQ ID NO: 1951539 - DNA, 22 bp, Homo sapiens
ttaaatttgggttgcaaagcta

SEQ ID NO: 1951540 - DNA, 21 bp, Homo sapiens
ttaagaatttaccagaaatat

SEQ ID NO: 1951541 - DNA, 22 bp, Homo sapiens
ttaagcacaaccatgttcttga

SEQ ID NO: 1951542 - DNA, 18 bp, Homo sapiens
ttaaggcatatactttgt

SEQ ID NO: 1951543 - DNA, 16 bp, Homo sapiens
ttaatctagagctatg

SEQ ID NO: 1951544 - DNA, 21 bp, Homo sapiens
ttaatgtttagtcagtgtact

SEQ ID NO: 1951545 - DNA, 12 bp, Homo sapiens
ttaattcaggtg

SEQ ID NO: 1951546 - DNA, 14 bp, Homo sapiens
ttaattcaggtgat

SEQ ID NO: 1951547 - DNA, 21 bp, Homo sapiens
ttaattcaggtgataactcac

SEQ ID NO: 1951548 - DNA, 14 bp, Homo sapiens
ttacagtgatagaa

SEQ ID NO: 1951549 - DNA, 12 bp, Homo sapiens
ttacataacagg

SEQ ID NO: 1951550 - DNA, 22 bp, Homo sapiens
ttacataacaggcattgcacta

SEQ ID NO: 1951551 - DNA, 16 bp, Homo sapiens
ttactaaccaccattt

SEQ ID NO: 1951552 - DNA, 13 bp, Homo sapiens
ttactttcagaat

SEQ ID NO: 1951553 - DNA, 15 bp, Homo sapiens
ttactttcagaatgt

SEQ ID NO: 1951554 - DNA, 22 bp, Homo sapiens
ttagaatataaaaaatgttatt

SEQ ID NO: 1951555 - DNA, 19 bp, Homo sapiens
ttagaatattgtaactcac

SEQ ID NO: 1951556 - DNA, 20 bp, Homo sapiens
ttagaatcaagtctgtgaaa

SEQ ID NO: 1951557 - DNA, 21 bp, Homo sapiens
ttagacaatgtggaattacat

SEQ ID NO: 1951558 - DNA, 17 bp, Homo sapiens
ttagattcctacttaaa

SEQ ID NO: 1951559 - DNA, 18 bp, Homo sapiens
ttagattcctacttaaac

SEQ ID NO: 1951560 - DNA, 22 bp, Homo sapiens
ttagattcctacttaaacaaaa

SEQ ID NO: 1951561 - DNA, 21 bp, Homo sapiens
ttagctcagaggagaggagca

SEQ ID NO: 1951562 - DNA, 15 bp, Homo sapiens
ttaggaatgctcaat

SEQ ID NO: 1951563 - DNA, 20 bp, Homo sapiens
ttaggaatgctcaatgtgct

SEQ ID NO: 1951564 - DNA, 15 bp, Homo sapiens
ttaggagttttgaga

SEQ ID NO: 1951565 - DNA, 13 bp, Homo sapiens
ttagtagaaaata

SEQ ID NO: 1951566 - DNA, 12 bp, Homo sapiens
ttagtcagaaat

SEQ ID NO: 1951567 - DNA, 16 bp, Homo sapiens
ttagtcatttaagaat

SEQ ID NO: 1951568 - DNA, 12 bp, Homo sapiens
ttagtgtgattg

SEQ ID NO: 1951569 - DNA, 16 bp, Homo sapiens
ttagttggcagagaaa

SEQ ID NO: 1951570 - DNA, 15 bp, Homo sapiens
ttataaaatctgtat

SEQ ID NO: 1951571 - DNA, 22 bp, Homo sapiens
ttatagaggtaaaatttgcaca

SEQ ID NO: 1951572 - DNA, 16 bp, Homo sapiens
ttatagttcatagttg

SEQ ID NO: 1951573 - DNA, 20 bp, Homo sapiens
ttatattcccaaatctcaaa

SEQ ID NO: 1951574 - DNA, 16 bp, Homo sapiens
ttatccttcacaattt

SEQ ID NO: 1951575 - DNA, 18 bp, Homo sapiens
ttatccttcacaatttca

SEQ ID NO: 1951576 - DNA, 20 bp, Homo sapiens
ttatctagtaggtctgcaca

SEQ ID NO: 1951577 - DNA, 22 bp, Homo sapiens
ttatctagtaggtctgcacaca

SEQ ID NO: 1951578 - DNA, 16 bp, Homo sapiens
ttatctgtctttatga

SEQ ID NO: 1951579 - DNA, 12 bp, Homo sapiens
ttatctttaaaa

SEQ ID NO: 1951580 - DNA, 22 bp, Homo sapiens
ttatgatttcatgattagacaa

SEQ ID NO: 1951581 - DNA, 19 bp, Homo sapiens
ttatgcatgagaactaaat

SEQ ID NO: 1951582 - DNA, 15 bp, Homo sapiens
ttattactgaggaaa

SEQ ID NO: 1951583 - DNA, 22 bp, Homo sapiens
ttattagaatataaaaaatgtt

SEQ ID NO: 1951584 - DNA, 22 bp, Homo sapiens
ttattatccttcacaatttcaa

SEQ ID NO: 1951585 - DNA, 13 bp, Homo sapiens
ttattcaataact

SEQ ID NO: 1951586 - DNA, 14 bp, Homo sapiens
ttatttattggcaa

SEQ ID NO: 1951587 - DNA, 16 bp, Homo sapiens
ttatttattggcaata

SEQ ID NO: 1951588 - DNA, 13 bp, Homo sapiens
ttatttgatctgg

SEQ ID NO: 1951589 - DNA, 15 bp, Homo sapiens
ttatttgtcagtgta

SEQ ID NO: 1951590 - DNA, 13 bp, Homo sapiens
ttcaaagaatcac

SEQ ID NO: 1951591 - DNA, 19 bp, Homo sapiens
ttcaaataaccctgaatca

SEQ ID NO: 1951592 - DNA, 22 bp, Homo sapiens
ttcaaatgaagattcagcagtg

SEQ ID NO: 1951593 - DNA, 16 bp, Homo sapiens
ttcaacttcaggaaag

SEQ ID NO: 1951594 - DNA, 14 bp, Homo sapiens
ttcaagaatgtttc

SEQ ID NO: 1951595 - DNA, 18 bp, Homo sapiens
ttcaagaatgtttcagtt

SEQ ID NO: 1951596 - DNA, 16 bp, Homo sapiens
ttcaagttattcagaa

SEQ ID NO: 1951597 - DNA, 16 bp, Homo sapiens
ttcaatccacagtatt

SEQ ID NO: 1951598 - DNA, 22 bp, Homo sapiens
ttcaatccacagtattgttctt

SEQ ID NO: 1951599 - DNA, 22 bp, Homo sapiens
ttcaatccccataatgcttctt

SEQ ID NO: 1951600 - DNA, 16 bp, Homo sapiens
ttcaatgctacaaaat

SEQ ID NO: 1951601 - DNA, 15 bp, Homo sapiens
ttcaattatttccca

SEQ ID NO: 1951602 - DNA, 14 bp, Homo sapiens
ttcacaatttcaat

SEQ ID NO: 1951603 - DNA, 21 bp, Homo sapiens
ttcacaatttcaatgcttctt

SEQ ID NO: 1951604 - DNA, 15 bp, Homo sapiens
ttcaccttctgtgca

SEQ ID NO: 1951605 - DNA, 16 bp, Homo sapiens
ttcacttttattgtat

SEQ ID NO: 1951606 - DNA, 22 bp, Homo sapiens
ttcagaaacaaagcatttgact

SEQ ID NO: 1951607 - DNA, 14 bp, Homo sapiens
ttcagataatgatg

SEQ ID NO: 1951608 - DNA, 19 bp, Homo sapiens
ttcaggaaagcagcagttt

SEQ ID NO: 1951609 - DNA, 14 bp, Homo sapiens
ttcatagttggaaa

SEQ ID NO: 1951610 - DNA, 19 bp, Homo sapiens
ttcatctgaggagtccaaa

SEQ ID NO: 1951611 - DNA, 19 bp, Homo sapiens
ttcatgagatgcagtattg

SEQ ID NO: 1951612 - DNA, 21 bp, Homo sapiens
ttcatttctatagccaaagct

SEQ ID NO: 1951613 - DNA, 17 bp, Homo sapiens
ttccaaaggttgtacat

SEQ ID NO: 1951614 - DNA, 16 bp, Homo sapiens
ttccaagtgtgtgtgc

SEQ ID NO: 1951615 - DNA, 17 bp, Homo sapiens
ttccaagtgtgtgtgca

SEQ ID NO: 1951616 - DNA, 18 bp, Homo sapiens
ttccaagtgtgtgtgcaa

SEQ ID NO: 1951617 - DNA, 21 bp, Homo sapiens
ttccaagtgtgtgtgcaatgt

SEQ ID NO: 1951618 - DNA, 12 bp, Homo sapiens
ttccagcaaaat

SEQ ID NO: 1951619 - DNA, 13 bp, Homo sapiens
ttccatgacagta

SEQ ID NO: 1951620 - DNA, 13 bp, Homo sapiens
ttcccgcagcacc

SEQ ID NO: 1951621 - DNA, 14 bp, Homo sapiens
ttcccgcagcacca

SEQ ID NO: 1951622 - DNA, 22 bp, Homo sapiens
ttcccgcagcaccagcctgagc

SEQ ID NO: 1951623 - DNA, 19 bp, Homo sapiens
ttccgttcatctgaggagt

SEQ ID NO: 1951624 - DNA, 18 bp, Homo sapiens
ttcctacaaagaaaaaag

SEQ ID NO: 1951625 - DNA, 22 bp, Homo sapiens
ttcctcatggctgttatctgtc

SEQ ID NO: 1951626 - DNA, 14 bp, Homo sapiens
ttcctcctgattct

SEQ ID NO: 1951627 - DNA, 23 bp, Homo sapiens
ttcctctctctctctctctctgt

SEQ ID NO: 1951628 - DNA, 15 bp, Homo sapiens
ttcctgaactcccag

SEQ ID NO: 1951629 - DNA, 11 bp, Homo sapiens
ttcctgtcaat

SEQ ID NO: 1951630 - DNA, 18 bp, Homo sapiens
ttctaaaggtttcactgt

SEQ ID NO: 1951631 - DNA, 14 bp, Homo sapiens
ttctaatccatgtg

SEQ ID NO: 1951632 - DNA, 15 bp, Homo sapiens
ttctacaaaagaagt

SEQ ID NO: 1951633 - DNA, 16 bp, Homo sapiens
ttctcagaagtgaaaa

SEQ ID NO: 1951634 - DNA, 22 bp, Homo sapiens
ttctcagaagtgaaaaagactt

SEQ ID NO: 1951635 - DNA, 13 bp, Homo sapiens
ttctcctccaaat

SEQ ID NO: 1951636 - DNA, 18 bp, Homo sapiens
ttctcctccaaatgctgt

SEQ ID NO: 1951637 - DNA, 17 bp, Homo sapiens
tcgggccgcctcctcca

SEQ ID NO: 1951638 - DNA, 14 bp, Homo sapiens
tcgggggaggagca

SEQ ID NO: 1951639 - DNA, 18 bp, Homo sapiens
tcgggggaggagcacccc

SEQ ID NO: 1951640 - DNA, 22 bp, Homo sapiens
tcgggggaggagcacccccagc

SEQ ID NO: 1951641 - DNA, 18 bp, Homo sapiens
tcggtggcatttgctgaa

SEQ ID NO: 1951642 - DNA, 22 bp, Homo sapiens
tcgtccggcctgcagcccagaa

SEQ ID NO: 1951643 - DNA, 16 bp, Homo sapiens
tctaaatcataatcat

SEQ ID NO: 1951644 - DNA, 16 bp, Homo sapiens
tctaatccatgtgctg

SEQ ID NO: 1951645 - DNA, 14 bp, Homo sapiens
tctagataaaagga

SEQ ID NO: 1951646 - DNA, 22 bp, Homo sapiens
tctagataaaaggagagaaagc

SEQ ID NO: 1951647 - DNA, 21 bp, Homo sapiens
tctagtaggtctgcacacata

SEQ ID NO: 1951648 - DNA, 17 bp, Homo sapiens
tctatagcatttaaaga

SEQ ID NO: 1951649 - DNA, 21 bp, Homo sapiens
tctatagccaaagctgttagt

SEQ ID NO: 1951650 - DNA, 14 bp, Homo sapiens
tctatgtacagatg

SEQ ID NO: 1951651 - DNA, 14 bp, Homo sapiens
tctcacccagcctg

SEQ ID NO: 1951652 - DNA, 19 bp, Homo sapiens
tctcagaagtgaaaaagac

SEQ ID NO: 1951653 - DNA, 15 bp, Homo sapiens
tctcagctccactct

SEQ ID NO: 1951654 - DNA, 16 bp, Homo sapiens
tctccacaacctcctc

SEQ ID NO: 1951655 - DNA, 22 bp, Homo sapiens
tctccacagggacacagtctgg

SEQ ID NO: 1951656 - DNA, 13 bp, Homo sapiens
tctcccttttcag

SEQ ID NO: 1951657 - DNA, 14 bp, Homo sapiens
tctcctccaaatgc

SEQ ID NO: 1951658 - DNA, 22 bp, Homo sapiens
tctcctcggtggcatttgctga

SEQ ID NO: 1951659 - DNA, 23 bp, Homo sapiens
tctcctcggtggcatttgctgaa

SEQ ID NO: 1951660 - DNA, 13 bp, Homo sapiens
tctcctctgtcag

SEQ ID NO: 1951661 - DNA, 16 bp, Homo sapiens
tctcctgagcctgtct

SEQ ID NO: 1951662 - DNA, 20 bp, Homo sapiens
tctcctgagcctgtctctcc

SEQ ID NO: 1951663 - DNA, 13 bp, Homo sapiens
tctctatgtacag

SEQ ID NO: 1951664 - DNA, 23 bp, Homo sapiens
tctctccctaccctcttctcagc

SEQ ID NO: 1951665 - DNA, 10 bp, Homo sapiens
tctctctctc

SEQ ID NO: 1951666 - DNA, 15 bp, Homo sapiens
tctctctctctctgt

SEQ ID NO: 1951667 - DNA, 12 bp, Homo sapiens
tctctctctctg

SEQ ID NO: 1951668 - DNA, 15 bp, Homo sapiens
tctctctctctgttc

SEQ ID NO: 1951669 - DNA, 12 bp, Homo sapiens
tctctctctgtt

SEQ ID NO: 1951670 - DNA, 14 bp, Homo sapiens
tctctctctgttcc

SEQ ID NO: 1951671 - DNA, 16 bp, Homo sapiens
tctctctgttccaagt

SEQ ID NO: 1951672 - DNA, 16 bp, Homo sapiens
tctctcttggtctctt

SEQ ID NO: 1951673 - DNA, 22 bp, Homo sapiens
tctctgtcctctgctttgctgt

SEQ ID NO: 1951674 - DNA, 13 bp, Homo sapiens
tctctgtgtggca

SEQ ID NO: 1951675 - DNA, 15 bp, Homo sapiens
tctctgtgtggcaaa

SEQ ID NO: 1951676 - DNA, 20 bp, Homo sapiens
tctctgtgtggcaaacattt

SEQ ID NO: 1951677 - DNA, 14 bp, Homo sapiens
tctctgttccaagt

SEQ ID NO: 1951678 - DNA, 14 bp, Homo sapiens
tctcttccttacag

SEQ ID NO: 1951679 - DNA, 16 bp, Homo sapiens
tctgaactgcaacact

SEQ ID NO: 1951680 - DNA, 15 bp, Homo sapiens
tctgaatctctcaaa

SEQ ID NO: 1951681 - DNA, 17 bp, Homo sapiens
tctgaatctctcaaaat

SEQ ID NO: 1951682 - DNA, 21 bp, Homo sapiens
tctgatgatgttctgaaatgg

SEQ ID NO: 1951683 - DNA, 15 bp, Homo sapiens
tctgcacacataaca

SEQ ID NO: 1951684 - DNA, 19 bp, Homo sapiens
tctgcacacataacacaca

SEQ ID NO: 1951685 - DNA, 18 bp, Homo sapiens
tctgcagcctgagctcca

SEQ ID NO: 1951686 - DNA, 23 bp, Homo sapiens
tctgcagcctgagctccaccctc

SEQ ID NO: 1951687 - DNA, 14 bp, Homo sapiens
tctgccccctcccc

SEQ ID NO: 1951688 - DNA, 16 bp, Homo sapiens
tctgccccctcccccg

SEQ ID NO: 1951689 - DNA, 22 bp, Homo sapiens
tctgccccctcccccgcagaca

SEQ ID NO: 1951690 - DNA, 12 bp, Homo sapiens
tctgcccctccg

SEQ ID NO: 1951691 - DNA, 17 bp, Homo sapiens
tctgccccttgacccca

SEQ ID NO: 1951692 - DNA, 20 bp, Homo sapiens
tctgccccttgaccccacac

SEQ ID NO: 1951693 - DNA, 16 bp, Homo sapiens
tctgctttgctgttat

SEQ ID NO: 1951694 - DNA, 22 bp, Homo sapiens
tctggtgcgtgtggccctgtgg

SEQ ID NO: 1951695 - DNA, 18 bp, Homo sapiens
tctgtaaaaagcaggtga

SEQ ID NO: 1951696 - DNA, 15 bp, Homo sapiens
tctgtcagcttccca

SEQ ID NO: 1951697 - DNA, 21 bp, Homo sapiens
tctgtcagcttcccaacaata

SEQ ID NO: 1951698 - DNA, 17 bp, Homo sapiens
tctgtcagtttgtgaag

SEQ ID NO: 1951699 - DNA, 18 bp, Homo sapiens
tctgtcagtttgtgaagt

SEQ ID NO: 1951700 - DNA, 18 bp, Homo sapiens
tctgtcccagttaactgt

SEQ ID NO: 1951701 - DNA, 21 bp, Homo sapiens
tctgtccttccaacctgttca

SEQ ID NO: 1951702 - DNA, 22 bp, Homo sapiens
tctgtccttccaacctgttcac

SEQ ID NO: 1951703 - DNA, 18 bp, Homo sapiens
tctgtctctcttttgctc

SEQ ID NO: 1951704 - DNA, 13 bp, Homo sapiens
tctgtctttatga

SEQ ID NO: 1951705 - DNA, 14 bp, Homo sapiens
tctgtctttatgat

SEQ ID NO: 1951706 - DNA, 19 bp, Homo sapiens
tctgtctttatgatttcat

SEQ ID NO: 1951707 - DNA, 21 bp, Homo sapiens
tctgtgaaagtctcctgtatc

SEQ ID NO: 1951708 - DNA, 23 bp, Homo sapiens
tctgtgaaagtctcctgtatcat

SEQ ID NO: 1951709 - DNA, 14 bp, Homo sapiens
tctgtgagtctgtc

SEQ ID NO: 1951710 - DNA, 22 bp, Homo sapiens
tctgtgagtctgtcctttccca

SEQ ID NO: 1951711 - DNA, 15 bp, Homo sapiens
tctgtgcatctggcc

SEQ ID NO: 1951712 - DNA, 11 bp, Homo sapiens
tctgtgtggca

SEQ ID NO: 1951713 - DNA, 17 bp, Homo sapiens
tctgtgtggcaaacatt

SEQ ID NO: 1951714 - DNA, 12 bp, Homo sapiens
tctgttccaagt

SEQ ID NO: 1951715 - DNA, 20 bp, Homo sapiens
tcttaagacttctctgtcct

SEQ ID NO: 1951716 - DNA, 18 bp, Homo sapiens
tcttaatgtctcaaaata

SEQ ID NO: 1951717 - DNA, 17 bp, Homo sapiens
tcttaggcactttttaa

SEQ ID NO: 1951718 - DNA, 13 bp, Homo sapiens
tcttatcaagtgt

SEQ ID NO: 1951719 - DNA, 21 bp, Homo sapiens
tcttatcaagtgttacagagg

SEQ ID NO: 1951720 - DNA, 17 bp, Homo sapiens
tcttcaaccctgccctg

SEQ ID NO: 1951721 - DNA, 16 bp, Homo sapiens
tcttctcagctccact

SEQ ID NO: 1951722 - DNA, 20 bp, Homo sapiens
tcttctcagctccactctga

SEQ ID NO: 1951723 - DNA, 13 bp, Homo sapiens
tcttgaagtcatt

SEQ ID NO: 1951724 - DNA, 16 bp, Homo sapiens
tcttgaagtcattgtc

SEQ ID NO: 1951725 - DNA, 23 bp, Homo sapiens
tcttgagcagctgaattggctgc

SEQ ID NO: 1951726 - DNA, 21 bp, Homo sapiens
tcttgcggcaccgcccaccca

SEQ ID NO: 1951727 - DNA, 11 bp, Homo sapiens
tcttgctgtga

SEQ ID NO: 1951728 - DNA, 14 bp, Homo sapiens
tcttgggattcctc

SEQ ID NO: 1951729 - DNA, 15 bp, Homo sapiens
tcttggtatgatcat

SEQ ID NO: 1951730 - DNA, 18 bp, Homo sapiens
tcttgtaaaactgtgaca

SEQ ID NO: 1951731 - DNA, 23 bp, Homo sapiens
tctttaaaatgattcacttttat

SEQ ID NO: 1951732 - DNA, 15 bp, Homo sapiens
tctttactaacactg

SEQ ID NO: 1951733 - DNA, 19 bp, Homo sapiens
tctttagtcatttaagaat

SEQ ID NO: 1951734 - DNA, 21 bp, Homo sapiens
tctttagtcatttaagaattt

SEQ ID NO: 1951735 - DNA, 12 bp, Homo sapiens
tctttatgattt

SEQ ID NO: 1951736 - DNA, 19 bp, Homo sapiens
tgccccctcccccgcagac

SEQ ID NO: 1951737 - DNA, 19 bp, Homo sapiens
tgcccctccgtccccaggg

SEQ ID NO: 1951738 - DNA, 17 bp, Homo sapiens
tgccccttgaccccaca

SEQ ID NO: 1951739 - DNA, 11 bp, Homo sapiens
tgccctccccc

SEQ ID NO: 1951740 - DNA, 14 bp, Homo sapiens
tgccctgcaccttg

SEQ ID NO: 1951741 - DNA, 16 bp, Homo sapiens
tgccctgcaccttggg

SEQ ID NO: 1951742 - DNA, 12 bp, Homo sapiens
tgccgtctttgg

SEQ ID NO: 1951743 - DNA, 17 bp, Homo sapiens
tgccgtctttggttcct

SEQ ID NO: 1951744 - DNA, 23 bp, Homo sapiens
tgccgtctttggttcctcatggc

SEQ ID NO: 1951745 - DNA, 19 bp, Homo sapiens
tgcctcttatcaagtgtta

SEQ ID NO: 1951746 - DNA, 22 bp, Homo sapiens
tgcctcttatcaagtgttacag

SEQ ID NO: 1951747 - DNA, 21 bp, Homo sapiens
tgcctggaggagaaggaggaa

SEQ ID NO: 1951748 - DNA, 13 bp, Homo sapiens
tgcctggcgggca

SEQ ID NO: 1951749 - DNA, 16 bp, Homo sapiens
tgcctggcgggcagcc

SEQ ID NO: 1951750 - DNA, 18 bp, Homo sapiens
tgcctggcgggcagcccc

SEQ ID NO: 1951751 - DNA, 20 bp, Homo sapiens
tgcctggcgggcagcccctg

SEQ ID NO: 1951752 - DNA, 21 bp, Homo sapiens
tgcctggcgggcagcccctgc

SEQ ID NO: 1951753 - DNA, 22 bp, Homo sapiens
tgcctggcgggcagcccctgct

SEQ ID NO: 1951754 - DNA, 16 bp, Homo sapiens
tgtacattaaatacca

SEQ ID NO: 1951755 - DNA, 20 bp, Homo sapiens
tgtacatttatgtgtgaagc

SEQ ID NO: 1951756 - DNA, 20 bp, Homo sapiens
tgtagatcaactcatgttaa

SEQ ID NO: 1951757 - DNA, 21 bp, Homo sapiens
tgtatatgtctagataaaagg

SEQ ID NO: 1951758 - DNA, 18 bp, Homo sapiens
tgtatgctgcatgaaagc

SEQ ID NO: 1951759 - DNA, 21 bp, Homo sapiens
tgtatttttcctctttcactt

SEQ ID NO: 1951760 - DNA, 13 bp, Homo sapiens
tgtcacttttttc

SEQ ID NO: 1951761 - DNA, 21 bp, Homo sapiens
tgtcacttttttcctgtcaat

SEQ ID NO: 1951762 - DNA, 19 bp, Homo sapiens
tgtcaggctctgaatctct

SEQ ID NO: 1951763 - DNA, 19 bp, Homo sapiens
tgtcagtgtcattattagt

SEQ ID NO: 1951764 - DNA, 14 bp, Homo sapiens
tgtcagtttgtgaa

SEQ ID NO: 1951765 - DNA, 17 bp, Homo sapiens
tgtccaggtcacaggca

SEQ ID NO: 1951766 - DNA, 22 bp, Homo sapiens
tgtccggtttccgtagcagttt

SEQ ID NO: 1951767 - DNA, 16 bp, Homo sapiens
tgtcctaaatgcaaag

SEQ ID NO: 1951768 - DNA, 22 bp, Homo sapiens
tgtcctctacataccacactta

SEQ ID NO: 1951769 - DNA, 12 bp, Homo sapiens
tgtcctgctcac

SEQ ID NO: 1951770 - DNA, 18 bp, Homo sapiens
tgtcctgctcacgtctgt

SEQ ID NO: 1951771 - DNA, 13 bp, Homo sapiens
tgtctcaaaataa

SEQ ID NO: 1951772 - DNA, 15 bp, Homo sapiens
tgtctcaaaataaaa

SEQ ID NO: 1951773 - DNA, 21 bp, Homo sapiens
tgtctcaaaataaaaccagaa

SEQ ID NO: 1951774 - DNA, 15 bp, Homo sapiens
tgtctcctctgtcag

SEQ ID NO: 1951775 - DNA, 20 bp, Homo sapiens
tgtctctacaaaaaaaatca

SEQ ID NO: 1951776 - DNA, 14 bp, Homo sapiens
tgtctgttcttcat

SEQ ID NO: 1951777 - DNA, 20 bp, Homo sapiens
tgtctgttcttcatttctat

SEQ ID NO: 1951778 - DNA, 22 bp, Homo sapiens
tgtcttcaaccctgccctgcac

SEQ ID NO: 1951779 - DNA, 15 bp, Homo sapiens
tgtctttaaaatgat

SEQ ID NO: 1951780 - DNA, 22 bp, Homo sapiens
tgtgaaacagtgtggatgtaaa

SEQ ID NO: 1951781 - DNA, 19 bp, Homo sapiens
tgtgaagtgattgacattt

SEQ ID NO: 1951782 - DNA, 14 bp, Homo sapiens
tgtgacattccaca

SEQ ID NO: 1951783 - DNA, 12 bp, Homo sapiens
tgtgagataaat

SEQ ID NO: 1951784 - DNA, 14 bp, Homo sapiens
tgtgagataaatat

SEQ ID NO: 1951785 - DNA, 14 bp, Homo sapiens
tgtgagtctgtcct

SEQ ID NO: 1951786 - DNA, 18 bp, Homo sapiens
tgtgcacctgactttgga

SEQ ID NO: 1951787 - DNA, 14 bp, Homo sapiens
tgtgcatctggcct

SEQ ID NO: 1951788 - DNA, 15 bp, Homo sapiens
tgtgcatctggcctg

SEQ ID NO: 1951789 - DNA, 16 bp, Homo sapiens
tgtgcatctggcctgg

SEQ ID NO: 1951790 - DNA, 18 bp, Homo sapiens
tgtgcatctggcctgggg

SEQ ID NO: 1951791 - DNA, 20 bp, Homo sapiens
tgtgcccacccgtgttctcc

SEQ ID NO: 1951792 - DNA, 21 bp, Homo sapiens
tgtgccccttccccatgctca

SEQ ID NO: 1951793 - DNA, 19 bp, Homo sapiens
tgtgccgtctttggttcct

SEQ ID NO: 1951794 - DNA, 20 bp, Homo sapiens
tgtgccgtctttggttcctc

SEQ ID NO: 1951795 - DNA, 18 bp, Homo sapiens
tgtgctgctgtggcatca

SEQ ID NO: 1951796 - DNA, 22 bp, Homo sapiens
tgtggaaggcacactgagcaag

SEQ ID NO: 1951797 - DNA, 23 bp, Homo sapiens
tgtggaatatggcaatagcattg

SEQ ID NO: 1951798 - DNA, 15 bp, Homo sapiens
tgtggcaaacattta

SEQ ID NO: 1951799 - DNA, 20 bp, Homo sapiens
tgtgggagtccactttcctc

SEQ ID NO: 1951800 - DNA, 23 bp, Homo sapiens
tgtgtgcaatgttccgttcatct

SEQ ID NO: 1951801 - DNA, 14 bp, Homo sapiens
tgtgtgtgcaatgt

SEQ ID NO: 1951802 - DNA, 15 bp, Homo sapiens
tgttacagaggacat

SEQ ID NO: 1951803 - DNA, 19 bp, Homo sapiens
tgttacagaggacatacca

SEQ ID NO: 1951804 - DNA, 20 bp, Homo sapiens
tgttataaaatctgtattgc

SEQ ID NO: 1951805 - DNA, 21 bp, Homo sapiens
tgttataaaatctgtattgct

SEQ ID NO: 1951806 - DNA, 20 bp, Homo sapiens
tgttatcagtacaattcttt

SEQ ID NO: 1951807 - DNA, 20 bp, Homo sapiens
tgttatctgtctttatgatt

SEQ ID NO: 1951808 - DNA, 15 bp, Homo sapiens
tgttcaccttctgtg

SEQ ID NO: 1951809 - DNA, 18 bp, Homo sapiens
tgttcaccttctgtgcat

SEQ ID NO: 1951810 - DNA, 20 bp, Homo sapiens
tgttcagtgaggtatgatgt

SEQ ID NO: 1951811 - DNA, 22 bp, Homo sapiens
tgttcatactttggctgtgatg

SEQ ID NO: 1951812 - DNA, 16 bp, Homo sapiens
tgttccaagtgtgtgt

SEQ ID NO: 1951813 - DNA, 21 bp, Homo sapiens
tgttccaagtgtgtgtgcaat

SEQ ID NO: 1951814 - DNA, 16 bp, Homo sapiens
tgttccgttcatctga

SEQ ID NO: 1951815 - DNA, 19 bp, Homo sapiens
tgttccgttcatctgagga

SEQ ID NO: 1951816 - DNA, 24 bp, Homo sapiens
tgttccgttcatctgaggagtcca

SEQ ID NO: 1951817 - DNA, 16 bp, Homo sapiens
tgttctcctccaaatg

SEQ ID NO: 1951818 - DNA, 20 bp, Homo sapiens
tgttctcctccaaatgctgt

SEQ ID NO: 1951819 - DNA, 13 bp, Homo sapiens
tgttgaaaaagaa

SEQ ID NO: 1951820 - DNA, 16 bp, Homo sapiens
tgttgattctttcaat

SEQ ID NO: 1951821 - DNA, 21 bp, Homo sapiens
tgttgattctttcaatccaca

SEQ ID NO: 1951822 - DNA, 19 bp, Homo sapiens
tgttgcttaatctagagct

SEQ ID NO: 1951823 - DNA, 21 bp, Homo sapiens
tgttgcttaatctagagctat

SEQ ID NO: 1951824 - DNA, 16 bp, Homo sapiens
tgttgtcctgtgtcat

SEQ ID NO: 1951825 - DNA, 22 bp, Homo sapiens
tgttgtcctgtgtcatctgtca

SEQ ID NO: 1951826 - DNA, 16 bp, Homo sapiens
tgtttacaacacagta

SEQ ID NO: 1951827 - DNA, 23 bp, Homo sapiens
tgtttacaacacagtagtgttct

SEQ ID NO: 1951828 - DNA, 12 bp, Homo sapiens
tgtttagtagct

SEQ ID NO: 1951829 - DNA, 15 bp, Homo sapiens
tgtttcctaaatcag

SEQ ID NO: 1951830 - DNA, 16 bp, Homo sapiens
ttaaaacagaaaaggt

SEQ ID NO: 1951831 - DNA, 23 bp, Homo sapiens
ttaaaatgattcacttttattgt

SEQ ID NO: 1951832 - DNA, 18 bp, Homo sapiens
tcatgagatgcagtattg

SEQ ID NO: 1951833 - DNA, 17 bp, Homo sapiens
tcatgcgcagtccccag

SEQ ID NO: 1951834 - DNA, 17 bp, Homo sapiens
tcatgcttctactccat

SEQ ID NO: 1951835 - DNA, 18 bp, Homo sapiens
tcatgcttttctcatggt

SEQ ID NO: 1951836 - DNA, 17 bp, Homo sapiens
tcatgggaattttaact

SEQ ID NO: 1951837 - DNA, 17 bp, Homo sapiens
tcatgttggtaccctgg

SEQ ID NO: 1951838 - DNA, 18 bp, Homo sapiens
tcattatagcatgtaata

SEQ ID NO: 1951839 - DNA, 21 bp, Homo sapiens
tcatttcattatttttcaatt

SEQ ID NO: 1951840 - DNA, 22 bp, Homo sapiens
tcattttatatatgaaaactaa

SEQ ID NO: 1951841 - DNA, 21 bp, Homo sapiens
tcattttattctgtcaatgaa

SEQ ID NO: 1951842 - DNA, 21 bp, Homo sapiens
tccaaaggttgtacatagtgg

SEQ ID NO: 1951843 - DNA, 15 bp, Homo sapiens
tccaagtgtgtgtgc

SEQ ID NO: 1951844 - DNA, 18 bp, Homo sapiens
tccacagagttactgcca

SEQ ID NO: 1951845 - DNA, 21 bp, Homo sapiens
tccacatccccaccctcccct

SEQ ID NO: 1951846 - DNA, 16 bp, Homo sapiens
tccactttcctctctc

SEQ ID NO: 1951847 - DNA, 18 bp, Homo sapiens
tccactttcctctctctc

SEQ ID NO: 1951848 - DNA, 16 bp, Homo sapiens
tccagactcgagaggg

SEQ ID NO: 1951849 - DNA, 23 bp, Homo sapiens
tccagactcgagagggctgagcc

SEQ ID NO: 1951850 - DNA, 19 bp, Homo sapiens
tccagctaagcctgatgat

SEQ ID NO: 1951851 - DNA, 22 bp, Homo sapiens
tccagctaagcctgatgatgga

SEQ ID NO: 1951852 - DNA, 22 bp, Homo sapiens
tccagtgtggtcttgtttaata

SEQ ID NO: 1951853 - DNA, 19 bp, Homo sapiens
tccatgacagtagcatact

SEQ ID NO: 1951854 - DNA, 17 bp, Homo sapiens
tccatggtgaactgaag

SEQ ID NO: 1951855 - DNA, 22 bp, Homo sapiens
tccatggtgaactgaagcagag

SEQ ID NO: 1951856 - DNA, 19 bp, Homo sapiens
tcccaaatctatagcattt

SEQ ID NO: 1951857 - DNA, 15 bp, Homo sapiens
tcccaaatctcaaaa

SEQ ID NO: 1951858 - DNA, 22 bp, Homo sapiens
tcccaacaatactttgtgtctt

SEQ ID NO: 1951859 - DNA, 17 bp, Homo sapiens
tcccacctcggacacca

SEQ ID NO: 1951860 - DNA, 15 bp, Homo sapiens
tcccagctggcagcg

SEQ ID NO: 1951861 - DNA, 21 bp, Homo sapiens
tcccagctggcagcgcctccc

SEQ ID NO: 1951862 - DNA, 15 bp, Homo sapiens
tcccagggcccgagc

SEQ ID NO: 1951863 - DNA, 15 bp, Homo sapiens
tcccatgaatatcaa

SEQ ID NO: 1951864 - DNA, 17 bp, Homo sapiens
tccccataatgcttctt

SEQ ID NO: 1951865 - DNA, 17 bp, Homo sapiens
tccccatgctcagctca

SEQ ID NO: 1951866 - DNA, 17 bp, Homo sapiens
tcccccacggccgtccc

SEQ ID NO: 1951867 - DNA, 21 bp, Homo sapiens
tcccccaggctgcgcctgccc

SEQ ID NO: 1951868 - DNA, 22 bp, Homo sapiens
tcccccaggctgcgcctgcccg

SEQ ID NO: 1951869 - DNA, 19 bp, Homo sapiens
tcccccgcagacagacaga

SEQ ID NO: 1951870 - DNA, 16 bp, Homo sapiens
tccccggacgctggct

SEQ ID NO: 1951871 - DNA, 17 bp, Homo sapiens
tccccggacgctggctc

SEQ ID NO: 1951872 - DNA, 18 bp, Homo sapiens
tccccggacgctggctcg

SEQ ID NO: 1951873 - DNA, 12 bp, Homo sapiens
tcccctctcctg

SEQ ID NO: 1951874 - DNA, 14 bp, Homo sapiens
tcccctctcctgag

SEQ ID NO: 1951875 - DNA, 17 bp, Homo sapiens
tcccctctcctgagcct

SEQ ID NO: 1951876 - DNA, 18 bp, Homo sapiens
tcccctgtggtttgttat

SEQ ID NO: 1951877 - DNA, 14 bp, Homo sapiens
tcccgcagcaccag

SEQ ID NO: 1951878 - DNA, 19 bp, Homo sapiens
tcccgcagcaccagcctga

SEQ ID NO: 1951879 - DNA, 21 bp, Homo sapiens
tcccgcagcaccagcctgagc

SEQ ID NO: 1951880 - DNA, 18 bp, Homo sapiens
tcccgccgcctcgggccg

SEQ ID NO: 1951881 - DNA, 22 bp, Homo sapiens
tcccgccgcctcgggccgcctc

SEQ ID NO: 1951882 - DNA, 14 bp, Homo sapiens
tcccggccccgcgc

SEQ ID NO: 1951883 - DNA, 14 bp, Homo sapiens
tcccgtccgtccgc

SEQ ID NO: 1951884 - DNA, 18 bp, Homo sapiens
tcccgtccgtccgcccgc

SEQ ID NO: 1951885 - DNA, 23 bp, Homo sapiens
tcccgtccgtccgcccgcccacc

SEQ ID NO: 1951886 - DNA, 16 bp, Homo sapiens
tccctaccctcttctc

SEQ ID NO: 1951887 - DNA, 17 bp, Homo sapiens
tccctaccctcttctca

SEQ ID NO: 1951888 - DNA, 19 bp, Homo sapiens
tccctaccctcttctcagc

SEQ ID NO: 1951889 - DNA, 16 bp, Homo sapiens
tccctcagccctcatt

SEQ ID NO: 1951890 - DNA, 17 bp, Homo sapiens
tccctcagccctcatta

SEQ ID NO: 1951891 - DNA, 14 bp, Homo sapiens
tccctcatttcatt

SEQ ID NO: 1951892 - DNA, 16 bp, Homo sapiens
tccctcggtcagcacc

SEQ ID NO: 1951893 - DNA, 18 bp, Homo sapiens
tccctcggtcagcaccgt

SEQ ID NO: 1951894 - DNA, 15 bp, Homo sapiens
tcccttcctgtcctg

SEQ ID NO: 1951895 - DNA, 16 bp, Homo sapiens
tccgcccgcccacccc

SEQ ID NO: 1951896 - DNA, 13 bp, Homo sapiens
tccggcagaggca

SEQ ID NO: 1951897 - DNA, 14 bp, Homo sapiens
tccggcagaggcag

SEQ ID NO: 1951898 - DNA, 16 bp, Homo sapiens
tccggcagaggcaggg

SEQ ID NO: 1951899 - DNA, 19 bp, Homo sapiens
tccggcagaggcagggccc

SEQ ID NO: 1951900 - DNA, 16 bp, Homo sapiens
tccggcctgcagccca

SEQ ID NO: 1951901 - DNA, 13 bp, Homo sapiens
tccgtccccaggg

SEQ ID NO: 1951902 - DNA, 22 bp, Homo sapiens
tccgtccccagggtgcaggcgc

SEQ ID NO: 1951903 - DNA, 17 bp, Homo sapiens
tccgtccgcccgcccac

SEQ ID NO: 1951904 - DNA, 18 bp, Homo sapiens
tccgtccgcccgcccacc

SEQ ID NO: 1951905 - DNA, 22 bp, Homo sapiens
tccgttcatctgaggagtccaa

SEQ ID NO: 1951906 - DNA, 22 bp, Homo sapiens
tcctacttaaacaaaaactttc

SEQ ID NO: 1951907 - DNA, 22 bp, Homo sapiens
tcctcatggctgttatctgtct

SEQ ID NO: 1951908 - DNA, 16 bp, Homo sapiens
tcctccaaatgctgtc

SEQ ID NO: 1951909 - DNA, 14 bp, Homo sapiens
tcctcccctggaag

SEQ ID NO: 1951910 - DNA, 16 bp, Homo sapiens
tcctcctgtctcctct

SEQ ID NO: 1951911 - DNA, 22 bp, Homo sapiens
tcctcgggcgcctgcgctcctc

SEQ ID NO: 1951912 - DNA, 14 bp, Homo sapiens
tcctcggtggcatt

SEQ ID NO: 1951913 - DNA, 20 bp, Homo sapiens
tcctcggtggcatttgctga

SEQ ID NO: 1951914 - DNA, 17 bp, Homo sapiens
tcctcgtccggcctgca

SEQ ID NO: 1951915 - DNA, 17 bp, Homo sapiens
tcctctgaagactgcta

SEQ ID NO: 1951916 - DNA, 14 bp, Homo sapiens
tcctctgcagcctg

SEQ ID NO: 1951917 - DNA, 17 bp, Homo sapiens
tcctctgcagcctgagc

SEQ ID NO: 1951918 - DNA, 12 bp, Homo sapiens
tcctctgccccc

SEQ ID NO: 1951919 - DNA, 14 bp, Homo sapiens
tcctctgccccctc

SEQ ID NO: 1951920 - DNA, 21 bp, Homo sapiens
tcctctgccccctcccccgca

SEQ ID NO: 1951921 - DNA, 23 bp, Homo sapiens
tcctctgccccctcccccgcaga

SEQ ID NO: 1951922 - DNA, 14 bp, Homo sapiens
tcctctgctttgct

SEQ ID NO: 1951923 - DNA, 21 bp, Homo sapiens
tcctcttaatgtctcaaaata

SEQ ID NO: 1951924 - DNA, 14 bp, Homo sapiens
tcctgagcctgtct

SEQ ID NO: 1951925 - DNA, 16 bp, Homo sapiens
tcctgagcctgtctct

SEQ ID NO: 1951926 - DNA, 18 bp, Homo sapiens
tcctgagcctgtctctcc

SEQ ID NO: 1951927 - DNA, 13 bp, Homo sapiens
tcctgatgtcttg

SEQ ID NO: 1951928 - DNA, 14 bp, Homo sapiens
tcctgattctctta

SEQ ID NO: 1951929 - DNA, 23 bp, Homo sapiens
tcctgctgctcgggaaggcctga

SEQ ID NO: 1951930 - DNA, 17 bp, Homo sapiens
tcctgtctcctctgtca

SEQ ID NO: 1951931 - DNA, 19 bp, Homo sapiens
tcctgtctcctctgtcagt

SEQ ID NO: 1951932 - DNA, 16 bp, Homo sapiens
tcctgtgtcatctgtc

SEQ ID NO: 1951933 - DNA, 15 bp, Homo sapiens
tccttcatgcttttc

SEQ ID NO: 1951934 - DNA, 16 bp, Homo sapiens
tccttcatgcttttct

SEQ ID NO: 1951935 - DNA, 22 bp, Homo sapiens
tccttcccgcagcaccagcctg

SEQ ID NO: 1951936 - DNA, 13 bp, Homo sapiens
tccttgtcagttg

SEQ ID NO: 1951937 - DNA, 15 bp, Homo sapiens
tcctttatgattctt

SEQ ID NO: 1951938 - DNA, 16 bp, Homo sapiens
tcctttggcaatatca

SEQ ID NO: 1951939 - DNA, 14 bp, Homo sapiens
tcgagagggctgag

SEQ ID NO: 1951940 - DNA, 16 bp, Homo sapiens
tcgagagggctgagcc

SEQ ID NO: 1951941 - DNA, 18 bp, Homo sapiens
tcgagagggctgagcccc

SEQ ID NO: 1951942 - DNA, 21 bp, Homo sapiens
tcgagagggctgagcccctcc

SEQ ID NO: 1951943 - DNA, 14 bp, Homo sapiens
aaaattattaaaaa

SEQ ID NO: 1951944 - DNA, 19 bp, Homo sapiens
aaaattattaaaaattata

SEQ ID NO: 1951945 - DNA, 19 bp, Homo sapiens
aaaattgacctcaaaagaa

SEQ ID NO: 1951946 - DNA, 17 bp, Homo sapiens
aaacaaaaactttccat

SEQ ID NO: 1951947 - DNA, 22 bp, Homo sapiens
aaacaaaatccttgccttcaaa

SEQ ID NO: 1951948 - DNA, 14 bp, Homo sapiens
aaacaacagcaaca

SEQ ID NO: 1951949 - DNA, 13 bp, Homo sapiens
aaacaattcaaag

SEQ ID NO: 1951950 - DNA, 13 bp, Homo sapiens
aaacagaaaaggt

SEQ ID NO: 1951951 - DNA, 20 bp, Homo sapiens
aaacatcttaggcacttttt

SEQ ID NO: 1951952 - DNA, 20 bp, Homo sapiens
aaacctctttcggaaatgat

SEQ ID NO: 1951953 - DNA, 17 bp, Homo sapiens
aaactatcagcagcggc

SEQ ID NO: 1951954 - DNA, 21 bp, Homo sapiens
aaactgtgacattccacagag

SEQ ID NO: 1951955 - DNA, 14 bp, Homo sapiens
aaactgtgagataa

SEQ ID NO: 1951956 - DNA, 19 bp, Homo sapiens
aaactgtgagataaatatc

SEQ ID NO: 1951957 - DNA, 22 bp, Homo sapiens
aaacttactatggtatatattt

SEQ ID NO: 1951958 - DNA, 23 bp, Homo sapiens
aaagagtagaactttaaaagaag

SEQ ID NO: 1951959 - DNA, 18 bp, Homo sapiens
aaagatatgaagaactat

SEQ ID NO: 1951960 - DNA, 22 bp, Homo sapiens
aaagatggatttgacacactca

SEQ ID NO: 1951961 - DNA, 15 bp, Homo sapiens
aaagcacctcttgaa

SEQ ID NO: 1951962 - DNA, 17 bp, Homo sapiens
aaagcatgccaatttct

SEQ ID NO: 1951963 - DNA, 18 bp, Homo sapiens
aaagcatgctcagtattg

SEQ ID NO: 1951964 - DNA, 18 bp, Homo sapiens
aaagccctccctgtctgt

SEQ ID NO: 1951965 - DNA, 19 bp, Homo sapiens
aaaggcaaaccaatttgtt

SEQ ID NO: 1951966 - DNA, 12 bp, Homo sapiens
aaagtaatttca

SEQ ID NO: 1951967 - DNA, 14 bp, Homo sapiens
aaagtaatttcaag

SEQ ID NO: 1951968 - DNA, 18 bp, Homo sapiens
aaagtcttgaatgttgaa

SEQ ID NO: 1951969 - DNA, 22 bp, Homo sapiens
aaagtgatgtgatttatgcatt

SEQ ID NO: 1951970 - DNA, 20 bp, Homo sapiens
aaagttaaacgtgatgtgct

SEQ ID NO: 1951971 - DNA, 13 bp, Homo sapiens
aaagttttgccta

SEQ ID NO: 1951972 - DNA, 13 bp, Homo sapiens
aaataattaaaac

SEQ ID NO: 1951973 - DNA, 16 bp, Homo sapiens
aaatagatttttagat

SEQ ID NO: 1951974 - DNA, 13 bp, Homo sapiens
aaatagctataaa

SEQ ID NO: 1951975 - DNA, 18 bp, Homo sapiens
aaatagctataaatagtg

SEQ ID NO: 1951976 - DNA, 21 bp, Homo sapiens
aaataggatttgcactgcttt

SEQ ID NO: 1951977 - DNA, 15 bp, Homo sapiens
aaatataaaaataat

SEQ ID NO: 1951978 - DNA, 19 bp, Homo sapiens
aaatatccctcatttcatt

SEQ ID NO: 1951979 - DNA, 17 bp, Homo sapiens
aaatgaatgaaatataa

SEQ ID NO: 1951980 - DNA, 13 bp, Homo sapiens
aaatgattcactt

SEQ ID NO: 1951981 - DNA, 14 bp, Homo sapiens
aaatggctttccac

SEQ ID NO: 1951982 - DNA, 23 bp, Homo sapiens
aaatggttttcaacaagcctgaa

SEQ ID NO: 1951983 - DNA, 21 bp, Homo sapiens
aaatgttattactgaggaaag

SEQ ID NO: 1951984 - DNA, 19 bp, Homo sapiens
aaattaaaattttccttta

SEQ ID NO: 1951985 - DNA, 20 bp, Homo sapiens
aaattaacttctattttcaa

SEQ ID NO: 1951986 - DNA, 13 bp, Homo sapiens
aaattattaaaaa

SEQ ID NO: 1951987 - DNA, 16 bp, Homo sapiens
aaattcacaaagttaa

SEQ ID NO: 1951988 - DNA, 15 bp, Homo sapiens
aaattcttgcactgt

SEQ ID NO: 1951989 - DNA, 22 bp, Homo sapiens
aaattgacctcaaaagaaaatg

SEQ ID NO: 1951990 - DNA, 15 bp, Homo sapiens
aaattgctgagatgt

SEQ ID NO: 1951991 - DNA, 13 bp, Homo sapiens
aaatttacagtga

SEQ ID NO: 1951992 - DNA, 20 bp, Homo sapiens
aaatttacagtgatagaaca

SEQ ID NO: 1951993 - DNA, 20 bp, Homo sapiens
aaatttgggttgcaaagcta

SEQ ID NO: 1951994 - DNA, 15 bp, Homo sapiens
aacaaaaactttcca

SEQ ID NO: 1951995 - DNA, 21 bp, Homo sapiens
aacaaagcatgctcagtattg

SEQ ID NO: 1951996 - DNA, 22 bp, Homo sapiens
aacaaagcatttgactttctgt

SEQ ID NO: 1951997 - DNA, 16 bp, Homo sapiens
aacaagcctgaaagta

SEQ ID NO: 1951998 - DNA, 22 bp, Homo sapiens
aacaagcctgaaagtaatttca

SEQ ID NO: 1951999 - DNA, 15 bp, Homo sapiens
aacacacacacacac

SEQ ID NO: 1952000 - DNA, 18 bp, Homo sapiens
aacactatcatagttatt

SEQ ID NO: 1952001 - DNA, 11 bp, Homo sapiens
aacagcaacaa

SEQ ID NO: 1952002 - DNA, 15 bp, Homo sapiens
aacaggattttcaag

SEQ ID NO: 1952003 - DNA, 16 bp, Homo sapiens
aacaggattttcaagt

SEQ ID NO: 1952004 - DNA, 19 bp, Homo sapiens
aacaggcattgcactaaaa

SEQ ID NO: 1952005 - DNA, 22 bp, Homo sapiens
aacaggcattgcactaaaagtg

SEQ ID NO: 1952006 - DNA, 21 bp, Homo sapiens
aacagtgtggatgtaaatttt

SEQ ID NO: 1952007 - DNA, 12 bp, Homo sapiens
aacagtgtggct

SEQ ID NO: 1952008 - DNA, 21 bp, Homo sapiens
aacagtgtggcttaaacattt

SEQ ID NO: 1952009 - DNA, 17 bp, Homo sapiens
aacatcttaggcacttt

SEQ ID NO: 1952010 - DNA, 21 bp, Homo sapiens
aacatcttaggcactttttaa

SEQ ID NO: 1952011 - DNA, 16 bp, Homo sapiens
aacattaatgttgaaa

SEQ ID NO: 1952012 - DNA, 19 bp, Homo sapiens
aacattaatgttgaaaaag

SEQ ID NO: 1952013 - DNA, 22 bp, Homo sapiens
aacattaatgttgaaaaagaaa

SEQ ID NO: 1952014 - DNA, 14 bp, Homo sapiens
aacattctatttca

SEQ ID NO: 1952015 - DNA, 18 bp, Homo sapiens
aacattttacagatttta

SEQ ID NO: 1952016 - DNA, 23 bp, Homo sapiens
aacattttgtatgctgcatgaaa

SEQ ID NO: 1952017 - DNA, 18 bp, Homo sapiens
aacattttttgtttcttg

SEQ ID NO: 1952018 - DNA, 13 bp, Homo sapiens
aaccagaaagagg

SEQ ID NO: 1952019 - DNA, 14 bp, Homo sapiens
aaccctgccctgca

SEQ ID NO: 1952020 - DNA, 19 bp, Homo sapiens
aaccttagtacctttttaa

SEQ ID NO: 1952021 - DNA, 21 bp, Homo sapiens
aaccttttaaaaaaataatat

SEQ ID NO: 1952022 - DNA, 17 bp, Homo sapiens
aacgatcatatctgtat

SEQ ID NO: 1952023 - DNA, 15 bp, Homo sapiens
aacgatttaatttat

SEQ ID NO: 1952024 - DNA, 23 bp, Homo sapiens
aacgtgatgtgctcatcagaaac

SEQ ID NO: 1952025 - DNA, 16 bp, Homo sapiens
aactcacatgccttct

SEQ ID NO: 1952026 - DNA, 12 bp, Homo sapiens
aactccttacag

SEQ ID NO: 1952027 - DNA, 13 bp, Homo sapiens
aactgaagcagag

SEQ ID NO: 1952028 - DNA, 22 bp, Homo sapiens
aactgatccatcctgtttttcc

SEQ ID NO: 1952029 - DNA, 14 bp, Homo sapiens
aactgatgctttca

SEQ ID NO: 1952030 - DNA, 12 bp, Homo sapiens
aactgcaacact

SEQ ID NO: 1952031 - DNA, 14 bp, Homo sapiens
aactggccccaggc

SEQ ID NO: 1952032 - DNA, 15 bp, Homo sapiens
aactgtcattacaga

SEQ ID NO: 1952033 - DNA, 13 bp, Homo sapiens
aactgtgacattc

SEQ ID NO: 1952034 - DNA, 17 bp, Homo sapiens
aactgtgacattccaca

SEQ ID NO: 1952035 - DNA, 17 bp, Homo sapiens
aactgtgagataaatat

SEQ ID NO: 1952036 - DNA, 18 bp, Homo sapiens
aactgtgagataaatatc

SEQ ID NO: 1952037 - DNA, 19 bp, Homo sapiens
aactgtttactcacattgt

SEQ ID NO: 1952038 - DNA, 15 bp, Homo sapiens
aacttgctgtgaaat

SEQ ID NO: 1952039 - DNA, 15 bp, Homo sapiens
aactttccatgacag

SEQ ID NO: 1952040 - DNA, 17 bp, Homo sapiens
aactttccatgacagta

SEQ ID NO: 1952041 - DNA, 14 bp, Homo sapiens
aagaaaacaaccaa

SEQ ID NO: 1952042 - DNA, 13 bp, Homo sapiens
aagaaaatgtgta

SEQ ID NO: 1952043 - DNA, 21 bp, Homo sapiens
aagaaaatgtgtaacagagtt

SEQ ID NO: 1952044 - DNA, 13 bp, Homo sapiens
aagaaacctttta

SEQ ID NO: 1952045 - DNA, 16 bp, Homo sapiens
aagaaagatgctgatg

SEQ ID NO: 1952046 - DNA, 17 bp, Homo sapiens
aagaaatggctttccac

SEQ ID NO: 1952047 - DNA, 21 bp, Homo sapiens
aagaaattagggctctaattt

SEQ ID NO: 1952048 - DNA, 22 bp, Homo sapiens
aagaaggggtagggatttggct

SEQ ID NO: 1952049 - DNA, 21 bp, Homo sapiens
aagaagtgtgactagatatca

SEQ ID NO: 1952050 - DNA, 21 bp, Homo sapiens
aagaatgtttcagttatagag

SEQ ID NO: 1952051 - DNA, 16 bp, Homo sapiens
aagagaaaaagccctc

SEQ ID NO: 1952052 - DNA, 22 bp, Homo sapiens
aagataattaaatgaaatactt

SEQ ID NO: 1952053 - DNA, 16 bp, Homo sapiens
aagatatgaagaacta

SEQ ID NO: 1952054 - DNA, 20 bp, Homo sapiens
aagatggatttgacacactc

SEQ ID NO: 1952055 - DNA, 14 bp, Homo sapiens
aagattcagcagtg

SEQ ID NO: 1952056 - DNA, 17 bp, Homo sapiens
aagcaaaacattttgta

SEQ ID NO: 1952057 - DNA, 14 bp, Homo sapiens
aagcaccagctgcc

SEQ ID NO: 1952058 - DNA, 19 bp, Homo sapiens
aagcagcagctagaaagag

SEQ ID NO: 1952059 - DNA, 19 bp, Homo sapiens
aagcatgccaatttctctt

SEQ ID NO: 1952060 - DNA, 20 bp, Homo sapiens
aagcatgctcagtattgaga

SEQ ID NO: 1952061 - DNA, 10 bp, Homo sapiens
aagcccaccc

SEQ ID NO: 1952062 - DNA, 17 bp, Homo sapiens
aagccctccctgtctgt

SEQ ID NO: 1952063 - DNA, 16 bp, Homo sapiens
aagctcacttgcttta

SEQ ID NO: 1952064 - DNA, 16 bp, Homo sapiens
aagctccatcttattt

SEQ ID NO: 1952065 - DNA, 23 bp, Homo sapiens
aagctgatgaagttaagcacaac

SEQ ID NO: 1952066 - DNA, 22 bp, Homo sapiens
aagctgttagttaaaatcccaa

SEQ ID NO: 1952067 - DNA, 20 bp, Homo sapiens
aaggagggaaagttccagca

SEQ ID NO: 1952068 - DNA, 16 bp, Homo sapiens
aaggcactaatgatgt

SEQ ID NO: 1952069 - DNA, 19 bp, Homo sapiens
aaggcatatactttgtctt

SEQ ID NO: 1952070 - DNA, 17 bp, Homo sapiens
aaggctgactcttacta

SEQ ID NO: 1952071 - DNA, 17 bp, Homo sapiens
aagggactccagaagca

SEQ ID NO: 1952072 - DNA, 18 bp, Homo sapiens
aagggactccagaagcag

SEQ ID NO: 1952073 - DNA, 15 bp, Homo sapiens
aaggttgtacatagt

SEQ ID NO: 1952074 - DNA, 16 bp, Homo sapiens
aaggtttcactgttca

SEQ ID NO: 1952075 - DNA, 17 bp, Homo sapiens
aaggtttcactgttcat

SEQ ID NO: 1952076 - DNA, 21 bp, Homo sapiens
aagtaataaattccaatacaa

SEQ ID NO: 1952077 - DNA, 12 bp, Homo sapiens
aagtaatttcaa

SEQ ID NO: 1952078 - DNA, 20 bp, Homo sapiens
aagtaatttcaagaatgttt

SEQ ID NO: 1952079 - DNA, 18 bp, Homo sapiens
aagtcccttcctgtcctg

SEQ ID NO: 1952080 - DNA, 15 bp, Homo sapiens
aagtgattgacattt

SEQ ID NO: 1952081 - DNA, 15 bp, Homo sapiens
aagttacatacattt

SEQ ID NO: 1952082 - DNA, 16 bp, Homo sapiens
aagttacatacattta

SEQ ID NO: 1952083 - DNA, 15 bp, Homo sapiens
aagttataccagcaa

SEQ ID NO: 1952084 - DNA, 17 bp, Homo sapiens
aagttataccagcaaaa

SEQ ID NO: 1952085 - DNA, 14 bp, Homo sapiens
aagttattcagaaa

SEQ ID NO: 1952086 - DNA, 18 bp, Homo sapiens
aagttattcagaaatatc

SEQ ID NO: 1952087 - DNA, 15 bp, Homo sapiens
aagttccagcagttt

SEQ ID NO: 1952088 - DNA, 21 bp, Homo sapiens
aagttccagcagtttcatgag

SEQ ID NO: 1952089 - DNA, 15 bp, Homo sapiens
aagtttttggtaatg

SEQ ID NO: 1952090 - DNA, 16 bp, Homo sapiens
aagtttttttgttcat

SEQ ID NO: 1952091 - DNA, 21 bp, Homo sapiens
aataaattccaatacaagtta

SEQ ID NO: 1952092 - DNA, 13 bp, Homo sapiens
aataatttagaaa

SEQ ID NO: 1952093 - DNA, 18 bp, Homo sapiens
aatacattattagaatat

SEQ ID NO: 1952094 - DNA, 21 bp, Homo sapiens
aatacctagtgatacggattt

SEQ ID NO: 1952095 - DNA, 19 bp, Homo sapiens
aatacttgacaacattttt

SEQ ID NO: 1952096 - DNA, 15 bp, Homo sapiens
aatactttgtgtctt

SEQ ID NO: 1952097 - DNA, 18 bp, Homo sapiens
aatagctataaatagtga

SEQ ID NO: 1952098 - DNA, 21 bp, Homo sapiens
aataggatttgcactgcttta

SEQ ID NO: 1952099 - DNA, 15 bp, Homo sapiens
aatataaaaaatgtt

SEQ ID NO: 1952100 - DNA, 18 bp, Homo sapiens
aatatagggtttgtttgc

SEQ ID NO: 1952101 - DNA, 14 bp, Homo sapiens
aatatatgtttggc

SEQ ID NO: 1952102 - DNA, 14 bp, Homo sapiens
aatatcaagaatag

SEQ ID NO: 1952103 - DNA, 15 bp, Homo sapiens
aatatcattatagca

SEQ ID NO: 1952104 - DNA, 16 bp, Homo sapiens
aatatcattatagcat

SEQ ID NO: 1952105 - DNA, 16 bp, Homo sapiens
aatatccctcatttca

SEQ ID NO: 1952106 - DNA, 17 bp, Homo sapiens
aatatccctcatttcat

SEQ ID NO: 1952107 - DNA, 21 bp, Homo sapiens
aatatccctcatttcattatt

SEQ ID NO: 1952108 - DNA, 18 bp, Homo sapiens
aatatggcaatagcattg

SEQ ID NO: 1952109 - DNA, 16 bp, Homo sapiens
aatcaaaaaattatct

SEQ ID NO: 1952110 - DNA, 18 bp, Homo sapiens
aatcaagtctgtgaaagt

SEQ ID NO: 1952111 - DNA, 12 bp, Homo sapiens
aatcataatcat

SEQ ID NO: 1952112 - DNA, 15 bp, Homo sapiens
aatcatctattgagt

SEQ ID NO: 1952113 - DNA, 17 bp, Homo sapiens
aatcatgggaattttaa

SEQ ID NO: 1952114 - DNA, 21 bp, Homo sapiens
aatcatttccagcaaaatata

SEQ ID NO: 1952115 - DNA, 14 bp, Homo sapiens
aatccacagtattg

SEQ ID NO: 1952116 - DNA, 15 bp, Homo sapiens
aatccacagtattgt

SEQ ID NO: 1952117 - DNA, 17 bp, Homo sapiens
aatctagagctatgcac

SEQ ID NO: 1952118 - DNA, 19 bp, Homo sapiens
aatctctcaaaatgtgccg

SEQ ID NO: 1952119 - DNA, 23 bp, Homo sapiens
aatcttgctgtgaaacagtgtgg

SEQ ID NO: 1952120 - DNA, 19 bp, Homo sapiens
aatgaaatataaactgtga

SEQ ID NO: 1952121 - DNA, 18 bp, Homo sapiens
aatgaatgaaatataaac

SEQ ID NO: 1952122 - DNA, 23 bp, Homo sapiens
aatgaatgaaatataaactgtga

SEQ ID NO: 1952123 - DNA, 20 bp, Homo sapiens
aatgagtttccagctaagcc

SEQ ID NO: 1952124 - DNA, 17 bp, Homo sapiens
aatgatatgtctttaaa

SEQ ID NO: 1952125 - DNA, 16 bp, Homo sapiens
aatgatgattcaatca

SEQ ID NO: 1952126 - DNA, 20 bp, Homo sapiens
aatgctacaaaatgtgtgct

SEQ ID NO: 1952127 - DNA, 20 bp, Homo sapiens
aatggcctcttaaaaattat

SEQ ID NO: 1952128 - DNA, 22 bp, Homo sapiens
aatgtgctgttgattctttcaa

SEQ ID NO: 1952129 - DNA, 23 bp, Homo sapiens
aatgttgaagaactcatgtgatt

SEQ ID NO: 1952130 - DNA, 12 bp, Homo sapiens
aatgttgtcctg

SEQ ID NO: 1952131 - DNA, 15 bp, Homo sapiens
aattaaatgaaatac

SEQ ID NO: 1952132 - DNA, 17 bp, Homo sapiens
aattaaatgaaatactt

SEQ ID NO: 1952133 - DNA, 19 bp, Homo sapiens
aattaaccattgctaattt

SEQ ID NO: 1952134 - DNA, 16 bp, Homo sapiens
aattacataacaggca

SEQ ID NO: 1952135 - DNA, 15 bp, Homo sapiens
aattactttgaacat

SEQ ID NO: 1952136 - DNA, 21 bp, Homo sapiens
aattactttgaacattaatgt

SEQ ID NO: 1952137 - DNA, 12 bp, Homo sapiens
aattatctttaa

SEQ ID NO: 1952138 - DNA, 15 bp, Homo sapiens
aattatctttaaaac

SEQ ID NO: 1952139 - DNA, 16 bp, Homo sapiens
aattatctttaaaact

SEQ ID NO: 1952140 - DNA, 19 bp, Homo sapiens
aattatgtcaaatggatgt

SEQ ID NO: 1952141 - DNA, 17 bp, Homo sapiens
aattctcagaagtgaaa

SEQ ID NO: 1952142 - DNA, 13 bp, Homo sapiens
aattgctgagatg

SEQ ID NO: 1952143 - DNA, 20 bp, Homo sapiens
aattgctgagatgtttagta

SEQ ID NO: 1952144 - DNA, 14 bp, Homo sapiens
aattgcttctctaa

SEQ ID NO: 1952145 - DNA, 20 bp, Homo sapiens
aatttacagtgatagaacaa

SEQ ID NO: 1952146 - DNA, 15 bp, Homo sapiens
aatttaccagaaata

SEQ ID NO: 1952147 - DNA, 17 bp, Homo sapiens
aatttaccagaaatatt

SEQ ID NO: 1952148 - DNA, 22 bp, Homo sapiens
aatttagaaataaaagatgata

SEQ ID NO: 1952149 - DNA, 22 bp, Homo sapiens
aatttaggaatgctcaatgtgc

SEQ ID NO: 1952150 - DNA, 21 bp, Homo sapiens
aatttcaagaatgtttcagtt

SEQ ID NO: 1952151 - DNA, 22 bp, Homo sapiens
aatttcaagaatgtttcagtta

SEQ ID NO: 1952152 - DNA, 23 bp, Homo sapiens
aatttcaagaatgtttcagttat

SEQ ID NO: 1952153 - DNA, 16 bp, Homo sapiens
aatttcaatgcttctt

SEQ ID NO: 1952154 - DNA, 17 bp, Homo sapiens
aatttcaatgcttcttt

SEQ ID NO: 1952155 - DNA, 19 bp, Homo sapiens
aatttcaatgcttctttta

SEQ ID NO: 1952156 - DNA, 12 bp, Homo sapiens
aatttcctgctc

SEQ ID NO: 1952157 - DNA, 20 bp, Homo sapiens
aatttctagatatgagaaat

SEQ ID NO: 1952158 - DNA, 20 bp, Homo sapiens
aattttcctttatgattctt

SEQ ID NO: 1952159 - DNA, 17 bp, Homo sapiens
acaaaaactttccatga

SEQ ID NO: 1952160 - DNA, 21 bp, Homo sapiens
acaaaaactttccatgacagt

SEQ ID NO: 1952161 - DNA, 13 bp, Homo sapiens
acaaaacaacagc

SEQ ID NO: 1952162 - DNA, 20 bp, Homo sapiens
agctagtttaaaattattaa

SEQ ID NO: 1952163 - DNA, 22 bp, Homo sapiens
agctagtttaaaattattaaaa

SEQ ID NO: 1952164 - DNA, 16 bp, Homo sapiens
agctatgcacaccaaa

SEQ ID NO: 1952165 - DNA, 14 bp, Homo sapiens
agctccaccctccc

SEQ ID NO: 1952166 - DNA, 13 bp, Homo sapiens
agctccactctga

SEQ ID NO: 1952167 - DNA, 19 bp, Homo sapiens
agctccactctgaagtccc

SEQ ID NO: 1952168 - DNA, 16 bp, Homo sapiens
agctccttcatgcttt

SEQ ID NO: 1952169 - DNA, 21 bp, Homo sapiens
agctccttcatgcttttctca

SEQ ID NO: 1952170 - DNA, 22 bp, Homo sapiens
agctccttcatgcttttctcat

SEQ ID NO: 1952171 - DNA, 18 bp, Homo sapiens
agctgagtcggctgggca

SEQ ID NO: 1952172 - DNA, 20 bp, Homo sapiens
agctgagtcggctgggcagg

SEQ ID NO: 1952173 - DNA, 23 bp, Homo sapiens
agctgagtcggctgggcagggcc

SEQ ID NO: 1952174 - DNA, 14 bp, Homo sapiens
agctggcagcgcct

SEQ ID NO: 1952175 - DNA, 15 bp, Homo sapiens
agctggcagcgcctc

SEQ ID NO: 1952176 - DNA, 19 bp, Homo sapiens
agctggcagcgcctcccgc

SEQ ID NO: 1952177 - DNA, 13 bp, Homo sapiens
agctggctgggtc

SEQ ID NO: 1952178 - DNA, 23 bp, Homo sapiens
agctggctgggtcgcccctcctc

SEQ ID NO: 1952179 - DNA, 14 bp, Homo sapiens
agcttcccaacaat

SEQ ID NO: 1952180 - DNA, 14 bp, Homo sapiens
aggaaaaggcttga

SEQ ID NO: 1952181 - DNA, 21 bp, Homo sapiens
aggaaaaggcttgagtctgga

SEQ ID NO: 1952182 - DNA, 12 bp, Homo sapiens
aggaatgctcaa

SEQ ID NO: 1952183 - DNA, 16 bp, Homo sapiens
aggaatgctcaatgtg

SEQ ID NO: 1952184 - DNA, 20 bp, Homo sapiens
aggaatgctcaatgtgctgt

SEQ ID NO: 1952185 - DNA, 21 bp, Homo sapiens
aggactctcacgatatgcaag

SEQ ID NO: 1952186 - DNA, 16 bp, Homo sapiens
aggagatgaggctgga

SEQ ID NO: 1952187 - DNA, 23 bp, Homo sapiens
aggagatgaggctggataggaga

SEQ ID NO: 1952188 - DNA, 13 bp, Homo sapiens
aggagcaaacagg

SEQ ID NO: 1952189 - DNA, 11 bp, Homo sapiens
aggagcacccc

SEQ ID NO: 1952190 - DNA, 19 bp, Homo sapiens
aggagcacccccagcctcc

SEQ ID NO: 1952191 - DNA, 20 bp, Homo sapiens
aggagcacccccagcctccc

SEQ ID NO: 1952192 - DNA, 18 bp, Homo sapiens
aggatttgcactgcttta

SEQ ID NO: 1952193 - DNA, 20 bp, Homo sapiens
aggattttcaagttattcag

SEQ ID NO: 1952194 - DNA, 19 bp, Homo sapiens
aggcactttttaacattct

SEQ ID NO: 1952195 - DNA, 20 bp, Homo sapiens
aggcactttttaacattctc

SEQ ID NO: 1952196 - DNA, 21 bp, Homo sapiens
aggcattgcactaaaagtgat

SEQ ID NO: 1952197 - DNA, 21 bp, Homo sapiens
aggccaagagtttgagaccaa

SEQ ID NO: 1952198 - DNA, 13 bp, Homo sapiens
aggcccccggagg

SEQ ID NO: 1952199 - DNA, 21 bp, Homo sapiens
aggcctgagggaagcccaccc

SEQ ID NO: 1952200 - DNA, 13 bp, Homo sapiens
aggcgcccacctg

SEQ ID NO: 1952201 - DNA, 14 bp, Homo sapiens
aggcgcccacctgc

SEQ ID NO: 1952202 - DNA, 22 bp, Homo sapiens
aggctgactcttactaaccacc

SEQ ID NO: 1952203 - DNA, 16 bp, Homo sapiens
aggctgcgcctgcccg

SEQ ID NO: 1952204 - DNA, 18 bp, Homo sapiens
aggctgcgcctgcccgcc

SEQ ID NO: 1952205 - DNA, 18 bp, Homo sapiens
aggctggataggagagga

SEQ ID NO: 1952206 - DNA, 20 bp, Homo sapiens
aggctggataggagaggaaa

SEQ ID NO: 1952207 - DNA, 18 bp, Homo sapiens
agggaagcccacccgccc

SEQ ID NO: 1952208 - DNA, 22 bp, Homo sapiens
agggaagcccacccgccccaga

SEQ ID NO: 1952209 - DNA, 14 bp, Homo sapiens
agggccgcagggcg

SEQ ID NO: 1952210 - DNA, 16 bp, Homo sapiens
agggccgcagggcgct

SEQ ID NO: 1952211 - DNA, 15 bp, Homo sapiens
agggcgctccggcag

SEQ ID NO: 1952212 - DNA, 14 bp, Homo sapiens
agggctgagcccct

SEQ ID NO: 1952213 - DNA, 17 bp, Homo sapiens
agggctgagcccctcct

SEQ ID NO: 1952214 - DNA, 19 bp, Homo sapiens
agggctgagcccctcctct

SEQ ID NO: 1952215 - DNA, 20 bp, Homo sapiens
agggctgagcccctcctctc

SEQ ID NO: 1952216 - DNA, 11 bp, Homo sapiens
aggggaggctg

SEQ ID NO: 1952217 - DNA, 12 bp, Homo sapiens
aggggaggctga

SEQ ID NO: 1952218 - DNA, 16 bp, Homo sapiens
aggggcttggagcaga

SEQ ID NO: 1952219 - DNA, 17 bp, Homo sapiens
aggggcttggagcagag

SEQ ID NO: 1952220 - DNA, 18 bp, Homo sapiens
agggtgcaggcgcgcacc

SEQ ID NO: 1952221 - DNA, 23 bp, Homo sapiens
aggtaaaatttgcacacaaaaca

SEQ ID NO: 1952222 - DNA, 21 bp, Homo sapiens
aggtcttgagtttcatttttc

SEQ ID NO: 1952223 - DNA, 22 bp, Homo sapiens
aggtgcggaccggagcggctga

SEQ ID NO: 1952224 - DNA, 14 bp, Homo sapiens
aggttaaattattg

SEQ ID NO: 1952225 - DNA, 19 bp, Homo sapiens
aggttgacagcaacaaagc

SEQ ID NO: 1952226 - DNA, 20 bp, Homo sapiens
agtaataaattccaatacaa

SEQ ID NO: 1952227 - DNA, 13 bp, Homo sapiens
agtaattaacata

SEQ ID NO: 1952228 - DNA, 15 bp, Homo sapiens
agtaatttcaagaat

SEQ ID NO: 1952229 - DNA, 14 bp, Homo sapiens
agtacaataaataa

SEQ ID NO: 1952230 - DNA, 14 bp, Homo sapiens
agtacaattctttg

SEQ ID NO: 1952231 - DNA, 22 bp, Homo sapiens
agtacaattctttgttgcttaa

SEQ ID NO: 1952232 - DNA, 15 bp, Homo sapiens
agtaccatcccactg

SEQ ID NO: 1952233 - DNA, 20 bp, Homo sapiens
agtagaaaatacattattag

SEQ ID NO: 1952234 - DNA, 16 bp, Homo sapiens
agtagagtcaggagaa

SEQ ID NO: 1952235 - DNA, 14 bp, Homo sapiens
agtagctgataaag

SEQ ID NO: 1952236 - DNA, 15 bp, Homo sapiens
agtagctgataaaga

SEQ ID NO: 1952237 - DNA, 23 bp, Homo sapiens
agtaggtctgcacacataacaca

SEQ ID NO: 1952238 - DNA, 21 bp, Homo sapiens
agtatacacatcataaacaaa

SEQ ID NO: 1952239 - DNA, 16 bp, Homo sapiens
agtcaaacagtgtggc

SEQ ID NO: 1952240 - DNA, 12 bp, Homo sapiens
agtcagaaatga

SEQ ID NO: 1952241 - DNA, 13 bp, Homo sapiens
agtcatttaagaa

SEQ ID NO: 1952242 - DNA, 13 bp, Homo sapiens
agtccactttcct

SEQ ID NO: 1952243 - DNA, 18 bp, Homo sapiens
agtccactttcctctctc

SEQ ID NO: 1952244 - DNA, 19 bp, Homo sapiens
agtccactttcctctctct

SEQ ID NO: 1952245 - DNA, 13 bp, Homo sapiens
agtcccttcctgt

SEQ ID NO: 1952246 - DNA, 21 bp, Homo sapiens
agtctcagtgctagcttattt

SEQ ID NO: 1952247 - DNA, 14 bp, Homo sapiens
agtctgtcctttcc

SEQ ID NO: 1952248 - DNA, 19 bp, Homo sapiens
agtgaaaaagacttcaaat

SEQ ID NO: 1952249 - DNA, 23 bp, Homo sapiens
agtgaaaaagacttcaaatgtta

SEQ ID NO: 1952250 - DNA, 22 bp, Homo sapiens
agtgcattcattcatcctctta

SEQ ID NO: 1952251 - DNA, 23 bp, Homo sapiens
agtgcattcattcatcctcttat

SEQ ID NO: 1952252 - DNA, 19 bp, Homo sapiens
agtggggcccatggcccca

SEQ ID NO: 1952253 - DNA, 22 bp, Homo sapiens
agtggggcccatggccccagct

SEQ ID NO: 1952254 - DNA, 15 bp, Homo sapiens
agtggttctgtgcct

SEQ ID NO: 1952255 - DNA, 16 bp, Homo sapiens
agtggttctgtgcctc

SEQ ID NO: 1952256 - DNA, 16 bp, Homo sapiens
agtgtactctgagtcc

SEQ ID NO: 1952257 - DNA, 16 bp, Homo sapiens
agtgtcacttttttcc

SEQ ID NO: 1952258 - DNA, 19 bp, Homo sapiens
agtgtcacttttttcctgt

SEQ ID NO: 1952259 - DNA, 12 bp, Homo sapiens
agtgtcattatt

SEQ ID NO: 1952260 - DNA, 13 bp, Homo sapiens
agtgtctgttctt

SEQ ID NO: 1952261 - DNA, 19 bp, Homo sapiens
agtgtctgttcttcatttc

SEQ ID NO: 1952262 - DNA, 18 bp, Homo sapiens
agtgtgactagatatcaa

SEQ ID NO: 1952263 - DNA, 21 bp, Homo sapiens
agtgtggatgtaaattttata

SEQ ID NO: 1952264 - DNA, 17 bp, Homo sapiens
agtgtggcttaaacatt

SEQ ID NO: 1952265 - DNA, 23 bp, Homo sapiens
agtgttataaaatctgtattgct

SEQ ID NO: 1952266 - DNA, 14 bp, Homo sapiens
agaagcagcagcta

SEQ ID NO: 1952267 - DNA, 14 bp, Homo sapiens
agaagtgaaaaaga

SEQ ID NO: 1952268 - DNA, 15 bp, Homo sapiens
agaatagttgtcaga

SEQ ID NO: 1952269 - DNA, 20 bp, Homo sapiens
agaatatgtatgtacctgag

SEQ ID NO: 1952270 - DNA, 14 bp, Homo sapiens
agaatcaagtctgt

SEQ ID NO: 1952271 - DNA, 18 bp, Homo sapiens
agaatttaccagaaatat

SEQ ID NO: 1952272 - DNA, 22 bp, Homo sapiens
agaattttaaaaaagatggatt

SEQ ID NO: 1952273 - DNA, 18 bp, Homo sapiens
agacaagtctagtggaac

SEQ ID NO: 1952274 - DNA, 22 bp, Homo sapiens
agacaatgtggaattacataac

SEQ ID NO: 1952275 - DNA, 20 bp, Homo sapiens
agacggacgggacagcggcc

SEQ ID NO: 1952276 - DNA, 23 bp, Homo sapiens
agacggacgggacagcggcccgg

SEQ ID NO: 1952277 - DNA, 14 bp, Homo sapiens
agacggcagcccca

SEQ ID NO: 1952278 - DNA, 12 bp, Homo sapiens
agactcaatcat

SEQ ID NO: 1952279 - DNA, 20 bp, Homo sapiens
agactcgagagggctgagcc

SEQ ID NO: 1952280 - DNA, 22 bp, Homo sapiens
agactctaaaactatcagcagc

SEQ ID NO: 1952281 - DNA, 22 bp, Homo sapiens
agactgcccaccctgggcctcc

SEQ ID NO: 1952282 - DNA, 14 bp, Homo sapiens
agacttctaaatca

SEQ ID NO: 1952283 - DNA, 17 bp, Homo sapiens
agacttctaaatcataa

SEQ ID NO: 1952284 - DNA, 16 bp, Homo sapiens
agagaaaaagccctct

SEQ ID NO: 1952285 - DNA, 17 bp, Homo sapiens
agagaaaaagccctctt

SEQ ID NO: 1952286 - DNA, 19 bp, Homo sapiens
agagaaagcaaaacatttt

SEQ ID NO: 1952287 - DNA, 23 bp, Homo sapiens
agagacaatttaaggcctgcact

SEQ ID NO: 1952288 - DNA, 16 bp, Homo sapiens
agagactgcccaccct

SEQ ID NO: 1952289 - DNA, 17 bp, Homo sapiens
agagacttctaaatcat

SEQ ID NO: 1952290 - DNA, 21 bp, Homo sapiens
agagagcaatcttgctgtgaa

SEQ ID NO: 1952291 - DNA, 13 bp, Homo sapiens
agagcagcctctt

SEQ ID NO: 1952292 - DNA, 19 bp, Homo sapiens
agagcgccacccgcccgcc

SEQ ID NO: 1952293 - DNA, 20 bp, Homo sapiens
agagctatgcacaccaaatt

SEQ ID NO: 1952294 - DNA, 22 bp, Homo sapiens
agagctatgcacaccaaattgc

SEQ ID NO: 1952295 - DNA, 17 bp, Homo sapiens
agagctgagtcggctgg

SEQ ID NO: 1952296 - DNA, 23 bp, Homo sapiens
agaggaaaaggcttgagtctgga

SEQ ID NO: 1952297 - DNA, 14 bp, Homo sapiens
agaggagcaaacag

SEQ ID NO: 1952298 - DNA, 18 bp, Homo sapiens
agaggagcaaacaggaaa

SEQ ID NO: 1952299 - DNA, 21 bp, Homo sapiens
agaggcagagacctcctgatg

SEQ ID NO: 1952300 - DNA, 15 bp, Homo sapiens
agaggcagggccctg

SEQ ID NO: 1952301 - DNA, 16 bp, Homo sapiens
agaggcagggccctgg

SEQ ID NO: 1952302 - DNA, 17 bp, Homo sapiens
agaggcagggccctggg

SEQ ID NO: 1952303 - DNA, 20 bp, Homo sapiens
agagggctgagcccctcctc

SEQ ID NO: 1952304 - DNA, 20 bp, Homo sapiens
agagtagaactttaaaagaa

SEQ ID NO: 1952305 - DNA, 15 bp, Homo sapiens
agagtcaagctgatg

SEQ ID NO: 1952306 - DNA, 14 bp, Homo sapiens
agataaatatcatt

SEQ ID NO: 1952307 - DNA, 16 bp, Homo sapiens
agataaatatcattat

SEQ ID NO: 1952308 - DNA, 15 bp, Homo sapiens
agataattaaatgaa

SEQ ID NO: 1952309 - DNA, 15 bp, Homo sapiens
agataccattttgaa

SEQ ID NO: 1952310 - DNA, 18 bp, Homo sapiens
agataccattttgaaata

SEQ ID NO: 1952311 - DNA, 21 bp, Homo sapiens
agatatgagaaatataaaaat

SEQ ID NO: 1952312 - DNA, 23 bp, Homo sapiens
agatatgagaaatataaaaataa

SEQ ID NO: 1952313 - DNA, 15 bp, Homo sapiens
agatcccaagtcaaa

SEQ ID NO: 1952314 - DNA, 19 bp, Homo sapiens
agatccctcggtcagcacc

SEQ ID NO: 1952315 - DNA, 20 bp, Homo sapiens
agatccctcggtcagcaccg

SEQ ID NO: 1952316 - DNA, 17 bp, Homo sapiens
agatctcctgtgcacct

SEQ ID NO: 1952317 - DNA, 20 bp, Homo sapiens
agatgacctgaggaaaggag

SEQ ID NO: 1952318 - DNA, 16 bp, Homo sapiens
agatgtttagtagctg

SEQ ID NO: 1952319 - DNA, 20 bp, Homo sapiens
agattaagttataccagcaa

SEQ ID NO: 1952320 - DNA, 16 bp, Homo sapiens
agattcagcagtgtct

SEQ ID NO: 1952321 - DNA, 21 bp, Homo sapiens
agattcctacttaaacaaaaa

SEQ ID NO: 1952322 - DNA, 22 bp, Homo sapiens
agatttcctttggcaatatcat

SEQ ID NO: 1952323 - DNA, 20 bp, Homo sapiens
agattttaaaacttcatctg

SEQ ID NO: 1952324 - DNA, 14 bp, Homo sapiens
agcaaaacattttg

SEQ ID NO: 1952325 - DNA, 20 bp, Homo sapiens
agcaaagcatgccaatttct

SEQ ID NO: 1952326 - DNA, 18 bp, Homo sapiens
agcaatcttgctgtgaaa

SEQ ID NO: 1952327 - DNA, 16 bp, Homo sapiens
agcaccacggggtcgg

SEQ ID NO: 1952328 - DNA, 15 bp, Homo sapiens
agcaccagcctgagc

SEQ ID NO: 1952329 - DNA, 17 bp, Homo sapiens
agcacccccagcctccc

SEQ ID NO: 1952330 - DNA, 18 bp, Homo sapiens
agcacccccagcctcccc

SEQ ID NO: 1952331 - DNA, 19 bp, Homo sapiens
agcaccgtggtgtgaggcc

SEQ ID NO: 1952332 - DNA, 21 bp, Homo sapiens
agcaccgtggtgtgaggcccc

SEQ ID NO: 1952333 - DNA, 14 bp, Homo sapiens
agcactcccagggc

SEQ ID NO: 1952334 - DNA, 18 bp, Homo sapiens
agcactttgggaggctga

SEQ ID NO: 1952335 - DNA, 17 bp, Homo sapiens
agcagagacggcagccc

SEQ ID NO: 1952336 - DNA, 22 bp, Homo sapiens
agcagagtcaagctgatgaagt

SEQ ID NO: 1952337 - DNA, 15 bp, Homo sapiens
agcagcagcagcagc

SEQ ID NO: 1952338 - DNA, 14 bp, Homo sapiens
agcagctagctgct

SEQ ID NO: 1952339 - DNA, 17 bp, Homo sapiens
agcagctagctgctttt

SEQ ID NO: 1952340 - DNA, 16 bp, Homo sapiens
agcagtaaatgtatat

SEQ ID NO: 1952341 - DNA, 16 bp, Homo sapiens
agcagtaccatcccac

SEQ ID NO: 1952342 - DNA, 18 bp, Homo sapiens
agcagtaccatcccactg

SEQ ID NO: 1952343 - DNA, 21 bp, Homo sapiens
agcagtaccatcccactgata

SEQ ID NO: 1952344 - DNA, 15 bp, Homo sapiens
agcagtggggagcgg

SEQ ID NO: 1952345 - DNA, 20 bp, Homo sapiens
agcagttttcttttaatttt

SEQ ID NO: 1952346 - DNA, 16 bp, Homo sapiens
agcatgtaatattaaa

SEQ ID NO: 1952347 - DNA, 17 bp, Homo sapiens
agcattcaaatgaagat

SEQ ID NO: 1952348 - DNA, 22 bp, Homo sapiens
agcattcaaatgaagattcagc

SEQ ID NO: 1952349 - DNA, 16 bp, Homo sapiens
agcatttgactttctg

SEQ ID NO: 1952350 - DNA, 17 bp, Homo sapiens
agcatttgactttctgt

SEQ ID NO: 1952351 - DNA, 21 bp, Homo sapiens
agcatttttctttagtcattt

SEQ ID NO: 1952352 - DNA, 19 bp, Homo sapiens
agccacttatttccatgga

SEQ ID NO: 1952353 - DNA, 20 bp, Homo sapiens
agccatatattttctgagta

SEQ ID NO: 1952354 - DNA, 16 bp, Homo sapiens
agcccacccgccccag

SEQ ID NO: 1952355 - DNA, 21 bp, Homo sapiens
agcccacccgccccagagact

SEQ ID NO: 1952356 - DNA, 15 bp, Homo sapiens
agcccagaacgggcc

SEQ ID NO: 1952357 - DNA, 15 bp, Homo sapiens
agccccatccttccc

SEQ ID NO: 1952358 - DNA, 12 bp, Homo sapiens
agcccctcctct

SEQ ID NO: 1952359 - DNA, 17 bp, Homo sapiens
agccccttcaattattt

SEQ ID NO: 1952360 - DNA, 18 bp, Homo sapiens
agccctaagtaaatctaa

SEQ ID NO: 1952361 - DNA, 22 bp, Homo sapiens
agccctaagtaaatctaaatta

SEQ ID NO: 1952362 - DNA, 13 bp, Homo sapiens
agccctctttctc

SEQ ID NO: 1952363 - DNA, 23 bp, Homo sapiens
agccctctttctctctgtgtggc

SEQ ID NO: 1952364 - DNA, 17 bp, Homo sapiens
agccgcgctctgcccct

SEQ ID NO: 1952365 - DNA, 18 bp, Homo sapiens
agccgcgctctgcccctc

SEQ ID NO: 1952366 - DNA, 23 bp, Homo sapiens
agcctccactttggatcaggaaa

SEQ ID NO: 1952367 - DNA, 13 bp, Homo sapiens
agcctcccccagg

SEQ ID NO: 1952368 - DNA, 22 bp, Homo sapiens
agcctcccccaggctgcgcctg

SEQ ID NO: 1952369 - DNA, 21 bp, Homo sapiens
agcctgaaagtaatttcaaga

SEQ ID NO: 1952370 - DNA, 14 bp, Homo sapiens
agcctgagctccac

SEQ ID NO: 1952371 - DNA, 14 bp, Homo sapiens
agcggcccggccca

SEQ ID NO: 1952372 - DNA, 15 bp, Homo sapiens
agcggctgaggacgg

SEQ ID NO: 1952373 - DNA, 23 bp, Homo sapiens
agcgggggctaactggccccagg

SEQ ID NO: 1952374 - DNA, 13 bp, Homo sapiens
agctaacaaaaga

SEQ ID NO: 1952375 - DNA, 17 bp, Homo sapiens
agctacaggggaggctg

SEQ ID NO: 1952376 - DNA, 14 bp, Homo sapiens
agctagctgctttt

SEQ ID NO: 1952377 - DNA, 18 bp, Homo sapiens
agctagtttaaaattatt

SEQ ID NO: 1952378 - DNA, 23 bp, Homo sapiens
acaaaatgtgtgcttggaaaatg

SEQ ID NO: 1952379 - DNA, 11 bp, Homo sapiens
acaaagaaaaa

SEQ ID NO: 1952380 - DNA, 15 bp, Homo sapiens
acaaagcatgctcag

SEQ ID NO: 1952381 - DNA, 18 bp, Homo sapiens
acaacaaagcatgctcag

SEQ ID NO: 1952382 - DNA, 14 bp, Homo sapiens
acaacaacagaaca

SEQ ID NO: 1952383 - DNA, 14 bp, Homo sapiens
acaacacacacaca

SEQ ID NO: 1952384 - DNA, 19 bp, Homo sapiens
acaacaggattttcaagtt

SEQ ID NO: 1952385 - DNA, 21 bp, Homo sapiens
acaagcctgaaagtaatttca

SEQ ID NO: 1952386 - DNA, 18 bp, Homo sapiens
acaagtgtaataaatcaa

SEQ ID NO: 1952387 - DNA, 17 bp, Homo sapiens
acaatcatctattgagt

SEQ ID NO: 1952388 - DNA, 14 bp, Homo sapiens
acaatgtggaatta

SEQ ID NO: 1952389 - DNA, 17 bp, Homo sapiens
acaatgtggaattacat

SEQ ID NO: 1952390 - DNA, 18 bp, Homo sapiens
acaatgtggaattacata

SEQ ID NO: 1952391 - DNA, 22 bp, Homo sapiens
acaattctttgttgcttaatct

SEQ ID NO: 1952392 - DNA, 20 bp, Homo sapiens
acaatttaggaatgctcaat

SEQ ID NO: 1952393 - DNA, 13 bp, Homo sapiens
acacaaaacaaca

SEQ ID NO: 1952394 - DNA, 16 bp, Homo sapiens
acacaaaacaacagca

SEQ ID NO: 1952395 - DNA, 14 bp, Homo sapiens
acacacacaaaaca

SEQ ID NO: 1952396 - DNA, 14 bp, Homo sapiens
acacataacacaca

SEQ ID NO: 1952397 - DNA, 21 bp, Homo sapiens
acaccaaattgctgagatgtt

SEQ ID NO: 1952398 - DNA, 18 bp, Homo sapiens
acaccccgtctgcccctt

SEQ ID NO: 1952399 - DNA, 19 bp, Homo sapiens
acacgccggggctggccct

SEQ ID NO: 1952400 - DNA, 17 bp, Homo sapiens
acagaaaaggttctgaa

SEQ ID NO: 1952401 - DNA, 15 bp, Homo sapiens
acagaacaacaacaa

SEQ ID NO: 1952402 - DNA, 17 bp, Homo sapiens
acagaacaacaacaaag

SEQ ID NO: 1952403 - DNA, 15 bp, Homo sapiens
acagaaccagcactc

SEQ ID NO: 1952404 - DNA, 16 bp, Homo sapiens
acagaaccagcactcc

SEQ ID NO: 1952405 - DNA, 23 bp, Homo sapiens
acagaagggagtgaaaacctctt

SEQ ID NO: 1952406 - DNA, 21 bp, Homo sapiens
acagacaagggggatgttgtg

SEQ ID NO: 1952407 - DNA, 23 bp, Homo sapiens
acagacggacgggacagcggccc

SEQ ID NO: 1952408 - DNA, 20 bp, Homo sapiens
acagaggacataccactgcc

SEQ ID NO: 1952409 - DNA, 18 bp, Homo sapiens
acagatgatgtaaaaata

SEQ ID NO: 1952410 - DNA, 13 bp, Homo sapiens
acagatgtacatt

SEQ ID NO: 1952411 - DNA, 15 bp, Homo sapiens
acagcaacaacaaca

SEQ ID NO: 1952412 - DNA, 22 bp, Homo sapiens
acagcatgtgggtgtcagtgtc

SEQ ID NO: 1952413 - DNA, 18 bp, Homo sapiens
acagcatttcagctgtga

SEQ ID NO: 1952414 - DNA, 13 bp, Homo sapiens
acagcggcccggc

SEQ ID NO: 1952415 - DNA, 13 bp, Homo sapiens
acaggattttcaa

SEQ ID NO: 1952416 - DNA, 14 bp, Homo sapiens
acaggattttcaag

SEQ ID NO: 1952417 - DNA, 16 bp, Homo sapiens
acaggattttcaagtt

SEQ ID NO: 1952418 - DNA, 23 bp, Homo sapiens
acagtaattactttcagaatgtt

SEQ ID NO: 1952419 - DNA, 18 bp, Homo sapiens
acagtagcatactgatga

SEQ ID NO: 1952420 - DNA, 22 bp, Homo sapiens
acagtagcatactgatgagaca

SEQ ID NO: 1952421 - DNA, 19 bp, Homo sapiens
acagtattgttcttgtaaa

SEQ ID NO: 1952422 - DNA, 15 bp, Homo sapiens
acagtggggcccatg

SEQ ID NO: 1952423 - DNA, 21 bp, Homo sapiens
acagtggggcccatggcccca

SEQ ID NO: 1952424 - DNA, 23 bp, Homo sapiens
acagtggggcccatggccccagc

SEQ ID NO: 1952425 - DNA, 19 bp, Homo sapiens
acagtgtggcttaaacatt

SEQ ID NO: 1952426 - DNA, 13 bp, Homo sapiens
acataacaggcat

SEQ ID NO: 1952427 - DNA, 18 bp, Homo sapiens
acataacaggcattgcac

SEQ ID NO: 1952428 - DNA, 23 bp, Homo sapiens
acatacatttaaaaaacatttta

SEQ ID NO: 1952429 - DNA, 17 bp, Homo sapiens
acataccacacttaaaa

SEQ ID NO: 1952430 - DNA, 17 bp, Homo sapiens
acatcaagggaggaagg

SEQ ID NO: 1952431 - DNA, 13 bp, Homo sapiens
acatctctgtaaa

SEQ ID NO: 1952432 - DNA, 20 bp, Homo sapiens
acatgctaacctctctgaac

SEQ ID NO: 1952433 - DNA, 14 bp, Homo sapiens
acattaatgttgaa

SEQ ID NO: 1952434 - DNA, 22 bp, Homo sapiens
acattaatgttgaaaaagaaaa

SEQ ID NO: 1952435 - DNA, 16 bp, Homo sapiens
acattagaatattgta

SEQ ID NO: 1952436 - DNA, 20 bp, Homo sapiens
acattcccatgaatatcaag

SEQ ID NO: 1952437 - DNA, 18 bp, Homo sapiens
acattctatttcaacttc

SEQ ID NO: 1952438 - DNA, 14 bp, Homo sapiens
acatttatgtgtga

SEQ ID NO: 1952439 - DNA, 12 bp, Homo sapiens
acattttgtagc

SEQ ID NO: 1952440 - DNA, 16 bp, Homo sapiens
acattttgtagctagt

SEQ ID NO: 1952441 - DNA, 19 bp, Homo sapiens
acattttttgtttcttggt

SEQ ID NO: 1952442 - DNA, 17 bp, Homo sapiens
accaaattgctgagatg

SEQ ID NO: 1952443 - DNA, 20 bp, Homo sapiens
accaaggtgcggaccggagc

SEQ ID NO: 1952444 - DNA, 16 bp, Homo sapiens
accacacttaaaagat

SEQ ID NO: 1952445 - DNA, 13 bp, Homo sapiens
accagaaagagga

SEQ ID NO: 1952446 - DNA, 11 bp, Homo sapiens
accagaaatat

SEQ ID NO: 1952447 - DNA, 16 bp, Homo sapiens
accagcactcccaggg

SEQ ID NO: 1952448 - DNA, 19 bp, Homo sapiens
accagcactcccagggccc

SEQ ID NO: 1952449 - DNA, 15 bp, Homo sapiens
accagcctgagccac

SEQ ID NO: 1952450 - DNA, 20 bp, Homo sapiens
accagttccctcagccctca

SEQ ID NO: 1952451 - DNA, 21 bp, Homo sapiens
accagttccctcagccctcat

SEQ ID NO: 1952452 - DNA, 14 bp, Homo sapiens
accatcccactgat

SEQ ID NO: 1952453 - DNA, 17 bp, Homo sapiens
accattgctaatttaaa

SEQ ID NO: 1952454 - DNA, 16 bp, Homo sapiens
accatttcccctgtgg

SEQ ID NO: 1952455 - DNA, 20 bp, Homo sapiens
accatttcccctgtggtttg

SEQ ID NO: 1952456 - DNA, 15 bp, Homo sapiens
accattttgaaatat

SEQ ID NO: 1952457 - DNA, 22 bp, Homo sapiens
accattttgaaatattcacaag

SEQ ID NO: 1952458 - DNA, 20 bp, Homo sapiens
acccactagccctctttctc

SEQ ID NO: 1952459 - DNA, 24 bp, Homo sapiens
acccactagccctctttctctctg

SEQ ID NO: 1952460 - DNA, 15 bp, Homo sapiens
accccacacgccggg

SEQ ID NO: 1952461 - DNA, 22 bp, Homo sapiens
accccacacgccggggctggcc

SEQ ID NO: 1952462 - DNA, 15 bp, Homo sapiens
accccatagtgcctt

SEQ ID NO: 1952463 - DNA, 14 bp, Homo sapiens
acccccacctcccg

SEQ ID NO: 1952464 - DNA, 12 bp, Homo sapiens
acccccagcctc

SEQ ID NO: 1952465 - DNA, 17 bp, Homo sapiens
acccccagcctccccca

SEQ ID NO: 1952466 - DNA, 18 bp, Homo sapiens
acccccagcctcccccag

SEQ ID NO: 1952467 - DNA, 21 bp, Homo sapiens
accccgctgcctggcgggcag

SEQ ID NO: 1952468 - DNA, 13 bp, Homo sapiens
accccgtcccggc

SEQ ID NO: 1952469 - DNA, 20 bp, Homo sapiens
accccgtcccggccccgcgc

SEQ ID NO: 1952470 - DNA, 13 bp, Homo sapiens
acccgccccagag

SEQ ID NO: 1952471 - DNA, 16 bp, Homo sapiens
acccgccccagagact

SEQ ID NO: 1952472 - DNA, 23 bp, Homo sapiens
acccgccccagagactgcccacc

SEQ ID NO: 1952473 - DNA, 14 bp, Homo sapiens
acccgcccgccccc

SEQ ID NO: 1952474 - DNA, 15 bp, Homo sapiens
accctcccctctcct

SEQ ID NO: 1952475 - DNA, 13 bp, Homo sapiens
accctcccctctt

SEQ ID NO: 1952476 - DNA, 13 bp, Homo sapiens
accctgaatcaga

SEQ ID NO: 1952477 - DNA, 15 bp, Homo sapiens
accctgaatcagagg

SEQ ID NO: 1952478 - DNA, 12 bp, Homo sapiens
accctgccctgc

SEQ ID NO: 1952479 - DNA, 16 bp, Homo sapiens
accctgccctgcacct

SEQ ID NO: 1952480 - DNA, 19 bp, Homo sapiens
accctgccctgcaccttgg

SEQ ID NO: 1952481 - DNA, 17 bp, Homo sapiens
accctggacagtgccta

SEQ ID NO: 1952482 - DNA, 20 bp, Homo sapiens
accgcccaacccccacctcc

SEQ ID NO: 1952483 - DNA, 14 bp, Homo sapiens
accgcccacccaca

SEQ ID NO: 1952484 - DNA, 16 bp, Homo sapiens
accgcccacccacacc

SEQ ID NO: 1952485 - DNA, 17 bp, Homo sapiens
accggagcggctgagga

SEQ ID NO: 1952486 - DNA, 21 bp, Homo sapiens
accgtggtgtgaggcccccgg

SEQ ID NO: 1952487 - DNA, 22 bp, Homo sapiens
acctattgctgtaaataaaaat

SEQ ID NO: 1952488 - DNA, 19 bp, Homo sapiens
acctccagggaatcagaaa

SEQ ID NO: 1952489 - DNA, 14 bp, Homo sapiens
catctggcctgggg

SEQ ID NO: 1952490 - DNA, 16 bp, Homo sapiens
catctggcctgggggc

SEQ ID NO: 1952491 - DNA, 17 bp, Homo sapiens
catctggcctgggggct

SEQ ID NO: 1952492 - DNA, 17 bp, Homo sapiens
catctgtcagcttccca

SEQ ID NO: 1952493 - DNA, 19 bp, Homo sapiens
catctgtcagcttcccaac

SEQ ID NO: 1952494 - DNA, 21 bp, Homo sapiens
catcttgggattcctcccctg

SEQ ID NO: 1952495 - DNA, 21 bp, Homo sapiens
catgaagacagtccagtagac

SEQ ID NO: 1952496 - DNA, 22 bp, Homo sapiens
catgacttctttactaacactg

SEQ ID NO: 1952497 - DNA, 18 bp, Homo sapiens
catgagaactaaatagat

SEQ ID NO: 1952498 - DNA, 21 bp, Homo sapiens
catgcagatagtatacacatc

SEQ ID NO: 1952499 - DNA, 16 bp, Homo sapiens
catgccaatgtccagg

SEQ ID NO: 1952500 - DNA, 15 bp, Homo sapiens
catgctcagctcagc

SEQ ID NO: 1952501 - DNA, 14 bp, Homo sapiens
catgcttttctcat

SEQ ID NO: 1952502 - DNA, 13 bp, Homo sapiens
catggccccagct

SEQ ID NO: 1952503 - DNA, 15 bp, Homo sapiens
catggtagactgtga

SEQ ID NO: 1952504 - DNA, 19 bp, Homo sapiens
catggtgaactgaagcaga

SEQ ID NO: 1952505 - DNA, 23 bp, Homo sapiens
catggtgaactgaagcagagtca

SEQ ID NO: 1952506 - DNA, 16 bp, Homo sapiens
catgtaatattaaatt

SEQ ID NO: 1952507 - DNA, 15 bp, Homo sapiens
catgtgctgctgtgg

SEQ ID NO: 1952508 - DNA, 17 bp, Homo sapiens
catgtgctgctgtggca

SEQ ID NO: 1952509 - DNA, 18 bp, Homo sapiens
catgttaattgatagaat

SEQ ID NO: 1952510 - DNA, 18 bp, Homo sapiens
cattaaataccagccagc

SEQ ID NO: 1952511 - DNA, 19 bp, Homo sapiens
cattaatgttgaaaaagaa

SEQ ID NO: 1952512 - DNA, 21 bp, Homo sapiens
cattaatgttgaaaaagaaaa

SEQ ID NO: 1952513 - DNA, 15 bp, Homo sapiens
cattattagaatata

SEQ ID NO: 1952514 - DNA, 14 bp, Homo sapiens
cattatttttcaat

SEQ ID NO: 1952515 - DNA, 14 bp, Homo sapiens
cattgcactaaaag

SEQ ID NO: 1952516 - DNA, 16 bp, Homo sapiens
cattgcactaaaagtg

SEQ ID NO: 1952517 - DNA, 21 bp, Homo sapiens
cattgcactaaaagtgatgtg

SEQ ID NO: 1952518 - DNA, 15 bp, Homo sapiens
cattgctaatttaaa

SEQ ID NO: 1952519 - DNA, 20 bp, Homo sapiens
cattgttcagaaaagcacct

SEQ ID NO: 1952520 - DNA, 15 bp, Homo sapiens
catttaaaaaacatt

SEQ ID NO: 1952521 - DNA, 23 bp, Homo sapiens
catttaagaatttaccagaaata

SEQ ID NO: 1952522 - DNA, 21 bp, Homo sapiens
catttatgcaatttacttgga

SEQ ID NO: 1952523 - DNA, 15 bp, Homo sapiens
catttatgcatgaga

SEQ ID NO: 1952524 - DNA, 17 bp, Homo sapiens
catttatgcatgagaac

SEQ ID NO: 1952525 - DNA, 21 bp, Homo sapiens
catttatgcatgagaactaaa

SEQ ID NO: 1952526 - DNA, 22 bp, Homo sapiens
catttatgtgtgaagcaaattt

SEQ ID NO: 1952527 - DNA, 18 bp, Homo sapiens
catttcattatttttcaa

SEQ ID NO: 1952528 - DNA, 21 bp, Homo sapiens
catttctatagccaaagctgt

SEQ ID NO: 1952529 - DNA, 11 bp, Homo sapiens
catttgctgaa

SEQ ID NO: 1952530 - DNA, 12 bp, Homo sapiens
catttgctgaat

SEQ ID NO: 1952531 - DNA, 13 bp, Homo sapiens
cattttacagatt

SEQ ID NO: 1952532 - DNA, 14 bp, Homo sapiens
cattttctctcctc

SEQ ID NO: 1952533 - DNA, 17 bp, Homo sapiens
catttttcattttctct

SEQ ID NO: 1952534 - DNA, 15 bp, Homo sapiens
ccaacccccacctcc

SEQ ID NO: 1952535 - DNA, 16 bp, Homo sapiens
ccaacccccacctccc

SEQ ID NO: 1952536 - DNA, 22 bp, Homo sapiens
ccaagcccagcctatctctctt

SEQ ID NO: 1952537 - DNA, 20 bp, Homo sapiens
ccaagtcaaacagtgtggct

SEQ ID NO: 1952538 - DNA, 15 bp, Homo sapiens
ccaagtgtgtgtgca

SEQ ID NO: 1952539 - DNA, 20 bp, Homo sapiens
ccaatacaagttacatacat

SEQ ID NO: 1952540 - DNA, 14 bp, Homo sapiens
ccaatttgttctgt

SEQ ID NO: 1952541 - DNA, 15 bp, Homo sapiens
ccacacgccggggct

SEQ ID NO: 1952542 - DNA, 19 bp, Homo sapiens
ccacacgccggggctggcc

SEQ ID NO: 1952543 - DNA, 21 bp, Homo sapiens
ccacatccccaccctcccctc

SEQ ID NO: 1952544 - DNA, 21 bp, Homo sapiens
ccacccacaccccgtctgccc

SEQ ID NO: 1952545 - DNA, 23 bp, Homo sapiens
ccacccacaccccgtctgcccct

SEQ ID NO: 1952546 - DNA, 17 bp, Homo sapiens
ccacccccattgtgaat

SEQ ID NO: 1952547 - DNA, 15 bp, Homo sapiens
ccaccccgctgcctg

SEQ ID NO: 1952548 - DNA, 17 bp, Homo sapiens
ccaccccgctgcctggc

SEQ ID NO: 1952549 - DNA, 18 bp, Homo sapiens
ccaccccgctgcctggcg

SEQ ID NO: 1952550 - DNA, 12 bp, Homo sapiens
ccaccccgtccc

SEQ ID NO: 1952551 - DNA, 14 bp, Homo sapiens
ccaccccgtcccgg

SEQ ID NO: 1952552 - DNA, 15 bp, Homo sapiens
ccaccccgtcccggc

SEQ ID NO: 1952553 - DNA, 23 bp, Homo sapiens
ccacccgccccagagactgccca

SEQ ID NO: 1952554 - DNA, 12 bp, Homo sapiens
ccaccctgggcc

SEQ ID NO: 1952555 - DNA, 17 bp, Homo sapiens
ccaccctgggcctcccg

SEQ ID NO: 1952556 - DNA, 21 bp, Homo sapiens
ccacctgcccagttagcccgg

SEQ ID NO: 1952557 - DNA, 22 bp, Homo sapiens
ccacctgcccagttagcccggc

SEQ ID NO: 1952558 - DNA, 23 bp, Homo sapiens
ccaccttgtacagaaccagcact

SEQ ID NO: 1952559 - DNA, 13 bp, Homo sapiens
ccacgcagagccc

SEQ ID NO: 1952560 - DNA, 19 bp, Homo sapiens
ccacgcagagccccggagc

SEQ ID NO: 1952561 - DNA, 24 bp, Homo sapiens
ccactgatatcacgggcccgctca

SEQ ID NO: 1952562 - DNA, 17 bp, Homo sapiens
ccacttatttccatgga

SEQ ID NO: 1952563 - DNA, 12 bp, Homo sapiens
ccactttcctct

SEQ ID NO: 1952564 - DNA, 14 bp, Homo sapiens
ccactttcctctct

SEQ ID NO: 1952565 - DNA, 11 bp, Homo sapiens
ccagaaagagg

SEQ ID NO: 1952566 - DNA, 13 bp, Homo sapiens
ccagaaagaggaa

SEQ ID NO: 1952567 - DNA, 22 bp, Homo sapiens
ccagaaagaggaataaaatgat

SEQ ID NO: 1952568 - DNA, 13 bp, Homo sapiens
ccagaacgggcct

SEQ ID NO: 1952569 - DNA, 20 bp, Homo sapiens
ccagaagctcaaggctgcag

SEQ ID NO: 1952570 - DNA, 17 bp, Homo sapiens
ccagactcgagagggct

SEQ ID NO: 1952571 - DNA, 22 bp, Homo sapiens
ccagagaaatgaaagtcagttt

SEQ ID NO: 1952572 - DNA, 23 bp, Homo sapiens
ccagagaaatgaaagtcagttta

SEQ ID NO: 1952573 - DNA, 22 bp, Homo sapiens
ccagagactgcccaccctgggc

SEQ ID NO: 1952574 - DNA, 17 bp, Homo sapiens
cagagcgatgtgttctt

SEQ ID NO: 1952575 - DNA, 19 bp, Homo sapiens
cagagctgagtcggctggg

SEQ ID NO: 1952576 - DNA, 22 bp, Homo sapiens
cagagctgagtcggctgggcag

SEQ ID NO: 1952577 - DNA, 13 bp, Homo sapiens
cagaggcagggcc

SEQ ID NO: 1952578 - DNA, 19 bp, Homo sapiens
cagaggcagggccctgggg

SEQ ID NO: 1952579 - DNA, 21 bp, Homo sapiens
cagaggcagggccctggggtc

SEQ ID NO: 1952580 - DNA, 19 bp, Homo sapiens
cagatccctcggtcagcac

SEQ ID NO: 1952581 - DNA, 20 bp, Homo sapiens
cagatgatgtaaaaatatgt

SEQ ID NO: 1952582 - DNA, 13 bp, Homo sapiens
cagcaccagcctg

SEQ ID NO: 1952583 - DNA, 14 bp, Homo sapiens
cagcaccagcctga

SEQ ID NO: 1952584 - DNA, 23 bp, Homo sapiens
cagcaccgtggtgtgaggccccc

SEQ ID NO: 1952585 - DNA, 16 bp, Homo sapiens
cagcactcccagggcc

SEQ ID NO: 1952586 - DNA, 17 bp, Homo sapiens
cagcactcccagggccc

SEQ ID NO: 1952587 - DNA, 14 bp, Homo sapiens
cagcagcagcagca

SEQ ID NO: 1952588 - DNA, 19 bp, Homo sapiens
cagcagctagaaagagaaa

SEQ ID NO: 1952589 - DNA, 21 bp, Homo sapiens
cagcagttttcttttaatttt

SEQ ID NO: 1952590 - DNA, 20 bp, Homo sapiens
cagcatgtgggtgtcagtgt

SEQ ID NO: 1952591 - DNA, 22 bp, Homo sapiens
cagcatgtgggtgtcagtgtca

SEQ ID NO: 1952592 - DNA, 19 bp, Homo sapiens
cagcatttttctttagtca

SEQ ID NO: 1952593 - DNA, 23 bp, Homo sapiens
cagcccagaacgggcctccccgg

SEQ ID NO: 1952594 - DNA, 15 bp, Homo sapiens
cagccccatccttcc

SEQ ID NO: 1952595 - DNA, 17 bp, Homo sapiens
cagccccatccttcccg

SEQ ID NO: 1952596 - DNA, 14 bp, Homo sapiens
cagcccctgctgga

SEQ ID NO: 1952597 - DNA, 15 bp, Homo sapiens
cagccgcgctctgcc

SEQ ID NO: 1952598 - DNA, 16 bp, Homo sapiens
cagccgcgctctgccc

SEQ ID NO: 1952599 - DNA, 17 bp, Homo sapiens
cagcctcccccaggctg

SEQ ID NO: 1952600 - DNA, 12 bp, Homo sapiens
cagcctcttgaa

SEQ ID NO: 1952601 - DNA, 20 bp, Homo sapiens
cagcctgagccacagtgggg

SEQ ID NO: 1952602 - DNA, 12 bp, Homo sapiens
cagcctgagctc

SEQ ID NO: 1952603 - DNA, 15 bp, Homo sapiens
cagcctgagctccac

SEQ ID NO: 1952604 - DNA, 21 bp, Homo sapiens
cagcctgagctccaccctccc

SEQ ID NO: 1952605 - DNA, 22 bp, Homo sapiens
cagcgcctcccgccgcctcggg

SEQ ID NO: 1952606 - DNA, 23 bp, Homo sapiens
cagcgcctcccgccgcctcgggc

SEQ ID NO: 1952607 - DNA, 12 bp, Homo sapiens
cagcggcccggc

SEQ ID NO: 1952608 - DNA, 18 bp, Homo sapiens
cagcggcccggcccacgc

SEQ ID NO: 1952609 - DNA, 20 bp, Homo sapiens
cagcggcccggcccacgcag

SEQ ID NO: 1952610 - DNA, 23 bp, Homo sapiens
cagcggcccggcccacgcagagc

SEQ ID NO: 1952611 - DNA, 15 bp, Homo sapiens
cagcgtggggctaac

SEQ ID NO: 1952612 - DNA, 20 bp, Homo sapiens
cagctacaggggaggctgag

SEQ ID NO: 1952613 - DNA, 20 bp, Homo sapiens
cagctcatcttttcctgctt

SEQ ID NO: 1952614 - DNA, 23 bp, Homo sapiens
cagctccactctgaagtcccttc

SEQ ID NO: 1952615 - DNA, 15 bp, Homo sapiens
cagctgagctggcct

SEQ ID NO: 1952616 - DNA, 20 bp, Homo sapiens
cagctgcctctttgctgctt

SEQ ID NO: 1952617 - DNA, 15 bp, Homo sapiens
cagctggcagcgcct

SEQ ID NO: 1952618 - DNA, 18 bp, Homo sapiens
cagctggcagcgcctccc

SEQ ID NO: 1952619 - DNA, 14 bp, Homo sapiens
cagctggctgggtc

SEQ ID NO: 1952620 - DNA, 17 bp, Homo sapiens
cagcttcccaacaatac

SEQ ID NO: 1952621 - DNA, 15 bp, Homo sapiens
caggaaaggaagatg

SEQ ID NO: 1952622 - DNA, 21 bp, Homo sapiens
caggattttcaagttattcag

SEQ ID NO: 1952623 - DNA, 22 bp, Homo sapiens
caggattttcaagttattcaga

SEQ ID NO: 1952624 - DNA, 15 bp, Homo sapiens
caggcacggaggctc

SEQ ID NO: 1952625 - DNA, 11 bp, Homo sapiens
caggcactctc

SEQ ID NO: 1952626 - DNA, 14 bp, Homo sapiens
caggcattgcacta

SEQ ID NO: 1952627 - DNA, 16 bp, Homo sapiens
caggcgcgcaccgccc

SEQ ID NO: 1952628 - DNA, 19 bp, Homo sapiens
caggcgcgcaccgcccaac

SEQ ID NO: 1952629 - DNA, 15 bp, Homo sapiens
caggcggaggggctt

SEQ ID NO: 1952630 - DNA, 19 bp, Homo sapiens
caggcggaggggcttggag

SEQ ID NO: 1952631 - DNA, 16 bp, Homo sapiens
caggctctgaatctct

SEQ ID NO: 1952632 - DNA, 23 bp, Homo sapiens
caggctgcgcctgcccgcccgcc

SEQ ID NO: 1952633 - DNA, 14 bp, Homo sapiens
cagggaaccagagc

SEQ ID NO: 1952634 - DNA, 15 bp, Homo sapiens
cagggcccgagcgcg

SEQ ID NO: 1952635 - DNA, 15 bp, Homo sapiens
cagggcgctccggca

SEQ ID NO: 1952636 - DNA, 23 bp, Homo sapiens
cagggcgctccggcagaggcagg

SEQ ID NO: 1952637 - DNA, 20 bp, Homo sapiens
caggggaatgctaagccagt

SEQ ID NO: 1952638 - DNA, 13 bp, Homo sapiens
caggggaggctga

SEQ ID NO: 1952639 - DNA, 23 bp, Homo sapiens
caggtaaactgatgctttcagat

SEQ ID NO: 1952640 - DNA, 19 bp, Homo sapiens
cagtaacacagtgcagtgc

SEQ ID NO: 1952641 - DNA, 20 bp, Homo sapiens
cagtaattaacatatcaagg

SEQ ID NO: 1952642 - DNA, 19 bp, Homo sapiens
cagtaattactttcagaat

SEQ ID NO: 1952643 - DNA, 13 bp, Homo sapiens
cagtacaattctt

SEQ ID NO: 1952644 - DNA, 20 bp, Homo sapiens
cagtacaattctttgttgct

SEQ ID NO: 1952645 - DNA, 16 bp, Homo sapiens
cagtattgagtgttct

SEQ ID NO: 1952646 - DNA, 22 bp, Homo sapiens
cagtattgttcttgtaaaactg

SEQ ID NO: 1952647 - DNA, 21 bp, Homo sapiens
cagtctgaagcgtagtagtgg

SEQ ID NO: 1952648 - DNA, 23 bp, Homo sapiens
cagtgaggtatgatgtgctgctg

SEQ ID NO: 1952649 - DNA, 19 bp, Homo sapiens
cagtgatagaacaaaagag

SEQ ID NO: 1952650 - DNA, 15 bp, Homo sapiens
cagtggggcccatgg

SEQ ID NO: 1952651 - DNA, 22 bp, Homo sapiens
cagtggggcccatggccccagc

SEQ ID NO: 1952652 - DNA, 14 bp, Homo sapiens
cagtgtcattatta

SEQ ID NO: 1952653 - DNA, 14 bp, Homo sapiens
cagtgtctgttctt

SEQ ID NO: 1952654 - DNA, 17 bp, Homo sapiens
cagtgtggcttaaacat

SEQ ID NO: 1952655 - DNA, 19 bp, Homo sapiens
cagtgtggcttaaacattt

SEQ ID NO: 1952656 - DNA, 20 bp, Homo sapiens
cagtgtggcttaaacatttt

SEQ ID NO: 1952657 - DNA, 17 bp, Homo sapiens
cagttagcccggccaag

SEQ ID NO: 1952658 - DNA, 17 bp, Homo sapiens
cagttcttaagacttct

SEQ ID NO: 1952659 - DNA, 12 bp, Homo sapiens
cagtttgtgaag

SEQ ID NO: 1952660 - DNA, 13 bp, Homo sapiens
cagtttgttcagt

SEQ ID NO: 1952661 - DNA, 23 bp, Homo sapiens
atctggtgcgtgtggccctgtgg

SEQ ID NO: 1952662 - DNA, 13 bp, Homo sapiens
atctgtatgcctc

SEQ ID NO: 1952663 - DNA, 15 bp, Homo sapiens
atctgtcagcttccc

SEQ ID NO: 1952664 - DNA, 17 bp, Homo sapiens
atctgtcagcttcccaa

SEQ ID NO: 1952665 - DNA, 19 bp, Homo sapiens
atctgtctttatgatttca

SEQ ID NO: 1952666 - DNA, 17 bp, Homo sapiens
atctgtttgcttctaaa

SEQ ID NO: 1952667 - DNA, 20 bp, Homo sapiens
atcttgggattcctcccctg

SEQ ID NO: 1952668 - DNA, 19 bp, Homo sapiens
atgaaaaccaccctatcat

SEQ ID NO: 1952669 - DNA, 19 bp, Homo sapiens
atgaaatacttgacaacat

SEQ ID NO: 1952670 - DNA, 15 bp, Homo sapiens
atgaaatataaactg

SEQ ID NO: 1952671 - DNA, 21 bp, Homo sapiens
atgaaatataaactgtgagat

SEQ ID NO: 1952672 - DNA, 17 bp, Homo sapiens
atgaagattcagcagtg

SEQ ID NO: 1952673 - DNA, 14 bp, Homo sapiens
atgaatatcaagaa

SEQ ID NO: 1952674 - DNA, 12 bp, Homo sapiens
atgaatgaaata

SEQ ID NO: 1952675 - DNA, 13 bp, Homo sapiens
atgaatgaaatat

SEQ ID NO: 1952676 - DNA, 21 bp, Homo sapiens
atgacagtagcatactgatga

SEQ ID NO: 1952677 - DNA, 23 bp, Homo sapiens
atgacctccagggaatcagaaag

SEQ ID NO: 1952678 - DNA, 17 bp, Homo sapiens
atgacctgaggaaagga

SEQ ID NO: 1952679 - DNA, 16 bp, Homo sapiens
atgagaactaaataga

SEQ ID NO: 1952680 - DNA, 12 bp, Homo sapiens
atgagattggaa

SEQ ID NO: 1952681 - DNA, 22 bp, Homo sapiens
atgagattggaaaaaattagac

SEQ ID NO: 1952682 - DNA, 18 bp, Homo sapiens
atgagcatgctccctcat

SEQ ID NO: 1952683 - DNA, 20 bp, Homo sapiens
atgaggctggataggagagg

SEQ ID NO: 1952684 - DNA, 16 bp, Homo sapiens
atgatatgtctttaaa

SEQ ID NO: 1952685 - DNA, 16 bp, Homo sapiens
atgatgttagtaactt

SEQ ID NO: 1952686 - DNA, 17 bp, Homo sapiens
atgatgttctgaaatgg

SEQ ID NO: 1952687 - DNA, 13 bp, Homo sapiens
atgattagacaat

SEQ ID NO: 1952688 - DNA, 21 bp, Homo sapiens
atgattcaatcattttgggaa

SEQ ID NO: 1952689 - DNA, 18 bp, Homo sapiens
atgattcttactgttctt

SEQ ID NO: 1952690 - DNA, 19 bp, Homo sapiens
atgattcttactgttcttc

SEQ ID NO: 1952691 - DNA, 15 bp, Homo sapiens
atgattgagagcagc

SEQ ID NO: 1952692 - DNA, 12 bp, Homo sapiens
atgatttaacat

SEQ ID NO: 1952693 - DNA, 17 bp, Homo sapiens
atgcaaagcacacctcg

SEQ ID NO: 1952694 - DNA, 17 bp, Homo sapiens
atgcactcttttgagca

SEQ ID NO: 1952695 - DNA, 19 bp, Homo sapiens
atgcagaattgctaggtaa

SEQ ID NO: 1952696 - DNA, 21 bp, Homo sapiens
atgcagaattgctaggtaaag

SEQ ID NO: 1952697 - DNA, 18 bp, Homo sapiens
atgcatgagaactaaata

SEQ ID NO: 1952698 - DNA, 16 bp, Homo sapiens
atgcatttatgcatga

SEQ ID NO: 1952699 - DNA, 17 bp, Homo sapiens
atgccattccatatata

SEQ ID NO: 1952700 - DNA, 18 bp, Homo sapiens
atgccttcactacaacat

SEQ ID NO: 1952701 - DNA, 12 bp, Homo sapiens
atgctaagccag

SEQ ID NO: 1952702 - DNA, 16 bp, Homo sapiens
atgctacaaaatgtgt

SEQ ID NO: 1952703 - DNA, 18 bp, Homo sapiens
atgctatctcgctagcca

SEQ ID NO: 1952704 - DNA, 19 bp, Homo sapiens
atgctatctcgctagccat

SEQ ID NO: 1952705 - DNA, 14 bp, Homo sapiens
atgctcaatgtgct

SEQ ID NO: 1952706 - DNA, 14 bp, Homo sapiens
atgctcagtattga

SEQ ID NO: 1952707 - DNA, 14 bp, Homo sapiens
atgctccctcatgc

SEQ ID NO: 1952708 - DNA, 15 bp, Homo sapiens
atgctgctgagcaca

SEQ ID NO: 1952709 - DNA, 22 bp, Homo sapiens
atgctgctgagcacatctcttc

SEQ ID NO: 1952710 - DNA, 20 bp, Homo sapiens
atgcttcttttagtcagaaa

SEQ ID NO: 1952711 - DNA, 21 bp, Homo sapiens
atgcttcttttagtcagaaat

SEQ ID NO: 1952712 - DNA, 22 bp, Homo sapiens
atgcttcttttagtcagaaatg

SEQ ID NO: 1952713 - DNA, 18 bp, Homo sapiens
atgcttttctcatggtat

SEQ ID NO: 1952714 - DNA, 15 bp, Homo sapiens
atggaacagtaatta

SEQ ID NO: 1952715 - DNA, 18 bp, Homo sapiens
atggaggtgatgaaaacc

SEQ ID NO: 1952716 - DNA, 15 bp, Homo sapiens
atggatgtaatatag

SEQ ID NO: 1952717 - DNA, 23 bp, Homo sapiens
atggattgggtatcaaaatgaat

SEQ ID NO: 1952718 - DNA, 16 bp, Homo sapiens
atggatttgacacact

SEQ ID NO: 1952719 - DNA, 18 bp, Homo sapiens
atggattttttttttcag

SEQ ID NO: 1952720 - DNA, 21 bp, Homo sapiens
atggattttttttttcaggtt

SEQ ID NO: 1952721 - DNA, 17 bp, Homo sapiens
atggcaatagcattgtt

SEQ ID NO: 1952722 - DNA, 12 bp, Homo sapiens
atggccccagct

SEQ ID NO: 1952723 - DNA, 15 bp, Homo sapiens
atggccccagctggc

SEQ ID NO: 1952724 - DNA, 16 bp, Homo sapiens
atggccccagctggct

SEQ ID NO: 1952725 - DNA, 13 bp, Homo sapiens
atggtatatattt

SEQ ID NO: 1952726 - DNA, 20 bp, Homo sapiens
atggtgaactgaagcagagt

SEQ ID NO: 1952727 - DNA, 20 bp, Homo sapiens
atggtgaactgtgagtacta

SEQ ID NO: 1952728 - DNA, 19 bp, Homo sapiens
atgtaatatagggtttgtt

SEQ ID NO: 1952729 - DNA, 18 bp, Homo sapiens
atgtcacagtttgttcag

SEQ ID NO: 1952730 - DNA, 19 bp, Homo sapiens
atgtcacagtttgttcagt

SEQ ID NO: 1952731 - DNA, 21 bp, Homo sapiens
atgtccaaacttaacagatca

SEQ ID NO: 1952732 - DNA, 16 bp, Homo sapiens
atgtccaggtcacagg

SEQ ID NO: 1952733 - DNA, 13 bp, Homo sapiens
atgtctttaaaat

SEQ ID NO: 1952734 - DNA, 16 bp, Homo sapiens
atgtctttaaaatgat

SEQ ID NO: 1952735 - DNA, 18 bp, Homo sapiens
atgtgatcctaaaattgt

SEQ ID NO: 1952736 - DNA, 14 bp, Homo sapiens
atgtgccgtctttg

SEQ ID NO: 1952737 - DNA, 23 bp, Homo sapiens
atgtgccgtctttggttcctcat

SEQ ID NO: 1952738 - DNA, 17 bp, Homo sapiens
atgtgctcatcagaaac

SEQ ID NO: 1952739 - DNA, 16 bp, Homo sapiens
atgtgtaacagagttg

SEQ ID NO: 1952740 - DNA, 16 bp, Homo sapiens
atgttagtaactttta

SEQ ID NO: 1952741 - DNA, 20 bp, Homo sapiens
atgttccgttcatctgagga

SEQ ID NO: 1952742 - DNA, 22 bp, Homo sapiens
atgttccgttcatctgaggagt

SEQ ID NO: 1952743 - DNA, 14 bp, Homo sapiens
atgttctgaaatgg

SEQ ID NO: 1952744 - DNA, 23 bp, Homo sapiens
atgttgtcctgtgtcatctgtca

SEQ ID NO: 1952745 - DNA, 21 bp, Homo sapiens
atgtttagtagctgataaaga

SEQ ID NO: 1952746 - DNA, 13 bp, Homo sapiens
atgtttgaaaata

SEQ ID NO: 1952747 - DNA, 23 bp, Homo sapiens
atgtttgaaaataggatttgcac

SEQ ID NO: 1952748 - DNA, 13 bp, Homo sapiens
atgtttggctgaa

SEQ ID NO: 1952749 - DNA, 16 bp, Homo sapiens
atgtttggctgaaatt

SEQ ID NO: 1952750 - DNA, 22 bp, Homo sapiens
atgttttggagagagcaatctt

SEQ ID NO: 1952751 - DNA, 13 bp, Homo sapiens
attaaaattttcc

SEQ ID NO: 1952752 - DNA, 14 bp, Homo sapiens
attaaaattttcct

SEQ ID NO: 1952753 - DNA, 15 bp, Homo sapiens
attaaatgaaatact

SEQ ID NO: 1952754 - DNA, 13 bp, Homo sapiens
attaacatatcaa

SEQ ID NO: 1952755 - DNA, 18 bp, Homo sapiens
attaacctaatgcagaat

SEQ ID NO: 1952756 - DNA, 16 bp, Homo sapiens
attaagagttactcag

SEQ ID NO: 1952757 - DNA, 18 bp, Homo sapiens
attaagttataccagcaa

SEQ ID NO: 1952758 - DNA, 14 bp, Homo sapiens
attaatgttgaaaa

SEQ ID NO: 1952759 - DNA, 23 bp, Homo sapiens
caagctgatgaagttaagcacaa

SEQ ID NO: 1952760 - DNA, 12 bp, Homo sapiens
caaggacactga

SEQ ID NO: 1952761 - DNA, 15 bp, Homo sapiens
caagggggatgttgt

SEQ ID NO: 1952762 - DNA, 20 bp, Homo sapiens
caagtgaatgagtttccagc

SEQ ID NO: 1952763 - DNA, 16 bp, Homo sapiens
caagttattcagaaat

SEQ ID NO: 1952764 - DNA, 12 bp, Homo sapiens
caagtttttggt

SEQ ID NO: 1952765 - DNA, 15 bp, Homo sapiens
caatactttgtgtct

SEQ ID NO: 1952766 - DNA, 16 bp, Homo sapiens
caatagcattgttctt

SEQ ID NO: 1952767 - DNA, 14 bp, Homo sapiens
caataggcttagtg

SEQ ID NO: 1952768 - DNA, 15 bp, Homo sapiens
caatatcatattcta

SEQ ID NO: 1952769 - DNA, 20 bp, Homo sapiens
caatcatgggaattttaact

SEQ ID NO: 1952770 - DNA, 19 bp, Homo sapiens
caatccccataatgcttct

SEQ ID NO: 1952771 - DNA, 13 bp, Homo sapiens
caatcttgctgtg

SEQ ID NO: 1952772 - DNA, 17 bp, Homo sapiens
caatcttgctgtgaaac

SEQ ID NO: 1952773 - DNA, 13 bp, Homo sapiens
caatgcttctttt

SEQ ID NO: 1952774 - DNA, 19 bp, Homo sapiens
caatgcttcttttagtcag

SEQ ID NO: 1952775 - DNA, 23 bp, Homo sapiens
caatgcttcttttagtcagaaat

SEQ ID NO: 1952776 - DNA, 16 bp, Homo sapiens
caatgtgctgttgatt

SEQ ID NO: 1952777 - DNA, 17 bp, Homo sapiens
caatgtggaattacata

SEQ ID NO: 1952778 - DNA, 19 bp, Homo sapiens
caatgttccgttcatctga

SEQ ID NO: 1952779 - DNA, 21 bp, Homo sapiens
caatgttccgttcatctgagg

SEQ ID NO: 1952780 - DNA, 22 bp, Homo sapiens
caatgttccgttcatctgagga

SEQ ID NO: 1952781 - DNA, 19 bp, Homo sapiens
caattccagggaaccagag

SEQ ID NO: 1952782 - DNA, 11 bp, Homo sapiens
cacaaaacaac

SEQ ID NO: 1952783 - DNA, 22 bp, Homo sapiens
cacaaaacaacagcaacaacaa

SEQ ID NO: 1952784 - DNA, 23 bp, Homo sapiens
cacaaaacaacagcaacaacaac

SEQ ID NO: 1952785 - DNA, 17 bp, Homo sapiens
cacaaccatgttcttga

SEQ ID NO: 1952786 - DNA, 18 bp, Homo sapiens
cacaacctcctcctccag

SEQ ID NO: 1952787 - DNA, 17 bp, Homo sapiens
cacaagtttttttgttc

SEQ ID NO: 1952788 - DNA, 15 bp, Homo sapiens
cacacaaaacaacag

SEQ ID NO: 1952789 - DNA, 12 bp, Homo sapiens
cacacacacaaa

SEQ ID NO: 1952790 - DNA, 13 bp, Homo sapiens
cacacacacaaaa

SEQ ID NO: 1952791 - DNA, 15 bp, Homo sapiens
cacacacacacacaa

SEQ ID NO: 1952792 - DNA, 13 bp, Homo sapiens
cacacataacaca

SEQ ID NO: 1952793 - DNA, 19 bp, Homo sapiens
cacaccaaattgctgagat

SEQ ID NO: 1952794 - DNA, 14 bp, Homo sapiens
cacaccccgtctgc

SEQ ID NO: 1952795 - DNA, 16 bp, Homo sapiens
cacaccccgtctgccc

SEQ ID NO: 1952796 - DNA, 18 bp, Homo sapiens
cacaccccgtctgcccct

SEQ ID NO: 1952797 - DNA, 22 bp, Homo sapiens
cacacgccggggctggccctgc

SEQ ID NO: 1952798 - DNA, 15 bp, Homo sapiens
cacacttaaaagatg

SEQ ID NO: 1952799 - DNA, 22 bp, Homo sapiens
cacagacaagggggatgttgtg

SEQ ID NO: 1952800 - DNA, 15 bp, Homo sapiens
cacagtattgttctt

SEQ ID NO: 1952801 - DNA, 14 bp, Homo sapiens
cacagtggggccca

SEQ ID NO: 1952802 - DNA, 20 bp, Homo sapiens
cacatccccaccctcccctc

SEQ ID NO: 1952803 - DNA, 23 bp, Homo sapiens
cacatccccaccctcccctctcc

SEQ ID NO: 1952804 - DNA, 15 bp, Homo sapiens
cacatgccttctaaa

SEQ ID NO: 1952805 - DNA, 18 bp, Homo sapiens
caccaaattgctgagatg

SEQ ID NO: 1952806 - DNA, 13 bp, Homo sapiens
caccagcctgagc

SEQ ID NO: 1952807 - DNA, 14 bp, Homo sapiens
caccagcctgagcc

SEQ ID NO: 1952808 - DNA, 20 bp, Homo sapiens
caccagcctgagccacagtg

SEQ ID NO: 1952809 - DNA, 23 bp, Homo sapiens
caccagctgcctctttgctgctt

SEQ ID NO: 1952810 - DNA, 23 bp, Homo sapiens
caccatttaatcatttccagcaa

SEQ ID NO: 1952811 - DNA, 13 bp, Homo sapiens
cacccacaccccg

SEQ ID NO: 1952812 - DNA, 20 bp, Homo sapiens
cacccacaccccgtctgccc

SEQ ID NO: 1952813 - DNA, 16 bp, Homo sapiens
cacccactagccctct

SEQ ID NO: 1952814 - DNA, 20 bp, Homo sapiens
cacccactagccctctttct

SEQ ID NO: 1952815 - DNA, 22 bp, Homo sapiens
cacccactagccctctttctct

SEQ ID NO: 1952816 - DNA, 15 bp, Homo sapiens
cacccccagcctccc

SEQ ID NO: 1952817 - DNA, 16 bp, Homo sapiens
cacccccagcctcccc

SEQ ID NO: 1952818 - DNA, 17 bp, Homo sapiens
cacccccagcctccccc

SEQ ID NO: 1952819 - DNA, 20 bp, Homo sapiens
cacccccagcctcccccagg

SEQ ID NO: 1952820 - DNA, 15 bp, Homo sapiens
cacccccattgtgaa

SEQ ID NO: 1952821 - DNA, 18 bp, Homo sapiens
caccccgtcccggccccg

SEQ ID NO: 1952822 - DNA, 16 bp, Homo sapiens
caccccgtctgcccct

SEQ ID NO: 1952823 - DNA, 11 bp, Homo sapiens
cacccgcccca

SEQ ID NO: 1952824 - DNA, 22 bp, Homo sapiens
cacccgccccagagactgccca

SEQ ID NO: 1952825 - DNA, 17 bp, Homo sapiens
cacccgcccgcccccgc

SEQ ID NO: 1952826 - DNA, 19 bp, Homo sapiens
cacccgcccgcccccgccc

SEQ ID NO: 1952827 - DNA, 14 bp, Homo sapiens
caccctcccctctc

SEQ ID NO: 1952828 - DNA, 14 bp, Homo sapiens
caccctgggcctcc

SEQ ID NO: 1952829 - DNA, 15 bp, Homo sapiens
caccctgggcctccc

SEQ ID NO: 1952830 - DNA, 21 bp, Homo sapiens
caccgcccaacccccacctcc

SEQ ID NO: 1952831 - DNA, 22 bp, Homo sapiens
caccgcccaacccccacctccc

SEQ ID NO: 1952832 - DNA, 23 bp, Homo sapiens
caccgtggtgtgaggcccccgga

SEQ ID NO: 1952833 - DNA, 17 bp, Homo sapiens
caccttgtacagaacca

SEQ ID NO: 1952834 - DNA, 18 bp, Homo sapiens
caccttgtacagaaccag

SEQ ID NO: 1952835 - DNA, 14 bp, Homo sapiens
cacgcagagccccg

SEQ ID NO: 1952836 - DNA, 23 bp, Homo sapiens
cacgcagagccccggagcaccac

SEQ ID NO: 1952837 - DNA, 20 bp, Homo sapiens
cacgccggggctggccctgc

SEQ ID NO: 1952838 - DNA, 16 bp, Homo sapiens
cacggccgtccctgac

SEQ ID NO: 1952839 - DNA, 14 bp, Homo sapiens
cacgggcccgctca

SEQ ID NO: 1952840 - DNA, 22 bp, Homo sapiens
cacggggtcgggggaggagcac

SEQ ID NO: 1952841 - DNA, 19 bp, Homo sapiens
cacgtgactcctcaattcc

SEQ ID NO: 1952842 - DNA, 17 bp, Homo sapiens
cactaaaagtgatgtga

SEQ ID NO: 1952843 - DNA, 18 bp, Homo sapiens
cactaaaagtgatgtgat

SEQ ID NO: 1952844 - DNA, 14 bp, Homo sapiens
cactacaacattag

SEQ ID NO: 1952845 - DNA, 16 bp, Homo sapiens
cactagccctctttct

SEQ ID NO: 1952846 - DNA, 22 bp, Homo sapiens
cactagccctctttctctctgt

SEQ ID NO: 1952847 - DNA, 12 bp, Homo sapiens
cactcaccattt

SEQ ID NO: 1952848 - DNA, 14 bp, Homo sapiens
cactgaagagtatg

SEQ ID NO: 1952849 - DNA, 19 bp, Homo sapiens
cactgatatcacgggcccg

SEQ ID NO: 1952850 - DNA, 21 bp, Homo sapiens
gacatgctaacctctctgaac

SEQ ID NO: 1952851 - DNA, 14 bp, Homo sapiens
gacattttgtagct

SEQ ID NO: 1952852 - DNA, 13 bp, Homo sapiens
gaccccacacgcc

SEQ ID NO: 1952853 - DNA, 19 bp, Homo sapiens
gaccccacacgccggggct

SEQ ID NO: 1952854 - DNA, 22 bp, Homo sapiens
gaccccacacgccggggctggc

SEQ ID NO: 1952855 - DNA, 17 bp, Homo sapiens
gacctcctgatgtcttg

SEQ ID NO: 1952856 - DNA, 22 bp, Homo sapiens
gaccttctgcggctccgggctg

SEQ ID NO: 1952857 - DNA, 13 bp, Homo sapiens
gacggggcagagc

SEQ ID NO: 1952858 - DNA, 17 bp, Homo sapiens
gactccagaagcagcag

SEQ ID NO: 1952859 - DNA, 16 bp, Homo sapiens
gactccccgcccgccc

SEQ ID NO: 1952860 - DNA, 21 bp, Homo sapiens
gactccccgcccgccctcctc

SEQ ID NO: 1952861 - DNA, 10 bp, Homo sapiens
gactgcccac

SEQ ID NO: 1952862 - DNA, 17 bp, Homo sapiens
gactgcccaccctgggc

SEQ ID NO: 1952863 - DNA, 20 bp, Homo sapiens
gactgcccaccctgggcctc

SEQ ID NO: 1952864 - DNA, 19 bp, Homo sapiens
gactgtcttcaaccctgcc

SEQ ID NO: 1952865 - DNA, 14 bp, Homo sapiens
gacttctaaatcat

SEQ ID NO: 1952866 - DNA, 14 bp, Homo sapiens
gagacaacacacac

SEQ ID NO: 1952867 - DNA, 19 bp, Homo sapiens
gagactgcccaccctgggc

SEQ ID NO: 1952868 - DNA, 21 bp, Homo sapiens
gagactgcccaccctgggcct

SEQ ID NO: 1952869 - DNA, 21 bp, Homo sapiens
gagagaaagcaaaacattttg

SEQ ID NO: 1952870 - DNA, 16 bp, Homo sapiens
gagagcgccacccgcc

SEQ ID NO: 1952871 - DNA, 15 bp, Homo sapiens
gagaggaaaaaggct

SEQ ID NO: 1952872 - DNA, 16 bp, Homo sapiens
gagagggctgagcccc

SEQ ID NO: 1952873 - DNA, 17 bp, Homo sapiens
gagagggctgagcccct

SEQ ID NO: 1952874 - DNA, 22 bp, Homo sapiens
gagagggctgagcccctcctct

SEQ ID NO: 1952875 - DNA, 12 bp, Homo sapiens
gagataaatatc

SEQ ID NO: 1952876 - DNA, 15 bp, Homo sapiens
gagatgaggctggat

SEQ ID NO: 1952877 - DNA, 17 bp, Homo sapiens
gagcaccacggggtcgg

SEQ ID NO: 1952878 - DNA, 22 bp, Homo sapiens
gagcaccacggggtcgggggag

SEQ ID NO: 1952879 - DNA, 16 bp, Homo sapiens
gagcacccccagcctc

SEQ ID NO: 1952880 - DNA, 19 bp, Homo sapiens
gagcacccccagcctcccc

SEQ ID NO: 1952881 - DNA, 22 bp, Homo sapiens
gagcacccccagcctcccccag

SEQ ID NO: 1952882 - DNA, 11 bp, Homo sapiens
gagcagagacg

SEQ ID NO: 1952883 - DNA, 24 bp, Homo sapiens
gagcagagacggcagccccatcct

SEQ ID NO: 1952884 - DNA, 18 bp, Homo sapiens
gagcagctagctgctttt

SEQ ID NO: 1952885 - DNA, 22 bp, Homo sapiens
gagccacagtggggcccatggc

SEQ ID NO: 1952886 - DNA, 24 bp, Homo sapiens
gagccacagtggggcccatggccc

SEQ ID NO: 1952887 - DNA, 13 bp, Homo sapiens
gagccccggagca

SEQ ID NO: 1952888 - DNA, 12 bp, Homo sapiens
gagcccctcctc

SEQ ID NO: 1952889 - DNA, 13 bp, Homo sapiens
gagcccctcctct

SEQ ID NO: 1952890 - DNA, 14 bp, Homo sapiens
gagcccctcctctc

SEQ ID NO: 1952891 - DNA, 13 bp, Homo sapiens
gagcgccacccgc

SEQ ID NO: 1952892 - DNA, 14 bp, Homo sapiens
gagcgccacccgcc

SEQ ID NO: 1952893 - DNA, 23 bp, Homo sapiens
gagcgccacccgcccgcccccgc

SEQ ID NO: 1952894 - DNA, 13 bp, Homo sapiens
gagcggctgagga

SEQ ID NO: 1952895 - DNA, 19 bp, Homo sapiens
gagcgggggctaactggcc

SEQ ID NO: 1952896 - DNA, 20 bp, Homo sapiens
gagcgggggctaactggccc

SEQ ID NO: 1952897 - DNA, 21 bp, Homo sapiens
gagcgggggctaactggcccc

SEQ ID NO: 1952898 - DNA, 15 bp, Homo sapiens
gagctatgcacacca

SEQ ID NO: 1952899 - DNA, 22 bp, Homo sapiens
gagctatgcacaccaaattgct

SEQ ID NO: 1952900 - DNA, 23 bp, Homo sapiens
gagctatgcacaccaaattgctg

SEQ ID NO: 1952901 - DNA, 14 bp, Homo sapiens
gagctccaccctcc

SEQ ID NO: 1952902 - DNA, 17 bp, Homo sapiens
gagctccaccctcccct

SEQ ID NO: 1952903 - DNA, 21 bp, Homo sapiens
gagctgagtcggctgggcagg

SEQ ID NO: 1952904 - DNA, 21 bp, Homo sapiens
gaggaaaaggcttgagtctgg

SEQ ID NO: 1952905 - DNA, 21 bp, Homo sapiens
gaggaaaggagggaaagttcc

SEQ ID NO: 1952906 - DNA, 21 bp, Homo sapiens
gaggacaagtgtaataaatca

SEQ ID NO: 1952907 - DNA, 22 bp, Homo sapiens
gaggacggggcagagctgagtc

SEQ ID NO: 1952908 - DNA, 13 bp, Homo sapiens
gaggagcaccccc

SEQ ID NO: 1952909 - DNA, 15 bp, Homo sapiens
gaggagcacccccag

SEQ ID NO: 1952910 - DNA, 16 bp, Homo sapiens
gaggagcacccccagc

SEQ ID NO: 1952911 - DNA, 19 bp, Homo sapiens
gaggagcacccccagcctc

SEQ ID NO: 1952912 - DNA, 20 bp, Homo sapiens
gaggagcacccccagcctcc

SEQ ID NO: 1952913 - DNA, 23 bp, Homo sapiens
gaggagcacccccagcctccccc

SEQ ID NO: 1952914 - DNA, 12 bp, Homo sapiens
gaggagtccaaa

SEQ ID NO: 1952915 - DNA, 13 bp, Homo sapiens
gaggagtccaaaa

SEQ ID NO: 1952916 - DNA, 12 bp, Homo sapiens
gaggcagggccc

SEQ ID NO: 1952917 - DNA, 13 bp, Homo sapiens
gaggcagggccct

SEQ ID NO: 1952918 - DNA, 14 bp, Homo sapiens
gaggccaaatgagt

SEQ ID NO: 1952919 - DNA, 19 bp, Homo sapiens
gaggcccccggaggcgccc

SEQ ID NO: 1952920 - DNA, 20 bp, Homo sapiens
gaggcccccggaggcgccca

SEQ ID NO: 1952921 - DNA, 12 bp, Homo sapiens
gaggcgcccacc

SEQ ID NO: 1952922 - DNA, 13 bp, Homo sapiens
gaggcgcccacct

SEQ ID NO: 1952923 - DNA, 16 bp, Homo sapiens
gaggcgcccacctgcc

SEQ ID NO: 1952924 - DNA, 15 bp, Homo sapiens
gagggaagcccaccc

SEQ ID NO: 1952925 - DNA, 14 bp, Homo sapiens
gagggctgagcccc

SEQ ID NO: 1952926 - DNA, 15 bp, Homo sapiens
gaggggcttggagca

SEQ ID NO: 1952927 - DNA, 23 bp, Homo sapiens
gaggtagtaagcaccagctgcct

SEQ ID NO: 1952928 - DNA, 16 bp, Homo sapiens
gaggtatgatgtgctg

SEQ ID NO: 1952929 - DNA, 22 bp, Homo sapiens
gaggttgttaaaacagaaaagg

SEQ ID NO: 1952930 - DNA, 16 bp, Homo sapiens
gagtccactttcctct

SEQ ID NO: 1952931 - DNA, 18 bp, Homo sapiens
gagtcggctgggcagggc

SEQ ID NO: 1952932 - DNA, 20 bp, Homo sapiens
gagtcggctgggcagggccg

SEQ ID NO: 1952933 - DNA, 23 bp, Homo sapiens
gagtcggctgggcagggccgcag

SEQ ID NO: 1952934 - DNA, 12 bp, Homo sapiens
gagtctgtcctt

SEQ ID NO: 1952935 - DNA, 21 bp, Homo sapiens
gagttcccttgattcaaataa

SEQ ID NO: 1952936 - DNA, 18 bp, Homo sapiens
gataactcaccatcttga

SEQ ID NO: 1952937 - DNA, 17 bp, Homo sapiens
gataattaaatgaaata

SEQ ID NO: 1952938 - DNA, 16 bp, Homo sapiens
gataccattttgaaat

SEQ ID NO: 1952939 - DNA, 14 bp, Homo sapiens
gatagctccttcat

SEQ ID NO: 1952940 - DNA, 15 bp, Homo sapiens
gatatcacgggcccg

SEQ ID NO: 1952941 - DNA, 20 bp, Homo sapiens
gatatctgtttgcttctaaa

SEQ ID NO: 1952942 - DNA, 23 bp, Homo sapiens
gatatgaagaactattatattga

SEQ ID NO: 1952943 - DNA, 15 bp, Homo sapiens
gatatgtctttaaaa

SEQ ID NO: 1952944 - DNA, 15 bp, Homo sapiens
gatcaaggagggaga

SEQ ID NO: 1952945 - DNA, 22 bp, Homo sapiens
gatcccaagtcaaacagtgtgg

SEQ ID NO: 1952946 - DNA, 20 bp, Homo sapiens
gatccctcggtcagcaccgt

SEQ ID NO: 1952947 - DNA, 14 bp, Homo sapiens
gatctcctgtgcac

SEQ ID NO: 1952948 - DNA, 18 bp, Homo sapiens
gatctggtgcgtgtggcc

SEQ ID NO: 1952949 - DNA, 16 bp, Homo sapiens
gatgagacaacacaca

SEQ ID NO: 1952950 - DNA, 19 bp, Homo sapiens
gatgataacctaacactat

SEQ ID NO: 1952951 - DNA, 18 bp, Homo sapiens
gatgatgtaaaaatatgt

SEQ ID NO: 1952952 - DNA, 13 bp, Homo sapiens
gatgatgttctga

SEQ ID NO: 1952953 - DNA, 12 bp, Homo sapiens
gatgatttcaga

SEQ ID NO: 1952954 - DNA, 21 bp, Homo sapiens
gatgcagtattgagtgttcta

SEQ ID NO: 1952955 - DNA, 15 bp, Homo sapiens
gatgggtcctgctgc

SEQ ID NO: 1952956 - DNA, 20 bp, Homo sapiens
gatgtaatatagggtttgtt

SEQ ID NO: 1952957 - DNA, 14 bp, Homo sapiens
gatgtacattaaat

SEQ ID NO: 1952958 - DNA, 20 bp, Homo sapiens
gatgtcacagtttgttcagt

SEQ ID NO: 1952959 - DNA, 13 bp, Homo sapiens
gatgtcccttccc

SEQ ID NO: 1952960 - DNA, 19 bp, Homo sapiens
gattaagttataccagcaa

SEQ ID NO: 1952961 - DNA, 21 bp, Homo sapiens
gattcaaataaccctgaatca

SEQ ID NO: 1952962 - DNA, 19 bp, Homo sapiens
gattcctacttaaacaaaa

SEQ ID NO: 1952963 - DNA, 15 bp, Homo sapiens
ctgcaccttgggcac

SEQ ID NO: 1952964 - DNA, 21 bp, Homo sapiens
ctgcagcctgagctccaccct

SEQ ID NO: 1952965 - DNA, 22 bp, Homo sapiens
ctgcatgaaagcgttatctctt

SEQ ID NO: 1952966 - DNA, 18 bp, Homo sapiens
ctgccaagagtccaagcc

SEQ ID NO: 1952967 - DNA, 15 bp, Homo sapiens
ctgcccaccctgggc

SEQ ID NO: 1952968 - DNA, 16 bp, Homo sapiens
ctgcccaccctgggcc

SEQ ID NO: 1952969 - DNA, 21 bp, Homo sapiens
ctgcccaccctgggcctcccg

SEQ ID NO: 1952970 - DNA, 15 bp, Homo sapiens
ctgccccctcccccg

SEQ ID NO: 1952971 - DNA, 21 bp, Homo sapiens
ctgcccctccgtccccagggt

SEQ ID NO: 1952972 - DNA, 17 bp, Homo sapiens
ctgccccttgaccccac

SEQ ID NO: 1952973 - DNA, 20 bp, Homo sapiens
ctgccccttgaccccacacg

SEQ ID NO: 1952974 - DNA, 22 bp, Homo sapiens
ctgccccttgaccccacacgcc

SEQ ID NO: 1952975 - DNA, 12 bp, Homo sapiens
ctgccctccccc

SEQ ID NO: 1952976 - DNA, 13 bp, Homo sapiens
ctgccctccccca

SEQ ID NO: 1952977 - DNA, 14 bp, Homo sapiens
ctgccctcccccac

SEQ ID NO: 1952978 - DNA, 15 bp, Homo sapiens
ctgccctcccccacg

SEQ ID NO: 1952979 - DNA, 16 bp, Homo sapiens
ctgccctcccccacgg

SEQ ID NO: 1952980 - DNA, 22 bp, Homo sapiens
ctgccctcccccacggccgtcc

SEQ ID NO: 1952981 - DNA, 15 bp, Homo sapiens
ctgccctgcaccttg

SEQ ID NO: 1952982 - DNA, 18 bp, Homo sapiens
ctgcctctttgctgcttt

SEQ ID NO: 1952983 - DNA, 19 bp, Homo sapiens
ctgcctggcgggcagcccc

SEQ ID NO: 1952984 - DNA, 22 bp, Homo sapiens
ctgcctggcgggcagcccctgc

SEQ ID NO: 1952985 - DNA, 23 bp, Homo sapiens
ctgcctggcgggcagcccctgct

SEQ ID NO: 1952986 - DNA, 12 bp, Homo sapiens
ctgcgcctgccc

SEQ ID NO: 1952987 - DNA, 13 bp, Homo sapiens
ctgcgctcctctg

SEQ ID NO: 1952988 - DNA, 18 bp, Homo sapiens
ctgcgtaggagagaacag

SEQ ID NO: 1952989 - DNA, 16 bp, Homo sapiens
ctgctcacgtctgtga

SEQ ID NO: 1952990 - DNA, 18 bp, Homo sapiens
ctgctcacgtctgtgagt

SEQ ID NO: 1952991 - DNA, 23 bp, Homo sapiens
ctgctcctccagtacaataaata

SEQ ID NO: 1952992 - DNA, 12 bp, Homo sapiens
ctgctcgggaag

SEQ ID NO: 1952993 - DNA, 13 bp, Homo sapiens
ctgctcgggaagg

SEQ ID NO: 1952994 - DNA, 15 bp, Homo sapiens
ctgctcgggaaggcc

SEQ ID NO: 1952995 - DNA, 19 bp, Homo sapiens
ctgctgaccttctgcggct

SEQ ID NO: 1952996 - DNA, 17 bp, Homo sapiens
ctgctgctcgggaaggc

SEQ ID NO: 1952997 - DNA, 21 bp, Homo sapiens
ctgctgctcgggaaggcctga

SEQ ID NO: 1952998 - DNA, 19 bp, Homo sapiens
ctgctggaccaaggtgcgg

SEQ ID NO: 1952999 - DNA, 17 bp, Homo sapiens
ctggaaaaaaaaaaata

SEQ ID NO: 1953000 - DNA, 16 bp, Homo sapiens
ctggaatctactagaa

SEQ ID NO: 1953001 - DNA, 23 bp, Homo sapiens
ctggaattagttggcagagaaaa

SEQ ID NO: 1953002 - DNA, 14 bp, Homo sapiens
ctggaggagaagga

SEQ ID NO: 1953003 - DNA, 17 bp, Homo sapiens
ctggaggagaaggagga

SEQ ID NO: 1953004 - DNA, 18 bp, Homo sapiens
ctggaggagaaggaggaa

SEQ ID NO: 1953005 - DNA, 14 bp, Homo sapiens
ctggataatttgta

SEQ ID NO: 1953006 - DNA, 17 bp, Homo sapiens
ctggataggagaggaaa

SEQ ID NO: 1953007 - DNA, 15 bp, Homo sapiens
ctggcagcgcctccc

SEQ ID NO: 1953008 - DNA, 12 bp, Homo sapiens
ctggccccaggc

SEQ ID NO: 1953009 - DNA, 14 bp, Homo sapiens
ctggccccaggcgg

SEQ ID NO: 1953010 - DNA, 18 bp, Homo sapiens
ctggccccaggcggaggg

SEQ ID NO: 1953011 - DNA, 16 bp, Homo sapiens
ctggccggtccacccc

SEQ ID NO: 1953012 - DNA, 22 bp, Homo sapiens
ctgggcagggccgcagggcgct

SEQ ID NO: 1953013 - DNA, 16 bp, Homo sapiens
ctggggtctctgagca

SEQ ID NO: 1953014 - DNA, 17 bp, Homo sapiens
ctgggtcgcccctcctc

SEQ ID NO: 1953015 - DNA, 18 bp, Homo sapiens
ctggtgcgtgtggccctg

SEQ ID NO: 1953016 - DNA, 22 bp, Homo sapiens
ctggtgcgtgtggccctgtggg

SEQ ID NO: 1953017 - DNA, 17 bp, Homo sapiens
ctgtaaataaaaatagc

SEQ ID NO: 1953018 - DNA, 14 bp, Homo sapiens
ctgtatcatttctt

SEQ ID NO: 1953019 - DNA, 24 bp, Homo sapiens
gaaacaaagcatttgactttctgt

SEQ ID NO: 1953020 - DNA, 20 bp, Homo sapiens
gaaacagtgtggatgtaaat

SEQ ID NO: 1953021 - DNA, 19 bp, Homo sapiens
gaaagaggaataaaatgat

SEQ ID NO: 1953022 - DNA, 16 bp, Homo sapiens
gaaagcaaaacatttt

SEQ ID NO: 1953023 - DNA, 19 bp, Homo sapiens
gaaagttccagcagtttca

SEQ ID NO: 1953024 - DNA, 20 bp, Homo sapiens
gaaatacttgacaacatttt

SEQ ID NO: 1953025 - DNA, 19 bp, Homo sapiens
gaaatataaaaataattaa

SEQ ID NO: 1953026 - DNA, 23 bp, Homo sapiens
gaaatatccctcatttcattatt

SEQ ID NO: 1953027 - DNA, 13 bp, Homo sapiens
gaaattatgtcaa

SEQ ID NO: 1953028 - DNA, 22 bp, Homo sapiens
gaacaacaacaaagcatgctca

SEQ ID NO: 1953029 - DNA, 23 bp, Homo sapiens
gaacaacaacaaagcatgctcag

SEQ ID NO: 1953030 - DNA, 22 bp, Homo sapiens
gaaccagagcgatgtgttcttt

SEQ ID NO: 1953031 - DNA, 15 bp, Homo sapiens
gaaccagcactccca

SEQ ID NO: 1953032 - DNA, 21 bp, Homo sapiens
gaaccagcactcccagggccc

SEQ ID NO: 1953033 - DNA, 22 bp, Homo sapiens
gaaccagcactcccagggcccg

SEQ ID NO: 1953034 - DNA, 22 bp, Homo sapiens
gaactaaatagatttttagatt

SEQ ID NO: 1953035 - DNA, 16 bp, Homo sapiens
gaactgaagcagagtc

SEQ ID NO: 1953036 - DNA, 17 bp, Homo sapiens
gaactgaagcagagtca

SEQ ID NO: 1953037 - DNA, 11 bp, Homo sapiens
gaagcccaccc

SEQ ID NO: 1953038 - DNA, 12 bp, Homo sapiens
gaagcccacccg

SEQ ID NO: 1953039 - DNA, 14 bp, Homo sapiens
gaagcccacccgcc

SEQ ID NO: 1953040 - DNA, 15 bp, Homo sapiens
gaagcccacccgccc

SEQ ID NO: 1953041 - DNA, 17 bp, Homo sapiens
gaagcccacccgcccca

SEQ ID NO: 1953042 - DNA, 21 bp, Homo sapiens
gaagcccacccgccccagaga

SEQ ID NO: 1953043 - DNA, 19 bp, Homo sapiens
gaagccctaagtaaatcta

SEQ ID NO: 1953044 - DNA, 18 bp, Homo sapiens
gaagctcaaggctgcagt

SEQ ID NO: 1953045 - DNA, 16 bp, Homo sapiens
gaaggcacactgagca

SEQ ID NO: 1953046 - DNA, 21 bp, Homo sapiens
gaaggcctgagggaagcccac

SEQ ID NO: 1953047 - DNA, 14 bp, Homo sapiens
gaagggtggatgtc

SEQ ID NO: 1953048 - DNA, 15 bp, Homo sapiens
gaagtcccttcctgt

SEQ ID NO: 1953049 - DNA, 19 bp, Homo sapiens
gaagtcccttcctgtcctg

SEQ ID NO: 1953050 - DNA, 16 bp, Homo sapiens
gaataacaacaattta

SEQ ID NO: 1953051 - DNA, 20 bp, Homo sapiens
gaatagttgtcagaatatgt

SEQ ID NO: 1953052 - DNA, 15 bp, Homo sapiens
gaatataaaaaatgt

SEQ ID NO: 1953053 - DNA, 19 bp, Homo sapiens
gaatataatggcctcttaa

SEQ ID NO: 1953054 - DNA, 18 bp, Homo sapiens
gaatcacctaattaattt

SEQ ID NO: 1953055 - DNA, 23 bp, Homo sapiens
gaatcacctaattaatttcagta

SEQ ID NO: 1953056 - DNA, 19 bp, Homo sapiens
gaatctctcaaaatgtgcc

SEQ ID NO: 1953057 - DNA, 22 bp, Homo sapiens
gaatgaaatataaactgtgaga

SEQ ID NO: 1953058 - DNA, 23 bp, Homo sapiens
gaatgaaatataaactgtgagat

SEQ ID NO: 1953059 - DNA, 24 bp, Homo sapiens
gaatgaaatataaactgtgagata

SEQ ID NO: 1953060 - DNA, 15 bp, Homo sapiens
gaatgctcaatgtgc

SEQ ID NO: 1953061 - DNA, 12 bp, Homo sapiens
gaatgtttcagt

SEQ ID NO: 1953062 - DNA, 17 bp, Homo sapiens
gaattacataacaggca

SEQ ID NO: 1953063 - DNA, 22 bp, Homo sapiens
gaattagttggcagagaaaatg

SEQ ID NO: 1953064 - DNA, 16 bp, Homo sapiens
gaatttaccagaaata

SEQ ID NO: 1953065 - DNA, 18 bp, Homo sapiens
gaatttaccagaaatatt

SEQ ID NO: 1953066 - DNA, 22 bp, Homo sapiens
gaattttaacttttgggatttg

SEQ ID NO: 1953067 - DNA, 20 bp, Homo sapiens
gacaacacacacacacacaa

SEQ ID NO: 1953068 - DNA, 18 bp, Homo sapiens
gacaagggggatgttgtg

SEQ ID NO: 1953069 - DNA, 23 bp, Homo sapiens
gacaatgtggaattacataacag

SEQ ID NO: 1953070 - DNA, 16 bp, Homo sapiens
gacacactcaccattt

SEQ ID NO: 1953071 - DNA, 22 bp, Homo sapiens
gacacctagactctaaaactat

SEQ ID NO: 1953072 - DNA, 14 bp, Homo sapiens
gacagacagacaga

SEQ ID NO: 1953073 - DNA, 23 bp, Homo sapiens
gacagacggacgggacagcggcc

SEQ ID NO: 1953074 - DNA, 14 bp, Homo sapiens
gacagcggcccggc

SEQ ID NO: 1953075 - DNA, 16 bp, Homo sapiens
gacagcggcccggccc

SEQ ID NO: 1953076 - DNA, 13 bp, Homo sapiens
gacagtgcagtgc

SEQ ID NO: 1953077 - DNA, 15 bp, Homo sapiens
gacatattcccatgg

SEQ ID NO: 1953078 - DNA, 16 bp, Homo sapiens
cccacccacaccccgt

SEQ ID NO: 1953079 - DNA, 15 bp, Homo sapiens
cccacccgccccaga

SEQ ID NO: 1953080 - DNA, 16 bp, Homo sapiens
cccacccgtgttctcc

SEQ ID NO: 1953081 - DNA, 12 bp, Homo sapiens
cccaccctgggc

SEQ ID NO: 1953082 - DNA, 18 bp, Homo sapiens
cccaccctgggcctcccg

SEQ ID NO: 1953083 - DNA, 17 bp, Homo sapiens
cccacgcagagccccgg

SEQ ID NO: 1953084 - DNA, 19 bp, Homo sapiens
cccacgcagagccccggag

SEQ ID NO: 1953085 - DNA, 20 bp, Homo sapiens
cccactgatatcacgggccc

SEQ ID NO: 1953086 - DNA, 16 bp, Homo sapiens
cccagaacgggcctcc

SEQ ID NO: 1953087 - DNA, 16 bp, Homo sapiens
cccagagactgcccac

SEQ ID NO: 1953088 - DNA, 19 bp, Homo sapiens
cccagagactgcccaccct

SEQ ID NO: 1953089 - DNA, 23 bp, Homo sapiens
cccagagactgcccaccctgggc

SEQ ID NO: 1953090 - DNA, 17 bp, Homo sapiens
cccagcctcccccaggc

SEQ ID NO: 1953091 - DNA, 19 bp, Homo sapiens
cccagcctcccccaggctg

SEQ ID NO: 1953092 - DNA, 20 bp, Homo sapiens
cccagcctcccccaggctgc

SEQ ID NO: 1953093 - DNA, 12 bp, Homo sapiens
cccagctggcag

SEQ ID NO: 1953094 - DNA, 15 bp, Homo sapiens
cccagctggcagcgc

SEQ ID NO: 1953095 - DNA, 12 bp, Homo sapiens
cccagctggctg

SEQ ID NO: 1953096 - DNA, 16 bp, Homo sapiens
cccagctggctgggtc

SEQ ID NO: 1953097 - DNA, 19 bp, Homo sapiens
cccagctggctgggtcgcc

SEQ ID NO: 1953098 - DNA, 19 bp, Homo sapiens
cccaggaggactccctgct

SEQ ID NO: 1953099 - DNA, 16 bp, Homo sapiens
cccaggctgcgcctgc

SEQ ID NO: 1953100 - DNA, 19 bp, Homo sapiens
cccaggctgcgcctgcccg

SEQ ID NO: 1953101 - DNA, 16 bp, Homo sapiens
cccagttagcccggcc

SEQ ID NO: 1953102 - DNA, 21 bp, Homo sapiens
cccatgaatatcaagaatagt

SEQ ID NO: 1953103 - DNA, 19 bp, Homo sapiens
cccatggccccagctggct

SEQ ID NO: 1953104 - DNA, 17 bp, Homo sapiens
cccatggtagactgtga

SEQ ID NO: 1953105 - DNA, 18 bp, Homo sapiens
cccattgtgaatgttgtc

SEQ ID NO: 1953106 - DNA, 22 bp, Homo sapiens
cccattgtgaatgttgtcctgt

SEQ ID NO: 1953107 - DNA, 18 bp, Homo sapiens
ccccaccctcccctctcc

SEQ ID NO: 1953108 - DNA, 16 bp, Homo sapiens
ccccacggccgtccct

SEQ ID NO: 1953109 - DNA, 18 bp, Homo sapiens
ccccagagactgcccacc

SEQ ID NO: 1953110 - DNA, 11 bp, Homo sapiens
ccccagcctcc

SEQ ID NO: 1953111 - DNA, 13 bp, Homo sapiens
ccccagcctcccc

SEQ ID NO: 1953112 - DNA, 18 bp, Homo sapiens
ccccagcctcccccaggc

SEQ ID NO: 1953113 - DNA, 21 bp, Homo sapiens
ccccaggcggaggggcttgga

SEQ ID NO: 1953114 - DNA, 23 bp, Homo sapiens
ccccaggcggaggggcttggagc

SEQ ID NO: 1953115 - DNA, 15 bp, Homo sapiens
ccccaggctgcgcct

SEQ ID NO: 1953116 - DNA, 14 bp, Homo sapiens
ccccatccttcccg

SEQ ID NO: 1953117 - DNA, 17 bp, Homo sapiens
ccccatccttcccgcag

SEQ ID NO: 1953118 - DNA, 21 bp, Homo sapiens
ccccatccttcccgcagcacc

SEQ ID NO: 1953119 - DNA, 20 bp, Homo sapiens
ccccatgccaatgtccaggt

SEQ ID NO: 1953120 - DNA, 14 bp, Homo sapiens
cccccacctcccgg

SEQ ID NO: 1953121 - DNA, 12 bp, Homo sapiens
cccccacggccg

SEQ ID NO: 1953122 - DNA, 16 bp, Homo sapiens
cccccagcctccccca

SEQ ID NO: 1953123 - DNA, 18 bp, Homo sapiens
cccccagcctcccccagg

SEQ ID NO: 1953124 - DNA, 15 bp, Homo sapiens
cccccaggctgcgcc

SEQ ID NO: 1953125 - DNA, 17 bp, Homo sapiens
cccccggaggcgcccac

SEQ ID NO: 1953126 - DNA, 19 bp, Homo sapiens
cccccggaggcgcccacct

SEQ ID NO: 1953127 - DNA, 16 bp, Homo sapiens
ccccgcagacagacag

SEQ ID NO: 1953128 - DNA, 18 bp, Homo sapiens
ccccgcccgccctcctct

SEQ ID NO: 1953129 - DNA, 20 bp, Homo sapiens
ccccgcccgccctcctctgc

SEQ ID NO: 1953130 - DNA, 15 bp, Homo sapiens
ccccgccctcgctcc

SEQ ID NO: 1953131 - DNA, 16 bp, Homo sapiens
ccccggacgctggctc

SEQ ID NO: 1953132 - DNA, 21 bp, Homo sapiens
ccccggaggcgcccacctgcc

SEQ ID NO: 1953133 - DNA, 22 bp, Homo sapiens
ccccggaggcgcccacctgccc

SEQ ID NO: 1953134 - DNA, 18 bp, Homo sapiens
ccccgtcccggccccgcg

SEQ ID NO: 1953135 - DNA, 18 bp, Homo sapiens
cccctcccccgcagacag

SEQ ID NO: 1953136 - DNA, 16 bp, Homo sapiens
cccctccgtccccagg

SEQ ID NO: 1953137 - DNA, 18 bp, Homo sapiens
cccctggaagttgtcctt

SEQ ID NO: 1953138 - DNA, 16 bp, Homo sapiens
ccccttgaccccacac

SEQ ID NO: 1953139 - DNA, 17 bp, Homo sapiens
cccgcagcaccagcctg

SEQ ID NO: 1953140 - DNA, 13 bp, Homo sapiens
cccgcccaccccg

SEQ ID NO: 1953141 - DNA, 16 bp, Homo sapiens
cccgcccaccccgctg

SEQ ID NO: 1953142 - DNA, 12 bp, Homo sapiens
cccgccccagag

SEQ ID NO: 1953143 - DNA, 21 bp, Homo sapiens
cccgccccagagactgcccac

SEQ ID NO: 1953144 - DNA, 11 bp, Homo sapiens
cccgccctcgc

SEQ ID NO: 1953145 - DNA, 16 bp, Homo sapiens
cccgcgcgtgccccca

SEQ ID NO: 1953146 - DNA, 18 bp, Homo sapiens
cccgcgcgtgcccccagc

SEQ ID NO: 1953147 - DNA, 19 bp, Homo sapiens
cccggaggcgcccacctgc

SEQ ID NO: 1953148 - DNA, 20 bp, Homo sapiens
cccggaggcgcccacctgcc

SEQ ID NO: 1953149 - DNA, 22 bp, Homo sapiens
cccggaggcgcccacctgccca

SEQ ID NO: 1953150 - DNA, 23 bp, Homo sapiens
cccggaggcgcccacctgcccag

SEQ ID NO: 1953151 - DNA, 17 bp, Homo sapiens
cccggccaaggacactg

SEQ ID NO: 1953152 - DNA, 18 bp, Homo sapiens
cccggcccacgcagagcc

SEQ ID NO: 1953153 - DNA, 19 bp, Homo sapiens
cccggcccacgcagagccc

SEQ ID NO: 1953154 - DNA, 12 bp, Homo sapiens
cccgtctgcccc

SEQ ID NO: 1953155 - DNA, 14 bp, Homo sapiens
cccgtctgcccctt

SEQ ID NO: 1953156 - DNA, 22 bp, Homo sapiens
cccgtgcggcccgtgcgcagcc

SEQ ID NO: 1953157 - DNA, 17 bp, Homo sapiens
ccctcagccctcattaa

SEQ ID NO: 1953158 - DNA, 20 bp, Homo sapiens
ccctcattaaactaattaaa

SEQ ID NO: 1953159 - DNA, 15 bp, Homo sapiens
ccctcccccacggcc

SEQ ID NO: 1953160 - DNA, 23 bp, Homo sapiens
ccctcccccacggccgtccctga

SEQ ID NO: 1953161 - DNA, 21 bp, Homo sapiens
gcctccccgggggtccccgga

SEQ ID NO: 1953162 - DNA, 22 bp, Homo sapiens
gcctccccgggggtccccggac

SEQ ID NO: 1953163 - DNA, 17 bp, Homo sapiens
gcctcgggccgcctcct

SEQ ID NO: 1953164 - DNA, 19 bp, Homo sapiens
gcctcgggccgcctcctcc

SEQ ID NO: 1953165 - DNA, 22 bp, Homo sapiens
gcctcgggccgcctcctccaga

SEQ ID NO: 1953166 - DNA, 14 bp, Homo sapiens
gcctcttaaaaatt

SEQ ID NO: 1953167 - DNA, 23 bp, Homo sapiens
gcctcttgaatgcttaaatgatc

SEQ ID NO: 1953168 - DNA, 19 bp, Homo sapiens
gcctgaaagtaatttcaag

SEQ ID NO: 1953169 - DNA, 18 bp, Homo sapiens
gcctgagccacagtgggg

SEQ ID NO: 1953170 - DNA, 20 bp, Homo sapiens
gcctgagccacagtggggcc

SEQ ID NO: 1953171 - DNA, 16 bp, Homo sapiens
gcctgagctccaccct

SEQ ID NO: 1953172 - DNA, 18 bp, Homo sapiens
gcctgagctccaccctcc

SEQ ID NO: 1953173 - DNA, 13 bp, Homo sapiens
gcctgagggaagc

SEQ ID NO: 1953174 - DNA, 14 bp, Homo sapiens
gcctgagggaagcc

SEQ ID NO: 1953175 - DNA, 16 bp, Homo sapiens
gcctgagggaagccca

SEQ ID NO: 1953176 - DNA, 21 bp, Homo sapiens
gcctgagggaagcccacccgc

SEQ ID NO: 1953177 - DNA, 16 bp, Homo sapiens
gcctgcgctcctctgc

SEQ ID NO: 1953178 - DNA, 18 bp, Homo sapiens
gcctgcgctcctctgcag

SEQ ID NO: 1953179 - DNA, 19 bp, Homo sapiens
gcctgcgctcctctgcagc

SEQ ID NO: 1953180 - DNA, 20 bp, Homo sapiens
gcctgcgctcctctgcagcc

SEQ ID NO: 1953181 - DNA, 22 bp, Homo sapiens
gcctgcgctcctctgcagcctg

SEQ ID NO: 1953182 - DNA, 13 bp, Homo sapiens
gcctggaggagaa

SEQ ID NO: 1953183 - DNA, 21 bp, Homo sapiens
gcctggaggagaaggaggaac

SEQ ID NO: 1953184 - DNA, 22 bp, Homo sapiens
gcctggaggagaaggaggaacc

SEQ ID NO: 1953185 - DNA, 18 bp, Homo sapiens
gcctggcgggcagcccct

SEQ ID NO: 1953186 - DNA, 20 bp, Homo sapiens
gcctggcgggcagcccctgc

SEQ ID NO: 1953187 - DNA, 15 bp, Homo sapiens
gccttccccgtgcgg

SEQ ID NO: 1953188 - DNA, 18 bp, Homo sapiens
gccttgattttaattcag

SEQ ID NO: 1953189 - DNA, 20 bp, Homo sapiens
gccttgattttaattcaggt

SEQ ID NO: 1953190 - DNA, 20 bp, Homo sapiens
gcgcagccgcgctctgcccc

SEQ ID NO: 1953191 - DNA, 21 bp, Homo sapiens
gcgcagccgcgctctgcccct

SEQ ID NO: 1953192 - DNA, 12 bp, Homo sapiens
gcgcccacctgc

SEQ ID NO: 1953193 - DNA, 14 bp, Homo sapiens
gcgcccacctgccc

SEQ ID NO: 1953194 - DNA, 14 bp, Homo sapiens
gcgcctcccgccgc

SEQ ID NO: 1953195 - DNA, 17 bp, Homo sapiens
gcgcctgcccgcccgcc

SEQ ID NO: 1953196 - DNA, 21 bp, Homo sapiens
gcgcctgcgctcctctgcagc

SEQ ID NO: 1953197 - DNA, 23 bp, Homo sapiens
gcgcctgcgctcctctgcagcct

SEQ ID NO: 1953198 - DNA, 22 bp, Homo sapiens
gcgcgcaccgcccaacccccac

SEQ ID NO: 1953199 - DNA, 13 bp, Homo sapiens
gcgcgtgccccca

SEQ ID NO: 1953200 - DNA, 14 bp, Homo sapiens
gcgcgtgcccccag

SEQ ID NO: 1953201 - DNA, 16 bp, Homo sapiens
gcgcgtgcccccagcg

SEQ ID NO: 1953202 - DNA, 20 bp, Homo sapiens
gcgctccggcagaggcaggg

SEQ ID NO: 1953203 - DNA, 13 bp, Homo sapiens
gcgctcctctgca

SEQ ID NO: 1953204 - DNA, 18 bp, Homo sapiens
gcgctcctctgcagcctg

SEQ ID NO: 1953205 - DNA, 21 bp, Homo sapiens
gcgctcctctgcagcctgagc

SEQ ID NO: 1953206 - DNA, 23 bp, Homo sapiens
gcgctcctctgcagcctgagctc

SEQ ID NO: 1953207 - DNA, 20 bp, Homo sapiens
gcggaccggagcggctgagg

SEQ ID NO: 1953208 - DNA, 12 bp, Homo sapiens
gcggcaccgccc

SEQ ID NO: 1953209 - DNA, 17 bp, Homo sapiens
gcggcaccgcccaccca

SEQ ID NO: 1953210 - DNA, 13 bp, Homo sapiens
gcggcccggccca

SEQ ID NO: 1953211 - DNA, 16 bp, Homo sapiens
gcggcccgtgcgcagc

SEQ ID NO: 1953212 - DNA, 17 bp, Homo sapiens
gcggcccgtgcgcagcc

SEQ ID NO: 1953213 - DNA, 20 bp, Homo sapiens
gcggcccgtgcgcagccgcg

SEQ ID NO: 1953214 - DNA, 22 bp, Homo sapiens
gcggcccgtgcgcagccgcgct

SEQ ID NO: 1953215 - DNA, 19 bp, Homo sapiens
gcgggcagcccctgctgga

SEQ ID NO: 1953216 - DNA, 18 bp, Homo sapiens
gcgtaaatggttttcaac

SEQ ID NO: 1953217 - DNA, 15 bp, Homo sapiens
gcgtgaccggcccgc

SEQ ID NO: 1953218 - DNA, 18 bp, Homo sapiens
gcgtgaccggcccgccac

SEQ ID NO: 1953219 - DNA, 18 bp, Homo sapiens
gcgtgtggccctgtggga

SEQ ID NO: 1953220 - DNA, 13 bp, Homo sapiens
gctaacaaaagat

SEQ ID NO: 1953221 - DNA, 14 bp, Homo sapiens
gctaacaaaagata

SEQ ID NO: 1953222 - DNA, 22 bp, Homo sapiens
gctaagataattaaatgaaata

SEQ ID NO: 1953223 - DNA, 23 bp, Homo sapiens
gctagaaagagaaaaagccctct

SEQ ID NO: 1953224 - DNA, 16 bp, Homo sapiens
gctataaatagtgaaa

SEQ ID NO: 1953225 - DNA, 12 bp, Homo sapiens
gctatgcacacc

SEQ ID NO: 1953226 - DNA, 17 bp, Homo sapiens
gctatgctgttcattga

SEQ ID NO: 1953227 - DNA, 20 bp, Homo sapiens
gctcaataaggcagtgcagt

SEQ ID NO: 1953228 - DNA, 21 bp, Homo sapiens
gctcaataaggcagtgcagtg

SEQ ID NO: 1953229 - DNA, 19 bp, Homo sapiens
gctcaatgtgctgttgatt

SEQ ID NO: 1953230 - DNA, 16 bp, Homo sapiens
gctcagaggagaggag

SEQ ID NO: 1953231 - DNA, 12 bp, Homo sapiens
gcagcgcctccc

SEQ ID NO: 1953232 - DNA, 13 bp, Homo sapiens
gcagcgcctcccg

SEQ ID NO: 1953233 - DNA, 17 bp, Homo sapiens
gcagcggcagcagcagc

SEQ ID NO: 1953234 - DNA, 14 bp, Homo sapiens
gcagctagctgctt

SEQ ID NO: 1953235 - DNA, 18 bp, Homo sapiens
gcaggaaagatcccaagt

SEQ ID NO: 1953236 - DNA, 21 bp, Homo sapiens
gcagggccctggggtctctga

SEQ ID NO: 1953237 - DNA, 14 bp, Homo sapiens
gcagggccgcaggg

SEQ ID NO: 1953238 - DNA, 14 bp, Homo sapiens
gcagggcgctccgg

SEQ ID NO: 1953239 - DNA, 14 bp, Homo sapiens
gcagtaccatccca

SEQ ID NO: 1953240 - DNA, 16 bp, Homo sapiens
gcagttttgaaacctt

SEQ ID NO: 1953241 - DNA, 22 bp, Homo sapiens
gcatagccagttctgacagtgt

SEQ ID NO: 1953242 - DNA, 14 bp, Homo sapiens
gcatgctcagtatt

SEQ ID NO: 1953243 - DNA, 19 bp, Homo sapiens
gcatgctccctcatgcaga

SEQ ID NO: 1953244 - DNA, 20 bp, Homo sapiens
gcatgctccctcatgcagat

SEQ ID NO: 1953245 - DNA, 17 bp, Homo sapiens
gcattgcactaaaagtg

SEQ ID NO: 1953246 - DNA, 15 bp, Homo sapiens
gccaaagctgttagt

SEQ ID NO: 1953247 - DNA, 15 bp, Homo sapiens
gccaatgtccaggtc

SEQ ID NO: 1953248 - DNA, 20 bp, Homo sapiens
gccaatttctcttaagtact

SEQ ID NO: 1953249 - DNA, 18 bp, Homo sapiens
gccacagtggggcccatg

SEQ ID NO: 1953250 - DNA, 12 bp, Homo sapiens
gccacccgcccg

SEQ ID NO: 1953251 - DNA, 17 bp, Homo sapiens
gccacccgcccgccccc

SEQ ID NO: 1953252 - DNA, 17 bp, Homo sapiens
gccaggcacggaggctc

SEQ ID NO: 1953253 - DNA, 13 bp, Homo sapiens
gcccaacccccac

SEQ ID NO: 1953254 - DNA, 14 bp, Homo sapiens
gcccaacccccacc

SEQ ID NO: 1953255 - DNA, 16 bp, Homo sapiens
gcccaacccccacctc

SEQ ID NO: 1953256 - DNA, 13 bp, Homo sapiens
gcccacccacacc

SEQ ID NO: 1953257 - DNA, 15 bp, Homo sapiens
gcccaccccgctgcc

SEQ ID NO: 1953258 - DNA, 18 bp, Homo sapiens
gcccaccccgctgcctgg

SEQ ID NO: 1953259 - DNA, 21 bp, Homo sapiens
gcccaccccgctgcctggcgg

SEQ ID NO: 1953260 - DNA, 23 bp, Homo sapiens
gcccacccgtgttctcctccaaa

SEQ ID NO: 1953261 - DNA, 15 bp, Homo sapiens
gcccaccctgggcct

SEQ ID NO: 1953262 - DNA, 18 bp, Homo sapiens
gcccaccctgggcctccc

SEQ ID NO: 1953263 - DNA, 13 bp, Homo sapiens
gcccacctgccca

SEQ ID NO: 1953264 - DNA, 15 bp, Homo sapiens
gcccacctgcccagt

SEQ ID NO: 1953265 - DNA, 18 bp, Homo sapiens
gcccacgcagagccccgg

SEQ ID NO: 1953266 - DNA, 23 bp, Homo sapiens
gcccacgcagagccccggagcac

SEQ ID NO: 1953267 - DNA, 20 bp, Homo sapiens
gcccagaacgggcctccccg

SEQ ID NO: 1953268 - DNA, 21 bp, Homo sapiens
gcccagttagcccggccaagg

SEQ ID NO: 1953269 - DNA, 15 bp, Homo sapiens
gcccatggccccagc

SEQ ID NO: 1953270 - DNA, 17 bp, Homo sapiens
gcccatggccccagctg

SEQ ID NO: 1953271 - DNA, 21 bp, Homo sapiens
gcccatggccccagctggctg

SEQ ID NO: 1953272 - DNA, 20 bp, Homo sapiens
gccccagagactgcccaccc

SEQ ID NO: 1953273 - DNA, 23 bp, Homo sapiens
gccccagagactgcccaccctgg

SEQ ID NO: 1953274 - DNA, 13 bp, Homo sapiens
gccccagctggct

SEQ ID NO: 1953275 - DNA, 14 bp, Homo sapiens
gccccagctggctg

SEQ ID NO: 1953276 - DNA, 19 bp, Homo sapiens
gccccatccttcccgcagc

SEQ ID NO: 1953277 - DNA, 21 bp, Homo sapiens
gccccatccttcccgcagcac

SEQ ID NO: 1953278 - DNA, 23 bp, Homo sapiens
gccccatccttcccgcagcacca

SEQ ID NO: 1953279 - DNA, 17 bp, Homo sapiens
gcccccggaggcgccca

SEQ ID NO: 1953280 - DNA, 19 bp, Homo sapiens
gcccccggaggcgcccacc

SEQ ID NO: 1953281 - DNA, 21 bp, Homo sapiens
gcccccggaggcgcccacctg

SEQ ID NO: 1953282 - DNA, 21 bp, Homo sapiens
gccccctcccccgcagacaga

SEQ ID NO: 1953283 - DNA, 15 bp, Homo sapiens
gccccgcgcgtgccc

SEQ ID NO: 1953284 - DNA, 17 bp, Homo sapiens
gccccgcgcgtgccccc

SEQ ID NO: 1953285 - DNA, 16 bp, Homo sapiens
gcccctccgtccccag

SEQ ID NO: 1953286 - DNA, 11 bp, Homo sapiens
gcccctcctcg

SEQ ID NO: 1953287 - DNA, 21 bp, Homo sapiens
gcccctcctcgggcgcctgcg

SEQ ID NO: 1953288 - DNA, 14 bp, Homo sapiens
gccccttgacccca

SEQ ID NO: 1953289 - DNA, 15 bp, Homo sapiens
gccccttgaccccac

SEQ ID NO: 1953290 - DNA, 15 bp, Homo sapiens
gcccgagcgcgtgcc

SEQ ID NO: 1953291 - DNA, 22 bp, Homo sapiens
gcccgcccaccccgctgcctgg

SEQ ID NO: 1953292 - DNA, 23 bp, Homo sapiens
gcccgcccaccccgctgcctggc

SEQ ID NO: 1953293 - DNA, 17 bp, Homo sapiens
gcccgcccccgccctcg

SEQ ID NO: 1953294 - DNA, 21 bp, Homo sapiens
gcccgcccccgccctcgctcc

SEQ ID NO: 1953295 - DNA, 14 bp, Homo sapiens
gcccgcccgccggt

SEQ ID NO: 1953296 - DNA, 13 bp, Homo sapiens
gcccgccctcctc

SEQ ID NO: 1953297 - DNA, 14 bp, Homo sapiens
gcccgccctcctct

SEQ ID NO: 1953298 - DNA, 20 bp, Homo sapiens
gcccgccctcctctgccccc

SEQ ID NO: 1953299 - DNA, 15 bp, Homo sapiens
gctcagtattgagac

SEQ ID NO: 1953300 - DNA, 13 bp, Homo sapiens
gctccaccctccc

SEQ ID NO: 1953301 - DNA, 15 bp, Homo sapiens
gctccaccctcccct

SEQ ID NO: 1953302 - DNA, 12 bp, Homo sapiens
gctccactctga

SEQ ID NO: 1953303 - DNA, 15 bp, Homo sapiens
gctccactctgaagt

SEQ ID NO: 1953304 - DNA, 15 bp, Homo sapiens
gctccggcagaggca

SEQ ID NO: 1953305 - DNA, 16 bp, Homo sapiens
gctccggcagaggcag

SEQ ID NO: 1953306 - DNA, 19 bp, Homo sapiens
gctccggcagaggcagggc

SEQ ID NO: 1953307 - DNA, 13 bp, Homo sapiens
gctcctctgcagc

SEQ ID NO: 1953308 - DNA, 20 bp, Homo sapiens
gctcctctgcagcctgagct

SEQ ID NO: 1953309 - DNA, 14 bp, Homo sapiens
gctccttcatgctt

SEQ ID NO: 1953310 - DNA, 21 bp, Homo sapiens
gctcggccaggcacggaggct

SEQ ID NO: 1953311 - DNA, 13 bp, Homo sapiens
gctcgggaaggcc

SEQ ID NO: 1953312 - DNA, 15 bp, Homo sapiens
gctcgggaaggcctg

SEQ ID NO: 1953313 - DNA, 16 bp, Homo sapiens
gctcgggaaggcctga

SEQ ID NO: 1953314 - DNA, 20 bp, Homo sapiens
gctctctcattcccaggcac

SEQ ID NO: 1953315 - DNA, 14 bp, Homo sapiens
gctctgaatctctc

SEQ ID NO: 1953316 - DNA, 16 bp, Homo sapiens
gctctgaatctctcaa

SEQ ID NO: 1953317 - DNA, 21 bp, Homo sapiens
gctctgaatctctcaaaatgt

SEQ ID NO: 1953318 - DNA, 12 bp, Homo sapiens
gctctgcccctc

SEQ ID NO: 1953319 - DNA, 18 bp, Homo sapiens
gctctgcccctccgtccc

SEQ ID NO: 1953320 - DNA, 22 bp, Homo sapiens
gctctgcccctccgtccccagg

SEQ ID NO: 1953321 - DNA, 12 bp, Homo sapiens
gctgaaattatg

SEQ ID NO: 1953322 - DNA, 16 bp, Homo sapiens
gctgaaattatgtcaa

SEQ ID NO: 1953323 - DNA, 18 bp, Homo sapiens
gctgaaattatgtcaaat

SEQ ID NO: 1953324 - DNA, 20 bp, Homo sapiens
gctgaaattatgtcaaatgg

SEQ ID NO: 1953325 - DNA, 14 bp, Homo sapiens
gctgactcttacta

SEQ ID NO: 1953326 - DNA, 20 bp, Homo sapiens
gctgagatgtttagtagctg

SEQ ID NO: 1953327 - DNA, 14 bp, Homo sapiens
gctgagctggccta

SEQ ID NO: 1953328 - DNA, 21 bp, Homo sapiens
gctgaggacggggcagagctg

SEQ ID NO: 1953329 - DNA, 16 bp, Homo sapiens
gctgagtcggctgggc

SEQ ID NO: 1953330 - DNA, 21 bp, Homo sapiens
gctgagtcggctgggcagggc

SEQ ID NO: 1953331 - DNA, 18 bp, Homo sapiens
gctgcctagtgctacaga

SEQ ID NO: 1953332 - DNA, 18 bp, Homo sapiens
gctgcctctttgctgctt

SEQ ID NO: 1953333 - DNA, 12 bp, Homo sapiens
gctgcctggcgg

SEQ ID NO: 1953334 - DNA, 20 bp, Homo sapiens
gctgcctggcgggcagcccc

SEQ ID NO: 1953335 - DNA, 21 bp, Homo sapiens
gctgcctggcgggcagcccct

SEQ ID NO: 1953336 - DNA, 12 bp, Homo sapiens
gctgcgcctgcc

SEQ ID NO: 1953337 - DNA, 18 bp, Homo sapiens
gctgcgcctgcccgcccg

SEQ ID NO: 1953338 - DNA, 22 bp, Homo sapiens
gctgcgcctgcccgcccgccgg

SEQ ID NO: 1953339 - DNA, 18 bp, Homo sapiens
ccgagcgcgtgccttccc

SEQ ID NO: 1953340 - DNA, 22 bp, Homo sapiens
ccgagcgcgtgccttccccgtg

SEQ ID NO: 1953341 - DNA, 15 bp, Homo sapiens
ccgcagcaccagcct

SEQ ID NO: 1953342 - DNA, 17 bp, Homo sapiens
ccgcagcaccagcctga

SEQ ID NO: 1953343 - DNA, 23 bp, Homo sapiens
ccgcagggcgctccggcagaggc

SEQ ID NO: 1953344 - DNA, 18 bp, Homo sapiens
ccgcccaacccccacctc

SEQ ID NO: 1953345 - DNA, 10 bp, Homo sapiens
ccgccccaga

SEQ ID NO: 1953346 - DNA, 12 bp, Homo sapiens
ccgccccagaga

SEQ ID NO: 1953347 - DNA, 15 bp, Homo sapiens
ccgccccagagactg

SEQ ID NO: 1953348 - DNA, 21 bp, Homo sapiens
ccgccccagagactgcccacc

SEQ ID NO: 1953349 - DNA, 22 bp, Homo sapiens
ccgccccagagactgcccaccc

SEQ ID NO: 1953350 - DNA, 17 bp, Homo sapiens
ccgcccccgccctcgct

SEQ ID NO: 1953351 - DNA, 18 bp, Homo sapiens
ccgcccgcccaccccgct

SEQ ID NO: 1953352 - DNA, 14 bp, Homo sapiens
ccgcccgcccccgc

SEQ ID NO: 1953353 - DNA, 14 bp, Homo sapiens
ccgcccgccctcct

SEQ ID NO: 1953354 - DNA, 15 bp, Homo sapiens
ccgcccgccctcctc

SEQ ID NO: 1953355 - DNA, 12 bp, Homo sapiens
ccgccctcctct

SEQ ID NO: 1953356 - DNA, 15 bp, Homo sapiens
ccgccctcctctgcc

SEQ ID NO: 1953357 - DNA, 16 bp, Homo sapiens
ccgccctcctctgccc

SEQ ID NO: 1953358 - DNA, 13 bp, Homo sapiens
ccgcctcctccag

SEQ ID NO: 1953359 - DNA, 20 bp, Homo sapiens
ccgcctcgggccgcctcctc

SEQ ID NO: 1953360 - DNA, 12 bp, Homo sapiens
ccgctgcctggc

SEQ ID NO: 1953361 - DNA, 13 bp, Homo sapiens
ccgctgcctggcg

SEQ ID NO: 1953362 - DNA, 21 bp, Homo sapiens
ccgctgcctggcgggcagccc

SEQ ID NO: 1953363 - DNA, 14 bp, Homo sapiens
ccggacgctggctc

SEQ ID NO: 1953364 - DNA, 15 bp, Homo sapiens
ccggagcggctgagg

SEQ ID NO: 1953365 - DNA, 17 bp, Homo sapiens
ccggagcggctgaggac

SEQ ID NO: 1953366 - DNA, 16 bp, Homo sapiens
ccggaggcgcccacct

SEQ ID NO: 1953367 - DNA, 20 bp, Homo sapiens
ccggaggcgcccacctgccc

SEQ ID NO: 1953368 - DNA, 21 bp, Homo sapiens
ccggcagaggcagggccctgg

SEQ ID NO: 1953369 - DNA, 18 bp, Homo sapiens
ccggccaaggacactgat

SEQ ID NO: 1953370 - DNA, 14 bp, Homo sapiens
ccggcccacgcaga

SEQ ID NO: 1953371 - DNA, 19 bp, Homo sapiens
ccggcccacgcagagcccc

SEQ ID NO: 1953372 - DNA, 16 bp, Homo sapiens
ccggcccccctctcgg

SEQ ID NO: 1953373 - DNA, 18 bp, Homo sapiens
ccggccccgcgcgtgccc

SEQ ID NO: 1953374 - DNA, 12 bp, Homo sapiens
ccggcctgcagc

SEQ ID NO: 1953375 - DNA, 15 bp, Homo sapiens
ccggcctgcagccca

SEQ ID NO: 1953376 - DNA, 17 bp, Homo sapiens
ccggcctgcagcccaga

SEQ ID NO: 1953377 - DNA, 21 bp, Homo sapiens
ccggctggccggtccaccccg

SEQ ID NO: 1953378 - DNA, 17 bp, Homo sapiens
ccggggctggccctgcc

SEQ ID NO: 1953379 - DNA, 18 bp, Homo sapiens
ccggggctggccctgccc

SEQ ID NO: 1953380 - DNA, 22 bp, Homo sapiens
ccggggctggccctgccctccc

SEQ ID NO: 1953381 - DNA, 22 bp, Homo sapiens
ccgggtgcgtgaccggcccgcc

SEQ ID NO: 1953382 - DNA, 13 bp, Homo sapiens
ccggtccaccccg

SEQ ID NO: 1953383 - DNA, 14 bp, Homo sapiens
ccgtcccggccccg

SEQ ID NO: 1953384 - DNA, 15 bp, Homo sapiens
ccgtccgcccgccca

SEQ ID NO: 1953385 - DNA, 16 bp, Homo sapiens
ccgtccgtccgcccgc

SEQ ID NO: 1953386 - DNA, 15 bp, Homo sapiens
ccgtgcggcccgtgc

SEQ ID NO: 1953387 - DNA, 14 bp, Homo sapiens
ccgtggtgtgaggc

SEQ ID NO: 1953388 - DNA, 16 bp, Homo sapiens
ccgtggtgtgaggccc

SEQ ID NO: 1953389 - DNA, 22 bp, Homo sapiens
ccgtggtgtgaggcccccggag

SEQ ID NO: 1953390 - DNA, 23 bp, Homo sapiens
ccgtggtgtgaggcccccggagg

SEQ ID NO: 1953391 - DNA, 20 bp, Homo sapiens
ccgttcatctgaggagtcca

SEQ ID NO: 1953392 - DNA, 19 bp, Homo sapiens
cctaagtaaatctaaatta

SEQ ID NO: 1953393 - DNA, 13 bp, Homo sapiens
cctaatgcagaat

SEQ ID NO: 1953394 - DNA, 17 bp, Homo sapiens
cctaattaatttcagta

SEQ ID NO: 1953395 - DNA, 14 bp, Homo sapiens
cctacaaagaaaaa

SEQ ID NO: 1953396 - DNA, 13 bp, Homo sapiens
cctacttaaacaa

SEQ ID NO: 1953397 - DNA, 15 bp, Homo sapiens
cctacttaaacaaaa

SEQ ID NO: 1953398 - DNA, 16 bp, Homo sapiens
cctacttaaacaaaaa

SEQ ID NO: 1953399 - DNA, 23 bp, Homo sapiens
cctatctggaaaaaaaaaaatat

SEQ ID NO: 1953400 - DNA, 16 bp, Homo sapiens
cctatgaccataaaat

SEQ ID NO: 1953401 - DNA, 13 bp, Homo sapiens
cctcaaaagaaaa

SEQ ID NO: 1953402 - DNA, 14 bp, Homo sapiens
cctcaaaagaaaat

SEQ ID NO: 1953403 - DNA, 19 bp, Homo sapiens
cctcatggctgttatctgt

SEQ ID NO: 1953404 - DNA, 15 bp, Homo sapiens
cctcccccaggctgc

SEQ ID NO: 1953405 - DNA, 17 bp, Homo sapiens
cctcccccgcagacaga

SEQ ID NO: 1953406 - DNA, 12 bp, Homo sapiens
cctcccctctcc

SEQ ID NO: 1953407 - DNA, 14 bp, Homo sapiens
cctcccctctcctg

SEQ ID NO: 1953408 - DNA, 15 bp, Homo sapiens
cctcccctctcctga

SEQ ID NO: 1953409 - DNA, 22 bp, Homo sapiens
cctcccctcttcttgcggcacc

SEQ ID NO: 1953410 - DNA, 14 bp, Homo sapiens
cctcccgccgcctc

SEQ ID NO: 1953411 - DNA, 16 bp, Homo sapiens
cctccgtccccagggt

SEQ ID NO: 1953412 - DNA, 14 bp, Homo sapiens
cctcctcgggcgcc

SEQ ID NO: 1953413 - DNA, 17 bp, Homo sapiens
cctcctcgggcgcctgc

SEQ ID NO: 1953414 - DNA, 11 bp, Homo sapiens
cctcctctgcc

SEQ ID NO: 1953415 - DNA, 20 bp, Homo sapiens
cctcctctgccccctccccc

SEQ ID NO: 1953416 - DNA, 23 bp, Homo sapiens
cctcctctgccccctcccccgca

SEQ ID NO: 1953417 - DNA, 20 bp, Homo sapiens
cctcctgtctcctctgtcag

SEQ ID NO: 1953418 - DNA, 16 bp, Homo sapiens
cctcgggccgcctcct

SEQ ID NO: 1953419 - DNA, 18 bp, Homo sapiens
cctcgggccgcctcctcc

SEQ ID NO: 1953420 - DNA, 18 bp, Homo sapiens
aaggagcagctagctgct

SEQ ID NO: 1953421 - DNA, 21 bp, Homo sapiens
aaggagcagctagctgctttt

SEQ ID NO: 1953422 - DNA, 17 bp, Homo sapiens
aaggcactaatgatgtt

SEQ ID NO: 1953423 - DNA, 22 bp, Homo sapiens
aaggcctgagggaagcccaccc

SEQ ID NO: 1953424 - DNA, 23 bp, Homo sapiens
aaggcctgagggaagcccacccg

SEQ ID NO: 1953425 - DNA, 15 bp, Homo sapiens
aaggggaattaacaa

SEQ ID NO: 1953426 - DNA, 13 bp, Homo sapiens
aaggttgtacata

SEQ ID NO: 1953427 - DNA, 16 bp, Homo sapiens
aaggttgtacatagtg

SEQ ID NO: 1953428 - DNA, 15 bp, Homo sapiens
aagtaataaattcca

SEQ ID NO: 1953429 - DNA, 16 bp, Homo sapiens
aagtcaaacagtgtgg

SEQ ID NO: 1953430 - DNA, 18 bp, Homo sapiens
aagtcaaacagtgtggct

SEQ ID NO: 1953431 - DNA, 13 bp, Homo sapiens
aagtcccttcctg

SEQ ID NO: 1953432 - DNA, 15 bp, Homo sapiens
aagtgatgtgattta

SEQ ID NO: 1953433 - DNA, 21 bp, Homo sapiens
aagtgatgtgatttatgcatt

SEQ ID NO: 1953434 - DNA, 23 bp, Homo sapiens
aagtgatgtgatttatgcattta

SEQ ID NO: 1953435 - DNA, 22 bp, Homo sapiens
aagtgattgacattttgtagct

SEQ ID NO: 1953436 - DNA, 16 bp, Homo sapiens
aagtgtgtgtgcaatg

SEQ ID NO: 1953437 - DNA, 17 bp, Homo sapiens
aagtgtgtgtgcaatgt

SEQ ID NO: 1953438 - DNA, 18 bp, Homo sapiens
aagttataccagcaaaag

SEQ ID NO: 1953439 - DNA, 16 bp, Homo sapiens
aagttattcagaaata

SEQ ID NO: 1953440 - DNA, 20 bp, Homo sapiens
aagttattcagaaatatccc

SEQ ID NO: 1953441 - DNA, 19 bp, Homo sapiens
aagttatttgatctggtgc

SEQ ID NO: 1953442 - DNA, 18 bp, Homo sapiens
aagttccagcagtttcat

SEQ ID NO: 1953443 - DNA, 11 bp, Homo sapiens
aataaaaatag

SEQ ID NO: 1953444 - DNA, 24 bp, Homo sapiens
aataaaaatagctataaatagtga

SEQ ID NO: 1953445 - DNA, 13 bp, Homo sapiens
aataaaaccagaa

SEQ ID NO: 1953446 - DNA, 15 bp, Homo sapiens
aataaccctgaatca

SEQ ID NO: 1953447 - DNA, 12 bp, Homo sapiens
aataatgaagat

SEQ ID NO: 1953448 - DNA, 20 bp, Homo sapiens
aataatttagaaataaaaga

SEQ ID NO: 1953449 - DNA, 19 bp, Homo sapiens
aatacaagttacatacatt

SEQ ID NO: 1953450 - DNA, 21 bp, Homo sapiens
aatacaagttacatacattta

SEQ ID NO: 1953451 - DNA, 15 bp, Homo sapiens
aatacattattagaa

SEQ ID NO: 1953452 - DNA, 17 bp, Homo sapiens
aatacattattagaata

SEQ ID NO: 1953453 - DNA, 14 bp, Homo sapiens
aatacttcttttta

SEQ ID NO: 1953454 - DNA, 16 bp, Homo sapiens
aatagcattgttcttc

SEQ ID NO: 1953455 - DNA, 22 bp, Homo sapiens
aatagctataaatagtgaaaat

SEQ ID NO: 1953456 - DNA, 13 bp, Homo sapiens
aataggatttgca

SEQ ID NO: 1953457 - DNA, 14 bp, Homo sapiens
aataggatttgcac

SEQ ID NO: 1953458 - DNA, 21 bp, Homo sapiens
aatagtcgggggaaaaaatta

SEQ ID NO: 1953459 - DNA, 13 bp, Homo sapiens
aatagtgaaaatt

SEQ ID NO: 1953460 - DNA, 21 bp, Homo sapiens
aatagtgaaaattttattgaa

SEQ ID NO: 1953461 - DNA, 15 bp, Homo sapiens
aatataaactgtgag

SEQ ID NO: 1953462 - DNA, 19 bp, Homo sapiens
aatataaactgtgagataa

SEQ ID NO: 1953463 - DNA, 20 bp, Homo sapiens
aatataatggcctcttaaaa

SEQ ID NO: 1953464 - DNA, 21 bp, Homo sapiens
aatatatgtttggctgaaatt

SEQ ID NO: 1953465 - DNA, 19 bp, Homo sapiens
aatatcaagaatagttgtc

SEQ ID NO: 1953466 - DNA, 22 bp, Homo sapiens
aatatcattatagcatgtaata

SEQ ID NO: 1953467 - DNA, 16 bp, Homo sapiens
aatatccaagcccagc

SEQ ID NO: 1953468 - DNA, 14 bp, Homo sapiens
aatatccctcattt

SEQ ID NO: 1953469 - DNA, 19 bp, Homo sapiens
aatatccctcatttcatta

SEQ ID NO: 1953470 - DNA, 15 bp, Homo sapiens
aatatgagattggaa

SEQ ID NO: 1953471 - DNA, 19 bp, Homo sapiens
aatatttgcgtaaatggtt

SEQ ID NO: 1953472 - DNA, 14 bp, Homo sapiens
aatcaaaaaattat

SEQ ID NO: 1953473 - DNA, 20 bp, Homo sapiens
aatcacctaattaatttcag

SEQ ID NO: 1953474 - DNA, 15 bp, Homo sapiens
aatcagaggcagaga

SEQ ID NO: 1953475 - DNA, 13 bp, Homo sapiens
aatcataatcatc

SEQ ID NO: 1953476 - DNA, 17 bp, Homo sapiens
aatcatttccagcaaaa

SEQ ID NO: 1953477 - DNA, 22 bp, Homo sapiens
aatcatttccagcaaaatatat

SEQ ID NO: 1953478 - DNA, 16 bp, Homo sapiens
aatcattttgggaaat

SEQ ID NO: 1953479 - DNA, 15 bp, Homo sapiens
aatccatgtgctgct

SEQ ID NO: 1953480 - DNA, 19 bp, Homo sapiens
aatccatgtgctgctgtgg

SEQ ID NO: 1953481 - DNA, 16 bp, Homo sapiens
aatccttgccttcaaa

SEQ ID NO: 1953482 - DNA, 15 bp, Homo sapiens
aatctactagaacct

SEQ ID NO: 1953483 - DNA, 14 bp, Homo sapiens
aatctatagcattt

SEQ ID NO: 1953484 - DNA, 18 bp, Homo sapiens
aatctatagcatttaaag

SEQ ID NO: 1953485 - DNA, 15 bp, Homo sapiens
aatctctcaaaatgt

SEQ ID NO: 1953486 - DNA, 18 bp, Homo sapiens
aatctctcaaaatgtgcc

SEQ ID NO: 1953487 - DNA, 22 bp, Homo sapiens
aatctctcaaaatgtgccgtct

SEQ ID NO: 1953488 - DNA, 16 bp, Homo sapiens
aatcttgctgtgaaac

SEQ ID NO: 1953489 - DNA, 18 bp, Homo sapiens
aatcttgctgtgaaacag

SEQ ID NO: 1953490 - DNA, 12 bp, Homo sapiens
aatgaaatactt

SEQ ID NO: 1953491 - DNA, 12 bp, Homo sapiens
aatgaaatataa

SEQ ID NO: 1953492 - DNA, 12 bp, Homo sapiens
aatgaatgaaat

SEQ ID NO: 1953493 - DNA, 13 bp, Homo sapiens
aatgaatgaaata

SEQ ID NO: 1953494 - DNA, 22 bp, Homo sapiens
aatgaatgaaatataaactgtg

SEQ ID NO: 1953495 - DNA, 21 bp, Homo sapiens
aatgatatgtctttaaaatga

SEQ ID NO: 1953496 - DNA, 21 bp, Homo sapiens
aatgcctttctagcaattgct

SEQ ID NO: 1953497 - DNA, 15 bp, Homo sapiens
aatgctcaatgtgct

SEQ ID NO: 1953498 - DNA, 16 bp, Homo sapiens
aatgctcaatgtgctg

SEQ ID NO: 1953499 - DNA, 23 bp, Homo sapiens
aatgcttcttttagtcagaaatg

SEQ ID NO: 1953500 - DNA, 15 bp, Homo sapiens
aatggatgtaatata

SEQ ID NO: 1953501 - DNA, 19 bp, Homo sapiens
aatggattttttttttcag

SEQ ID NO: 1953502 - DNA, 21 bp, Homo sapiens
aatggattttttttttcaggt

SEQ ID NO: 1953503 - DNA, 14 bp, Homo sapiens
aatggcctcttaaa

SEQ ID NO: 1953504 - DNA, 14 bp, Homo sapiens
aatggttttcaaca

SEQ ID NO: 1953505 - DNA, 16 bp, Homo sapiens
aatggttttcaacaag

SEQ ID NO: 1953506 - DNA, 19 bp, Homo sapiens
aatgtccaggtcacaggca

SEQ ID NO: 1953507 - DNA, 20 bp, Homo sapiens
aatgtgatcctaaaattgtt

SEQ ID NO: 1953508 - DNA, 18 bp, Homo sapiens
aatgtgctgttgattctt

SEQ ID NO: 1953509 - DNA, 15 bp, Homo sapiens
aatgtggaattacat

SEQ ID NO: 1953510 - DNA, 19 bp, Homo sapiens
aatgttattactgaggaaa

SEQ ID NO: 1953511 - DNA, 18 bp, Homo sapiens
aatgttccgttcatctga

SEQ ID NO: 1953512 - DNA, 15 bp, Homo sapiens
aatgttgaaaaagaa

SEQ ID NO: 1953513 - DNA, 16 bp, Homo sapiens
aatgttgaagaactca

SEQ ID NO: 1953514 - DNA, 12 bp, Homo sapiens
aattaaactgat

SEQ ID NO: 1953515 - DNA, 16 bp, Homo sapiens
aattaaccattgctaa

SEQ ID NO: 1953516 - DNA, 18 bp, Homo sapiens
aattaacttctattttca

SEQ ID NO: 1953517 - DNA, 13 bp, Homo sapiens
aattacataacag

SEQ ID NO: 1953518 - DNA, 18 bp, Homo sapiens
aattacataacaggcatt

SEQ ID NO: 1953519 - DNA, 17 bp, Homo sapiens
aattactttcagaatgt

SEQ ID NO: 1953520 - DNA, 16 bp, Homo sapiens
aattactttgaacatt

SEQ ID NO: 1953521 - DNA, 21 bp, Homo sapiens
aattagattttaaaacttcat

SEQ ID NO: 1953522 - DNA, 18 bp, Homo sapiens
aattagggctctaatttc

SEQ ID NO: 1953523 - DNA, 13 bp, Homo sapiens
aattatctttaaa

SEQ ID NO: 1953524 - DNA, 15 bp, Homo sapiens
aattatgtttgaaaa

SEQ ID NO: 1953525 - DNA, 22 bp, Homo sapiens
aattatgtttgaaaataggatt

SEQ ID NO: 1953526 - DNA, 16 bp, Homo sapiens
aattcaaacctaagtt

SEQ ID NO: 1953527 - DNA, 15 bp, Homo sapiens
aattcttgcactgta

SEQ ID NO: 1953528 - DNA, 14 bp, Homo sapiens
aattgctgagatgt

SEQ ID NO: 1953529 - DNA, 15 bp, Homo sapiens
aattgcttctctaaa

SEQ ID NO: 1953530 - DNA, 20 bp, Homo sapiens
aattgcttctctaaaacagc

SEQ ID NO: 1953531 - DNA, 16 bp, Homo sapiens
aatttaccagaaatat

SEQ ID NO: 1953532 - DNA, 15 bp, Homo sapiens
agagacggcagcccc

SEQ ID NO: 1953533 - DNA, 12 bp, Homo sapiens
agagactgccca

SEQ ID NO: 1953534 - DNA, 14 bp, Homo sapiens
agagactgcccacc

SEQ ID NO: 1953535 - DNA, 16 bp, Homo sapiens
agagcagcctcttgaa

SEQ ID NO: 1953536 - DNA, 16 bp, Homo sapiens
agagccccggagcacc

SEQ ID NO: 1953537 - DNA, 17 bp, Homo sapiens
agagcgatgtgttcttt

SEQ ID NO: 1953538 - DNA, 16 bp, Homo sapiens
agagcgccacccgccc

SEQ ID NO: 1953539 - DNA, 17 bp, Homo sapiens
agagcgccacccgcccg

SEQ ID NO: 1953540 - DNA, 16 bp, Homo sapiens
agagctatgcacacca

SEQ ID NO: 1953541 - DNA, 17 bp, Homo sapiens
agagctatgcacaccaa

SEQ ID NO: 1953542 - DNA, 21 bp, Homo sapiens
agagctgagtcggctgggcag

SEQ ID NO: 1953543 - DNA, 16 bp, Homo sapiens
agaggattagtagaaa

SEQ ID NO: 1953544 - DNA, 18 bp, Homo sapiens
agaggattagtagaaaat

SEQ ID NO: 1953545 - DNA, 13 bp, Homo sapiens
agaggcagggccc

SEQ ID NO: 1953546 - DNA, 13 bp, Homo sapiens
agagggctgagcc

SEQ ID NO: 1953547 - DNA, 14 bp, Homo sapiens
agagggctgagccc

SEQ ID NO: 1953548 - DNA, 17 bp, Homo sapiens
agagggctgagcccctc

SEQ ID NO: 1953549 - DNA, 19 bp, Homo sapiens
agagtcaggagaaacccct

SEQ ID NO: 1953550 - DNA, 22 bp, Homo sapiens
agagttgaggttgttaaaacag

SEQ ID NO: 1953551 - DNA, 13 bp, Homo sapiens
agataaaaggaga

SEQ ID NO: 1953552 - DNA, 22 bp, Homo sapiens
agataattaaatgaaatacttg

SEQ ID NO: 1953553 - DNA, 18 bp, Homo sapiens
agataccaaatagaaaca

SEQ ID NO: 1953554 - DNA, 14 bp, Homo sapiens
agatagctccttca

SEQ ID NO: 1953555 - DNA, 19 bp, Homo sapiens
agatatgaagaactattat

SEQ ID NO: 1953556 - DNA, 17 bp, Homo sapiens
agatcccaagtcaaaca

SEQ ID NO: 1953557 - DNA, 15 bp, Homo sapiens
agatccctcggtcag

SEQ ID NO: 1953558 - DNA, 13 bp, Homo sapiens
agatgaggctgga

SEQ ID NO: 1953559 - DNA, 15 bp, Homo sapiens
agatgaggctggata

SEQ ID NO: 1953560 - DNA, 18 bp, Homo sapiens
agatgatgtaaaaatatg

SEQ ID NO: 1953561 - DNA, 19 bp, Homo sapiens
agatgctgctgagcacatc

SEQ ID NO: 1953562 - DNA, 18 bp, Homo sapiens
agattaacctaatgcaga

SEQ ID NO: 1953563 - DNA, 14 bp, Homo sapiens
agattcctacttaa

SEQ ID NO: 1953564 - DNA, 16 bp, Homo sapiens
agattcctacttaaac

SEQ ID NO: 1953565 - DNA, 18 bp, Homo sapiens
agattggaaaaaattaga

SEQ ID NO: 1953566 - DNA, 12 bp, Homo sapiens
agatttcctttg

SEQ ID NO: 1953567 - DNA, 12 bp, Homo sapiens
agcaaaatatat

SEQ ID NO: 1953568 - DNA, 14 bp, Homo sapiens
agcaatcttgctgt

SEQ ID NO: 1953569 - DNA, 19 bp, Homo sapiens
agcaatcttgctgtgaaac

SEQ ID NO: 1953570 - DNA, 23 bp, Homo sapiens
agcaatcttgctgtgaaacagtg

SEQ ID NO: 1953571 - DNA, 15 bp, Homo sapiens
agcacatctcttcat

SEQ ID NO: 1953572 - DNA, 17 bp, Homo sapiens
agcaccagcctgagcca

SEQ ID NO: 1953573 - DNA, 15 bp, Homo sapiens
agcaccagctgcctc

SEQ ID NO: 1953574 - DNA, 11 bp, Homo sapiens
agcacccccag

SEQ ID NO: 1953575 - DNA, 12 bp, Homo sapiens
agcacccccagc

SEQ ID NO: 1953576 - DNA, 19 bp, Homo sapiens
agcacccccagcctccccc

SEQ ID NO: 1953577 - DNA, 20 bp, Homo sapiens
agcacccccagcctccccca

SEQ ID NO: 1953578 - DNA, 22 bp, Homo sapiens
agcacccccagcctcccccagg

SEQ ID NO: 1953579 - DNA, 16 bp, Homo sapiens
agcaccgtggtgtgag

SEQ ID NO: 1953580 - DNA, 17 bp, Homo sapiens
agcaccgtggtgtgagg

SEQ ID NO: 1953581 - DNA, 13 bp, Homo sapiens
agcacctcttgaa

SEQ ID NO: 1953582 - DNA, 12 bp, Homo sapiens
agcactcccagg

SEQ ID NO: 1953583 - DNA, 16 bp, Homo sapiens
agcactcccagggccc

SEQ ID NO: 1953584 - DNA, 18 bp, Homo sapiens
agcactcccagggcccga

SEQ ID NO: 1953585 - DNA, 18 bp, Homo sapiens
agcagagacggcagcccc

SEQ ID NO: 1953586 - DNA, 21 bp, Homo sapiens
agcagagacggcagccccatc

SEQ ID NO: 1953587 - DNA, 15 bp, Homo sapiens
agcagcagtttgtga

SEQ ID NO: 1953588 - DNA, 18 bp, Homo sapiens
agcagctagaaagagaaa

SEQ ID NO: 1953589 - DNA, 12 bp, Homo sapiens
agcagctagctg

SEQ ID NO: 1953590 - DNA, 15 bp, Homo sapiens
agcagctagctgctt

SEQ ID NO: 1953591 - DNA, 20 bp, Homo sapiens
agcagctagctgcttttctg

SEQ ID NO: 1953592 - DNA, 15 bp, Homo sapiens
agcagtaccatccca

SEQ ID NO: 1953593 - DNA, 13 bp, Homo sapiens
agcagtggggagc

SEQ ID NO: 1953594 - DNA, 17 bp, Homo sapiens
agcagtttgtgatctgt

SEQ ID NO: 1953595 - DNA, 17 bp, Homo sapiens
agcatgccaatttctct

SEQ ID NO: 1953596 - DNA, 15 bp, Homo sapiens
agcatgctccctcat

SEQ ID NO: 1953597 - DNA, 21 bp, Homo sapiens
agcatgtgggtgtcagtgtca

SEQ ID NO: 1953598 - DNA, 23 bp, Homo sapiens
agcattcaaatgaagattcagca

SEQ ID NO: 1953599 - DNA, 11 bp, Homo sapiens
agcatttaaag

SEQ ID NO: 1953600 - DNA, 22 bp, Homo sapiens
agcatttttctttagtcattta

SEQ ID NO: 1953601 - DNA, 13 bp, Homo sapiens
agccacagtgggg

SEQ ID NO: 1953602 - DNA, 14 bp, Homo sapiens
agccacagtggggc

SEQ ID NO: 1953603 - DNA, 15 bp, Homo sapiens
agccagttctgacag

SEQ ID NO: 1953604 - DNA, 17 bp, Homo sapiens
agcccacccgccccaga

SEQ ID NO: 1953605 - DNA, 19 bp, Homo sapiens
agcccacccgccccagaga

SEQ ID NO: 1953606 - DNA, 21 bp, Homo sapiens
agcccagaagctcaaggctgc

SEQ ID NO: 1953607 - DNA, 16 bp, Homo sapiens
agccccatccttcccg

SEQ ID NO: 1953608 - DNA, 20 bp, Homo sapiens
agccccatccttcccgcagc

SEQ ID NO: 1953609 - DNA, 21 bp, Homo sapiens
agccccatccttcccgcagca

SEQ ID NO: 1953610 - DNA, 19 bp, Homo sapiens
agccccggagcaccacggg

SEQ ID NO: 1953611 - DNA, 11 bp, Homo sapiens
agcccctcctc

SEQ ID NO: 1953612 - DNA, 14 bp, Homo sapiens
agcccctcctctcc

SEQ ID NO: 1953613 - DNA, 21 bp, Homo sapiens
agcccctgctggaccaaggtg

SEQ ID NO: 1953614 - DNA, 15 bp, Homo sapiens
agcccggccaaggac

SEQ ID NO: 1953615 - DNA, 19 bp, Homo sapiens
agcccggccaaggacactg

SEQ ID NO: 1953616 - DNA, 21 bp, Homo sapiens
agcccggccaaggacactgat

SEQ ID NO: 1953617 - DNA, 14 bp, Homo sapiens
agccctctttctct

SEQ ID NO: 1953618 - DNA, 18 bp, Homo sapiens
agccctctttctctctgt

SEQ ID NO: 1953619 - DNA, 19 bp, Homo sapiens
agccctctttctctctgtg

SEQ ID NO: 1953620 - DNA, 14 bp, Homo sapiens
agccgcgctctgcc

SEQ ID NO: 1953621 - DNA, 16 bp, Homo sapiens
agccgcgctctgcccc

SEQ ID NO: 1953622 - DNA, 19 bp, Homo sapiens
agccgcgctctgcccctcc

SEQ ID NO: 1953623 - DNA, 14 bp, Homo sapiens
agcctcccccaggc

SEQ ID NO: 1953624 - DNA, 16 bp, Homo sapiens
agcctcccccaggctg

SEQ ID NO: 1953625 - DNA, 22 bp, Homo sapiens
agcctcttgaatgcttaaatga

SEQ ID NO: 1953626 - DNA, 11 bp, Homo sapiens
agcctgagcca

SEQ ID NO: 1953627 - DNA, 12 bp, Homo sapiens
agcctgagctcc

SEQ ID NO: 1953628 - DNA, 13 bp, Homo sapiens
agcctgagctcca

SEQ ID NO: 1953629 - DNA, 16 bp, Homo sapiens
agcctgagctccaccc

SEQ ID NO: 1953630 - DNA, 15 bp, Homo sapiens
agcctttaataggct

SEQ ID NO: 1953631 - DNA, 15 bp, Homo sapiens
agcgcgtgccttccc

SEQ ID NO: 1953632 - DNA, 18 bp, Homo sapiens
agcggcccggcccacgca

SEQ ID NO: 1953633 - DNA, 19 bp, Homo sapiens
agcggcccggcccacgcag

SEQ ID NO: 1953634 - DNA, 21 bp, Homo sapiens
agcggcccggcccacgcagag

SEQ ID NO: 1953635 - DNA, 22 bp, Homo sapiens
agcggctgaggacggggcagag

SEQ ID NO: 1953636 - DNA, 13 bp, Homo sapiens
agcgggggctaac

SEQ ID NO: 1953637 - DNA, 19 bp, Homo sapiens
agcgggggctaactggccc

SEQ ID NO: 1953638 - DNA, 21 bp, Homo sapiens
agcgggggctaactggcccca

SEQ ID NO: 1953639 - DNA, 20 bp, Homo sapiens
agctaaatgaccatccagta

SEQ ID NO: 1953640 - DNA, 15 bp, Homo sapiens
agctaacaaaagata

SEQ ID NO: 1953641 - DNA, 17 bp, Homo sapiens
agctaagcctgatgatg

SEQ ID NO: 1953642 - DNA, 21 bp, Homo sapiens
agctagtttaaaattattaaa

SEQ ID NO: 1953643 - DNA, 12 bp, Homo sapiens
agctataaatag

SEQ ID NO: 1953644 - DNA, 14 bp, Homo sapiens
agctatgcacacca

SEQ ID NO: 1953645 - DNA, 17 bp, Homo sapiens
caagaatagttgtcaga

SEQ ID NO: 1953646 - DNA, 22 bp, Homo sapiens
caagaatagttgtcagaatatg

SEQ ID NO: 1953647 - DNA, 14 bp, Homo sapiens
caagaatgtttcag

SEQ ID NO: 1953648 - DNA, 19 bp, Homo sapiens
caagagtccaagccatctg

SEQ ID NO: 1953649 - DNA, 18 bp, Homo sapiens
caagcctgaaagtaattt

SEQ ID NO: 1953650 - DNA, 14 bp, Homo sapiens
caagctcacttgct

SEQ ID NO: 1953651 - DNA, 14 bp, Homo sapiens
caaggacactgatg

SEQ ID NO: 1953652 - DNA, 15 bp, Homo sapiens
caagtctagtggaac

SEQ ID NO: 1953653 - DNA, 11 bp, Homo sapiens
caagtctgtga

SEQ ID NO: 1953654 - DNA, 21 bp, Homo sapiens
caagtgtaataaatcaaaatt

SEQ ID NO: 1953655 - DNA, 14 bp, Homo sapiens
caagtgtgtgtgca

SEQ ID NO: 1953656 - DNA, 17 bp, Homo sapiens
caatactttgtgtcttt

SEQ ID NO: 1953657 - DNA, 18 bp, Homo sapiens
caatactttgtgtctttt

SEQ ID NO: 1953658 - DNA, 14 bp, Homo sapiens
caatcatgggaatt

SEQ ID NO: 1953659 - DNA, 16 bp, Homo sapiens
caatcattttgggaaa

SEQ ID NO: 1953660 - DNA, 15 bp, Homo sapiens
caatccacagtattg

SEQ ID NO: 1953661 - DNA, 17 bp, Homo sapiens
caatccacagtattgtt

SEQ ID NO: 1953662 - DNA, 20 bp, Homo sapiens
caatccccataatgcttctt

SEQ ID NO: 1953663 - DNA, 15 bp, Homo sapiens
caatcttgctgtgaa

SEQ ID NO: 1953664 - DNA, 20 bp, Homo sapiens
caatgctacaaaatgtgtgc

SEQ ID NO: 1953665 - DNA, 11 bp, Homo sapiens
caatgcttctt

SEQ ID NO: 1953666 - DNA, 22 bp, Homo sapiens
caatgcttcttttagtcagaaa

SEQ ID NO: 1953667 - DNA, 22 bp, Homo sapiens
caatgtgctgttgattctttca

SEQ ID NO: 1953668 - DNA, 16 bp, Homo sapiens
caatgtggaattacat

SEQ ID NO: 1953669 - DNA, 18 bp, Homo sapiens
caatgttccgttcatctg

SEQ ID NO: 1953670 - DNA, 17 bp, Homo sapiens
cacacaaaacaacagca

SEQ ID NO: 1953671 - DNA, 23 bp, Homo sapiens
cacacaaaacaacagcaacaaca

SEQ ID NO: 1953672 - DNA, 22 bp, Homo sapiens
cacacaaaacatcttaggcact

SEQ ID NO: 1953673 - DNA, 10 bp, Homo sapiens
cacacacaaa

SEQ ID NO: 1953674 - DNA, 13 bp, Homo sapiens
cacacacaaaaca

SEQ ID NO: 1953675 - DNA, 15 bp, Homo sapiens
cacacacacaaaaca

SEQ ID NO: 1953676 - DNA, 16 bp, Homo sapiens
cacacacacacacaaa

SEQ ID NO: 1953677 - DNA, 18 bp, Homo sapiens
cacacataacacacatca

SEQ ID NO: 1953678 - DNA, 15 bp, Homo sapiens
cacaccaaattgctg

SEQ ID NO: 1953679 - DNA, 17 bp, Homo sapiens
cacaccccgtctgcccc

SEQ ID NO: 1953680 - DNA, 21 bp, Homo sapiens
cacaccccgtctgccccttga

SEQ ID NO: 1953681 - DNA, 20 bp, Homo sapiens
cacacgccggggctggccct

SEQ ID NO: 1953682 - DNA, 14 bp, Homo sapiens
cacactcaccattt

SEQ ID NO: 1953683 - DNA, 20 bp, Homo sapiens
cacagacaagggggatgttg

SEQ ID NO: 1953684 - DNA, 20 bp, Homo sapiens
cacagtggggcccatggccc

SEQ ID NO: 1953685 - DNA, 13 bp, Homo sapiens
cacagtttgttca

SEQ ID NO: 1953686 - DNA, 15 bp, Homo sapiens
cacagtttgttcagt

SEQ ID NO: 1953687 - DNA, 13 bp, Homo sapiens
cacataacacaca

SEQ ID NO: 1953688 - DNA, 14 bp, Homo sapiens
cacataacacacat

SEQ ID NO: 1953689 - DNA, 19 bp, Homo sapiens
cacatcataaacaaagagt

SEQ ID NO: 1953690 - DNA, 15 bp, Homo sapiens
cacatccccaccctc

SEQ ID NO: 1953691 - DNA, 14 bp, Homo sapiens
cacatgcccctctt

SEQ ID NO: 1953692 - DNA, 20 bp, Homo sapiens
cacattcccatgaatatcaa

SEQ ID NO: 1953693 - DNA, 23 bp, Homo sapiens
caccaaattgctgagatgtttag

SEQ ID NO: 1953694 - DNA, 23 bp, Homo sapiens
caccacggggtcgggggaggagc

SEQ ID NO: 1953695 - DNA, 16 bp, Homo sapiens
caccatttcccctgtg

SEQ ID NO: 1953696 - DNA, 22 bp, Homo sapiens
cacccacaccccgtctgcccct

SEQ ID NO: 1953697 - DNA, 11 bp, Homo sapiens
cacccagcctg

SEQ ID NO: 1953698 - DNA, 10 bp, Homo sapiens
cacccccagc

SEQ ID NO: 1953699 - DNA, 13 bp, Homo sapiens
cacccccagcctc

SEQ ID NO: 1953700 - DNA, 14 bp, Homo sapiens
caccccgctgcctg

SEQ ID NO: 1953701 - DNA, 16 bp, Homo sapiens
caccccgctgcctggc

SEQ ID NO: 1953702 - DNA, 15 bp, Homo sapiens
caccccgtcccggcc

SEQ ID NO: 1953703 - DNA, 14 bp, Homo sapiens
caccccgtctgccc

SEQ ID NO: 1953704 - DNA, 15 bp, Homo sapiens
caccccgtctgcccc

SEQ ID NO: 1953705 - DNA, 13 bp, Homo sapiens
cacccgccccaga

SEQ ID NO: 1953706 - DNA, 14 bp, Homo sapiens
cacccgccccagag

SEQ ID NO: 1953707 - DNA, 15 bp, Homo sapiens
cacccgccccagaga

SEQ ID NO: 1953708 - DNA, 16 bp, Homo sapiens
cacccgccccagagac

SEQ ID NO: 1953709 - DNA, 17 bp, Homo sapiens
cacccgccccagagact

SEQ ID NO: 1953710 - DNA, 21 bp, Homo sapiens
cacccgccccagagactgccc

SEQ ID NO: 1953711 - DNA, 17 bp, Homo sapiens
cacccgtgttctcctcc

SEQ ID NO: 1953712 - DNA, 13 bp, Homo sapiens
caccctcccctct

SEQ ID NO: 1953713 - DNA, 14 bp, Homo sapiens
caccctcccctctt

SEQ ID NO: 1953714 - DNA, 18 bp, Homo sapiens
caccctgggcctcccgtc

SEQ ID NO: 1953715 - DNA, 22 bp, Homo sapiens
caccgagaggaaaaaggcttct

SEQ ID NO: 1953716 - DNA, 13 bp, Homo sapiens
caccgcccaccca

SEQ ID NO: 1953717 - DNA, 16 bp, Homo sapiens
caccgcccacccacac

SEQ ID NO: 1953718 - DNA, 22 bp, Homo sapiens
caccgcccacccacaccccgtc

SEQ ID NO: 1953719 - DNA, 20 bp, Homo sapiens
caccgtggtgtgaggccccc

SEQ ID NO: 1953720 - DNA, 21 bp, Homo sapiens
caccgtggtgtgaggcccccg

SEQ ID NO: 1953721 - DNA, 11 bp, Homo sapiens
cacctgcccag

SEQ ID NO: 1953722 - DNA, 12 bp, Homo sapiens
cacctgcccagt

SEQ ID NO: 1953723 - DNA, 18 bp, Homo sapiens
cacctgcccagttagccc

SEQ ID NO: 1953724 - DNA, 21 bp, Homo sapiens
cacctgcccagttagcccggc

SEQ ID NO: 1953725 - DNA, 15 bp, Homo sapiens
caccttctgtgcatc

SEQ ID NO: 1953726 - DNA, 20 bp, Homo sapiens
caccttgggcacgggagagc

SEQ ID NO: 1953727 - DNA, 16 bp, Homo sapiens
cacgcagagccccgga

SEQ ID NO: 1953728 - DNA, 16 bp, Homo sapiens
cacgccggggctggcc

SEQ ID NO: 1953729 - DNA, 17 bp, Homo sapiens
cacgccggggctggccc

SEQ ID NO: 1953730 - DNA, 22 bp, Homo sapiens
cacgccggggctggccctgccc

SEQ ID NO: 1953731 - DNA, 21 bp, Homo sapiens
cacggaggctcgtgcatgtaa

SEQ ID NO: 1953732 - DNA, 13 bp, Homo sapiens
cacggccgtccct

SEQ ID NO: 1953733 - DNA, 15 bp, Homo sapiens
cacgggagagcgcca

SEQ ID NO: 1953734 - DNA, 23 bp, Homo sapiens
cacgggcccgctcaacctctcag

SEQ ID NO: 1953735 - DNA, 19 bp, Homo sapiens
cacggggtcgggggaggag

SEQ ID NO: 1953736 - DNA, 22 bp, Homo sapiens
cactaatgatgttagtaacttt

SEQ ID NO: 1953737 - DNA, 12 bp, Homo sapiens
cactcccagggc

SEQ ID NO: 1953738 - DNA, 13 bp, Homo sapiens
cactcccagggcc

SEQ ID NO: 1953739 - DNA, 20 bp, Homo sapiens
cactctgaagtcccttcctg

SEQ ID NO: 1953740 - DNA, 22 bp, Homo sapiens
cactgatatcacgggcccgctc

SEQ ID NO: 1953741 - DNA, 22 bp, Homo sapiens
cactgatgggtcctgctgctcg

SEQ ID NO: 1953742 - DNA, 20 bp, Homo sapiens
cactgccatttcctcctggg

SEQ ID NO: 1953743 - DNA, 17 bp, Homo sapiens
cactgtcaagattaagt

SEQ ID NO: 1953744 - DNA, 14 bp, Homo sapiens
cacttatttccatg

SEQ ID NO: 1953745 - DNA, 14 bp, Homo sapiens
cactttcctctctc

SEQ ID NO: 1953746 - DNA, 11 bp, Homo sapiens
cagaaaagcac

SEQ ID NO: 1953747 - DNA, 16 bp, Homo sapiens
cagaaaagcacctctt

SEQ ID NO: 1953748 - DNA, 14 bp, Homo sapiens
cagaaatatttgct

SEQ ID NO: 1953749 - DNA, 13 bp, Homo sapiens
cagaaccagcact

SEQ ID NO: 1953750 - DNA, 18 bp, Homo sapiens
cagaaccagcactcccag

SEQ ID NO: 1953751 - DNA, 16 bp, Homo sapiens
cagaacgggcctcccc

SEQ ID NO: 1953752 - DNA, 22 bp, Homo sapiens
cagaagcagcagctagaaagag

SEQ ID NO: 1953753 - DNA, 17 bp, Homo sapiens
cagaagtgaaaaagact

SEQ ID NO: 1953754 - DNA, 22 bp, Homo sapiens
cagaattgctaggtaaagaggt

SEQ ID NO: 1953755 - DNA, 14 bp, Homo sapiens
cagacagacagacg

SEQ ID NO: 1953756 - DNA, 21 bp, Homo sapiens
cagacggacgggacagcggcc

SEQ ID NO: 1953757 - DNA, 18 bp, Homo sapiens
catccttcccgcagcacc

SEQ ID NO: 1953758 - DNA, 22 bp, Homo sapiens
catccttttttaaaaaaaagaa

SEQ ID NO: 1953759 - DNA, 17 bp, Homo sapiens
catctgaggagtccaaa

SEQ ID NO: 1953760 - DNA, 12 bp, Homo sapiens
catctggcctgg

SEQ ID NO: 1953761 - DNA, 13 bp, Homo sapiens
catctgtcagctt

SEQ ID NO: 1953762 - DNA, 16 bp, Homo sapiens
catgaatatcaagaat

SEQ ID NO: 1953763 - DNA, 15 bp, Homo sapiens
catgacagtagcata

SEQ ID NO: 1953764 - DNA, 18 bp, Homo sapiens
catgacagtagcatactg

SEQ ID NO: 1953765 - DNA, 15 bp, Homo sapiens
catgagaactaaata

SEQ ID NO: 1953766 - DNA, 16 bp, Homo sapiens
catgatgatttcagaa

SEQ ID NO: 1953767 - DNA, 19 bp, Homo sapiens
catgcccctcttagaagaa

SEQ ID NO: 1953768 - DNA, 17 bp, Homo sapiens
catgctaacctctctga

SEQ ID NO: 1953769 - DNA, 19 bp, Homo sapiens
catgctaacctctctgaac

SEQ ID NO: 1953770 - DNA, 9 bp, Homo sapiens
catgctcag

SEQ ID NO: 1953771 - DNA, 14 bp, Homo sapiens
catgctcagtattg

SEQ ID NO: 1953772 - DNA, 15 bp, Homo sapiens
catgctcagtattga

SEQ ID NO: 1953773 - DNA, 21 bp, Homo sapiens
catggagtagagtcaggagaa

SEQ ID NO: 1953774 - DNA, 12 bp, Homo sapiens
catggccccagc

SEQ ID NO: 1953775 - DNA, 18 bp, Homo sapiens
catggccccagctggctg

SEQ ID NO: 1953776 - DNA, 20 bp, Homo sapiens
catggccccagctggctggg

SEQ ID NO: 1953777 - DNA, 20 bp, Homo sapiens
catggtgaactgaagcagag

SEQ ID NO: 1953778 - DNA, 15 bp, Homo sapiens
catgtaatattaaat

SEQ ID NO: 1953779 - DNA, 17 bp, Homo sapiens
catgttggtaccctgga

SEQ ID NO: 1953780 - DNA, 13 bp, Homo sapiens
cattaaactaatt

SEQ ID NO: 1953781 - DNA, 17 bp, Homo sapiens
cattaagagttactcag

SEQ ID NO: 1953782 - DNA, 14 bp, Homo sapiens
cattcatcctctta

SEQ ID NO: 1953783 - DNA, 12 bp, Homo sapiens
cattgcactaaa

SEQ ID NO: 1953784 - DNA, 19 bp, Homo sapiens
cattgcactaaaagtgatg

SEQ ID NO: 1953785 - DNA, 21 bp, Homo sapiens
cattgttcagaaaagcacctc

SEQ ID NO: 1953786 - DNA, 22 bp, Homo sapiens
cattgttcagaaaagcacctct

SEQ ID NO: 1953787 - DNA, 23 bp, Homo sapiens
catttatgcatgagaactaaata

SEQ ID NO: 1953788 - DNA, 19 bp, Homo sapiens
catttcattatttttcaat

SEQ ID NO: 1953789 - DNA, 19 bp, Homo sapiens
catttccagcaaaatatat

SEQ ID NO: 1953790 - DNA, 18 bp, Homo sapiens
catttcccctgtggtttg

SEQ ID NO: 1953791 - DNA, 15 bp, Homo sapiens
cattttacagatttt

SEQ ID NO: 1953792 - DNA, 15 bp, Homo sapiens
cattttgaaatattc

SEQ ID NO: 1953793 - DNA, 13 bp, Homo sapiens
cattttgtagcta

SEQ ID NO: 1953794 - DNA, 16 bp, Homo sapiens
catttttctttagtca

SEQ ID NO: 1953795 - DNA, 23 bp, Homo sapiens
ccaaatgctgtcgggcaagatag

SEQ ID NO: 1953796 - DNA, 13 bp, Homo sapiens
ccaaattgctgag

SEQ ID NO: 1953797 - DNA, 19 bp, Homo sapiens
ccaacgatcatatctgtat

SEQ ID NO: 1953798 - DNA, 11 bp, Homo sapiens
ccaagcccagc

SEQ ID NO: 1953799 - DNA, 22 bp, Homo sapiens
ccaagttatttgatctggtgcg

SEQ ID NO: 1953800 - DNA, 10 bp, Homo sapiens
ccaatttctc

SEQ ID NO: 1953801 - DNA, 20 bp, Homo sapiens
ccacaagggtgcccacctct

SEQ ID NO: 1953802 - DNA, 12 bp, Homo sapiens
ccacaataggct

SEQ ID NO: 1953803 - DNA, 17 bp, Homo sapiens
ccacacgccggggctgg

SEQ ID NO: 1953804 - DNA, 18 bp, Homo sapiens
ccacacgccggggctggc

SEQ ID NO: 1953805 - DNA, 21 bp, Homo sapiens
ccacacgccggggctggccct

SEQ ID NO: 1953806 - DNA, 15 bp, Homo sapiens
ccacagtggggccca

SEQ ID NO: 1953807 - DNA, 22 bp, Homo sapiens
ccacagtggggcccatggcccc

SEQ ID NO: 1953808 - DNA, 21 bp, Homo sapiens
ccacattcccatgaatatcaa

SEQ ID NO: 1953809 - DNA, 13 bp, Homo sapiens
ccaccccgctgcc

SEQ ID NO: 1953810 - DNA, 14 bp, Homo sapiens
ccaccccgctgcct

SEQ ID NO: 1953811 - DNA, 20 bp, Homo sapiens
ccacccgccccagagactgc

SEQ ID NO: 1953812 - DNA, 12 bp, Homo sapiens
ccacccgcccgc

SEQ ID NO: 1953813 - DNA, 14 bp, Homo sapiens
ccaccctgggcctc

SEQ ID NO: 1953814 - DNA, 15 bp, Homo sapiens
ccaccctgggcctcc

SEQ ID NO: 1953815 - DNA, 17 bp, Homo sapiens
ccacctcggacaccatc

SEQ ID NO: 1953816 - DNA, 13 bp, Homo sapiens
ccacctgcccagt

SEQ ID NO: 1953817 - DNA, 14 bp, Homo sapiens
ccacgcagagcccc

SEQ ID NO: 1953818 - DNA, 15 bp, Homo sapiens
ccacgcagagccccg

SEQ ID NO: 1953819 - DNA, 20 bp, Homo sapiens
ccacgcagagccccggagca

SEQ ID NO: 1953820 - DNA, 17 bp, Homo sapiens
ccacggccgtccctgac

SEQ ID NO: 1953821 - DNA, 14 bp, Homo sapiens
ccacggtcctttga

SEQ ID NO: 1953822 - DNA, 20 bp, Homo sapiens
ccactagccctctttctctc

SEQ ID NO: 1953823 - DNA, 22 bp, Homo sapiens
ccactagccctctttctctctg

SEQ ID NO: 1953824 - DNA, 23 bp, Homo sapiens
ccactagccctctttctctctgt

SEQ ID NO: 1953825 - DNA, 16 bp, Homo sapiens
ccactttcctctctct

SEQ ID NO: 1953826 - DNA, 16 bp, Homo sapiens
ccagaacgggcctccc

SEQ ID NO: 1953827 - DNA, 20 bp, Homo sapiens
ccagaacgggcctccccggg

SEQ ID NO: 1953828 - DNA, 13 bp, Homo sapiens
ccagaagcagcag

SEQ ID NO: 1953829 - DNA, 19 bp, Homo sapiens
ccagaagctcaaggctgca

SEQ ID NO: 1953830 - DNA, 20 bp, Homo sapiens
ccagacgtgctcctgctgac

SEQ ID NO: 1953831 - DNA, 16 bp, Homo sapiens
ccagactcgagagggc

SEQ ID NO: 1953832 - DNA, 22 bp, Homo sapiens
ccagactcgagagggctgagcc

SEQ ID NO: 1953833 - DNA, 23 bp, Homo sapiens
ccagactcgagagggctgagccc

SEQ ID NO: 1953834 - DNA, 18 bp, Homo sapiens
ccagagactgcccaccct

SEQ ID NO: 1953835 - DNA, 21 bp, Homo sapiens
ccagagactgcccaccctggg

SEQ ID NO: 1953836 - DNA, 10 bp, Homo sapiens
ccagcaaaag

SEQ ID NO: 1953837 - DNA, 16 bp, Homo sapiens
ccagcactcccagggc

SEQ ID NO: 1953838 - DNA, 17 bp, Homo sapiens
ccagcactcccagggcc

SEQ ID NO: 1953839 - DNA, 19 bp, Homo sapiens
ccagcactcccagggcccg

SEQ ID NO: 1953840 - DNA, 21 bp, Homo sapiens
ccagcactcccagggcccgag

SEQ ID NO: 1953841 - DNA, 12 bp, Homo sapiens
ccagcctccccc

SEQ ID NO: 1953842 - DNA, 15 bp, Homo sapiens
ccagcctcccccagg

SEQ ID NO: 1953843 - DNA, 12 bp, Homo sapiens
ccagcctgagcc

SEQ ID NO: 1953844 - DNA, 19 bp, Homo sapiens
ccagcctgagccacagtgg

SEQ ID NO: 1953845 - DNA, 12 bp, Homo sapiens
ccagcgtggggc

SEQ ID NO: 1953846 - DNA, 23 bp, Homo sapiens
ccagcgtggggctaacgggcgcc

SEQ ID NO: 1953847 - DNA, 22 bp, Homo sapiens
ccagctgcctctttgctgcttt

SEQ ID NO: 1953848 - DNA, 12 bp, Homo sapiens
ccagctggcagc

SEQ ID NO: 1953849 - DNA, 15 bp, Homo sapiens
ccagctggcagcgcc

SEQ ID NO: 1953850 - DNA, 17 bp, Homo sapiens
ccagctggcagcgcctc

SEQ ID NO: 1953851 - DNA, 19 bp, Homo sapiens
ccagctggcagcgcctccc

SEQ ID NO: 1953852 - DNA, 22 bp, Homo sapiens
ccagctggctgggtcgcccctc

SEQ ID NO: 1953853 - DNA, 23 bp, Homo sapiens
ccagctggctgggtcgcccctcc

SEQ ID NO: 1953854 - DNA, 18 bp, Homo sapiens
ccaggcacggaggctcgt

SEQ ID NO: 1953855 - DNA, 13 bp, Homo sapiens
ccaggctgcgcct

SEQ ID NO: 1953856 - DNA, 16 bp, Homo sapiens
ccaggctgcgcctgcc

SEQ ID NO: 1953857 - DNA, 18 bp, Homo sapiens
ccaggctgcgcctgcccg

SEQ ID NO: 1953858 - DNA, 22 bp, Homo sapiens
ccagggcccgagcgcgtgcctt

SEQ ID NO: 1953859 - DNA, 15 bp, Homo sapiens
ccagggtgcaggcgc

SEQ ID NO: 1953860 - DNA, 16 bp, Homo sapiens
ccagggtgcaggcgcg

SEQ ID NO: 1953861 - DNA, 22 bp, Homo sapiens
ccaggtatctgatgatgttctg

SEQ ID NO: 1953862 - DNA, 16 bp, Homo sapiens
ccagtagagatttccc

SEQ ID NO: 1953863 - DNA, 14 bp, Homo sapiens
ccagtcttctagtg

SEQ ID NO: 1953864 - DNA, 16 bp, Homo sapiens
ccagttagcccggcca

SEQ ID NO: 1953865 - DNA, 19 bp, Homo sapiens
ccagttagcccggccaagg

SEQ ID NO: 1953866 - DNA, 21 bp, Homo sapiens
ccagttagcccggccaaggac

SEQ ID NO: 1953867 - DNA, 17 bp, Homo sapiens
ccagttccctcagccct

SEQ ID NO: 1953868 - DNA, 15 bp, Homo sapiens
ccatccttcccgcag

SEQ ID NO: 1953869 - DNA, 15 bp, Homo sapiens
cggcccacgcagagc

SEQ ID NO: 1953870 - DNA, 19 bp, Homo sapiens
cggcccacgcagagccccg

SEQ ID NO: 1953871 - DNA, 22 bp, Homo sapiens
cggcccacgcagagccccggag

SEQ ID NO: 1953872 - DNA, 12 bp, Homo sapiens
cggcccccctct

SEQ ID NO: 1953873 - DNA, 16 bp, Homo sapiens
cggccccgcgcgtgcc

SEQ ID NO: 1953874 - DNA, 22 bp, Homo sapiens
cggccccgcgcgtgcccccagc

SEQ ID NO: 1953875 - DNA, 15 bp, Homo sapiens
cggcccgccaccttg

SEQ ID NO: 1953876 - DNA, 18 bp, Homo sapiens
cggcccggcccacgcaga

SEQ ID NO: 1953877 - DNA, 15 bp, Homo sapiens
cggcccgtgcgcagc

SEQ ID NO: 1953878 - DNA, 17 bp, Homo sapiens
cggcccgtgcgcagccg

SEQ ID NO: 1953879 - DNA, 13 bp, Homo sapiens
cggcctgcagccc

SEQ ID NO: 1953880 - DNA, 18 bp, Homo sapiens
cggcctgcagcccagaac

SEQ ID NO: 1953881 - DNA, 23 bp, Homo sapiens
cggctgaggacggggcagagctg

SEQ ID NO: 1953882 - DNA, 14 bp, Homo sapiens
cggctggccggtcc

SEQ ID NO: 1953883 - DNA, 22 bp, Homo sapiens
cggctggccggtccaccccgtc

SEQ ID NO: 1953884 - DNA, 13 bp, Homo sapiens
cggctgggcaggg

SEQ ID NO: 1953885 - DNA, 14 bp, Homo sapiens
cggctgggcagggc

SEQ ID NO: 1953886 - DNA, 15 bp, Homo sapiens
cggctgggcagggcc

SEQ ID NO: 1953887 - DNA, 16 bp, Homo sapiens
cggctgggcagggccg

SEQ ID NO: 1953888 - DNA, 15 bp, Homo sapiens
cgggaaggcctgagg

SEQ ID NO: 1953889 - DNA, 20 bp, Homo sapiens
cgggaaggcctgagggaagc

SEQ ID NO: 1953890 - DNA, 16 bp, Homo sapiens
cgggacagcggcccgg

SEQ ID NO: 1953891 - DNA, 20 bp, Homo sapiens
cgggagagcgccacccgccc

SEQ ID NO: 1953892 - DNA, 20 bp, Homo sapiens
cgggcaagatagctccttca

SEQ ID NO: 1953893 - DNA, 12 bp, Homo sapiens
cgggcagcccct

SEQ ID NO: 1953894 - DNA, 18 bp, Homo sapiens
cgggcccgctcaacctct

SEQ ID NO: 1953895 - DNA, 21 bp, Homo sapiens
cgggcccgctcaacctctcag

SEQ ID NO: 1953896 - DNA, 13 bp, Homo sapiens
cgggccgcctcct

SEQ ID NO: 1953897 - DNA, 16 bp, Homo sapiens
cgggccgcctcctcca

SEQ ID NO: 1953898 - DNA, 21 bp, Homo sapiens
cgggccgcctcctccagactc

SEQ ID NO: 1953899 - DNA, 18 bp, Homo sapiens
cgggcgcctgcgctcctc

SEQ ID NO: 1953900 - DNA, 20 bp, Homo sapiens
cgggcgcctgcgctcctctg

SEQ ID NO: 1953901 - DNA, 23 bp, Homo sapiens
cgggcgcctgcgctcctctgcag

SEQ ID NO: 1953902 - DNA, 13 bp, Homo sapiens
cggggcagagctg

SEQ ID NO: 1953903 - DNA, 12 bp, Homo sapiens
cggggctggccc

SEQ ID NO: 1953904 - DNA, 17 bp, Homo sapiens
cggggctggccctgccc

SEQ ID NO: 1953905 - DNA, 20 bp, Homo sapiens
cggggctggccctgccctcc

SEQ ID NO: 1953906 - DNA, 17 bp, Homo sapiens
cgggggaggagcacccc

SEQ ID NO: 1953907 - DNA, 18 bp, Homo sapiens
cgggggaggagcaccccc

SEQ ID NO: 1953908 - DNA, 23 bp, Homo sapiens
cgggggaggagcacccccagcct

SEQ ID NO: 1953909 - DNA, 17 bp, Homo sapiens
cgggggctaactggccc

SEQ ID NO: 1953910 - DNA, 18 bp, Homo sapiens
cgggggctaactggcccc

SEQ ID NO: 1953911 - DNA, 23 bp, Homo sapiens
cgggggctaactggccccaggcg

SEQ ID NO: 1953912 - DNA, 18 bp, Homo sapiens
cggggtcgggggaggagc

SEQ ID NO: 1953913 - DNA, 21 bp, Homo sapiens
cgggtgcgtgaccggcccgcc

SEQ ID NO: 1953914 - DNA, 23 bp, Homo sapiens
cgggtgcgtgaccggcccgccac

SEQ ID NO: 1953915 - DNA, 12 bp, Homo sapiens
cggtccaccccg

SEQ ID NO: 1953916 - DNA, 21 bp, Homo sapiens
cggtcctttgagtgtcaggct

SEQ ID NO: 1953917 - DNA, 18 bp, Homo sapiens
cgtaaatggttttcaaca

SEQ ID NO: 1953918 - DNA, 11 bp, Homo sapiens
cgtccccaggg

SEQ ID NO: 1953919 - DNA, 12 bp, Homo sapiens
cgtccccagggt

SEQ ID NO: 1953920 - DNA, 22 bp, Homo sapiens
cgtcccggccccgcgcgtgccc

SEQ ID NO: 1953921 - DNA, 17 bp, Homo sapiens
cgtccctgacttcccag

SEQ ID NO: 1953922 - DNA, 17 bp, Homo sapiens
cgtccggcctgcagccc

SEQ ID NO: 1953923 - DNA, 10 bp, Homo sapiens
cgtctgcccc

SEQ ID NO: 1953924 - DNA, 13 bp, Homo sapiens
cgtgccttccccg

SEQ ID NO: 1953925 - DNA, 16 bp, Homo sapiens
cgtgccttccccgtgc

SEQ ID NO: 1953926 - DNA, 20 bp, Homo sapiens
cgtgcgcagccgcgctctgc

SEQ ID NO: 1953927 - DNA, 23 bp, Homo sapiens
cgtgcgcagccgcgctctgcccc

SEQ ID NO: 1953928 - DNA, 22 bp, Homo sapiens
cgtgcggcccgtgcgcagccgc

SEQ ID NO: 1953929 - DNA, 17 bp, Homo sapiens
cgtggcaactgtggaag

SEQ ID NO: 1953930 - DNA, 14 bp, Homo sapiens
cgtgtggccctgtg

SEQ ID NO: 1953931 - DNA, 15 bp, Homo sapiens
cgtgtggccctgtgg

SEQ ID NO: 1953932 - DNA, 23 bp, Homo sapiens
cgtgtggccctgtgggagtccac

SEQ ID NO: 1953933 - DNA, 18 bp, Homo sapiens
cgtgttctcctccaaatg

SEQ ID NO: 1953934 - DNA, 16 bp, Homo sapiens
ctaaaagtgatgtgat

SEQ ID NO: 1953935 - DNA, 22 bp, Homo sapiens
ctaaatagatttttagattcct

SEQ ID NO: 1953936 - DNA, 21 bp, Homo sapiens
ctaacaaaagatatgaagaac

SEQ ID NO: 1953937 - DNA, 17 bp, Homo sapiens
ctaactccttacagaag

SEQ ID NO: 1953938 - DNA, 17 bp, Homo sapiens
ctaactggccccaggcg

SEQ ID NO: 1953939 - DNA, 22 bp, Homo sapiens
ctaagataattaaatgaaatac

SEQ ID NO: 1953940 - DNA, 22 bp, Homo sapiens
ctaataagttcctctgaagact

SEQ ID NO: 1953941 - DNA, 14 bp, Homo sapiens
ctaattaatttcag

SEQ ID NO: 1953942 - DNA, 15 bp, Homo sapiens
ctaattaatttcagt

SEQ ID NO: 1953943 - DNA, 23 bp, Homo sapiens
ctacaaaaaaaatcaaaaaatta

SEQ ID NO: 1953944 - DNA, 13 bp, Homo sapiens
ctacaaagaaaaa

SEQ ID NO: 1953945 - DNA, 19 bp, Homo sapiens
ctacaattactttgaacat

SEQ ID NO: 1953946 - DNA, 16 bp, Homo sapiens
ctacaggggaggctga

SEQ ID NO: 1953947 - DNA, 23 bp, Homo sapiens
ctacttaaacaaaaactttccat

SEQ ID NO: 1953948 - DNA, 14 bp, Homo sapiens
ctagaaagagaaaa

SEQ ID NO: 1953949 - DNA, 21 bp, Homo sapiens
ctagaaagagaaaaagccctc

SEQ ID NO: 1953950 - DNA, 12 bp, Homo sapiens
ctagctgctttt

SEQ ID NO: 1953951 - DNA, 13 bp, Homo sapiens
ctagctgcttttc

SEQ ID NO: 1953952 - DNA, 22 bp, Homo sapiens
ctaggacatctctgtaaaaagc

SEQ ID NO: 1953953 - DNA, 22 bp, Homo sapiens
ctagtaggtctgcacacataac

SEQ ID NO: 1953954 - DNA, 16 bp, Homo sapiens
ctagtgatacggattt

SEQ ID NO: 1953955 - DNA, 15 bp, Homo sapiens
ctagtttaaaattat

SEQ ID NO: 1953956 - DNA, 16 bp, Homo sapiens
ctagtttaaaattatt

SEQ ID NO: 1953957 - DNA, 17 bp, Homo sapiens
ctataaatagtgaaaat

SEQ ID NO: 1953958 - DNA, 22 bp, Homo sapiens
ctatcagcagcggcagcagcag

SEQ ID NO: 1953959 - DNA, 18 bp, Homo sapiens
ctatgacactcatcaggt

SEQ ID NO: 1953960 - DNA, 16 bp, Homo sapiens
ctatgcacaccaaatt

SEQ ID NO: 1953961 - DNA, 21 bp, Homo sapiens
ctattagcttactgattaact

SEQ ID NO: 1953962 - DNA, 21 bp, Homo sapiens
ctcaaaatgtggaccagttcc

SEQ ID NO: 1953963 - DNA, 13 bp, Homo sapiens
ctcaacctctcag

SEQ ID NO: 1953964 - DNA, 18 bp, Homo sapiens
ctcaacctctcagatccc

SEQ ID NO: 1953965 - DNA, 15 bp, Homo sapiens
ctcaatgtgctgttg

SEQ ID NO: 1953966 - DNA, 20 bp, Homo sapiens
ctcaatgtgctgttgattct

SEQ ID NO: 1953967 - DNA, 15 bp, Homo sapiens
ctcaccatcttgaag

SEQ ID NO: 1953968 - DNA, 13 bp, Homo sapiens
ctcacccagcctg

SEQ ID NO: 1953969 - DNA, 23 bp, Homo sapiens
ctcacgtctgtgagtctgtcctt

SEQ ID NO: 1953970 - DNA, 16 bp, Homo sapiens
ctcagacacctagact

SEQ ID NO: 1953971 - DNA, 15 bp, Homo sapiens
ctcagaggagaggag

SEQ ID NO: 1953972 - DNA, 17 bp, Homo sapiens
ctcagaggagaggagca

SEQ ID NO: 1953973 - DNA, 18 bp, Homo sapiens
ctcagaggagaggagcaa

SEQ ID NO: 1953974 - DNA, 20 bp, Homo sapiens
ctcagccctcattaaactaa

SEQ ID NO: 1953975 - DNA, 12 bp, Homo sapiens
ctcagctccact

SEQ ID NO: 1953976 - DNA, 14 bp, Homo sapiens
ctcagctccactct

SEQ ID NO: 1953977 - DNA, 16 bp, Homo sapiens
ctcagctccactctga

SEQ ID NO: 1953978 - DNA, 17 bp, Homo sapiens
ctcagctccactctgaa

SEQ ID NO: 1953979 - DNA, 19 bp, Homo sapiens
ctcagctccactctgaagt

SEQ ID NO: 1953980 - DNA, 16 bp, Homo sapiens
gaatatgtatgtacct

SEQ ID NO: 1953981 - DNA, 17 bp, Homo sapiens
gaatatgtatgtacctg

SEQ ID NO: 1953982 - DNA, 18 bp, Homo sapiens
gaatattgtaactcacat

SEQ ID NO: 1953983 - DNA, 16 bp, Homo sapiens
gaatcaagtctgtgaa

SEQ ID NO: 1953984 - DNA, 19 bp, Homo sapiens
gaatcacctaattaatttc

SEQ ID NO: 1953985 - DNA, 15 bp, Homo sapiens
gaatcagaggcagag

SEQ ID NO: 1953986 - DNA, 16 bp, Homo sapiens
gaatcagaggcagaga

SEQ ID NO: 1953987 - DNA, 21 bp, Homo sapiens
gaatgaaatataaactgtgag

SEQ ID NO: 1953988 - DNA, 18 bp, Homo sapiens
gaatgctaagccagttct

SEQ ID NO: 1953989 - DNA, 16 bp, Homo sapiens
gaatgctcaatgtgct

SEQ ID NO: 1953990 - DNA, 18 bp, Homo sapiens
gaatgctcaatgtgctgt

SEQ ID NO: 1953991 - DNA, 18 bp, Homo sapiens
gaatgttgtcctgtgtca

SEQ ID NO: 1953992 - DNA, 15 bp, Homo sapiens
gaattaaccattgct

SEQ ID NO: 1953993 - DNA, 15 bp, Homo sapiens
gaattacataacagg

SEQ ID NO: 1953994 - DNA, 13 bp, Homo sapiens
gaattagttggca

SEQ ID NO: 1953995 - DNA, 20 bp, Homo sapiens
gaattttaaaaaagatggat

SEQ ID NO: 1953996 - DNA, 18 bp, Homo sapiens
gacaatgtggaattacat

SEQ ID NO: 1953997 - DNA, 21 bp, Homo sapiens
gacactgatgggtcctgctgc

SEQ ID NO: 1953998 - DNA, 23 bp, Homo sapiens
gacactgatgggtcctgctgctc

SEQ ID NO: 1953999 - DNA, 23 bp, Homo sapiens
gacagcaacaaagcataagacaa

SEQ ID NO: 1954000 - DNA, 17 bp, Homo sapiens
gacagcggcccggccca

SEQ ID NO: 1954001 - DNA, 21 bp, Homo sapiens
gacagcggcccggcccacgca

SEQ ID NO: 1954002 - DNA, 22 bp, Homo sapiens
gacagcggcccggcccacgcag

SEQ ID NO: 1954003 - DNA, 14 bp, Homo sapiens
gacagtagcatact

SEQ ID NO: 1954004 - DNA, 20 bp, Homo sapiens
gacagtgttttaggtgcctg

SEQ ID NO: 1954005 - DNA, 13 bp, Homo sapiens
gacattttgtagc

SEQ ID NO: 1954006 - DNA, 17 bp, Homo sapiens
gacattttgtagctagt

SEQ ID NO: 1954007 - DNA, 21 bp, Homo sapiens
gaccaaggtgcggaccggagc

SEQ ID NO: 1954008 - DNA, 10 bp, Homo sapiens
gaccccacac

SEQ ID NO: 1954009 - DNA, 18 bp, Homo sapiens
gaccggagcggctgagga

SEQ ID NO: 1954010 - DNA, 15 bp, Homo sapiens
gaccggcccgccacc

SEQ ID NO: 1954011 - DNA, 14 bp, Homo sapiens
gacctcaaaagaaa

SEQ ID NO: 1954012 - DNA, 14 bp, Homo sapiens
gacctcctgatgtc

SEQ ID NO: 1954013 - DNA, 19 bp, Homo sapiens
gacggacgggacagcggcc

SEQ ID NO: 1954014 - DNA, 14 bp, Homo sapiens
gacggcagccccat

SEQ ID NO: 1954015 - DNA, 18 bp, Homo sapiens
gacggcagccccatcctt

SEQ ID NO: 1954016 - DNA, 19 bp, Homo sapiens
gacgggacagcggcccggc

SEQ ID NO: 1954017 - DNA, 14 bp, Homo sapiens
gacggggcagagct

SEQ ID NO: 1954018 - DNA, 15 bp, Homo sapiens
gacggggcagagctg

SEQ ID NO: 1954019 - DNA, 23 bp, Homo sapiens
gactccccgcccgccctcctctg

SEQ ID NO: 1954020 - DNA, 15 bp, Homo sapiens
gactcgagagggctg

SEQ ID NO: 1954021 - DNA, 20 bp, Homo sapiens
gactcgagagggctgagccc

SEQ ID NO: 1954022 - DNA, 22 bp, Homo sapiens
gactctaaaactatcagcagcg

SEQ ID NO: 1954023 - DNA, 14 bp, Homo sapiens
gactgcccaccctg

SEQ ID NO: 1954024 - DNA, 19 bp, Homo sapiens
gactgcccaccctgggcct

SEQ ID NO: 1954025 - DNA, 18 bp, Homo sapiens
gactgtcttcaaccctgc

SEQ ID NO: 1954026 - DNA, 21 bp, Homo sapiens
gactgtcttcaaccctgccct

SEQ ID NO: 1954027 - DNA, 16 bp, Homo sapiens
gacttcccagctggca

SEQ ID NO: 1954028 - DNA, 21 bp, Homo sapiens
gacttcccagctggcagcgcc

SEQ ID NO: 1954029 - DNA, 22 bp, Homo sapiens
gacttcccagctggcagcgcct

SEQ ID NO: 1954030 - DNA, 24 bp, Homo sapiens
gacttcccagctggcagcgcctcc

SEQ ID NO: 1954031 - DNA, 21 bp, Homo sapiens
gacttctctgtcctctgcttt

SEQ ID NO: 1954032 - DNA, 16 bp, Homo sapiens
gactttcctatgacac

SEQ ID NO: 1954033 - DNA, 15 bp, Homo sapiens
gagaaaaagccctct

SEQ ID NO: 1954034 - DNA, 14 bp, Homo sapiens
gagaaggaggaacc

SEQ ID NO: 1954035 - DNA, 22 bp, Homo sapiens
gagacaacacacacacacacaa

SEQ ID NO: 1954036 - DNA, 14 bp, Homo sapiens
gagacggcagcccc

SEQ ID NO: 1954037 - DNA, 16 bp, Homo sapiens
gagacggcagccccat

SEQ ID NO: 1954038 - DNA, 19 bp, Homo sapiens
gagacggcagccccatcct

SEQ ID NO: 1954039 - DNA, 11 bp, Homo sapiens
gagactgccca

SEQ ID NO: 1954040 - DNA, 13 bp, Homo sapiens
gagactgcccacc

SEQ ID NO: 1954041 - DNA, 15 bp, Homo sapiens
gagactgcccaccct

SEQ ID NO: 1954042 - DNA, 16 bp, Homo sapiens
gagactgcccaccctg

SEQ ID NO: 1954043 - DNA, 20 bp, Homo sapiens
gagactgcccaccctgggcc

SEQ ID NO: 1954044 - DNA, 18 bp, Homo sapiens
gagacttctaaatcataa

SEQ ID NO: 1954045 - DNA, 14 bp, Homo sapiens
gagagagcaatctt

SEQ ID NO: 1954046 - DNA, 22 bp, Homo sapiens
gagagagcaatcttgctgtgaa

SEQ ID NO: 1954047 - DNA, 13 bp, Homo sapiens
gagagcgccaccc

SEQ ID NO: 1954048 - DNA, 15 bp, Homo sapiens
gagagggctgagccc

SEQ ID NO: 1954049 - DNA, 20 bp, Homo sapiens
gagagggctgagcccctcct

SEQ ID NO: 1954050 - DNA, 15 bp, Homo sapiens
gagatgcagtattga

SEQ ID NO: 1954051 - DNA, 17 bp, Homo sapiens
gagattggaaaaaatta

SEQ ID NO: 1954052 - DNA, 19 bp, Homo sapiens
gagattggaaaaaattaga

SEQ ID NO: 1954053 - DNA, 20 bp, Homo sapiens
gagcaatcttgctgtgaaac

SEQ ID NO: 1954054 - DNA, 12 bp, Homo sapiens
gagcacccccag

SEQ ID NO: 1954055 - DNA, 15 bp, Homo sapiens
gagcacccccagcct

SEQ ID NO: 1954056 - DNA, 20 bp, Homo sapiens
gagcagagacggcagcccca

SEQ ID NO: 1954057 - DNA, 17 bp, Homo sapiens
gagcagctagctgcttt

SEQ ID NO: 1954058 - DNA, 21 bp, Homo sapiens
gagcccagaagctcaaggctg

SEQ ID NO: 1954059 - DNA, 12 bp, Homo sapiens
gagccccggagc

SEQ ID NO: 1954060 - DNA, 16 bp, Homo sapiens
gagccccggagcacca

SEQ ID NO: 1954061 - DNA, 15 bp, Homo sapiens
gagcccctcctctcc

SEQ ID NO: 1954062 - DNA, 17 bp, Homo sapiens
gagcccctcctctcctc

SEQ ID NO: 1954063 - DNA, 18 bp, Homo sapiens
gagcccctcctctcctcg

SEQ ID NO: 1954064 - DNA, 13 bp, Homo sapiens
gagcctgtctctc

SEQ ID NO: 1954065 - DNA, 16 bp, Homo sapiens
gagcctgtctctccct

SEQ ID NO: 1954066 - DNA, 16 bp, Homo sapiens
gagcgatgtgttcttt

SEQ ID NO: 1954067 - DNA, 17 bp, Homo sapiens
gagcgatgtgttctttg

SEQ ID NO: 1954068 - DNA, 12 bp, Homo sapiens
gagcgccacccg

SEQ ID NO: 1954069 - DNA, 22 bp, Homo sapiens
gagcgccacccgcccgcccccg

SEQ ID NO: 1954070 - DNA, 14 bp, Homo sapiens
gagcggctgaggac

SEQ ID NO: 1954071 - DNA, 15 bp, Homo sapiens
gagctccaccctccc

SEQ ID NO: 1954072 - DNA, 18 bp, Homo sapiens
gagctccaccctcccctc

SEQ ID NO: 1954073 - DNA, 22 bp, Homo sapiens
gagctccaccctcccctcttct

SEQ ID NO: 1954074 - DNA, 16 bp, Homo sapiens
gaggaaaaggcttgag

SEQ ID NO: 1954075 - DNA, 14 bp, Homo sapiens
gaggaacccccatg

SEQ ID NO: 1954076 - DNA, 10 bp, Homo sapiens
gaggagcacc

SEQ ID NO: 1954077 - DNA, 11 bp, Homo sapiens
gaggagcaccc

SEQ ID NO: 1954078 - DNA, 14 bp, Homo sapiens
gaggagcaccccca

SEQ ID NO: 1954079 - DNA, 18 bp, Homo sapiens
gaggagcacccccagcct

SEQ ID NO: 1954080 - DNA, 21 bp, Homo sapiens
gaggagcacccccagcctccc

SEQ ID NO: 1954081 - DNA, 22 bp, Homo sapiens
gaggagcacccccagcctcccc

SEQ ID NO: 1954082 - DNA, 20 bp, Homo sapiens
gaggattagtagaaaataca

SEQ ID NO: 1954083 - DNA, 14 bp, Homo sapiens
gaggcagggccctg

SEQ ID NO: 1954084 - DNA, 15 bp, Homo sapiens
gaggcagggccctgg

SEQ ID NO: 1954085 - DNA, 16 bp, Homo sapiens
gaggcagggccctggg

SEQ ID NO: 1954086 - DNA, 17 bp, Homo sapiens
gaggcagggccctgggg

SEQ ID NO: 1954087 - DNA, 13 bp, Homo sapiens
gaggcccccggag

SEQ ID NO: 1954088 - DNA, 15 bp, Homo sapiens
gaggcgcccacctgc

SEQ ID NO: 1954089 - DNA, 20 bp, Homo sapiens
gaggctggataggagaggaa

SEQ ID NO: 1954090 - DNA, 12 bp, Homo sapiens
gagggctgagcc

SEQ ID NO: 1954091 - DNA, 18 bp, Homo sapiens
gagggctgagcccctcct

SEQ ID NO: 1954092 - DNA, 18 bp, Homo sapiens
gcctgagggaagcccacc

SEQ ID NO: 1954093 - DNA, 20 bp, Homo sapiens
gcctgagggaagcccacccg

SEQ ID NO: 1954094 - DNA, 22 bp, Homo sapiens
gcctgagggaagcccacccgcc

SEQ ID NO: 1954095 - DNA, 12 bp, Homo sapiens
gcctgcagccca

SEQ ID NO: 1954096 - DNA, 14 bp, Homo sapiens
gcctgcagcccaga

SEQ ID NO: 1954097 - DNA, 14 bp, Homo sapiens
gcctgcgctcctct

SEQ ID NO: 1954098 - DNA, 21 bp, Homo sapiens
gcctgcgctcctctgcagcct

SEQ ID NO: 1954099 - DNA, 16 bp, Homo sapiens
gcctggaggagaagga

SEQ ID NO: 1954100 - DNA, 19 bp, Homo sapiens
gcctggaggagaaggagga

SEQ ID NO: 1954101 - DNA, 13 bp, Homo sapiens
gcctggcgggcag

SEQ ID NO: 1954102 - DNA, 16 bp, Homo sapiens
gcctggcgggcagccc

SEQ ID NO: 1954103 - DNA, 19 bp, Homo sapiens
gcctggcgggcagcccctg

SEQ ID NO: 1954104 - DNA, 22 bp, Homo sapiens
gcctggcgggcagcccctgctg

SEQ ID NO: 1954105 - DNA, 21 bp, Homo sapiens
gccttcactacaacattagaa

SEQ ID NO: 1954106 - DNA, 16 bp, Homo sapiens
gcgcagccgcgctctg

SEQ ID NO: 1954107 - DNA, 15 bp, Homo sapiens
gcgccacccgcccgc

SEQ ID NO: 1954108 - DNA, 15 bp, Homo sapiens
gcgcccacctgccca

SEQ ID NO: 1954109 - DNA, 16 bp, Homo sapiens
gcgcccacctgcccag

SEQ ID NO: 1954110 - DNA, 17 bp, Homo sapiens
gcgcctcccgccgcctc

SEQ ID NO: 1954111 - DNA, 11 bp, Homo sapiens
gcgcctgcccg

SEQ ID NO: 1954112 - DNA, 15 bp, Homo sapiens
gcgcctgcgctcctc

SEQ ID NO: 1954113 - DNA, 16 bp, Homo sapiens
gcgcctgcgctcctct

SEQ ID NO: 1954114 - DNA, 22 bp, Homo sapiens
gcgcctgcgctcctctgcagcc

SEQ ID NO: 1954115 - DNA, 13 bp, Homo sapiens
gcgcgcaccgccc

SEQ ID NO: 1954116 - DNA, 13 bp, Homo sapiens
gcgcgtgccttcc

SEQ ID NO: 1954117 - DNA, 14 bp, Homo sapiens
gcgcgtgccttccc

SEQ ID NO: 1954118 - DNA, 21 bp, Homo sapiens
gcgctccggcagaggcagggc

SEQ ID NO: 1954119 - DNA, 22 bp, Homo sapiens
gcgctccggcagaggcagggcc

SEQ ID NO: 1954120 - DNA, 15 bp, Homo sapiens
gcgctcctctgcagc

SEQ ID NO: 1954121 - DNA, 17 bp, Homo sapiens
gcgctcctctgcagcct

SEQ ID NO: 1954122 - DNA, 22 bp, Homo sapiens
gcgctcctctgcagcctgagct

SEQ ID NO: 1954123 - DNA, 13 bp, Homo sapiens
gcgctctgcccct

SEQ ID NO: 1954124 - DNA, 14 bp, Homo sapiens
gcgctctgcccctc

SEQ ID NO: 1954125 - DNA, 20 bp, Homo sapiens
gcgctctgcccctccgtccc

SEQ ID NO: 1954126 - DNA, 21 bp, Homo sapiens
gcggaccggagcggctgagga

SEQ ID NO: 1954127 - DNA, 23 bp, Homo sapiens
gcggaggggcttggagcagagac

SEQ ID NO: 1954128 - DNA, 15 bp, Homo sapiens
gcggcaccgcccacc

SEQ ID NO: 1954129 - DNA, 14 bp, Homo sapiens
gcggcccggcccac

SEQ ID NO: 1954130 - DNA, 17 bp, Homo sapiens
gcggcccggcccacgca

SEQ ID NO: 1954131 - DNA, 12 bp, Homo sapiens
gcggctgaggac

SEQ ID NO: 1954132 - DNA, 12 bp, Homo sapiens
gcgggcagcccc

SEQ ID NO: 1954133 - DNA, 14 bp, Homo sapiens
gcgtgcccccagcg

SEQ ID NO: 1954134 - DNA, 11 bp, Homo sapiens
gcgtgtggccc

SEQ ID NO: 1954135 - DNA, 13 bp, Homo sapiens
gctaacgggcgcc

SEQ ID NO: 1954136 - DNA, 13 bp, Homo sapiens
gctaactggcccc

SEQ ID NO: 1954137 - DNA, 14 bp, Homo sapiens
gctaactggcccca

SEQ ID NO: 1954138 - DNA, 15 bp, Homo sapiens
gctaactggccccag

SEQ ID NO: 1954139 - DNA, 16 bp, Homo sapiens
gctaagcctgatgatg

SEQ ID NO: 1954140 - DNA, 16 bp, Homo sapiens
gctacaaaatgtgtgc

SEQ ID NO: 1954141 - DNA, 23 bp, Homo sapiens
gctacagatgtacattaaatacc

SEQ ID NO: 1954142 - DNA, 16 bp, Homo sapiens
gctacaggggaggctg

SEQ ID NO: 1954143 - DNA, 15 bp, Homo sapiens
gctagaaagagaaaa

SEQ ID NO: 1954144 - DNA, 14 bp, Homo sapiens
gctagccatatatt

SEQ ID NO: 1954145 - DNA, 22 bp, Homo sapiens
gctatgcacaccaaattgctga

SEQ ID NO: 1954146 - DNA, 13 bp, Homo sapiens
gctcaacctctca

SEQ ID NO: 1954147 - DNA, 20 bp, Homo sapiens
gctcaacctctcagatccct

SEQ ID NO: 1954148 - DNA, 17 bp, Homo sapiens
gctcaaggctgcagtga

SEQ ID NO: 1954149 - DNA, 14 bp, Homo sapiens
gctcaatgtgctgt

SEQ ID NO: 1954150 - DNA, 22 bp, Homo sapiens
gctcacgtctgtgagtctgtcc

SEQ ID NO: 1954151 - DNA, 15 bp, Homo sapiens
gctcagctatgaaat

SEQ ID NO: 1954152 - DNA, 20 bp, Homo sapiens
gctcagtaacacagtgcagt

SEQ ID NO: 1954153 - DNA, 22 bp, Homo sapiens
gctcagtaacacagtgcagtgc

SEQ ID NO: 1954154 - DNA, 19 bp, Homo sapiens
gctccaccctcccctcttc

SEQ ID NO: 1954155 - DNA, 15 bp, Homo sapiens
gctcccacctcggac

SEQ ID NO: 1954156 - DNA, 17 bp, Homo sapiens
gctccctcatgcagata

SEQ ID NO: 1954157 - DNA, 12 bp, Homo sapiens
gctccggcagag

SEQ ID NO: 1954158 - DNA, 14 bp, Homo sapiens
gctccggcagaggc

SEQ ID NO: 1954159 - DNA, 21 bp, Homo sapiens
gctccggcagaggcagggccc

SEQ ID NO: 1954160 - DNA, 22 bp, Homo sapiens
gctccgggtgcgtgaccggccc

SEQ ID NO: 1954161 - DNA, 19 bp, Homo sapiens
gctcctctgcagcctgagc

SEQ ID NO: 1954162 - DNA, 19 bp, Homo sapiens
gctcctgctgaccttctgc

SEQ ID NO: 1954163 - DNA, 17 bp, Homo sapiens
gctccttcatgcttttc

SEQ ID NO: 1954164 - DNA, 22 bp, Homo sapiens
gctcggccaggcacggaggctc

SEQ ID NO: 1954165 - DNA, 13 bp, Homo sapiens
gctcgtgcatgta

SEQ ID NO: 1954166 - DNA, 23 bp, Homo sapiens
gctctctcacccagcctggtact

SEQ ID NO: 1954167 - DNA, 15 bp, Homo sapiens
gctctgaatctctca

SEQ ID NO: 1954168 - DNA, 17 bp, Homo sapiens
gctctgaatctctcaaa

SEQ ID NO: 1954169 - DNA, 22 bp, Homo sapiens
gctctgaatctctcaaaatgtg

SEQ ID NO: 1954170 - DNA, 11 bp, Homo sapiens
gctctgcccct

SEQ ID NO: 1954171 - DNA, 13 bp, Homo sapiens
gctctgcccctcc

SEQ ID NO: 1954172 - DNA, 14 bp, Homo sapiens
gctctgcccctccg

SEQ ID NO: 1954173 - DNA, 12 bp, Homo sapiens
gctgaataacaa

SEQ ID NO: 1954174 - DNA, 15 bp, Homo sapiens
gctgaataacaacaa

SEQ ID NO: 1954175 - DNA, 23 bp, Homo sapiens
gctgactcttactaaccaccatt

SEQ ID NO: 1954176 - DNA, 18 bp, Homo sapiens
gctgagatgtttagtagc

SEQ ID NO: 1954177 - DNA, 19 bp, Homo sapiens
gctgagatgtttagtagct

SEQ ID NO: 1954178 - DNA, 14 bp, Homo sapiens
gctgagcccctcct

SEQ ID NO: 1954179 - DNA, 19 bp, Homo sapiens
gctgagcccctcctctcct

SEQ ID NO: 1954180 - DNA, 15 bp, Homo sapiens
gctgagtcggctggg

SEQ ID NO: 1954181 - DNA, 19 bp, Homo sapiens
gctgagtcggctgggcagg

SEQ ID NO: 1954182 - DNA, 20 bp, Homo sapiens
gctgagtcggctgggcaggg

SEQ ID NO: 1954183 - DNA, 22 bp, Homo sapiens
gctgagtcggctgggcagggcc

SEQ ID NO: 1954184 - DNA, 11 bp, Homo sapiens
gctgcctggcg

SEQ ID NO: 1954185 - DNA, 17 bp, Homo sapiens
gctgcctggcgggcagc

SEQ ID NO: 1954186 - DNA, 18 bp, Homo sapiens
gctgcctggcgggcagcc

SEQ ID NO: 1954187 - DNA, 13 bp, Homo sapiens
gctgcgcctgccc

SEQ ID NO: 1954188 - DNA, 14 bp, Homo sapiens
gctgcgcctgcccg

SEQ ID NO: 1954189 - DNA, 19 bp, Homo sapiens
gctgcttttgatggctatg

SEQ ID NO: 1954190 - DNA, 14 bp, Homo sapiens
gctggccctgccct

SEQ ID NO: 1954191 - DNA, 17 bp, Homo sapiens
gctggccctgccctccc

SEQ ID NO: 1954192 - DNA, 19 bp, Homo sapiens
gctggccctgccctccccc

SEQ ID NO: 1954193 - DNA, 21 bp, Homo sapiens
gctggctgggtcgcccctcct

SEQ ID NO: 1954194 - DNA, 18 bp, Homo sapiens
gctgggcagggccgcagg

SEQ ID NO: 1954195 - DNA, 23 bp, Homo sapiens
gctgggcagggccgcagggcgct

SEQ ID NO: 1954196 - DNA, 17 bp, Homo sapiens
gctgtaaataaaaatag

SEQ ID NO: 1954197 - DNA, 20 bp, Homo sapiens
gctgtgaaacagtgtggatg

SEQ ID NO: 1954198 - DNA, 16 bp, Homo sapiens
gctgttcattgatgac

SEQ ID NO: 1954199 - DNA, 16 bp, Homo sapiens
gctgttgattctttca

SEQ ID NO: 1954200 - DNA, 12 bp, Homo sapiens
gcttaaacattt

SEQ ID NO: 1954201 - DNA, 13 bp, Homo sapiens
gcttaaacatttt

SEQ ID NO: 1954202 - DNA, 15 bp, Homo sapiens
gcttaatctagagct

SEQ ID NO: 1954203 - DNA, 22 bp, Homo sapiens
gcttaatctagagctatgcaca

SEQ ID NO: 1954204 - DNA, 17 bp, Homo sapiens
gttccagcagtttcatg

SEQ ID NO: 1954205 - DNA, 19 bp, Homo sapiens
gttccctcagccctcatta

SEQ ID NO: 1954206 - DNA, 14 bp, Homo sapiens
gttctgacagtgtt

SEQ ID NO: 1954207 - DNA, 15 bp, Homo sapiens
gttcttgagcagctg

SEQ ID NO: 1954208 - DNA, 19 bp, Homo sapiens
gttcttgtaaaactgtgac

SEQ ID NO: 1954209 - DNA, 13 bp, Homo sapiens
gttctttgtacct

SEQ ID NO: 1954210 - DNA, 17 bp, Homo sapiens
gttgcttaatctagagc

SEQ ID NO: 1954211 - DNA, 14 bp, Homo sapiens
gttggagtgcagtg

SEQ ID NO: 1954212 - DNA, 15 bp, Homo sapiens
gttggagtgcagtgg

SEQ ID NO: 1954213 - DNA, 15 bp, Homo sapiens
gttggcagagaaaat

SEQ ID NO: 1954214 - DNA, 15 bp, Homo sapiens
gttggccggctggcc

SEQ ID NO: 1954215 - DNA, 20 bp, Homo sapiens
gttggccggctggccggtcc

SEQ ID NO: 1954216 - DNA, 18 bp, Homo sapiens
gttgtcctgtgtcatctg

SEQ ID NO: 1954217 - DNA, 13 bp, Homo sapiens
gttgtcctttctg

SEQ ID NO: 1954218 - DNA, 16 bp, Homo sapiens
gttgtcctttctgatc

SEQ ID NO: 1954219 - DNA, 15 bp, Homo sapiens
gtttcactgttcatg

SEQ ID NO: 1954220 - DNA, 22 bp, Homo sapiens
gtttccagctaagcctgatgat

SEQ ID NO: 1954221 - DNA, 19 bp, Homo sapiens
gtttccatcaaagccctcc

SEQ ID NO: 1954222 - DNA, 16 bp, Homo sapiens
gtttccgtagcagttt

SEQ ID NO: 1954223 - DNA, 18 bp, Homo sapiens
gtttcctaaatcagcatt

SEQ ID NO: 1954224 - DNA, 19 bp, Homo sapiens
gtttgcttctaaaggtttc

SEQ ID NO: 1954225 - DNA, 19 bp, Homo sapiens
gtttgttatcagtacaatt

SEQ ID NO: 1954226 - DNA, 19 bp, Homo sapiens
gttttcaacaagcctgaaa

SEQ ID NO: 1954227 - DNA, 18 bp, Homo sapiens
gtttttgttcaccttctg

SEQ ID NO: 1954228 - DNA, 15 bp, Homo sapiens
taaaaaaataatata

SEQ ID NO: 1954229 - DNA, 18 bp, Homo sapiens
taaaaaaataatataaat

SEQ ID NO: 1954230 - DNA, 21 bp, Homo sapiens
taaaaaaatcccatttatgca

SEQ ID NO: 1954231 - DNA, 17 bp, Homo sapiens
taaaaattatctttaaa

SEQ ID NO: 1954232 - DNA, 12 bp, Homo sapiens
taaaacaaaatc

SEQ ID NO: 1954233 - DNA, 22 bp, Homo sapiens
taaaacagaaaaggttctgaat

SEQ ID NO: 1954234 - DNA, 13 bp, Homo sapiens
taaaactgtgaca

SEQ ID NO: 1954235 - DNA, 14 bp, Homo sapiens
taaaactgtgacat

SEQ ID NO: 1954236 - DNA, 18 bp, Homo sapiens
taaaagaaagatgctgat

SEQ ID NO: 1954237 - DNA, 17 bp, Homo sapiens
taaaaggagagaaagca

SEQ ID NO: 1954238 - DNA, 19 bp, Homo sapiens
taaaagtaataaattccaa

SEQ ID NO: 1954239 - DNA, 15 bp, Homo sapiens
taaaagtgatgtgat

SEQ ID NO: 1954240 - DNA, 13 bp, Homo sapiens
taaaatacttctt

SEQ ID NO: 1954241 - DNA, 14 bp, Homo sapiens
taaaatgattcact

SEQ ID NO: 1954242 - DNA, 20 bp, Homo sapiens
taaacattttttgtttcttg

SEQ ID NO: 1954243 - DNA, 11 bp, Homo sapiens
taaactgtgag

SEQ ID NO: 1954244 - DNA, 18 bp, Homo sapiens
taaactgtgagataaata

SEQ ID NO: 1954245 - DNA, 13 bp, Homo sapiens
taaagataccaaa

SEQ ID NO: 1954246 - DNA, 20 bp, Homo sapiens
taaaggagcagctagctgct

SEQ ID NO: 1954247 - DNA, 20 bp, Homo sapiens
taaatatcattatagcatgt

SEQ ID NO: 1954248 - DNA, 14 bp, Homo sapiens
taaatcagcatttt

SEQ ID NO: 1954249 - DNA, 16 bp, Homo sapiens
taaatctaaattaact

SEQ ID NO: 1954250 - DNA, 17 bp, Homo sapiens
taaatctaaattaactt

SEQ ID NO: 1954251 - DNA, 21 bp, Homo sapiens
taaatctaaattaacttctat

SEQ ID NO: 1954252 - DNA, 14 bp, Homo sapiens
taaatgaaatactt

SEQ ID NO: 1954253 - DNA, 17 bp, Homo sapiens
taaatgaatgaaatata

SEQ ID NO: 1954254 - DNA, 22 bp, Homo sapiens
taaatgaatgaaatataaactg

SEQ ID NO: 1954255 - DNA, 24 bp, Homo sapiens
taaatgaccatccagtagagattt

SEQ ID NO: 1954256 - DNA, 15 bp, Homo sapiens
taaattcaaacctaa

SEQ ID NO: 1954257 - DNA, 16 bp, Homo sapiens
taaattcctcctgtct

SEQ ID NO: 1954258 - DNA, 23 bp, Homo sapiens
taaattttataaggctgactctt

SEQ ID NO: 1954259 - DNA, 20 bp, Homo sapiens
taacaaaagatatgaagaac

SEQ ID NO: 1954260 - DNA, 13 bp, Homo sapiens
taacaaagtgaga

SEQ ID NO: 1954261 - DNA, 11 bp, Homo sapiens
taacaacaatt

SEQ ID NO: 1954262 - DNA, 22 bp, Homo sapiens
taacaacaatttaggaatgctc

SEQ ID NO: 1954263 - DNA, 17 bp, Homo sapiens
taacaggcattgcacta

SEQ ID NO: 1954264 - DNA, 18 bp, Homo sapiens
taacattatattcccaaa

SEQ ID NO: 1954265 - DNA, 23 bp, Homo sapiens
taacattatattcccaaatctca

SEQ ID NO: 1954266 - DNA, 15 bp, Homo sapiens
taacattctatttca

SEQ ID NO: 1954267 - DNA, 15 bp, Homo sapiens
taacattgtaaatga

SEQ ID NO: 1954268 - DNA, 20 bp, Homo sapiens
taaccctgaatcagaggcag

SEQ ID NO: 1954269 - DNA, 17 bp, Homo sapiens
taactacctttggctta

SEQ ID NO: 1954270 - DNA, 21 bp, Homo sapiens
taactacctttggcttaattc

SEQ ID NO: 1954271 - DNA, 11 bp, Homo sapiens
taactggcccc

SEQ ID NO: 1954272 - DNA, 19 bp, Homo sapiens
taacttgctgtgaaatgac

SEQ ID NO: 1954273 - DNA, 20 bp, Homo sapiens
taacttgctgtgaaatgact

SEQ ID NO: 1954274 - DNA, 22 bp, Homo sapiens
taacttttgggatttgttgaaa

SEQ ID NO: 1954275 - DNA, 20 bp, Homo sapiens
taagaatttaccagaaatat

SEQ ID NO: 1954276 - DNA, 21 bp, Homo sapiens
taagataattaaatgaaatac

SEQ ID NO: 1954277 - DNA, 19 bp, Homo sapiens
taagcacaaccatgttctt

SEQ ID NO: 1954278 - DNA, 13 bp, Homo sapiens
taagcctgatgat

SEQ ID NO: 1954279 - DNA, 13 bp, Homo sapiens
taaggctgactct

SEQ ID NO: 1954280 - DNA, 22 bp, Homo sapiens
taaggtcagtgttataaaatct

SEQ ID NO: 1954281 - DNA, 18 bp, Homo sapiens
taagttataccagcaaaa

SEQ ID NO: 1954282 - DNA, 19 bp, Homo sapiens
taagttataccagcaaaag

SEQ ID NO: 1954283 - DNA, 14 bp, Homo sapiens
taataaattccaat

SEQ ID NO: 1954284 - DNA, 12 bp, Homo sapiens
taatataaatga

SEQ ID NO: 1954285 - DNA, 14 bp, Homo sapiens
taatataaatgaat

SEQ ID NO: 1954286 - DNA, 21 bp, Homo sapiens
taatataaatgaatgaaatat

SEQ ID NO: 1954287 - DNA, 19 bp, Homo sapiens
taatctagagctatgcaca

SEQ ID NO: 1954288 - DNA, 23 bp, Homo sapiens
taatctagagctatgcacaccaa

SEQ ID NO: 1954289 - DNA, 16 bp, Homo sapiens
taatgcagaattgcta

SEQ ID NO: 1954290 - DNA, 16 bp, Homo sapiens
taatgtttagtcagtg

SEQ ID NO: 1954291 - DNA, 12 bp, Homo sapiens
taattaaatgaa

SEQ ID NO: 1954292 - DNA, 15 bp, Homo sapiens
taattaaatgaaata

SEQ ID NO: 1954293 - DNA, 18 bp, Homo sapiens
taattaaatgaaatactt

SEQ ID NO: 1954294 - DNA, 20 bp, Homo sapiens
taattactttcagaatgttg

SEQ ID NO: 1954295 - DNA, 23 bp, Homo sapiens
taattctcagaagtgaaaaagac

SEQ ID NO: 1954296 - DNA, 13 bp, Homo sapiens
taatttagaaata

SEQ ID NO: 1954297 - DNA, 14 bp, Homo sapiens
taatttcaagaatg

SEQ ID NO: 1954298 - DNA, 16 bp, Homo sapiens
taatttcaagaatgtt

SEQ ID NO: 1954299 - DNA, 17 bp, Homo sapiens
taatttcaagaatgttt

SEQ ID NO: 1954300 - DNA, 17 bp, Homo sapiens
tacaaagaaaaaagaag

SEQ ID NO: 1954301 - DNA, 16 bp, Homo sapiens
tacaacattagaatat

SEQ ID NO: 1954302 - DNA, 16 bp, Homo sapiens
tacaattactttgaac

SEQ ID NO: 1954303 - DNA, 17 bp, Homo sapiens
tacacagaaatcctaac

SEQ ID NO: 1954304 - DNA, 16 bp, Homo sapiens
tacagaggacatacca

SEQ ID NO: 1954305 - DNA, 19 bp, Homo sapiens
tacagatgatgtaaaaata

SEQ ID NO: 1954306 - DNA, 15 bp, Homo sapiens
tacaggggaggctga

SEQ ID NO: 1954307 - DNA, 15 bp, Homo sapiens
tacataacaggcatt

SEQ ID NO: 1954308 - DNA, 13 bp, Homo sapiens
tacatacatttaa

SEQ ID NO: 1954309 - DNA, 15 bp, Homo sapiens
tacatatgataaatt

SEQ ID NO: 1954310 - DNA, 17 bp, Homo sapiens
tacatgatgatttcaga

SEQ ID NO: 1954311 - DNA, 20 bp, Homo sapiens
tacattaaataccagccagc

SEQ ID NO: 1954312 - DNA, 15 bp, Homo sapiens
tacatttatgtgtga

SEQ ID NO: 1954313 - DNA, 14 bp, Homo sapiens
taccaaatgccttt

SEQ ID NO: 1954314 - DNA, 18 bp, Homo sapiens
taccagcaaaagtgcagt

SEQ ID NO: 1954315 - DNA, 14 bp, Homo sapiens
taccatcccactga

SEQ ID NO: 1954316 - DNA, 14 bp, Homo sapiens
tctgttcttcattt

SEQ ID NO: 1954317 - DNA, 18 bp, Homo sapiens
tcttaaaaattatcttta

SEQ ID NO: 1954318 - DNA, 20 bp, Homo sapiens
tcttaaaaattatctttaaa

SEQ ID NO: 1954319 - DNA, 23 bp, Homo sapiens
tcttaaatttgggttgcaaagct

SEQ ID NO: 1954320 - DNA, 20 bp, Homo sapiens
tcttcaaccctgccctgcac

SEQ ID NO: 1954321 - DNA, 15 bp, Homo sapiens
tcttctcagctccac

SEQ ID NO: 1954322 - DNA, 15 bp, Homo sapiens
tcttcttttcccatt

SEQ ID NO: 1954323 - DNA, 19 bp, Homo sapiens
tcttgcggcaccgcccacc

SEQ ID NO: 1954324 - DNA, 20 bp, Homo sapiens
tcttgcggcaccgcccaccc

SEQ ID NO: 1954325 - DNA, 14 bp, Homo sapiens
tctttactaacact

SEQ ID NO: 1954326 - DNA, 12 bp, Homo sapiens
tctttagtcatt

SEQ ID NO: 1954327 - DNA, 13 bp, Homo sapiens
tctttatgatttc

SEQ ID NO: 1954328 - DNA, 16 bp, Homo sapiens
tctttatgatttcatg

SEQ ID NO: 1954329 - DNA, 20 bp, Homo sapiens
tctttcaatccacagtattg

SEQ ID NO: 1954330 - DNA, 14 bp, Homo sapiens
tctttctctctgtg

SEQ ID NO: 1954331 - DNA, 16 bp, Homo sapiens
tctttctgcagaaaat

SEQ ID NO: 1954332 - DNA, 14 bp, Homo sapiens
tctttctttccaaa

SEQ ID NO: 1954333 - DNA, 18 bp, Homo sapiens
tctttggttcctcatggc

SEQ ID NO: 1954334 - DNA, 14 bp, Homo sapiens
tctttgttgcttaa

SEQ ID NO: 1954335 - DNA, 19 bp, Homo sapiens
tcttttagtcagaaatgat

SEQ ID NO: 1954336 - DNA, 20 bp, Homo sapiens
tcttttagtcagaaatgatt

SEQ ID NO: 1954337 - DNA, 21 bp, Homo sapiens
tcttttcccatttacaaatga

SEQ ID NO: 1954338 - DNA, 19 bp, Homo sapiens
tcttttcctgcttagaatt

SEQ ID NO: 1954339 - DNA, 14 bp, Homo sapiens
tcttttgttctctc

SEQ ID NO: 1954340 - DNA, 17 bp, Homo sapiens
tgaaaacctctttcgga

SEQ ID NO: 1954341 - DNA, 19 bp, Homo sapiens
tgaaagtaatttcaagaat

SEQ ID NO: 1954342 - DNA, 14 bp, Homo sapiens
tgaaagtcagttta

SEQ ID NO: 1954343 - DNA, 21 bp, Homo sapiens
tgaaagtcagtttaagaggct

SEQ ID NO: 1954344 - DNA, 20 bp, Homo sapiens
tgaaagtctcctgtatcatt

SEQ ID NO: 1954345 - DNA, 17 bp, Homo sapiens
tgaaatataaactgtga

SEQ ID NO: 1954346 - DNA, 19 bp, Homo sapiens
tgaaatataaactgtgaga

SEQ ID NO: 1954347 - DNA, 20 bp, Homo sapiens
tgaaatataaactgtgagat

SEQ ID NO: 1954348 - DNA, 14 bp, Homo sapiens
tgaaattatgtcaa

SEQ ID NO: 1954349 - DNA, 22 bp, Homo sapiens
tgaaattatgtcaaatggatgt

SEQ ID NO: 1954350 - DNA, 17 bp, Homo sapiens
tgaagattcagcagtgt

SEQ ID NO: 1954351 - DNA, 19 bp, Homo sapiens
tgaagattcagcagtgtct

SEQ ID NO: 1954352 - DNA, 16 bp, Homo sapiens
tgaagcagagtcaagc

SEQ ID NO: 1954353 - DNA, 18 bp, Homo sapiens
tgaagtcccttcctgtcc

SEQ ID NO: 1954354 - DNA, 20 bp, Homo sapiens
tgaagtcccttcctgtcctg

SEQ ID NO: 1954355 - DNA, 16 bp, Homo sapiens
tgaagtgattgacatt

SEQ ID NO: 1954356 - DNA, 15 bp, Homo sapiens
tgaatcagaggcaga

SEQ ID NO: 1954357 - DNA, 19 bp, Homo sapiens
tgaatcagaggcagagacc

SEQ ID NO: 1954358 - DNA, 19 bp, Homo sapiens
tgaatctctcaaaatgtgc

SEQ ID NO: 1954359 - DNA, 20 bp, Homo sapiens
tgaatctctcaaaatgtgcc

SEQ ID NO: 1954360 - DNA, 21 bp, Homo sapiens
tgaatgttgtcctgtgtcatc

SEQ ID NO: 1954361 - DNA, 16 bp, Homo sapiens
tgaattggctgccaag

SEQ ID NO: 1954362 - DNA, 20 bp, Homo sapiens
tgacagcatttcagctgtga

SEQ ID NO: 1954363 - DNA, 16 bp, Homo sapiens
tgacagtagcatactg

SEQ ID NO: 1954364 - DNA, 21 bp, Homo sapiens
tgacagtagcatactgatgag

SEQ ID NO: 1954365 - DNA, 16 bp, Homo sapiens
tgacattttgtagcta

SEQ ID NO: 1954366 - DNA, 18 bp, Homo sapiens
tgacattttgtagctagt

SEQ ID NO: 1954367 - DNA, 20 bp, Homo sapiens
tgacattttgtagctagttt

SEQ ID NO: 1954368 - DNA, 13 bp, Homo sapiens
tgaccataaaatt

SEQ ID NO: 1954369 - DNA, 20 bp, Homo sapiens
tgaccatccagtagagattt

SEQ ID NO: 1954370 - DNA, 13 bp, Homo sapiens
tgaccccacacgc

SEQ ID NO: 1954371 - DNA, 15 bp, Homo sapiens
tgacctcaaaagaaa

SEQ ID NO: 1954372 - DNA, 17 bp, Homo sapiens
tgacctcaaaagaaaat

SEQ ID NO: 1954373 - DNA, 14 bp, Homo sapiens
tgactagatatcaa

SEQ ID NO: 1954374 - DNA, 22 bp, Homo sapiens
tgactagatatcaatcagtaat

SEQ ID NO: 1954375 - DNA, 15 bp, Homo sapiens
tgactcctcaattcc

SEQ ID NO: 1954376 - DNA, 23 bp, Homo sapiens
tgactcttactaaccaccatttc

SEQ ID NO: 1954377 - DNA, 16 bp, Homo sapiens
tgacttcccagctggc

SEQ ID NO: 1954378 - DNA, 17 bp, Homo sapiens
tgacttcccagctggca

SEQ ID NO: 1954379 - DNA, 18 bp, Homo sapiens
tgacttcccagctggcag

SEQ ID NO: 1954380 - DNA, 22 bp, Homo sapiens
tgacttcccagctggcagcgcc

SEQ ID NO: 1954381 - DNA, 15 bp, Homo sapiens
tgacttcctgaactc

SEQ ID NO: 1954382 - DNA, 20 bp, Homo sapiens
tgacttctttactaacactg

SEQ ID NO: 1954383 - DNA, 22 bp, Homo sapiens
tgacttctttactaacactggc

SEQ ID NO: 1954384 - DNA, 16 bp, Homo sapiens
tgagaactaaatagat

SEQ ID NO: 1954385 - DNA, 16 bp, Homo sapiens
tgagacaacacacaca

SEQ ID NO: 1954386 - DNA, 15 bp, Homo sapiens
tgagacactgtcaag

SEQ ID NO: 1954387 - DNA, 22 bp, Homo sapiens
tgagacactgtcaagattaagt

SEQ ID NO: 1954388 - DNA, 14 bp, Homo sapiens
tgagagcagcctct

SEQ ID NO: 1954389 - DNA, 18 bp, Homo sapiens
tgagattggaaaaaatta

SEQ ID NO: 1954390 - DNA, 20 bp, Homo sapiens
tgagattggaaaaaattaga

SEQ ID NO: 1954391 - DNA, 19 bp, Homo sapiens
tgagcacctttcctgaaat

SEQ ID NO: 1954392 - DNA, 21 bp, Homo sapiens
tgagcagtaaatgtatattga

SEQ ID NO: 1954393 - DNA, 12 bp, Homo sapiens
tgagcagtgggg

SEQ ID NO: 1954394 - DNA, 15 bp, Homo sapiens
tgagcagtggggagc

SEQ ID NO: 1954395 - DNA, 17 bp, Homo sapiens
tgagcagtggggagcgg

SEQ ID NO: 1954396 - DNA, 21 bp, Homo sapiens
tgagcagtggggagcgggggc

SEQ ID NO: 1954397 - DNA, 23 bp, Homo sapiens
tgagccacagtggggcccatggc

SEQ ID NO: 1954398 - DNA, 23 bp, Homo sapiens
tgagcccagaagctcaaggctgc

SEQ ID NO: 1954399 - DNA, 11 bp, Homo sapiens
tgagcccctcc

SEQ ID NO: 1954400 - DNA, 17 bp, Homo sapiens
tgagcccctcctctcct

SEQ ID NO: 1954401 - DNA, 13 bp, Homo sapiens
tgagcctgtctct

SEQ ID NO: 1954402 - DNA, 14 bp, Homo sapiens
tgagcctgtctctc

SEQ ID NO: 1954403 - DNA, 13 bp, Homo sapiens
tgagctccaccct

SEQ ID NO: 1954404 - DNA, 17 bp, Homo sapiens
tgaggacataaatcttc

SEQ ID NO: 1954405 - DNA, 14 bp, Homo sapiens
tgaggcccccggag

SEQ ID NO: 1954406 - DNA, 18 bp, Homo sapiens
tgaggctggataggagag

SEQ ID NO: 1954407 - DNA, 16 bp, Homo sapiens
tgagggaagcccaccc

SEQ ID NO: 1954408 - DNA, 22 bp, Homo sapiens
tgagggaagcccacccgcccca

SEQ ID NO: 1954409 - DNA, 19 bp, Homo sapiens
tgaggtcttgagtttcatt

SEQ ID NO: 1954410 - DNA, 21 bp, Homo sapiens
tgaggtcttgagtttcatttt

SEQ ID NO: 1954411 - DNA, 20 bp, Homo sapiens
tgagtcctcattgttcagaa

SEQ ID NO: 1954412 - DNA, 15 bp, Homo sapiens
tgagtcggctgggca

SEQ ID NO: 1954413 - DNA, 17 bp, Homo sapiens
tgagtcggctgggcagg

SEQ ID NO: 1954414 - DNA, 19 bp, Homo sapiens
tgagtcggctgggcagggc

SEQ ID NO: 1954415 - DNA, 21 bp, Homo sapiens
tgagtcggctgggcagggccg

SEQ ID NO: 1954416 - DNA, 18 bp, Homo sapiens
tgagtttccagctaagcc

SEQ ID NO: 1954417 - DNA, 16 bp, Homo sapiens
tgataaagaaaccttt

SEQ ID NO: 1954418 - DNA, 21 bp, Homo sapiens
tgataactcaccatcttgaag

SEQ ID NO: 1954419 - DNA, 20 bp, Homo sapiens
tgatacaacaggattttcaa

SEQ ID NO: 1954420 - DNA, 21 bp, Homo sapiens
tgatacaacaggattttcaag

SEQ ID NO: 1954421 - DNA, 13 bp, Homo sapiens
tgatagaacaaaa

SEQ ID NO: 1954422 - DNA, 18 bp, Homo sapiens
tgatatcacgggcccgct

SEQ ID NO: 1954423 - DNA, 14 bp, Homo sapiens
tgatatgtctttaa

SEQ ID NO: 1954424 - DNA, 16 bp, Homo sapiens
tgatatgtctttaaaa

SEQ ID NO: 1954425 - DNA, 17 bp, Homo sapiens
tgatattcctacaaaga

SEQ ID NO: 1954426 - DNA, 19 bp, Homo sapiens
tgatattcctacaaagaaa

SEQ ID NO: 1954427 - DNA, 19 bp, Homo sapiens
ttctctatgtacagatgat

SEQ ID NO: 1954428 - DNA, 12 bp, Homo sapiens
ttctgcagaaaa

SEQ ID NO: 1954429 - DNA, 14 bp, Homo sapiens
ttctgcagaaaatt

SEQ ID NO: 1954430 - DNA, 14 bp, Homo sapiens
ttctgtcagtctga

SEQ ID NO: 1954431 - DNA, 14 bp, Homo sapiens
ttctgtgcatctgg

SEQ ID NO: 1954432 - DNA, 23 bp, Homo sapiens
ttctgtgcatctggcctgggggc

SEQ ID NO: 1954433 - DNA, 11 bp, Homo sapiens
ttctgtgcctc

SEQ ID NO: 1954434 - DNA, 15 bp, Homo sapiens
ttcttcatttctata

SEQ ID NO: 1954435 - DNA, 21 bp, Homo sapiens
ttcttcgcagctcatcttttc

SEQ ID NO: 1954436 - DNA, 20 bp, Homo sapiens
ttcttctcccctttcaaatt

SEQ ID NO: 1954437 - DNA, 19 bp, Homo sapiens
ttcttgcggcaccgcccac

SEQ ID NO: 1954438 - DNA, 22 bp, Homo sapiens
ttcttgcggcaccgcccaccca

SEQ ID NO: 1954439 - DNA, 18 bp, Homo sapiens
ttcttgtaaaactgtgac

SEQ ID NO: 1954440 - DNA, 20 bp, Homo sapiens
ttcttgtaaaactgtgacat

SEQ ID NO: 1954441 - DNA, 23 bp, Homo sapiens
ttcttgtaaaactgtgacattcc

SEQ ID NO: 1954442 - DNA, 12 bp, Homo sapiens
ttctttgttgct

SEQ ID NO: 1954443 - DNA, 18 bp, Homo sapiens
ttcttttagtcagaaatg

SEQ ID NO: 1954444 - DNA, 21 bp, Homo sapiens
ttcttttagtcagaaatgatt

SEQ ID NO: 1954445 - DNA, 14 bp, Homo sapiens
ttgaaaaagaaaac

SEQ ID NO: 1954446 - DNA, 20 bp, Homo sapiens
ttgaaaggagaaaaaaaaag

SEQ ID NO: 1954447 - DNA, 23 bp, Homo sapiens
ttgaaaggagaaaaaaaaagcca

SEQ ID NO: 1954448 - DNA, 16 bp, Homo sapiens
ttgaatgcttaaatga

SEQ ID NO: 1954449 - DNA, 21 bp, Homo sapiens
ttgacacactcaccatttaat

SEQ ID NO: 1954450 - DNA, 18 bp, Homo sapiens
ttgacagcaacaaagcat

SEQ ID NO: 1954451 - DNA, 15 bp, Homo sapiens
ttgaccttatgccat

SEQ ID NO: 1954452 - DNA, 17 bp, Homo sapiens
ttgagacactgtcaaga

SEQ ID NO: 1954453 - DNA, 20 bp, Homo sapiens
ttgagcattcaaatgaagat

SEQ ID NO: 1954454 - DNA, 13 bp, Homo sapiens
ttgagtcatttta

SEQ ID NO: 1954455 - DNA, 14 bp, Homo sapiens
ttgagtgttctagt

SEQ ID NO: 1954456 - DNA, 17 bp, Homo sapiens
ttgatacaacaggattt

SEQ ID NO: 1954457 - DNA, 22 bp, Homo sapiens
ttgatacaacaggattttcaag

SEQ ID NO: 1954458 - DNA, 18 bp, Homo sapiens
ttgatattcctacaaaga

SEQ ID NO: 1954459 - DNA, 19 bp, Homo sapiens
ttgatggaaaaagaatata

SEQ ID NO: 1954460 - DNA, 12 bp, Homo sapiens
ttgattctttca

SEQ ID NO: 1954461 - DNA, 17 bp, Homo sapiens
ttgcactaaaagtgatg

SEQ ID NO: 1954462 - DNA, 20 bp, Homo sapiens
ttgcactaaaagtgatgtga

SEQ ID NO: 1954463 - DNA, 21 bp, Homo sapiens
ttgcactaaaagtgatgtgat

SEQ ID NO: 1954464 - DNA, 14 bp, Homo sapiens
ttgcagcagtacca

SEQ ID NO: 1954465 - DNA, 22 bp, Homo sapiens
ttgctaagataattaaatgaaa

SEQ ID NO: 1954466 - DNA, 13 bp, Homo sapiens
ttgctcaatatga

SEQ ID NO: 1954467 - DNA, 20 bp, Homo sapiens
ttgctgaataacaacaattt

SEQ ID NO: 1954468 - DNA, 15 bp, Homo sapiens
ttgctgtaaataaaa

SEQ ID NO: 1954469 - DNA, 23 bp, Homo sapiens
ttgctgtaaataaaaatagctat

SEQ ID NO: 1954470 - DNA, 18 bp, Homo sapiens
ttgcttaatctagagcta

SEQ ID NO: 1954471 - DNA, 20 bp, Homo sapiens
ttggaaaacgatttaattta

SEQ ID NO: 1954472 - DNA, 20 bp, Homo sapiens
ttggaacagtaatcagtttg

SEQ ID NO: 1954473 - DNA, 23 bp, Homo sapiens
ttggagcagagacggcagcccca

SEQ ID NO: 1954474 - DNA, 20 bp, Homo sapiens
ttggctgtgatgtcacagtt

SEQ ID NO: 1954475 - DNA, 15 bp, Homo sapiens
ttgggaaattcttgc

SEQ ID NO: 1954476 - DNA, 11 bp, Homo sapiens
ttgggaggctg

SEQ ID NO: 1954477 - DNA, 12 bp, Homo sapiens
ttgggaggctga

SEQ ID NO: 1954478 - DNA, 20 bp, Homo sapiens
ttgggattcctcccctggaa

SEQ ID NO: 1954479 - DNA, 16 bp, Homo sapiens
ttgggatttgttgaaa

SEQ ID NO: 1954480 - DNA, 19 bp, Homo sapiens
ttgggtaagggactccaga

SEQ ID NO: 1954481 - DNA, 19 bp, Homo sapiens
ttggtaatgatgattcaat

SEQ ID NO: 1954482 - DNA, 23 bp, Homo sapiens
ttggtaatgatgattcaatcatt

SEQ ID NO: 1954483 - DNA, 16 bp, Homo sapiens
ttggtttgtgggtcca

SEQ ID NO: 1954484 - DNA, 22 bp, Homo sapiens
ttgtaactcacatgccttctaa

SEQ ID NO: 1954485 - DNA, 20 bp, Homo sapiens
ttgtagctagtttaaaatta

SEQ ID NO: 1954486 - DNA, 15 bp, Homo sapiens
ttgtataattatgaa

SEQ ID NO: 1954487 - DNA, 13 bp, Homo sapiens
ttgtcctgtgtca

SEQ ID NO: 1954488 - DNA, 18 bp, Homo sapiens
ttgtcctttctgatcctc

SEQ ID NO: 1954489 - DNA, 17 bp, Homo sapiens
ttgtctttctgcagaaa

SEQ ID NO: 1954490 - DNA, 16 bp, Homo sapiens
ttgtgaatgttgtcct

SEQ ID NO: 1954491 - DNA, 16 bp, Homo sapiens
ttgttatcagtacaat

SEQ ID NO: 1954492 - DNA, 15 bp, Homo sapiens
ttgttctgtgcaaca

SEQ ID NO: 1954493 - DNA, 16 bp, Homo sapiens
ttgttgaaatcttttt

SEQ ID NO: 1954494 - DNA, 13 bp, Homo sapiens
tttaaaattatta

SEQ ID NO: 1954495 - DNA, 21 bp, Homo sapiens
tttaaaattattaaaaattat

SEQ ID NO: 1954496 - DNA, 23 bp, Homo sapiens
tttacaaatgatttcgtgactgt

SEQ ID NO: 1954497 - DNA, 15 bp, Homo sapiens
tttacagtgatagaa

SEQ ID NO: 1954498 - DNA, 11 bp, Homo sapiens
tttactcacat

SEQ ID NO: 1954499 - DNA, 18 bp, Homo sapiens
tttagaaataaaagatga

SEQ ID NO: 1954500 - DNA, 20 bp, Homo sapiens
tttagattcctacttaaaca

SEQ ID NO: 1954501 - DNA, 17 bp, Homo sapiens
tttagctaacaaaagat

SEQ ID NO: 1954502 - DNA, 23 bp, Homo sapiens
tttagctaacaaaagatatgaag

SEQ ID NO: 1954503 - DNA, 14 bp, Homo sapiens
tttaggaatgctca

SEQ ID NO: 1954504 - DNA, 15 bp, Homo sapiens
tttaggaatgctcaa

SEQ ID NO: 1954505 - DNA, 21 bp, Homo sapiens
tttaggaatgctcaatgtgct

SEQ ID NO: 1954506 - DNA, 16 bp, Homo sapiens
tttagtagctgataaa

SEQ ID NO: 1954507 - DNA, 13 bp, Homo sapiens
tttagtcagaaat

SEQ ID NO: 1954508 - DNA, 16 bp, Homo sapiens
tttagtcagaaatgat

SEQ ID NO: 1954509 - DNA, 17 bp, Homo sapiens
tttagtcatttaagaat

SEQ ID NO: 1954510 - DNA, 20 bp, Homo sapiens
tttataacattgtaaatgat

SEQ ID NO: 1954511 - DNA, 17 bp, Homo sapiens
tttatgattcttactgt

SEQ ID NO: 1954512 - DNA, 12 bp, Homo sapiens
tttatgatttca

SEQ ID NO: 1954513 - DNA, 17 bp, Homo sapiens
tttatgatttcatgatt

SEQ ID NO: 1954514 - DNA, 19 bp, Homo sapiens
tttatgcatgagaactaaa

SEQ ID NO: 1954515 - DNA, 18 bp, Homo sapiens
tttcaagaatgtttcagt

SEQ ID NO: 1954516 - DNA, 15 bp, Homo sapiens
tttcaatccacagta

SEQ ID NO: 1954517 - DNA, 18 bp, Homo sapiens
tttcaattatgtttgaaa

SEQ ID NO: 1954518 - DNA, 20 bp, Homo sapiens
tttcatagataccattttga

SEQ ID NO: 1954519 - DNA, 16 bp, Homo sapiens
tttcatgattagacaa

SEQ ID NO: 1954520 - DNA, 22 bp, Homo sapiens
tttcattatttttcaattatgt

SEQ ID NO: 1954521 - DNA, 13 bp, Homo sapiens
tttcattttctct

SEQ ID NO: 1954522 - DNA, 18 bp, Homo sapiens
tttccacatccccaccct

SEQ ID NO: 1954523 - DNA, 18 bp, Homo sapiens
tttcccctgtggtttgtt

SEQ ID NO: 1954524 - DNA, 19 bp, Homo sapiens
tttcctaaatcagcatttt

SEQ ID NO: 1954525 - DNA, 14 bp, Homo sapiens
tttcctcctgggca

SEQ ID NO: 1954526 - DNA, 24 bp, Homo sapiens
tttcctgaaattctgacaccatgt

SEQ ID NO: 1954527 - DNA, 16 bp, Homo sapiens
tttcctgtcaatatat

SEQ ID NO: 1954528 - DNA, 19 bp, Homo sapiens
tttcctttggcaatatcat

SEQ ID NO: 1954529 - DNA, 15 bp, Homo sapiens
tttctagcaattgct

SEQ ID NO: 1954530 - DNA, 11 bp, Homo sapiens
tttctctctgt

SEQ ID NO: 1954531 - DNA, 12 bp, Homo sapiens
tttctctctgtg

SEQ ID NO: 1954532 - DNA, 13 bp, Homo sapiens
tttctctctgtgt

SEQ ID NO: 1954533 - DNA, 17 bp, Homo sapiens
tttctctctgtgtggca

SEQ ID NO: 1954534 - DNA, 19 bp, Homo sapiens
tttgagaccaacctgggta

SEQ ID NO: 1954535 - DNA, 18 bp, Homo sapiens
tttgagtgtcaggctctg

SEQ ID NO: 1954536 - DNA, 21 bp, Homo sapiens
tttgagtgtcaggctctgaat

SEQ ID NO: 1954537 - DNA, 16 bp, Homo sapiens
tttgatggctatgttt

SEQ ID NO: 1954538 - DNA, 21 bp, Homo sapiens
agcggctgaggacggggcaga

SEQ ID NO: 1954539 - DNA, 23 bp, Homo sapiens
agcggctgaggacggggcagagc

SEQ ID NO: 1954540 - DNA, 19 bp, Homo sapiens
agctaacaaaagatatgaa

SEQ ID NO: 1954541 - DNA, 18 bp, Homo sapiens
aacaacaaagcatgctca

SEQ ID NO: 1954542 - DNA, 15 bp, Homo sapiens
aacaaccaaagaaaa

SEQ ID NO: 1954543 - DNA, 19 bp, Homo sapiens
aacaatttaggaatgctca

SEQ ID NO: 1954544 - DNA, 11 bp, Homo sapiens
aacagaaaagg

SEQ ID NO: 1954545 - DNA, 21 bp, Homo sapiens
aacagatcacatgcccctctt

SEQ ID NO: 1954546 - DNA, 23 bp, Homo sapiens
aacagatcacatgcccctcttag

SEQ ID NO: 1954547 - DNA, 17 bp, Homo sapiens
aacagcaacaacaacag

SEQ ID NO: 1954548 - DNA, 14 bp, Homo sapiens
aacagtaatcagtt

SEQ ID NO: 1954549 - DNA, 20 bp, Homo sapiens
aacagtaattactttcagaa

SEQ ID NO: 1954550 - DNA, 22 bp, Homo sapiens
aacagtaattactttcagaatg

SEQ ID NO: 1954551 - DNA, 17 bp, Homo sapiens
aacagtgtggatgtaaa

SEQ ID NO: 1954552 - DNA, 22 bp, Homo sapiens
aacagtgtggcttaaacatttt

SEQ ID NO: 1954553 - DNA, 18 bp, Homo sapiens
aacattaatgttgaaaaa

SEQ ID NO: 1954554 - DNA, 13 bp, Homo sapiens
aacattagaatat

SEQ ID NO: 1954555 - DNA, 18 bp, Homo sapiens
aacattgccttatattgg

SEQ ID NO: 1954556 - DNA, 13 bp, Homo sapiens
aacattttgtatg

SEQ ID NO: 1954557 - DNA, 15 bp, Homo sapiens
aaccaatttgttctg

SEQ ID NO: 1954558 - DNA, 16 bp, Homo sapiens
aaccagcactcccagg

SEQ ID NO: 1954559 - DNA, 11 bp, Homo sapiens
aacccccacct

SEQ ID NO: 1954560 - DNA, 18 bp, Homo sapiens
aacccccacctcccggtg

SEQ ID NO: 1954561 - DNA, 21 bp, Homo sapiens
aacccctctcccttttcagat

SEQ ID NO: 1954562 - DNA, 19 bp, Homo sapiens
aacccctgacaccttttca

SEQ ID NO: 1954563 - DNA, 15 bp, Homo sapiens
aaccctgccctgcac

SEQ ID NO: 1954564 - DNA, 17 bp, Homo sapiens
aaccctgccctgcacct

SEQ ID NO: 1954565 - DNA, 15 bp, Homo sapiens
aacctctcagatccc

SEQ ID NO: 1954566 - DNA, 22 bp, Homo sapiens
aacctctctgaactgcaacact

SEQ ID NO: 1954567 - DNA, 22 bp, Homo sapiens
aaccttttaaaaaaataatata

SEQ ID NO: 1954568 - DNA, 17 bp, Homo sapiens
aacgtgaactaagattt

SEQ ID NO: 1954569 - DNA, 20 bp, Homo sapiens
aactaaatagatttttagat

SEQ ID NO: 1954570 - DNA, 22 bp, Homo sapiens
aactagcaaaaggatgatttaa

SEQ ID NO: 1954571 - DNA, 16 bp, Homo sapiens
aactgatgctttcaga

SEQ ID NO: 1954572 - DNA, 23 bp, Homo sapiens
aactgatgggtatcatgcttcta

SEQ ID NO: 1954573 - DNA, 23 bp, Homo sapiens
aactggccccaggcggaggggct

SEQ ID NO: 1954574 - DNA, 15 bp, Homo sapiens
aactgtaaaatactt

SEQ ID NO: 1954575 - DNA, 14 bp, Homo sapiens
aactgtgagataaa

SEQ ID NO: 1954576 - DNA, 20 bp, Homo sapiens
aactgtgagataaatatcat

SEQ ID NO: 1954577 - DNA, 12 bp, Homo sapiens
aacttcaggaaa

SEQ ID NO: 1954578 - DNA, 16 bp, Homo sapiens
aacttcatctgtctgt

SEQ ID NO: 1954579 - DNA, 15 bp, Homo sapiens
aacttttagtggttc

SEQ ID NO: 1954580 - DNA, 23 bp, Homo sapiens
aacttttagtggttctgtgcctc

SEQ ID NO: 1954581 - DNA, 18 bp, Homo sapiens
aacttttgggatttgttg

SEQ ID NO: 1954582 - DNA, 14 bp, Homo sapiens
aagaaaatgtgtaa

SEQ ID NO: 1954583 - DNA, 18 bp, Homo sapiens
aagaaggggtagggattt

SEQ ID NO: 1954584 - DNA, 20 bp, Homo sapiens
aagaatagttgtcagaatat

SEQ ID NO: 1954585 - DNA, 14 bp, Homo sapiens
aagaatgtttcagt

SEQ ID NO: 1954586 - DNA, 15 bp, Homo sapiens
aagaatgtttcagtt

SEQ ID NO: 1954587 - DNA, 18 bp, Homo sapiens
aagaatttaccagaaata

SEQ ID NO: 1954588 - DNA, 13 bp, Homo sapiens
aagactcaatcat

SEQ ID NO: 1954589 - DNA, 17 bp, Homo sapiens
aagagaaaaagccctct

SEQ ID NO: 1954590 - DNA, 19 bp, Homo sapiens
aagataattaaatgaaata

SEQ ID NO: 1954591 - DNA, 18 bp, Homo sapiens
aagatatgaagaactatt

SEQ ID NO: 1954592 - DNA, 16 bp, Homo sapiens
aagatctcctgtgcac

SEQ ID NO: 1954593 - DNA, 22 bp, Homo sapiens
aagatgctgctgagcacatctc

SEQ ID NO: 1954594 - DNA, 23 bp, Homo sapiens
aagatgctgctgagcacatctct

SEQ ID NO: 1954595 - DNA, 15 bp, Homo sapiens
aagatgtaagaagct

SEQ ID NO: 1954596 - DNA, 20 bp, Homo sapiens
aagattaagttataccagca

SEQ ID NO: 1954597 - DNA, 19 bp, Homo sapiens
aagcacctcttgaagaact

SEQ ID NO: 1954598 - DNA, 18 bp, Homo sapiens
aagcagcagctagaaaga

SEQ ID NO: 1954599 - DNA, 12 bp, Homo sapiens
aagcatgctcag

SEQ ID NO: 1954600 - DNA, 14 bp, Homo sapiens
aagcccacccgccc

SEQ ID NO: 1954601 - DNA, 19 bp, Homo sapiens
aagcccacccgccccagag

SEQ ID NO: 1954602 - DNA, 19 bp, Homo sapiens
aagcctgaaagtaatttca

SEQ ID NO: 1954603 - DNA, 17 bp, Homo sapiens
aagctaaaatgaaaaat

SEQ ID NO: 1954604 - DNA, 19 bp, Homo sapiens
aagctcaaggctgcagtga

SEQ ID NO: 1954605 - DNA, 17 bp, Homo sapiens
aagctcagctatgaaat

SEQ ID NO: 1954606 - DNA, 18 bp, Homo sapiens
aagctgatgaagttaagc

SEQ ID NO: 1954607 - DNA, 20 bp, Homo sapiens
aaggacactgatgggtcctg

SEQ ID NO: 1954608 - DNA, 15 bp, Homo sapiens
aaggcagtgcagtgc

SEQ ID NO: 1954609 - DNA, 18 bp, Homo sapiens
aaggcatatactttgtct

SEQ ID NO: 1954610 - DNA, 19 bp, Homo sapiens
aaggcctgagggaagccca

SEQ ID NO: 1954611 - DNA, 14 bp, Homo sapiens
aagggccttctcca

SEQ ID NO: 1954612 - DNA, 18 bp, Homo sapiens
aaggtcagtgttataaaa

SEQ ID NO: 1954613 - DNA, 22 bp, Homo sapiens
aaggtcagtgttataaaatctg

SEQ ID NO: 1954614 - DNA, 12 bp, Homo sapiens
aaggttgtacat

SEQ ID NO: 1954615 - DNA, 18 bp, Homo sapiens
aagtaataaattccaata

SEQ ID NO: 1954616 - DNA, 14 bp, Homo sapiens
aagtgatgtgattt

SEQ ID NO: 1954617 - DNA, 20 bp, Homo sapiens
aagtgatgtgatttatgcat

SEQ ID NO: 1954618 - DNA, 13 bp, Homo sapiens
aagtgattgacat

SEQ ID NO: 1954619 - DNA, 14 bp, Homo sapiens
aagtgattgacatt

SEQ ID NO: 1954620 - DNA, 13 bp, Homo sapiens
aagtgtaataaat

SEQ ID NO: 1954621 - DNA, 13 bp, Homo sapiens
aagtgttacagag

SEQ ID NO: 1954622 - DNA, 13 bp, Homo sapiens
aagttacatacat

SEQ ID NO: 1954623 - DNA, 23 bp, Homo sapiens
aagttacatacatttaaaaaaca

SEQ ID NO: 1954624 - DNA, 15 bp, Homo sapiens
aagttattcagaaat

SEQ ID NO: 1954625 - DNA, 17 bp, Homo sapiens
aagttattcagaaatat

SEQ ID NO: 1954626 - DNA, 17 bp, Homo sapiens
aagttccagcagtttca

SEQ ID NO: 1954627 - DNA, 15 bp, Homo sapiens
aagttgtcctttctg

SEQ ID NO: 1954628 - DNA, 13 bp, Homo sapiens
aataaaaatagct

SEQ ID NO: 1954629 - DNA, 19 bp, Homo sapiens
aataaaaccagaaagagga

SEQ ID NO: 1954630 - DNA, 20 bp, Homo sapiens
acaatgtggaattacataac

SEQ ID NO: 1954631 - DNA, 21 bp, Homo sapiens
acaatgtggaattacataaca

SEQ ID NO: 1954632 - DNA, 23 bp, Homo sapiens
acaatgtggaattacataacagg

SEQ ID NO: 1954633 - DNA, 20 bp, Homo sapiens
acaattactttgaacattaa

SEQ ID NO: 1954634 - DNA, 19 bp, Homo sapiens
acaattcaaagaatcacct

SEQ ID NO: 1954635 - DNA, 20 bp, Homo sapiens
acaattctttgttgcttaat

SEQ ID NO: 1954636 - DNA, 11 bp, Homo sapiens
acaatttcaat

SEQ ID NO: 1954637 - DNA, 13 bp, Homo sapiens
acaatttcaatgc

SEQ ID NO: 1954638 - DNA, 17 bp, Homo sapiens
acaatttcaatgcttct

SEQ ID NO: 1954639 - DNA, 18 bp, Homo sapiens
acaatttcaatgcttctt

SEQ ID NO: 1954640 - DNA, 14 bp, Homo sapiens
acacacacacacaa

SEQ ID NO: 1954641 - DNA, 15 bp, Homo sapiens
acacactcaccattt

SEQ ID NO: 1954642 - DNA, 14 bp, Homo sapiens
acacagtctggtgc

SEQ ID NO: 1954643 - DNA, 15 bp, Homo sapiens
acacataacacacat

SEQ ID NO: 1954644 - DNA, 16 bp, Homo sapiens
acacataacacacatc

SEQ ID NO: 1954645 - DNA, 15 bp, Homo sapiens
acaccaaattgctga

SEQ ID NO: 1954646 - DNA, 19 bp, Homo sapiens
acaccaaattgctgagatg

SEQ ID NO: 1954647 - DNA, 16 bp, Homo sapiens
acaccccgtctgcccc

SEQ ID NO: 1954648 - DNA, 17 bp, Homo sapiens
acaccccgtctgcccct

SEQ ID NO: 1954649 - DNA, 21 bp, Homo sapiens
acacctagactctaaaactat

SEQ ID NO: 1954650 - DNA, 15 bp, Homo sapiens
acacgccggggctgg

SEQ ID NO: 1954651 - DNA, 20 bp, Homo sapiens
acacgccggggctggccctg

SEQ ID NO: 1954652 - DNA, 16 bp, Homo sapiens
acactgatgggtcctg

SEQ ID NO: 1954653 - DNA, 17 bp, Homo sapiens
acactgatgggtcctgc

SEQ ID NO: 1954654 - DNA, 22 bp, Homo sapiens
acactgatgggtcctgctgctc

SEQ ID NO: 1954655 - DNA, 14 bp, Homo sapiens
acacttaaaagatg

SEQ ID NO: 1954656 - DNA, 19 bp, Homo sapiens
acagaaccagcactcccag

SEQ ID NO: 1954657 - DNA, 22 bp, Homo sapiens
acagaaccagcactcccagggc

SEQ ID NO: 1954658 - DNA, 18 bp, Homo sapiens
acagacggacgggacagc

SEQ ID NO: 1954659 - DNA, 20 bp, Homo sapiens
acagacggacgggacagcgg

SEQ ID NO: 1954660 - DNA, 19 bp, Homo sapiens
acagatcacatgcccctct

SEQ ID NO: 1954661 - DNA, 12 bp, Homo sapiens
acagatgtacat

SEQ ID NO: 1954662 - DNA, 13 bp, Homo sapiens
acagcaacaacaa

SEQ ID NO: 1954663 - DNA, 19 bp, Homo sapiens
acagcatttcagctgtgag

SEQ ID NO: 1954664 - DNA, 14 bp, Homo sapiens
acagcggcccggcc

SEQ ID NO: 1954665 - DNA, 15 bp, Homo sapiens
acagcggcccggccc

SEQ ID NO: 1954666 - DNA, 16 bp, Homo sapiens
acagcggcccggccca

SEQ ID NO: 1954667 - DNA, 21 bp, Homo sapiens
acagcggcccggcccacgcag

SEQ ID NO: 1954668 - DNA, 18 bp, Homo sapiens
acaggcattgcactaaaa

SEQ ID NO: 1954669 - DNA, 19 bp, Homo sapiens
acaggcattgcactaaaag

SEQ ID NO: 1954670 - DNA, 22 bp, Homo sapiens
acaggcattgcactaaaagtga

SEQ ID NO: 1954671 - DNA, 20 bp, Homo sapiens
acagggacacagtctggtgc

SEQ ID NO: 1954672 - DNA, 14 bp, Homo sapiens
acaggggaggctga

SEQ ID NO: 1954673 - DNA, 20 bp, Homo sapiens
acagtagcatactgatgaga

SEQ ID NO: 1954674 - DNA, 20 bp, Homo sapiens
acagtgatgccatgaagaca

SEQ ID NO: 1954675 - DNA, 14 bp, Homo sapiens
acagtggggcccat

SEQ ID NO: 1954676 - DNA, 16 bp, Homo sapiens
acagtggggcccatgg

SEQ ID NO: 1954677 - DNA, 22 bp, Homo sapiens
acagtggggcccatggccccag

SEQ ID NO: 1954678 - DNA, 13 bp, Homo sapiens
acagtttgttcag

SEQ ID NO: 1954679 - DNA, 16 bp, Homo sapiens
acagtttgttcagtga

SEQ ID NO: 1954680 - DNA, 14 bp, Homo sapiens
acataacaggcatt

SEQ ID NO: 1954681 - DNA, 12 bp, Homo sapiens
acatacatttaa

SEQ ID NO: 1954682 - DNA, 14 bp, Homo sapiens
acatacatttaaaa

SEQ ID NO: 1954683 - DNA, 20 bp, Homo sapiens
acataccacacttaaaagat

SEQ ID NO: 1954684 - DNA, 15 bp, Homo sapiens
acatagtggtcattt

SEQ ID NO: 1954685 - DNA, 23 bp, Homo sapiens
acatccccaccctcccctctcct

SEQ ID NO: 1954686 - DNA, 18 bp, Homo sapiens
acatctctgtaaaaagca

SEQ ID NO: 1954687 - DNA, 12 bp, Homo sapiens
acatctcttcat

SEQ ID NO: 1954688 - DNA, 15 bp, Homo sapiens
acatgcccctcttag

SEQ ID NO: 1954689 - DNA, 20 bp, Homo sapiens
acatggttacctctgcataa

SEQ ID NO: 1954690 - DNA, 13 bp, Homo sapiens
acattagaatatt

SEQ ID NO: 1954691 - DNA, 16 bp, Homo sapiens
acattattagaatata

SEQ ID NO: 1954692 - DNA, 15 bp, Homo sapiens
acatttaaaaaacat

SEQ ID NO: 1954693 - DNA, 16 bp, Homo sapiens
acatttaaaaaacatt

SEQ ID NO: 1954694 - DNA, 18 bp, Homo sapiens
acatttaaaaaacatttt

SEQ ID NO: 1954695 - DNA, 15 bp, Homo sapiens
acattttgtatgctg

SEQ ID NO: 1954696 - DNA, 18 bp, Homo sapiens
acattttgtatgctgcat

SEQ ID NO: 1954697 - DNA, 21 bp, Homo sapiens
acattttttgtttcttggtgt

SEQ ID NO: 1954698 - DNA, 13 bp, Homo sapiens
accaccatttccc

SEQ ID NO: 1954699 - DNA, 23 bp, Homo sapiens
accaccctatcatcagttaggat

SEQ ID NO: 1954700 - DNA, 15 bp, Homo sapiens
accagaaagaggaat

SEQ ID NO: 1954701 - DNA, 18 bp, Homo sapiens
accagagcgatgtgttct

SEQ ID NO: 1954702 - DNA, 18 bp, Homo sapiens
accagcactcccagggcc

SEQ ID NO: 1954703 - DNA, 23 bp, Homo sapiens
accagcctgagccacagtggggc

SEQ ID NO: 1954704 - DNA, 19 bp, Homo sapiens
accagctgcctctttgctg

SEQ ID NO: 1954705 - DNA, 20 bp, Homo sapiens
accatcttgaagtcattgtc

SEQ ID NO: 1954706 - DNA, 23 bp, Homo sapiens
accatcttgggattcctcccctg

SEQ ID NO: 1954707 - DNA, 18 bp, Homo sapiens
accattgctaatttaaag

SEQ ID NO: 1954708 - DNA, 15 bp, Homo sapiens
accatttaatcattt

SEQ ID NO: 1954709 - DNA, 19 bp, Homo sapiens
acccaagttggagtgcagt

SEQ ID NO: 1954710 - DNA, 23 bp, Homo sapiens
acccacaccccgtctgccccttg

SEQ ID NO: 1954711 - DNA, 16 bp, Homo sapiens
acccactagccctctt

SEQ ID NO: 1954712 - DNA, 19 bp, Homo sapiens
acccactagccctctttct

SEQ ID NO: 1954713 - DNA, 21 bp, Homo sapiens
acccactagccctctttctct

SEQ ID NO: 1954714 - DNA, 23 bp, Homo sapiens
accccacacgccggggctggccc

SEQ ID NO: 1954715 - DNA, 20 bp, Homo sapiens
accccatagtgccttgattt

SEQ ID NO: 1954716 - DNA, 14 bp, Homo sapiens
acccccagcctccc

SEQ ID NO: 1954717 - DNA, 16 bp, Homo sapiens
acccccagcctccccc

SEQ ID NO: 1954718 - DNA, 15 bp, Homo sapiens
acccccatgccaatg

SEQ ID NO: 1954719 - DNA, 19 bp, Homo sapiens
acccctctcccttttcaga

SEQ ID NO: 1954720 - DNA, 14 bp, Homo sapiens
acccgccccagaga

SEQ ID NO: 1954721 - DNA, 21 bp, Homo sapiens
acccgccccagagactgccca

SEQ ID NO: 1954722 - DNA, 22 bp, Homo sapiens
acccgccccagagactgcccac

SEQ ID NO: 1954723 - DNA, 13 bp, Homo sapiens
acccgtgttctcc

SEQ ID NO: 1954724 - DNA, 16 bp, Homo sapiens
accctcccctctcctg

SEQ ID NO: 1954725 - DNA, 18 bp, Homo sapiens
accctcccctctcctgag

SEQ ID NO: 1954726 - DNA, 18 bp, Homo sapiens
accctgaatcagaggcag

SEQ ID NO: 1954727 - DNA, 15 bp, Homo sapiens
accctgggcctcccg

SEQ ID NO: 1954728 - DNA, 21 bp, Homo sapiens
acccttctacaaaagaagtgt

SEQ ID NO: 1954729 - DNA, 18 bp, Homo sapiens
accgcccaacccccacct

SEQ ID NO: 1954730 - DNA, 12 bp, Homo sapiens
accgcccaccca

SEQ ID NO: 1954731 - DNA, 18 bp, Homo sapiens
accgcccacccacacccc

SEQ ID NO: 1954732 - DNA, 18 bp, Homo sapiens
accgtggtgtgaggcccc

SEQ ID NO: 1954733 - DNA, 20 bp, Homo sapiens
accgtggtgtgaggcccccg

SEQ ID NO: 1954734 - DNA, 22 bp, Homo sapiens
accgtggtgtgaggcccccgga

SEQ ID NO: 1954735 - DNA, 15 bp, Homo sapiens
acctaattaatttca

SEQ ID NO: 1954736 - DNA, 15 bp, Homo sapiens
acctcaaaagaaaat

SEQ ID NO: 1954737 - DNA, 19 bp, Homo sapiens
acctctctgaactgcaaca

SEQ ID NO: 1954738 - DNA, 12 bp, Homo sapiens
acctcttgtttt

SEQ ID NO: 1954739 - DNA, 10 bp, Homo sapiens
acctgcccag

SEQ ID NO: 1954740 - DNA, 19 bp, Homo sapiens
acctgcccagttagcccgg

SEQ ID NO: 1954741 - DNA, 22 bp, Homo sapiens
acctgcccagttagcccggcca

SEQ ID NO: 1954742 - DNA, 21 bp, Homo sapiens
accttagtacctttttaacag

SEQ ID NO: 1954743 - DNA, 22 bp, Homo sapiens
accttctgtgcatctggcctgg

SEQ ID NO: 1954744 - DNA, 19 bp, Homo sapiens
accttgggcacgggagagc

SEQ ID NO: 1954745 - DNA, 23 bp, Homo sapiens
accttgggcacgggagagcgcca

SEQ ID NO: 1954746 - DNA, 22 bp, Homo sapiens
accttttaaaaaaataatataa

SEQ ID NO: 1954747 - DNA, 13 bp, Homo sapiens
acctttttaacag

SEQ ID NO: 1954748 - DNA, 13 bp, Homo sapiens
acgatttaattta

SEQ ID NO: 1954749 - DNA, 14 bp, Homo sapiens
acgcagagccccgg

SEQ ID NO: 1954750 - DNA, 19 bp, Homo sapiens
acgcagagccccggagcac

SEQ ID NO: 1954751 - DNA, 20 bp, Homo sapiens
acgcagagccccggagcacc

SEQ ID NO: 1954752 - DNA, 17 bp, Homo sapiens
acgccggggctggccct

SEQ ID NO: 1954753 - DNA, 11 bp, Homo sapiens
acgctggctcg

SEQ ID NO: 1954754 - DNA, 14 bp, Homo sapiens
acggacgggacagc

SEQ ID NO: 1954755 - DNA, 21 bp, Homo sapiens
acggacgggacagcggcccgg

SEQ ID NO: 1954756 - DNA, 10 bp, Homo sapiens
acggaggctc

SEQ ID NO: 1954757 - DNA, 14 bp, Homo sapiens
acgggacagcggcc

SEQ ID NO: 1954758 - DNA, 21 bp, Homo sapiens
agaattttaaaaaagatggat

SEQ ID NO: 1954759 - DNA, 21 bp, Homo sapiens
agacaagtctagtggaaccaa

SEQ ID NO: 1954760 - DNA, 20 bp, Homo sapiens
agacagacggacgggacagc

SEQ ID NO: 1954761 - DNA, 14 bp, Homo sapiens
agacctcctgatgt

SEQ ID NO: 1954762 - DNA, 15 bp, Homo sapiens
agacggacgggacag

SEQ ID NO: 1954763 - DNA, 13 bp, Homo sapiens
agacggcagcccc

SEQ ID NO: 1954764 - DNA, 15 bp, Homo sapiens
agactcgagagggct

SEQ ID NO: 1954765 - DNA, 17 bp, Homo sapiens
atccatgtgctgctgtg

SEQ ID NO: 1954766 - DNA, 19 bp, Homo sapiens
atccatgtgctgctgtggc

SEQ ID NO: 1954767 - DNA, 19 bp, Homo sapiens
atcccaagtcaaacagtgt

SEQ ID NO: 1954768 - DNA, 17 bp, Homo sapiens
atccctcggtcagcacc

SEQ ID NO: 1954769 - DNA, 16 bp, Homo sapiens
atcctaaaattgtttc

SEQ ID NO: 1954770 - DNA, 20 bp, Homo sapiens
atcctcttatatgtgcccct

SEQ ID NO: 1954771 - DNA, 21 bp, Homo sapiens
atccttaaggcatatactttg

SEQ ID NO: 1954772 - DNA, 18 bp, Homo sapiens
atccttcacaatttcaat

SEQ ID NO: 1954773 - DNA, 16 bp, Homo sapiens
atctaaattaacttct

SEQ ID NO: 1954774 - DNA, 19 bp, Homo sapiens
atctaaattaacttctatt

SEQ ID NO: 1954775 - DNA, 14 bp, Homo sapiens
atctactagaacct

SEQ ID NO: 1954776 - DNA, 15 bp, Homo sapiens
atctatagcatttaa

SEQ ID NO: 1954777 - DNA, 19 bp, Homo sapiens
atctatagcatttaaagat

SEQ ID NO: 1954778 - DNA, 21 bp, Homo sapiens
atctcaaaagatctcctgtgc

SEQ ID NO: 1954779 - DNA, 17 bp, Homo sapiens
atctctcaaaatgtgcc

SEQ ID NO: 1954780 - DNA, 16 bp, Homo sapiens
atctgaggagtccaaa

SEQ ID NO: 1954781 - DNA, 16 bp, Homo sapiens
atctgatgatgttctg

SEQ ID NO: 1954782 - DNA, 17 bp, Homo sapiens
atctggtgcgtgtggcc

SEQ ID NO: 1954783 - DNA, 13 bp, Homo sapiens
atctgtctttatg

SEQ ID NO: 1954784 - DNA, 15 bp, Homo sapiens
atctgtctttatgat

SEQ ID NO: 1954785 - DNA, 18 bp, Homo sapiens
atcttaggcactttttaa

SEQ ID NO: 1954786 - DNA, 22 bp, Homo sapiens
atcttaggcactttttaacatt

SEQ ID NO: 1954787 - DNA, 21 bp, Homo sapiens
atcttcctagtgggccacccc

SEQ ID NO: 1954788 - DNA, 18 bp, Homo sapiens
atcttgaagtcattgtcc

SEQ ID NO: 1954789 - DNA, 12 bp, Homo sapiens
atcttgctgtga

SEQ ID NO: 1954790 - DNA, 15 bp, Homo sapiens
atcttgctgtgaaac

SEQ ID NO: 1954791 - DNA, 12 bp, Homo sapiens
atcttttcctgc

SEQ ID NO: 1954792 - DNA, 17 bp, Homo sapiens
atgaaacttgagcattc

SEQ ID NO: 1954793 - DNA, 19 bp, Homo sapiens
atgaaatataaactgtgag

SEQ ID NO: 1954794 - DNA, 22 bp, Homo sapiens
atgaactcaggtttccggctac

SEQ ID NO: 1954795 - DNA, 19 bp, Homo sapiens
atgaagttaagcacaacca

SEQ ID NO: 1954796 - DNA, 15 bp, Homo sapiens
atgaatgaaatataa

SEQ ID NO: 1954797 - DNA, 15 bp, Homo sapiens
atgacagtagcatac

SEQ ID NO: 1954798 - DNA, 20 bp, Homo sapiens
atgaccataaaattagacat

SEQ ID NO: 1954799 - DNA, 20 bp, Homo sapiens
atgacttctttactaacact

SEQ ID NO: 1954800 - DNA, 23 bp, Homo sapiens
atgacttctttactaacactggc

SEQ ID NO: 1954801 - DNA, 19 bp, Homo sapiens
atgagaaatataaaaataa

SEQ ID NO: 1954802 - DNA, 13 bp, Homo sapiens
atgagaactaaat

SEQ ID NO: 1954803 - DNA, 15 bp, Homo sapiens
atgagacaacacaca

SEQ ID NO: 1954804 - DNA, 16 bp, Homo sapiens
atgagacaacacacac

SEQ ID NO: 1954805 - DNA, 20 bp, Homo sapiens
atgagtttccagctaagcct

SEQ ID NO: 1954806 - DNA, 15 bp, Homo sapiens
atgatgattcaatca

SEQ ID NO: 1954807 - DNA, 14 bp, Homo sapiens
atgattagacaatg

SEQ ID NO: 1954808 - DNA, 16 bp, Homo sapiens
atgattagacaatgtg

SEQ ID NO: 1954809 - DNA, 21 bp, Homo sapiens
atgattcacttttattgtata

SEQ ID NO: 1954810 - DNA, 14 bp, Homo sapiens
atgattgagagcag

SEQ ID NO: 1954811 - DNA, 13 bp, Homo sapiens
atgatttaacatt

SEQ ID NO: 1954812 - DNA, 13 bp, Homo sapiens
atgatttcagaaa

SEQ ID NO: 1954813 - DNA, 17 bp, Homo sapiens
atgatttcgtgactgta

SEQ ID NO: 1954814 - DNA, 13 bp, Homo sapiens
atgcacaccaaat

SEQ ID NO: 1954815 - DNA, 20 bp, Homo sapiens
atgcacaccaaattgctgag

SEQ ID NO: 1954816 - DNA, 16 bp, Homo sapiens
atgcagtattgagtgt

SEQ ID NO: 1954817 - DNA, 16 bp, Homo sapiens
atgcatgagaactaaa

SEQ ID NO: 1954818 - DNA, 20 bp, Homo sapiens
atgcatgagaactaaataga

SEQ ID NO: 1954819 - DNA, 13 bp, Homo sapiens
atgccaatgtcca

SEQ ID NO: 1954820 - DNA, 16 bp, Homo sapiens
atgcctcattttattc

SEQ ID NO: 1954821 - DNA, 16 bp, Homo sapiens
atgctaacctctctga

SEQ ID NO: 1954822 - DNA, 18 bp, Homo sapiens
atgctaagccagttctta

SEQ ID NO: 1954823 - DNA, 13 bp, Homo sapiens
atgctcaatgtgc

SEQ ID NO: 1954824 - DNA, 15 bp, Homo sapiens
atgctcaatgtgctg

SEQ ID NO: 1954825 - DNA, 16 bp, Homo sapiens
atgcttttctcatggt

SEQ ID NO: 1954826 - DNA, 18 bp, Homo sapiens
atggaacagtaattactt

SEQ ID NO: 1954827 - DNA, 15 bp, Homo sapiens
atggagtagagtcag

SEQ ID NO: 1954828 - DNA, 23 bp, Homo sapiens
atggatgggggttacctagccct

SEQ ID NO: 1954829 - DNA, 14 bp, Homo sapiens
atggatttgacaca

SEQ ID NO: 1954830 - DNA, 17 bp, Homo sapiens
atggattttttttttca

SEQ ID NO: 1954831 - DNA, 20 bp, Homo sapiens
atggccccagctggctgggt

SEQ ID NO: 1954832 - DNA, 20 bp, Homo sapiens
atggctgttatctgtcttta

SEQ ID NO: 1954833 - DNA, 15 bp, Homo sapiens
atggtagactgtgac

SEQ ID NO: 1954834 - DNA, 16 bp, Homo sapiens
atggtagactgtgaca

SEQ ID NO: 1954835 - DNA, 16 bp, Homo sapiens
atggtgaactgtcatt

SEQ ID NO: 1954836 - DNA, 14 bp, Homo sapiens
atgtaatattaaat

SEQ ID NO: 1954837 - DNA, 18 bp, Homo sapiens
atgtacattaaataccag

SEQ ID NO: 1954838 - DNA, 19 bp, Homo sapiens
atgtatgtacctgagcata

SEQ ID NO: 1954839 - DNA, 15 bp, Homo sapiens
atgtcaaatggatgt

SEQ ID NO: 1954840 - DNA, 15 bp, Homo sapiens
atgtcacagtttgtt

SEQ ID NO: 1954841 - DNA, 22 bp, Homo sapiens
atgtcacagtttgttcagtgag

SEQ ID NO: 1954842 - DNA, 17 bp, Homo sapiens
atgtcaggggtttgctt

SEQ ID NO: 1954843 - DNA, 18 bp, Homo sapiens
atgtccaggtcacaggca

SEQ ID NO: 1954844 - DNA, 22 bp, Homo sapiens
atgtctcaaaataaaaccagaa

SEQ ID NO: 1954845 - DNA, 19 bp, Homo sapiens
atgtgctgttgattctttc

SEQ ID NO: 1954846 - DNA, 22 bp, Homo sapiens
atgtgctgttgattctttcaat

SEQ ID NO: 1954847 - DNA, 18 bp, Homo sapiens
atgttattactgaggaaa

SEQ ID NO: 1954848 - DNA, 20 bp, Homo sapiens
atgttattactgaggaaagg

SEQ ID NO: 1954849 - DNA, 18 bp, Homo sapiens
atgttccgttcatctgag

SEQ ID NO: 1954850 - DNA, 19 bp, Homo sapiens
atgttctgacagcatttca

SEQ ID NO: 1954851 - DNA, 12 bp, Homo sapiens
atgttgtggaat

SEQ ID NO: 1954852 - DNA, 16 bp, Homo sapiens
atgtttagtagctgat

SEQ ID NO: 1954853 - DNA, 19 bp, Homo sapiens
atgtttagtagctgataaa

SEQ ID NO: 1954854 - DNA, 15 bp, Homo sapiens
attaaaaattataga

SEQ ID NO: 1954855 - DNA, 16 bp, Homo sapiens
attaaaacaaaatcct

SEQ ID NO: 1954856 - DNA, 15 bp, Homo sapiens
attaaactgatgggt

SEQ ID NO: 1954857 - DNA, 23 bp, Homo sapiens
attaaatgaaatacttgacaaca

SEQ ID NO: 1954858 - DNA, 20 bp, Homo sapiens
attaaccattgctaatttaa

SEQ ID NO: 1954859 - DNA, 20 bp, Homo sapiens
attaacttctattttcaagt

SEQ ID NO: 1954860 - DNA, 13 bp, Homo sapiens
attaatgttgaaa

SEQ ID NO: 1954861 - DNA, 14 bp, Homo sapiens
attactttcagaat

SEQ ID NO: 1954862 - DNA, 18 bp, Homo sapiens
attactttcagaatgttg

SEQ ID NO: 1954863 - DNA, 18 bp, Homo sapiens
attactttgaacattaat

SEQ ID NO: 1954864 - DNA, 21 bp, Homo sapiens
caacctgttcacgtgactcct

SEQ ID NO: 1954865 - DNA, 13 bp, Homo sapiens
caagaatgtttca

SEQ ID NO: 1954866 - DNA, 16 bp, Homo sapiens
caagaatgtttcagtt

SEQ ID NO: 1954867 - DNA, 21 bp, Homo sapiens
caagattaagttataccagca

SEQ ID NO: 1954868 - DNA, 16 bp, Homo sapiens
caaggcctccagccac

SEQ ID NO: 1954869 - DNA, 21 bp, Homo sapiens
caaggtgcggaccggagcggc

SEQ ID NO: 1954870 - DNA, 12 bp, Homo sapiens
caagtctgtgaa

SEQ ID NO: 1954871 - DNA, 13 bp, Homo sapiens
caagtctgtgaaa

SEQ ID NO: 1954872 - DNA, 19 bp, Homo sapiens
caagtgtgtgtgcaatgtt

SEQ ID NO: 1954873 - DNA, 18 bp, Homo sapiens
caagttacatacatttaa

SEQ ID NO: 1954874 - DNA, 14 bp, Homo sapiens
caagttattcagaa

SEQ ID NO: 1954875 - DNA, 17 bp, Homo sapiens
caagttattcagaaata

SEQ ID NO: 1954876 - DNA, 18 bp, Homo sapiens
caagtttttttgttcata

SEQ ID NO: 1954877 - DNA, 21 bp, Homo sapiens
caagtttttttgttcatactt

SEQ ID NO: 1954878 - DNA, 19 bp, Homo sapiens
caatacaagttacatacat

SEQ ID NO: 1954879 - DNA, 15 bp, Homo sapiens
caatagcattgttct

SEQ ID NO: 1954880 - DNA, 14 bp, Homo sapiens
caatccacagtatt

SEQ ID NO: 1954881 - DNA, 16 bp, Homo sapiens
caatcttgctgtgaaa

SEQ ID NO: 1954882 - DNA, 22 bp, Homo sapiens
caatcttgctgtgaaacagtgt

SEQ ID NO: 1954883 - DNA, 12 bp, Homo sapiens
caatgtccaggt

SEQ ID NO: 1954884 - DNA, 19 bp, Homo sapiens
caatgtggaattacataac

SEQ ID NO: 1954885 - DNA, 17 bp, Homo sapiens
caattctttgttgctta

SEQ ID NO: 1954886 - DNA, 23 bp, Homo sapiens
caatttaggaatgctcaatgtgc

SEQ ID NO: 1954887 - DNA, 15 bp, Homo sapiens
cacaaaacaacagca

SEQ ID NO: 1954888 - DNA, 18 bp, Homo sapiens
cacaagtttttttgttca

SEQ ID NO: 1954889 - DNA, 12 bp, Homo sapiens
cacacacaaaac

SEQ ID NO: 1954890 - DNA, 14 bp, Homo sapiens
cacacacaaaacaa

SEQ ID NO: 1954891 - DNA, 15 bp, Homo sapiens
cacacacaaaacaac

SEQ ID NO: 1954892 - DNA, 15 bp, Homo sapiens
cacacgccggggctg

SEQ ID NO: 1954893 - DNA, 18 bp, Homo sapiens
cacacgccggggctggcc

SEQ ID NO: 1954894 - DNA, 19 bp, Homo sapiens
cacacgccggggctggccc

SEQ ID NO: 1954895 - DNA, 21 bp, Homo sapiens
cacacgccggggctggccctg

SEQ ID NO: 1954896 - DNA, 23 bp, Homo sapiens
cacacgccggggctggccctgcc

SEQ ID NO: 1954897 - DNA, 17 bp, Homo sapiens
cacagctgagctggcct

SEQ ID NO: 1954898 - DNA, 14 bp, Homo sapiens
cacatctcttcatg

SEQ ID NO: 1954899 - DNA, 19 bp, Homo sapiens
cacatgcccctcttagaag

SEQ ID NO: 1954900 - DNA, 15 bp, Homo sapiens
caccaaattgctgag

SEQ ID NO: 1954901 - DNA, 11 bp, Homo sapiens
caccagcctga

SEQ ID NO: 1954902 - DNA, 18 bp, Homo sapiens
caccagcctgagccacag

SEQ ID NO: 1954903 - DNA, 22 bp, Homo sapiens
caccagcctgagccacagtggg

SEQ ID NO: 1954904 - DNA, 20 bp, Homo sapiens
caccatttaatcatttccag

SEQ ID NO: 1954905 - DNA, 22 bp, Homo sapiens
caccatttaatcatttccagca

SEQ ID NO: 1954906 - DNA, 17 bp, Homo sapiens
caccatttcccctgtgg

SEQ ID NO: 1954907 - DNA, 18 bp, Homo sapiens
caccatttcccctgtggt

SEQ ID NO: 1954908 - DNA, 21 bp, Homo sapiens
caccatttcccctgtggtttg

SEQ ID NO: 1954909 - DNA, 19 bp, Homo sapiens
cacccacaccccgtctgcc

SEQ ID NO: 1954910 - DNA, 14 bp, Homo sapiens
cacccactagccct

SEQ ID NO: 1954911 - DNA, 12 bp, Homo sapiens
cacccagcctgg

SEQ ID NO: 1954912 - DNA, 12 bp, Homo sapiens
cacccccagcct

SEQ ID NO: 1954913 - DNA, 14 bp, Homo sapiens
cacccccagcctcc

SEQ ID NO: 1954914 - DNA, 17 bp, Homo sapiens
caccccgctgcctggcg

SEQ ID NO: 1954915 - DNA, 18 bp, Homo sapiens
caccccgctgcctggcgg

SEQ ID NO: 1954916 - DNA, 23 bp, Homo sapiens
caccccgctgcctggcgggcagc

SEQ ID NO: 1954917 - DNA, 12 bp, Homo sapiens
caccccgtcccg

SEQ ID NO: 1954918 - DNA, 19 bp, Homo sapiens
caccccgtcccggccccgc

SEQ ID NO: 1954919 - DNA, 19 bp, Homo sapiens
cacccgccccagagactgc

SEQ ID NO: 1954920 - DNA, 23 bp, Homo sapiens
cacccgccccagagactgcccac

SEQ ID NO: 1954921 - DNA, 14 bp, Homo sapiens
cacccgcccgcccc

SEQ ID NO: 1954922 - DNA, 18 bp, Homo sapiens
cacccgtgttctcctcca

SEQ ID NO: 1954923 - DNA, 16 bp, Homo sapiens
caccctgggcctcccg

SEQ ID NO: 1954924 - DNA, 12 bp, Homo sapiens
caccgcccaccc

SEQ ID NO: 1954925 - DNA, 14 bp, Homo sapiens
caccgcccacccac

SEQ ID NO: 1954926 - DNA, 17 bp, Homo sapiens
caccgtggtgtgaggcc

SEQ ID NO: 1954927 - DNA, 15 bp, Homo sapiens
cacctaattaatttc

SEQ ID NO: 1954928 - DNA, 22 bp, Homo sapiens
cacctcccggtgtatgcagtgg

SEQ ID NO: 1954929 - DNA, 14 bp, Homo sapiens
cacctgcccagtta

SEQ ID NO: 1954930 - DNA, 22 bp, Homo sapiens
cacctgcccagttagcccggcc

SEQ ID NO: 1954931 - DNA, 21 bp, Homo sapiens
caccttctgtgcatctggcct

SEQ ID NO: 1954932 - DNA, 21 bp, Homo sapiens
caccttgtacagaaccagcac

SEQ ID NO: 1954933 - DNA, 22 bp, Homo sapiens
caccttgtacagaaccagcact

SEQ ID NO: 1954934 - DNA, 23 bp, Homo sapiens
caccttgtacagaaccagcactc

SEQ ID NO: 1954935 - DNA, 11 bp, Homo sapiens
cacgcagagcc

SEQ ID NO: 1954936 - DNA, 15 bp, Homo sapiens
cacgcagagccccgg

SEQ ID NO: 1954937 - DNA, 21 bp, Homo sapiens
cacgcagagccccggagcacc

SEQ ID NO: 1954938 - DNA, 21 bp, Homo sapiens
cacggccgtccctgacttccc

SEQ ID NO: 1954939 - DNA, 16 bp, Homo sapiens
cacgggagagcgccac

SEQ ID NO: 1954940 - DNA, 19 bp, Homo sapiens
cacgggagagcgccacccg

SEQ ID NO: 1954941 - DNA, 22 bp, Homo sapiens
cacgggagagcgccacccgccc

SEQ ID NO: 1954942 - DNA, 12 bp, Homo sapiens
cacgggcccgct

SEQ ID NO: 1954943 - DNA, 23 bp, Homo sapiens
cacggggtcgggggaggagcacc

SEQ ID NO: 1954944 - DNA, 19 bp, Homo sapiens
cacggtcctttgagtgtca

SEQ ID NO: 1954945 - DNA, 21 bp, Homo sapiens
cacgtctgtgagtctgtcctt

SEQ ID NO: 1954946 - DNA, 21 bp, Homo sapiens
cactaaaagtgatgtgattta

SEQ ID NO: 1954947 - DNA, 15 bp, Homo sapiens
cactagccctctttc

SEQ ID NO: 1954948 - DNA, 15 bp, Homo sapiens
cactcccagggcccg

SEQ ID NO: 1954949 - DNA, 19 bp, Homo sapiens
cactctgaagtcccttcct

SEQ ID NO: 1954950 - DNA, 21 bp, Homo sapiens
cactctgaagtcccttcctgt

SEQ ID NO: 1954951 - DNA, 18 bp, Homo sapiens
cactgatatcacgggccc

SEQ ID NO: 1954952 - DNA, 21 bp, Homo sapiens
cactgatgggtcctgctgctc

SEQ ID NO: 1954953 - DNA, 13 bp, Homo sapiens
cacttaaaagatg

SEQ ID NO: 1954954 - DNA, 12 bp, Homo sapiens
cactttcctctc

SEQ ID NO: 1954955 - DNA, 16 bp, Homo sapiens
cactttcctctctctc

SEQ ID NO: 1954956 - DNA, 22 bp, Homo sapiens
cacttttttcctgtcaatatat

SEQ ID NO: 1954957 - DNA, 21 bp, Homo sapiens
cagaaagaggaataaaatgat

SEQ ID NO: 1954958 - DNA, 22 bp, Homo sapiens
cagaaagaggaataaaatgatt

SEQ ID NO: 1954959 - DNA, 17 bp, Homo sapiens
cagaaatgattcagggt

SEQ ID NO: 1954960 - DNA, 15 bp, Homo sapiens
cagaaccagcactcc

SEQ ID NO: 1954961 - DNA, 16 bp, Homo sapiens
cagaaccagcactccc

SEQ ID NO: 1954962 - DNA, 17 bp, Homo sapiens
cagaaccagcactccca

SEQ ID NO: 1954963 - DNA, 17 bp, Homo sapiens
cagaacgggcctccccg

SEQ ID NO: 1954964 - DNA, 14 bp, Homo sapiens
cagaagcagcagct

SEQ ID NO: 1954965 - DNA, 21 bp, Homo sapiens
cagaagcagcagctagaaaga

SEQ ID NO: 1954966 - DNA, 19 bp, Homo sapiens
cagaagctcaaggctgcag

SEQ ID NO: 1954967 - DNA, 20 bp, Homo sapiens
cagaattgctaggtaaagag

SEQ ID NO: 1954968 - DNA, 14 bp, Homo sapiens
cagacacctagact

SEQ ID NO: 1954969 - DNA, 16 bp, Homo sapiens
cagactcgagagggct

SEQ ID NO: 1954970 - DNA, 22 bp, Homo sapiens
cagagacggcagccccatcctt

SEQ ID NO: 1954971 - DNA, 12 bp, Homo sapiens
cagagactgccc

SEQ ID NO: 1954972 - DNA, 18 bp, Homo sapiens
cagagactgcccaccctg

SEQ ID NO: 1954973 - DNA, 21 bp, Homo sapiens
cagagactgcccaccctgggc

SEQ ID NO: 1954974 - DNA, 17 bp, Homo sapiens
cagagccccggagcacc

SEQ ID NO: 1954975 - DNA, 23 bp, Homo sapiens
cagagcgatgtgttctttgtacc

SEQ ID NO: 1954976 - DNA, 18 bp, Homo sapiens
cagagctgagtcggctgg

SEQ ID NO: 1954977 - DNA, 15 bp, Homo sapiens
cagaggcagggccct

SEQ ID NO: 1954978 - DNA, 16 bp, Homo sapiens
cagaggcagggccctg

SEQ ID NO: 1954979 - DNA, 13 bp, Homo sapiens
cagataatgatgg

SEQ ID NO: 1954980 - DNA, 17 bp, Homo sapiens
cagatcacatgcccctc

SEQ ID NO: 1954981 - DNA, 13 bp, Homo sapiens
cagatccatcggt

SEQ ID NO: 1954982 - DNA, 14 bp, Homo sapiens
cagatccctcggtc

SEQ ID NO: 1954983 - DNA, 21 bp, Homo sapiens
cagatccctcggtcagcaccg

SEQ ID NO: 1954984 - DNA, 18 bp, Homo sapiens
cagcaaaatatatgtttg

SEQ ID NO: 1954985 - DNA, 21 bp, Homo sapiens
cagcaccgtggtgtgaggccc

SEQ ID NO: 1954986 - DNA, 20 bp, Homo sapiens
cagcactcccagggcccgag

SEQ ID NO: 1954987 - DNA, 21 bp, Homo sapiens
cagcactcccagggcccgagc

SEQ ID NO: 1954988 - DNA, 18 bp, Homo sapiens
cagcagctagaaagagaa

SEQ ID NO: 1954989 - DNA, 17 bp, Homo sapiens
cagcagtaccatcccac

SEQ ID NO: 1954990 - DNA, 18 bp, Homo sapiens
cagcagtaccatcccact

SEQ ID NO: 1954991 - DNA, 22 bp, Homo sapiens
cagcagtaccatcccactgata

SEQ ID NO: 1954992 - DNA, 14 bp, Homo sapiens
cagcagtttcatga

SEQ ID NO: 1954993 - DNA, 20 bp, Homo sapiens
cagcagtttgtgatctgtcc

SEQ ID NO: 1954994 - DNA, 19 bp, Homo sapiens
cagcatgtgggtgtcagtg

SEQ ID NO: 1954995 - DNA, 18 bp, Homo sapiens
ctcctgagcctgtctctc

SEQ ID NO: 1954996 - DNA, 19 bp, Homo sapiens
ctcctgtctcctctgtcag

SEQ ID NO: 1954997 - DNA, 15 bp, Homo sapiens
ctcgggaaggcctga

SEQ ID NO: 1954998 - DNA, 17 bp, Homo sapiens
ctcgggaaggcctgagg

SEQ ID NO: 1954999 - DNA, 23 bp, Homo sapiens
ctcgggaaggcctgagggaagcc

SEQ ID NO: 1955000 - DNA, 17 bp, Homo sapiens
ctcgggccgcctcctcc

SEQ ID NO: 1955001 - DNA, 14 bp, Homo sapiens
ctcggtcagcaccg

SEQ ID NO: 1955002 - DNA, 19 bp, Homo sapiens
ctcggtggcatttgctgaa

SEQ ID NO: 1955003 - DNA, 16 bp, Homo sapiens
ctcgtccggcctgcag

SEQ ID NO: 1955004 - DNA, 17 bp, Homo sapiens
ctcgtccggcctgcagc

SEQ ID NO: 1955005 - DNA, 13 bp, Homo sapiens
ctctaaaactatc

SEQ ID NO: 1955006 - DNA, 13 bp, Homo sapiens
ctctcaaaatgtg

SEQ ID NO: 1955007 - DNA, 13 bp, Homo sapiens
ctctcagatccct

SEQ ID NO: 1955008 - DNA, 22 bp, Homo sapiens
ctctcagatccctcggtcagca

SEQ ID NO: 1955009 - DNA, 23 bp, Homo sapiens
ctctcagatccctcggtcagcac

SEQ ID NO: 1955010 - DNA, 14 bp, Homo sapiens
ctctcattcccagg

SEQ ID NO: 1955011 - DNA, 15 bp, Homo sapiens
ctctcccttttcaga

SEQ ID NO: 1955012 - DNA, 18 bp, Homo sapiens
ctctcctcggtggcattt

SEQ ID NO: 1955013 - DNA, 12 bp, Homo sapiens
ctctcctcgtcc

SEQ ID NO: 1955014 - DNA, 18 bp, Homo sapiens
ctctcctgagcctgtctc

SEQ ID NO: 1955015 - DNA, 20 bp, Homo sapiens
ctctcctgagcctgtctctc

SEQ ID NO: 1955016 - DNA, 14 bp, Homo sapiens
ctctctcattccca

SEQ ID NO: 1955017 - DNA, 10 bp, Homo sapiens
ctctctctct

SEQ ID NO: 1955018 - DNA, 13 bp, Homo sapiens
ctctctctctctg

SEQ ID NO: 1955019 - DNA, 14 bp, Homo sapiens
ctctctctctctgt

SEQ ID NO: 1955020 - DNA, 14 bp, Homo sapiens
ctctctctgttcca

SEQ ID NO: 1955021 - DNA, 18 bp, Homo sapiens
ctctctgaactgcaacac

SEQ ID NO: 1955022 - DNA, 21 bp, Homo sapiens
ctctctgaactgcaacactgg

SEQ ID NO: 1955023 - DNA, 15 bp, Homo sapiens
ctctctgtgtggcaa

SEQ ID NO: 1955024 - DNA, 18 bp, Homo sapiens
ctctctgttccaagtgtg

SEQ ID NO: 1955025 - DNA, 23 bp, Homo sapiens
ctctgaagtcccttcctgtcctg

SEQ ID NO: 1955026 - DNA, 14 bp, Homo sapiens
ctctgagcagtggg

SEQ ID NO: 1955027 - DNA, 14 bp, Homo sapiens
ctctgagtcctcat

SEQ ID NO: 1955028 - DNA, 18 bp, Homo sapiens
ctctgcagcctgagctcc

SEQ ID NO: 1955029 - DNA, 10 bp, Homo sapiens
ctctgccccc

SEQ ID NO: 1955030 - DNA, 16 bp, Homo sapiens
ctctgccccctccccc

SEQ ID NO: 1955031 - DNA, 21 bp, Homo sapiens
ctctgccccctcccccgcaga

SEQ ID NO: 1955032 - DNA, 21 bp, Homo sapiens
ctctgcccctccgtccccagg

SEQ ID NO: 1955033 - DNA, 18 bp, Homo sapiens
ctctgtcagtttgtgaag

SEQ ID NO: 1955034 - DNA, 23 bp, Homo sapiens
ctctgtcagtttgtgaagtgatt

SEQ ID NO: 1955035 - DNA, 11 bp, Homo sapiens
ctctgttccaa

SEQ ID NO: 1955036 - DNA, 22 bp, Homo sapiens
ctcttaaaaattatctttaaaa

SEQ ID NO: 1955037 - DNA, 19 bp, Homo sapiens
ctcttactaaccaccattt

SEQ ID NO: 1955038 - DNA, 17 bp, Homo sapiens
ctcttatatgtgcccct

SEQ ID NO: 1955039 - DNA, 23 bp, Homo sapiens
ctcttatatgtgccccttcccca

SEQ ID NO: 1955040 - DNA, 16 bp, Homo sapiens
ctcttcttgcggcacc

SEQ ID NO: 1955041 - DNA, 20 bp, Homo sapiens
ctcttgacatcaagggagga

SEQ ID NO: 1955042 - DNA, 22 bp, Homo sapiens
ctcttggtctctttctttccaa

SEQ ID NO: 1955043 - DNA, 16 bp, Homo sapiens
ctctttctctctgtgt

SEQ ID NO: 1955044 - DNA, 18 bp, Homo sapiens
ctctttctctctgtgtgg

SEQ ID NO: 1955045 - DNA, 15 bp, Homo sapiens
ctctttctttccaaa

SEQ ID NO: 1955046 - DNA, 16 bp, Homo sapiens
ctctttctttccaaag

SEQ ID NO: 1955047 - DNA, 15 bp, Homo sapiens
ctctttgctgctttg

SEQ ID NO: 1955048 - DNA, 16 bp, Homo sapiens
ctcttttgctctctca

SEQ ID NO: 1955049 - DNA, 17 bp, Homo sapiens
ctcttttgctctctcat

SEQ ID NO: 1955050 - DNA, 17 bp, Homo sapiens
ctgaaagtaatttcaag

SEQ ID NO: 1955051 - DNA, 23 bp, Homo sapiens
ctgaaagtaatttcaagaatgtt

SEQ ID NO: 1955052 - DNA, 17 bp, Homo sapiens
ctgaaattatgtcaaat

SEQ ID NO: 1955053 - DNA, 20 bp, Homo sapiens
ctgaaattatgtcaaatgga

SEQ ID NO: 1955054 - DNA, 16 bp, Homo sapiens
ctgaactgcaacactg

SEQ ID NO: 1955055 - DNA, 13 bp, Homo sapiens
ctgaagtcccttc

SEQ ID NO: 1955056 - DNA, 15 bp, Homo sapiens
ctgaagtcccttcct

SEQ ID NO: 1955057 - DNA, 18 bp, Homo sapiens
ctgaagtcccttcctgtc

SEQ ID NO: 1955058 - DNA, 22 bp, Homo sapiens
ctgaataacaacaatttaggaa

SEQ ID NO: 1955059 - DNA, 15 bp, Homo sapiens
ctgaatcagaggcag

SEQ ID NO: 1955060 - DNA, 13 bp, Homo sapiens
ctgaatctctcaa

SEQ ID NO: 1955061 - DNA, 18 bp, Homo sapiens
ctgaatctctcaaaatgt

SEQ ID NO: 1955062 - DNA, 15 bp, Homo sapiens
ctgaattggctgcca

SEQ ID NO: 1955063 - DNA, 13 bp, Homo sapiens
ctgaccttctgcg

SEQ ID NO: 1955064 - DNA, 15 bp, Homo sapiens
ctgacttcccagctg

SEQ ID NO: 1955065 - DNA, 22 bp, Homo sapiens
ctgacttcccagctggcagcgc

SEQ ID NO: 1955066 - DNA, 23 bp, Homo sapiens
ctgacttcccagctggcagcgcc

SEQ ID NO: 1955067 - DNA, 17 bp, Homo sapiens
ctgagacgcaaggatca

SEQ ID NO: 1955068 - DNA, 18 bp, Homo sapiens
ctgagatgtttagtagct

SEQ ID NO: 1955069 - DNA, 14 bp, Homo sapiens
ctgagcagtgggga

SEQ ID NO: 1955070 - DNA, 14 bp, Homo sapiens
ctgagccacagtgg

SEQ ID NO: 1955071 - DNA, 16 bp, Homo sapiens
ctgagccacagtgggg

SEQ ID NO: 1955072 - DNA, 17 bp, Homo sapiens
ctgagccacagtggggc

SEQ ID NO: 1955073 - DNA, 16 bp, Homo sapiens
ctgagcccctcctctc

SEQ ID NO: 1955074 - DNA, 19 bp, Homo sapiens
ctgagcccctcctctcctc

SEQ ID NO: 1955075 - DNA, 19 bp, Homo sapiens
ctgagcctgtctctcccta

SEQ ID NO: 1955076 - DNA, 20 bp, Homo sapiens
ctgaggaaaggagggaaagt

SEQ ID NO: 1955077 - DNA, 19 bp, Homo sapiens
ctgaggaaagggaggagag

SEQ ID NO: 1955078 - DNA, 13 bp, Homo sapiens
ctgaggacggggc

SEQ ID NO: 1955079 - DNA, 18 bp, Homo sapiens
ctgaggacggggcagagc

SEQ ID NO: 1955080 - DNA, 19 bp, Homo sapiens
ctgaggacggggcagagct

SEQ ID NO: 1955081 - DNA, 21 bp, Homo sapiens
ctgaggacggggcagagctga

SEQ ID NO: 1955082 - DNA, 22 bp, Homo sapiens
ctgaggacggggcagagctgag

SEQ ID NO: 1955083 - DNA, 12 bp, Homo sapiens
ctgaggagtcca

SEQ ID NO: 1955084 - DNA, 17 bp, Homo sapiens
ctgagggaagcccaccc

SEQ ID NO: 1955085 - DNA, 20 bp, Homo sapiens
ctgagggaagcccacccgcc

SEQ ID NO: 1955086 - DNA, 23 bp, Homo sapiens
ctgagggaagcccacccgcccca

SEQ ID NO: 1955087 - DNA, 17 bp, Homo sapiens
ctgagtcggctgggcag

SEQ ID NO: 1955088 - DNA, 20 bp, Homo sapiens
ctgagtcggctgggcagggc

SEQ ID NO: 1955089 - DNA, 21 bp, Homo sapiens
ctgagttgtgcctcatttatt

SEQ ID NO: 1955090 - DNA, 15 bp, Homo sapiens
ctgataaagaaacct

SEQ ID NO: 1955091 - DNA, 21 bp, Homo sapiens
ctgatatcacgggcccgctca

SEQ ID NO: 1955092 - DNA, 22 bp, Homo sapiens
ctgatatctgtttgcttctaaa

SEQ ID NO: 1955093 - DNA, 15 bp, Homo sapiens
ctgatgatggaaggg

SEQ ID NO: 1955094 - DNA, 21 bp, Homo sapiens
ctgatgggtatcatgcttcta

SEQ ID NO: 1955095 - DNA, 18 bp, Homo sapiens
ctgatgggtcctgctgct

SEQ ID NO: 1955096 - DNA, 13 bp, Homo sapiens
ctgcaacactgga

SEQ ID NO: 1955097 - DNA, 18 bp, Homo sapiens
ctgcacacataacacaca

SEQ ID NO: 1955098 - DNA, 15 bp, Homo sapiens
ctgcagaaaattcta

SEQ ID NO: 1955099 - DNA, 13 bp, Homo sapiens
ctgcagcccagaa

SEQ ID NO: 1955100 - DNA, 15 bp, Homo sapiens
ctgcagcccagaacg

SEQ ID NO: 1955101 - DNA, 15 bp, Homo sapiens
ctgcagcctgagctc

SEQ ID NO: 1955102 - DNA, 22 bp, Homo sapiens
ctgcagcctgagctccaccctc

SEQ ID NO: 1955103 - DNA, 15 bp, Homo sapiens
ctgccaagagtccaa

SEQ ID NO: 1955104 - DNA, 12 bp, Homo sapiens
ctgcccaccctg

SEQ ID NO: 1955105 - DNA, 23 bp, Homo sapiens
ctgcccaccctgggcctcccgtc

SEQ ID NO: 1955106 - DNA, 14 bp, Homo sapiens
ctgcccagttagcc

SEQ ID NO: 1955107 - DNA, 20 bp, Homo sapiens
ctgcccagttagcccggcca

SEQ ID NO: 1955108 - DNA, 13 bp, Homo sapiens
cccgcagcaccag

SEQ ID NO: 1955109 - DNA, 14 bp, Homo sapiens
cccgcagcaccagc

SEQ ID NO: 1955110 - DNA, 22 bp, Homo sapiens
cccgcagcaccagcctgagcca

SEQ ID NO: 1955111 - DNA, 13 bp, Homo sapiens
cccgccccagaga

SEQ ID NO: 1955112 - DNA, 16 bp, Homo sapiens
cccgccccagagactg

SEQ ID NO: 1955113 - DNA, 18 bp, Homo sapiens
cccgcccccgccctcgct

SEQ ID NO: 1955114 - DNA, 18 bp, Homo sapiens
cccgccgcctcgggccgc

SEQ ID NO: 1955115 - DNA, 18 bp, Homo sapiens
cccgccggttggccggct

SEQ ID NO: 1955116 - DNA, 15 bp, Homo sapiens
cccgcgcgtgccccc

SEQ ID NO: 1955117 - DNA, 19 bp, Homo sapiens
cccgcgcgtgcccccagcg

SEQ ID NO: 1955118 - DNA, 18 bp, Homo sapiens
cccgctcaacctctcaga

SEQ ID NO: 1955119 - DNA, 14 bp, Homo sapiens
cccgctgcctggcg

SEQ ID NO: 1955120 - DNA, 19 bp, Homo sapiens
cccgctgcctggcgggcag

SEQ ID NO: 1955121 - DNA, 15 bp, Homo sapiens
cccggacgctggctc

SEQ ID NO: 1955122 - DNA, 19 bp, Homo sapiens
cccggagcaccacggggtc

SEQ ID NO: 1955123 - DNA, 15 bp, Homo sapiens
cccggaggcgcccac

SEQ ID NO: 1955124 - DNA, 17 bp, Homo sapiens
cccggaggcgcccacct

SEQ ID NO: 1955125 - DNA, 21 bp, Homo sapiens
cccggaggcgcccacctgccc

SEQ ID NO: 1955126 - DNA, 19 bp, Homo sapiens
cccggcccccctctcgggc

SEQ ID NO: 1955127 - DNA, 16 bp, Homo sapiens
cccggtgtatgcagtg

SEQ ID NO: 1955128 - DNA, 17 bp, Homo sapiens
cccgtccgtccgcccgc

SEQ ID NO: 1955129 - DNA, 18 bp, Homo sapiens
cccgtccgtccgcccgcc

SEQ ID NO: 1955130 - DNA, 15 bp, Homo sapiens
ccctcccccgcagac

SEQ ID NO: 1955131 - DNA, 23 bp, Homo sapiens
ccctccctgtctgtctgtctctc

SEQ ID NO: 1955132 - DNA, 15 bp, Homo sapiens
ccctccgtccccagg

SEQ ID NO: 1955133 - DNA, 14 bp, Homo sapiens
ccctcctcgggcgc

SEQ ID NO: 1955134 - DNA, 12 bp, Homo sapiens
ccctcctctgcc

SEQ ID NO: 1955135 - DNA, 14 bp, Homo sapiens
ccctcctctgcccc

SEQ ID NO: 1955136 - DNA, 13 bp, Homo sapiens
ccctcgctccggg

SEQ ID NO: 1955137 - DNA, 21 bp, Homo sapiens
ccctctcctgagcctgtctct

SEQ ID NO: 1955138 - DNA, 15 bp, Homo sapiens
ccctcttagaagaaa

SEQ ID NO: 1955139 - DNA, 22 bp, Homo sapiens
ccctcttagaagaaatatgagc

SEQ ID NO: 1955140 - DNA, 20 bp, Homo sapiens
ccctctttctctctgtgtgg

SEQ ID NO: 1955141 - DNA, 22 bp, Homo sapiens
ccctctttctctctgtgtggca

SEQ ID NO: 1955142 - DNA, 14 bp, Homo sapiens
ccctgacttcccag

SEQ ID NO: 1955143 - DNA, 16 bp, Homo sapiens
ccctgacttcccagct

SEQ ID NO: 1955144 - DNA, 18 bp, Homo sapiens
ccctgacttcccagctgg

SEQ ID NO: 1955145 - DNA, 19 bp, Homo sapiens
ccctgacttcccagctggc

SEQ ID NO: 1955146 - DNA, 21 bp, Homo sapiens
ccctgacttcccagctggcag

SEQ ID NO: 1955147 - DNA, 15 bp, Homo sapiens
ccctgcaccttgggc

SEQ ID NO: 1955148 - DNA, 16 bp, Homo sapiens
ccctgccctcccccac

SEQ ID NO: 1955149 - DNA, 21 bp, Homo sapiens
cagcccagaacgggcctcccc

SEQ ID NO: 1955150 - DNA, 19 bp, Homo sapiens
cagccctcattaaactaat

SEQ ID NO: 1955151 - DNA, 21 bp, Homo sapiens
cagccgcgctctgcccctccg

SEQ ID NO: 1955152 - DNA, 13 bp, Homo sapiens
cagcctcccccag

SEQ ID NO: 1955153 - DNA, 14 bp, Homo sapiens
cagcctcccccagg

SEQ ID NO: 1955154 - DNA, 15 bp, Homo sapiens
cagcctcccccaggc

SEQ ID NO: 1955155 - DNA, 16 bp, Homo sapiens
cagcctcccccaggct

SEQ ID NO: 1955156 - DNA, 22 bp, Homo sapiens
cagcctcccccaggctgcgcct

SEQ ID NO: 1955157 - DNA, 12 bp, Homo sapiens
cagcctgagcca

SEQ ID NO: 1955158 - DNA, 14 bp, Homo sapiens
cagcctgagccaca

SEQ ID NO: 1955159 - DNA, 18 bp, Homo sapiens
cagcctgagccacagtgg

SEQ ID NO: 1955160 - DNA, 16 bp, Homo sapiens
cagcctgagctccacc

SEQ ID NO: 1955161 - DNA, 18 bp, Homo sapiens
cagcctgagctccaccct

SEQ ID NO: 1955162 - DNA, 12 bp, Homo sapiens
cagcgcctcccg

SEQ ID NO: 1955163 - DNA, 15 bp, Homo sapiens
cagcgcctcccgccg

SEQ ID NO: 1955164 - DNA, 15 bp, Homo sapiens
cagcggcagcagcag

SEQ ID NO: 1955165 - DNA, 13 bp, Homo sapiens
cagcggcccggcc

SEQ ID NO: 1955166 - DNA, 17 bp, Homo sapiens
cagcggcccggcccacg

SEQ ID NO: 1955167 - DNA, 19 bp, Homo sapiens
cagcggcccggcccacgca

SEQ ID NO: 1955168 - DNA, 22 bp, Homo sapiens
cagcggcccggcccacgcagag

SEQ ID NO: 1955169 - DNA, 15 bp, Homo sapiens
cagctagaaagagaa

SEQ ID NO: 1955170 - DNA, 16 bp, Homo sapiens
cagctagaaagagaaa

SEQ ID NO: 1955171 - DNA, 12 bp, Homo sapiens
cagctagctgct

SEQ ID NO: 1955172 - DNA, 15 bp, Homo sapiens
cagctagctgctttt

SEQ ID NO: 1955173 - DNA, 17 bp, Homo sapiens
cagctccactctgaagt

SEQ ID NO: 1955174 - DNA, 13 bp, Homo sapiens
cagctggcagcgc

SEQ ID NO: 1955175 - DNA, 14 bp, Homo sapiens
cagctggcagcgcc

SEQ ID NO: 1955176 - DNA, 22 bp, Homo sapiens
cagctggctgggtcgcccctcc

SEQ ID NO: 1955177 - DNA, 14 bp, Homo sapiens
cagctgtgagcttt

SEQ ID NO: 1955178 - DNA, 16 bp, Homo sapiens
cagcttcccaacaata

SEQ ID NO: 1955179 - DNA, 11 bp, Homo sapiens
caggaaaatga

SEQ ID NO: 1955180 - DNA, 14 bp, Homo sapiens
caggaaagatccca

SEQ ID NO: 1955181 - DNA, 13 bp, Homo sapiens
caggattttcaag

SEQ ID NO: 1955182 - DNA, 16 bp, Homo sapiens
caggcacggaggctcg

SEQ ID NO: 1955183 - DNA, 18 bp, Homo sapiens
caggcattgcactaaaag

SEQ ID NO: 1955184 - DNA, 20 bp, Homo sapiens
caggcattgcactaaaagtg

SEQ ID NO: 1955185 - DNA, 17 bp, Homo sapiens
caggcgcgcaccgccca

SEQ ID NO: 1955186 - DNA, 23 bp, Homo sapiens
caggcgcgcaccgcccaaccccc

SEQ ID NO: 1955187 - DNA, 13 bp, Homo sapiens
caggcggaggggc

SEQ ID NO: 1955188 - DNA, 17 bp, Homo sapiens
caggcggaggggcttgg

SEQ ID NO: 1955189 - DNA, 23 bp, Homo sapiens
caggcggaggggcttggagcaga

SEQ ID NO: 1955190 - DNA, 13 bp, Homo sapiens
caggctgcgcctg

SEQ ID NO: 1955191 - DNA, 19 bp, Homo sapiens
caggctgcgcctgcccgcc

SEQ ID NO: 1955192 - DNA, 20 bp, Homo sapiens
caggctgcgcctgcccgccc

SEQ ID NO: 1955193 - DNA, 21 bp, Homo sapiens
cagggccctggggtctctgag

SEQ ID NO: 1955194 - DNA, 22 bp, Homo sapiens
cagggccctggggtctctgagc

SEQ ID NO: 1955195 - DNA, 14 bp, Homo sapiens
cagggccgcagggc

SEQ ID NO: 1955196 - DNA, 15 bp, Homo sapiens
cagggccgcagggcg

SEQ ID NO: 1955197 - DNA, 16 bp, Homo sapiens
cagggccgcagggcgc

SEQ ID NO: 1955198 - DNA, 17 bp, Homo sapiens
cagggccgcagggcgct

SEQ ID NO: 1955199 - DNA, 18 bp, Homo sapiens
cagggccgcagggcgctc

SEQ ID NO: 1955200 - DNA, 20 bp, Homo sapiens
cagggccgcagggcgctccg

SEQ ID NO: 1955201 - DNA, 18 bp, Homo sapiens
cagggcgctccggcagag

SEQ ID NO: 1955202 - DNA, 19 bp, Homo sapiens
cagggcgctccggcagagg

SEQ ID NO: 1955203 - DNA, 20 bp, Homo sapiens
cagggcgctccggcagaggc

SEQ ID NO: 1955204 - DNA, 21 bp, Homo sapiens
caggggaatgctaagccagtt

SEQ ID NO: 1955205 - DNA, 12 bp, Homo sapiens
caggggaggctg

SEQ ID NO: 1955206 - DNA, 20 bp, Homo sapiens
caggggtttgcttacagtga

SEQ ID NO: 1955207 - DNA, 13 bp, Homo sapiens
caggtcacaggca

SEQ ID NO: 1955208 - DNA, 22 bp, Homo sapiens
caggtgtgagcacctttcctga

SEQ ID NO: 1955209 - DNA, 17 bp, Homo sapiens
cagtaaatgtatattga

SEQ ID NO: 1955210 - DNA, 14 bp, Homo sapiens
cagtacaattcttt

SEQ ID NO: 1955211 - DNA, 13 bp, Homo sapiens
cagtaccatccca

SEQ ID NO: 1955212 - DNA, 15 bp, Homo sapiens
cagtaccatcccact

SEQ ID NO: 1955213 - DNA, 24 bp, Homo sapiens
cagtagagggtccagtcttctagt

SEQ ID NO: 1955214 - DNA, 23 bp, Homo sapiens
cagtagtgtcacttttttcctgt

SEQ ID NO: 1955215 - DNA, 22 bp, Homo sapiens
cagtagtgttctgttcactttt

SEQ ID NO: 1955216 - DNA, 13 bp, Homo sapiens
cagtattgttctt

SEQ ID NO: 1955217 - DNA, 20 bp, Homo sapiens
cagtccacccccattgtgaa

SEQ ID NO: 1955218 - DNA, 20 bp, Homo sapiens
cagtgaggtatgatgtgctg

SEQ ID NO: 1955219 - DNA, 19 bp, Homo sapiens
cagtgcctaactccttaca

SEQ ID NO: 1955220 - DNA, 23 bp, Homo sapiens
cagtgtactctgagtcctcattg

SEQ ID NO: 1955221 - DNA, 23 bp, Homo sapiens
cagtgtctgttcttcatttctat

SEQ ID NO: 1955222 - DNA, 19 bp, Homo sapiens
cagtgtggatgtaaatttt

SEQ ID NO: 1955223 - DNA, 16 bp, Homo sapiens
cagtgtggcttaaaca

SEQ ID NO: 1955224 - DNA, 16 bp, Homo sapiens
cagtgttataaaatct

SEQ ID NO: 1955225 - DNA, 18 bp, Homo sapiens
cagtgttttaggtgcctg

SEQ ID NO: 1955226 - DNA, 14 bp, Homo sapiens
cagttccctcagcc

SEQ ID NO: 1955227 - DNA, 17 bp, Homo sapiens
cagttccctcagccctc

SEQ ID NO: 1955228 - DNA, 18 bp, Homo sapiens
cagtttgtgaagtgattg

SEQ ID NO: 1955229 - DNA, 23 bp, Homo sapiens
cagtttgtgaagtgattgacatt

SEQ ID NO: 1955230 - DNA, 11 bp, Homo sapiens
cataacacaca

SEQ ID NO: 1955231 - DNA, 16 bp, Homo sapiens
cataacaggcattgca

SEQ ID NO: 1955232 - DNA, 16 bp, Homo sapiens
cataagctttttctct

SEQ ID NO: 1955233 - DNA, 14 bp, Homo sapiens
catactttggctgt

SEQ ID NO: 1955234 - DNA, 17 bp, Homo sapiens
catagccagttctgaca

SEQ ID NO: 1955235 - DNA, 23 bp, Homo sapiens
catagttattaatgtgatcctaa

SEQ ID NO: 1955236 - DNA, 23 bp, Homo sapiens
catatatatctgagttgtgcctc

SEQ ID NO: 1955237 - DNA, 12 bp, Homo sapiens
catcaaagccct

SEQ ID NO: 1955238 - DNA, 22 bp, Homo sapiens
catcagtccacccccattgtga

SEQ ID NO: 1955239 - DNA, 22 bp, Homo sapiens
catcccactgatatcacgggcc

SEQ ID NO: 1955240 - DNA, 17 bp, Homo sapiens
catcctcttatatgtgc

SEQ ID NO: 1955241 - DNA, 21 bp, Homo sapiens
catcctcttatatgtgcccct

SEQ ID NO: 1955242 - DNA, 18 bp, Homo sapiens
catcctgtttttcctttt

SEQ ID NO: 1955243 - DNA, 20 bp, Homo sapiens
catccttcccgcagcaccag

SEQ ID NO: 1955244 - DNA, 17 bp, Homo sapiens
catctccacaaatagtc

SEQ ID NO: 1955245 - DNA, 17 bp, Homo sapiens
catctctgtaaaaagca

SEQ ID NO: 1955246 - DNA, 16 bp, Homo sapiens
catctgaggagtccaa

SEQ ID NO: 1955247 - DNA, 11 bp, Homo sapiens
catctgtcagc

SEQ ID NO: 1955248 - DNA, 16 bp, Homo sapiens
catcttttcctgctta

SEQ ID NO: 1955249 - DNA, 20 bp, Homo sapiens
catcttttcctgcttagaat

SEQ ID NO: 1955250 - DNA, 22 bp, Homo sapiens
catgaatatcaagaatagttgt

SEQ ID NO: 1955251 - DNA, 22 bp, Homo sapiens
catgacagtagcatactgatga

SEQ ID NO: 1955252 - DNA, 14 bp, Homo sapiens
catgattagacaat

SEQ ID NO: 1955253 - DNA, 18 bp, Homo sapiens
catgattagacaatgtgg

SEQ ID NO: 1955254 - DNA, 20 bp, Homo sapiens
catgattagacaatgtggaa

SEQ ID NO: 1955255 - DNA, 17 bp, Homo sapiens
catgcccctcttagaag

SEQ ID NO: 1955256 - DNA, 19 bp, Homo sapiens
catgctccctcatgcagat

SEQ ID NO: 1955257 - DNA, 15 bp, Homo sapiens
catggccccagctgg

SEQ ID NO: 1955258 - DNA, 21 bp, Homo sapiens
catggctgttatctgtcttta

SEQ ID NO: 1955259 - DNA, 16 bp, Homo sapiens
catgggaattttaact

SEQ ID NO: 1955260 - DNA, 14 bp, Homo sapiens
catgtaatattaaa

SEQ ID NO: 1955261 - DNA, 19 bp, Homo sapiens
catgtaatattaaattcct

SEQ ID NO: 1955262 - DNA, 10 bp, Homo sapiens
cattaagagt

SEQ ID NO: 1955263 - DNA, 14 bp, Homo sapiens
cattaatgttgaaa

SEQ ID NO: 1955264 - DNA, 22 bp, Homo sapiens
cattaatgttgaaaaagaaaac

SEQ ID NO: 1955265 - DNA, 18 bp, Homo sapiens
cattatagcatgtaatat

SEQ ID NO: 1955266 - DNA, 21 bp, Homo sapiens
cattatagcatgtaatattaa

SEQ ID NO: 1955267 - DNA, 22 bp, Homo sapiens
cattatagcatgtaatattaaa

SEQ ID NO: 1955268 - DNA, 22 bp, Homo sapiens
cattcccatgaatatcaagaat

SEQ ID NO: 1955269 - DNA, 17 bp, Homo sapiens
cattgcactaaaagtga

SEQ ID NO: 1955270 - DNA, 23 bp, Homo sapiens
cattgcactaaaagtgatgtgat

SEQ ID NO: 1955271 - DNA, 17 bp, Homo sapiens
cattgggccatgtttaa

SEQ ID NO: 1955272 - DNA, 20 bp, Homo sapiens
cattgtgaatgttgtcctgt

SEQ ID NO: 1955273 - DNA, 17 bp, Homo sapiens
catttaaagataccaaa

SEQ ID NO: 1955274 - DNA, 12 bp, Homo sapiens
catttaatcatt

SEQ ID NO: 1955275 - DNA, 22 bp, Homo sapiens
catttatgcatgagaactaaat

SEQ ID NO: 1955276 - DNA, 21 bp, Homo sapiens
catttccagcaaaatatatgt

SEQ ID NO: 1955277 - DNA, 20 bp, Homo sapiens
catttcccctgtggtttgtt

SEQ ID NO: 1955278 - DNA, 16 bp, Homo sapiens
catttctatagccaaa

SEQ ID NO: 1955279 - DNA, 22 bp, Homo sapiens
catttctatagccaaagctgtt

SEQ ID NO: 1955280 - DNA, 20 bp, Homo sapiens
catttgctgaataacaacaa

SEQ ID NO: 1955281 - DNA, 21 bp, Homo sapiens
catttgctgcatttcaagtta

SEQ ID NO: 1955282 - DNA, 14 bp, Homo sapiens
catttggtggctct

SEQ ID NO: 1955283 - DNA, 15 bp, Homo sapiens
catttggtggctcta

SEQ ID NO: 1955284 - DNA, 16 bp, Homo sapiens
cattttagctaattta

SEQ ID NO: 1955285 - DNA, 11 bp, Homo sapiens
ccaaagaaaat

SEQ ID NO: 1955286 - DNA, 15 bp, Homo sapiens
ccaaattgctgagat

SEQ ID NO: 1955287 - DNA, 18 bp, Homo sapiens
ccaaattgctgagatgtt

SEQ ID NO: 1955288 - DNA, 22 bp, Homo sapiens
ccaacaatactttgtgtctttt

SEQ ID NO: 1955289 - DNA, 17 bp, Homo sapiens
ccaacccccacctcccg

SEQ ID NO: 1955290 - DNA, 18 bp, Homo sapiens
ccaacccccacctcccgg

SEQ ID NO: 1955291 - DNA, 22 bp, Homo sapiens
ccaacccctctcccttttcaga

SEQ ID NO: 1955292 - DNA, 22 bp, Homo sapiens
ccaaggacactgatgggtcctg

SEQ ID NO: 1955293 - DNA, 19 bp, Homo sapiens
ccaagtcaaacagtgtggc

SEQ ID NO: 1955294 - DNA, 16 bp, Homo sapiens
ccaagtgtgtgtgcaa

SEQ ID NO: 1955295 - DNA, 17 bp, Homo sapiens
ccaagtgtgtgtgcaat

SEQ ID NO: 1955296 - DNA, 17 bp, Homo sapiens
ccaatgtccaggtcaca

SEQ ID NO: 1955297 - DNA, 19 bp, Homo sapiens
ccaatgtccaggtcacagg

SEQ ID NO: 1955298 - DNA, 22 bp, Homo sapiens
ccaatgtccaggtcacaggcat

SEQ ID NO: 1955299 - DNA, 22 bp, Homo sapiens
ccacagagttactgccacggtc

SEQ ID NO: 1955300 - DNA, 16 bp, Homo sapiens
ccacagtattgttctt

SEQ ID NO: 1955301 - DNA, 21 bp, Homo sapiens
ccacagtggggcccatggccc

SEQ ID NO: 1955302 - DNA, 22 bp, Homo sapiens
ccacatccccaccctcccctct

SEQ ID NO: 1955303 - DNA, 15 bp, Homo sapiens
ccacattcccatgaa

SEQ ID NO: 1955304 - DNA, 22 bp, Homo sapiens
ccacccacaccccgtctgcccc

SEQ ID NO: 1955305 - DNA, 15 bp, Homo sapiens
ccacccactagccct

SEQ ID NO: 1955306 - DNA, 16 bp, Homo sapiens
ccacccactagccctc

SEQ ID NO: 1955307 - DNA, 17 bp, Homo sapiens
ccacccactagccctct

SEQ ID NO: 1955308 - DNA, 22 bp, Homo sapiens
ccaccccgtcccggccccgcgc

SEQ ID NO: 1955309 - DNA, 15 bp, Homo sapiens
ccacccgccccagag

SEQ ID NO: 1955310 - DNA, 17 bp, Homo sapiens
ccacccgccccagagac

SEQ ID NO: 1955311 - DNA, 19 bp, Homo sapiens
ccacccgccccagagactg

SEQ ID NO: 1955312 - DNA, 21 bp, Homo sapiens
ccacccgcccgcccccgccct

SEQ ID NO: 1955313 - DNA, 15 bp, Homo sapiens
ccacccgtgttctcc

SEQ ID NO: 1955314 - DNA, 14 bp, Homo sapiens
ccaccctcccctct

SEQ ID NO: 1955315 - DNA, 18 bp, Homo sapiens
ccaccctcccctctcctg

SEQ ID NO: 1955316 - DNA, 13 bp, Homo sapiens
ccaccctgggcct

SEQ ID NO: 1955317 - DNA, 16 bp, Homo sapiens
ccaccctgggcctccc

SEQ ID NO: 1955318 - DNA, 12 bp, Homo sapiens
ccacctgcccag

SEQ ID NO: 1955319 - DNA, 16 bp, Homo sapiens
ccacgcagagccccgg

SEQ ID NO: 1955320 - DNA, 17 bp, Homo sapiens
ccacgcagagccccgga

SEQ ID NO: 1955321 - DNA, 22 bp, Homo sapiens
ccacggggtcgggggaggagca

SEQ ID NO: 1955322 - DNA, 13 bp, Homo sapiens
ccactagccctct

SEQ ID NO: 1955323 - DNA, 21 bp, Homo sapiens
ccactctgaagtcccttcctg

SEQ ID NO: 1955324 - DNA, 23 bp, Homo sapiens
ccactgatatcacgggcccgctc

SEQ ID NO: 1955325 - DNA, 14 bp, Homo sapiens
ccacttatttccat

SEQ ID NO: 1955326 - DNA, 13 bp, Homo sapiens
ccactttcctctc

SEQ ID NO: 1955327 - DNA, 15 bp, Homo sapiens
ccactttcctctctc

SEQ ID NO: 1955328 - DNA, 14 bp, Homo sapiens
ccagaaagaggaat

SEQ ID NO: 1955329 - DNA, 18 bp, Homo sapiens
ccagaaagaggaataaaa

SEQ ID NO: 1955330 - DNA, 14 bp, Homo sapiens
ccagaacgggcctc

SEQ ID NO: 1955331 - DNA, 18 bp, Homo sapiens
ccagaagctcaaggctgc

SEQ ID NO: 1955332 - DNA, 18 bp, Homo sapiens
ccagactcgagagggctg

SEQ ID NO: 1955333 - DNA, 20 bp, Homo sapiens
ccagactcgagagggctgag

SEQ ID NO: 1955334 - DNA, 19 bp, Homo sapiens
ccagagactgcccaccctg

SEQ ID NO: 1955335 - DNA, 18 bp, Homo sapiens
ccagagcgatgtgttctt

SEQ ID NO: 1955336 - DNA, 22 bp, Homo sapiens
ccagcactcccagggcccgagc

SEQ ID NO: 1955337 - DNA, 20 bp, Homo sapiens
ccagcctatctctcttctgc

SEQ ID NO: 1955338 - DNA, 16 bp, Homo sapiens
ccagcctcccccaggc

SEQ ID NO: 1955339 - DNA, 22 bp, Homo sapiens
ccagcctcccccaggctgcgcc

SEQ ID NO: 1955340 - DNA, 23 bp, Homo sapiens
ccagcctcccccaggctgcgcct

SEQ ID NO: 1955341 - DNA, 14 bp, Homo sapiens
ccagcctgagccac

SEQ ID NO: 1955342 - DNA, 23 bp, Homo sapiens
ccagctgcctctttgctgctttg

SEQ ID NO: 1955343 - DNA, 16 bp, Homo sapiens
ccagctggcagcgcct

SEQ ID NO: 1955344 - DNA, 20 bp, Homo sapiens
ccagctggcagcgcctcccg

SEQ ID NO: 1955345 - DNA, 13 bp, Homo sapiens
ccagctggctggg

SEQ ID NO: 1955346 - DNA, 16 bp, Homo sapiens
ccagctggctgggtcg

SEQ ID NO: 1955347 - DNA, 15 bp, Homo sapiens
ccaggcggaggggct

SEQ ID NO: 1955348 - DNA, 19 bp, Homo sapiens
ccaggcggaggggcttgga

SEQ ID NO: 1955349 - DNA, 20 bp, Homo sapiens
ccaggcggaggggcttggag

SEQ ID NO: 1955350 - DNA, 24 bp, Homo sapiens
ccaggcggaggggcttggagcaga

SEQ ID NO: 1955351 - DNA, 12 bp, Homo sapiens
ccaggctgcgcc

SEQ ID NO: 1955352 - DNA, 15 bp, Homo sapiens
ccaggctgcgcctgc

SEQ ID NO: 1955353 - DNA, 17 bp, Homo sapiens
ccaggctgcgcctgccc

SEQ ID NO: 1955354 - DNA, 20 bp, Homo sapiens
ccagggcccgagcgcgtgcc

SEQ ID NO: 1955355 - DNA, 23 bp, Homo sapiens
ccagggcccgagcgcgtgccttc

SEQ ID NO: 1955356 - DNA, 14 bp, Homo sapiens
ccaggtcacaggca

SEQ ID NO: 1955357 - DNA, 15 bp, Homo sapiens
ccaggtcacaggcat

SEQ ID NO: 1955358 - DNA, 23 bp, Homo sapiens
ccagttccctcagccctcattaa

SEQ ID NO: 1955359 - DNA, 23 bp, Homo sapiens
ccataatgcttctttcctcttaa

SEQ ID NO: 1955360 - DNA, 14 bp, Homo sapiens
ccatccagtagaga

SEQ ID NO: 1955361 - DNA, 14 bp, Homo sapiens
ccatcccactgata

SEQ ID NO: 1955362 - DNA, 18 bp, Homo sapiens
ccatccttcccgcagcac

SEQ ID NO: 1955363 - DNA, 21 bp, Homo sapiens
ccatccttcccgcagcaccag

SEQ ID NO: 1955364 - DNA, 14 bp, Homo sapiens
ccatgacagtagca

SEQ ID NO: 1955365 - DNA, 16 bp, Homo sapiens
ccatggattcccctgg

SEQ ID NO: 1955366 - DNA, 14 bp, Homo sapiens
ccatggccccagct

SEQ ID NO: 1955367 - DNA, 16 bp, Homo sapiens
ccatggccccagctgg

SEQ ID NO: 1955368 - DNA, 15 bp, Homo sapiens
ccatggtagactgtg

SEQ ID NO: 1955369 - DNA, 22 bp, Homo sapiens
ccatggtgaactgaagcagagt

SEQ ID NO: 1955370 - DNA, 15 bp, Homo sapiens
ccatgtgctgctgtg

SEQ ID NO: 1955371 - DNA, 21 bp, Homo sapiens
ccattgtgaatgttgtcctgt

SEQ ID NO: 1955372 - DNA, 22 bp, Homo sapiens
ccattgtgaatgttgtcctgtg

SEQ ID NO: 1955373 - DNA, 14 bp, Homo sapiens
ccattttgaaatat

SEQ ID NO: 1955374 - DNA, 21 bp, Homo sapiens
tcgggctctctcacccagcct

SEQ ID NO: 1955375 - DNA, 17 bp, Homo sapiens
tcgggggaggagcaccc

SEQ ID NO: 1955376 - DNA, 17 bp, Homo sapiens
tcgtccggcctgcagcc

SEQ ID NO: 1955377 - DNA, 20 bp, Homo sapiens
tcgtccggcctgcagcccag

SEQ ID NO: 1955378 - DNA, 22 bp, Homo sapiens
tctaaaggtttcactgttcatg

SEQ ID NO: 1955379 - DNA, 13 bp, Homo sapiens
tctaaatcataat

SEQ ID NO: 1955380 - DNA, 23 bp, Homo sapiens
tctaagaaatggctttccacatc

SEQ ID NO: 1955381 - DNA, 13 bp, Homo sapiens
tctacaaaagaag

SEQ ID NO: 1955382 - DNA, 19 bp, Homo sapiens
tctagagctatgcacacca

SEQ ID NO: 1955383 - DNA, 20 bp, Homo sapiens
tctagagctatgcacaccaa

SEQ ID NO: 1955384 - DNA, 22 bp, Homo sapiens
tctagagctatgcacaccaaat

SEQ ID NO: 1955385 - DNA, 15 bp, Homo sapiens
tctagatatgagaaa

SEQ ID NO: 1955386 - DNA, 23 bp, Homo sapiens
tctatgatgtccaaacttaacag

SEQ ID NO: 1955387 - DNA, 17 bp, Homo sapiens
tctatgtacagatgatg

SEQ ID NO: 1955388 - DNA, 20 bp, Homo sapiens
tctattagcttactgattaa

SEQ ID NO: 1955389 - DNA, 20 bp, Homo sapiens
tctcagaagtgaaaaagact

SEQ ID NO: 1955390 - DNA, 14 bp, Homo sapiens
tctcagatccctcg

SEQ ID NO: 1955391 - DNA, 16 bp, Homo sapiens
tctcagctccactctg

SEQ ID NO: 1955392 - DNA, 20 bp, Homo sapiens
tctcagctccactctgaagt

SEQ ID NO: 1955393 - DNA, 12 bp, Homo sapiens
tctcatggtatt

SEQ ID NO: 1955394 - DNA, 23 bp, Homo sapiens
tctcatggtattatctagtaggt

SEQ ID NO: 1955395 - DNA, 11 bp, Homo sapiens
tctcattccca

SEQ ID NO: 1955396 - DNA, 22 bp, Homo sapiens
tctccctaccctcttctcagct

SEQ ID NO: 1955397 - DNA, 15 bp, Homo sapiens
tctcctcgtccggcc

SEQ ID NO: 1955398 - DNA, 20 bp, Homo sapiens
tctcctcgtccggcctgcag

SEQ ID NO: 1955399 - DNA, 12 bp, Homo sapiens
tctcctctgtca

SEQ ID NO: 1955400 - DNA, 18 bp, Homo sapiens
tctcctgagcctgtctct

SEQ ID NO: 1955401 - DNA, 14 bp, Homo sapiens
tctcctgtatcatt

SEQ ID NO: 1955402 - DNA, 22 bp, Homo sapiens
tctctatgtacagatgatgtaa

SEQ ID NO: 1955403 - DNA, 11 bp, Homo sapiens
tctctctctct

SEQ ID NO: 1955404 - DNA, 16 bp, Homo sapiens
tctctctctctctctg

SEQ ID NO: 1955405 - DNA, 14 bp, Homo sapiens
tctctctctctctg

SEQ ID NO: 1955406 - DNA, 11 bp, Homo sapiens
tctctctctgt

SEQ ID NO: 1955407 - DNA, 9 bp, Homo sapiens
tctctctgt

SEQ ID NO: 1955408 - DNA, 15 bp, Homo sapiens
tctctctgtgtggca

SEQ ID NO: 1955409 - DNA, 17 bp, Homo sapiens
tctctctgtgtggcaaa

SEQ ID NO: 1955410 - DNA, 18 bp, Homo sapiens
tctctctgtgtggcaaac

SEQ ID NO: 1955411 - DNA, 20 bp, Homo sapiens
tctctctgtgtggcaaacat

SEQ ID NO: 1955412 - DNA, 10 bp, Homo sapiens
tctctctgtt

SEQ ID NO: 1955413 - DNA, 13 bp, Homo sapiens
tctctcttggtct

SEQ ID NO: 1955414 - DNA, 19 bp, Homo sapiens
tctctgaactgcaacactg

SEQ ID NO: 1955415 - DNA, 16 bp, Homo sapiens
tctctgagcagtgggg

SEQ ID NO: 1955416 - DNA, 17 bp, Homo sapiens
tctctggggtctgtgat

SEQ ID NO: 1955417 - DNA, 15 bp, Homo sapiens
tctctgtaaaaagca

SEQ ID NO: 1955418 - DNA, 16 bp, Homo sapiens
tctcttccttacaggt

SEQ ID NO: 1955419 - DNA, 13 bp, Homo sapiens
tctcttggtctct

SEQ ID NO: 1955420 - DNA, 17 bp, Homo sapiens
tctcttggtctctttct

SEQ ID NO: 1955421 - DNA, 13 bp, Homo sapiens
tctctttctttcc

SEQ ID NO: 1955422 - DNA, 19 bp, Homo sapiens
tctgaagtcccttcctgtc

SEQ ID NO: 1955423 - DNA, 21 bp, Homo sapiens
tctgaagtcccttcctgtcct

SEQ ID NO: 1955424 - DNA, 13 bp, Homo sapiens
tctgagcagtggg

SEQ ID NO: 1955425 - DNA, 13 bp, Homo sapiens
tctgaggagtcca

SEQ ID NO: 1955426 - DNA, 16 bp, Homo sapiens
tctgaggagtccaaaa

SEQ ID NO: 1955427 - DNA, 19 bp, Homo sapiens
tctgaggagtccaaaatat

SEQ ID NO: 1955428 - DNA, 12 bp, Homo sapiens
tctgagtcctca

SEQ ID NO: 1955429 - DNA, 14 bp, Homo sapiens
tctgcagcctgagc

SEQ ID NO: 1955430 - DNA, 15 bp, Homo sapiens
tctgcagcctgagct

SEQ ID NO: 1955431 - DNA, 24 bp, Homo sapiens
tctgcagcctgagctccaccctcc

SEQ ID NO: 1955432 - DNA, 9 bp, Homo sapiens
tctgccccc

SEQ ID NO: 1955433 - DNA, 15 bp, Homo sapiens
tctgccccctccccc

SEQ ID NO: 1955434 - DNA, 19 bp, Homo sapiens
tctgccccctcccccgcag

SEQ ID NO: 1955435 - DNA, 20 bp, Homo sapiens
tctgccccctcccccgcaga

SEQ ID NO: 1955436 - DNA, 23 bp, Homo sapiens
tctgccccctcccccgcagacag

SEQ ID NO: 1955437 - DNA, 20 bp, Homo sapiens
tctgcccctccgtccccagg

SEQ ID NO: 1955438 - DNA, 21 bp, Homo sapiens
tctgcccctccgtccccaggg

SEQ ID NO: 1955439 - DNA, 12 bp, Homo sapiens
tctgctttgctg

SEQ ID NO: 1955440 - DNA, 19 bp, Homo sapiens
tctggaaaaaaaaaaatat

SEQ ID NO: 1955441 - DNA, 22 bp, Homo sapiens
tctggataatttgtataagatg

SEQ ID NO: 1955442 - DNA, 19 bp, Homo sapiens
tctggtgcgtgtggccctg

SEQ ID NO: 1955443 - DNA, 14 bp, Homo sapiens
tctgtcaatgaaaa

SEQ ID NO: 1955444 - DNA, 16 bp, Homo sapiens
tctgtcagcttcccaa

SEQ ID NO: 1955445 - DNA, 16 bp, Homo sapiens
tctgtcagtttgtgaa

SEQ ID NO: 1955446 - DNA, 12 bp, Homo sapiens
tctgtcctttcc

SEQ ID NO: 1955447 - DNA, 14 bp, Homo sapiens
tctgtcctttccca

SEQ ID NO: 1955448 - DNA, 21 bp, Homo sapiens
tctgtctctcttttgctctct

SEQ ID NO: 1955449 - DNA, 17 bp, Homo sapiens
tctgtgcatctggcctg

SEQ ID NO: 1955450 - DNA, 22 bp, Homo sapiens
tctgtgcatctggcctgggggc

SEQ ID NO: 1955451 - DNA, 12 bp, Homo sapiens
tctgtgtggcaa

SEQ ID NO: 1955452 - DNA, 19 bp, Homo sapiens
tctgtgtggcaaacattta

SEQ ID NO: 1955453 - DNA, 15 bp, Homo sapiens
tctgttccaagtgtg

SEQ ID NO: 1955454 - DNA, 21 bp, Homo sapiens
tctgttccaagtgtgtgtgca

SEQ ID NO: 1955455 - DNA, 17 bp, Homo sapiens
tctgttcttcatttcta

SEQ ID NO: 1955456 - DNA, 13 bp, Homo sapiens
tcttaaaaattat

SEQ ID NO: 1955457 - DNA, 18 bp, Homo sapiens
tcttatcaagtgttacag

SEQ ID NO: 1955458 - DNA, 14 bp, Homo sapiens
tcttcaaccctgcc

SEQ ID NO: 1955459 - DNA, 15 bp, Homo sapiens
tcttcaaccctgccc

SEQ ID NO: 1955460 - DNA, 18 bp, Homo sapiens
tcttcaaccctgccctgc

SEQ ID NO: 1955461 - DNA, 19 bp, Homo sapiens
tcttcaaccctgccctgca

SEQ ID NO: 1955462 - DNA, 23 bp, Homo sapiens
tcttcatttctatagccaaagct

SEQ ID NO: 1955463 - DNA, 20 bp, Homo sapiens
tcttcttgcggcaccgccca

SEQ ID NO: 1955464 - DNA, 18 bp, Homo sapiens
tcttgaatgcttaaatga

SEQ ID NO: 1955465 - DNA, 19 bp, Homo sapiens
tcttgagtttcatttttca

SEQ ID NO: 1955466 - DNA, 12 bp, Homo sapiens
tcttgcactgta

SEQ ID NO: 1955467 - DNA, 19 bp, Homo sapiens
tcttgcactgtatccaagt

SEQ ID NO: 1955468 - DNA, 12 bp, Homo sapiens
tcttgctgtgaa

SEQ ID NO: 1955469 - DNA, 13 bp, Homo sapiens
tcttgctgtgaaa

SEQ ID NO: 1955470 - DNA, 23 bp, Homo sapiens
tcttgggattcctcccctggaag

SEQ ID NO: 1955471 - DNA, 12 bp, Homo sapiens
tcttggtctctt

SEQ ID NO: 1955472 - DNA, 21 bp, Homo sapiens
tcttggtctctttctttccaa

SEQ ID NO: 1955473 - DNA, 19 bp, Homo sapiens
tcttgtaaaactgtgacat

SEQ ID NO: 1955474 - DNA, 23 bp, Homo sapiens
tcttgtaaaactgtgacattcca

SEQ ID NO: 1955475 - DNA, 18 bp, Homo sapiens
tctttactaacactggct

SEQ ID NO: 1955476 - DNA, 14 bp, Homo sapiens
tctttatgatttca

SEQ ID NO: 1955477 - DNA, 17 bp, Homo sapiens
tctttatgatttcatga

SEQ ID NO: 1955478 - DNA, 15 bp, Homo sapiens
tctttctctctgtgt

SEQ ID NO: 1955479 - DNA, 19 bp, Homo sapiens
tctttctctctgtgtggca

SEQ ID NO: 1955480 - DNA, 12 bp, Homo sapiens
tctttctttcca

SEQ ID NO: 1955481 - DNA, 13 bp, Homo sapiens
tctttctttccaa

SEQ ID NO: 1955482 - DNA, 15 bp, Homo sapiens
tctttctttccaaag

SEQ ID NO: 1955483 - DNA, 14 bp, Homo sapiens
tctttgctgctttg

SEQ ID NO: 1955484 - DNA, 15 bp, Homo sapiens
tctttggttcctcat

SEQ ID NO: 1955485 - DNA, 13 bp, Homo sapiens
tcttttgttctct

SEQ ID NO: 1955486 - DNA, 17 bp, Homo sapiens
tgaaactgacttgctgt

SEQ ID NO: 1955487 - DNA, 15 bp, Homo sapiens
tgaaagtaatttcaa

SEQ ID NO: 1955488 - DNA, 17 bp, Homo sapiens
tgaaagtaatttcaaga

SEQ ID NO: 1955489 - DNA, 21 bp, Homo sapiens
tgaaagtaatttcaagaatgt

SEQ ID NO: 1955490 - DNA, 22 bp, Homo sapiens
tgaaatacatatgataaatttg

SEQ ID NO: 1955491 - DNA, 13 bp, Homo sapiens
tgaaatataaact

SEQ ID NO: 1955492 - DNA, 16 bp, Homo sapiens
tgaaatataaactgtg

SEQ ID NO: 1955493 - DNA, 21 bp, Homo sapiens
tgaaatataaactgtgagata

SEQ ID NO: 1955494 - DNA, 21 bp, Homo sapiens
tgaaatggatagattgtttta

SEQ ID NO: 1955495 - DNA, 15 bp, Homo sapiens
tgaaattatgtcaaa

SEQ ID NO: 1955496 - DNA, 18 bp, Homo sapiens
tgaaattatgtcaaatgg

SEQ ID NO: 1955497 - DNA, 18 bp, Homo sapiens
tgaaattcacaaagttaa

SEQ ID NO: 1955498 - DNA, 15 bp, Homo sapiens
tgaaatttacagtga

SEQ ID NO: 1955499 - DNA, 17 bp, Homo sapiens
tgaaatttacagtgata

SEQ ID NO: 1955500 - DNA, 22 bp, Homo sapiens
tgaaatttacagtgatagaaca

SEQ ID NO: 1955501 - DNA, 13 bp, Homo sapiens
tgaacattaatgt

SEQ ID NO: 1955502 - DNA, 14 bp, Homo sapiens
tgaactgcaacact

SEQ ID NO: 1955503 - DNA, 15 bp, Homo sapiens
tgaactgcaacactg

SEQ ID NO: 1955504 - DNA, 15 bp, Homo sapiens
tgaagattcagcagt

SEQ ID NO: 1955505 - DNA, 12 bp, Homo sapiens
tgaagcagagtc

SEQ ID NO: 1955506 - DNA, 23 bp, Homo sapiens
tgaagcagagtcaagctgatgaa

SEQ ID NO: 1955507 - DNA, 18 bp, Homo sapiens
tgaagcgtagtagtggaa

SEQ ID NO: 1955508 - DNA, 21 bp, Homo sapiens
tgaagtcccttcctgtcctgc

SEQ ID NO: 1955509 - DNA, 12 bp, Homo sapiens
tgaatatcaaga

SEQ ID NO: 1955510 - DNA, 21 bp, Homo sapiens
tgaatgaaatataaactgtga

SEQ ID NO: 1955511 - DNA, 22 bp, Homo sapiens
tgaatgagtttccagctaagcc

SEQ ID NO: 1955512 - DNA, 17 bp, Homo sapiens
tgaatgcttaaatgatc

SEQ ID NO: 1955513 - DNA, 17 bp, Homo sapiens
tgacacactcaccattt

SEQ ID NO: 1955514 - DNA, 18 bp, Homo sapiens
tgacacactcaccattta

SEQ ID NO: 1955515 - DNA, 23 bp, Homo sapiens
tgacacactcaccatttaatcat

SEQ ID NO: 1955516 - DNA, 18 bp, Homo sapiens
tgacactcatcaggtaaa

SEQ ID NO: 1955517 - DNA, 21 bp, Homo sapiens
tgacagcatttcagctgtgag

SEQ ID NO: 1955518 - DNA, 15 bp, Homo sapiens
tgacagtagcatact

SEQ ID NO: 1955519 - DNA, 17 bp, Homo sapiens
tgacattttgtagctag

SEQ ID NO: 1955520 - DNA, 19 bp, Homo sapiens
tgaccccacacgccggggc

SEQ ID NO: 1955521 - DNA, 22 bp, Homo sapiens
tgaccccacacgccggggctgg

SEQ ID NO: 1955522 - DNA, 19 bp, Homo sapiens
tgaccggcccgccaccttg

SEQ ID NO: 1955523 - DNA, 19 bp, Homo sapiens
tgacctcaaaagaaaatgt

SEQ ID NO: 1955524 - DNA, 15 bp, Homo sapiens
tgagaaatataaaaa

SEQ ID NO: 1955525 - DNA, 18 bp, Homo sapiens
tgagaaatataaaaataa

SEQ ID NO: 1955526 - DNA, 13 bp, Homo sapiens
tgagaactaaata

SEQ ID NO: 1955527 - DNA, 14 bp, Homo sapiens
tgagacaacacaca

SEQ ID NO: 1955528 - DNA, 14 bp, Homo sapiens
tgagataaatatca

SEQ ID NO: 1955529 - DNA, 17 bp, Homo sapiens
tgagataaatatcatta

SEQ ID NO: 1955530 - DNA, 19 bp, Homo sapiens
tgagatgtttagtagctga

SEQ ID NO: 1955531 - DNA, 21 bp, Homo sapiens
tgagatgtttagtagctgata

SEQ ID NO: 1955532 - DNA, 13 bp, Homo sapiens
tgagcagtgggga

SEQ ID NO: 1955533 - DNA, 15 bp, Homo sapiens
tgagccacagtgggg

SEQ ID NO: 1955534 - DNA, 19 bp, Homo sapiens
tgagccacagtggggccca

SEQ ID NO: 1955535 - DNA, 14 bp, Homo sapiens
tgagcccctcctct

SEQ ID NO: 1955536 - DNA, 15 bp, Homo sapiens
tgagcccctcctctc

SEQ ID NO: 1955537 - DNA, 17 bp, Homo sapiens
tgaggacggggcagagc

SEQ ID NO: 1955538 - DNA, 12 bp, Homo sapiens
tgaggcccccgg

SEQ ID NO: 1955539 - DNA, 16 bp, Homo sapiens
tgaggcccccggaggc

SEQ ID NO: 1955540 - DNA, 22 bp, Homo sapiens
tgaggcccccggaggcgcccac

SEQ ID NO: 1955541 - DNA, 22 bp, Homo sapiens
tgaggctggataggagaggaaa

SEQ ID NO: 1955542 - DNA, 18 bp, Homo sapiens
tgagggaagcccacccgc

SEQ ID NO: 1955543 - DNA, 21 bp, Homo sapiens
tgagggaagcccacccgcccc

SEQ ID NO: 1955544 - DNA, 12 bp, Homo sapiens
tgagtagcatat

SEQ ID NO: 1955545 - DNA, 15 bp, Homo sapiens
tgagtagcatatata

SEQ ID NO: 1955546 - DNA, 14 bp, Homo sapiens
tgagtcggctgggc

SEQ ID NO: 1955547 - DNA, 13 bp, Homo sapiens
tgagtctgtcctt

SEQ ID NO: 1955548 - DNA, 18 bp, Homo sapiens
tgagtctgtcctttccca

SEQ ID NO: 1955549 - DNA, 22 bp, Homo sapiens
tgagtgtacatttatgtgtgaa

SEQ ID NO: 1955550 - DNA, 19 bp, Homo sapiens
tgagttggttacctattgc

SEQ ID NO: 1955551 - DNA, 16 bp, Homo sapiens
tgagtttcatttttca

SEQ ID NO: 1955552 - DNA, 17 bp, Homo sapiens
tgataaatttgactgtt

SEQ ID NO: 1955553 - DNA, 11 bp, Homo sapiens
tgataactcac

SEQ ID NO: 1955554 - DNA, 21 bp, Homo sapiens
tgatacttatttataacattg

SEQ ID NO: 1955555 - DNA, 16 bp, Homo sapiens
tgatagaacaaaagag

SEQ ID NO: 1955556 - DNA, 16 bp, Homo sapiens
tgatcaaggagggaga

SEQ ID NO: 1955557 - DNA, 24 bp, Homo sapiens
tgatcactttctgaaattcacaaa

SEQ ID NO: 1955558 - DNA, 15 bp, Homo sapiens
tgatctgtccttcca

SEQ ID NO: 1955559 - DNA, 19 bp, Homo sapiens
tgatgagacaacacacaca

SEQ ID NO: 1955560 - DNA, 15 bp, Homo sapiens
tgatggaaaaagaat

SEQ ID NO: 1955561 - DNA, 13 bp, Homo sapiens
tgatgggtcctgc

SEQ ID NO: 1955562 - DNA, 16 bp, Homo sapiens
tgatgggtcctgctgc

SEQ ID NO: 1955563 - DNA, 14 bp, Homo sapiens
tgatgtcacagttt

SEQ ID NO: 1955564 - DNA, 19 bp, Homo sapiens
tgatgtcacagtttgttca

SEQ ID NO: 1955565 - DNA, 21 bp, Homo sapiens
tgatgtcacagtttgttcagt

SEQ ID NO: 1955566 - DNA, 14 bp, Homo sapiens
tgatgtccaaactt

SEQ ID NO: 1955567 - DNA, 15 bp, Homo sapiens
tgatgtccaaactta

SEQ ID NO: 1955568 - DNA, 13 bp, Homo sapiens
tgatgtgatttat

SEQ ID NO: 1955569 - DNA, 19 bp, Homo sapiens
tgatgtgctgctgggaatg

SEQ ID NO: 1955570 - DNA, 16 bp, Homo sapiens
tgatgttctgaaatgg

SEQ ID NO: 1955571 - DNA, 17 bp, Homo sapiens
tgattaactcagtcctg

SEQ ID NO: 1955572 - DNA, 21 bp, Homo sapiens
tgattctttcaatccacagta

SEQ ID NO: 1955573 - DNA, 22 bp, Homo sapiens
tgattctttcaatccacagtat

SEQ ID NO: 1955574 - DNA, 20 bp, Homo sapiens
tgattgacattttgtagcta

SEQ ID NO: 1955575 - DNA, 21 bp, Homo sapiens
tgattgagagcagcctcttga

SEQ ID NO: 1955576 - DNA, 13 bp, Homo sapiens
tgatttaacatta

SEQ ID NO: 1955577 - DNA, 17 bp, Homo sapiens
tgcaatttacttggaat

SEQ ID NO: 1955578 - DNA, 21 bp, Homo sapiens
tgcacacataacacacatcag

SEQ ID NO: 1955579 - DNA, 13 bp, Homo sapiens
tgcacaccaaatt

SEQ ID NO: 1955580 - DNA, 14 bp, Homo sapiens
tgcaccttgggcac

SEQ ID NO: 1955581 - DNA, 22 bp, Homo sapiens
tgcactaaaagtgatgtgattt

SEQ ID NO: 1955582 - DNA, 16 bp, Homo sapiens
tgcactgtatccaagt

SEQ ID NO: 1955583 - DNA, 19 bp, Homo sapiens
tgcagcagtaccatcccac

SEQ ID NO: 1955584 - DNA, 11 bp, Homo sapiens
tgcagcccaga

SEQ ID NO: 1955585 - DNA, 12 bp, Homo sapiens
tgcagcctgagc

SEQ ID NO: 1955586 - DNA, 19 bp, Homo sapiens
tgcagcctgagctccaccc

SEQ ID NO: 1955587 - DNA, 18 bp, Homo sapiens
tgcaggcgcgcaccgccc

SEQ ID NO: 1955588 - DNA, 21 bp, Homo sapiens
tgcaggcgcgcaccgcccaac

SEQ ID NO: 1955589 - DNA, 13 bp, Homo sapiens
tgcagtattgagt

SEQ ID NO: 1955590 - DNA, 14 bp, Homo sapiens
tgcatctggcctgg

SEQ ID NO: 1955591 - DNA, 22 bp, Homo sapiens
tgcatgagaactaaatagattt

SEQ ID NO: 1955592 - DNA, 18 bp, Homo sapiens
tgcattcattcatcctct

SEQ ID NO: 1955593 - DNA, 21 bp, Homo sapiens
tgccaatgtccaggtcacagg

SEQ ID NO: 1955594 - DNA, 23 bp, Homo sapiens
tgccaatgtccaggtcacaggca

SEQ ID NO: 1955595 - DNA, 23 bp, Homo sapiens
tgccatttcctcctgggcaacag

SEQ ID NO: 1955596 - DNA, 15 bp, Homo sapiens
tgcccaccctgggcc

SEQ ID NO: 1955597 - DNA, 14 bp, Homo sapiens
tgccccctcccccg

SEQ ID NO: 1955598 - DNA, 17 bp, Homo sapiens
tgccccctcccccgcag

SEQ ID NO: 1955599 - DNA, 20 bp, Homo sapiens
tgccccctcccccgcagaca

SEQ ID NO: 1955600 - DNA, 18 bp, Homo sapiens
tgccccttccccatgctc

SEQ ID NO: 1955601 - DNA, 15 bp, Homo sapiens
tatcacgggcccgct

SEQ ID NO: 1955602 - DNA, 17 bp, Homo sapiens
tatcagtacaattcttt

SEQ ID NO: 1955603 - DNA, 18 bp, Homo sapiens
tatcatagttattaatgt

SEQ ID NO: 1955604 - DNA, 14 bp, Homo sapiens
tatccttcacaatt

SEQ ID NO: 1955605 - DNA, 16 bp, Homo sapiens
tatctagtaggtctgc

SEQ ID NO: 1955606 - DNA, 23 bp, Homo sapiens
tatctagtaggtctgcacacata

SEQ ID NO: 1955607 - DNA, 17 bp, Homo sapiens
tatctgagttgtgcctc

SEQ ID NO: 1955608 - DNA, 15 bp, Homo sapiens
tatctgatatctgtt

SEQ ID NO: 1955609 - DNA, 14 bp, Homo sapiens
tatctgtctttatg

SEQ ID NO: 1955610 - DNA, 15 bp, Homo sapiens
tatctgtctttatga

SEQ ID NO: 1955611 - DNA, 17 bp, Homo sapiens
tatgaagaactattata

SEQ ID NO: 1955612 - DNA, 18 bp, Homo sapiens
tatgagaaatataaaaat

SEQ ID NO: 1955613 - DNA, 18 bp, Homo sapiens
tatgatgtccaaacttaa

SEQ ID NO: 1955614 - DNA, 18 bp, Homo sapiens
tatgattcttactgttct

SEQ ID NO: 1955615 - DNA, 20 bp, Homo sapiens
tatgcacaccaaattgctga

SEQ ID NO: 1955616 - DNA, 16 bp, Homo sapiens
tatgcatgagaactaa

SEQ ID NO: 1955617 - DNA, 19 bp, Homo sapiens
tatgcatgagaactaaata

SEQ ID NO: 1955618 - DNA, 15 bp, Homo sapiens
tatgcatttatgcat

SEQ ID NO: 1955619 - DNA, 19 bp, Homo sapiens
tatgcatttatgcatgaga

SEQ ID NO: 1955620 - DNA, 16 bp, Homo sapiens
tatgccttcactacaa

SEQ ID NO: 1955621 - DNA, 13 bp, Homo sapiens
tatgtcaaatgga

SEQ ID NO: 1955622 - DNA, 16 bp, Homo sapiens
tatgtctttaaaatga

SEQ ID NO: 1955623 - DNA, 19 bp, Homo sapiens
tatgtgccccttccccatg

SEQ ID NO: 1955624 - DNA, 15 bp, Homo sapiens
tatgtttgaaaatag

SEQ ID NO: 1955625 - DNA, 18 bp, Homo sapiens
tatgtttggctgaaatta

SEQ ID NO: 1955626 - DNA, 23 bp, Homo sapiens
tattaatgtgatcctaaaattgt

SEQ ID NO: 1955627 - DNA, 17 bp, Homo sapiens
tattagaatataaaaaa

SEQ ID NO: 1955628 - DNA, 12 bp, Homo sapiens
tattcagaaata

SEQ ID NO: 1955629 - DNA, 14 bp, Homo sapiens
tattcagaaatatc

SEQ ID NO: 1955630 - DNA, 17 bp, Homo sapiens
tattcccaaatctcaaa

SEQ ID NO: 1955631 - DNA, 21 bp, Homo sapiens
tattcccatggtagactgtga

SEQ ID NO: 1955632 - DNA, 23 bp, Homo sapiens
tattcccatggtagactgtgaca

SEQ ID NO: 1955633 - DNA, 16 bp, Homo sapiens
tattgagacactgtca

SEQ ID NO: 1955634 - DNA, 14 bp, Homo sapiens
tattgagtgtacat

SEQ ID NO: 1955635 - DNA, 19 bp, Homo sapiens
tattgctgtaaataaaaat

SEQ ID NO: 1955636 - DNA, 21 bp, Homo sapiens
tattgctgtaaataaaaatag

SEQ ID NO: 1955637 - DNA, 14 bp, Homo sapiens
tattgtaactcaca

SEQ ID NO: 1955638 - DNA, 15 bp, Homo sapiens
tattgttcttgtaaa

SEQ ID NO: 1955639 - DNA, 16 bp, Homo sapiens
tattgttcttgtaaaa

SEQ ID NO: 1955640 - DNA, 23 bp, Homo sapiens
tattgttcttgtaaaactgtgac

SEQ ID NO: 1955641 - DNA, 21 bp, Homo sapiens
tatttataacattgtaaatga

SEQ ID NO: 1955642 - DNA, 11 bp, Homo sapiens
tatttccatgg

SEQ ID NO: 1955643 - DNA, 23 bp, Homo sapiens
tatttgaggggaaaaaaccccat

SEQ ID NO: 1955644 - DNA, 17 bp, Homo sapiens
tatttgcgtaaatggtt

SEQ ID NO: 1955645 - DNA, 19 bp, Homo sapiens
tattttggacgtgtgagga

SEQ ID NO: 1955646 - DNA, 13 bp, Homo sapiens
tatttttcaatta

SEQ ID NO: 1955647 - DNA, 16 bp, Homo sapiens
tatttttcaattatgt

SEQ ID NO: 1955648 - DNA, 19 bp, Homo sapiens
tatttttcaattatgtttg

SEQ ID NO: 1955649 - DNA, 15 bp, Homo sapiens
tcaaaataaaaccag

SEQ ID NO: 1955650 - DNA, 20 bp, Homo sapiens
tcaaaattgacctcaaaaga

SEQ ID NO: 1955651 - DNA, 21 bp, Homo sapiens
tcaaaattgacctcaaaagaa

SEQ ID NO: 1955652 - DNA, 14 bp, Homo sapiens
tcaaacagtgtggc

SEQ ID NO: 1955653 - DNA, 20 bp, Homo sapiens
tcaaagccctccctgtctgt

SEQ ID NO: 1955654 - DNA, 13 bp, Homo sapiens
tcaaattctctat

SEQ ID NO: 1955655 - DNA, 23 bp, Homo sapiens
tcaaattctctatgtacagatga

SEQ ID NO: 1955656 - DNA, 16 bp, Homo sapiens
tcaaattgcctttctt

SEQ ID NO: 1955657 - DNA, 13 bp, Homo sapiens
tcaaccctgccct

SEQ ID NO: 1955658 - DNA, 22 bp, Homo sapiens
tcaagattaagttataccagca

SEQ ID NO: 1955659 - DNA, 18 bp, Homo sapiens
tcaagctccatcttattt

SEQ ID NO: 1955660 - DNA, 15 bp, Homo sapiens
tcaaggctgcagtga

SEQ ID NO: 1955661 - DNA, 16 bp, Homo sapiens
tcaagtgttacagagg

SEQ ID NO: 1955662 - DNA, 17 bp, Homo sapiens
tcaagtgttacagagga

SEQ ID NO: 1955663 - DNA, 18 bp, Homo sapiens
tcaagttattcagaaata

SEQ ID NO: 1955664 - DNA, 19 bp, Homo sapiens
tcaagttattcagaaatat

SEQ ID NO: 1955665 - DNA, 20 bp, Homo sapiens
tcaatatgatcttgatattc

SEQ ID NO: 1955666 - DNA, 13 bp, Homo sapiens
tcaatccacagta

SEQ ID NO: 1955667 - DNA, 17 bp, Homo sapiens
tcaatccacagtattgt

SEQ ID NO: 1955668 - DNA, 20 bp, Homo sapiens
tcaatccacagtattgttct

SEQ ID NO: 1955669 - DNA, 14 bp, Homo sapiens
tcaatgcttctttt

SEQ ID NO: 1955670 - DNA, 19 bp, Homo sapiens
tcaatgtgctgttgattct

SEQ ID NO: 1955671 - DNA, 11 bp, Homo sapiens
tcaattatttc

SEQ ID NO: 1955672 - DNA, 14 bp, Homo sapiens
tcaattatttccca

SEQ ID NO: 1955673 - DNA, 12 bp, Homo sapiens
tcacaatttcaa

SEQ ID NO: 1955674 - DNA, 14 bp, Homo sapiens
tcacaatttcaatg

SEQ ID NO: 1955675 - DNA, 17 bp, Homo sapiens
tcacaccactgccattt

SEQ ID NO: 1955676 - DNA, 12 bp, Homo sapiens
tcacagtttgtt

SEQ ID NO: 1955677 - DNA, 13 bp, Homo sapiens
tcacccagcctgg

SEQ ID NO: 1955678 - DNA, 23 bp, Homo sapiens
tcaccgagaggaaaaaggcttct

SEQ ID NO: 1955679 - DNA, 16 bp, Homo sapiens
tcacctatctggaaaa

SEQ ID NO: 1955680 - DNA, 22 bp, Homo sapiens
tcacgtctgtgagtctgtcctt

SEQ ID NO: 1955681 - DNA, 20 bp, Homo sapiens
tcactacaacattagaatat

SEQ ID NO: 1955682 - DNA, 23 bp, Homo sapiens
tcactacaacattagaatattgt

SEQ ID NO: 1955683 - DNA, 18 bp, Homo sapiens
tcacttttttcctgtcaa

SEQ ID NO: 1955684 - DNA, 21 bp, Homo sapiens
tcagaaaagcacctcttgaag

SEQ ID NO: 1955685 - DNA, 14 bp, Homo sapiens
tcagaaatatccct

SEQ ID NO: 1955686 - DNA, 14 bp, Homo sapiens
tcagaatatgtatg

SEQ ID NO: 1955687 - DNA, 17 bp, Homo sapiens
tcagacacctagactct

SEQ ID NO: 1955688 - DNA, 12 bp, Homo sapiens
tcagatccctcg

SEQ ID NO: 1955689 - DNA, 17 bp, Homo sapiens
tcagcagcggcagcagc

SEQ ID NO: 1955690 - DNA, 14 bp, Homo sapiens
tcagcagtgtctgt

SEQ ID NO: 1955691 - DNA, 21 bp, Homo sapiens
tcagctccactctgaagtccc

SEQ ID NO: 1955692 - DNA, 21 bp, Homo sapiens
tcagcttcccaacaatacttt

SEQ ID NO: 1955693 - DNA, 12 bp, Homo sapiens
tcaggctctgaa

SEQ ID NO: 1955694 - DNA, 15 bp, Homo sapiens
tcaggctctgaatct

SEQ ID NO: 1955695 - DNA, 16 bp, Homo sapiens
tcaggctctgaatctc

SEQ ID NO: 1955696 - DNA, 21 bp, Homo sapiens
tcaggctctgaatctctcaaa

SEQ ID NO: 1955697 - DNA, 21 bp, Homo sapiens
tcagggttatttgaggggaaa

SEQ ID NO: 1955698 - DNA, 16 bp, Homo sapiens
tcaggttaaattattg

SEQ ID NO: 1955699 - DNA, 21 bp, Homo sapiens
tcaggtttccggctactgaca

SEQ ID NO: 1955700 - DNA, 20 bp, Homo sapiens
tcagtaattaacatatcaag

SEQ ID NO: 1955701 - DNA, 14 bp, Homo sapiens
tcagtattgagaca

SEQ ID NO: 1955702 - DNA, 15 bp, Homo sapiens
tcagtattgagacac

SEQ ID NO: 1955703 - DNA, 20 bp, Homo sapiens
tcagtattgagacactgtca

SEQ ID NO: 1955704 - DNA, 23 bp, Homo sapiens
tcagtccacccccattgtgaatg

SEQ ID NO: 1955705 - DNA, 17 bp, Homo sapiens
tcagtgctagcttattt

SEQ ID NO: 1955706 - DNA, 17 bp, Homo sapiens
tcagtgtcattattagt

SEQ ID NO: 1955707 - DNA, 13 bp, Homo sapiens
tcagtgttataaa

SEQ ID NO: 1955708 - DNA, 22 bp, Homo sapiens
tcagttaggattaggtttagaa

SEQ ID NO: 1955709 - DNA, 13 bp, Homo sapiens
tcagtttgtgaag

SEQ ID NO: 1955710 - DNA, 13 bp, Homo sapiens
tcataaattcaaa

SEQ ID NO: 1955711 - DNA, 20 bp, Homo sapiens
tcatacacagaaatcctaac

SEQ ID NO: 1955712 - DNA, 13 bp, Homo sapiens
tcatactttggct

SEQ ID NO: 1955713 - DNA, 14 bp, Homo sapiens
tcatagataccatt

SEQ ID NO: 1955714 - DNA, 20 bp, Homo sapiens
tcatagataccattttgaaa

SEQ ID NO: 1955715 - DNA, 22 bp, Homo sapiens
tcatagataccattttgaaata

SEQ ID NO: 1955716 - DNA, 16 bp, Homo sapiens
tcatagttggaaatat

SEQ ID NO: 1955717 - DNA, 22 bp, Homo sapiens
tcatagttggaaatatttgcgt

SEQ ID NO: 1955718 - DNA, 21 bp, Homo sapiens
tcatattctaaaagtaataaa

SEQ ID NO: 1955719 - DNA, 11 bp, Homo sapiens
tcatctgtcag

SEQ ID NO: 1955720 - DNA, 12 bp, Homo sapiens
tcatctgtcagc

SEQ ID NO: 1955721 - DNA, 23 bp, Homo sapiens
tcatcttttcctgcttagaatta

SEQ ID NO: 1955722 - DNA, 14 bp, Homo sapiens
tcatgattagacaa

SEQ ID NO: 1955723 - DNA, 15 bp, Homo sapiens
tcatgattagacaat

SEQ ID NO: 1955724 - DNA, 16 bp, Homo sapiens
tcatgattagacaatg

SEQ ID NO: 1955725 - DNA, 20 bp, Homo sapiens
tcatggctgttatctgtctt

SEQ ID NO: 1955726 - DNA, 13 bp, Homo sapiens
tcatgggaatttt

SEQ ID NO: 1955727 - DNA, 15 bp, Homo sapiens
tcattatagcatgta

SEQ ID NO: 1955728 - DNA, 13 bp, Homo sapiens
tcattatttttca

SEQ ID NO: 1955729 - DNA, 14 bp, Homo sapiens
tcattatttttcaa

SEQ ID NO: 1955730 - DNA, 15 bp, Homo sapiens
tcattatttttcaat

SEQ ID NO: 1955731 - DNA, 22 bp, Homo sapiens
tcattgggccatgtttaagtgt

SEQ ID NO: 1955732 - DNA, 18 bp, Homo sapiens
tcatttcattatttttca

SEQ ID NO: 1955733 - DNA, 16 bp, Homo sapiens
tcatttccagcaaaat

SEQ ID NO: 1955734 - DNA, 20 bp, Homo sapiens
tcatttccagcaaaatatat

SEQ ID NO: 1955735 - DNA, 23 bp, Homo sapiens
tcatttccagcaaaatatatgtt

SEQ ID NO: 1955736 - DNA, 18 bp, Homo sapiens
tccaaacttaacagatca

SEQ ID NO: 1955737 - DNA, 16 bp, Homo sapiens
tccaaaggttgtacat

SEQ ID NO: 1955738 - DNA, 12 bp, Homo sapiens
tccaagtgtgtg

SEQ ID NO: 1955739 - DNA, 14 bp, Homo sapiens
tccaagtgtgtgtg

SEQ ID NO: 1955740 - DNA, 18 bp, Homo sapiens
tccaagtgtgtgtgcaat

SEQ ID NO: 1955741 - DNA, 21 bp, Homo sapiens
tccaagttatttgatctggtg

SEQ ID NO: 1955742 - DNA, 13 bp, Homo sapiens
tccacagtattgt

SEQ ID NO: 1955743 - DNA, 16 bp, Homo sapiens
tccacagtattgttct

SEQ ID NO: 1955744 - DNA, 18 bp, Homo sapiens
tccacccccattgtgaat

SEQ ID NO: 1955745 - DNA, 12 bp, Homo sapiens
tccactttcctc

SEQ ID NO: 1955746 - DNA, 12 bp, Homo sapiens
tccagaagcagc

SEQ ID NO: 1955747 - DNA, 22 bp, Homo sapiens
tccagactcgagagggctgagc

SEQ ID NO: 1955748 - DNA, 16 bp, Homo sapiens
tccagggaaccagagc

SEQ ID NO: 1955749 - DNA, 14 bp, Homo sapiens
tccaggtcacaggc

SEQ ID NO: 1955750 - DNA, 15 bp, Homo sapiens
tccaggtcacaggca

SEQ ID NO: 1955751 - DNA, 23 bp, Homo sapiens
tccaggtcacaggcatccgctgc

SEQ ID NO: 1955752 - DNA, 15 bp, Homo sapiens
tccagttctgatgag

SEQ ID NO: 1955753 - DNA, 14 bp, Homo sapiens
tccatcaaagccct

SEQ ID NO: 1955754 - DNA, 14 bp, Homo sapiens
tccatcctgttttt

SEQ ID NO: 1955755 - DNA, 16 bp, Homo sapiens
tccatggtgaactgaa

SEQ ID NO: 1955756 - DNA, 19 bp, Homo sapiens
tcccaacaatactttgtgt

SEQ ID NO: 1955757 - DNA, 20 bp, Homo sapiens
tcccaagtcaaacagtgtgg

SEQ ID NO: 1955758 - DNA, 13 bp, Homo sapiens
tcccagctggcag

SEQ ID NO: 1955759 - DNA, 16 bp, Homo sapiens
tcccagctggcagcgc

SEQ ID NO: 1955760 - DNA, 22 bp, Homo sapiens
tcccagctggcagcgcctcccg

SEQ ID NO: 1955761 - DNA, 16 bp, Homo sapiens
tcccaggcactctctt

SEQ ID NO: 1955762 - DNA, 11 bp, Homo sapiens
tcccagggccc

SEQ ID NO: 1955763 - DNA, 22 bp, Homo sapiens
tcccagggcccgagcgcgtgcc

SEQ ID NO: 1955764 - DNA, 19 bp, Homo sapiens
tcccatgaatatcaagaat

SEQ ID NO: 1955765 - DNA, 21 bp, Homo sapiens
tccccaccctcccctctcctg

SEQ ID NO: 1955766 - DNA, 22 bp, Homo sapiens
tccccaccctcccctctcctga

SEQ ID NO: 1955767 - DNA, 13 bp, Homo sapiens
tcccccaggctgc

SEQ ID NO: 1955768 - DNA, 17 bp, Homo sapiens
tcccccaggctgcgcct

SEQ ID NO: 1955769 - DNA, 20 bp, Homo sapiens
tcccccaggctgcgcctgcc

SEQ ID NO: 1955770 - DNA, 20 bp, Homo sapiens
tccccgcccgccctcctctg

SEQ ID NO: 1955771 - DNA, 21 bp, Homo sapiens
tccccgcccgccctcctctgc

SEQ ID NO: 1955772 - DNA, 20 bp, Homo sapiens
tccccgtgcggcccgtgcgc

SEQ ID NO: 1955773 - DNA, 15 bp, Homo sapiens
tcccctctcctgagc

SEQ ID NO: 1955774 - DNA, 23 bp, Homo sapiens
tcccgcagcaccagcctgagcca

SEQ ID NO: 1955775 - DNA, 23 bp, Homo sapiens
tcccgccgcctcgggccgcctcc

SEQ ID NO: 1955776 - DNA, 15 bp, Homo sapiens
tcccggccccgcgcg

SEQ ID NO: 1955777 - DNA, 19 bp, Homo sapiens
tcccggccccgcgcgtgcc

SEQ ID NO: 1955778 - DNA, 15 bp, Homo sapiens
tcccgtccgtccgcc

SEQ ID NO: 1955779 - DNA, 14 bp, Homo sapiens
tccctcatgcagat

SEQ ID NO: 1955780 - DNA, 22 bp, Homo sapiens
tccctgacttcccagctggcag

SEQ ID NO: 1955781 - DNA, 20 bp, Homo sapiens
tccctgtctgtctgtctctc

SEQ ID NO: 1955782 - DNA, 16 bp, Homo sapiens
tcccttgattcaaata

SEQ ID NO: 1955783 - DNA, 13 bp, Homo sapiens
tcccttttcagat

SEQ ID NO: 1955784 - DNA, 16 bp, Homo sapiens
tcccttttcagataat

SEQ ID NO: 1955785 - DNA, 12 bp, Homo sapiens
tccgcccgccca

SEQ ID NO: 1955786 - DNA, 15 bp, Homo sapiens
tccgcccgcccaccc

SEQ ID NO: 1955787 - DNA, 20 bp, Homo sapiens
tccgcccgcccaccccgctg

SEQ ID NO: 1955788 - DNA, 12 bp, Homo sapiens
tccggcagaggc

SEQ ID NO: 1955789 - DNA, 18 bp, Homo sapiens
tccggcagaggcagggcc

SEQ ID NO: 1955790 - DNA, 13 bp, Homo sapiens
tccggcctgcagc

SEQ ID NO: 1955791 - DNA, 14 bp, Homo sapiens
tccggcctgcagcc

SEQ ID NO: 1955792 - DNA, 15 bp, Homo sapiens
tccggcctgcagccc

SEQ ID NO: 1955793 - DNA, 22 bp, Homo sapiens
tccgggtgcgtgaccggcccgc

SEQ ID NO: 1955794 - DNA, 12 bp, Homo sapiens
tccgtccgcccg

SEQ ID NO: 1955795 - DNA, 14 bp, Homo sapiens
tcctacttaaacaa

SEQ ID NO: 1955796 - DNA, 16 bp, Homo sapiens
tcctacttaaacaaaa

SEQ ID NO: 1955797 - DNA, 22 bp, Homo sapiens
tcctagcactttgggaggctga

SEQ ID NO: 1955798 - DNA, 17 bp, Homo sapiens
tcctccaaatgctgtcg

SEQ ID NO: 1955799 - DNA, 22 bp, Homo sapiens
tcctccagactcgagagggctg

SEQ ID NO: 1955800 - DNA, 15 bp, Homo sapiens
tcctccagtacaata

SEQ ID NO: 1955801 - DNA, 18 bp, Homo sapiens
tcctcgggcgcctgcgct

SEQ ID NO: 1955802 - DNA, 22 bp, Homo sapiens
tcctcggtggcatttgctgaat

SEQ ID NO: 1955803 - DNA, 19 bp, Homo sapiens
tcctcgtccggcctgcagc

SEQ ID NO: 1955804 - DNA, 21 bp, Homo sapiens
tcctcgtccggcctgcagccc

SEQ ID NO: 1955805 - DNA, 14 bp, Homo sapiens
tcctctcctcgtcc

SEQ ID NO: 1955806 - DNA, 15 bp, Homo sapiens
tcctctctctctctc

SEQ ID NO: 1955807 - DNA, 21 bp, Homo sapiens
tcctctctctctctctctctg

SEQ ID NO: 1955808 - DNA, 15 bp, Homo sapiens
tcctctgccccctcc

SEQ ID NO: 1955809 - DNA, 22 bp, Homo sapiens
tcctctgtcagtttgtgaagtg

SEQ ID NO: 1955810 - DNA, 21 bp, Homo sapiens
tcctgctcacgtctgtgagtc

SEQ ID NO: 1955811 - DNA, 17 bp, Homo sapiens
tcctgctgaccttctgc

SEQ ID NO: 1955812 - DNA, 16 bp, Homo sapiens
tcctgctgctcgggaa

SEQ ID NO: 1955813 - DNA, 15 bp, Homo sapiens
tcctgtctcctctgt

SEQ ID NO: 1955814 - DNA, 18 bp, Homo sapiens
tcctgtgtcatctgtcag

SEQ ID NO: 1955815 - DNA, 20 bp, Homo sapiens
tccttacagaagggagtgaa

SEQ ID NO: 1955816 - DNA, 18 bp, Homo sapiens
tccttcacaatttcaatg

SEQ ID NO: 1955817 - DNA, 17 bp, Homo sapiens
tccttcatgcttttctc

SEQ ID NO: 1955818 - DNA, 16 bp, Homo sapiens
tccttcccgcagcacc

SEQ ID NO: 1955819 - DNA, 15 bp, Homo sapiens
tccttgccttcaaac

SEQ ID NO: 1955820 - DNA, 20 bp, Homo sapiens
tcctttggcaatatcatatt

SEQ ID NO: 1955821 - DNA, 14 bp, Homo sapiens
tcgcagctcatctt

SEQ ID NO: 1955822 - DNA, 12 bp, Homo sapiens
tcgcccctcctc

SEQ ID NO: 1955823 - DNA, 13 bp, Homo sapiens
tcgcccctcctcg

SEQ ID NO: 1955824 - DNA, 19 bp, Homo sapiens
tcgggccgcctcctccaga

SEQ ID NO: 1955825 - DNA, 21 bp, Homo sapiens
tcgggcgcctgcgctcctctg

SEQ ID NO: 1955826 - DNA, 22 bp, Homo sapiens
tcgggcgcctgcgctcctctgc

SEQ ID NO: 1955827 - DNA, 22 bp, Homo sapiens
gtgatttatgcatttatgcatg

SEQ ID NO: 1955828 - DNA, 15 bp, Homo sapiens
gtgcagtagtgtcac

SEQ ID NO: 1955829 - DNA, 22 bp, Homo sapiens
gtgcccacccgtgttctcctcc

SEQ ID NO: 1955830 - DNA, 21 bp, Homo sapiens
gtgccttccccgtgcggcccg

SEQ ID NO: 1955831 - DNA, 20 bp, Homo sapiens
gtgcgcagccgcgctctgcc

SEQ ID NO: 1955832 - DNA, 11 bp, Homo sapiens
gtgcggcccgt

SEQ ID NO: 1955833 - DNA, 19 bp, Homo sapiens
gtgcggcccgtgcgcagcc

SEQ ID NO: 1955834 - DNA, 12 bp, Homo sapiens
gtgcgtgtggcc

SEQ ID NO: 1955835 - DNA, 18 bp, Homo sapiens
gtgcgtgtggccctgtgg

SEQ ID NO: 1955836 - DNA, 15 bp, Homo sapiens
gtgctcctgctgacc

SEQ ID NO: 1955837 - DNA, 17 bp, Homo sapiens
gtgctgttgattctttc

SEQ ID NO: 1955838 - DNA, 14 bp, Homo sapiens
gtggatgtaaattt

SEQ ID NO: 1955839 - DNA, 19 bp, Homo sapiens
gtggatgtcccttccccac

SEQ ID NO: 1955840 - DNA, 13 bp, Homo sapiens
gtggcaactgtgg

SEQ ID NO: 1955841 - DNA, 22 bp, Homo sapiens
gtgggagtccactttcctctct

SEQ ID NO: 1955842 - DNA, 16 bp, Homo sapiens
gtggggcccatggccc

SEQ ID NO: 1955843 - DNA, 18 bp, Homo sapiens
gtggggcccatggcccca

SEQ ID NO: 1955844 - DNA, 23 bp, Homo sapiens
gtgggtgtcagtgtcattattag

SEQ ID NO: 1955845 - DNA, 15 bp, Homo sapiens
gtggtgatgcctaaa

SEQ ID NO: 1955846 - DNA, 14 bp, Homo sapiens
gtggtgtgaggccc

SEQ ID NO: 1955847 - DNA, 18 bp, Homo sapiens
gtggtgtgaggcccccgg

SEQ ID NO: 1955848 - DNA, 23 bp, Homo sapiens
gtggtttgttatcagtacaattc

SEQ ID NO: 1955849 - DNA, 22 bp, Homo sapiens
gtgtatttctattttgcagcag

SEQ ID NO: 1955850 - DNA, 19 bp, Homo sapiens
gtgtcaggattgaggatga

SEQ ID NO: 1955851 - DNA, 16 bp, Homo sapiens
gtgtcatctgtcagct

SEQ ID NO: 1955852 - DNA, 20 bp, Homo sapiens
gtgtcttttgttctctcttg

SEQ ID NO: 1955853 - DNA, 17 bp, Homo sapiens
gtgtggccctgtgggag

SEQ ID NO: 1955854 - DNA, 20 bp, Homo sapiens
gttaaaacagaaaaggttct

SEQ ID NO: 1955855 - DNA, 22 bp, Homo sapiens
gttacatacatttaaaaaacat

SEQ ID NO: 1955856 - DNA, 23 bp, Homo sapiens
gttactcagatgacctgaggaaa

SEQ ID NO: 1955857 - DNA, 13 bp, Homo sapiens
gttagcccggcca

SEQ ID NO: 1955858 - DNA, 21 bp, Homo sapiens
gttagctcagaggagaggagc

SEQ ID NO: 1955859 - DNA, 19 bp, Homo sapiens
gttaggattaggtttagaa

SEQ ID NO: 1955860 - DNA, 21 bp, Homo sapiens
gttataaaatctgtattgcta

SEQ ID NO: 1955861 - DNA, 21 bp, Homo sapiens
gttatctcttccttacaggtg

SEQ ID NO: 1955862 - DNA, 19 bp, Homo sapiens
gttatctgtctttatgatt

SEQ ID NO: 1955863 - DNA, 21 bp, Homo sapiens
gttatggcaagtttttggtaa

SEQ ID NO: 1955864 - DNA, 16 bp, Homo sapiens
gttcacgtgactcctc

SEQ ID NO: 1955865 - DNA, 12 bp, Homo sapiens
gttcatgaatac

SEQ ID NO: 1955866 - DNA, 9 bp, Homo sapiens
gttccaagt

SEQ ID NO: 1955867 - DNA, 11 bp, Homo sapiens
gttccaagtgt

SEQ ID NO: 1955868 - DNA, 11 bp, Homo sapiens
gttccagcagt

SEQ ID NO: 1955869 - DNA, 15 bp, Homo sapiens
gttccctcagccctc

SEQ ID NO: 1955870 - DNA, 23 bp, Homo sapiens
gttccgttcatctgaggagtcca

SEQ ID NO: 1955871 - DNA, 12 bp, Homo sapiens
gttcctctgaag

SEQ ID NO: 1955872 - DNA, 22 bp, Homo sapiens
gttctctcttggtctctttctt

SEQ ID NO: 1955873 - DNA, 20 bp, Homo sapiens
gttcttcgcagctcatcttt

SEQ ID NO: 1955874 - DNA, 17 bp, Homo sapiens
gttggccggctggccgg

SEQ ID NO: 1955875 - DNA, 15 bp, Homo sapiens
gttgtcctgtgtcat

SEQ ID NO: 1955876 - DNA, 17 bp, Homo sapiens
gtttaaaattattaaaa

SEQ ID NO: 1955877 - DNA, 13 bp, Homo sapiens
gtttacaacacag

SEQ ID NO: 1955878 - DNA, 22 bp, Homo sapiens
gtttacaacacagtagtgttct

SEQ ID NO: 1955879 - DNA, 20 bp, Homo sapiens
gtttagtagctgataaagaa

SEQ ID NO: 1955880 - DNA, 18 bp, Homo sapiens
gtttccatcaaagccctc

SEQ ID NO: 1955881 - DNA, 13 bp, Homo sapiens
gtttgttcagtga

SEQ ID NO: 1955882 - DNA, 13 bp, Homo sapiens
gtttgtttgctgc

SEQ ID NO: 1955883 - DNA, 21 bp, Homo sapiens
gttttcaacaagcctgaaagt

SEQ ID NO: 1955884 - DNA, 14 bp, Homo sapiens
gtttttttgttcat

SEQ ID NO: 1955885 - DNA, 20 bp, Homo sapiens
taaaaaaataatataaatga

SEQ ID NO: 1955886 - DNA, 18 bp, Homo sapiens
taaaaaacattttacaga

SEQ ID NO: 1955887 - DNA, 10 bp, Homo sapiens
taaaactgtg

SEQ ID NO: 1955888 - DNA, 16 bp, Homo sapiens
taaaactgtgacattc

SEQ ID NO: 1955889 - DNA, 22 bp, Homo sapiens
taaaactgtgacattccacaga

SEQ ID NO: 1955890 - DNA, 18 bp, Homo sapiens
taaaacttactatggtat

SEQ ID NO: 1955891 - DNA, 17 bp, Homo sapiens
taaaagaaggtaaataa

SEQ ID NO: 1955892 - DNA, 23 bp, Homo sapiens
taaaagatggtgaactgtgagta

SEQ ID NO: 1955893 - DNA, 18 bp, Homo sapiens
taaaatctgtattgctaa

SEQ ID NO: 1955894 - DNA, 14 bp, Homo sapiens
taaaattattaaaa

SEQ ID NO: 1955895 - DNA, 15 bp, Homo sapiens
taaaattattaaaaa

SEQ ID NO: 1955896 - DNA, 20 bp, Homo sapiens
taaaattattaaaaattata

SEQ ID NO: 1955897 - DNA, 21 bp, Homo sapiens
taaaattattaaaaattatag

SEQ ID NO: 1955898 - DNA, 12 bp, Homo sapiens
taaaattgtttc

SEQ ID NO: 1955899 - DNA, 13 bp, Homo sapiens
taaaatttgcaca

SEQ ID NO: 1955900 - DNA, 13 bp, Homo sapiens
taaaattttcctt

SEQ ID NO: 1955901 - DNA, 22 bp, Homo sapiens
taaacaaaaactttccatgaca

SEQ ID NO: 1955902 - DNA, 23 bp, Homo sapiens
taaacaaaaactttccatgacag

SEQ ID NO: 1955903 - DNA, 22 bp, Homo sapiens
taaacgtgaactaagatttcct

SEQ ID NO: 1955904 - DNA, 10 bp, Homo sapiens
taaactgtga

SEQ ID NO: 1955905 - DNA, 19 bp, Homo sapiens
taaactgtgagataaatat

SEQ ID NO: 1955906 - DNA, 19 bp, Homo sapiens
taaactgtttactcacatt

SEQ ID NO: 1955907 - DNA, 13 bp, Homo sapiens
taaagaaaccttt

SEQ ID NO: 1955908 - DNA, 17 bp, Homo sapiens
taaagaaaccttttaaa

SEQ ID NO: 1955909 - DNA, 15 bp, Homo sapiens
taaagataccaaata

SEQ ID NO: 1955910 - DNA, 18 bp, Homo sapiens
taaagataccaaatagaa

SEQ ID NO: 1955911 - DNA, 19 bp, Homo sapiens
taaagcaagctcacttgct

SEQ ID NO: 1955912 - DNA, 21 bp, Homo sapiens
taaagcaagctcacttgcttt

SEQ ID NO: 1955913 - DNA, 13 bp, Homo sapiens
taaataaaaatag

SEQ ID NO: 1955914 - DNA, 17 bp, Homo sapiens
taaataaaaatagctat

SEQ ID NO: 1955915 - DNA, 15 bp, Homo sapiens
taaataatcatacac

SEQ ID NO: 1955916 - DNA, 21 bp, Homo sapiens
taaatagatttttagattcct

SEQ ID NO: 1955917 - DNA, 21 bp, Homo sapiens
taaatatcattatagcatgta

SEQ ID NO: 1955918 - DNA, 12 bp, Homo sapiens
taaatgaaatac

SEQ ID NO: 1955919 - DNA, 19 bp, Homo sapiens
taaatgatatgtctttaaa

SEQ ID NO: 1955920 - DNA, 14 bp, Homo sapiens
taaatggttttcaa

SEQ ID NO: 1955921 - DNA, 18 bp, Homo sapiens
taaatggttttcaacaag

SEQ ID NO: 1955922 - DNA, 15 bp, Homo sapiens
taaattaacttctat

SEQ ID NO: 1955923 - DNA, 19 bp, Homo sapiens
taaattccaatacaagtta

SEQ ID NO: 1955924 - DNA, 16 bp, Homo sapiens
taacaaaagatatgaa

SEQ ID NO: 1955925 - DNA, 17 bp, Homo sapiens
taacactatcatagtta

SEQ ID NO: 1955926 - DNA, 13 bp, Homo sapiens
taacattctcaat

SEQ ID NO: 1955927 - DNA, 23 bp, Homo sapiens
taacattctcaatcatgggaatt

SEQ ID NO: 1955928 - DNA, 17 bp, Homo sapiens
taacattgtaaatgata

SEQ ID NO: 1955929 - DNA, 20 bp, Homo sapiens
taaccaccatttcccctgtg

SEQ ID NO: 1955930 - DNA, 16 bp, Homo sapiens
taacctaatgcagaat

SEQ ID NO: 1955931 - DNA, 20 bp, Homo sapiens
taacctaatgcagaattgct

SEQ ID NO: 1955932 - DNA, 13 bp, Homo sapiens
taacttgctgtga

SEQ ID NO: 1955933 - DNA, 15 bp, Homo sapiens
taacttgctgtgaaa

SEQ ID NO: 1955934 - DNA, 15 bp, Homo sapiens
taacttttgggattt

SEQ ID NO: 1955935 - DNA, 17 bp, Homo sapiens
taagaaatggctttcca

SEQ ID NO: 1955936 - DNA, 18 bp, Homo sapiens
taagaaatggctttccac

SEQ ID NO: 1955937 - DNA, 19 bp, Homo sapiens
taagaatttaccagaaata

SEQ ID NO: 1955938 - DNA, 18 bp, Homo sapiens
taagacttctctgtcctc

SEQ ID NO: 1955939 - DNA, 12 bp, Homo sapiens
taagatttcctt

SEQ ID NO: 1955940 - DNA, 18 bp, Homo sapiens
taaggggaattaacaatt

SEQ ID NO: 1955941 - DNA, 19 bp, Homo sapiens
taaggtcagtgttataaaa

SEQ ID NO: 1955942 - DNA, 23 bp, Homo sapiens
taagtgcttgaggccaaatgagt

SEQ ID NO: 1955943 - DNA, 14 bp, Homo sapiens
taataaatcaaaat

SEQ ID NO: 1955944 - DNA, 14 bp, Homo sapiens
taatatagggtttg

SEQ ID NO: 1955945 - DNA, 15 bp, Homo sapiens
taatattaaattcct

SEQ ID NO: 1955946 - DNA, 19 bp, Homo sapiens
taatcatttccagcaaaat

SEQ ID NO: 1955947 - DNA, 20 bp, Homo sapiens
taatccatgtgctgctgtgg

SEQ ID NO: 1955948 - DNA, 13 bp, Homo sapiens
taatgaagattaa

SEQ ID NO: 1955949 - DNA, 17 bp, Homo sapiens
taatgttgaaaaagaaa

SEQ ID NO: 1955950 - DNA, 16 bp, Homo sapiens
taattaaatgaaatac

SEQ ID NO: 1955951 - DNA, 22 bp, Homo sapiens
taattaaatgaaatacttgaca

SEQ ID NO: 1955952 - DNA, 11 bp, Homo sapiens
taattaatttc

SEQ ID NO: 1955953 - DNA, 14 bp, Homo sapiens
taattaatttcagt

SEQ ID NO: 1955954 - DNA, 15 bp, Homo sapiens
taattactttcagaa

SEQ ID NO: 1955955 - DNA, 22 bp, Homo sapiens
taattcaggtgataactcacca

SEQ ID NO: 1955956 - DNA, 14 bp, Homo sapiens
taatttagaaataa

SEQ ID NO: 1955957 - DNA, 12 bp, Homo sapiens
taatttcaagaa

SEQ ID NO: 1955958 - DNA, 15 bp, Homo sapiens
taatttcaagaatgt

SEQ ID NO: 1955959 - DNA, 17 bp, Homo sapiens
taatttccttaaagcaa

SEQ ID NO: 1955960 - DNA, 21 bp, Homo sapiens
taatttgtataagatgctgct

SEQ ID NO: 1955961 - DNA, 15 bp, Homo sapiens
tacaaaaaaaatcaa

SEQ ID NO: 1955962 - DNA, 22 bp, Homo sapiens
tacaaaaaaaatcaaaaaatta

SEQ ID NO: 1955963 - DNA, 21 bp, Homo sapiens
tacaaaatgtgtgcttggaaa

SEQ ID NO: 1955964 - DNA, 16 bp, Homo sapiens
tacaaataatttagaa

SEQ ID NO: 1955965 - DNA, 17 bp, Homo sapiens
tacaaataatttagaaa

SEQ ID NO: 1955966 - DNA, 16 bp, Homo sapiens
tacaacaggattttca

SEQ ID NO: 1955967 - DNA, 18 bp, Homo sapiens
tacaacaggattttcaag

SEQ ID NO: 1955968 - DNA, 15 bp, Homo sapiens
tacaacattagaata

SEQ ID NO: 1955969 - DNA, 14 bp, Homo sapiens
tacaattactttga

SEQ ID NO: 1955970 - DNA, 18 bp, Homo sapiens
tacagaaccagcactccc

SEQ ID NO: 1955971 - DNA, 22 bp, Homo sapiens
tacagaaccagcactcccaggg

SEQ ID NO: 1955972 - DNA, 15 bp, Homo sapiens
tacagatgtacatta

SEQ ID NO: 1955973 - DNA, 22 bp, Homo sapiens
tacaggtgtgagcacctttcct

SEQ ID NO: 1955974 - DNA, 17 bp, Homo sapiens
tacagtgatagaacaaa

SEQ ID NO: 1955975 - DNA, 20 bp, Homo sapiens
tacagtgatagaacaaaaga

SEQ ID NO: 1955976 - DNA, 16 bp, Homo sapiens
tacataacaggcattg

SEQ ID NO: 1955977 - DNA, 15 bp, Homo sapiens
tacatgatgatttca

SEQ ID NO: 1955978 - DNA, 16 bp, Homo sapiens
tacattattagaatat

SEQ ID NO: 1955979 - DNA, 18 bp, Homo sapiens
tacatttaaaaaacattt

SEQ ID NO: 1955980 - DNA, 17 bp, Homo sapiens
taccagaaatatttgct

SEQ ID NO: 1955981 - DNA, 12 bp, Homo sapiens
taccagcaaaag

SEQ ID NO: 1955982 - DNA, 16 bp, Homo sapiens
taccattttgaaatat

SEQ ID NO: 1955983 - DNA, 18 bp, Homo sapiens
tacccttctacaaaagaa

SEQ ID NO: 1955984 - DNA, 19 bp, Homo sapiens
tacccttctacaaaagaag

SEQ ID NO: 1955985 - DNA, 21 bp, Homo sapiens
tacctgagcatatgtacacag

SEQ ID NO: 1955986 - DNA, 23 bp, Homo sapiens
tacctggctacaattactttgaa

SEQ ID NO: 1955987 - DNA, 14 bp, Homo sapiens
tactaacactggct

SEQ ID NO: 1955988 - DNA, 17 bp, Homo sapiens
tactaaccaccatttcc

SEQ ID NO: 1955989 - DNA, 18 bp, Homo sapiens
tactaatgaaatttacag

SEQ ID NO: 1955990 - DNA, 20 bp, Homo sapiens
tacttaaacaaaaactttcc

SEQ ID NO: 1955991 - DNA, 18 bp, Homo sapiens
tactttcagaatgttgtg

SEQ ID NO: 1955992 - DNA, 21 bp, Homo sapiens
tactttgtctttctgcagaaa

SEQ ID NO: 1955993 - DNA, 16 bp, Homo sapiens
tagaaaatacattatt

SEQ ID NO: 1955994 - DNA, 15 bp, Homo sapiens
tagaaataaaagatg

SEQ ID NO: 1955995 - DNA, 13 bp, Homo sapiens
tagaaccttctaa

SEQ ID NO: 1955996 - DNA, 17 bp, Homo sapiens
tagaatataaaaaatgt

SEQ ID NO: 1955997 - DNA, 21 bp, Homo sapiens
tagaatattgtaactcacatg

SEQ ID NO: 1955998 - DNA, 15 bp, Homo sapiens
tagaatcaagtctgt

SEQ ID NO: 1955999 - DNA, 12 bp, Homo sapiens
tagacaatgtgg

SEQ ID NO: 1956000 - DNA, 23 bp, Homo sapiens
tagacaatgtggaattacataac

SEQ ID NO: 1956001 - DNA, 18 bp, Homo sapiens
tagactctaaaactatca

SEQ ID NO: 1956002 - DNA, 19 bp, Homo sapiens
tagagacttctaaatcata

SEQ ID NO: 1956003 - DNA, 18 bp, Homo sapiens
tagaggtaaaatttgcac

SEQ ID NO: 1956004 - DNA, 19 bp, Homo sapiens
tagataccattttgaaata

SEQ ID NO: 1956005 - DNA, 15 bp, Homo sapiens
tagatatcaatcagt

SEQ ID NO: 1956006 - DNA, 18 bp, Homo sapiens
tagattcctacttaaaca

SEQ ID NO: 1956007 - DNA, 17 bp, Homo sapiens
tagatttttagattcct

SEQ ID NO: 1956008 - DNA, 21 bp, Homo sapiens
tagcaattgcttctctaaaac

SEQ ID NO: 1956009 - DNA, 23 bp, Homo sapiens
tagcatactgatgagacaacaca

SEQ ID NO: 1956010 - DNA, 21 bp, Homo sapiens
tagcatgtaatattaaattcc

SEQ ID NO: 1956011 - DNA, 15 bp, Homo sapiens
tagccctctttctct

SEQ ID NO: 1956012 - DNA, 16 bp, Homo sapiens
tagccctctttctctc

SEQ ID NO: 1956013 - DNA, 18 bp, Homo sapiens
tagccctctttctctctg

SEQ ID NO: 1956014 - DNA, 12 bp, Homo sapiens
tagctaaatgac

SEQ ID NO: 1956015 - DNA, 16 bp, Homo sapiens
tagctaacaaaagata

SEQ ID NO: 1956016 - DNA, 17 bp, Homo sapiens
tagctagtttaaaatta

SEQ ID NO: 1956017 - DNA, 15 bp, Homo sapiens
tagctataaatagtg

SEQ ID NO: 1956018 - DNA, 11 bp, Homo sapiens
tagctccttca

SEQ ID NO: 1956019 - DNA, 11 bp, Homo sapiens
tagctgctttt

SEQ ID NO: 1956020 - DNA, 23 bp, Homo sapiens
tagctgcttttctgtcagtctga

SEQ ID NO: 1956021 - DNA, 14 bp, Homo sapiens
taggaatgctcaat

SEQ ID NO: 1956022 - DNA, 19 bp, Homo sapiens
taggatttgcactgcttta

SEQ ID NO: 1956023 - DNA, 15 bp, Homo sapiens
taggcactttttaac

SEQ ID NO: 1956024 - DNA, 16 bp, Homo sapiens
taggcactttttaaca

SEQ ID NO: 1956025 - DNA, 22 bp, Homo sapiens
taggcactttttaacattctca

SEQ ID NO: 1956026 - DNA, 17 bp, Homo sapiens
tagggctctaatttcct

SEQ ID NO: 1956027 - DNA, 18 bp, Homo sapiens
tagggtttgtttgctgct

SEQ ID NO: 1956028 - DNA, 15 bp, Homo sapiens
taggtctgcacacat

SEQ ID NO: 1956029 - DNA, 16 bp, Homo sapiens
tagtacctttttaaca

SEQ ID NO: 1956030 - DNA, 14 bp, Homo sapiens
tagtagctgataaa

SEQ ID NO: 1956031 - DNA, 18 bp, Homo sapiens
tagtagctgataaagaaa

SEQ ID NO: 1956032 - DNA, 15 bp, Homo sapiens
tagtcagaaatgatt

SEQ ID NO: 1956033 - DNA, 14 bp, Homo sapiens
tagtcatttaagaa

SEQ ID NO: 1956034 - DNA, 18 bp, Homo sapiens
tagtgtcacttttttcct

SEQ ID NO: 1956035 - DNA, 13 bp, Homo sapiens
tagtgtgtccatg

SEQ ID NO: 1956036 - DNA, 14 bp, Homo sapiens
tagttggaaatatt

SEQ ID NO: 1956037 - DNA, 21 bp, Homo sapiens
tagttggcagagaaaatgctg

SEQ ID NO: 1956038 - DNA, 14 bp, Homo sapiens
tagttgttaagttt

SEQ ID NO: 1956039 - DNA, 21 bp, Homo sapiens
tataaaaaatgttattactga

SEQ ID NO: 1956040 - DNA, 15 bp, Homo sapiens
tataaactgtgagat

SEQ ID NO: 1956041 - DNA, 15 bp, Homo sapiens
tataaatgaatgaaa

SEQ ID NO: 1956042 - DNA, 18 bp, Homo sapiens
tataatggcctcttaaaa

SEQ ID NO: 1956043 - DNA, 18 bp, Homo sapiens
tataattttattgctgga

SEQ ID NO: 1956044 - DNA, 17 bp, Homo sapiens
tataccagcaaaagtgc

SEQ ID NO: 1956045 - DNA, 23 bp, Homo sapiens
tatactatttattaaaaccattc

SEQ ID NO: 1956046 - DNA, 22 bp, Homo sapiens
tatagaggtaaaatttgcacac

SEQ ID NO: 1956047 - DNA, 10 bp, Homo sapiens
tatagccaaa

SEQ ID NO: 1956048 - DNA, 18 bp, Homo sapiens
tatataattttattgctg

SEQ ID NO: 1956049 - DNA, 21 bp, Homo sapiens
tatatagagacttctaaatca

SEQ ID NO: 1956050 - DNA, 16 bp, Homo sapiens
tatatgtttggctgaa

SEQ ID NO: 1956051 - DNA, 12 bp, Homo sapiens
tatcaagaatag

SEQ ID NO: 1956052 - DNA, 15 bp, Homo sapiens
tatcaatcagtaatt

SEQ ID NO: 1956053 - DNA, 18 bp, Homo sapiens
ggggaggagcacccccag

SEQ ID NO: 1956054 - DNA, 22 bp, Homo sapiens
ggggaggagcacccccagcctc

SEQ ID NO: 1956055 - DNA, 14 bp, Homo sapiens
ggggcagagctgag

SEQ ID NO: 1956056 - DNA, 13 bp, Homo sapiens
ggggcccatggcc

SEQ ID NO: 1956057 - DNA, 15 bp, Homo sapiens
ggggcccatggcccc

SEQ ID NO: 1956058 - DNA, 18 bp, Homo sapiens
ggggcccatggccccagc

SEQ ID NO: 1956059 - DNA, 15 bp, Homo sapiens
ggggctggccctgcc

SEQ ID NO: 1956060 - DNA, 16 bp, Homo sapiens
ggggctggccctgccc

SEQ ID NO: 1956061 - DNA, 14 bp, Homo sapiens
ggggcttggagcag

SEQ ID NO: 1956062 - DNA, 24 bp, Homo sapiens
ggggcttggagcagagacggcagc

SEQ ID NO: 1956063 - DNA, 15 bp, Homo sapiens
gggggaggagcaccc

SEQ ID NO: 1956064 - DNA, 23 bp, Homo sapiens
gggggctgttagctcagaggaga

SEQ ID NO: 1956065 - DNA, 20 bp, Homo sapiens
ggggtcgggggaggagcacc

SEQ ID NO: 1956066 - DNA, 13 bp, Homo sapiens
gggtcgcccctcc

SEQ ID NO: 1956067 - DNA, 19 bp, Homo sapiens
gggtcgggggaggagcacc

SEQ ID NO: 1956068 - DNA, 22 bp, Homo sapiens
gggtgcaggcgcgcaccgccca

SEQ ID NO: 1956069 - DNA, 16 bp, Homo sapiens
ggtactaatgaaattt

SEQ ID NO: 1956070 - DNA, 20 bp, Homo sapiens
ggtatctgatgatgttctga

SEQ ID NO: 1956071 - DNA, 22 bp, Homo sapiens
ggtcccagctacaggggaggct

SEQ ID NO: 1956072 - DNA, 19 bp, Homo sapiens
ggtccccggacgctggctc

SEQ ID NO: 1956073 - DNA, 17 bp, Homo sapiens
ggtcctttgagtgtcag

SEQ ID NO: 1956074 - DNA, 14 bp, Homo sapiens
ggtcgcccctcctc

SEQ ID NO: 1956075 - DNA, 18 bp, Homo sapiens
ggtcgggggaggagcacc

SEQ ID NO: 1956076 - DNA, 21 bp, Homo sapiens
ggtcgggggaggagcaccccc

SEQ ID NO: 1956077 - DNA, 12 bp, Homo sapiens
ggtctctgagca

SEQ ID NO: 1956078 - DNA, 20 bp, Homo sapiens
ggtctgcacacataacacac

SEQ ID NO: 1956079 - DNA, 19 bp, Homo sapiens
ggtgataactcaccatctt

SEQ ID NO: 1956080 - DNA, 21 bp, Homo sapiens
ggtgcccagactcaaggcctc

SEQ ID NO: 1956081 - DNA, 20 bp, Homo sapiens
ggtgcgtgaccggcccgcca

SEQ ID NO: 1956082 - DNA, 22 bp, Homo sapiens
ggtgcgtgtggccctgtgggag

SEQ ID NO: 1956083 - DNA, 13 bp, Homo sapiens
ggttcctcatggc

SEQ ID NO: 1956084 - DNA, 19 bp, Homo sapiens
ggtttgttatcagtacaat

SEQ ID NO: 1956085 - DNA, 11 bp, Homo sapiens
gtaaaactgtg

SEQ ID NO: 1956086 - DNA, 15 bp, Homo sapiens
gtaaaactgtgacat

SEQ ID NO: 1956087 - DNA, 16 bp, Homo sapiens
gtaaaactgtgacatt

SEQ ID NO: 1956088 - DNA, 14 bp, Homo sapiens
gtaaaatttgcaca

SEQ ID NO: 1956089 - DNA, 15 bp, Homo sapiens
gtaaatgatatgtct

SEQ ID NO: 1956090 - DNA, 17 bp, Homo sapiens
gtaacattctatttcaa

SEQ ID NO: 1956091 - DNA, 19 bp, Homo sapiens
gtaacttgctgtgaaatga

SEQ ID NO: 1956092 - DNA, 21 bp, Homo sapiens
gtaacttgctgtgaaatgact

SEQ ID NO: 1956093 - DNA, 18 bp, Homo sapiens
gtaagcaccagctgcctc

SEQ ID NO: 1956094 - DNA, 24 bp, Homo sapiens
gtaagggactccagaagcagcagc

SEQ ID NO: 1956095 - DNA, 19 bp, Homo sapiens
gtaattactttcagaatgt

SEQ ID NO: 1956096 - DNA, 22 bp, Homo sapiens
gtaatttcaagaatgtttcagt

SEQ ID NO: 1956097 - DNA, 18 bp, Homo sapiens
gtaatttcctgctcctcc

SEQ ID NO: 1956098 - DNA, 21 bp, Homo sapiens
gtacaaataatttagaaataa

SEQ ID NO: 1956099 - DNA, 22 bp, Homo sapiens
gtacaattctttgttgcttaat

SEQ ID NO: 1956100 - DNA, 15 bp, Homo sapiens
gtacattaaatacca

SEQ ID NO: 1956101 - DNA, 15 bp, Homo sapiens
gtaccatcccactga

SEQ ID NO: 1956102 - DNA, 20 bp, Homo sapiens
gtactaatgaaatttacagt

SEQ ID NO: 1956103 - DNA, 19 bp, Homo sapiens
gtactctgagtcctcattg

SEQ ID NO: 1956104 - DNA, 22 bp, Homo sapiens
gtacttacccttctacaaaaga

SEQ ID NO: 1956105 - DNA, 17 bp, Homo sapiens
gtagagtcctaggacat

SEQ ID NO: 1956106 - DNA, 20 bp, Homo sapiens
gtagcatactgatgagacaa

SEQ ID NO: 1956107 - DNA, 18 bp, Homo sapiens
gtagctagtttaaaatta

SEQ ID NO: 1956108 - DNA, 18 bp, Homo sapiens
gtagctgataaagaaacc

SEQ ID NO: 1956109 - DNA, 16 bp, Homo sapiens
gtaggtctatgatgtc

SEQ ID NO: 1956110 - DNA, 17 bp, Homo sapiens
gtataagatgctgctga

SEQ ID NO: 1956111 - DNA, 21 bp, Homo sapiens
gtataagatgctgctgagcac

SEQ ID NO: 1956112 - DNA, 18 bp, Homo sapiens
gtatatattttgaaagga

SEQ ID NO: 1956113 - DNA, 19 bp, Homo sapiens
gtatctgatgatgttctga

SEQ ID NO: 1956114 - DNA, 14 bp, Homo sapiens
gtattgagtgttct

SEQ ID NO: 1956115 - DNA, 17 bp, Homo sapiens
gtattgttcttgtaaaa

SEQ ID NO: 1956116 - DNA, 22 bp, Homo sapiens
gtattgttcttgtaaaactgtg

SEQ ID NO: 1956117 - DNA, 20 bp, Homo sapiens
gtatttggtaacttgctgtg

SEQ ID NO: 1956118 - DNA, 13 bp, Homo sapiens
gtcaatgaaaagc

SEQ ID NO: 1956119 - DNA, 19 bp, Homo sapiens
gtcacttttttcctgtcaa

SEQ ID NO: 1956120 - DNA, 14 bp, Homo sapiens
gtcagaaatgattc

SEQ ID NO: 1956121 - DNA, 19 bp, Homo sapiens
gtcagaaatgattcagggt

SEQ ID NO: 1956122 - DNA, 13 bp, Homo sapiens
gtcagcttcccaa

SEQ ID NO: 1956123 - DNA, 16 bp, Homo sapiens
gtcagtgtactctgag

SEQ ID NO: 1956124 - DNA, 19 bp, Homo sapiens
gtcagtgtactctgagtcc

SEQ ID NO: 1956125 - DNA, 13 bp, Homo sapiens
gtcagtttgtgaa

SEQ ID NO: 1956126 - DNA, 18 bp, Homo sapiens
gtcatgttggtaccctgg

SEQ ID NO: 1956127 - DNA, 19 bp, Homo sapiens
gtcatttggtggctctaac

SEQ ID NO: 1956128 - DNA, 18 bp, Homo sapiens
gtccacccccattgtgaa

SEQ ID NO: 1956129 - DNA, 20 bp, Homo sapiens
gtccacccccattgtgaatg

SEQ ID NO: 1956130 - DNA, 21 bp, Homo sapiens
gtccaggagatgaggctggat

SEQ ID NO: 1956131 - DNA, 15 bp, Homo sapiens
gtccaggtcacaggc

SEQ ID NO: 1956132 - DNA, 16 bp, Homo sapiens
gtccaggtcacaggca

SEQ ID NO: 1956133 - DNA, 11 bp, Homo sapiens
gtccccagggt

SEQ ID NO: 1956134 - DNA, 10 bp, Homo sapiens
gtccccggac

SEQ ID NO: 1956135 - DNA, 14 bp, Homo sapiens
gtccctgacttccc

SEQ ID NO: 1956136 - DNA, 15 bp, Homo sapiens
gtccctgacttccca

SEQ ID NO: 1956137 - DNA, 16 bp, Homo sapiens
gtccctgacttcccag

SEQ ID NO: 1956138 - DNA, 19 bp, Homo sapiens
gtccctgacttcccagctg

SEQ ID NO: 1956139 - DNA, 23 bp, Homo sapiens
gtccctgacttcccagctggcag

SEQ ID NO: 1956140 - DNA, 15 bp, Homo sapiens
gtccggcctgcagcc

SEQ ID NO: 1956141 - DNA, 16 bp, Homo sapiens
gtccggcctgcagccc

SEQ ID NO: 1956142 - DNA, 21 bp, Homo sapiens
gtccggtttccgtagcagttt

SEQ ID NO: 1956143 - DNA, 17 bp, Homo sapiens
gtcctcattgttcagaa

SEQ ID NO: 1956144 - DNA, 13 bp, Homo sapiens
gtcctctgctttg

SEQ ID NO: 1956145 - DNA, 14 bp, Homo sapiens
gtcctgctgctcgg

SEQ ID NO: 1956146 - DNA, 20 bp, Homo sapiens
gtcctgctgctcgggaaggc

SEQ ID NO: 1956147 - DNA, 19 bp, Homo sapiens
gtcctgtgtcatctgtcag

SEQ ID NO: 1956148 - DNA, 20 bp, Homo sapiens
gtcctttctgatcctctctt

SEQ ID NO: 1956149 - DNA, 17 bp, Homo sapiens
gtcgggggaggagcacc

SEQ ID NO: 1956150 - DNA, 22 bp, Homo sapiens
gtcgggggaggagcacccccag

SEQ ID NO: 1956151 - DNA, 21 bp, Homo sapiens
gtctaaactgtttactcacat

SEQ ID NO: 1956152 - DNA, 22 bp, Homo sapiens
gtctcctctgtcagtttgtgaa

SEQ ID NO: 1956153 - DNA, 15 bp, Homo sapiens
gtctcctgtatcatt

SEQ ID NO: 1956154 - DNA, 18 bp, Homo sapiens
gtctcctgtatcatttct

SEQ ID NO: 1956155 - DNA, 23 bp, Homo sapiens
gtctctccctaccctcttctcag

SEQ ID NO: 1956156 - DNA, 13 bp, Homo sapiens
gtctctgagcagt

SEQ ID NO: 1956157 - DNA, 19 bp, Homo sapiens
gtctctttctttccaaagg

SEQ ID NO: 1956158 - DNA, 20 bp, Homo sapiens
gtctctttctttccaaaggt

SEQ ID NO: 1956159 - DNA, 20 bp, Homo sapiens
gtctgcacacataacacaca

SEQ ID NO: 1956160 - DNA, 21 bp, Homo sapiens
gtctgcacacataacacacat

SEQ ID NO: 1956161 - DNA, 21 bp, Homo sapiens
gtctgtgaaagtctcctgtat

SEQ ID NO: 1956162 - DNA, 22 bp, Homo sapiens
gtctgttcttcatttctatagc

SEQ ID NO: 1956163 - DNA, 21 bp, Homo sapiens
gtcttcaaccctgccctgcac

SEQ ID NO: 1956164 - DNA, 22 bp, Homo sapiens
gtcttcaaccctgccctgcacc

SEQ ID NO: 1956165 - DNA, 20 bp, Homo sapiens
gtcttgagtttcatttttca

SEQ ID NO: 1956166 - DNA, 23 bp, Homo sapiens
gtcttggtttccatcaaagccct

SEQ ID NO: 1956167 - DNA, 19 bp, Homo sapiens
gtctttatgatttcatgat

SEQ ID NO: 1956168 - DNA, 19 bp, Homo sapiens
gtctttggttcctcatggc

SEQ ID NO: 1956169 - DNA, 20 bp, Homo sapiens
gtctttggttcctcatggct

SEQ ID NO: 1956170 - DNA, 18 bp, Homo sapiens
gtcttttgttctctcttg

SEQ ID NO: 1956171 - DNA, 20 bp, Homo sapiens
gtcttttgttctctcttggt

SEQ ID NO: 1956172 - DNA, 17 bp, Homo sapiens
gtgaaacagtgtggatg

SEQ ID NO: 1956173 - DNA, 21 bp, Homo sapiens
gtgaacttggtgcctaatgtt

SEQ ID NO: 1956174 - DNA, 21 bp, Homo sapiens
gtgaatgttgtcctgtgtcat

SEQ ID NO: 1956175 - DNA, 20 bp, Homo sapiens
gtgacacagctgagctggcc

SEQ ID NO: 1956176 - DNA, 15 bp, Homo sapiens
gtgaccggcccgcca

SEQ ID NO: 1956177 - DNA, 21 bp, Homo sapiens
gtgaccggcccgccaccttgt

SEQ ID NO: 1956178 - DNA, 14 bp, Homo sapiens
gtgagataaatatc

SEQ ID NO: 1956179 - DNA, 15 bp, Homo sapiens
gtgaggcccccggag

SEQ ID NO: 1956180 - DNA, 16 bp, Homo sapiens
gtgaggcccccggagg

SEQ ID NO: 1956181 - DNA, 23 bp, Homo sapiens
gtgatcactttctgaaattcaca

SEQ ID NO: 1956182 - DNA, 22 bp, Homo sapiens
gtgatcataggggcatagccag

SEQ ID NO: 1956183 - DNA, 20 bp, Homo sapiens
gtgatgtcacagtttgttca

SEQ ID NO: 1956184 - DNA, 21 bp, Homo sapiens
gtgatgtcacagtttgttcag

SEQ ID NO: 1956185 - DNA, 22 bp, Homo sapiens
gtgatgtcacagtttgttcagt

SEQ ID NO: 1956186 - DNA, 21 bp, Homo sapiens
gattcagcagtgtctgttctt

SEQ ID NO: 1956187 - DNA, 17 bp, Homo sapiens
gattcagggttatttga

SEQ ID NO: 1956188 - DNA, 15 bp, Homo sapiens
gattcctacttaaac

SEQ ID NO: 1956189 - DNA, 16 bp, Homo sapiens
gattcttactgttctt

SEQ ID NO: 1956190 - DNA, 23 bp, Homo sapiens
gattctttcaatccacagtattg

SEQ ID NO: 1956191 - DNA, 17 bp, Homo sapiens
gatttagctaacaaaag

SEQ ID NO: 1956192 - DNA, 15 bp, Homo sapiens
gatttcatgattaga

SEQ ID NO: 1956193 - DNA, 18 bp, Homo sapiens
gatttcatgattagacaa

SEQ ID NO: 1956194 - DNA, 14 bp, Homo sapiens
gatttgcactgctt

SEQ ID NO: 1956195 - DNA, 18 bp, Homo sapiens
gattttcaagttattcag

SEQ ID NO: 1956196 - DNA, 19 bp, Homo sapiens
gattttcaagttattcaga

SEQ ID NO: 1956197 - DNA, 20 bp, Homo sapiens
gattttcaagttattcagaa

SEQ ID NO: 1956198 - DNA, 19 bp, Homo sapiens
gattttttttttcaggtta

SEQ ID NO: 1956199 - DNA, 10 bp, Homo sapiens
gcaaacattt

SEQ ID NO: 1956200 - DNA, 15 bp, Homo sapiens
gcaaaccaatttgtt

SEQ ID NO: 1956201 - DNA, 18 bp, Homo sapiens
gcaacaacaacagaacaa

SEQ ID NO: 1956202 - DNA, 16 bp, Homo sapiens
gcaagtttttggtaat

SEQ ID NO: 1956203 - DNA, 22 bp, Homo sapiens
gcaatgttccgttcatctgagg

SEQ ID NO: 1956204 - DNA, 21 bp, Homo sapiens
gcaattgcttctctaaaacag

SEQ ID NO: 1956205 - DNA, 19 bp, Homo sapiens
gcacaagtttttttgttca

SEQ ID NO: 1956206 - DNA, 20 bp, Homo sapiens
gcacaagtttttttgttcat

SEQ ID NO: 1956207 - DNA, 17 bp, Homo sapiens
gcacacataacacacat

SEQ ID NO: 1956208 - DNA, 18 bp, Homo sapiens
gcacaccaaattgctgag

SEQ ID NO: 1956209 - DNA, 12 bp, Homo sapiens
gcaccagcctga

SEQ ID NO: 1956210 - DNA, 12 bp, Homo sapiens
gcacccccagcc

SEQ ID NO: 1956211 - DNA, 16 bp, Homo sapiens
gcacccccagcctccc

SEQ ID NO: 1956212 - DNA, 21 bp, Homo sapiens
gcacccccagcctcccccagg

SEQ ID NO: 1956213 - DNA, 21 bp, Homo sapiens
gcaccgcccaacccccacctc

SEQ ID NO: 1956214 - DNA, 17 bp, Homo sapiens
gcaccgcccacccacac

SEQ ID NO: 1956215 - DNA, 18 bp, Homo sapiens
gcaccgtggtgtgaggcc

SEQ ID NO: 1956216 - DNA, 21 bp, Homo sapiens
gcaccgtggtgtgaggccccc

SEQ ID NO: 1956217 - DNA, 12 bp, Homo sapiens
gcacctcttgaa

SEQ ID NO: 1956218 - DNA, 13 bp, Homo sapiens
gcaccttgggcac

SEQ ID NO: 1956219 - DNA, 18 bp, Homo sapiens
gcaccttgggcacgggag

SEQ ID NO: 1956220 - DNA, 23 bp, Homo sapiens
gcaccttgggcacgggagagcgc

SEQ ID NO: 1956221 - DNA, 20 bp, Homo sapiens
gcacgggagagcgccacccg

SEQ ID NO: 1956222 - DNA, 11 bp, Homo sapiens
gcactgcttta

SEQ ID NO: 1956223 - DNA, 17 bp, Homo sapiens
gcactgctttattttag

SEQ ID NO: 1956224 - DNA, 19 bp, Homo sapiens
gcagagacctcctgatgtc

SEQ ID NO: 1956225 - DNA, 14 bp, Homo sapiens
gcagagacggcagc

SEQ ID NO: 1956226 - DNA, 17 bp, Homo sapiens
gcagagacggcagcccc

SEQ ID NO: 1956227 - DNA, 13 bp, Homo sapiens
gcagagccccgga

SEQ ID NO: 1956228 - DNA, 17 bp, Homo sapiens
gcagagccccggagcac

SEQ ID NO: 1956229 - DNA, 17 bp, Homo sapiens
gcagaggcagggccctg

SEQ ID NO: 1956230 - DNA, 20 bp, Homo sapiens
gcagaggcagggccctgggg

SEQ ID NO: 1956231 - DNA, 22 bp, Homo sapiens
gcagagtcaagctgatgaagtt

SEQ ID NO: 1956232 - DNA, 19 bp, Homo sapiens
gcagcaccagcctgagcca

SEQ ID NO: 1956233 - DNA, 20 bp, Homo sapiens
gcagcaccagcctgagccac

SEQ ID NO: 1956234 - DNA, 21 bp, Homo sapiens
gcagcaccagcctgagccaca

SEQ ID NO: 1956235 - DNA, 22 bp, Homo sapiens
gcagcaccagcctgagccacag

SEQ ID NO: 1956236 - DNA, 21 bp, Homo sapiens
gcagcagtaccatcccactga

SEQ ID NO: 1956237 - DNA, 14 bp, Homo sapiens
gcagcccctgctgg

SEQ ID NO: 1956238 - DNA, 17 bp, Homo sapiens
gcagccgcgctctgccc

SEQ ID NO: 1956239 - DNA, 18 bp, Homo sapiens
gcagccgcgctctgcccc

SEQ ID NO: 1956240 - DNA, 11 bp, Homo sapiens
gcagcctgagc

SEQ ID NO: 1956241 - DNA, 15 bp, Homo sapiens
gcagcctgagctcca

SEQ ID NO: 1956242 - DNA, 16 bp, Homo sapiens
gcagcctgagctccac

SEQ ID NO: 1956243 - DNA, 18 bp, Homo sapiens
gcagcctgagctccaccc

SEQ ID NO: 1956244 - DNA, 21 bp, Homo sapiens
gcagcctgagctccaccctcc

SEQ ID NO: 1956245 - DNA, 17 bp, Homo sapiens
gcagcgcctcccgccgc

SEQ ID NO: 1956246 - DNA, 15 bp, Homo sapiens
gcagctagaaagaga

SEQ ID NO: 1956247 - DNA, 16 bp, Homo sapiens
gcagctagctgctttt

SEQ ID NO: 1956248 - DNA, 17 bp, Homo sapiens
gcaggcgcgcaccgccc

SEQ ID NO: 1956249 - DNA, 14 bp, Homo sapiens
gcagggccctgggg

SEQ ID NO: 1956250 - DNA, 20 bp, Homo sapiens
gcagggccctggggtctctg

SEQ ID NO: 1956251 - DNA, 18 bp, Homo sapiens
gcagggccgcagggcgct

SEQ ID NO: 1956252 - DNA, 19 bp, Homo sapiens
gcagggcgctccggcagag

SEQ ID NO: 1956253 - DNA, 20 bp, Homo sapiens
gcagggcgctccggcagagg

SEQ ID NO: 1956254 - DNA, 15 bp, Homo sapiens
gcagtggtgatgcct

SEQ ID NO: 1956255 - DNA, 14 bp, Homo sapiens
gcatactgatgaga

SEQ ID NO: 1956256 - DNA, 20 bp, Homo sapiens
gcatagccagttctgacagt

SEQ ID NO: 1956257 - DNA, 13 bp, Homo sapiens
gcatctggcctgg

SEQ ID NO: 1956258 - DNA, 18 bp, Homo sapiens
gcatgagaactaaataga

SEQ ID NO: 1956259 - DNA, 11 bp, Homo sapiens
gcatgctcagt

SEQ ID NO: 1956260 - DNA, 15 bp, Homo sapiens
gcatgctcagtattg

SEQ ID NO: 1956261 - DNA, 20 bp, Homo sapiens
gcatgtgggtgtcagtgtca

SEQ ID NO: 1956262 - DNA, 23 bp, Homo sapiens
gcattgcactaaaagtgatgtga

SEQ ID NO: 1956263 - DNA, 10 bp, Homo sapiens
gcatttatgc

SEQ ID NO: 1956264 - DNA, 13 bp, Homo sapiens
gcatttatgcatg

SEQ ID NO: 1956265 - DNA, 14 bp, Homo sapiens
gcatttatgcatga

SEQ ID NO: 1956266 - DNA, 16 bp, Homo sapiens
gcatttatgcatgaga

SEQ ID NO: 1956267 - DNA, 23 bp, Homo sapiens
gcatttatgcatgagaactaaat

SEQ ID NO: 1956268 - DNA, 12 bp, Homo sapiens
gcatttgctgaa

SEQ ID NO: 1956269 - DNA, 22 bp, Homo sapiens
gcatttgctgaataacaacaat

SEQ ID NO: 1956270 - DNA, 20 bp, Homo sapiens
gccaaggacactgatgggtc

SEQ ID NO: 1956271 - DNA, 15 bp, Homo sapiens
gccacagtggggccc

SEQ ID NO: 1956272 - DNA, 20 bp, Homo sapiens
gccacagtggggcccatggc

SEQ ID NO: 1956273 - DNA, 21 bp, Homo sapiens
gccacagtggggcccatggcc

SEQ ID NO: 1956274 - DNA, 16 bp, Homo sapiens
gccacttatttccatg

SEQ ID NO: 1956275 - DNA, 17 bp, Homo sapiens
gcccaacccccacctcc

SEQ ID NO: 1956276 - DNA, 18 bp, Homo sapiens
gcccaacccccacctccc

SEQ ID NO: 1956277 - DNA, 21 bp, Homo sapiens
gcccacccacaccccgtctgc

SEQ ID NO: 1956278 - DNA, 16 bp, Homo sapiens
gcccaccccgctgcct

SEQ ID NO: 1956279 - DNA, 12 bp, Homo sapiens
gcccacccgccc

SEQ ID NO: 1956280 - DNA, 18 bp, Homo sapiens
gcccacccgccccagaga

SEQ ID NO: 1956281 - DNA, 20 bp, Homo sapiens
gcccacccgccccagagact

SEQ ID NO: 1956282 - DNA, 19 bp, Homo sapiens
gcccaccctgggcctcccg

SEQ ID NO: 1956283 - DNA, 20 bp, Homo sapiens
gcccaccctgggcctcccgt

SEQ ID NO: 1956284 - DNA, 13 bp, Homo sapiens
gcccacgcagagc

SEQ ID NO: 1956285 - DNA, 14 bp, Homo sapiens
gcccacgcagagcc

SEQ ID NO: 1956286 - DNA, 19 bp, Homo sapiens
gcccacgcagagccccgga

SEQ ID NO: 1956287 - DNA, 22 bp, Homo sapiens
gcccacgcagagccccggagca

SEQ ID NO: 1956288 - DNA, 18 bp, Homo sapiens
gcccagaacgggcctccc

SEQ ID NO: 1956289 - DNA, 22 bp, Homo sapiens
gcccagaacgggcctccccggg

SEQ ID NO: 1956290 - DNA, 17 bp, Homo sapiens
gcccagttagcccggcc

SEQ ID NO: 1956291 - DNA, 14 bp, Homo sapiens
gcccatggccccag

SEQ ID NO: 1956292 - DNA, 18 bp, Homo sapiens
gcccatggccccagctgg

SEQ ID NO: 1956293 - DNA, 19 bp, Homo sapiens
gcccatggccccagctggc

SEQ ID NO: 1956294 - DNA, 18 bp, Homo sapiens
agtggggcccatggcccc

SEQ ID NO: 1956295 - DNA, 21 bp, Homo sapiens
agtggggcccatggccccagc

SEQ ID NO: 1956296 - DNA, 20 bp, Homo sapiens
agtggtagagtcctaggaca

SEQ ID NO: 1956297 - DNA, 20 bp, Homo sapiens
agtggtcatttggtggctct

SEQ ID NO: 1956298 - DNA, 16 bp, Homo sapiens
agtgtactggatttaa

SEQ ID NO: 1956299 - DNA, 21 bp, Homo sapiens
agtgtcattattagtctccta

SEQ ID NO: 1956300 - DNA, 20 bp, Homo sapiens
agtgtggatgtaaattttat

SEQ ID NO: 1956301 - DNA, 15 bp, Homo sapiens
agtgtggcttaaaca

SEQ ID NO: 1956302 - DNA, 12 bp, Homo sapiens
agtgtgtgtgca

SEQ ID NO: 1956303 - DNA, 15 bp, Homo sapiens
agtgttataaaatct

SEQ ID NO: 1956304 - DNA, 17 bp, Homo sapiens
agtgttataaaatctgt

SEQ ID NO: 1956305 - DNA, 14 bp, Homo sapiens
agttactcagatga

SEQ ID NO: 1956306 - DNA, 21 bp, Homo sapiens
agttactgccacggtcctttg

SEQ ID NO: 1956307 - DNA, 16 bp, Homo sapiens
agttagcccggccaag

SEQ ID NO: 1956308 - DNA, 18 bp, Homo sapiens
agttatagaggtaaaatt

SEQ ID NO: 1956309 - DNA, 14 bp, Homo sapiens
agttattcagaaat

SEQ ID NO: 1956310 - DNA, 16 bp, Homo sapiens
agttattcagaaatat

SEQ ID NO: 1956311 - DNA, 16 bp, Homo sapiens
agttattttgtgtcct

SEQ ID NO: 1956312 - DNA, 19 bp, Homo sapiens
agttcccttgattcaaata

SEQ ID NO: 1956313 - DNA, 20 bp, Homo sapiens
agttcccttgattcaaataa

SEQ ID NO: 1956314 - DNA, 20 bp, Homo sapiens
agttcttaagacttctctgt

SEQ ID NO: 1956315 - DNA, 19 bp, Homo sapiens
agttggttacctattgctg

SEQ ID NO: 1956316 - DNA, 15 bp, Homo sapiens
agttgtcagaatatg

SEQ ID NO: 1956317 - DNA, 15 bp, Homo sapiens
agttgtcctttctga

SEQ ID NO: 1956318 - DNA, 17 bp, Homo sapiens
agttgtcctttctgatc

SEQ ID NO: 1956319 - DNA, 17 bp, Homo sapiens
agttgtgcctcatttat

SEQ ID NO: 1956320 - DNA, 14 bp, Homo sapiens
agtttaaaattatt

SEQ ID NO: 1956321 - DNA, 19 bp, Homo sapiens
agtttcatgagatgcagta

SEQ ID NO: 1956322 - DNA, 14 bp, Homo sapiens
agtttcatttttca

SEQ ID NO: 1956323 - DNA, 19 bp, Homo sapiens
agtttccagctaagcctga

SEQ ID NO: 1956324 - DNA, 14 bp, Homo sapiens
agtttgttcagtga

SEQ ID NO: 1956325 - DNA, 15 bp, Homo sapiens
agttttgattgcata

SEQ ID NO: 1956326 - DNA, 23 bp, Homo sapiens
agtttttggtaatgatgattcaa

SEQ ID NO: 1956327 - DNA, 21 bp, Homo sapiens
agtttttgttcaccttctgtg

SEQ ID NO: 1956328 - DNA, 19 bp, Homo sapiens
agtttttttgttcatactt

SEQ ID NO: 1956329 - DNA, 16 bp, Homo sapiens
ataaaaataattaaaa

SEQ ID NO: 1956330 - DNA, 18 bp, Homo sapiens
ataaaaccagaaagagga

SEQ ID NO: 1956331 - DNA, 14 bp, Homo sapiens
ataaactgtgagat

SEQ ID NO: 1956332 - DNA, 15 bp, Homo sapiens
ataaagaaacctttt

SEQ ID NO: 1956333 - DNA, 16 bp, Homo sapiens
ataaatatcattatag

SEQ ID NO: 1956334 - DNA, 18 bp, Homo sapiens
ataaatcttccaaagttt

SEQ ID NO: 1956335 - DNA, 11 bp, Homo sapiens
ataacacacat

SEQ ID NO: 1956336 - DNA, 12 bp, Homo sapiens
ataacacacatc

SEQ ID NO: 1956337 - DNA, 19 bp, Homo sapiens
ataacaggcattgcactaa

SEQ ID NO: 1956338 - DNA, 20 bp, Homo sapiens
ataaccctgaatcagaggca

SEQ ID NO: 1956339 - DNA, 13 bp, Homo sapiens
ataactattgctg

SEQ ID NO: 1956340 - DNA, 20 bp, Homo sapiens
ataactcaccatcttgaagt

SEQ ID NO: 1956341 - DNA, 16 bp, Homo sapiens
ataaggcctcatcctc

SEQ ID NO: 1956342 - DNA, 13 bp, Homo sapiens
ataatataaatga

SEQ ID NO: 1956343 - DNA, 18 bp, Homo sapiens
ataatataaatgaatgaa

SEQ ID NO: 1956344 - DNA, 16 bp, Homo sapiens
ataatggcctcttaaa

SEQ ID NO: 1956345 - DNA, 14 bp, Homo sapiens
ataattaaaacaaa

SEQ ID NO: 1956346 - DNA, 21 bp, Homo sapiens
ataattaaaacaaaatccttg

SEQ ID NO: 1956347 - DNA, 16 bp, Homo sapiens
ataattaaatgaaata

SEQ ID NO: 1956348 - DNA, 18 bp, Homo sapiens
ataattaaatgaaatact

SEQ ID NO: 1956349 - DNA, 15 bp, Homo sapiens
atacaacaggatttt

SEQ ID NO: 1956350 - DNA, 17 bp, Homo sapiens
atacaacaggattttca

SEQ ID NO: 1956351 - DNA, 19 bp, Homo sapiens
atacacagaaatcctaaca

SEQ ID NO: 1956352 - DNA, 16 bp, Homo sapiens
atacattattagaata

SEQ ID NO: 1956353 - DNA, 14 bp, Homo sapiens
atacatttaaaaaa

SEQ ID NO: 1956354 - DNA, 19 bp, Homo sapiens
atacatttaaaaaacattt

SEQ ID NO: 1956355 - DNA, 15 bp, Homo sapiens
ataccagcaaaagtg

SEQ ID NO: 1956356 - DNA, 16 bp, Homo sapiens
ataccattttgaaata

SEQ ID NO: 1956357 - DNA, 17 bp, Homo sapiens
ataccattttgaaatat

SEQ ID NO: 1956358 - DNA, 21 bp, Homo sapiens
atacctagtgatacggattta

SEQ ID NO: 1956359 - DNA, 19 bp, Homo sapiens
atactatttattaaaacca

SEQ ID NO: 1956360 - DNA, 13 bp, Homo sapiens
atactgatgagac

SEQ ID NO: 1956361 - DNA, 18 bp, Homo sapiens
atactgatgagacaacac

SEQ ID NO: 1956362 - DNA, 22 bp, Homo sapiens
atactttgtctttctgcagaaa

SEQ ID NO: 1956363 - DNA, 23 bp, Homo sapiens
atactttgtctttctgcagaaaa

SEQ ID NO: 1956364 - DNA, 15 bp, Homo sapiens
atactttgtgtcttt

SEQ ID NO: 1956365 - DNA, 23 bp, Homo sapiens
atactttgtgtcttttgttctct

SEQ ID NO: 1956366 - DNA, 14 bp, Homo sapiens
atagaacaaaagag

SEQ ID NO: 1956367 - DNA, 20 bp, Homo sapiens
atagaggtaaaatttgcaca

SEQ ID NO: 1956368 - DNA, 18 bp, Homo sapiens
atagataccattttgaaa

SEQ ID NO: 1956369 - DNA, 20 bp, Homo sapiens
atagcatttaaagataccaa

SEQ ID NO: 1956370 - DNA, 13 bp, Homo sapiens
atagccaaagctg

SEQ ID NO: 1956371 - DNA, 14 bp, Homo sapiens
atagctataaatag

SEQ ID NO: 1956372 - DNA, 14 bp, Homo sapiens
ataggagaggaaaa

SEQ ID NO: 1956373 - DNA, 13 bp, Homo sapiens
ataggatttgcac

SEQ ID NO: 1956374 - DNA, 20 bp, Homo sapiens
atagttggaaatatttgcgt

SEQ ID NO: 1956375 - DNA, 16 bp, Homo sapiens
atagttgtcagaatat

SEQ ID NO: 1956376 - DNA, 22 bp, Homo sapiens
atataaaaataattaaaacaaa

SEQ ID NO: 1956377 - DNA, 12 bp, Homo sapiens
atataaactgtg

SEQ ID NO: 1956378 - DNA, 13 bp, Homo sapiens
atataaactgtga

SEQ ID NO: 1956379 - DNA, 14 bp, Homo sapiens
atatactttgtctt

SEQ ID NO: 1956380 - DNA, 18 bp, Homo sapiens
atatactttgtctttctg

SEQ ID NO: 1956381 - DNA, 21 bp, Homo sapiens
atatagagacttctaaatcat

SEQ ID NO: 1956382 - DNA, 13 bp, Homo sapiens
atatatatctgag

SEQ ID NO: 1956383 - DNA, 19 bp, Homo sapiens
atatatgaaaactaagttc

SEQ ID NO: 1956384 - DNA, 15 bp, Homo sapiens
atatatgtttggctg

SEQ ID NO: 1956385 - DNA, 12 bp, Homo sapiens
atatcaagaata

SEQ ID NO: 1956386 - DNA, 14 bp, Homo sapiens
atatcaagaatagt

SEQ ID NO: 1956387 - DNA, 15 bp, Homo sapiens
atatcaatcagtaat

SEQ ID NO: 1956388 - DNA, 17 bp, Homo sapiens
atatccctcatttcatt

SEQ ID NO: 1956389 - DNA, 13 bp, Homo sapiens
atatgaagaacta

SEQ ID NO: 1956390 - DNA, 19 bp, Homo sapiens
atatgtttggctgaaatta

SEQ ID NO: 1956391 - DNA, 21 bp, Homo sapiens
atattgacaagtttaaaggct

SEQ ID NO: 1956392 - DNA, 19 bp, Homo sapiens
atattgaggcctgtcctct

SEQ ID NO: 1956393 - DNA, 18 bp, Homo sapiens
atattgatgtaactgtgt

SEQ ID NO: 1956394 - DNA, 18 bp, Homo sapiens
atatttgcgtaaatggtt

SEQ ID NO: 1956395 - DNA, 22 bp, Homo sapiens
atcaaagccctccctgtctgtc

SEQ ID NO: 1956396 - DNA, 13 bp, Homo sapiens
atcaagtctgtga

SEQ ID NO: 1956397 - DNA, 17 bp, Homo sapiens
atcacctaattaatttc

SEQ ID NO: 1956398 - DNA, 16 bp, Homo sapiens
atcacgggcccgctca

SEQ ID NO: 1956399 - DNA, 17 bp, Homo sapiens
atcagcatttttcttta

SEQ ID NO: 1956400 - DNA, 13 bp, Homo sapiens
atcatatctgtat

SEQ ID NO: 1956401 - DNA, 16 bp, Homo sapiens
atcatatctgtatgcc

SEQ ID NO: 1956402 - DNA, 16 bp, Homo sapiens
atcatattctaaaagt

SEQ ID NO: 1956403 - DNA, 20 bp, Homo sapiens
atcattggtatctgatatct

SEQ ID NO: 1956404 - DNA, 13 bp, Homo sapiens
atcatttccagca

SEQ ID NO: 1956405 - DNA, 19 bp, Homo sapiens
atcatttccagcaaaatat

SEQ ID NO: 1956406 - DNA, 15 bp, Homo sapiens
atccaagcccagcct

SEQ ID NO: 1956407 - DNA, 13 bp, Homo sapiens
atccacagtattg

SEQ ID NO: 1956408 - DNA, 12 bp, Homo sapiens
ctgccccctccc

SEQ ID NO: 1956409 - DNA, 17 bp, Homo sapiens
ctgccccctcccccgca

SEQ ID NO: 1956410 - DNA, 19 bp, Homo sapiens
ctgccccctcccccgcaga

SEQ ID NO: 1956411 - DNA, 21 bp, Homo sapiens
ctgccccctcccccgcagaca

SEQ ID NO: 1956412 - DNA, 23 bp, Homo sapiens
ctgccccctcccccgcagacaga

SEQ ID NO: 1956413 - DNA, 20 bp, Homo sapiens
ctgcccctccgtccccaggg

SEQ ID NO: 1956414 - DNA, 19 bp, Homo sapiens
ctgccccttgaccccacac

SEQ ID NO: 1956415 - DNA, 18 bp, Homo sapiens
ctgccctcccccacggcc

SEQ ID NO: 1956416 - DNA, 13 bp, Homo sapiens
ctgccctgcacct

SEQ ID NO: 1956417 - DNA, 19 bp, Homo sapiens
ctgcctggaggagaaggag

SEQ ID NO: 1956418 - DNA, 15 bp, Homo sapiens
ctgcctggcgggcag

SEQ ID NO: 1956419 - DNA, 16 bp, Homo sapiens
ctgcctggcgggcagc

SEQ ID NO: 1956420 - DNA, 13 bp, Homo sapiens
ctgcgcctgcccg

SEQ ID NO: 1956421 - DNA, 14 bp, Homo sapiens
ctgcgcctgcccgc

SEQ ID NO: 1956422 - DNA, 15 bp, Homo sapiens
ctgcgcctgcccgcc

SEQ ID NO: 1956423 - DNA, 19 bp, Homo sapiens
ctgcgctcccacctcggac

SEQ ID NO: 1956424 - DNA, 20 bp, Homo sapiens
ctgcgctcctctgcagcctg

SEQ ID NO: 1956425 - DNA, 15 bp, Homo sapiens
ctgctatcagtctct

SEQ ID NO: 1956426 - DNA, 22 bp, Homo sapiens
ctgctatgctgttcattgatga

SEQ ID NO: 1956427 - DNA, 17 bp, Homo sapiens
ctgctcgggaaggcctg

SEQ ID NO: 1956428 - DNA, 13 bp, Homo sapiens
ctgctgagcacat

SEQ ID NO: 1956429 - DNA, 19 bp, Homo sapiens
ctgctgctcgggaaggcct

SEQ ID NO: 1956430 - DNA, 13 bp, Homo sapiens
cgcccacctgccc

SEQ ID NO: 1956431 - DNA, 14 bp, Homo sapiens
cgcccacctgccca

SEQ ID NO: 1956432 - DNA, 13 bp, Homo sapiens
cgccccagagact

SEQ ID NO: 1956433 - DNA, 14 bp, Homo sapiens
cgccccagagactg

SEQ ID NO: 1956434 - DNA, 19 bp, Homo sapiens
cgccccagagactgcccac

SEQ ID NO: 1956435 - DNA, 22 bp, Homo sapiens
cgccccagagactgcccaccct

SEQ ID NO: 1956436 - DNA, 23 bp, Homo sapiens
cgccccagagactgcccaccctg

SEQ ID NO: 1956437 - DNA, 18 bp, Homo sapiens
cgcccccgccctcgctcc

SEQ ID NO: 1956438 - DNA, 12 bp, Homo sapiens
cgcccctcctcg

SEQ ID NO: 1956439 - DNA, 15 bp, Homo sapiens
cgcccgcccaccccg

SEQ ID NO: 1956440 - DNA, 20 bp, Homo sapiens
cgcccgcccaccccgctgcc

SEQ ID NO: 1956441 - DNA, 13 bp, Homo sapiens
cgcccgcccccgc

SEQ ID NO: 1956442 - DNA, 17 bp, Homo sapiens
cgcccgcccccgccctc

SEQ ID NO: 1956443 - DNA, 19 bp, Homo sapiens
cgcccgccctcctctgccc

SEQ ID NO: 1956444 - DNA, 16 bp, Homo sapiens
cgcccgccggttggcc

SEQ ID NO: 1956445 - DNA, 21 bp, Homo sapiens
cgcccgccggttggccggctg

SEQ ID NO: 1956446 - DNA, 11 bp, Homo sapiens
cgccctcctct

SEQ ID NO: 1956447 - DNA, 15 bp, Homo sapiens
cgccctcctctgccc

SEQ ID NO: 1956448 - DNA, 19 bp, Homo sapiens
cgccctcctctgccccctc

SEQ ID NO: 1956449 - DNA, 14 bp, Homo sapiens
cgccggggctggcc

SEQ ID NO: 1956450 - DNA, 15 bp, Homo sapiens
cgcctcccgccgcct

SEQ ID NO: 1956451 - DNA, 14 bp, Homo sapiens
cgcctcctccagac

SEQ ID NO: 1956452 - DNA, 17 bp, Homo sapiens
cgcctcctccagactcg

SEQ ID NO: 1956453 - DNA, 19 bp, Homo sapiens
cgcctcgggccgcctcctc

SEQ ID NO: 1956454 - DNA, 13 bp, Homo sapiens
cgcctgcccgccc

SEQ ID NO: 1956455 - DNA, 16 bp, Homo sapiens
cgcctgcgctcctctg

SEQ ID NO: 1956456 - DNA, 17 bp, Homo sapiens
cgcctgcgctcctctgc

SEQ ID NO: 1956457 - DNA, 20 bp, Homo sapiens
cgcctgcgctcctctgcagc

SEQ ID NO: 1956458 - DNA, 15 bp, Homo sapiens
cgcgtgcccccagcg

SEQ ID NO: 1956459 - DNA, 17 bp, Homo sapiens
cgcgtgcccccagcgtg

SEQ ID NO: 1956460 - DNA, 14 bp, Homo sapiens
cgcgtgccttcccc

SEQ ID NO: 1956461 - DNA, 20 bp, Homo sapiens
cgctcaacctctcagatccc

SEQ ID NO: 1956462 - DNA, 14 bp, Homo sapiens
cgctccggcagagg

SEQ ID NO: 1956463 - DNA, 21 bp, Homo sapiens
cgctccggcagaggcagggcc

SEQ ID NO: 1956464 - DNA, 24 bp, Homo sapiens
cgctccggcagaggcagggccctg

SEQ ID NO: 1956465 - DNA, 18 bp, Homo sapiens
cgctcctctgcagcctga

SEQ ID NO: 1956466 - DNA, 19 bp, Homo sapiens
cgctcctctgcagcctgag

SEQ ID NO: 1956467 - DNA, 14 bp, Homo sapiens
cgctctgcccctcc

SEQ ID NO: 1956468 - DNA, 20 bp, Homo sapiens
cgctctgcccctccgtcccc

SEQ ID NO: 1956469 - DNA, 22 bp, Homo sapiens
cgctctgcccctccgtccccag

SEQ ID NO: 1956470 - DNA, 12 bp, Homo sapiens
cgctgcctggcg

SEQ ID NO: 1956471 - DNA, 23 bp, Homo sapiens
cgctgcctggcgggcagcccctg

SEQ ID NO: 1956472 - DNA, 18 bp, Homo sapiens
cggaccggagcggctgag

SEQ ID NO: 1956473 - DNA, 16 bp, Homo sapiens
cggacgggacagcggc

SEQ ID NO: 1956474 - DNA, 18 bp, Homo sapiens
cggacgggacagcggccc

SEQ ID NO: 1956475 - DNA, 14 bp, Homo sapiens
cggaggcgcccacc

SEQ ID NO: 1956476 - DNA, 17 bp, Homo sapiens
cggaggcgcccacctgc

SEQ ID NO: 1956477 - DNA, 15 bp, Homo sapiens
cggcaccgcccaccc

SEQ ID NO: 1956478 - DNA, 16 bp, Homo sapiens
cggcagaggcagggcc

SEQ ID NO: 1956479 - DNA, 19 bp, Homo sapiens
cggccaaggacactgatgg

SEQ ID NO: 1956480 - DNA, 17 bp, Homo sapiens
cggccccgcgcgtgccc

SEQ ID NO: 1956481 - DNA, 14 bp, Homo sapiens
cggcccgccacctt

SEQ ID NO: 1956482 - DNA, 14 bp, Homo sapiens
cggcccggcccacg

SEQ ID NO: 1956483 - DNA, 15 bp, Homo sapiens
cggcccggcccacgc

SEQ ID NO: 1956484 - DNA, 15 bp, Homo sapiens
cggccgtccctgact

SEQ ID NO: 1956485 - DNA, 12 bp, Homo sapiens
cggcctgcagcc

SEQ ID NO: 1956486 - DNA, 16 bp, Homo sapiens
cggctgaggacggggc

SEQ ID NO: 1956487 - DNA, 22 bp, Homo sapiens
cggctgaggacggggcagagct

SEQ ID NO: 1956488 - DNA, 20 bp, Homo sapiens
cggctggccggtccaccccg

SEQ ID NO: 1956489 - DNA, 13 bp, Homo sapiens
cgggaaggcctga

SEQ ID NO: 1956490 - DNA, 15 bp, Homo sapiens
ccctgccctgcacct

SEQ ID NO: 1956491 - DNA, 14 bp, Homo sapiens
ccctgggcctcccg

SEQ ID NO: 1956492 - DNA, 18 bp, Homo sapiens
ccctggggtctctgagca

SEQ ID NO: 1956493 - DNA, 21 bp, Homo sapiens
ccctggggtctctgagcagtg

SEQ ID NO: 1956494 - DNA, 19 bp, Homo sapiens
ccctgtctgtctgtctctc

SEQ ID NO: 1956495 - DNA, 14 bp, Homo sapiens
ccctgtgggagtcc

SEQ ID NO: 1956496 - DNA, 15 bp, Homo sapiens
ccctgtgggagtcca

SEQ ID NO: 1956497 - DNA, 14 bp, Homo sapiens
cccttcctgtcctg

SEQ ID NO: 1956498 - DNA, 17 bp, Homo sapiens
cccttcctgtcctgctc

SEQ ID NO: 1956499 - DNA, 18 bp, Homo sapiens
cccttcctgtcctgctca

SEQ ID NO: 1956500 - DNA, 21 bp, Homo sapiens
cccttcctgtcctgctcacgt

SEQ ID NO: 1956501 - DNA, 16 bp, Homo sapiens
ccgcagcaccagcctg

SEQ ID NO: 1956502 - DNA, 18 bp, Homo sapiens
ccgcagcaccagcctgag

SEQ ID NO: 1956503 - DNA, 19 bp, Homo sapiens
ccgcagcaccagcctgagc

SEQ ID NO: 1956504 - DNA, 22 bp, Homo sapiens
ccgcagcaccagcctgagccac

SEQ ID NO: 1956505 - DNA, 15 bp, Homo sapiens
ccgcccacccacacc

SEQ ID NO: 1956506 - DNA, 18 bp, Homo sapiens
ccgcccacccacaccccg

SEQ ID NO: 1956507 - DNA, 12 bp, Homo sapiens
ccgcccaccccg

SEQ ID NO: 1956508 - DNA, 14 bp, Homo sapiens
ccgcccgcccaccc

SEQ ID NO: 1956509 - DNA, 14 bp, Homo sapiens
ccgccctcctctgc

SEQ ID NO: 1956510 - DNA, 13 bp, Homo sapiens
ccgccctcgctcc

SEQ ID NO: 1956511 - DNA, 11 bp, Homo sapiens
ccgcctcctcc

SEQ ID NO: 1956512 - DNA, 15 bp, Homo sapiens
ccgcctcctccagac

SEQ ID NO: 1956513 - DNA, 16 bp, Homo sapiens
ccgcctcgggccgcct

SEQ ID NO: 1956514 - DNA, 21 bp, Homo sapiens
ccgcctcgggccgcctcctcc

SEQ ID NO: 1956515 - DNA, 15 bp, Homo sapiens
ccgcgcgtgccccca

SEQ ID NO: 1956516 - DNA, 13 bp, Homo sapiens
ccgcgctctgccc

SEQ ID NO: 1956517 - DNA, 17 bp, Homo sapiens
ccgcgctctgcccctcc

SEQ ID NO: 1956518 - DNA, 19 bp, Homo sapiens
ccgcgctctgcccctccgt

SEQ ID NO: 1956519 - DNA, 23 bp, Homo sapiens
ccgctgcctggcgggcagcccct

SEQ ID NO: 1956520 - DNA, 13 bp, Homo sapiens
ccggacgctggct

SEQ ID NO: 1956521 - DNA, 14 bp, Homo sapiens
ccggagcggctgag

SEQ ID NO: 1956522 - DNA, 16 bp, Homo sapiens
ccggagcggctgagga

SEQ ID NO: 1956523 - DNA, 18 bp, Homo sapiens
ccggaggcgcccacctgc

SEQ ID NO: 1956524 - DNA, 22 bp, Homo sapiens
ccggaggcgcccacctgcccag

SEQ ID NO: 1956525 - DNA, 12 bp, Homo sapiens
ccggcagaggca

SEQ ID NO: 1956526 - DNA, 15 bp, Homo sapiens
ccggcagaggcaggg

SEQ ID NO: 1956527 - DNA, 18 bp, Homo sapiens
ccggcagaggcagggccc

SEQ ID NO: 1956528 - DNA, 19 bp, Homo sapiens
ccggcagaggcagggccct

SEQ ID NO: 1956529 - DNA, 19 bp, Homo sapiens
ccggccaaggacactgatg

SEQ ID NO: 1956530 - DNA, 18 bp, Homo sapiens
ccggcccacgcagagccc

SEQ ID NO: 1956531 - DNA, 20 bp, Homo sapiens
ccggcccacgcagagccccg

SEQ ID NO: 1956532 - DNA, 17 bp, Homo sapiens
ccggccccgcgcgtgcc

SEQ ID NO: 1956533 - DNA, 13 bp, Homo sapiens
ccggcctgcagcc

SEQ ID NO: 1956534 - DNA, 15 bp, Homo sapiens
ccggctggccggtcc

SEQ ID NO: 1956535 - DNA, 13 bp, Homo sapiens
ccggggctggccc

SEQ ID NO: 1956536 - DNA, 21 bp, Homo sapiens
ccgggtgcgtgaccggcccgc

SEQ ID NO: 1956537 - DNA, 18 bp, Homo sapiens
ccggttggccggctggcc

SEQ ID NO: 1956538 - DNA, 19 bp, Homo sapiens
ccggtttccgtagcagttt

SEQ ID NO: 1956539 - DNA, 12 bp, Homo sapiens
ccgtccccaggg

SEQ ID NO: 1956540 - DNA, 13 bp, Homo sapiens
ccgtcccggcccc

SEQ ID NO: 1956541 - DNA, 12 bp, Homo sapiens
ccgtccgcccgc

SEQ ID NO: 1956542 - DNA, 17 bp, Homo sapiens
ccgtccgcccgcccacc

SEQ ID NO: 1956543 - DNA, 11 bp, Homo sapiens
ccgtctgcccc

SEQ ID NO: 1956544 - DNA, 21 bp, Homo sapiens
ccgtctgccccttgaccccac

SEQ ID NO: 1956545 - DNA, 18 bp, Homo sapiens
ccgtctttggttcctcat

SEQ ID NO: 1956546 - DNA, 13 bp, Homo sapiens
ccgtgcgcagccg

SEQ ID NO: 1956547 - DNA, 21 bp, Homo sapiens
ccgtggtgtgaggcccccgga

SEQ ID NO: 1956548 - DNA, 14 bp, Homo sapiens
ccgttcatctgagg

SEQ ID NO: 1956549 - DNA, 15 bp, Homo sapiens
ccgttcatctgagga

SEQ ID NO: 1956550 - DNA, 17 bp, Homo sapiens
ccgttcatctgaggagt

SEQ ID NO: 1956551 - DNA, 21 bp, Homo sapiens
ccgttcatctgaggagtccaa

SEQ ID NO: 1956552 - DNA, 12 bp, Homo sapiens
cctaaatgcaaa

SEQ ID NO: 1956553 - DNA, 14 bp, Homo sapiens
cctacttaaacaaa

SEQ ID NO: 1956554 - DNA, 22 bp, Homo sapiens
aatgttgtgtgggttcaaattc

SEQ ID NO: 1956555 - DNA, 15 bp, Homo sapiens
aattaaactgatggg

SEQ ID NO: 1956556 - DNA, 13 bp, Homo sapiens
aattaatttcagt

SEQ ID NO: 1956557 - DNA, 14 bp, Homo sapiens
aattacataacagg

SEQ ID NO: 1956558 - DNA, 14 bp, Homo sapiens
aattactttcagaa

SEQ ID NO: 1956559 - DNA, 15 bp, Homo sapiens
aattactttcagaat

SEQ ID NO: 1956560 - DNA, 19 bp, Homo sapiens
aattactttcagaatgttg

SEQ ID NO: 1956561 - DNA, 19 bp, Homo sapiens
aattagggctctaatttcc

SEQ ID NO: 1956562 - DNA, 20 bp, Homo sapiens
aattagggctctaatttcct

SEQ ID NO: 1956563 - DNA, 20 bp, Homo sapiens
aattatgaagccctaagtaa

SEQ ID NO: 1956564 - DNA, 18 bp, Homo sapiens
aattattaaaaattatag

SEQ ID NO: 1956565 - DNA, 22 bp, Homo sapiens
aattattgatacaacaggattt

SEQ ID NO: 1956566 - DNA, 15 bp, Homo sapiens
aattcacaaagttaa

SEQ ID NO: 1956567 - DNA, 18 bp, Homo sapiens
aattccagggaaccagag

SEQ ID NO: 1956568 - DNA, 18 bp, Homo sapiens
aattcctcctgtctcctc

SEQ ID NO: 1956569 - DNA, 17 bp, Homo sapiens
aattctctatgtacaga

SEQ ID NO: 1956570 - DNA, 13 bp, Homo sapiens
aattcttgcactg

SEQ ID NO: 1956571 - DNA, 14 bp, Homo sapiens
aattcttgcactgt

SEQ ID NO: 1956572 - DNA, 17 bp, Homo sapiens
aattgacctcaaaagaa

SEQ ID NO: 1956573 - DNA, 13 bp, Homo sapiens
aatttacagtgat

SEQ ID NO: 1956574 - DNA, 14 bp, Homo sapiens
aatttacagtgata

SEQ ID NO: 1956575 - DNA, 15 bp, Homo sapiens
aatttcaagaatgtt

SEQ ID NO: 1956576 - DNA, 18 bp, Homo sapiens
aatttcaagaatgtttca

SEQ ID NO: 1956577 - DNA, 13 bp, Homo sapiens
aatttcaatgctt

SEQ ID NO: 1956578 - DNA, 16 bp, Homo sapiens
aatttcagtaagatca

SEQ ID NO: 1956579 - DNA, 17 bp, Homo sapiens
aatttgcacacaaaaca

SEQ ID NO: 1956580 - DNA, 21 bp, Homo sapiens
aatttgcacacaaaacatctt

SEQ ID NO: 1956581 - DNA, 20 bp, Homo sapiens
aattttaacttttgggattt

SEQ ID NO: 1956582 - DNA, 13 bp, Homo sapiens
aattttattgctg

SEQ ID NO: 1956583 - DNA, 20 bp, Homo sapiens
acaaaaactttccatgacag

SEQ ID NO: 1956584 - DNA, 14 bp, Homo sapiens
acaaaacaacagca

SEQ ID NO: 1956585 - DNA, 10 bp, Homo sapiens
acaaaagaag

SEQ ID NO: 1956586 - DNA, 14 bp, Homo sapiens
acaaagcatgctca

SEQ ID NO: 1956587 - DNA, 20 bp, Homo sapiens
acaaagcatgctcagtattg

SEQ ID NO: 1956588 - DNA, 15 bp, Homo sapiens
acaacaaagcatgct

SEQ ID NO: 1956589 - DNA, 18 bp, Homo sapiens
acaacacagtagtgttct

SEQ ID NO: 1956590 - DNA, 14 bp, Homo sapiens
acaacagcaacaac

SEQ ID NO: 1956591 - DNA, 15 bp, Homo sapiens
acaacaggattttca

SEQ ID NO: 1956592 - DNA, 16 bp, Homo sapiens
acaacaggattttcaa

SEQ ID NO: 1956593 - DNA, 17 bp, Homo sapiens
acaacaggattttcaag

SEQ ID NO: 1956594 - DNA, 18 bp, Homo sapiens
acaacaggattttcaagt

SEQ ID NO: 1956595 - DNA, 15 bp, Homo sapiens
acaaccaaagaaaat

SEQ ID NO: 1956596 - DNA, 19 bp, Homo sapiens
acaatttaggaatgctcaa

SEQ ID NO: 1956597 - DNA, 12 bp, Homo sapiens
acaatttcaatg

SEQ ID NO: 1956598 - DNA, 17 bp, Homo sapiens
acacaaaacaacagcaa

SEQ ID NO: 1956599 - DNA, 20 bp, Homo sapiens
acacaaaacaacagcaacaa

SEQ ID NO: 1956600 - DNA, 13 bp, Homo sapiens
acacacacaaaac

SEQ ID NO: 1956601 - DNA, 15 bp, Homo sapiens
acacacacacacaca

SEQ ID NO: 1956602 - DNA, 20 bp, Homo sapiens
acacatcataaacaaagagt

SEQ ID NO: 1956603 - DNA, 15 bp, Homo sapiens
acaccccgtctgccc

SEQ ID NO: 1956604 - DNA, 17 bp, Homo sapiens
acacgccggggctggcc

SEQ ID NO: 1956605 - DNA, 21 bp, Homo sapiens
acacgccggggctggccctgc

SEQ ID NO: 1956606 - DNA, 15 bp, Homo sapiens
acacgttggagtata

SEQ ID NO: 1956607 - DNA, 14 bp, Homo sapiens
acactcaccattta

SEQ ID NO: 1956608 - DNA, 20 bp, Homo sapiens
acactgatgggtcctgctgc

SEQ ID NO: 1956609 - DNA, 13 bp, Homo sapiens
acactgtcaagat

SEQ ID NO: 1956610 - DNA, 16 bp, Homo sapiens
acactgtcaagattaa

SEQ ID NO: 1956611 - DNA, 14 bp, Homo sapiens
acagaacaacaaca

SEQ ID NO: 1956612 - DNA, 20 bp, Homo sapiens
acagaaccagcactcccagg

SEQ ID NO: 1956613 - DNA, 22 bp, Homo sapiens
acagacggacgggacagcggcc

SEQ ID NO: 1956614 - DNA, 18 bp, Homo sapiens
acagcggcccggcccacg

SEQ ID NO: 1956615 - DNA, 19 bp, Homo sapiens
acagcggcccggcccacgc

SEQ ID NO: 1956616 - DNA, 15 bp, Homo sapiens
acaggattttcaagt

SEQ ID NO: 1956617 - DNA, 22 bp, Homo sapiens
acaggcatccgctgcgctccca

SEQ ID NO: 1956618 - DNA, 16 bp, Homo sapiens
acaggggaggctgaga

SEQ ID NO: 1956619 - DNA, 13 bp, Homo sapiens
acagtaatcagtt

SEQ ID NO: 1956620 - DNA, 18 bp, Homo sapiens
acagtaattactttcaga

SEQ ID NO: 1956621 - DNA, 19 bp, Homo sapiens
acagtaattactttcagaa

SEQ ID NO: 1956622 - DNA, 21 bp, Homo sapiens
acagtaattactttcagaatg

SEQ ID NO: 1956623 - DNA, 16 bp, Homo sapiens
acagtattgttcttgt

SEQ ID NO: 1956624 - DNA, 18 bp, Homo sapiens
acagtgtggatgtaaatt

SEQ ID NO: 1956625 - DNA, 14 bp, Homo sapiens
acagtttgttcagt

SEQ ID NO: 1956626 - DNA, 12 bp, Homo sapiens
acataacacaca

SEQ ID NO: 1956627 - DNA, 13 bp, Homo sapiens
acataacacacat

SEQ ID NO: 1956628 - DNA, 17 bp, Homo sapiens
acataacaggcattgca

SEQ ID NO: 1956629 - DNA, 22 bp, Homo sapiens
acataacaggcattgcactaaa

SEQ ID NO: 1956630 - DNA, 21 bp, Homo sapiens
acatacatttaaaaaacattt

SEQ ID NO: 1956631 - DNA, 23 bp, Homo sapiens
acatcagtccacccccattgtga

SEQ ID NO: 1956632 - DNA, 23 bp, Homo sapiens
acatctctgtaaaaagcaggtga

SEQ ID NO: 1956633 - DNA, 21 bp, Homo sapiens
acatgcccctcttagaagaaa

SEQ ID NO: 1956634 - DNA, 18 bp, Homo sapiens
acattttacagattttat

SEQ ID NO: 1956635 - DNA, 15 bp, Homo sapiens
accaaattgctgaga

SEQ ID NO: 1956636 - DNA, 16 bp, Homo sapiens
accaaattgctgagat

SEQ ID NO: 1956637 - DNA, 15 bp, Homo sapiens
accaatttgttctgt

SEQ ID NO: 1956638 - DNA, 17 bp, Homo sapiens
accaatttgttctgtgc

SEQ ID NO: 1956639 - DNA, 19 bp, Homo sapiens
accacggggtcgggggagg

SEQ ID NO: 1956640 - DNA, 12 bp, Homo sapiens
accagcactccc

SEQ ID NO: 1956641 - DNA, 14 bp, Homo sapiens
accagcactcccag

SEQ ID NO: 1956642 - DNA, 17 bp, Homo sapiens
accagcactcccagggc

SEQ ID NO: 1956643 - DNA, 14 bp, Homo sapiens
accagctgcctctt

SEQ ID NO: 1956644 - DNA, 20 bp, Homo sapiens
accattgctaatttaaagga

SEQ ID NO: 1956645 - DNA, 14 bp, Homo sapiens
accatttaatcatt

SEQ ID NO: 1956646 - DNA, 22 bp, Homo sapiens
accatttcccctgtggtttgtt

SEQ ID NO: 1956647 - DNA, 20 bp, Homo sapiens
acccacaccccgtctgcccc

SEQ ID NO: 1956648 - DNA, 21 bp, Homo sapiens
acccacaccccgtctgcccct

SEQ ID NO: 1956649 - DNA, 22 bp, Homo sapiens
acccacaccccgtctgcccctt

SEQ ID NO: 1956650 - DNA, 15 bp, Homo sapiens
acccactagccctct

SEQ ID NO: 1956651 - DNA, 22 bp, Homo sapiens
accccatagtgccttgatttta

SEQ ID NO: 1956652 - DNA, 13 bp, Homo sapiens
acccccagcctcc

SEQ ID NO: 1956653 - DNA, 19 bp, Homo sapiens
acccccatgccaatgtcca

SEQ ID NO: 1956654 - DNA, 13 bp, Homo sapiens
accccgctgcctg

SEQ ID NO: 1956655 - DNA, 14 bp, Homo sapiens
accccgctgcctgg

SEQ ID NO: 1956656 - DNA, 18 bp, Homo sapiens
accccgtcccggccccgc

SEQ ID NO: 1956657 - DNA, 19 bp, Homo sapiens
accccgtcccggccccgcg

SEQ ID NO: 1956658 - DNA, 13 bp, Homo sapiens
accccgtctgccc

SEQ ID NO: 1956659 - DNA, 15 bp, Homo sapiens
accccgtctgcccct

SEQ ID NO: 1956660 - DNA, 16 bp, Homo sapiens
accccgtctgcccctt

SEQ ID NO: 1956661 - DNA, 23 bp, Homo sapiens
accccgtctgccccttgacccca

SEQ ID NO: 1956662 - DNA, 21 bp, Homo sapiens
acccctctcccttttcagata

SEQ ID NO: 1956663 - DNA, 15 bp, Homo sapiens
acccgccccagagac

SEQ ID NO: 1956664 - DNA, 18 bp, Homo sapiens
acccgccccagagactgc

SEQ ID NO: 1956665 - DNA, 20 bp, Homo sapiens
acccgccccagagactgccc

SEQ ID NO: 1956666 - DNA, 16 bp, Homo sapiens
acccgtgttctcctcc

SEQ ID NO: 1956667 - DNA, 14 bp, Homo sapiens
accctatcatcagt

SEQ ID NO: 1956668 - DNA, 22 bp, Homo sapiens
aagcccagcctatctctcttct

SEQ ID NO: 1956669 - DNA, 15 bp, Homo sapiens
aagctcaaggctgca

SEQ ID NO: 1956670 - DNA, 12 bp, Homo sapiens
aaggagaaaaaa

SEQ ID NO: 1956671 - DNA, 13 bp, Homo sapiens
aaggagggagaaa

SEQ ID NO: 1956672 - DNA, 12 bp, Homo sapiens
aaggcctgaggg

SEQ ID NO: 1956673 - DNA, 13 bp, Homo sapiens
aaggcttctccac

SEQ ID NO: 1956674 - DNA, 22 bp, Homo sapiens
aagggactccagaagcagcagc

SEQ ID NO: 1956675 - DNA, 16 bp, Homo sapiens
aagggagtgaaaacct

SEQ ID NO: 1956676 - DNA, 13 bp, Homo sapiens
aagtaatttcaag

SEQ ID NO: 1956677 - DNA, 14 bp, Homo sapiens
aagtaatttcaaga

SEQ ID NO: 1956678 - DNA, 21 bp, Homo sapiens
aagtaatttcaagaatgtttc

SEQ ID NO: 1956679 - DNA, 15 bp, Homo sapiens
aagtctcctgtatca

SEQ ID NO: 1956680 - DNA, 12 bp, Homo sapiens
aagtgaaaaaga

SEQ ID NO: 1956681 - DNA, 20 bp, Homo sapiens
aagtgaaaaagacttcaaat

SEQ ID NO: 1956682 - DNA, 17 bp, Homo sapiens
aagtgatgtgatttatg

SEQ ID NO: 1956683 - DNA, 19 bp, Homo sapiens
aagtgatgtgatttatgca

SEQ ID NO: 1956684 - DNA, 22 bp, Homo sapiens
aagtgatgtgatttatgcattt

SEQ ID NO: 1956685 - DNA, 15 bp, Homo sapiens
aagtgtactggattt

SEQ ID NO: 1956686 - DNA, 17 bp, Homo sapiens
aagttacatacatttaa

SEQ ID NO: 1956687 - DNA, 17 bp, Homo sapiens
aagttatttgatctggt

SEQ ID NO: 1956688 - DNA, 17 bp, Homo sapiens
aagttggagtgcagtgg

SEQ ID NO: 1956689 - DNA, 21 bp, Homo sapiens
aataaagccttgtgatcactt

SEQ ID NO: 1956690 - DNA, 13 bp, Homo sapiens
aataaatcaaaat

SEQ ID NO: 1956691 - DNA, 17 bp, Homo sapiens
aataagttcctctgaag

SEQ ID NO: 1956692 - DNA, 19 bp, Homo sapiens
aataatttagaaataaaag

SEQ ID NO: 1956693 - DNA, 20 bp, Homo sapiens
aatacaagttacatacattt

SEQ ID NO: 1956694 - DNA, 17 bp, Homo sapiens
aatactttgtgtctttt

SEQ ID NO: 1956695 - DNA, 15 bp, Homo sapiens
aatagatttttagat

SEQ ID NO: 1956696 - DNA, 12 bp, Homo sapiens
aatataaactgt

SEQ ID NO: 1956697 - DNA, 14 bp, Homo sapiens
aatataaactgtga

SEQ ID NO: 1956698 - DNA, 16 bp, Homo sapiens
aatataaactgtgaga

SEQ ID NO: 1956699 - DNA, 15 bp, Homo sapiens
aatataaatgaatga

SEQ ID NO: 1956700 - DNA, 19 bp, Homo sapiens
aatataaatgaatgaaata

SEQ ID NO: 1956701 - DNA, 22 bp, Homo sapiens
aatataaatgaatgaaatataa

SEQ ID NO: 1956702 - DNA, 23 bp, Homo sapiens
aatatagggtttgtttgctgctt

SEQ ID NO: 1956703 - DNA, 14 bp, Homo sapiens
aatatattgccaaa

SEQ ID NO: 1956704 - DNA, 18 bp, Homo sapiens
aatatattgccaaatatt

SEQ ID NO: 1956705 - DNA, 23 bp, Homo sapiens
aatatattgccaaatattaagaa

SEQ ID NO: 1956706 - DNA, 18 bp, Homo sapiens
aatatcattatagcatgt

SEQ ID NO: 1956707 - DNA, 13 bp, Homo sapiens
aatatgatcttga

SEQ ID NO: 1956708 - DNA, 19 bp, Homo sapiens
aatcacctaattaatttca

SEQ ID NO: 1956709 - DNA, 20 bp, Homo sapiens
aatcagtaattaacatatca

SEQ ID NO: 1956710 - DNA, 14 bp, Homo sapiens
aatcatacacagaa

SEQ ID NO: 1956711 - DNA, 12 bp, Homo sapiens
aatcatctattg

SEQ ID NO: 1956712 - DNA, 15 bp, Homo sapiens
aatcatgggaatttt

SEQ ID NO: 1956713 - DNA, 19 bp, Homo sapiens
aatccacagtattgttctt

SEQ ID NO: 1956714 - DNA, 19 bp, Homo sapiens
aatctagagctatgcacac

SEQ ID NO: 1956715 - DNA, 16 bp, Homo sapiens
aatctatagcatttaa

SEQ ID NO: 1956716 - DNA, 17 bp, Homo sapiens
aatctctcaaaatgtgc

SEQ ID NO: 1956717 - DNA, 17 bp, Homo sapiens
aatgaaatataaactgt

SEQ ID NO: 1956718 - DNA, 20 bp, Homo sapiens
aatgaaatataaactgtgag

SEQ ID NO: 1956719 - DNA, 21 bp, Homo sapiens
aatgacctccagggaatcaga

SEQ ID NO: 1956720 - DNA, 14 bp, Homo sapiens
aatgagttcccttg

SEQ ID NO: 1956721 - DNA, 16 bp, Homo sapiens
aatgatatgtctttaa

SEQ ID NO: 1956722 - DNA, 19 bp, Homo sapiens
aatgattcacttttattgt

SEQ ID NO: 1956723 - DNA, 14 bp, Homo sapiens
aatgcagaattgct

SEQ ID NO: 1956724 - DNA, 14 bp, Homo sapiens
aatgctcaatgtgc

SEQ ID NO: 1956725 - DNA, 16 bp, Homo sapiens
aatgctgcctagtgct

SEQ ID NO: 1956726 - DNA, 14 bp, Homo sapiens
aatgcttaaatgat

SEQ ID NO: 1956727 - DNA, 18 bp, Homo sapiens
aatgcttctttcctctta

SEQ ID NO: 1956728 - DNA, 21 bp, Homo sapiens
aatgcttcttttagtcagaaa

SEQ ID NO: 1956729 - DNA, 22 bp, Homo sapiens
aatgcttcttttagtcagaaat

SEQ ID NO: 1956730 - DNA, 13 bp, Homo sapiens
aatggatgtaata

SEQ ID NO: 1956731 - DNA, 14 bp, Homo sapiens
aatggatgtaatat

SEQ ID NO: 1956732 - DNA, 17 bp, Homo sapiens
aatggatgtaatatagg

SEQ ID NO: 1956733 - DNA, 13 bp, Homo sapiens
aatggcctcttaa

SEQ ID NO: 1956734 - DNA, 16 bp, Homo sapiens
aatggcctcttaaaaa

SEQ ID NO: 1956735 - DNA, 19 bp, Homo sapiens
aatggcctcttaaaaatta

SEQ ID NO: 1956736 - DNA, 22 bp, Homo sapiens
aatggtgaactgtcattacaga

SEQ ID NO: 1956737 - DNA, 17 bp, Homo sapiens
aatgtatattgatgtaa

SEQ ID NO: 1956738 - DNA, 15 bp, Homo sapiens
aatgtctcaaaataa

SEQ ID NO: 1956739 - DNA, 21 bp, Homo sapiens
aatgtggaattacataacagg

SEQ ID NO: 1956740 - DNA, 16 bp, Homo sapiens
aatgtgtgcttggaaa

SEQ ID NO: 1956741 - DNA, 17 bp, Homo sapiens
aatgttccgttcatctg

SEQ ID NO: 1956742 - DNA, 14 bp, Homo sapiens
aatgttgaaaaaga

SEQ ID NO: 1956743 - DNA, 18 bp, Homo sapiens
aatgttgaaaaagaaaac

SEQ ID NO: 1956744 - DNA, 19 bp, Homo sapiens
aatgttgaaaaagaaaaca

SEQ ID NO: 1956745 - DNA, 17 bp, Homo sapiens
aatgttgtcctgtgtca

SEQ ID NO: 1956746 - DNA, 16 bp, Homo sapiens
agactgctttgagaaa

SEQ ID NO: 1956747 - DNA, 23 bp, Homo sapiens
agacttctctgtcctctgctttg

SEQ ID NO: 1956748 - DNA, 14 bp, Homo sapiens
agagaaaaagccct

SEQ ID NO: 1956749 - DNA, 19 bp, Homo sapiens
agagacggcagccccatcc

SEQ ID NO: 1956750 - DNA, 20 bp, Homo sapiens
agagacggcagccccatcct

SEQ ID NO: 1956751 - DNA, 21 bp, Homo sapiens
agagacggcagccccatcctt

SEQ ID NO: 1956752 - DNA, 13 bp, Homo sapiens
agagactgcccac

SEQ ID NO: 1956753 - DNA, 22 bp, Homo sapiens
agagactgcccaccctgggcct

SEQ ID NO: 1956754 - DNA, 20 bp, Homo sapiens
agagcaatcttgctgtgaaa

SEQ ID NO: 1956755 - DNA, 22 bp, Homo sapiens
agagccccggagcaccacgggg

SEQ ID NO: 1956756 - DNA, 20 bp, Homo sapiens
agagcgccacccgcccgccc

SEQ ID NO: 1956757 - DNA, 20 bp, Homo sapiens
agagctgagtcggctgggca

SEQ ID NO: 1956758 - DNA, 21 bp, Homo sapiens
agaggaataaaatgattaagt

SEQ ID NO: 1956759 - DNA, 13 bp, Homo sapiens
agaggacatacca

SEQ ID NO: 1956760 - DNA, 19 bp, Homo sapiens
agaggattagtagaaaata

SEQ ID NO: 1956761 - DNA, 22 bp, Homo sapiens
agaggattagtagaaaatacat

SEQ ID NO: 1956762 - DNA, 13 bp, Homo sapiens
agaggcagagacc

SEQ ID NO: 1956763 - DNA, 12 bp, Homo sapiens
agagggctgagc

SEQ ID NO: 1956764 - DNA, 15 bp, Homo sapiens
agagggctgagcccc

SEQ ID NO: 1956765 - DNA, 17 bp, Homo sapiens
agaggtaaaatttgcac

SEQ ID NO: 1956766 - DNA, 14 bp, Homo sapiens
agagtcaggagaaa

SEQ ID NO: 1956767 - DNA, 22 bp, Homo sapiens
agagttactgccacggtccttt

SEQ ID NO: 1956768 - DNA, 18 bp, Homo sapiens
agataaaaggagagaaag

SEQ ID NO: 1956769 - DNA, 15 bp, Homo sapiens
agataaatatcatta

SEQ ID NO: 1956770 - DNA, 18 bp, Homo sapiens
agataattaaatgaaata

SEQ ID NO: 1956771 - DNA, 20 bp, Homo sapiens
agataattaaatgaaatact

SEQ ID NO: 1956772 - DNA, 15 bp, Homo sapiens
agatatcaatcagta

SEQ ID NO: 1956773 - DNA, 15 bp, Homo sapiens
agatcacatgcccct

SEQ ID NO: 1956774 - DNA, 23 bp, Homo sapiens
agatccatcggtttatactattt

SEQ ID NO: 1956775 - DNA, 16 bp, Homo sapiens
agatgacctgaggaaa

SEQ ID NO: 1956776 - DNA, 22 bp, Homo sapiens
agatgaggctggataggagagg

SEQ ID NO: 1956777 - DNA, 15 bp, Homo sapiens
agatgcagtattgag

SEQ ID NO: 1956778 - DNA, 20 bp, Homo sapiens
agattcctacttaaacaaaa

SEQ ID NO: 1956779 - DNA, 13 bp, Homo sapiens
agatttttagatt

SEQ ID NO: 1956780 - DNA, 13 bp, Homo sapiens
agcaaaatatatg

SEQ ID NO: 1956781 - DNA, 13 bp, Homo sapiens
agcaatcttgctg

SEQ ID NO: 1956782 - DNA, 15 bp, Homo sapiens
agcaatcttgctgtg

SEQ ID NO: 1956783 - DNA, 19 bp, Homo sapiens
agcacaaccatgttcttga

SEQ ID NO: 1956784 - DNA, 21 bp, Homo sapiens
agcaccagcctgagccacagt

SEQ ID NO: 1956785 - DNA, 16 bp, Homo sapiens
agcaccagctgcctct

SEQ ID NO: 1956786 - DNA, 14 bp, Homo sapiens
agcacccccagcct

SEQ ID NO: 1956787 - DNA, 16 bp, Homo sapiens
agcacccccagcctcc

SEQ ID NO: 1956788 - DNA, 22 bp, Homo sapiens
agcaccgtggtgtgaggccccc

SEQ ID NO: 1956789 - DNA, 22 bp, Homo sapiens
agcacctcttgaagaactgact

SEQ ID NO: 1956790 - DNA, 20 bp, Homo sapiens
agcactatcgaggtatttgg

SEQ ID NO: 1956791 - DNA, 19 bp, Homo sapiens
agcactcccagggcccgag

SEQ ID NO: 1956792 - DNA, 16 bp, Homo sapiens
agcagagacggcagcc

SEQ ID NO: 1956793 - DNA, 15 bp, Homo sapiens
agcagctagaaagag

SEQ ID NO: 1956794 - DNA, 17 bp, Homo sapiens
agcagctagaaagagaa

SEQ ID NO: 1956795 - DNA, 21 bp, Homo sapiens
agcagctagaaagagaaaaag

SEQ ID NO: 1956796 - DNA, 16 bp, Homo sapiens
agcagctagctgcttt

SEQ ID NO: 1956797 - DNA, 17 bp, Homo sapiens
agcaggaaagatcccaa

SEQ ID NO: 1956798 - DNA, 21 bp, Homo sapiens
agcagtaaatgtatattgatg

SEQ ID NO: 1956799 - DNA, 16 bp, Homo sapiens
agcagtgtctgttctt

SEQ ID NO: 1956800 - DNA, 18 bp, Homo sapiens
agcagtgtctgttcttca

SEQ ID NO: 1956801 - DNA, 20 bp, Homo sapiens
agcatactgatgagacaaca

SEQ ID NO: 1956802 - DNA, 22 bp, Homo sapiens
agcatactgatgagacaacaca

SEQ ID NO: 1956803 - DNA, 16 bp, Homo sapiens
agcatgctcagtattg

SEQ ID NO: 1956804 - DNA, 17 bp, Homo sapiens
agcatgctcagtattga

SEQ ID NO: 1956805 - DNA, 21 bp, Homo sapiens
agcatgctccctcatgcagat

SEQ ID NO: 1956806 - DNA, 12 bp, Homo sapiens
agcatgtaatat

SEQ ID NO: 1956807 - DNA, 21 bp, Homo sapiens
agcatttgactttctgtctgt

SEQ ID NO: 1956808 - DNA, 13 bp, Homo sapiens
agccaaagctgtt

SEQ ID NO: 1956809 - DNA, 16 bp, Homo sapiens
agccacagtggggccc

SEQ ID NO: 1956810 - DNA, 20 bp, Homo sapiens
agccacagtggggcccatgg

SEQ ID NO: 1956811 - DNA, 21 bp, Homo sapiens
agcccagaacgggcctccccg

SEQ ID NO: 1956812 - DNA, 22 bp, Homo sapiens
agccccaggtaaacgtctaaac

SEQ ID NO: 1956813 - DNA, 13 bp, Homo sapiens
agcccctcctctc

SEQ ID NO: 1956814 - DNA, 10 bp, Homo sapiens
agcccggcca

SEQ ID NO: 1956815 - DNA, 20 bp, Homo sapiens
agcccggccaaggacactga

SEQ ID NO: 1956816 - DNA, 22 bp, Homo sapiens
agcccggccaaggacactgatg

SEQ ID NO: 1956817 - DNA, 16 bp, Homo sapiens
agccctctttctctct

SEQ ID NO: 1956818 - DNA, 17 bp, Homo sapiens
agccctctttctctctg

SEQ ID NO: 1956819 - DNA, 20 bp, Homo sapiens
agccctctttctctctgtgt

SEQ ID NO: 1956820 - DNA, 21 bp, Homo sapiens
agccctctttctctctgtgtg

SEQ ID NO: 1956821 - DNA, 15 bp, Homo sapiens
agccgcgctctgccc

SEQ ID NO: 1956822 - DNA, 15 bp, Homo sapiens
agcctatctctcttc

SEQ ID NO: 1956823 - DNA, 17 bp, Homo sapiens
agcctcccccaggctgc

SEQ ID NO: 1956824 - DNA, 16 bp, Homo sapiens
agcctgaaagtaattt

SEQ ID NO: 1956825 - DNA, 20 bp, Homo sapiens
agcctgaaagtaatttcaag

SEQ ID NO: 1956826 - DNA, 14 bp, Homo sapiens
agcctgagccacag

SEQ ID NO: 1956827 - DNA, 20 bp, Homo sapiens
agcctgagccacagtggggc

SEQ ID NO: 1956828 - DNA, 23 bp, Homo sapiens
agccttgtgatcactttctgaaa

SEQ ID NO: 1956829 - DNA, 14 bp, Homo sapiens
agcgatgtgttctt

SEQ ID NO: 1956830 - DNA, 14 bp, Homo sapiens
agcgccacccgccc

SEQ ID NO: 1956831 - DNA, 20 bp, Homo sapiens
agcgcctcccgccgcctcgg

SEQ ID NO: 1956832 - DNA, 16 bp, Homo sapiens
agcgcgtgccttcccc

SEQ ID NO: 1956833 - DNA, 22 bp, Homo sapiens
agcggcccggcccacgcagagc

SEQ ID NO: 1956834 - DNA, 23 bp, Homo sapiens
agcggcccggcccacgcagagcc

SEQ ID NO: 1956835 - DNA, 20 bp, Homo sapiens
agcgggggctaactggcccc

SEQ ID NO: 1956836 - DNA, 22 bp, Homo sapiens
agcgggggctaactggccccag

SEQ ID NO: 1956837 - DNA, 12 bp, Homo sapiens
agctaacaaaag

SEQ ID NO: 1956838 - DNA, 22 bp, Homo sapiens
agctaacaaaagatatgaagaa

SEQ ID NO: 1956839 - DNA, 15 bp, Homo sapiens
agctaagcctgatga

SEQ ID NO: 1956840 - DNA, 13 bp, Homo sapiens
agctagctgcttt

SEQ ID NO: 1956841 - DNA, 17 bp, Homo sapiens
agctagtttaaaattat

SEQ ID NO: 1956842 - DNA, 17 bp, Homo sapiens
agctatgcacaccaaat

SEQ ID NO: 1956843 - DNA, 14 bp, Homo sapiens
agctcaaggctgca

SEQ ID NO: 1956844 - DNA, 16 bp, Homo sapiens
agctccaccctcccct

SEQ ID NO: 1956845 - DNA, 13 bp, Homo sapiens
agctgagctggcc

SEQ ID NO: 1956846 - DNA, 14 bp, Homo sapiens
agctgagctggcct

SEQ ID NO: 1956847 - DNA, 19 bp, Homo sapiens
agctgagtcggctgggcag

SEQ ID NO: 1956848 - DNA, 22 bp, Homo sapiens
agctgagtcggctgggcagggc

SEQ ID NO: 1956849 - DNA, 12 bp, Homo sapiens
agctggcagcgc

SEQ ID NO: 1956850 - DNA, 22 bp, Homo sapiens
agctggctgggtcgcccctcct

SEQ ID NO: 1956851 - DNA, 18 bp, Homo sapiens
agcttcccaacaatactt

SEQ ID NO: 1956852 - DNA, 20 bp, Homo sapiens
aggaaagatcccaagtcaaa

SEQ ID NO: 1956853 - DNA, 16 bp, Homo sapiens
aggaaagcagtgcagt

SEQ ID NO: 1956854 - DNA, 17 bp, Homo sapiens
aggaatgctcaatgtgc

SEQ ID NO: 1956855 - DNA, 20 bp, Homo sapiens
aggacactgatgggtcctgc

SEQ ID NO: 1956856 - DNA, 21 bp, Homo sapiens
aggacactgatgggtcctgct

SEQ ID NO: 1956857 - DNA, 15 bp, Homo sapiens
aggacggggcagagc

SEQ ID NO: 1956858 - DNA, 19 bp, Homo sapiens
accctcttctcagctccac

SEQ ID NO: 1956859 - DNA, 23 bp, Homo sapiens
accctcttctcagctccactctg

SEQ ID NO: 1956860 - DNA, 14 bp, Homo sapiens
accctgaatcagag

SEQ ID NO: 1956861 - DNA, 20 bp, Homo sapiens
accctgaatcagaggcagag

SEQ ID NO: 1956862 - DNA, 14 bp, Homo sapiens
accctgccctgcac

SEQ ID NO: 1956863 - DNA, 15 bp, Homo sapiens
accggagcggctgag

SEQ ID NO: 1956864 - DNA, 16 bp, Homo sapiens
accggcccgccacctt

SEQ ID NO: 1956865 - DNA, 17 bp, Homo sapiens
acctcaaaagaaaatgt

SEQ ID NO: 1956866 - DNA, 18 bp, Homo sapiens
acctcggccgaggcctgc

SEQ ID NO: 1956867 - DNA, 20 bp, Homo sapiens
accttttaaaaaaataatat

SEQ ID NO: 1956868 - DNA, 12 bp, Homo sapiens
acctttttaaca

SEQ ID NO: 1956869 - DNA, 14 bp, Homo sapiens
acgatttaatttat

SEQ ID NO: 1956870 - DNA, 12 bp, Homo sapiens
acgcagagcccc

SEQ ID NO: 1956871 - DNA, 16 bp, Homo sapiens
acgcagagccccggag

SEQ ID NO: 1956872 - DNA, 21 bp, Homo sapiens
acgcagagccccggagcacca

SEQ ID NO: 1956873 - DNA, 18 bp, Homo sapiens
acgccggggctggccctg

SEQ ID NO: 1956874 - DNA, 19 bp, Homo sapiens
acgccggggctggccctgc

SEQ ID NO: 1956875 - DNA, 20 bp, Homo sapiens
acgccggggctggccctgcc

SEQ ID NO: 1956876 - DNA, 11 bp, Homo sapiens
acggcagcccc

SEQ ID NO: 1956877 - DNA, 17 bp, Homo sapiens
acgggacagcggcccgg

SEQ ID NO: 1956878 - DNA, 23 bp, Homo sapiens
acgggcccgctcaacctctcaga

SEQ ID NO: 1956879 - DNA, 21 bp, Homo sapiens
acgtgatgtgctcatcagaaa

SEQ ID NO: 1956880 - DNA, 21 bp, Homo sapiens
acgtgcttcctctcttgacat

SEQ ID NO: 1956881 - DNA, 12 bp, Homo sapiens
actaagatttcc

SEQ ID NO: 1956882 - DNA, 17 bp, Homo sapiens
actacaacattagaata

SEQ ID NO: 1956883 - DNA, 12 bp, Homo sapiens
actagccctctt

SEQ ID NO: 1956884 - DNA, 17 bp, Homo sapiens
actagccctctttctct

SEQ ID NO: 1956885 - DNA, 22 bp, Homo sapiens
actagccctctttctctctgtg

SEQ ID NO: 1956886 - DNA, 18 bp, Homo sapiens
actatggtatatattttg

SEQ ID NO: 1956887 - DNA, 20 bp, Homo sapiens
actcagtaacacagtgcagt

SEQ ID NO: 1956888 - DNA, 18 bp, Homo sapiens
actcagtaacagtgcagt

SEQ ID NO: 1956889 - DNA, 14 bp, Homo sapiens
actcatgttaattg

SEQ ID NO: 1956890 - DNA, 16 bp, Homo sapiens
actccagaagcagcag

SEQ ID NO: 1956891 - DNA, 23 bp, Homo sapiens
actccatggtgaactgaagcaga

SEQ ID NO: 1956892 - DNA, 13 bp, Homo sapiens
actcccagggccc

SEQ ID NO: 1956893 - DNA, 21 bp, Homo sapiens
actcgagagggctgagcccct

SEQ ID NO: 1956894 - DNA, 18 bp, Homo sapiens
actctgaagtcccttcct

SEQ ID NO: 1956895 - DNA, 13 bp, Homo sapiens
actctgagtcctc

SEQ ID NO: 1956896 - DNA, 14 bp, Homo sapiens
actgcaacactgga

SEQ ID NO: 1956897 - DNA, 23 bp, Homo sapiens
actgccatgtcaggggtttgctt

SEQ ID NO: 1956898 - DNA, 14 bp, Homo sapiens
actgcccaccctgg

SEQ ID NO: 1956899 - DNA, 16 bp, Homo sapiens
actgcccaccctgggc

SEQ ID NO: 1956900 - DNA, 10 bp, Homo sapiens
actggcccca

SEQ ID NO: 1956901 - DNA, 11 bp, Homo sapiens
actggccccag

SEQ ID NO: 1956902 - DNA, 12 bp, Homo sapiens
actggccccagg

SEQ ID NO: 1956903 - DNA, 18 bp, Homo sapiens
actgtcttcaaccctgcc

SEQ ID NO: 1956904 - DNA, 19 bp, Homo sapiens
actgtcttcaaccctgccc

SEQ ID NO: 1956905 - DNA, 18 bp, Homo sapiens
actgtgacattccacaga

SEQ ID NO: 1956906 - DNA, 21 bp, Homo sapiens
actgtgacattccacagagtt

SEQ ID NO: 1956907 - DNA, 21 bp, Homo sapiens
actgtggtcccagctacaggg

SEQ ID NO: 1956908 - DNA, 20 bp, Homo sapiens
actgtttactcacattgtcc

SEQ ID NO: 1956909 - DNA, 15 bp, Homo sapiens
acttaaacaaaaact

SEQ ID NO: 1956910 - DNA, 16 bp, Homo sapiens
acttaaacaaaaactt

SEQ ID NO: 1956911 - DNA, 13 bp, Homo sapiens
acttatttccatg

SEQ ID NO: 1956912 - DNA, 15 bp, Homo sapiens
acttcccagctggca

SEQ ID NO: 1956913 - DNA, 23 bp, Homo sapiens
acttcccagctggcagcgcctcc

SEQ ID NO: 1956914 - DNA, 16 bp, Homo sapiens
acttctaaatcataat

SEQ ID NO: 1956915 - DNA, 18 bp, Homo sapiens
acttgctgtgaaatgact

SEQ ID NO: 1956916 - DNA, 22 bp, Homo sapiens
actttccatgacagtagcatac

SEQ ID NO: 1956917 - DNA, 14 bp, Homo sapiens
actttcctctctct

SEQ ID NO: 1956918 - DNA, 15 bp, Homo sapiens
acttttattgtataa

SEQ ID NO: 1956919 - DNA, 15 bp, Homo sapiens
acttttgggatttgt

SEQ ID NO: 1956920 - DNA, 12 bp, Homo sapiens
agaaaaaagaag

SEQ ID NO: 1956921 - DNA, 15 bp, Homo sapiens
agaaaaagccctctt

SEQ ID NO: 1956922 - DNA, 19 bp, Homo sapiens
agaaaaggttctgaataat

SEQ ID NO: 1956923 - DNA, 14 bp, Homo sapiens
agaaaatacattat

SEQ ID NO: 1956924 - DNA, 14 bp, Homo sapiens
agaaacaatttctg

SEQ ID NO: 1956925 - DNA, 15 bp, Homo sapiens
agaaacaatttctgt

SEQ ID NO: 1956926 - DNA, 22 bp, Homo sapiens
agaaacccctgacaccttttca

SEQ ID NO: 1956927 - DNA, 16 bp, Homo sapiens
agaaatataaaaataa

SEQ ID NO: 1956928 - DNA, 13 bp, Homo sapiens
agaaatatttgct

SEQ ID NO: 1956929 - DNA, 21 bp, Homo sapiens
agaaatcctaacattatattc

SEQ ID NO: 1956930 - DNA, 15 bp, Homo sapiens
agaaatgattcaggg

SEQ ID NO: 1956931 - DNA, 16 bp, Homo sapiens
agaaatggctttccac

SEQ ID NO: 1956932 - DNA, 13 bp, Homo sapiens
agaaattagggct

SEQ ID NO: 1956933 - DNA, 20 bp, Homo sapiens
agaaattagggctctaattt

SEQ ID NO: 1956934 - DNA, 12 bp, Homo sapiens
agaacaaaagag

SEQ ID NO: 1956935 - DNA, 23 bp, Homo sapiens
agaacaacaacaaagcatgctca

SEQ ID NO: 1956936 - DNA, 14 bp, Homo sapiens
agaaccagcactcc

SEQ ID NO: 1956937 - DNA, 16 bp, Homo sapiens
agaaccagcactccca

SEQ ID NO: 1956938 - DNA, 19 bp, Homo sapiens
agaaccagcactcccaggg

SEQ ID NO: 1956939 - DNA, 20 bp, Homo sapiens
agaaccagcactcccagggc

SEQ ID NO: 1956940 - DNA, 22 bp, Homo sapiens
agaaccagcactcccagggccc

SEQ ID NO: 1956941 - DNA, 13 bp, Homo sapiens
agaacgggcctcc

SEQ ID NO: 1956942 - DNA, 15 bp, Homo sapiens
agaacgggcctcccc

SEQ ID NO: 1956943 - DNA, 14 bp, Homo sapiens
agaactaaatagat

SEQ ID NO: 1956944 - DNA, 15 bp, Homo sapiens
agaactcatgtgatt

SEQ ID NO: 1956945 - DNA, 13 bp, Homo sapiens
agaagctcagcta

SEQ ID NO: 1956946 - DNA, 14 bp, Homo sapiens
agaaggtaaataat

SEQ ID NO: 1956947 - DNA, 16 bp, Homo sapiens
agaagtgaaaaagact

SEQ ID NO: 1956948 - DNA, 23 bp, Homo sapiens
agaataaagccttgtgatcactt

SEQ ID NO: 1956949 - DNA, 13 bp, Homo sapiens
agaatagttgtca

SEQ ID NO: 1956950 - DNA, 19 bp, Homo sapiens
agaatataaaaaatgttat

SEQ ID NO: 1956951 - DNA, 19 bp, Homo sapiens
agaatattgtaactcacat

SEQ ID NO: 1956952 - DNA, 19 bp, Homo sapiens
agaatcacctaattaattt

SEQ ID NO: 1956953 - DNA, 17 bp, Homo sapiens
agaattttaaaaaagat

SEQ ID NO: 1956954 - DNA, 18 bp, Homo sapiens
agaattttaaaaaagatg

SEQ ID NO: 1956955 - DNA, 14 bp, Homo sapiens
agacaatgtggaat

SEQ ID NO: 1956956 - DNA, 20 bp, Homo sapiens
agacaatgtggaattacata

SEQ ID NO: 1956957 - DNA, 21 bp, Homo sapiens
agacaatgtggaattacataa

SEQ ID NO: 1956958 - DNA, 12 bp, Homo sapiens
agacactgtcaa

SEQ ID NO: 1956959 - DNA, 24 bp, Homo sapiens
agacagacggacgggacagcggcc

SEQ ID NO: 1956960 - DNA, 18 bp, Homo sapiens
agacctcctgatgtcttg

SEQ ID NO: 1956961 - DNA, 21 bp, Homo sapiens
agactcaaggcctccagccac

SEQ ID NO: 1956962 - DNA, 18 bp, Homo sapiens
agactcgagagggctgag

SEQ ID NO: 1956963 - DNA, 21 bp, Homo sapiens
agactcgagagggctgagccc

SEQ ID NO: 1956964 - DNA, 23 bp, Homo sapiens
agactcgagagggctgagcccct

SEQ ID NO: 1956965 - DNA, 23 bp, Homo sapiens
agactctaaaactatcagcagcg

SEQ ID NO: 1956966 - DNA, 11 bp, Homo sapiens
agactgcccac

SEQ ID NO: 1956967 - DNA, 15 bp, Homo sapiens
agactgcccaccctg

SEQ ID NO: 1956968 - DNA, 20 bp, Homo sapiens
agactgcccaccctgggcct

SEQ ID NO: 1956969 - DNA, 21 bp, Homo sapiens
agactgcccaccctgggcctc

SEQ ID NO: 1956970 - DNA, 23 bp, Homo sapiens
agactgcccaccctgggcctccc

SEQ ID NO: 1956971 - DNA, 17 bp, Homo sapiens
aggagcacccccagcct

SEQ ID NO: 1956972 - DNA, 18 bp, Homo sapiens
aggagcacccccagcctc

SEQ ID NO: 1956973 - DNA, 23 bp, Homo sapiens
aggagcacccccagcctccccca

SEQ ID NO: 1956974 - DNA, 21 bp, Homo sapiens
aggagcagctagctgcttttc

SEQ ID NO: 1956975 - DNA, 16 bp, Homo sapiens
aggatgtggatggagg

SEQ ID NO: 1956976 - DNA, 22 bp, Homo sapiens
aggatgtggatggaggtgatga

SEQ ID NO: 1956977 - DNA, 19 bp, Homo sapiens
aggattaggtttagaatca

SEQ ID NO: 1956978 - DNA, 13 bp, Homo sapiens
aggatttgcactg

SEQ ID NO: 1956979 - DNA, 22 bp, Homo sapiens
aggattttcaagttattcagaa

SEQ ID NO: 1956980 - DNA, 21 bp, Homo sapiens
aggcaaaccaatttgttctgt

SEQ ID NO: 1956981 - DNA, 19 bp, Homo sapiens
aggcacactgagcaagttt

SEQ ID NO: 1956982 - DNA, 12 bp, Homo sapiens
aggcagggccct

SEQ ID NO: 1956983 - DNA, 14 bp, Homo sapiens
aggcagggccctgg

SEQ ID NO: 1956984 - DNA, 19 bp, Homo sapiens
aggcccccggaggcgccca

SEQ ID NO: 1956985 - DNA, 21 bp, Homo sapiens
aggcccccggaggcgcccacc

SEQ ID NO: 1956986 - DNA, 15 bp, Homo sapiens
aggcctgagggaagc

SEQ ID NO: 1956987 - DNA, 17 bp, Homo sapiens
aggcctgagggaagccc

SEQ ID NO: 1956988 - DNA, 12 bp, Homo sapiens
aggcgcccacct

SEQ ID NO: 1956989 - DNA, 16 bp, Homo sapiens
aggcgcccacctgccc

SEQ ID NO: 1956990 - DNA, 18 bp, Homo sapiens
aggcgcccacctgcccag

SEQ ID NO: 1956991 - DNA, 12 bp, Homo sapiens
aggcgcgcaccg

SEQ ID NO: 1956992 - DNA, 15 bp, Homo sapiens
aggcgcgcaccgccc

SEQ ID NO: 1956993 - DNA, 15 bp, Homo sapiens
aggctctgaatctct

SEQ ID NO: 1956994 - DNA, 17 bp, Homo sapiens
aggctgcagtgagccaa

SEQ ID NO: 1956995 - DNA, 14 bp, Homo sapiens
aggctgcgcctgcc

SEQ ID NO: 1956996 - DNA, 12 bp, Homo sapiens
aggcttctccac

SEQ ID NO: 1956997 - DNA, 21 bp, Homo sapiens
aggcttgtgtaatttcctgct

SEQ ID NO: 1956998 - DNA, 19 bp, Homo sapiens
agggaaagttccagcagtt

SEQ ID NO: 1956999 - DNA, 13 bp, Homo sapiens
agggaaccagagc

SEQ ID NO: 1957000 - DNA, 14 bp, Homo sapiens
agggaagcccaccc

SEQ ID NO: 1957001 - DNA, 15 bp, Homo sapiens
agggaagcccacccg

SEQ ID NO: 1957002 - DNA, 20 bp, Homo sapiens
agggaagcccacccgcccca

SEQ ID NO: 1957003 - DNA, 21 bp, Homo sapiens
agggaagcccacccgccccag

SEQ ID NO: 1957004 - DNA, 15 bp, Homo sapiens
agggccctggggtct

SEQ ID NO: 1957005 - DNA, 20 bp, Homo sapiens
agggccctggggtctctgag

SEQ ID NO: 1957006 - DNA, 17 bp, Homo sapiens
agggcgctccggcagag

SEQ ID NO: 1957007 - DNA, 20 bp, Homo sapiens
agggcgctccggcagaggca

SEQ ID NO: 1957008 - DNA, 16 bp, Homo sapiens
agggctgagcccctcc

SEQ ID NO: 1957009 - DNA, 21 bp, Homo sapiens
agggtttgtttgctgcttttg

SEQ ID NO: 1957010 - DNA, 16 bp, Homo sapiens
aggtaaataatcatac

SEQ ID NO: 1957011 - DNA, 23 bp, Homo sapiens
aggtacaaataatttagaaataa

SEQ ID NO: 1957012 - DNA, 17 bp, Homo sapiens
aggtatctgatgatgtt

SEQ ID NO: 1957013 - DNA, 19 bp, Homo sapiens
aggtatgatgtgctgctgg

SEQ ID NO: 1957014 - DNA, 21 bp, Homo sapiens
aggtcagtgttataaaatctg

SEQ ID NO: 1957015 - DNA, 16 bp, Homo sapiens
aggtctgcacacataa

SEQ ID NO: 1957016 - DNA, 23 bp, Homo sapiens
aggtctgcacacataacacacat

SEQ ID NO: 1957017 - DNA, 20 bp, Homo sapiens
aggttgttaaaacagaaaag

SEQ ID NO: 1957018 - DNA, 22 bp, Homo sapiens
aggtttagaatcaagtctgtga

SEQ ID NO: 1957019 - DNA, 18 bp, Homo sapiens
agtaaatctaaattaact

SEQ ID NO: 1957020 - DNA, 18 bp, Homo sapiens
agtaacacagtgcagtgc

SEQ ID NO: 1957021 - DNA, 21 bp, Homo sapiens
agtaagcaccagctgcctctt

SEQ ID NO: 1957022 - DNA, 12 bp, Homo sapiens
agtaatttcaag

SEQ ID NO: 1957023 - DNA, 13 bp, Homo sapiens
agtaatttcaaga

SEQ ID NO: 1957024 - DNA, 17 bp, Homo sapiens
agtaatttcaagaatgt

SEQ ID NO: 1957025 - DNA, 18 bp, Homo sapiens
agtaatttcaagaatgtt

SEQ ID NO: 1957026 - DNA, 22 bp, Homo sapiens
agtaatttcaagaatgtttcag

SEQ ID NO: 1957027 - DNA, 15 bp, Homo sapiens
agtacaataaataaa

SEQ ID NO: 1957028 - DNA, 16 bp, Homo sapiens
agtaccatcccactga

SEQ ID NO: 1957029 - DNA, 17 bp, Homo sapiens
agtaccatcccactgat

SEQ ID NO: 1957030 - DNA, 19 bp, Homo sapiens
agtagaaaatacattatta

SEQ ID NO: 1957031 - DNA, 20 bp, Homo sapiens
agtagcatactgatgagaca

SEQ ID NO: 1957032 - DNA, 16 bp, Homo sapiens
agtagctgataaagaa

SEQ ID NO: 1957033 - DNA, 14 bp, Homo sapiens
agtaggtctgcaca

SEQ ID NO: 1957034 - DNA, 17 bp, Homo sapiens
agtaggtctgcacacat

SEQ ID NO: 1957035 - DNA, 14 bp, Homo sapiens
agtagtgttctgtt

SEQ ID NO: 1957036 - DNA, 18 bp, Homo sapiens
agtagtgttctgttcact

SEQ ID NO: 1957037 - DNA, 22 bp, Homo sapiens
agtagtgttctgttcacttttc

SEQ ID NO: 1957038 - DNA, 23 bp, Homo sapiens
agtagtgttctgttcacttttcc

SEQ ID NO: 1957039 - DNA, 20 bp, Homo sapiens
agtatacacatcataaacaa

SEQ ID NO: 1957040 - DNA, 22 bp, Homo sapiens
agtatacacatcataaacaaag

SEQ ID NO: 1957041 - DNA, 18 bp, Homo sapiens
agtattgagacactgtca

SEQ ID NO: 1957042 - DNA, 21 bp, Homo sapiens
agtattgagacactgtcaaga

SEQ ID NO: 1957043 - DNA, 15 bp, Homo sapiens
agtattgagtgttct

SEQ ID NO: 1957044 - DNA, 22 bp, Homo sapiens
agtattgttcttgtaaaactgt

SEQ ID NO: 1957045 - DNA, 17 bp, Homo sapiens
agtcaaacagtgtggct

SEQ ID NO: 1957046 - DNA, 16 bp, Homo sapiens
agtcaagctgatgaag

SEQ ID NO: 1957047 - DNA, 15 bp, Homo sapiens
agtcagtgtactctg

SEQ ID NO: 1957048 - DNA, 20 bp, Homo sapiens
agtccacccccattgtgaat

SEQ ID NO: 1957049 - DNA, 12 bp, Homo sapiens
agtccactttcc

SEQ ID NO: 1957050 - DNA, 17 bp, Homo sapiens
agtcccttcctgtcctg

SEQ ID NO: 1957051 - DNA, 17 bp, Homo sapiens
agtcctcattgttcaga

SEQ ID NO: 1957052 - DNA, 18 bp, Homo sapiens
agtcctcattgttcagaa

SEQ ID NO: 1957053 - DNA, 20 bp, Homo sapiens
agtctcctaataagttcctc

SEQ ID NO: 1957054 - DNA, 22 bp, Homo sapiens
agtctcctaataagttcctctg

SEQ ID NO: 1957055 - DNA, 11 bp, Homo sapiens
agtctggataa

SEQ ID NO: 1957056 - DNA, 20 bp, Homo sapiens
agtgaatgagtttccagcta

SEQ ID NO: 1957057 - DNA, 16 bp, Homo sapiens
agtgatagaacaaaag

SEQ ID NO: 1957058 - DNA, 17 bp, Homo sapiens
agtgatgccatgaagac

SEQ ID NO: 1957059 - DNA, 14 bp, Homo sapiens
agtgatgtgattta

SEQ ID NO: 1957060 - DNA, 19 bp, Homo sapiens
agtgatgtgatttatgcat

SEQ ID NO: 1957061 - DNA, 14 bp, Homo sapiens
agtgattgacattt

SEQ ID NO: 1957062 - DNA, 20 bp, Homo sapiens
agtgcattcattcatcctct

SEQ ID NO: 1957063 - DNA, 19 bp, Homo sapiens
agtgccttgattttaattc

SEQ ID NO: 1957064 - DNA, 18 bp, Homo sapiens
agtgctacagatgtacat

SEQ ID NO: 1957065 - DNA, 14 bp, Homo sapiens
agtgcttgaggcca

SEQ ID NO: 1957066 - DNA, 15 bp, Homo sapiens
agtgtaataaatcaa

SEQ ID NO: 1957067 - DNA, 17 bp, Homo sapiens
agtgtcaggctctgaat

SEQ ID NO: 1957068 - DNA, 16 bp, Homo sapiens
agtgtggatgtaaatt

SEQ ID NO: 1957069 - DNA, 15 bp, Homo sapiens
agtgttctgttcact

SEQ ID NO: 1957070 - DNA, 17 bp, Homo sapiens
agtgttctgttcacttt

SEQ ID NO: 1957071 - DNA, 24 bp, Homo sapiens
agttaagcacaaccatgttcttga

SEQ ID NO: 1957072 - DNA, 14 bp, Homo sapiens
agttacatacattt

SEQ ID NO: 1957073 - DNA, 15 bp, Homo sapiens
agttacatacattta

SEQ ID NO: 1957074 - DNA, 18 bp, Homo sapiens
agttacatacatttaaaa

SEQ ID NO: 1957075 - DNA, 13 bp, Homo sapiens
agttagcccggcc

SEQ ID NO: 1957076 - DNA, 19 bp, Homo sapiens
agttagcccggccaaggac

SEQ ID NO: 1957077 - DNA, 15 bp, Homo sapiens
agttataccagcaaa

SEQ ID NO: 1957078 - DNA, 16 bp, Homo sapiens
agttccagcagtttca

SEQ ID NO: 1957079 - DNA, 17 bp, Homo sapiens
agttccctcagccctca

SEQ ID NO: 1957080 - DNA, 15 bp, Homo sapiens
agttctgacagtgtt

SEQ ID NO: 1957081 - DNA, 13 bp, Homo sapiens
agttggaaatatt

SEQ ID NO: 1957082 - DNA, 16 bp, Homo sapiens
agttggcagagaaaat

SEQ ID NO: 1957083 - DNA, 23 bp, Homo sapiens
agttggcagagaaaatgctgcct

SEQ ID NO: 1957084 - DNA, 19 bp, Homo sapiens
attcctacttaaacaaaaa

SEQ ID NO: 1957085 - DNA, 12 bp, Homo sapiens
attcctcctgtc

SEQ ID NO: 1957086 - DNA, 22 bp, Homo sapiens
attcctcctgtctcctctgtca

SEQ ID NO: 1957087 - DNA, 23 bp, Homo sapiens
attcctcctgtctcctctgtcag

SEQ ID NO: 1957088 - DNA, 12 bp, Homo sapiens
attctatttcaa

SEQ ID NO: 1957089 - DNA, 19 bp, Homo sapiens
attctcagaagtgaaaaag

SEQ ID NO: 1957090 - DNA, 20 bp, Homo sapiens
attctctatgtacagatgat

SEQ ID NO: 1957091 - DNA, 15 bp, Homo sapiens
attctcttaaatttg

SEQ ID NO: 1957092 - DNA, 15 bp, Homo sapiens
attcttactgttctt

SEQ ID NO: 1957093 - DNA, 16 bp, Homo sapiens
attcttactgttcttc

SEQ ID NO: 1957094 - DNA, 12 bp, Homo sapiens
attcttgcactg

SEQ ID NO: 1957095 - DNA, 13 bp, Homo sapiens
attcttgcactgt

SEQ ID NO: 1957096 - DNA, 14 bp, Homo sapiens
attcttgcactgta

SEQ ID NO: 1957097 - DNA, 16 bp, Homo sapiens
attcttgcactgtatc

SEQ ID NO: 1957098 - DNA, 17 bp, Homo sapiens
attcttgcactgtatcc

SEQ ID NO: 1957099 - DNA, 20 bp, Homo sapiens
attcttgcactgtatccaag

SEQ ID NO: 1957100 - DNA, 22 bp, Homo sapiens
attctttcaatccacagtattg

SEQ ID NO: 1957101 - DNA, 12 bp, Homo sapiens
attgacaagttt

SEQ ID NO: 1957102 - DNA, 18 bp, Homo sapiens
attgacattttgtagcta

SEQ ID NO: 1957103 - DNA, 15 bp, Homo sapiens
attgagacactgtca

SEQ ID NO: 1957104 - DNA, 17 bp, Homo sapiens
attgagagcagcctctt

SEQ ID NO: 1957105 - DNA, 22 bp, Homo sapiens
attgagtcattttatatatgaa

SEQ ID NO: 1957106 - DNA, 13 bp, Homo sapiens
attgatagaataa

SEQ ID NO: 1957107 - DNA, 14 bp, Homo sapiens
attgcactaaaagt

SEQ ID NO: 1957108 - DNA, 15 bp, Homo sapiens
attgctaatttaaag

SEQ ID NO: 1957109 - DNA, 18 bp, Homo sapiens
attgctaatttaaaggag

SEQ ID NO: 1957110 - DNA, 17 bp, Homo sapiens
attgctgagatgtttag

SEQ ID NO: 1957111 - DNA, 23 bp, Homo sapiens
attgctgagatgtttagtagctg

SEQ ID NO: 1957112 - DNA, 21 bp, Homo sapiens
attgctgtaaataaaaatagc

SEQ ID NO: 1957113 - DNA, 22 bp, Homo sapiens
attggctgccaagagtccaagc

SEQ ID NO: 1957114 - DNA, 19 bp, Homo sapiens
atttaaaaaacattttaca

SEQ ID NO: 1957115 - DNA, 22 bp, Homo sapiens
atttaaagataccaaatagaaa

SEQ ID NO: 1957116 - DNA, 17 bp, Homo sapiens
atttaagaatttaccag

SEQ ID NO: 1957117 - DNA, 20 bp, Homo sapiens
atttaagaatttaccagaaa

SEQ ID NO: 1957118 - DNA, 14 bp, Homo sapiens
atttaatcatttcc

SEQ ID NO: 1957119 - DNA, 15 bp, Homo sapiens
atttaccagaaatat

SEQ ID NO: 1957120 - DNA, 17 bp, Homo sapiens
atttaccagaaatattt

SEQ ID NO: 1957121 - DNA, 15 bp, Homo sapiens
atttataacattgta

SEQ ID NO: 1957122 - DNA, 16 bp, Homo sapiens
atttataacattgtaa

SEQ ID NO: 1957123 - DNA, 14 bp, Homo sapiens
atttatgcatgaga

SEQ ID NO: 1957124 - DNA, 13 bp, Homo sapiens
atttatgcattta

SEQ ID NO: 1957125 - DNA, 18 bp, Homo sapiens
atttatgcatttatgcat

SEQ ID NO: 1957126 - DNA, 14 bp, Homo sapiens
atttattctaatta

SEQ ID NO: 1957127 - DNA, 13 bp, Homo sapiens
atttattggcaat

SEQ ID NO: 1957128 - DNA, 14 bp, Homo sapiens
atttcaagaatgtt

SEQ ID NO: 1957129 - DNA, 18 bp, Homo sapiens
atttcattatttttcaat

SEQ ID NO: 1957130 - DNA, 22 bp, Homo sapiens
atttccagcaaaatatatgttt

SEQ ID NO: 1957131 - DNA, 14 bp, Homo sapiens
atttctatagccaa

SEQ ID NO: 1957132 - DNA, 19 bp, Homo sapiens
atttctctggggtctgtga

SEQ ID NO: 1957133 - DNA, 13 bp, Homo sapiens
atttgcactgctt

SEQ ID NO: 1957134 - DNA, 14 bp, Homo sapiens
atttgcactgcttt

SEQ ID NO: 1957135 - DNA, 15 bp, Homo sapiens
atttgctgcatttca

SEQ ID NO: 1957136 - DNA, 15 bp, Homo sapiens
atttgttgaaatctt

SEQ ID NO: 1957137 - DNA, 14 bp, Homo sapiens
attttaacttttgg

SEQ ID NO: 1957138 - DNA, 18 bp, Homo sapiens
attttaattcaggtgata

SEQ ID NO: 1957139 - DNA, 17 bp, Homo sapiens
attttacagattttatg

SEQ ID NO: 1957140 - DNA, 13 bp, Homo sapiens
attttattgaata

SEQ ID NO: 1957141 - DNA, 23 bp, Homo sapiens
attttattgaatataatggcctc

SEQ ID NO: 1957142 - DNA, 16 bp, Homo sapiens
attttcaagtggaaac

SEQ ID NO: 1957143 - DNA, 20 bp, Homo sapiens
attttcaagtggaaaccttg

SEQ ID NO: 1957144 - DNA, 19 bp, Homo sapiens
attttcaagttattcagaa

SEQ ID NO: 1957145 - DNA, 22 bp, Homo sapiens
attttcaagttattcagaaata

SEQ ID NO: 1957146 - DNA, 12 bp, Homo sapiens
attttgaaatat

SEQ ID NO: 1957147 - DNA, 20 bp, Homo sapiens
attttgttatagttcatagt

SEQ ID NO: 1957148 - DNA, 15 bp, Homo sapiens
attttttgatggaaa

SEQ ID NO: 1957149 - DNA, 15 bp, Homo sapiens
attttttttttcagg

SEQ ID NO: 1957150 - DNA, 24 bp, Homo sapiens
caaaaactttccatgacagtagca

SEQ ID NO: 1957151 - DNA, 10 bp, Homo sapiens
caaaacaaca

SEQ ID NO: 1957152 - DNA, 13 bp, Homo sapiens
caaaacaacagca

SEQ ID NO: 1957153 - DNA, 15 bp, Homo sapiens
caaaacaacagcaac

SEQ ID NO: 1957154 - DNA, 21 bp, Homo sapiens
caaaacaacagcaacaacaac

SEQ ID NO: 1957155 - DNA, 16 bp, Homo sapiens
caaaagaaaatgtgta

SEQ ID NO: 1957156 - DNA, 19 bp, Homo sapiens
caaaagtgcagtagtgtca

SEQ ID NO: 1957157 - DNA, 22 bp, Homo sapiens
caaaagtgcagtagtgtcactt

SEQ ID NO: 1957158 - DNA, 22 bp, Homo sapiens
caaaatacatgatgatttcaga

SEQ ID NO: 1957159 - DNA, 21 bp, Homo sapiens
caaaatatatgtttggctgaa

SEQ ID NO: 1957160 - DNA, 11 bp, Homo sapiens
caaaatgtgcc

SEQ ID NO: 1957161 - DNA, 20 bp, Homo sapiens
caaaattgacctcaaaagaa

SEQ ID NO: 1957162 - DNA, 13 bp, Homo sapiens
caaacctaagttg

SEQ ID NO: 1957163 - DNA, 21 bp, Homo sapiens
caaactgatccatcctgtttt

SEQ ID NO: 1957164 - DNA, 14 bp, Homo sapiens
caaagcatgctcag

SEQ ID NO: 1957165 - DNA, 15 bp, Homo sapiens
caaaggttgtacata

SEQ ID NO: 1957166 - DNA, 21 bp, Homo sapiens
caaatgttattcaataactat

SEQ ID NO: 1957167 - DNA, 13 bp, Homo sapiens
caaattgctgaga

SEQ ID NO: 1957168 - DNA, 16 bp, Homo sapiens
caaattgctgagatgt

SEQ ID NO: 1957169 - DNA, 13 bp, Homo sapiens
caacaacaacaga

SEQ ID NO: 1957170 - DNA, 16 bp, Homo sapiens
caacaatactttgtgt

SEQ ID NO: 1957171 - DNA, 22 bp, Homo sapiens
caacaatttaggaatgctcaat

SEQ ID NO: 1957172 - DNA, 18 bp, Homo sapiens
caacacacacacacacaa

SEQ ID NO: 1957173 - DNA, 21 bp, Homo sapiens
caacacacacacacacaaaac

SEQ ID NO: 1957174 - DNA, 17 bp, Homo sapiens
caacacagtagtgttct

SEQ ID NO: 1957175 - DNA, 16 bp, Homo sapiens
caacagaacaacaaca

SEQ ID NO: 1957176 - DNA, 19 bp, Homo sapiens
caacagaacaacaacaaag

SEQ ID NO: 1957177 - DNA, 21 bp, Homo sapiens
caacagaacaacaacaaagca

SEQ ID NO: 1957178 - DNA, 15 bp, Homo sapiens
caacagcaacaacaa

SEQ ID NO: 1957179 - DNA, 13 bp, Homo sapiens
caaccaaagaaaa

SEQ ID NO: 1957180 - DNA, 14 bp, Homo sapiens
caacccccacctcc

SEQ ID NO: 1957181 - DNA, 15 bp, Homo sapiens
caacccccacctccc

SEQ ID NO: 1957182 - DNA, 19 bp, Homo sapiens
caacccccacctcccggtg

SEQ ID NO: 1957183 - DNA, 15 bp, Homo sapiens
caaccctgccctgca

SEQ ID NO: 1957184 - DNA, 23 bp, Homo sapiens
caactgtggtcccagctacaggg

SEQ ID NO: 1957185 - DNA, 17 bp, Homo sapiens
caacttacatatgtctt

SEQ ID NO: 1957186 - DNA, 22 bp, Homo sapiens
caagattaagttataccagcaa

SEQ ID NO: 1957187 - DNA, 21 bp, Homo sapiens
agttgtcagaatatgtatgta

SEQ ID NO: 1957188 - DNA, 19 bp, Homo sapiens
agttgtcctttctgatcct

SEQ ID NO: 1957189 - DNA, 17 bp, Homo sapiens
agtttaaaattattaaa

SEQ ID NO: 1957190 - DNA, 16 bp, Homo sapiens
agtttgtgaagtgatt

SEQ ID NO: 1957191 - DNA, 21 bp, Homo sapiens
agtttgtgaagtgattgacat

SEQ ID NO: 1957192 - DNA, 13 bp, Homo sapiens
agtttgttcagtg

SEQ ID NO: 1957193 - DNA, 16 bp, Homo sapiens
agttttcttttaattt

SEQ ID NO: 1957194 - DNA, 18 bp, Homo sapiens
agttttgattgcatattt

SEQ ID NO: 1957195 - DNA, 15 bp, Homo sapiens
agtttttttgttcat

SEQ ID NO: 1957196 - DNA, 13 bp, Homo sapiens
ataaaaataatta

SEQ ID NO: 1957197 - DNA, 15 bp, Homo sapiens
ataaaaccagaaaga

SEQ ID NO: 1957198 - DNA, 15 bp, Homo sapiens
ataaaatctgtattg

SEQ ID NO: 1957199 - DNA, 16 bp, Homo sapiens
ataaactgtgagataa

SEQ ID NO: 1957200 - DNA, 22 bp, Homo sapiens
ataaactgtgagataaatatca

SEQ ID NO: 1957201 - DNA, 13 bp, Homo sapiens
ataaatatcatta

SEQ ID NO: 1957202 - DNA, 18 bp, Homo sapiens
ataaatgaatgaaatata

SEQ ID NO: 1957203 - DNA, 11 bp, Homo sapiens
ataacaacaat

SEQ ID NO: 1957204 - DNA, 21 bp, Homo sapiens
ataacaggcattgcactaaaa

SEQ ID NO: 1957205 - DNA, 17 bp, Homo sapiens
ataacattgtaaatgat

SEQ ID NO: 1957206 - DNA, 14 bp, Homo sapiens
ataatgaagattaa

SEQ ID NO: 1957207 - DNA, 23 bp, Homo sapiens
ataatggcctcttaaaaattatc

SEQ ID NO: 1957208 - DNA, 14 bp, Homo sapiens
ataatttagaaata

SEQ ID NO: 1957209 - DNA, 15 bp, Homo sapiens
ataatttagaaataa

SEQ ID NO: 1957210 - DNA, 20 bp, Homo sapiens
atacaacaggattttcaagt

SEQ ID NO: 1957211 - DNA, 21 bp, Homo sapiens
atacaagttacatacatttaa

SEQ ID NO: 1957212 - DNA, 14 bp, Homo sapiens
atacattattagaa

SEQ ID NO: 1957213 - DNA, 17 bp, Homo sapiens
atacattattagaatat

SEQ ID NO: 1957214 - DNA, 13 bp, Homo sapiens
ataccagcaaaag

SEQ ID NO: 1957215 - DNA, 15 bp, Homo sapiens
ataccattttgaaat

SEQ ID NO: 1957216 - DNA, 14 bp, Homo sapiens
atactgatgagaca

SEQ ID NO: 1957217 - DNA, 20 bp, Homo sapiens
atacttatttataacattgt

SEQ ID NO: 1957218 - DNA, 16 bp, Homo sapiens
atactttgtctttctg

SEQ ID NO: 1957219 - DNA, 14 bp, Homo sapiens
atactttgtgtctt

SEQ ID NO: 1957220 - DNA, 16 bp, Homo sapiens
atactttgtgtctttt

SEQ ID NO: 1957221 - DNA, 17 bp, Homo sapiens
atagagacttctaaatc

SEQ ID NO: 1957222 - DNA, 22 bp, Homo sapiens
atagataccattttgaaatatt

SEQ ID NO: 1957223 - DNA, 14 bp, Homo sapiens
atagatttttagat

SEQ ID NO: 1957224 - DNA, 14 bp, Homo sapiens
atagcattgttctt

SEQ ID NO: 1957225 - DNA, 15 bp, Homo sapiens
atagcatttaaagat

SEQ ID NO: 1957226 - DNA, 15 bp, Homo sapiens
atagccaaagctgtt

SEQ ID NO: 1957227 - DNA, 23 bp, Homo sapiens
atagctccttcatgcttttctca

SEQ ID NO: 1957228 - DNA, 20 bp, Homo sapiens
ataggatttgcactgcttta

SEQ ID NO: 1957229 - DNA, 21 bp, Homo sapiens
ataggatttgcactgctttat

SEQ ID NO: 1957230 - DNA, 15 bp, Homo sapiens
atagtatacacatca

SEQ ID NO: 1957231 - DNA, 14 bp, Homo sapiens
atagttattaatgt

SEQ ID NO: 1957232 - DNA, 22 bp, Homo sapiens
atagttggaaatatttgcgtaa

SEQ ID NO: 1957233 - DNA, 18 bp, Homo sapiens
atagttgtcagaatatgt

SEQ ID NO: 1957234 - DNA, 14 bp, Homo sapiens
atataaactgtgag

SEQ ID NO: 1957235 - DNA, 17 bp, Homo sapiens
atatatctgagttgtgc

SEQ ID NO: 1957236 - DNA, 13 bp, Homo sapiens
atatattttgaaa

SEQ ID NO: 1957237 - DNA, 21 bp, Homo sapiens
atatcaagaatagttgtcaga

SEQ ID NO: 1957238 - DNA, 22 bp, Homo sapiens
atatcatattctaaaagtaata

SEQ ID NO: 1957239 - DNA, 17 bp, Homo sapiens
atatcattatagcatgt

SEQ ID NO: 1957240 - DNA, 20 bp, Homo sapiens
atatccctcatttcattatt

SEQ ID NO: 1957241 - DNA, 17 bp, Homo sapiens
atatctgtttgcttcta

SEQ ID NO: 1957242 - DNA, 19 bp, Homo sapiens
atatgagaaatataaaaat

SEQ ID NO: 1957243 - DNA, 22 bp, Homo sapiens
atatgagaaatataaaaataat

SEQ ID NO: 1957244 - DNA, 14 bp, Homo sapiens
atatgagattggaa

SEQ ID NO: 1957245 - DNA, 22 bp, Homo sapiens
atatgagattggaaaaaattag

SEQ ID NO: 1957246 - DNA, 17 bp, Homo sapiens
atatgagcatgctccct

SEQ ID NO: 1957247 - DNA, 17 bp, Homo sapiens
atatggcaatagcattg

SEQ ID NO: 1957248 - DNA, 19 bp, Homo sapiens
atatgtctagataaaagga

SEQ ID NO: 1957249 - DNA, 13 bp, Homo sapiens
atatgtctttaaa

SEQ ID NO: 1957250 - DNA, 15 bp, Homo sapiens
atatgtttggctgaa

SEQ ID NO: 1957251 - DNA, 16 bp, Homo sapiens
atattgccaaatatta

SEQ ID NO: 1957252 - DNA, 13 bp, Homo sapiens
atatttaaagtct

SEQ ID NO: 1957253 - DNA, 17 bp, Homo sapiens
atatttgcgtaaatggt

SEQ ID NO: 1957254 - DNA, 22 bp, Homo sapiens
atatttgcgtaaatggttttca

SEQ ID NO: 1957255 - DNA, 23 bp, Homo sapiens
atatttgcgtaaatggttttcaa

SEQ ID NO: 1957256 - DNA, 12 bp, Homo sapiens
atattttgaaag

SEQ ID NO: 1957257 - DNA, 22 bp, Homo sapiens
atattttttgatggaaaaagaa

SEQ ID NO: 1957258 - DNA, 12 bp, Homo sapiens
atcaaagccctc

SEQ ID NO: 1957259 - DNA, 16 bp, Homo sapiens
atcacatgcccctctt

SEQ ID NO: 1957260 - DNA, 19 bp, Homo sapiens
atcagcagcggcagcagca

SEQ ID NO: 1957261 - DNA, 17 bp, Homo sapiens
atcagtaattaacatat

SEQ ID NO: 1957262 - DNA, 18 bp, Homo sapiens
atcagtacaattctttgt

SEQ ID NO: 1957263 - DNA, 23 bp, Homo sapiens
atcagtacaattctttgttgctt

SEQ ID NO: 1957264 - DNA, 22 bp, Homo sapiens
atcagtccacccccattgtgaa

SEQ ID NO: 1957265 - DNA, 23 bp, Homo sapiens
atcagtccacccccattgtgaat

SEQ ID NO: 1957266 - DNA, 19 bp, Homo sapiens
atcataggggcatagccag

SEQ ID NO: 1957267 - DNA, 13 bp, Homo sapiens
atcatattctaaa

SEQ ID NO: 1957268 - DNA, 15 bp, Homo sapiens
atcatgggaatttta

SEQ ID NO: 1957269 - DNA, 16 bp, Homo sapiens
atcatttccagcaaaa

SEQ ID NO: 1957270 - DNA, 22 bp, Homo sapiens
atcattttgggaaattcttgca

SEQ ID NO: 1957271 - DNA, 14 bp, Homo sapiens
atccacagtattgt

SEQ ID NO: 1957272 - DNA, 13 bp, Homo sapiens
atcccaagtcaaa

SEQ ID NO: 1957273 - DNA, 18 bp, Homo sapiens
atccctcggtcagcaccg

SEQ ID NO: 1957274 - DNA, 15 bp, Homo sapiens
atcctgtttttcctt

SEQ ID NO: 1957275 - DNA, 23 bp, Homo sapiens
atccttcacaatttcaatgcttc

SEQ ID NO: 1957276 - DNA, 14 bp, Homo sapiens
atccttcccgcagc

SEQ ID NO: 1957277 - DNA, 21 bp, Homo sapiens
atccttcccgcagcaccagcc

SEQ ID NO: 1957278 - DNA, 22 bp, Homo sapiens
atccttcccgcagcaccagcct

SEQ ID NO: 1957279 - DNA, 22 bp, Homo sapiens
atctagtaggtctgcacacata

SEQ ID NO: 1957280 - DNA, 21 bp, Homo sapiens
atctcctgtgcacctgacttt

SEQ ID NO: 1957281 - DNA, 13 bp, Homo sapiens
atctcgctagcca

SEQ ID NO: 1957282 - DNA, 14 bp, Homo sapiens
atctctcaaaatgt

SEQ ID NO: 1957283 - DNA, 16 bp, Homo sapiens
atctctcaaaatgtgc

SEQ ID NO: 1957284 - DNA, 19 bp, Homo sapiens
atctctcaaaatgtgccgt

SEQ ID NO: 1957285 - DNA, 14 bp, Homo sapiens
atctgaggagtcca

SEQ ID NO: 1957286 - DNA, 15 bp, Homo sapiens
atctgagttgtgcct

SEQ ID NO: 1957287 - DNA, 16 bp, Homo sapiens
atctgagttgtgcctc

SEQ ID NO: 1957288 - DNA, 23 bp, Homo sapiens
atctgagttgtgcctcatttatt

SEQ ID NO: 1957289 - DNA, 16 bp, Homo sapiens
atctggcctgggggct

SEQ ID NO: 1957290 - DNA, 13 bp, Homo sapiens
atctggtgcgtgt

SEQ ID NO: 1957291 - DNA, 18 bp, Homo sapiens
atctggtgcgtgtggccc

SEQ ID NO: 1957292 - DNA, 22 bp, Homo sapiens
atctggtgcgtgtggccctgtg

SEQ ID NO: 1957293 - DNA, 18 bp, Homo sapiens
atctgtcagcttcccaac

SEQ ID NO: 1957294 - DNA, 14 bp, Homo sapiens
atctgtctttatga

SEQ ID NO: 1957295 - DNA, 17 bp, Homo sapiens
atcttaggcacttttta

SEQ ID NO: 1957296 - DNA, 14 bp, Homo sapiens
atcttgctgtgaaa

SEQ ID NO: 1957297 - DNA, 21 bp, Homo sapiens
atgaaaaatagtgtgtccatg

SEQ ID NO: 1957298 - DNA, 16 bp, Homo sapiens
atgaaagtcagtttaa

SEQ ID NO: 1957299 - DNA, 17 bp, Homo sapiens
atgaaatataaactgtg

SEQ ID NO: 1957300 - DNA, 20 bp, Homo sapiens
atgaaatataaactgtgaga

SEQ ID NO: 1957301 - DNA, 20 bp, Homo sapiens
atgaagccctaagtaaatct

SEQ ID NO: 1957302 - DNA, 20 bp, Homo sapiens
atgaatacgtaaactgcgta

SEQ ID NO: 1957303 - DNA, 15 bp, Homo sapiens
atgaatatcaagaat

SEQ ID NO: 1957304 - DNA, 21 bp, Homo sapiens
atgaatatcaagaatagttgt

SEQ ID NO: 1957305 - DNA, 14 bp, Homo sapiens
atgaatgaaatata

SEQ ID NO: 1957306 - DNA, 16 bp, Homo sapiens
atgaatgaaatataaa

SEQ ID NO: 1957307 - DNA, 21 bp, Homo sapiens
atgaatgaaatataaactgtg

SEQ ID NO: 1957308 - DNA, 23 bp, Homo sapiens
atgaatgaaatataaactgtgag

SEQ ID NO: 1957309 - DNA, 17 bp, Homo sapiens
atgacagtagcatactg

SEQ ID NO: 1957310 - DNA, 22 bp, Homo sapiens
atgaccatccagtagagatttc

SEQ ID NO: 1957311 - DNA, 16 bp, Homo sapiens
atgacctgaggaaagg

SEQ ID NO: 1957312 - DNA, 17 bp, Homo sapiens
atgagacaacacacaca

SEQ ID NO: 1957313 - DNA, 17 bp, Homo sapiens
atgagcatgctccctca

SEQ ID NO: 1957314 - DNA, 14 bp, Homo sapiens
atgaggctggatag

SEQ ID NO: 1957315 - DNA, 19 bp, Homo sapiens
atgaggctggataggagag

SEQ ID NO: 1957316 - DNA, 15 bp, Homo sapiens
atgatcaaggaggga

SEQ ID NO: 1957317 - DNA, 23 bp, Homo sapiens
atgatcaaggagggagaaaggca

SEQ ID NO: 1957318 - DNA, 13 bp, Homo sapiens
atgatcttgatat

SEQ ID NO: 1957319 - DNA, 21 bp, Homo sapiens
atgatgtaaaaatatgtatat

SEQ ID NO: 1957320 - DNA, 12 bp, Homo sapiens
atgatgttctga

SEQ ID NO: 1957321 - DNA, 13 bp, Homo sapiens
atgatgttctgaa

SEQ ID NO: 1957322 - DNA, 17 bp, Homo sapiens
atgattagacaatgtgg

SEQ ID NO: 1957323 - DNA, 21 bp, Homo sapiens
atgattagacaatgtggaatt

SEQ ID NO: 1957324 - DNA, 20 bp, Homo sapiens
atgattcagggttatttgag

SEQ ID NO: 1957325 - DNA, 20 bp, Homo sapiens
atgattcttactgttcttcg

SEQ ID NO: 1957326 - DNA, 21 bp, Homo sapiens
atgattgagagcagcctcttg

SEQ ID NO: 1957327 - DNA, 14 bp, Homo sapiens
atgatttcagaaac

SEQ ID NO: 1957328 - DNA, 16 bp, Homo sapiens
atgatttcagaaacaa

SEQ ID NO: 1957329 - DNA, 19 bp, Homo sapiens
atgatttcatgattagaca

SEQ ID NO: 1957330 - DNA, 17 bp, Homo sapiens
atgcaatttacttggaa

SEQ ID NO: 1957331 - DNA, 17 bp, Homo sapiens
atgcacaccaaattgct

SEQ ID NO: 1957332 - DNA, 22 bp, Homo sapiens
atgcacaccaaattgctgagat

SEQ ID NO: 1957333 - DNA, 15 bp, Homo sapiens
atgcatgagaactaa

SEQ ID NO: 1957334 - DNA, 18 bp, Homo sapiens
atgcatgcactcttttga

SEQ ID NO: 1957335 - DNA, 15 bp, Homo sapiens
atgcatttatgcatg

SEQ ID NO: 1957336 - DNA, 19 bp, Homo sapiens
atgcatttatgcatgagaa

SEQ ID NO: 1957337 - DNA, 16 bp, Homo sapiens
atgccaatgtccaggt

SEQ ID NO: 1957338 - DNA, 17 bp, Homo sapiens
atgccaatgtccaggtc

SEQ ID NO: 1957339 - DNA, 23 bp, Homo sapiens
atgccaatgtccaggtcacaggc

SEQ ID NO: 1957340 - DNA, 20 bp, Homo sapiens
atgccagtccagatgtgcct

SEQ ID NO: 1957341 - DNA, 22 bp, Homo sapiens
atgccattccatatatatctga

SEQ ID NO: 1957342 - DNA, 19 bp, Homo sapiens
atgcctttctagcaattgc

SEQ ID NO: 1957343 - DNA, 22 bp, Homo sapiens
atgcctttctagcaattgcttc

SEQ ID NO: 1957344 - DNA, 19 bp, Homo sapiens
atgctaacctctctgaact

SEQ ID NO: 1957345 - DNA, 18 bp, Homo sapiens
atgctacaaaatgtgtgc

SEQ ID NO: 1957346 - DNA, 21 bp, Homo sapiens
atgctatctcgctagccatat

SEQ ID NO: 1957347 - DNA, 20 bp, Homo sapiens
atgctcaatgtgctgttgat

SEQ ID NO: 1957348 - DNA, 16 bp, Homo sapiens
atgctcagctcagcat

SEQ ID NO: 1957349 - DNA, 18 bp, Homo sapiens
atgctcagtattgagaca

SEQ ID NO: 1957350 - DNA, 19 bp, Homo sapiens
atgctgcctagtgctacag

SEQ ID NO: 1957351 - DNA, 23 bp, Homo sapiens
atgctgcctagtgctacagatgt

SEQ ID NO: 1957352 - DNA, 14 bp, Homo sapiens
atgctgttcattga

SEQ ID NO: 1957353 - DNA, 13 bp, Homo sapiens
atggaaaaagaat

SEQ ID NO: 1957354 - DNA, 19 bp, Homo sapiens
atggaagggccttctccac

SEQ ID NO: 1957355 - DNA, 17 bp, Homo sapiens
atggaggagagtgttta

SEQ ID NO: 1957356 - DNA, 14 bp, Homo sapiens
atggatagattgtt

SEQ ID NO: 1957357 - DNA, 13 bp, Homo sapiens
atggatgtaatat

SEQ ID NO: 1957358 - DNA, 18 bp, Homo sapiens
atggatttgacacactca

SEQ ID NO: 1957359 - DNA, 19 bp, Homo sapiens
atggattttttttttcagg

SEQ ID NO: 1957360 - DNA, 17 bp, Homo sapiens
atggcaagtttttggta

SEQ ID NO: 1957361 - DNA, 19 bp, Homo sapiens
atggcctcttaaaaattat

SEQ ID NO: 1957362 - DNA, 19 bp, Homo sapiens
atggctgttatctgtcttt

SEQ ID NO: 1957363 - DNA, 17 bp, Homo sapiens
atgggaattttaacttt

SEQ ID NO: 1957364 - DNA, 18 bp, Homo sapiens
atgggtatcatgcttcta

SEQ ID NO: 1957365 - DNA, 21 bp, Homo sapiens
atggttacctctgcataaata

SEQ ID NO: 1957366 - DNA, 17 bp, Homo sapiens
atgtcacagtttgttca

SEQ ID NO: 1957367 - DNA, 19 bp, Homo sapiens
atgtccaaacttaacagat

SEQ ID NO: 1957368 - DNA, 16 bp, Homo sapiens
atgtcttggtttccat

SEQ ID NO: 1957369 - DNA, 16 bp, Homo sapiens
atgtgctcatcagaaa

SEQ ID NO: 1957370 - DNA, 20 bp, Homo sapiens
atgtggaattacataacagg

SEQ ID NO: 1957371 - DNA, 18 bp, Homo sapiens
atgtggatggaggtgatg

SEQ ID NO: 1957372 - DNA, 14 bp, Homo sapiens
atgtgtaacagagt

SEQ ID NO: 1957373 - DNA, 14 bp, Homo sapiens
atgtgttctttgta

SEQ ID NO: 1957374 - DNA, 16 bp, Homo sapiens
atgttattcaataact

SEQ ID NO: 1957375 - DNA, 17 bp, Homo sapiens
atgttccgttcatctga

SEQ ID NO: 1957376 - DNA, 16 bp, Homo sapiens
atgttgtcctgtgtca

SEQ ID NO: 1957377 - DNA, 17 bp, Homo sapiens
atgttgtcctgtgtcat

SEQ ID NO: 1957378 - DNA, 13 bp, Homo sapiens
atgttgtggaata

SEQ ID NO: 1957379 - DNA, 19 bp, Homo sapiens
atgtttgaaaataggattt

SEQ ID NO: 1957380 - DNA, 19 bp, Homo sapiens
atgtttggctgaaattatg

SEQ ID NO: 1957381 - DNA, 21 bp, Homo sapiens
attaaaattttcctttatgat

SEQ ID NO: 1957382 - DNA, 13 bp, Homo sapiens
attaaatgaaata

SEQ ID NO: 1957383 - DNA, 14 bp, Homo sapiens
attaaatgaaatac

SEQ ID NO: 1957384 - DNA, 18 bp, Homo sapiens
attaacttctattttcaa

SEQ ID NO: 1957385 - DNA, 17 bp, Homo sapiens
attaagttataccagca

SEQ ID NO: 1957386 - DNA, 17 bp, Homo sapiens
attactgaggaaaggga

SEQ ID NO: 1957387 - DNA, 18 bp, Homo sapiens
attactgaggaaagggag

SEQ ID NO: 1957388 - DNA, 13 bp, Homo sapiens
attactttcagaa

SEQ ID NO: 1957389 - DNA, 15 bp, Homo sapiens
attactttcagaatg

SEQ ID NO: 1957390 - DNA, 22 bp, Homo sapiens
attagacaatgtggaattacat

SEQ ID NO: 1957391 - DNA, 21 bp, Homo sapiens
attagtagaaaatacattatt

SEQ ID NO: 1957392 - DNA, 18 bp, Homo sapiens
attagttggcagagaaaa

SEQ ID NO: 1957393 - DNA, 12 bp, Homo sapiens
attatagcatgt

SEQ ID NO: 1957394 - DNA, 21 bp, Homo sapiens
attatccttcacaatttcaat

SEQ ID NO: 1957395 - DNA, 23 bp, Homo sapiens
attatccttcacaatttcaatgc

SEQ ID NO: 1957396 - DNA, 23 bp, Homo sapiens
attatctagtaggtctgcacaca

SEQ ID NO: 1957397 - DNA, 15 bp, Homo sapiens
attatctttaaaact

SEQ ID NO: 1957398 - DNA, 21 bp, Homo sapiens
attatgtcaaatggatgtaat

SEQ ID NO: 1957399 - DNA, 23 bp, Homo sapiens
attatgtcaaatggatgtaatat

SEQ ID NO: 1957400 - DNA, 22 bp, Homo sapiens
attcaaataaccctgaatcaga

SEQ ID NO: 1957401 - DNA, 20 bp, Homo sapiens
attcaaatgaagattcagca

SEQ ID NO: 1957402 - DNA, 18 bp, Homo sapiens
attcaataactattgctg

SEQ ID NO: 1957403 - DNA, 14 bp, Homo sapiens
attcacttttattg

SEQ ID NO: 1957404 - DNA, 18 bp, Homo sapiens
attcacttttattgtata

SEQ ID NO: 1957405 - DNA, 17 bp, Homo sapiens
attcagcagtgtctgtt

SEQ ID NO: 1957406 - DNA, 21 bp, Homo sapiens
attcagcagtgtctgttcttc

SEQ ID NO: 1957407 - DNA, 19 bp, Homo sapiens
attcagggttatttgaggg

SEQ ID NO: 1957408 - DNA, 17 bp, Homo sapiens
attcattcatcctctta

SEQ ID NO: 1957409 - DNA, 21 bp, Homo sapiens
attcccatgaatatcaagaat

SEQ ID NO: 1957410 - DNA, 22 bp, Homo sapiens
attcccatggtagactgtgaca

SEQ ID NO: 1957411 - DNA, 17 bp, Homo sapiens
attcctacttaaacaaa

SEQ ID NO: 1957412 - DNA, 20 bp, Homo sapiens
ccatggattcccctggacat

SEQ ID NO: 1957413 - DNA, 18 bp, Homo sapiens
ccatggccccagctggct

SEQ ID NO: 1957414 - DNA, 16 bp, Homo sapiens
ccatggtagactgtga

SEQ ID NO: 1957415 - DNA, 14 bp, Homo sapiens
ccatggtgaactga

SEQ ID NO: 1957416 - DNA, 21 bp, Homo sapiens
ccatggtgaactgaagcagag

SEQ ID NO: 1957417 - DNA, 12 bp, Homo sapiens
ccatgtgctgct

SEQ ID NO: 1957418 - DNA, 21 bp, Homo sapiens
ccatttaatcatttccagcaa

SEQ ID NO: 1957419 - DNA, 22 bp, Homo sapiens
ccatttaatcatttccagcaaa

SEQ ID NO: 1957420 - DNA, 14 bp, Homo sapiens
ccatttcccctgtg

SEQ ID NO: 1957421 - DNA, 15 bp, Homo sapiens
ccatttcctcctggg

SEQ ID NO: 1957422 - DNA, 14 bp, Homo sapiens
cccaaatctatagc

SEQ ID NO: 1957423 - DNA, 20 bp, Homo sapiens
cccaacaatactttgtgtct

SEQ ID NO: 1957424 - DNA, 12 bp, Homo sapiens
cccaacccccac

SEQ ID NO: 1957425 - DNA, 18 bp, Homo sapiens
cccaacccccacctcccg

SEQ ID NO: 1957426 - DNA, 15 bp, Homo sapiens
cccacaccccgtctg

SEQ ID NO: 1957427 - DNA, 18 bp, Homo sapiens
cccacaccccgtctgccc

SEQ ID NO: 1957428 - DNA, 16 bp, Homo sapiens
cccacacgccggggct

SEQ ID NO: 1957429 - DNA, 20 bp, Homo sapiens
cccacacgccggggctggcc

SEQ ID NO: 1957430 - DNA, 21 bp, Homo sapiens
cccacccacaccccgtctgcc

SEQ ID NO: 1957431 - DNA, 17 bp, Homo sapiens
cccacccgccccagaga

SEQ ID NO: 1957432 - DNA, 23 bp, Homo sapiens
cccacccgccccagagactgccc

SEQ ID NO: 1957433 - DNA, 19 bp, Homo sapiens
cccaccctgggcctcccgt

SEQ ID NO: 1957434 - DNA, 14 bp, Homo sapiens
cccacctgcccagt

SEQ ID NO: 1957435 - DNA, 13 bp, Homo sapiens
cccacgcagagcc

SEQ ID NO: 1957436 - DNA, 15 bp, Homo sapiens
cccacgcagagcccc

SEQ ID NO: 1957437 - DNA, 20 bp, Homo sapiens
cccacgcagagccccggagc

SEQ ID NO: 1957438 - DNA, 21 bp, Homo sapiens
cccacgcagagccccggagca

SEQ ID NO: 1957439 - DNA, 23 bp, Homo sapiens
cccacgcagagccccggagcacc

SEQ ID NO: 1957440 - DNA, 19 bp, Homo sapiens
cccacggccgtccctgact

SEQ ID NO: 1957441 - DNA, 23 bp, Homo sapiens
cccacggccgtccctgacttccc

SEQ ID NO: 1957442 - DNA, 14 bp, Homo sapiens
cccactagccctct

SEQ ID NO: 1957443 - DNA, 15 bp, Homo sapiens
cccactagccctctt

SEQ ID NO: 1957444 - DNA, 23 bp, Homo sapiens
cccactagccctctttctctctg

SEQ ID NO: 1957445 - DNA, 13 bp, Homo sapiens
cccagaacgggcc

SEQ ID NO: 1957446 - DNA, 14 bp, Homo sapiens
cccagaacgggcct

SEQ ID NO: 1957447 - DNA, 15 bp, Homo sapiens
cccagaacgggcctc

SEQ ID NO: 1957448 - DNA, 17 bp, Homo sapiens
cccagaacgggcctccc

SEQ ID NO: 1957449 - DNA, 13 bp, Homo sapiens
cccagagactgcc

SEQ ID NO: 1957450 - DNA, 14 bp, Homo sapiens
cccagagactgccc

SEQ ID NO: 1957451 - DNA, 18 bp, Homo sapiens
cccagagactgcccaccc

SEQ ID NO: 1957452 - DNA, 20 bp, Homo sapiens
cccagagactgcccaccctg

SEQ ID NO: 1957453 - DNA, 17 bp, Homo sapiens
cccagcctatctctctt

SEQ ID NO: 1957454 - DNA, 12 bp, Homo sapiens
cccagcctcccc

SEQ ID NO: 1957455 - DNA, 16 bp, Homo sapiens
cccagcctcccccagg

SEQ ID NO: 1957456 - DNA, 23 bp, Homo sapiens
cccagcctcccccaggctgcgcc

SEQ ID NO: 1957457 - DNA, 17 bp, Homo sapiens
cccagctggcagcgcct

SEQ ID NO: 1957458 - DNA, 18 bp, Homo sapiens
cccagctggcagcgcctc

SEQ ID NO: 1957459 - DNA, 15 bp, Homo sapiens
cccaggcactctctt

SEQ ID NO: 1957460 - DNA, 23 bp, Homo sapiens
cccaggcggaggggcttggagca

SEQ ID NO: 1957461 - DNA, 13 bp, Homo sapiens
cccaggctgcgcc

SEQ ID NO: 1957462 - DNA, 18 bp, Homo sapiens
cccaggctgcgcctgccc

SEQ ID NO: 1957463 - DNA, 13 bp, Homo sapiens
cccagggcccgag

SEQ ID NO: 1957464 - DNA, 14 bp, Homo sapiens
cccagggcccgagc

SEQ ID NO: 1957465 - DNA, 14 bp, Homo sapiens
cccagggtgcaggc

SEQ ID NO: 1957466 - DNA, 16 bp, Homo sapiens
cccagggtgcaggcgc

SEQ ID NO: 1957467 - DNA, 14 bp, Homo sapiens
cccagttagcccgg

SEQ ID NO: 1957468 - DNA, 21 bp, Homo sapiens
cccataatgcttctttcctct

SEQ ID NO: 1957469 - DNA, 14 bp, Homo sapiens
cccatgccaatgtc

SEQ ID NO: 1957470 - DNA, 15 bp, Homo sapiens
cccatgccaatgtcc

SEQ ID NO: 1957471 - DNA, 13 bp, Homo sapiens
cccatggccccag

SEQ ID NO: 1957472 - DNA, 14 bp, Homo sapiens
cccatggccccagc

SEQ ID NO: 1957473 - DNA, 16 bp, Homo sapiens
cccatggccccagctg

SEQ ID NO: 1957474 - DNA, 14 bp, Homo sapiens
ccccacacgccggg

SEQ ID NO: 1957475 - DNA, 20 bp, Homo sapiens
ccccacacgccggggctggc

SEQ ID NO: 1957476 - DNA, 22 bp, Homo sapiens
ccccacacgccggggctggccc

SEQ ID NO: 1957477 - DNA, 15 bp, Homo sapiens
ccccacggccgtccc

SEQ ID NO: 1957478 - DNA, 18 bp, Homo sapiens
ccccacggccgtccctga

SEQ ID NO: 1957479 - DNA, 21 bp, Homo sapiens
ccccagagactgcccaccctg

SEQ ID NO: 1957480 - DNA, 22 bp, Homo sapiens
ccccagagactgcccaccctgg

SEQ ID NO: 1957481 - DNA, 10 bp, Homo sapiens
ccccagcctc

SEQ ID NO: 1957482 - DNA, 20 bp, Homo sapiens
ccccagcctcccccaggctg

SEQ ID NO: 1957483 - DNA, 22 bp, Homo sapiens
ccccagcgtggggctaacgggc

SEQ ID NO: 1957484 - DNA, 16 bp, Homo sapiens
ccccagctggctgggt

SEQ ID NO: 1957485 - DNA, 19 bp, Homo sapiens
ccccaggcggaggggcttg

SEQ ID NO: 1957486 - DNA, 18 bp, Homo sapiens
ccccaggctgcgcctgcc

SEQ ID NO: 1957487 - DNA, 12 bp, Homo sapiens
cccccagcctcc

SEQ ID NO: 1957488 - DNA, 14 bp, Homo sapiens
cccccaggctgcgc

SEQ ID NO: 1957489 - DNA, 16 bp, Homo sapiens
cccccaggctgcgcct

SEQ ID NO: 1957490 - DNA, 14 bp, Homo sapiens
cccccggaggcgcc

SEQ ID NO: 1957491 - DNA, 20 bp, Homo sapiens
cccccggaggcgcccacctg

SEQ ID NO: 1957492 - DNA, 21 bp, Homo sapiens
cccccggaggcgcccacctgc

SEQ ID NO: 1957493 - DNA, 23 bp, Homo sapiens
cccccggaggcgcccacctgccc

SEQ ID NO: 1957494 - DNA, 22 bp, Homo sapiens
ccccgcgcgtgcccccagcgtg

SEQ ID NO: 1957495 - DNA, 20 bp, Homo sapiens
ccccgctgcctggcgggcag

SEQ ID NO: 1957496 - DNA, 20 bp, Homo sapiens
ccccggaggcgcccacctgc

SEQ ID NO: 1957497 - DNA, 15 bp, Homo sapiens
ccccggcccccctct

SEQ ID NO: 1957498 - DNA, 12 bp, Homo sapiens
ccccgtctgccc

SEQ ID NO: 1957499 - DNA, 13 bp, Homo sapiens
ccccgtctgcccc

SEQ ID NO: 1957500 - DNA, 23 bp, Homo sapiens
ccccgtctgccccttgaccccac

SEQ ID NO: 1957501 - DNA, 13 bp, Homo sapiens
ccccgtgcggccc

SEQ ID NO: 1957502 - DNA, 22 bp, Homo sapiens
ccccgtgcggcccgtgcgcagc

SEQ ID NO: 1957503 - DNA, 11 bp, Homo sapiens
cccctcccccg

SEQ ID NO: 1957504 - DNA, 10 bp, Homo sapiens
cccctcctcg

SEQ ID NO: 1957505 - DNA, 22 bp, Homo sapiens
cccctctcctgagcctgtctct

SEQ ID NO: 1957506 - DNA, 23 bp, Homo sapiens
cccctcttcttgcggcaccgccc

SEQ ID NO: 1957507 - DNA, 18 bp, Homo sapiens
cccgagcgcgtgccttcc

SEQ ID NO: 1957508 - DNA, 15 bp, Homo sapiens
cccgcagacagacag

SEQ ID NO: 1957509 - DNA, 16 bp, Homo sapiens
cccgcagcaccagcct

SEQ ID NO: 1957510 - DNA, 21 bp, Homo sapiens
cccgcagcaccagcctgagcc

SEQ ID NO: 1957511 - DNA, 19 bp, Homo sapiens
cccgcccaccccgctgcct

SEQ ID NO: 1957512 - DNA, 15 bp, Homo sapiens
cccgccccagagact

SEQ ID NO: 1957513 - DNA, 18 bp, Homo sapiens
cccgccccagagactgcc

SEQ ID NO: 1957514 - DNA, 15 bp, Homo sapiens
cccgccctcctctgc

SEQ ID NO: 1957515 - DNA, 16 bp, Homo sapiens
cccgccctcctctgcc

SEQ ID NO: 1957516 - DNA, 23 bp, Homo sapiens
cccgccggttggccggctggccg

SEQ ID NO: 1957517 - DNA, 17 bp, Homo sapiens
cccgcgcgtgcccccag

SEQ ID NO: 1957518 - DNA, 23 bp, Homo sapiens
cccgctcaacctctcagatccct

SEQ ID NO: 1957519 - DNA, 18 bp, Homo sapiens
cccggaggcgcccacctg

SEQ ID NO: 1957520 - DNA, 14 bp, Homo sapiens
cccggcccacgcag

SEQ ID NO: 1957521 - DNA, 17 bp, Homo sapiens
cccggcccacgcagagc

SEQ ID NO: 1957522 - DNA, 20 bp, Homo sapiens
cccggccccgcgcgtgcccc

SEQ ID NO: 1957523 - DNA, 17 bp, Homo sapiens
cccgggggtccccggac

SEQ ID NO: 1957524 - DNA, 13 bp, Homo sapiens
cccgtctgcccct

SEQ ID NO: 1957525 - DNA, 22 bp, Homo sapiens
caatcattttgggaaattcttg

SEQ ID NO: 1957526 - DNA, 16 bp, Homo sapiens
caatccacagtattgt

SEQ ID NO: 1957527 - DNA, 11 bp, Homo sapiens
caatcttgctg

SEQ ID NO: 1957528 - DNA, 21 bp, Homo sapiens
caatgcttcttttagtcagaa

SEQ ID NO: 1957529 - DNA, 23 bp, Homo sapiens
caatggtgaactgtcattacaga

SEQ ID NO: 1957530 - DNA, 14 bp, Homo sapiens
caatgtccaggtca

SEQ ID NO: 1957531 - DNA, 20 bp, Homo sapiens
caatgtccaggtcacaggca

SEQ ID NO: 1957532 - DNA, 12 bp, Homo sapiens
caatgtgctgtt

SEQ ID NO: 1957533 - DNA, 23 bp, Homo sapiens
caatgtgctgttgattctttcaa

SEQ ID NO: 1957534 - DNA, 20 bp, Homo sapiens
caatgtggaattacataaca

SEQ ID NO: 1957535 - DNA, 18 bp, Homo sapiens
caatttaggaatgctcaa

SEQ ID NO: 1957536 - DNA, 12 bp, Homo sapiens
caatttgttctg

SEQ ID NO: 1957537 - DNA, 16 bp, Homo sapiens
cacaaaacaacagcaa

SEQ ID NO: 1957538 - DNA, 19 bp, Homo sapiens
cacaagtttttttgttcat

SEQ ID NO: 1957539 - DNA, 14 bp, Homo sapiens
cacacaaaacaaca

SEQ ID NO: 1957540 - DNA, 19 bp, Homo sapiens
cacacacaaaacaacagca

SEQ ID NO: 1957541 - DNA, 15 bp, Homo sapiens
cacacataacacaca

SEQ ID NO: 1957542 - DNA, 19 bp, Homo sapiens
cacaccccgtctgcccctt

SEQ ID NO: 1957543 - DNA, 20 bp, Homo sapiens
cacaccccgtctgccccttg

SEQ ID NO: 1957544 - DNA, 18 bp, Homo sapiens
cacagctgagctggccta

SEQ ID NO: 1957545 - DNA, 21 bp, Homo sapiens
cacagtagtgttctgttcact

SEQ ID NO: 1957546 - DNA, 22 bp, Homo sapiens
cacagtagtgttctgttcactt

SEQ ID NO: 1957547 - DNA, 19 bp, Homo sapiens
cacagtattgttcttgtaa

SEQ ID NO: 1957548 - DNA, 17 bp, Homo sapiens
cacagtggggcccatgg

SEQ ID NO: 1957549 - DNA, 22 bp, Homo sapiens
cacagtggggcccatggcccca

SEQ ID NO: 1957550 - DNA, 12 bp, Homo sapiens
cacagtttgttc

SEQ ID NO: 1957551 - DNA, 22 bp, Homo sapiens
cacatgcccctcttagaagaaa

SEQ ID NO: 1957552 - DNA, 20 bp, Homo sapiens
caccaaattgctgagatgtt

SEQ ID NO: 1957553 - DNA, 15 bp, Homo sapiens
caccagcctgagcca

SEQ ID NO: 1957554 - DNA, 19 bp, Homo sapiens
caccatttcccctgtggtt

SEQ ID NO: 1957555 - DNA, 11 bp, Homo sapiens
cacccccagcc

SEQ ID NO: 1957556 - DNA, 13 bp, Homo sapiens
caccccgctgcct

SEQ ID NO: 1957557 - DNA, 12 bp, Homo sapiens
cacccgccccag

SEQ ID NO: 1957558 - DNA, 18 bp, Homo sapiens
cacccgccccagagactg

SEQ ID NO: 1957559 - DNA, 18 bp, Homo sapiens
cacccgcccgcccccgcc

SEQ ID NO: 1957560 - DNA, 17 bp, Homo sapiens
caccctcccctctcctg

SEQ ID NO: 1957561 - DNA, 18 bp, Homo sapiens
caccctcccctctcctga

SEQ ID NO: 1957562 - DNA, 13 bp, Homo sapiens
caccctgggcctc

SEQ ID NO: 1957563 - DNA, 15 bp, Homo sapiens
caccgcccaaccccc

SEQ ID NO: 1957564 - DNA, 20 bp, Homo sapiens
caccgcccaacccccacctc

SEQ ID NO: 1957565 - DNA, 23 bp, Homo sapiens
cacctcccggtgtatgcagtggt

SEQ ID NO: 1957566 - DNA, 19 bp, Homo sapiens
caccttctgtgcatctggc

SEQ ID NO: 1957567 - DNA, 22 bp, Homo sapiens
caccttctgtgcatctggcctg

SEQ ID NO: 1957568 - DNA, 23 bp, Homo sapiens
caccttctgtgcatctggcctgg

SEQ ID NO: 1957569 - DNA, 23 bp, Homo sapiens
caccttgggcacgggagagcgcc

SEQ ID NO: 1957570 - DNA, 12 bp, Homo sapiens
cacgcagagccc

SEQ ID NO: 1957571 - DNA, 18 bp, Homo sapiens
cacgcagagccccggagc

SEQ ID NO: 1957572 - DNA, 20 bp, Homo sapiens
cacgcagagccccggagcac

SEQ ID NO: 1957573 - DNA, 21 bp, Homo sapiens
cacgccggggctggccctgcc

SEQ ID NO: 1957574 - DNA, 23 bp, Homo sapiens
cacggccgtccctgacttcccag

SEQ ID NO: 1957575 - DNA, 13 bp, Homo sapiens
cacgggagagcgc

SEQ ID NO: 1957576 - DNA, 21 bp, Homo sapiens
cacgggagagcgccacccgcc

SEQ ID NO: 1957577 - DNA, 18 bp, Homo sapiens
cacgggcccgctcaacct

SEQ ID NO: 1957578 - DNA, 20 bp, Homo sapiens
cacgggcccgctcaacctct

SEQ ID NO: 1957579 - DNA, 17 bp, Homo sapiens
cacggggtcgggggagg

SEQ ID NO: 1957580 - DNA, 14 bp, Homo sapiens
cactaaaagtgatg

SEQ ID NO: 1957581 - DNA, 19 bp, Homo sapiens
cactaaaagtgatgtgatt

SEQ ID NO: 1957582 - DNA, 17 bp, Homo sapiens
cactacaacattagaat

SEQ ID NO: 1957583 - DNA, 18 bp, Homo sapiens
cactacaacattagaata

SEQ ID NO: 1957584 - DNA, 21 bp, Homo sapiens
cactagccctctttctctctg

SEQ ID NO: 1957585 - DNA, 23 bp, Homo sapiens
cactagccctctttctctctgtg

SEQ ID NO: 1957586 - DNA, 13 bp, Homo sapiens
cactatcatagtt

SEQ ID NO: 1957587 - DNA, 14 bp, Homo sapiens
cactcccagggccc

SEQ ID NO: 1957588 - DNA, 18 bp, Homo sapiens
cactcccagggcccgagc

SEQ ID NO: 1957589 - DNA, 11 bp, Homo sapiens
cactctgaagt

SEQ ID NO: 1957590 - DNA, 18 bp, Homo sapiens
cactctgaagtcccttcc

SEQ ID NO: 1957591 - DNA, 16 bp, Homo sapiens
cactgatgggtcctgc

SEQ ID NO: 1957592 - DNA, 17 bp, Homo sapiens
cactgatgggtcctgct

SEQ ID NO: 1957593 - DNA, 19 bp, Homo sapiens
cactgatgggtcctgctgc

SEQ ID NO: 1957594 - DNA, 15 bp, Homo sapiens
cactgccatgtcagg

SEQ ID NO: 1957595 - DNA, 17 bp, Homo sapiens
cactgctttattttagg

SEQ ID NO: 1957596 - DNA, 15 bp, Homo sapiens
cactttcctctctct

SEQ ID NO: 1957597 - DNA, 16 bp, Homo sapiens
cactttgggaggctga

SEQ ID NO: 1957598 - DNA, 18 bp, Homo sapiens
cactttttaacattctca

SEQ ID NO: 1957599 - DNA, 16 bp, Homo sapiens
cacttttttcctgtca

SEQ ID NO: 1957600 - DNA, 20 bp, Homo sapiens
cagaaaggcactaatgatgt

SEQ ID NO: 1957601 - DNA, 14 bp, Homo sapiens
cagaaccagcactc

SEQ ID NO: 1957602 - DNA, 21 bp, Homo sapiens
cagaaccagcactcccagggc

SEQ ID NO: 1957603 - DNA, 15 bp, Homo sapiens
cagaacgggcctccc

SEQ ID NO: 1957604 - DNA, 18 bp, Homo sapiens
cagaagctcaaggctgca

SEQ ID NO: 1957605 - DNA, 14 bp, Homo sapiens
cagaagtgaaaaag

SEQ ID NO: 1957606 - DNA, 15 bp, Homo sapiens
cagacagacagacag

SEQ ID NO: 1957607 - DNA, 12 bp, Homo sapiens
cagacggacggg

SEQ ID NO: 1957608 - DNA, 17 bp, Homo sapiens
cagacggacgggacagc

SEQ ID NO: 1957609 - DNA, 20 bp, Homo sapiens
cagacggacgggacagcggc

SEQ ID NO: 1957610 - DNA, 17 bp, Homo sapiens
cagactcgagagggctg

SEQ ID NO: 1957611 - DNA, 15 bp, Homo sapiens
cagagaaaatgctgc

SEQ ID NO: 1957612 - DNA, 16 bp, Homo sapiens
cagagacctcctgatg

SEQ ID NO: 1957613 - DNA, 14 bp, Homo sapiens
cagagacggcagcc

SEQ ID NO: 1957614 - DNA, 15 bp, Homo sapiens
cagagacggcagccc

SEQ ID NO: 1957615 - DNA, 17 bp, Homo sapiens
cagagacggcagcccca

SEQ ID NO: 1957616 - DNA, 13 bp, Homo sapiens
cagagactgccca

SEQ ID NO: 1957617 - DNA, 14 bp, Homo sapiens
cagagactgcccac

SEQ ID NO: 1957618 - DNA, 14 bp, Homo sapiens
cagagccccggagc

SEQ ID NO: 1957619 - DNA, 15 bp, Homo sapiens
cagagccccggagca

SEQ ID NO: 1957620 - DNA, 16 bp, Homo sapiens
cagagccccggagcac

SEQ ID NO: 1957621 - DNA, 16 bp, Homo sapiens
cagagcgatgtgttct

SEQ ID NO: 1957622 - DNA, 20 bp, Homo sapiens
cagagctgagtcggctgggc

SEQ ID NO: 1957623 - DNA, 15 bp, Homo sapiens
catgaatatcaagaa

SEQ ID NO: 1957624 - DNA, 16 bp, Homo sapiens
catgattagacaatgt

SEQ ID NO: 1957625 - DNA, 21 bp, Homo sapiens
catgattagacaatgtggaat

SEQ ID NO: 1957626 - DNA, 18 bp, Homo sapiens
catgccaatgtccaggtc

SEQ ID NO: 1957627 - DNA, 17 bp, Homo sapiens
catgcttttctcatggt

SEQ ID NO: 1957628 - DNA, 20 bp, Homo sapiens
catggagtagagtcaggaga

SEQ ID NO: 1957629 - DNA, 14 bp, Homo sapiens
catggccccagctg

SEQ ID NO: 1957630 - DNA, 17 bp, Homo sapiens
catggccccagctggct

SEQ ID NO: 1957631 - DNA, 18 bp, Homo sapiens
catggctgttatctgtct

SEQ ID NO: 1957632 - DNA, 17 bp, Homo sapiens
catggtagactgtgaca

SEQ ID NO: 1957633 - DNA, 15 bp, Homo sapiens
catggtgaactgaag

SEQ ID NO: 1957634 - DNA, 17 bp, Homo sapiens
catggtgaactgaagca

SEQ ID NO: 1957635 - DNA, 21 bp, Homo sapiens
catgtgggtgtcagtgtcatt

SEQ ID NO: 1957636 - DNA, 13 bp, Homo sapiens
cattatagcatgt

SEQ ID NO: 1957637 - DNA, 17 bp, Homo sapiens
cattatagcatgtaata

SEQ ID NO: 1957638 - DNA, 13 bp, Homo sapiens
cattatttttcaa

SEQ ID NO: 1957639 - DNA, 15 bp, Homo sapiens
cattatttttcaatt

SEQ ID NO: 1957640 - DNA, 15 bp, Homo sapiens
cattcaaatgaagat

SEQ ID NO: 1957641 - DNA, 16 bp, Homo sapiens
cattcaaatgaagatt

SEQ ID NO: 1957642 - DNA, 15 bp, Homo sapiens
cattcatcctcttat

SEQ ID NO: 1957643 - DNA, 17 bp, Homo sapiens
cattcattcatcctctt

SEQ ID NO: 1957644 - DNA, 13 bp, Homo sapiens
cattccacagagt

SEQ ID NO: 1957645 - DNA, 20 bp, Homo sapiens
cattccatatatatctgagt

SEQ ID NO: 1957646 - DNA, 13 bp, Homo sapiens
cattgcactaaaa

SEQ ID NO: 1957647 - DNA, 15 bp, Homo sapiens
cattgtgaatgttgt

SEQ ID NO: 1957648 - DNA, 21 bp, Homo sapiens
cattgtgaatgttgtcctgtg

SEQ ID NO: 1957649 - DNA, 22 bp, Homo sapiens
cattgtgaatgttgtcctgtgt

SEQ ID NO: 1957650 - DNA, 15 bp, Homo sapiens
cattgttcagaaaag

SEQ ID NO: 1957651 - DNA, 18 bp, Homo sapiens
catttaaaaaacatttta

SEQ ID NO: 1957652 - DNA, 17 bp, Homo sapiens
catttaagaatttacca

SEQ ID NO: 1957653 - DNA, 22 bp, Homo sapiens
catttaagaatttaccagaaat

SEQ ID NO: 1957654 - DNA, 13 bp, Homo sapiens
catttaatcattt

SEQ ID NO: 1957655 - DNA, 13 bp, Homo sapiens
catttatgcatga

SEQ ID NO: 1957656 - DNA, 14 bp, Homo sapiens
catttatgcatgag

SEQ ID NO: 1957657 - DNA, 13 bp, Homo sapiens
catttatgtgtga

SEQ ID NO: 1957658 - DNA, 15 bp, Homo sapiens
catttccagcaaaat

SEQ ID NO: 1957659 - DNA, 20 bp, Homo sapiens
catttctatagccaaagctg

SEQ ID NO: 1957660 - DNA, 17 bp, Homo sapiens
catttcttggtatgatc

SEQ ID NO: 1957661 - DNA, 12 bp, Homo sapiens
cattttctctcc

SEQ ID NO: 1957662 - DNA, 16 bp, Homo sapiens
cattttgggaaattct

SEQ ID NO: 1957663 - DNA, 17 bp, Homo sapiens
cattttgtatgctgcat

SEQ ID NO: 1957664 - DNA, 21 bp, Homo sapiens
cattttgtatgctgcatgaaa

SEQ ID NO: 1957665 - DNA, 24 bp, Homo sapiens
catttttctttagtcatttaagaa

SEQ ID NO: 1957666 - DNA, 17 bp, Homo sapiens
ccaaaggttgtacatag

SEQ ID NO: 1957667 - DNA, 20 bp, Homo sapiens
ccaacaatactttgtgtctt

SEQ ID NO: 1957668 - DNA, 16 bp, Homo sapiens
ccaagagtccaagcca

SEQ ID NO: 1957669 - DNA, 15 bp, Homo sapiens
ccaaggacactgatg

SEQ ID NO: 1957670 - DNA, 21 bp, Homo sapiens
ccaaggacactgatgggtcct

SEQ ID NO: 1957671 - DNA, 18 bp, Homo sapiens
ccaatttgttctgtgcaa

SEQ ID NO: 1957672 - DNA, 17 bp, Homo sapiens
ccacaccccgtctgccc

SEQ ID NO: 1957673 - DNA, 18 bp, Homo sapiens
ccacaccccgtctgcccc

SEQ ID NO: 1957674 - DNA, 19 bp, Homo sapiens
ccacaccccgtctgcccct

SEQ ID NO: 1957675 - DNA, 14 bp, Homo sapiens
ccacacgccggggc

SEQ ID NO: 1957676 - DNA, 22 bp, Homo sapiens
ccacacgccggggctggccctg

SEQ ID NO: 1957677 - DNA, 23 bp, Homo sapiens
ccacacgccggggctggccctgc

SEQ ID NO: 1957678 - DNA, 18 bp, Homo sapiens
ccacagagttactgccac

SEQ ID NO: 1957679 - DNA, 11 bp, Homo sapiens
ccacagtattg

SEQ ID NO: 1957680 - DNA, 20 bp, Homo sapiens
ccacagtggggcccatggcc

SEQ ID NO: 1957681 - DNA, 23 bp, Homo sapiens
ccacagtggggcccatggcccca

SEQ ID NO: 1957682 - DNA, 24 bp, Homo sapiens
ccacagtggggcccatggccccag

SEQ ID NO: 1957683 - DNA, 13 bp, Homo sapiens
ccacccgccccag

SEQ ID NO: 1957684 - DNA, 14 bp, Homo sapiens
ccacccgccccaga

SEQ ID NO: 1957685 - DNA, 18 bp, Homo sapiens
ccacccgccccagagact

SEQ ID NO: 1957686 - DNA, 22 bp, Homo sapiens
ccacccgccccagagactgccc

SEQ ID NO: 1957687 - DNA, 14 bp, Homo sapiens
ccacctcggacacc

SEQ ID NO: 1957688 - DNA, 15 bp, Homo sapiens
ccacctgcccagtta

SEQ ID NO: 1957689 - DNA, 16 bp, Homo sapiens
ccacggccgtccctga

SEQ ID NO: 1957690 - DNA, 18 bp, Homo sapiens
ccacggggtcgggggagg

SEQ ID NO: 1957691 - DNA, 23 bp, Homo sapiens
ccacggggtcgggggaggagcac

SEQ ID NO: 1957692 - DNA, 19 bp, Homo sapiens
ccactagccctctttctct

SEQ ID NO: 1957693 - DNA, 21 bp, Homo sapiens
ccactagccctctttctctct

SEQ ID NO: 1957694 - DNA, 22 bp, Homo sapiens
ccactctgaagtcccttcctgt

SEQ ID NO: 1957695 - DNA, 23 bp, Homo sapiens
ccactctgaagtcccttcctgtc

SEQ ID NO: 1957696 - DNA, 22 bp, Homo sapiens
ccactgatatcacgggcccgct

SEQ ID NO: 1957697 - DNA, 12 bp, Homo sapiens
ccactgccatgt

SEQ ID NO: 1957698 - DNA, 17 bp, Homo sapiens
ccactttcctctctctc

SEQ ID NO: 1957699 - DNA, 21 bp, Homo sapiens
ccagaaagaggaataaaatga

SEQ ID NO: 1957700 - DNA, 15 bp, Homo sapiens
ccagaacgggcctcc

SEQ ID NO: 1957701 - DNA, 17 bp, Homo sapiens
ccagaacgggcctcccc

SEQ ID NO: 1957702 - DNA, 18 bp, Homo sapiens
ccagaacgggcctccccg

SEQ ID NO: 1957703 - DNA, 14 bp, Homo sapiens
ccagaagcagcagc

SEQ ID NO: 1957704 - DNA, 15 bp, Homo sapiens
ccagaagcagcagct

SEQ ID NO: 1957705 - DNA, 13 bp, Homo sapiens
ccagagactgccc

SEQ ID NO: 1957706 - DNA, 14 bp, Homo sapiens
ccagagactgccca

SEQ ID NO: 1957707 - DNA, 15 bp, Homo sapiens
ccagagactgcccac

SEQ ID NO: 1957708 - DNA, 16 bp, Homo sapiens
ccagagactgcccacc

SEQ ID NO: 1957709 - DNA, 17 bp, Homo sapiens
ccagagactgcccaccc

SEQ ID NO: 1957710 - DNA, 10 bp, Homo sapiens
ccagcaaaat

SEQ ID NO: 1957711 - DNA, 13 bp, Homo sapiens
ccagcactcccag

SEQ ID NO: 1957712 - DNA, 15 bp, Homo sapiens
ccagcactcccaggg

SEQ ID NO: 1957713 - DNA, 22 bp, Homo sapiens
cctcatttcattatttttcaat

SEQ ID NO: 1957714 - DNA, 23 bp, Homo sapiens
cctcatttcattatttttcaatt

SEQ ID NO: 1957715 - DNA, 15 bp, Homo sapiens
cctccaaatgctgtc

SEQ ID NO: 1957716 - DNA, 22 bp, Homo sapiens
cctccagactcgagagggctga

SEQ ID NO: 1957717 - DNA, 19 bp, Homo sapiens
cctccagttctgatgaggc

SEQ ID NO: 1957718 - DNA, 14 bp, Homo sapiens
cctcccccaggctg

SEQ ID NO: 1957719 - DNA, 18 bp, Homo sapiens
cctcccccaggctgcgcc

SEQ ID NO: 1957720 - DNA, 16 bp, Homo sapiens
cctcccccgcagacag

SEQ ID NO: 1957721 - DNA, 21 bp, Homo sapiens
cctcctccagttctgatgagg

SEQ ID NO: 1957722 - DNA, 22 bp, Homo sapiens
cctcctcgggcgcctgcgctcc

SEQ ID NO: 1957723 - DNA, 23 bp, Homo sapiens
cctcctcgggcgcctgcgctcct

SEQ ID NO: 1957724 - DNA, 15 bp, Homo sapiens
cctcctctcctcgtc

SEQ ID NO: 1957725 - DNA, 13 bp, Homo sapiens
cctcctctgcccc

SEQ ID NO: 1957726 - DNA, 14 bp, Homo sapiens
cctcctctgccccc

SEQ ID NO: 1957727 - DNA, 15 bp, Homo sapiens
cctcctgtctcctct

SEQ ID NO: 1957728 - DNA, 20 bp, Homo sapiens
cctcggacaccatcttggga

SEQ ID NO: 1957729 - DNA, 15 bp, Homo sapiens
cctcgggccgcctcc

SEQ ID NO: 1957730 - DNA, 20 bp, Homo sapiens
cctcgggccgcctcctccag

SEQ ID NO: 1957731 - DNA, 18 bp, Homo sapiens
cctcgggcgcctgcgctc

SEQ ID NO: 1957732 - DNA, 14 bp, Homo sapiens
cctcggtcagcacc

SEQ ID NO: 1957733 - DNA, 17 bp, Homo sapiens
cctcgtccggcctgcag

SEQ ID NO: 1957734 - DNA, 18 bp, Homo sapiens
cctcgtccggcctgcagc

SEQ ID NO: 1957735 - DNA, 22 bp, Homo sapiens
cctcgtccggcctgcagcccag

SEQ ID NO: 1957736 - DNA, 23 bp, Homo sapiens
cctctaggtaaactagcaaaagg

SEQ ID NO: 1957737 - DNA, 14 bp, Homo sapiens
cctctcagatccct

SEQ ID NO: 1957738 - DNA, 18 bp, Homo sapiens
cctctcagatccctcggt

SEQ ID NO: 1957739 - DNA, 20 bp, Homo sapiens
cctctcctcgtccggcctgc

SEQ ID NO: 1957740 - DNA, 22 bp, Homo sapiens
cctctcctcgtccggcctgcag

SEQ ID NO: 1957741 - DNA, 15 bp, Homo sapiens
cctctgcagcctgag

SEQ ID NO: 1957742 - DNA, 13 bp, Homo sapiens
cctctgccccctc

SEQ ID NO: 1957743 - DNA, 15 bp, Homo sapiens
cctcttcaatcccca

SEQ ID NO: 1957744 - DNA, 15 bp, Homo sapiens
cctcttctcagctcc

SEQ ID NO: 1957745 - DNA, 16 bp, Homo sapiens
cctcttctcagctcca

SEQ ID NO: 1957746 - DNA, 17 bp, Homo sapiens
cctctttcggaaatgat

SEQ ID NO: 1957747 - DNA, 13 bp, Homo sapiens
cctctttctctct

SEQ ID NO: 1957748 - DNA, 15 bp, Homo sapiens
cctctttctctctgt

SEQ ID NO: 1957749 - DNA, 16 bp, Homo sapiens
cctctttctctctgtg

SEQ ID NO: 1957750 - DNA, 18 bp, Homo sapiens
cctctttctctctgtgtg

SEQ ID NO: 1957751 - DNA, 17 bp, Homo sapiens
cctgaaagtaatttcaa

SEQ ID NO: 1957752 - DNA, 16 bp, Homo sapiens
ctgcagcctgagctcc

SEQ ID NO: 1957753 - DNA, 17 bp, Homo sapiens
ctgcagcctgagctcca

SEQ ID NO: 1957754 - DNA, 23 bp, Homo sapiens
ctgcagcctgagctccaccctcc

SEQ ID NO: 1957755 - DNA, 13 bp, Homo sapiens
ctgccaagagtcc

SEQ ID NO: 1957756 - DNA, 13 bp, Homo sapiens
ctgcccaccctgg

SEQ ID NO: 1957757 - DNA, 14 bp, Homo sapiens
ctgcccaccctggg

SEQ ID NO: 1957758 - DNA, 17 bp, Homo sapiens
ctgcccaccctgggcct

SEQ ID NO: 1957759 - DNA, 20 bp, Homo sapiens
ctgcccaccctgggcctccc

SEQ ID NO: 1957760 - DNA, 21 bp, Homo sapiens
ctgcccagttagcccggccaa

SEQ ID NO: 1957761 - DNA, 14 bp, Homo sapiens
ctgccccctccccc

SEQ ID NO: 1957762 - DNA, 18 bp, Homo sapiens
ctgccccctcccccgcag

SEQ ID NO: 1957763 - DNA, 22 bp, Homo sapiens
ctgccccctcccccgcagacag

SEQ ID NO: 1957764 - DNA, 19 bp, Homo sapiens
ctgcccctccgtccccagg

SEQ ID NO: 1957765 - DNA, 13 bp, Homo sapiens
ctgcccgcccgcc

SEQ ID NO: 1957766 - DNA, 17 bp, Homo sapiens
ctgccctcccccacggc

SEQ ID NO: 1957767 - DNA, 21 bp, Homo sapiens
ctgccctcccccacggccgtc

SEQ ID NO: 1957768 - DNA, 19 bp, Homo sapiens
ctgccctgcaccttgggca

SEQ ID NO: 1957769 - DNA, 22 bp, Homo sapiens
ctgcctggaggagaaggaggaa

SEQ ID NO: 1957770 - DNA, 20 bp, Homo sapiens
ctgcctggcgggcagcccct

SEQ ID NO: 1957771 - DNA, 21 bp, Homo sapiens
ctgcctggcgggcagcccctg

SEQ ID NO: 1957772 - DNA, 19 bp, Homo sapiens
ctgccttctcccctccaag

SEQ ID NO: 1957773 - DNA, 14 bp, Homo sapiens
ctgcgctcctctgc

SEQ ID NO: 1957774 - DNA, 16 bp, Homo sapiens
ctgcgctcctctgcag

SEQ ID NO: 1957775 - DNA, 18 bp, Homo sapiens
ctgcgctcctctgcagcc

SEQ ID NO: 1957776 - DNA, 19 bp, Homo sapiens
ctgcgctcctctgcagcct

SEQ ID NO: 1957777 - DNA, 21 bp, Homo sapiens
ctgcgctcctctgcagcctga

SEQ ID NO: 1957778 - DNA, 22 bp, Homo sapiens
ctgcgctcctctgcagcctgag

SEQ ID NO: 1957779 - DNA, 17 bp, Homo sapiens
ctgctcacgtctgtgag

SEQ ID NO: 1957780 - DNA, 21 bp, Homo sapiens
ctgctcgggaaggcctgaggg

SEQ ID NO: 1957781 - DNA, 22 bp, Homo sapiens
ctgctgctcgggaaggcctgag

SEQ ID NO: 1957782 - DNA, 14 bp, Homo sapiens
ctgctgtggcatca

SEQ ID NO: 1957783 - DNA, 20 bp, Homo sapiens
ctggaccaaggtgcggaccg

SEQ ID NO: 1957784 - DNA, 22 bp, Homo sapiens
ctggaccaaggtgcggaccgga

SEQ ID NO: 1957785 - DNA, 15 bp, Homo sapiens
ctggaggagaaggag

SEQ ID NO: 1957786 - DNA, 15 bp, Homo sapiens
ctggataatttgtat

SEQ ID NO: 1957787 - DNA, 16 bp, Homo sapiens
ctggcagcgcctcccg

SEQ ID NO: 1957788 - DNA, 21 bp, Homo sapiens
ctggcagcgcctcccgccgcc

SEQ ID NO: 1957789 - DNA, 11 bp, Homo sapiens
ctggccccagg

SEQ ID NO: 1957790 - DNA, 15 bp, Homo sapiens
ctggccccaggcgga

SEQ ID NO: 1957791 - DNA, 16 bp, Homo sapiens
ctggccctgccctccc

SEQ ID NO: 1957792 - DNA, 18 bp, Homo sapiens
ctggccggtccaccccgt

SEQ ID NO: 1957793 - DNA, 14 bp, Homo sapiens
ctggcgggcagccc

SEQ ID NO: 1957794 - DNA, 20 bp, Homo sapiens
ctggcgggcagcccctgctg

SEQ ID NO: 1957795 - DNA, 21 bp, Homo sapiens
ctggcgggcagcccctgctgg

SEQ ID NO: 1957796 - DNA, 20 bp, Homo sapiens
ctggctgggtcgcccctcct

SEQ ID NO: 1957797 - DNA, 18 bp, Homo sapiens
ctgggagttttgattgca

SEQ ID NO: 1957798 - DNA, 12 bp, Homo sapiens
ctgggcagggcc

SEQ ID NO: 1957799 - DNA, 13 bp, Homo sapiens
ctgggcagggccg

SEQ ID NO: 1957800 - DNA, 17 bp, Homo sapiens
ctgggcagggccgcagg

SEQ ID NO: 1957801 - DNA, 22 bp, Homo sapiens
ctgggcctcccgtccgtccgcc

SEQ ID NO: 1957802 - DNA, 16 bp, Homo sapiens
ctgggtcgcccctcct

SEQ ID NO: 1957803 - DNA, 18 bp, Homo sapiens
ctgggtcgcccctcctcg

SEQ ID NO: 1957804 - DNA, 15 bp, Homo sapiens
ctggtgcgtgtggcc

SEQ ID NO: 1957805 - DNA, 19 bp, Homo sapiens
ctgtcaagattaagttata

SEQ ID NO: 1957806 - DNA, 15 bp, Homo sapiens
ctgtcctctgctttg

SEQ ID NO: 1957807 - DNA, 13 bp, Homo sapiens
ctgtcctgctcac

SEQ ID NO: 1957808 - DNA, 22 bp, Homo sapiens
ctgtcctgctcacgtctgtgag

SEQ ID NO: 1957809 - DNA, 21 bp, Homo sapiens
ctgtccttccaacctgttcac

SEQ ID NO: 1957810 - DNA, 20 bp, Homo sapiens
ctgtctctacaaaaaaaatc

SEQ ID NO: 1957811 - DNA, 23 bp, Homo sapiens
ctgtctctccctaccctcttctc

SEQ ID NO: 1957812 - DNA, 19 bp, Homo sapiens
ctgtctctcttttgctctc

SEQ ID NO: 1957813 - DNA, 15 bp, Homo sapiens
ctgtcttcaaccctg

SEQ ID NO: 1957814 - DNA, 19 bp, Homo sapiens
ctgtcttcaaccctgccct

SEQ ID NO: 1957815 - DNA, 21 bp, Homo sapiens
ctgtcttcaaccctgccctgc

SEQ ID NO: 1957816 - DNA, 23 bp, Homo sapiens
ctgtcttcaaccctgccctgcac

SEQ ID NO: 1957817 - DNA, 18 bp, Homo sapiens
ctgtgaaagtctcctgta

SEQ ID NO: 1957818 - DNA, 17 bp, Homo sapiens
ctgtgacacagctgagc

SEQ ID NO: 1957819 - DNA, 21 bp, Homo sapiens
ctgtgagataaatatcattat

SEQ ID NO: 1957820 - DNA, 22 bp, Homo sapiens
ctgtgagataaatatcattata

SEQ ID NO: 1957821 - DNA, 15 bp, Homo sapiens
ctgtgagtctgtcct

SEQ ID NO: 1957822 - DNA, 20 bp, Homo sapiens
ctgtgagtctgtcctttccc

SEQ ID NO: 1957823 - DNA, 23 bp, Homo sapiens
ctgtgcatctggcctgggggctg

SEQ ID NO: 1957824 - DNA, 19 bp, Homo sapiens
ctgtgggagtccactttcc

SEQ ID NO: 1957825 - DNA, 15 bp, Homo sapiens
ctgtgtggcaaacat

SEQ ID NO: 1957826 - DNA, 18 bp, Homo sapiens
ctgtgtggcaaacattta

SEQ ID NO: 1957827 - DNA, 22 bp, Homo sapiens
ctgtgtggcaaacatttaaaaa

SEQ ID NO: 1957828 - DNA, 15 bp, Homo sapiens
ctgttatctgtcttt

SEQ ID NO: 1957829 - DNA, 16 bp, Homo sapiens
ctgttatctgtcttta

SEQ ID NO: 1957830 - DNA, 18 bp, Homo sapiens
ctgttcacgtgactcctc

SEQ ID NO: 1957831 - DNA, 20 bp, Homo sapiens
ctgttccaagtgtgtgtgca

SEQ ID NO: 1957832 - DNA, 17 bp, Homo sapiens
ctgtttactcacattgt

SEQ ID NO: 1957833 - DNA, 12 bp, Homo sapiens
ctgtttttcctt

SEQ ID NO: 1957834 - DNA, 11 bp, Homo sapiens
cttaaaagatg

SEQ ID NO: 1957835 - DNA, 12 bp, Homo sapiens
cttaaacaaaaa

SEQ ID NO: 1957836 - DNA, 16 bp, Homo sapiens
cttaaacattgcctta

SEQ ID NO: 1957837 - DNA, 11 bp, Homo sapiens
cttaaacattt

SEQ ID NO: 1957838 - DNA, 23 bp, Homo sapiens
cttaaatttgggttgcaaagcta

SEQ ID NO: 1957839 - DNA, 19 bp, Homo sapiens
cttaaggcatatactttgt

SEQ ID NO: 1957840 - DNA, 22 bp, Homo sapiens
cttaaggcatatactttgtctt

SEQ ID NO: 1957841 - DNA, 15 bp, Homo sapiens
cttactgattaactc

SEQ ID NO: 1957842 - DNA, 16 bp, Homo sapiens
cttagaagaaatatga

SEQ ID NO: 1957843 - DNA, 17 bp, Homo sapiens
cttcaaccctgccctgc

SEQ ID NO: 1957844 - DNA, 18 bp, Homo sapiens
cttcaaccctgccctgca

SEQ ID NO: 1957845 - DNA, 19 bp, Homo sapiens
cttcaaccctgccctgcac

SEQ ID NO: 1957846 - DNA, 15 bp, Homo sapiens
cttcacaatttcaat

SEQ ID NO: 1957847 - DNA, 16 bp, Homo sapiens
cttcacaatttcaatg

SEQ ID NO: 1957848 - DNA, 21 bp, Homo sapiens
cttcaggaaagcagcagtttt

SEQ ID NO: 1957849 - DNA, 21 bp, Homo sapiens
cttcccagctggcagcgcctc

SEQ ID NO: 1957850 - DNA, 15 bp, Homo sapiens
cttcccgcagcacca

SEQ ID NO: 1957851 - DNA, 18 bp, Homo sapiens
cttcccgcagcaccagcc

SEQ ID NO: 1957852 - DNA, 13 bp, Homo sapiens
cttcctgtcctgc

SEQ ID NO: 1957853 - DNA, 15 bp, Homo sapiens
cttcctgtcctgctc

SEQ ID NO: 1957854 - DNA, 16 bp, Homo sapiens
cttcctgtcctgctca

SEQ ID NO: 1957855 - DNA, 23 bp, Homo sapiens
cttctaaaggtttcactgttcat

SEQ ID NO: 1957856 - DNA, 13 bp, Homo sapiens
cttctaaatcata

SEQ ID NO: 1957857 - DNA, 19 bp, Homo sapiens
cttctaaatcataatcatc

SEQ ID NO: 1957858 - DNA, 21 bp, Homo sapiens
cttctaatccatgtgctgctg

SEQ ID NO: 1957859 - DNA, 14 bp, Homo sapiens
cttctacaaaagaa

SEQ ID NO: 1957860 - DNA, 17 bp, Homo sapiens
cttctcagctccactct

SEQ ID NO: 1957861 - DNA, 20 bp, Homo sapiens
cttctgtgcatctggcctgg

SEQ ID NO: 1957862 - DNA, 19 bp, Homo sapiens
cttcttgcggcaccgccca

SEQ ID NO: 1957863 - DNA, 12 bp, Homo sapiens
cgcagcaccagc

SEQ ID NO: 1957864 - DNA, 17 bp, Homo sapiens
cgcagcaccagcctgag

SEQ ID NO: 1957865 - DNA, 20 bp, Homo sapiens
cgcagcaccagcctgagcca

SEQ ID NO: 1957866 - DNA, 21 bp, Homo sapiens
cgcagcaccagcctgagccac

SEQ ID NO: 1957867 - DNA, 20 bp, Homo sapiens
cgcagccgcgctctgcccct

SEQ ID NO: 1957868 - DNA, 21 bp, Homo sapiens
cgcagccgcgctctgcccctc

SEQ ID NO: 1957869 - DNA, 13 bp, Homo sapiens
cgcagggcgctcc

SEQ ID NO: 1957870 - DNA, 22 bp, Homo sapiens
cgcagggcgctccggcagaggc

SEQ ID NO: 1957871 - DNA, 22 bp, Homo sapiens
cgccacccgcccgcccccgccc

SEQ ID NO: 1957872 - DNA, 16 bp, Homo sapiens
cgcccaccccgctgcc

SEQ ID NO: 1957873 - DNA, 17 bp, Homo sapiens
cgcccaccccgctgcct

SEQ ID NO: 1957874 - DNA, 16 bp, Homo sapiens
cgcccacctgcccagt

SEQ ID NO: 1957875 - DNA, 11 bp, Homo sapiens
cgccccagaga

SEQ ID NO: 1957876 - DNA, 18 bp, Homo sapiens
cgccccagagactgccca

SEQ ID NO: 1957877 - DNA, 13 bp, Homo sapiens
cgcccctcctcgg

SEQ ID NO: 1957878 - DNA, 13 bp, Homo sapiens
cgcccgcccaccc

SEQ ID NO: 1957879 - DNA, 22 bp, Homo sapiens
cgcccgcccaccccgctgcctg

SEQ ID NO: 1957880 - DNA, 23 bp, Homo sapiens
cgcccgcccccgccctcgctccg

SEQ ID NO: 1957881 - DNA, 16 bp, Homo sapiens
cgcccgccctcctctg

SEQ ID NO: 1957882 - DNA, 14 bp, Homo sapiens
cgccctcctctgcc

SEQ ID NO: 1957883 - DNA, 21 bp, Homo sapiens
cgccctcctctgccccctccc

SEQ ID NO: 1957884 - DNA, 18 bp, Homo sapiens
cgccgcctcgggccgcct

SEQ ID NO: 1957885 - DNA, 17 bp, Homo sapiens
cgccggggctggccctg

SEQ ID NO: 1957886 - DNA, 16 bp, Homo sapiens
cgccggttggccggct

SEQ ID NO: 1957887 - DNA, 20 bp, Homo sapiens
cgccggttggccggctggcc

SEQ ID NO: 1957888 - DNA, 21 bp, Homo sapiens
cgccggttggccggctggccg

SEQ ID NO: 1957889 - DNA, 13 bp, Homo sapiens
cgcctcctccaga

SEQ ID NO: 1957890 - DNA, 17 bp, Homo sapiens
cgcctcgggccgcctcc

SEQ ID NO: 1957891 - DNA, 12 bp, Homo sapiens
cgcctgcccgcc

SEQ ID NO: 1957892 - DNA, 14 bp, Homo sapiens
cgcctgcgctcctc

SEQ ID NO: 1957893 - DNA, 15 bp, Homo sapiens
cgcctgcgctcctct

SEQ ID NO: 1957894 - DNA, 19 bp, Homo sapiens
cgcctgcgctcctctgcag

SEQ ID NO: 1957895 - DNA, 22 bp, Homo sapiens
cgcctgcgctcctctgcagcct

SEQ ID NO: 1957896 - DNA, 13 bp, Homo sapiens
cgcgcaccgccca

SEQ ID NO: 1957897 - DNA, 13 bp, Homo sapiens
cgcgcgtgccccc

SEQ ID NO: 1957898 - DNA, 15 bp, Homo sapiens
cgcgcgtgcccccag

SEQ ID NO: 1957899 - DNA, 13 bp, Homo sapiens
cgcgctctgcccc

SEQ ID NO: 1957900 - DNA, 12 bp, Homo sapiens
cgcgtgccccca

SEQ ID NO: 1957901 - DNA, 18 bp, Homo sapiens
cgcgtgcccccagcgtgg

SEQ ID NO: 1957902 - DNA, 21 bp, Homo sapiens
cgcgtgccttccccgtgcggc

SEQ ID NO: 1957903 - DNA, 16 bp, Homo sapiens
cgctccggcagaggca

SEQ ID NO: 1957904 - DNA, 20 bp, Homo sapiens
cgctccggcagaggcagggc

SEQ ID NO: 1957905 - DNA, 20 bp, Homo sapiens
cgctcctctgcagcctgagc

SEQ ID NO: 1957906 - DNA, 23 bp, Homo sapiens
cgctcctctgcagcctgagctcc

SEQ ID NO: 1957907 - DNA, 10 bp, Homo sapiens
cgctgcctgg

SEQ ID NO: 1957908 - DNA, 19 bp, Homo sapiens
cgctgcctggcgggcagcc

SEQ ID NO: 1957909 - DNA, 14 bp, Homo sapiens
cgctgcgctcccac

SEQ ID NO: 1957910 - DNA, 13 bp, Homo sapiens
cggagcggctgag

SEQ ID NO: 1957911 - DNA, 15 bp, Homo sapiens
cggaggcgcccacct

SEQ ID NO: 1957912 - DNA, 17 bp, Homo sapiens
gaaatattcacaaggtt

SEQ ID NO: 1957913 - DNA, 23 bp, Homo sapiens
gaaatatttgcgtaaatggtttt

SEQ ID NO: 1957914 - DNA, 15 bp, Homo sapiens
gaaatgattcagggt

SEQ ID NO: 1957915 - DNA, 21 bp, Homo sapiens
gaaatgattcagggttatttg

SEQ ID NO: 1957916 - DNA, 17 bp, Homo sapiens
gaaatgattgagagcag

SEQ ID NO: 1957917 - DNA, 18 bp, Homo sapiens
gaaatggatagattgttt

SEQ ID NO: 1957918 - DNA, 20 bp, Homo sapiens
gaaatggatagattgtttta

SEQ ID NO: 1957919 - DNA, 16 bp, Homo sapiens
gaaattcttgcactgt

SEQ ID NO: 1957920 - DNA, 13 bp, Homo sapiens
gaaccagcactcc

SEQ ID NO: 1957921 - DNA, 16 bp, Homo sapiens
gaaccagcactcccag

SEQ ID NO: 1957922 - DNA, 18 bp, Homo sapiens
gaaccagcactcccaggg

SEQ ID NO: 1957923 - DNA, 20 bp, Homo sapiens
gaaccagcactcccagggcc

SEQ ID NO: 1957924 - DNA, 14 bp, Homo sapiens
gaactgaagcagag

SEQ ID NO: 1957925 - DNA, 16 bp, Homo sapiens
gaactgcaacactgga

SEQ ID NO: 1957926 - DNA, 14 bp, Homo sapiens
gaagaaatatgagc

SEQ ID NO: 1957927 - DNA, 16 bp, Homo sapiens
gaagaactgacttcct

SEQ ID NO: 1957928 - DNA, 13 bp, Homo sapiens
gaagcccacccgc

SEQ ID NO: 1957929 - DNA, 20 bp, Homo sapiens
gaagcccacccgccccagag

SEQ ID NO: 1957930 - DNA, 14 bp, Homo sapiens
gaaggcctgaggga

SEQ ID NO: 1957931 - DNA, 17 bp, Homo sapiens
gaaggcctgagggaagc

SEQ ID NO: 1957932 - DNA, 22 bp, Homo sapiens
gaaggcctgagggaagcccacc

SEQ ID NO: 1957933 - DNA, 17 bp, Homo sapiens
gaagggagtgaaaacct

SEQ ID NO: 1957934 - DNA, 14 bp, Homo sapiens
gaagtcccttcctg

SEQ ID NO: 1957935 - DNA, 17 bp, Homo sapiens
gaagtcccttcctgtcc

SEQ ID NO: 1957936 - DNA, 16 bp, Homo sapiens
gaagttgtcctttctg

SEQ ID NO: 1957937 - DNA, 20 bp, Homo sapiens
gaatcacctaattaatttca

SEQ ID NO: 1957938 - DNA, 16 bp, Homo sapiens
gaatctctcaaaatgt

SEQ ID NO: 1957939 - DNA, 18 bp, Homo sapiens
gaatgaaatataaactgt

SEQ ID NO: 1957940 - DNA, 19 bp, Homo sapiens
gaatgctaagccagttctt

SEQ ID NO: 1957941 - DNA, 23 bp, Homo sapiens
gaatgctaagccagttcttaaga

SEQ ID NO: 1957942 - DNA, 17 bp, Homo sapiens
gaatgctcaatgtgctg

SEQ ID NO: 1957943 - DNA, 19 bp, Homo sapiens
gaatgttgtcctgtgtcat

SEQ ID NO: 1957944 - DNA, 14 bp, Homo sapiens
gaattacataacag

SEQ ID NO: 1957945 - DNA, 21 bp, Homo sapiens
gaattagttggcagagaaaat

SEQ ID NO: 1957946 - DNA, 18 bp, Homo sapiens
gaattggctgccaagagt

SEQ ID NO: 1957947 - DNA, 13 bp, Homo sapiens
gacaacacacaca

SEQ ID NO: 1957948 - DNA, 13 bp, Homo sapiens
gacaatgtggaat

SEQ ID NO: 1957949 - DNA, 22 bp, Homo sapiens
gacacactcaccatttaatcat

SEQ ID NO: 1957950 - DNA, 19 bp, Homo sapiens
gacacagctgagctggcct

SEQ ID NO: 1957951 - DNA, 19 bp, Homo sapiens
gacactgatgggtcctgct

SEQ ID NO: 1957952 - DNA, 12 bp, Homo sapiens
gacagacagacg

SEQ ID NO: 1957953 - DNA, 18 bp, Homo sapiens
gacagcggcccggcccac

SEQ ID NO: 1957954 - DNA, 10 bp, Homo sapiens
gacagtgcct

SEQ ID NO: 1957955 - DNA, 13 bp, Homo sapiens
gacatctctgtaa

SEQ ID NO: 1957956 - DNA, 15 bp, Homo sapiens
gacattttgtagcta

SEQ ID NO: 1957957 - DNA, 22 bp, Homo sapiens
gacattttgtagctagtttaaa

SEQ ID NO: 1957958 - DNA, 20 bp, Homo sapiens
gaccagttccctcagccctc

SEQ ID NO: 1957959 - DNA, 20 bp, Homo sapiens
gaccccacacgccggggctg

SEQ ID NO: 1957960 - DNA, 21 bp, Homo sapiens
gaccccacacgccggggctgg

SEQ ID NO: 1957961 - DNA, 19 bp, Homo sapiens
gaccggagcggctgaggac

SEQ ID NO: 1957962 - DNA, 11 bp, Homo sapiens
gaccggcccgc

SEQ ID NO: 1957963 - DNA, 17 bp, Homo sapiens
gaccggcccgccacctt

SEQ ID NO: 1957964 - DNA, 15 bp, Homo sapiens
gacctcaaaagaaaa

SEQ ID NO: 1957965 - DNA, 16 bp, Homo sapiens
gacctcaaaagaaaat

SEQ ID NO: 1957966 - DNA, 21 bp, Homo sapiens
gacctccagggaatcagaaag

SEQ ID NO: 1957967 - DNA, 15 bp, Homo sapiens
gacggacgggacagc

SEQ ID NO: 1957968 - DNA, 12 bp, Homo sapiens
gacggcagcccc

SEQ ID NO: 1957969 - DNA, 13 bp, Homo sapiens
gacggcagcccca

SEQ ID NO: 1957970 - DNA, 16 bp, Homo sapiens
gacggcagccccatcc

SEQ ID NO: 1957971 - DNA, 22 bp, Homo sapiens
gactccccgcccgccctcctct

SEQ ID NO: 1957972 - DNA, 17 bp, Homo sapiens
gactcgagagggctgag

SEQ ID NO: 1957973 - DNA, 21 bp, Homo sapiens
gactcgagagggctgagcccc

SEQ ID NO: 1957974 - DNA, 21 bp, Homo sapiens
gactcttactaaccaccattt

SEQ ID NO: 1957975 - DNA, 21 bp, Homo sapiens
gactgcccaccctgggcctcc

SEQ ID NO: 1957976 - DNA, 22 bp, Homo sapiens
gactgcccaccctgggcctccc

SEQ ID NO: 1957977 - DNA, 23 bp, Homo sapiens
gactgcccaccctgggcctcccg

SEQ ID NO: 1957978 - DNA, 14 bp, Homo sapiens
gacttcccagctgg

SEQ ID NO: 1957979 - DNA, 23 bp, Homo sapiens
gacttcccagctggcagcgcctc

SEQ ID NO: 1957980 - DNA, 19 bp, Homo sapiens
gacttctttactaacactg

SEQ ID NO: 1957981 - DNA, 22 bp, Homo sapiens
gacttctttactaacactggct

SEQ ID NO: 1957982 - DNA, 12 bp, Homo sapiens
gagaaggaggaa

SEQ ID NO: 1957983 - DNA, 15 bp, Homo sapiens
gagacggcagcccca

SEQ ID NO: 1957984 - DNA, 12 bp, Homo sapiens
gagactgcccac

SEQ ID NO: 1957985 - DNA, 17 bp, Homo sapiens
gagactgcccaccctgg

SEQ ID NO: 1957986 - DNA, 22 bp, Homo sapiens
gagactgcccaccctgggcctc

SEQ ID NO: 1957987 - DNA, 15 bp, Homo sapiens
gagagcgccacccgc

SEQ ID NO: 1957988 - DNA, 22 bp, Homo sapiens
gagagcgccacccgcccgcccc

SEQ ID NO: 1957989 - DNA, 12 bp, Homo sapiens
gagagggctgag

SEQ ID NO: 1957990 - DNA, 19 bp, Homo sapiens
gagagggctgagcccctcc

SEQ ID NO: 1957991 - DNA, 11 bp, Homo sapiens
gagcaccccca

SEQ ID NO: 1957992 - DNA, 13 bp, Homo sapiens
gagcacccccagc

SEQ ID NO: 1957993 - DNA, 14 bp, Homo sapiens
gagcacccccagcc

SEQ ID NO: 1957994 - DNA, 21 bp, Homo sapiens
gagcagagacggcagccccat

SEQ ID NO: 1957995 - DNA, 11 bp, Homo sapiens
gagcagtgggg

SEQ ID NO: 1957996 - DNA, 13 bp, Homo sapiens
gagcagtggggag

SEQ ID NO: 1957997 - DNA, 16 bp, Homo sapiens
gagcagtggggagcgg

SEQ ID NO: 1957998 - DNA, 22 bp, Homo sapiens
gagcatgctccctcatgcagat

SEQ ID NO: 1957999 - DNA, 18 bp, Homo sapiens
gagccacagtggggccca

SEQ ID NO: 1958000 - DNA, 20 bp, Homo sapiens
gagccacagtggggcccatg

SEQ ID NO: 1958001 - DNA, 14 bp, Homo sapiens
gagccccggagcac

SEQ ID NO: 1958002 - DNA, 11 bp, Homo sapiens
gagcctgtctc

SEQ ID NO: 1958003 - DNA, 16 bp, Homo sapiens
gagcgcgtgccttccc

SEQ ID NO: 1958004 - DNA, 15 bp, Homo sapiens
gagcggctgaggacg

SEQ ID NO: 1958005 - DNA, 22 bp, Homo sapiens
gagcgggggctaactggcccca

SEQ ID NO: 1958006 - DNA, 14 bp, Homo sapiens
gagctatgcacacc

SEQ ID NO: 1958007 - DNA, 21 bp, Homo sapiens
gagctatgcacaccaaattgc

SEQ ID NO: 1958008 - DNA, 13 bp, Homo sapiens
gagctccaccctc

SEQ ID NO: 1958009 - DNA, 17 bp, Homo sapiens
gagctgagtcggctggg

SEQ ID NO: 1958010 - DNA, 18 bp, Homo sapiens
gagctgagtcggctgggc

SEQ ID NO: 1958011 - DNA, 23 bp, Homo sapiens
gagctgagtcggctgggcagggc

SEQ ID NO: 1958012 - DNA, 21 bp, Homo sapiens
gagctggcctattttggacgt

SEQ ID NO: 1958013 - DNA, 21 bp, Homo sapiens
gaggagcaaacaggaaaatga

SEQ ID NO: 1958014 - DNA, 14 bp, Homo sapiens
gaggagtccaaaat

SEQ ID NO: 1958015 - DNA, 19 bp, Homo sapiens
gaggcgcccacctgcccag

SEQ ID NO: 1958016 - DNA, 17 bp, Homo sapiens
gaggctcgtgcatgtaa

SEQ ID NO: 1958017 - DNA, 17 bp, Homo sapiens
gagggaagcccacccgc

SEQ ID NO: 1958018 - DNA, 18 bp, Homo sapiens
gagggaagcccacccgcc

SEQ ID NO: 1958019 - DNA, 13 bp, Homo sapiens
gagggctgagccc

SEQ ID NO: 1958020 - DNA, 15 bp, Homo sapiens
gagggctgagcccct

SEQ ID NO: 1958021 - DNA, 16 bp, Homo sapiens
gaggggcttggagcag

SEQ ID NO: 1958022 - DNA, 14 bp, Homo sapiens
gagtccactttcct

SEQ ID NO: 1958023 - DNA, 18 bp, Homo sapiens
gagtccactttcctctct

SEQ ID NO: 1958024 - DNA, 21 bp, Homo sapiens
gagtcctcattgttcagaaaa

SEQ ID NO: 1958025 - DNA, 14 bp, Homo sapiens
gatgtttagtagct

SEQ ID NO: 1958026 - DNA, 19 bp, Homo sapiens
gattaacctaatgcagaat

SEQ ID NO: 1958027 - DNA, 16 bp, Homo sapiens
gattagacaatgtgga

SEQ ID NO: 1958028 - DNA, 17 bp, Homo sapiens
gattcaaataaccctga

SEQ ID NO: 1958029 - DNA, 15 bp, Homo sapiens
gattcagcagtgtct

SEQ ID NO: 1958030 - DNA, 18 bp, Homo sapiens
gattcagggttatttgag

SEQ ID NO: 1958031 - DNA, 15 bp, Homo sapiens
gattcttactgttct

SEQ ID NO: 1958032 - DNA, 19 bp, Homo sapiens
gatttcatgattagacaat

SEQ ID NO: 1958033 - DNA, 15 bp, Homo sapiens
gattttaattcaggt

SEQ ID NO: 1958034 - DNA, 22 bp, Homo sapiens
gattttcaagttattcagaaat

SEQ ID NO: 1958035 - DNA, 23 bp, Homo sapiens
gattttcaagttattcagaaata

SEQ ID NO: 1958036 - DNA, 11 bp, Homo sapiens
gcaaaacattt

SEQ ID NO: 1958037 - DNA, 11 bp, Homo sapiens
gcaaacattta

SEQ ID NO: 1958038 - DNA, 18 bp, Homo sapiens
gcaaaccaatttgttctg

SEQ ID NO: 1958039 - DNA, 22 bp, Homo sapiens
gcaaatttctagatatgagaaa

SEQ ID NO: 1958040 - DNA, 11 bp, Homo sapiens
gcaacactgga

SEQ ID NO: 1958041 - DNA, 22 bp, Homo sapiens
gcaagatagctccttcatgctt

SEQ ID NO: 1958042 - DNA, 12 bp, Homo sapiens
gcaatcttgctg

SEQ ID NO: 1958043 - DNA, 16 bp, Homo sapiens
gcaatcttgctgtgaa

SEQ ID NO: 1958044 - DNA, 20 bp, Homo sapiens
gcaatgttccgttcatctga

SEQ ID NO: 1958045 - DNA, 18 bp, Homo sapiens
gcacaaccatgttcttga

SEQ ID NO: 1958046 - DNA, 15 bp, Homo sapiens
gcacacaaaacatct

SEQ ID NO: 1958047 - DNA, 20 bp, Homo sapiens
gcacacaactgtggtcccag

SEQ ID NO: 1958048 - DNA, 15 bp, Homo sapiens
gcaccagcctgagcc

SEQ ID NO: 1958049 - DNA, 18 bp, Homo sapiens
gcaccagcctgagccaca

SEQ ID NO: 1958050 - DNA, 13 bp, Homo sapiens
gcacccccagcct

SEQ ID NO: 1958051 - DNA, 14 bp, Homo sapiens
gcacccccagcctc

SEQ ID NO: 1958052 - DNA, 17 bp, Homo sapiens
gcacccccagcctcccc

SEQ ID NO: 1958053 - DNA, 19 bp, Homo sapiens
gcacccccagcctccccca

SEQ ID NO: 1958054 - DNA, 16 bp, Homo sapiens
gcaccgcccacccaca

SEQ ID NO: 1958055 - DNA, 19 bp, Homo sapiens
gcaccgtggtgtgaggccc

SEQ ID NO: 1958056 - DNA, 20 bp, Homo sapiens
gcaccgtggtgtgaggcccc

SEQ ID NO: 1958057 - DNA, 13 bp, Homo sapiens
gcacgggagagcg

SEQ ID NO: 1958058 - DNA, 22 bp, Homo sapiens
gcacgggagagcgccacccgcc

SEQ ID NO: 1958059 - DNA, 14 bp, Homo sapiens
gcactcccagggcc

SEQ ID NO: 1958060 - DNA, 19 bp, Homo sapiens
gcactcccagggcccgagc

SEQ ID NO: 1958061 - DNA, 21 bp, Homo sapiens
gcactcccagggcccgagcgc

SEQ ID NO: 1958062 - DNA, 17 bp, Homo sapiens
gcactttgggaggctga

SEQ ID NO: 1958063 - DNA, 18 bp, Homo sapiens
gcagagacggcagcccca

SEQ ID NO: 1958064 - DNA, 14 bp, Homo sapiens
gcagagccccggag

SEQ ID NO: 1958065 - DNA, 16 bp, Homo sapiens
gcagagccccggagca

SEQ ID NO: 1958066 - DNA, 18 bp, Homo sapiens
gcagagccccggagcacc

SEQ ID NO: 1958067 - DNA, 19 bp, Homo sapiens
gcagagccccggagcacca

SEQ ID NO: 1958068 - DNA, 13 bp, Homo sapiens
gcagaggcagggc

SEQ ID NO: 1958069 - DNA, 15 bp, Homo sapiens
gcagaggcagggccc

SEQ ID NO: 1958070 - DNA, 18 bp, Homo sapiens
gcagcaccagcctgagcc

SEQ ID NO: 1958071 - DNA, 23 bp, Homo sapiens
gcagcaccagcctgagccacagt

SEQ ID NO: 1958072 - DNA, 20 bp, Homo sapiens
gcagcagctagaaagagaaa

SEQ ID NO: 1958073 - DNA, 20 bp, Homo sapiens
gcagcagtaccatcccactg

SEQ ID NO: 1958074 - DNA, 23 bp, Homo sapiens
gcagcccagaacgggcctccccg

SEQ ID NO: 1958075 - DNA, 18 bp, Homo sapiens
gcagccccatccttcccg

SEQ ID NO: 1958076 - DNA, 11 bp, Homo sapiens
gcagcccctgc

SEQ ID NO: 1958077 - DNA, 18 bp, Homo sapiens
gcagcccctgctggacca

SEQ ID NO: 1958078 - DNA, 22 bp, Homo sapiens
gcagcccctgctggaccaaggt

SEQ ID NO: 1958079 - DNA, 14 bp, Homo sapiens
gcagccgcgctctg

SEQ ID NO: 1958080 - DNA, 16 bp, Homo sapiens
gcagccgcgctctgcc

SEQ ID NO: 1958081 - DNA, 20 bp, Homo sapiens
gcagccgcgctctgcccctc

SEQ ID NO: 1958082 - DNA, 20 bp, Homo sapiens
gcagcctgagctccaccctc

SEQ ID NO: 1958083 - DNA, 22 bp, Homo sapiens
gcagcctgagctccaccctccc

SEQ ID NO: 1958084 - DNA, 15 bp, Homo sapiens
gcagcgcctcccgcc

SEQ ID NO: 1958085 - DNA, 21 bp, Homo sapiens
gcaggcgcgcaccgcccaacc

SEQ ID NO: 1958086 - DNA, 13 bp, Homo sapiens
gcagggccgcagg

SEQ ID NO: 1958087 - DNA, 17 bp, Homo sapiens
gcagggccgcagggcgc

SEQ ID NO: 1958088 - DNA, 17 bp, Homo sapiens
gcagggcgctccggcag

SEQ ID NO: 1958089 - DNA, 21 bp, Homo sapiens
gcagggcgctccggcagaggc

SEQ ID NO: 1958090 - DNA, 17 bp, Homo sapiens
gcagtaccatcccactg

SEQ ID NO: 1958091 - DNA, 18 bp, Homo sapiens
gcagtaccatcccactga

SEQ ID NO: 1958092 - DNA, 20 bp, Homo sapiens
gcagtaccatcccactgata

SEQ ID NO: 1958093 - DNA, 12 bp, Homo sapiens
gcagtgcagtgc

SEQ ID NO: 1958094 - DNA, 16 bp, Homo sapiens
gcagtgtctgttcttc

SEQ ID NO: 1958095 - DNA, 19 bp, Homo sapiens
gcatactgatgagacaaca

SEQ ID NO: 1958096 - DNA, 18 bp, Homo sapiens
gcatccgctgcgctccca

SEQ ID NO: 1958097 - DNA, 12 bp, Homo sapiens
gcatctggcctg

SEQ ID NO: 1958098 - DNA, 14 bp, Homo sapiens
gcatctggcctggg

SEQ ID NO: 1958099 - DNA, 15 bp, Homo sapiens
gcatgagaactaaat

SEQ ID NO: 1958100 - DNA, 16 bp, Homo sapiens
gcatgctcagtattga

SEQ ID NO: 1958101 - DNA, 15 bp, Homo sapiens
gcatgctccctcatg

SEQ ID NO: 1958102 - DNA, 17 bp, Homo sapiens
gcatgtaatattaaatt

SEQ ID NO: 1958103 - DNA, 15 bp, Homo sapiens
gcattgcactaaaag

SEQ ID NO: 1958104 - DNA, 20 bp, Homo sapiens
gcattgcactaaaagtgatg

SEQ ID NO: 1958105 - DNA, 21 bp, Homo sapiens
gcattgcactaaaagtgatgt

SEQ ID NO: 1958106 - DNA, 22 bp, Homo sapiens
gcatttatgcatgagaactaaa

SEQ ID NO: 1958107 - DNA, 14 bp, Homo sapiens
gcatttcagctgtg

SEQ ID NO: 1958108 - DNA, 11 bp, Homo sapiens
gccaaatgagt

SEQ ID NO: 1958109 - DNA, 20 bp, Homo sapiens
gccaaatgagttcccttgat

SEQ ID NO: 1958110 - DNA, 16 bp, Homo sapiens
gccacagtggggccca

SEQ ID NO: 1958111 - DNA, 22 bp, Homo sapiens
gccacagtggggcccatggccc

SEQ ID NO: 1958112 - DNA, 15 bp, Homo sapiens
gcccaacccccacct

SEQ ID NO: 1958113 - DNA, 15 bp, Homo sapiens
gcccacccacacccc

SEQ ID NO: 1958114 - DNA, 17 bp, Homo sapiens
gcccacccacaccccgt

SEQ ID NO: 1958115 - DNA, 10 bp, Homo sapiens
gcccaccccg

SEQ ID NO: 1958116 - DNA, 15 bp, Homo sapiens
gcccacccgccccag

SEQ ID NO: 1958117 - DNA, 21 bp, Homo sapiens
gcccacccgccccagagactg

SEQ ID NO: 1958118 - DNA, 20 bp, Homo sapiens
gcccacccgtgttctcctcc

SEQ ID NO: 1958119 - DNA, 12 bp, Homo sapiens
gcccacctgccc

SEQ ID NO: 1958120 - DNA, 15 bp, Homo sapiens
gcccacgcagagccc

SEQ ID NO: 1958121 - DNA, 17 bp, Homo sapiens
gcccacgcagagccccg

SEQ ID NO: 1958122 - DNA, 17 bp, Homo sapiens
gcccagaacgggcctcc

SEQ ID NO: 1958123 - DNA, 13 bp, Homo sapiens
gcccagttagccc

SEQ ID NO: 1958124 - DNA, 16 bp, Homo sapiens
gcccagttagcccggc

SEQ ID NO: 1958125 - DNA, 20 bp, Homo sapiens
gcccagttagcccggccaag

SEQ ID NO: 1958126 - DNA, 13 bp, Homo sapiens
gcccatggcccca

SEQ ID NO: 1958127 - DNA, 22 bp, Homo sapiens
gcccatggccccagctggctgg

SEQ ID NO: 1958128 - DNA, 17 bp, Homo sapiens
gccccagagactgccca

SEQ ID NO: 1958129 - DNA, 18 bp, Homo sapiens
gccccagagactgcccac

SEQ ID NO: 1958130 - DNA, 22 bp, Homo sapiens
gccccagagactgcccaccctg

SEQ ID NO: 1958131 - DNA, 17 bp, Homo sapiens
gccccagctggctgggt

SEQ ID NO: 1958132 - DNA, 19 bp, Homo sapiens
gccccagctggctgggtcg

SEQ ID NO: 1958133 - DNA, 13 bp, Homo sapiens
gccccatccttcc

SEQ ID NO: 1958134 - DNA, 16 bp, Homo sapiens
gcccccgccctcgctc

SEQ ID NO: 1958135 - DNA, 18 bp, Homo sapiens
gcccccggaggcgcccac

SEQ ID NO: 1958136 - DNA, 12 bp, Homo sapiens
gccccctccccc

SEQ ID NO: 1958137 - DNA, 21 bp, Homo sapiens
gctagaaagagaaaaagccct

SEQ ID NO: 1958138 - DNA, 14 bp, Homo sapiens
gctagtttaaaatt

SEQ ID NO: 1958139 - DNA, 21 bp, Homo sapiens
gctagtttaaaattattaaaa

SEQ ID NO: 1958140 - DNA, 18 bp, Homo sapiens
gctataaatagtgaaaat

SEQ ID NO: 1958141 - DNA, 13 bp, Homo sapiens
gctatgcacacca

SEQ ID NO: 1958142 - DNA, 17 bp, Homo sapiens
gctatgcacaccaaatt

SEQ ID NO: 1958143 - DNA, 18 bp, Homo sapiens
gctatgcacaccaaattg

SEQ ID NO: 1958144 - DNA, 23 bp, Homo sapiens
gctatgcacaccaaattgctgag

SEQ ID NO: 1958145 - DNA, 12 bp, Homo sapiens
gctcaatgtgct

SEQ ID NO: 1958146 - DNA, 13 bp, Homo sapiens
gctcaatgtgctg

SEQ ID NO: 1958147 - DNA, 16 bp, Homo sapiens
gctcacgtctgtgagt

SEQ ID NO: 1958148 - DNA, 15 bp, Homo sapiens
gctcagcattgtgta

SEQ ID NO: 1958149 - DNA, 16 bp, Homo sapiens
gctcatcttttcctgc

SEQ ID NO: 1958150 - DNA, 14 bp, Homo sapiens
gctccaccctcccc

SEQ ID NO: 1958151 - DNA, 16 bp, Homo sapiens
gctccaccctcccctc

SEQ ID NO: 1958152 - DNA, 20 bp, Homo sapiens
gctccaccctcccctcttct

SEQ ID NO: 1958153 - DNA, 14 bp, Homo sapiens
gctccatcttattt

SEQ ID NO: 1958154 - DNA, 17 bp, Homo sapiens
gctccggcagaggcagg

SEQ ID NO: 1958155 - DNA, 20 bp, Homo sapiens
gctccggcagaggcagggcc

SEQ ID NO: 1958156 - DNA, 22 bp, Homo sapiens
gctccggcagaggcagggccct

SEQ ID NO: 1958157 - DNA, 14 bp, Homo sapiens
gctccgggtgcgtg

SEQ ID NO: 1958158 - DNA, 14 bp, Homo sapiens
gctcctctgcagcc

SEQ ID NO: 1958159 - DNA, 15 bp, Homo sapiens
gctcctctgcagcct

SEQ ID NO: 1958160 - DNA, 17 bp, Homo sapiens
gctcctctgcagcctga

SEQ ID NO: 1958161 - DNA, 18 bp, Homo sapiens
gctcctctgcagcctgag

SEQ ID NO: 1958162 - DNA, 20 bp, Homo sapiens
gctccttcatgcttttctca

SEQ ID NO: 1958163 - DNA, 19 bp, Homo sapiens
gctcgggaaggcctgaggg

SEQ ID NO: 1958164 - DNA, 23 bp, Homo sapiens
gctcgggaaggcctgagggaagc

SEQ ID NO: 1958165 - DNA, 16 bp, Homo sapiens
gctctctcacccagcc

SEQ ID NO: 1958166 - DNA, 19 bp, Homo sapiens
gctctctcacccagcctgg

SEQ ID NO: 1958167 - DNA, 16 bp, Homo sapiens
gctctgcccctccgtc

SEQ ID NO: 1958168 - DNA, 18 bp, Homo sapiens
gctgaataacaacaattt

SEQ ID NO: 1958169 - DNA, 23 bp, Homo sapiens
gctgagatgggaggatcacttga

SEQ ID NO: 1958170 - DNA, 13 bp, Homo sapiens
gctgagcccctcc

SEQ ID NO: 1958171 - DNA, 15 bp, Homo sapiens
gctgagcccctcctc

SEQ ID NO: 1958172 - DNA, 21 bp, Homo sapiens
gctgagcccctcctctcctcg

SEQ ID NO: 1958173 - DNA, 16 bp, Homo sapiens
gctgaggacggggcag

SEQ ID NO: 1958174 - DNA, 17 bp, Homo sapiens
gctgaggacggggcaga

SEQ ID NO: 1958175 - DNA, 20 bp, Homo sapiens
gctgaggacggggcagagct

SEQ ID NO: 1958176 - DNA, 22 bp, Homo sapiens
gctgaggacggggcagagctga

SEQ ID NO: 1958177 - DNA, 23 bp, Homo sapiens
gctgaggacggggcagagctgag

SEQ ID NO: 1958178 - DNA, 17 bp, Homo sapiens
gctgagtcggctgggca

SEQ ID NO: 1958179 - DNA, 12 bp, Homo sapiens
gctgcatgaaag

SEQ ID NO: 1958180 - DNA, 14 bp, Homo sapiens
gctgcatttcaagt

SEQ ID NO: 1958181 - DNA, 15 bp, Homo sapiens
gctgcctggcgggca

SEQ ID NO: 1958182 - DNA, 16 bp, Homo sapiens
gctgcctggcgggcag

SEQ ID NO: 1958183 - DNA, 19 bp, Homo sapiens
gctgcctggcgggcagccc

SEQ ID NO: 1958184 - DNA, 22 bp, Homo sapiens
gctgcctggcgggcagcccctg

SEQ ID NO: 1958185 - DNA, 20 bp, Homo sapiens
gctgcgctcccacctcggac

SEQ ID NO: 1958186 - DNA, 16 bp, Homo sapiens
gctgctcgggaaggcc

SEQ ID NO: 1958187 - DNA, 18 bp, Homo sapiens
gctgctcgggaaggcctg

SEQ ID NO: 1958188 - DNA, 17 bp, Homo sapiens
gctgcttttctgtcagt

SEQ ID NO: 1958189 - DNA, 19 bp, Homo sapiens
gctggcagcgcctcccgcc

SEQ ID NO: 1958190 - DNA, 18 bp, Homo sapiens
gctggccggtccaccccg

SEQ ID NO: 1958191 - DNA, 13 bp, Homo sapiens
gctgggcagggcc

SEQ ID NO: 1958192 - DNA, 14 bp, Homo sapiens
gctgggtcgcccct

SEQ ID NO: 1958193 - DNA, 15 bp, Homo sapiens
gctgggtcgcccctc

SEQ ID NO: 1958194 - DNA, 18 bp, Homo sapiens
gctgggtcgcccctcctc

SEQ ID NO: 1958195 - DNA, 15 bp, Homo sapiens
gctgtgatgtcacag

SEQ ID NO: 1958196 - DNA, 18 bp, Homo sapiens
gctgtggcatcaggaaag

SEQ ID NO: 1958197 - DNA, 14 bp, Homo sapiens
gctgttagctcaga

SEQ ID NO: 1958198 - DNA, 13 bp, Homo sapiens
gctgttatctgtc

SEQ ID NO: 1958199 - DNA, 17 bp, Homo sapiens
gcttacagtgatgccat

SEQ ID NO: 1958200 - DNA, 12 bp, Homo sapiens
gcttcttttagt

SEQ ID NO: 1958201 - DNA, 19 bp, Homo sapiens
gcttcttttagtcagaaat

SEQ ID NO: 1958202 - DNA, 20 bp, Homo sapiens
gcttcttttagtcagaaatg

SEQ ID NO: 1958203 - DNA, 21 bp, Homo sapiens
gcttcttttagtcagaaatga

SEQ ID NO: 1958204 - DNA, 11 bp, Homo sapiens
gcttggagcag

SEQ ID NO: 1958205 - DNA, 20 bp, Homo sapiens
gcttggagcagagacggcag

SEQ ID NO: 1958206 - DNA, 23 bp, Homo sapiens
gctttgttttcctcctgattctc

SEQ ID NO: 1958207 - DNA, 15 bp, Homo sapiens
gcttttctcatggta

SEQ ID NO: 1958208 - DNA, 14 bp, Homo sapiens
gcttttgatggcta

SEQ ID NO: 1958209 - DNA, 17 bp, Homo sapiens
gcttttgatggctatgt

SEQ ID NO: 1958210 - DNA, 20 bp, Homo sapiens
gcttttgatggctatgtttt

SEQ ID NO: 1958211 - DNA, 15 bp, Homo sapiens
ggaaaacgatttaat

SEQ ID NO: 1958212 - DNA, 15 bp, Homo sapiens
ggaaagatcccaagt

SEQ ID NO: 1958213 - DNA, 18 bp, Homo sapiens
ggaaagttccagcagttt

SEQ ID NO: 1958214 - DNA, 14 bp, Homo sapiens
ggaaatgctgattt

SEQ ID NO: 1958215 - DNA, 18 bp, Homo sapiens
ggaaattcttgcactgta

SEQ ID NO: 1958216 - DNA, 22 bp, Homo sapiens
ggaagcccacccgccccagaga

SEQ ID NO: 1958217 - DNA, 15 bp, Homo sapiens
ggaaggcctgaggga

SEQ ID NO: 1958218 - DNA, 22 bp, Homo sapiens
ggaatggattttttttttcagg

SEQ ID NO: 1958219 - DNA, 24 bp, Homo sapiens
ggacactgatgggtcctgctgctc

SEQ ID NO: 1958220 - DNA, 17 bp, Homo sapiens
ggacagcggcccggccc

SEQ ID NO: 1958221 - DNA, 14 bp, Homo sapiens
ggaccggagcggct

SEQ ID NO: 1958222 - DNA, 17 bp, Homo sapiens
ggaccggagcggctgag

SEQ ID NO: 1958223 - DNA, 12 bp, Homo sapiens
ggacgctggctc

SEQ ID NO: 1958224 - DNA, 13 bp, Homo sapiens
ggacgggacagcg

SEQ ID NO: 1958225 - DNA, 21 bp, Homo sapiens
ggacgggacagcggcccggcc

SEQ ID NO: 1958226 - DNA, 16 bp, Homo sapiens
ggacggggcagagctg

SEQ ID NO: 1958227 - DNA, 18 bp, Homo sapiens
ggagaaaggcaaaccaat

SEQ ID NO: 1958228 - DNA, 23 bp, Homo sapiens
ggagagagcaatcttgctgtgaa

SEQ ID NO: 1958229 - DNA, 15 bp, Homo sapiens
ggagatgaggctgga

SEQ ID NO: 1958230 - DNA, 16 bp, Homo sapiens
ggagatgaggctggat

SEQ ID NO: 1958231 - DNA, 14 bp, Homo sapiens
ggagcacccccagc

SEQ ID NO: 1958232 - DNA, 21 bp, Homo sapiens
ggagcacccccagcctccccc

SEQ ID NO: 1958233 - DNA, 17 bp, Homo sapiens
ggagcagagacggcagc

SEQ ID NO: 1958234 - DNA, 20 bp, Homo sapiens
ggagcagagacggcagcccc

SEQ ID NO: 1958235 - DNA, 22 bp, Homo sapiens
ggagcggctgaggacggggcag

SEQ ID NO: 1958236 - DNA, 13 bp, Homo sapiens
ggaggcgcccacc

SEQ ID NO: 1958237 - DNA, 16 bp, Homo sapiens
ggaggcgcccacctgc

SEQ ID NO: 1958238 - DNA, 21 bp, Homo sapiens
ggaggctgagacgcaaggatc

SEQ ID NO: 1958239 - DNA, 12 bp, Homo sapiens
ggaggctgagat

SEQ ID NO: 1958240 - DNA, 20 bp, Homo sapiens
ggaggggcttggagcagaga

SEQ ID NO: 1958241 - DNA, 14 bp, Homo sapiens
ggagtccactttcc

SEQ ID NO: 1958242 - DNA, 22 bp, Homo sapiens
ggagtccactttcctctctctc

SEQ ID NO: 1958243 - DNA, 12 bp, Homo sapiens
ggagtgcagtgg

SEQ ID NO: 1958244 - DNA, 14 bp, Homo sapiens
ggatgatttaacat

SEQ ID NO: 1958245 - DNA, 21 bp, Homo sapiens
ggatgtaatatagggtttgtt

SEQ ID NO: 1958246 - DNA, 17 bp, Homo sapiens
ggatttgcactgcttta

SEQ ID NO: 1958247 - DNA, 21 bp, Homo sapiens
ggcaaaccaatttgttctgtg

SEQ ID NO: 1958248 - DNA, 22 bp, Homo sapiens
ggcacaagtttttttgttcata

SEQ ID NO: 1958249 - DNA, 21 bp, Homo sapiens
gtcccttcctgtcctgctcac

SEQ ID NO: 1958250 - DNA, 16 bp, Homo sapiens
gtccgcccgcccaccc

SEQ ID NO: 1958251 - DNA, 19 bp, Homo sapiens
gtccgtccgcccgcccacc

SEQ ID NO: 1958252 - DNA, 21 bp, Homo sapiens
gtccgtccgcccgcccacccc

SEQ ID NO: 1958253 - DNA, 14 bp, Homo sapiens
gtcctaaatgcaaa

SEQ ID NO: 1958254 - DNA, 13 bp, Homo sapiens
gtcctgctcacgt

SEQ ID NO: 1958255 - DNA, 21 bp, Homo sapiens
gtcctgctcacgtctgtgagt

SEQ ID NO: 1958256 - DNA, 22 bp, Homo sapiens
gtcctgctgctcgggaaggcct

SEQ ID NO: 1958257 - DNA, 18 bp, Homo sapiens
gtcctgtgtcatctgtca

SEQ ID NO: 1958258 - DNA, 18 bp, Homo sapiens
gtccttccaacctgttca

SEQ ID NO: 1958259 - DNA, 22 bp, Homo sapiens
gtcctttgagtgtcaggctctg

SEQ ID NO: 1958260 - DNA, 15 bp, Homo sapiens
gtcggctgggcaggg

SEQ ID NO: 1958261 - DNA, 18 bp, Homo sapiens
gtcggctgggcagggccg

SEQ ID NO: 1958262 - DNA, 23 bp, Homo sapiens
gtcggctgggcagggccgcaggg

SEQ ID NO: 1958263 - DNA, 20 bp, Homo sapiens
gtctctacaaaaaaaatcaa

SEQ ID NO: 1958264 - DNA, 15 bp, Homo sapiens
gtctctgagcagtgg

SEQ ID NO: 1958265 - DNA, 15 bp, Homo sapiens
gtctctttctttcca

SEQ ID NO: 1958266 - DNA, 17 bp, Homo sapiens
gtctctttctttccaaa

SEQ ID NO: 1958267 - DNA, 9 bp, Homo sapiens
gtctgcccc

SEQ ID NO: 1958268 - DNA, 16 bp, Homo sapiens
gtctgccccttgaccc

SEQ ID NO: 1958269 - DNA, 16 bp, Homo sapiens
gtctggataatttgta

SEQ ID NO: 1958270 - DNA, 19 bp, Homo sapiens
gtctgtcccagttaactgt

SEQ ID NO: 1958271 - DNA, 17 bp, Homo sapiens
gtctgtgagtctgtcct

SEQ ID NO: 1958272 - DNA, 17 bp, Homo sapiens
gtcttcaaccctgccct

SEQ ID NO: 1958273 - DNA, 17 bp, Homo sapiens
gtcttgagtttcatttt

SEQ ID NO: 1958274 - DNA, 14 bp, Homo sapiens
gtctttaaaatgat

SEQ ID NO: 1958275 - DNA, 15 bp, Homo sapiens
gtctttatgatttca

SEQ ID NO: 1958276 - DNA, 17 bp, Homo sapiens
gtctttatgatttcatg

SEQ ID NO: 1958277 - DNA, 21 bp, Homo sapiens
gtctttggttcctcatggctg

SEQ ID NO: 1958278 - DNA, 13 bp, Homo sapiens
gtcttttgttctc

SEQ ID NO: 1958279 - DNA, 17 bp, Homo sapiens
gtgaaaattttattgaa

SEQ ID NO: 1958280 - DNA, 12 bp, Homo sapiens
gtgaaacagtgt

SEQ ID NO: 1958281 - DNA, 15 bp, Homo sapiens
gtgaactgaagcaga

SEQ ID NO: 1958282 - DNA, 14 bp, Homo sapiens
gtgaagtgattgac

SEQ ID NO: 1958283 - DNA, 19 bp, Homo sapiens
gtgaccggcccgccacctt

SEQ ID NO: 1958284 - DNA, 16 bp, Homo sapiens
gtgagataaatatcat

SEQ ID NO: 1958285 - DNA, 16 bp, Homo sapiens
gtgatgtcacagtttg

SEQ ID NO: 1958286 - DNA, 17 bp, Homo sapiens
gtgatgtcacagtttgt

SEQ ID NO: 1958287 - DNA, 17 bp, Homo sapiens
gtgatgtgatttatgca

SEQ ID NO: 1958288 - DNA, 18 bp, Homo sapiens
gtgcaggcgcgcaccgcc

SEQ ID NO: 1958289 - DNA, 19 bp, Homo sapiens
gtgcaggcgcgcaccgccc

SEQ ID NO: 1958290 - DNA, 20 bp, Homo sapiens
gtgcaggcgcgcaccgccca

SEQ ID NO: 1958291 - DNA, 14 bp, Homo sapiens
gtgcagtagtgtca

SEQ ID NO: 1958292 - DNA, 13 bp, Homo sapiens
gtgcatctggcct

SEQ ID NO: 1958293 - DNA, 15 bp, Homo sapiens
gtgcatctggcctgg

SEQ ID NO: 1958294 - DNA, 17 bp, Homo sapiens
gtgcatctggcctgggg

SEQ ID NO: 1958295 - DNA, 15 bp, Homo sapiens
gtgccagacgtgctc

SEQ ID NO: 1958296 - DNA, 12 bp, Homo sapiens
gtgcccccagcg

SEQ ID NO: 1958297 - DNA, 16 bp, Homo sapiens
gtgcccctcctgcccc

SEQ ID NO: 1958298 - DNA, 15 bp, Homo sapiens
gtgcgcagccgcgct

SEQ ID NO: 1958299 - DNA, 17 bp, Homo sapiens
gtgcggcccgtgcgcag

SEQ ID NO: 1958300 - DNA, 18 bp, Homo sapiens
gtgcggcccgtgcgcagc

SEQ ID NO: 1958301 - DNA, 21 bp, Homo sapiens
gtgcggcccgtgcgcagccgc

SEQ ID NO: 1958302 - DNA, 22 bp, Homo sapiens
gtgctcatcagaaacaatttct

SEQ ID NO: 1958303 - DNA, 17 bp, Homo sapiens
gtgctgctgtggcatca

SEQ ID NO: 1958304 - DNA, 14 bp, Homo sapiens
gtgctgttgattct

SEQ ID NO: 1958305 - DNA, 23 bp, Homo sapiens
gtggaattacataacaggcattg

SEQ ID NO: 1958306 - DNA, 17 bp, Homo sapiens
gtggcacacaactgtgg

SEQ ID NO: 1958307 - DNA, 16 bp, Homo sapiens
gtggcatttgctgaat

SEQ ID NO: 1958308 - DNA, 17 bp, Homo sapiens
gtggctctaactccttg

SEQ ID NO: 1958309 - DNA, 12 bp, Homo sapiens
gtgggagtccac

SEQ ID NO: 1958310 - DNA, 18 bp, Homo sapiens
gtgggagtccactttcct

SEQ ID NO: 1958311 - DNA, 21 bp, Homo sapiens
gtggggcccatggccccagct

SEQ ID NO: 1958312 - DNA, 17 bp, Homo sapiens
gtgggtccaggagatga

SEQ ID NO: 1958313 - DNA, 15 bp, Homo sapiens
gtggtgtgaggcccc

SEQ ID NO: 1958314 - DNA, 19 bp, Homo sapiens
gtggtgtgaggcccccgga

SEQ ID NO: 1958315 - DNA, 17 bp, Homo sapiens
gtgtacatttatgtgtg

SEQ ID NO: 1958316 - DNA, 15 bp, Homo sapiens
gtgtactctgagtcc

SEQ ID NO: 1958317 - DNA, 15 bp, Homo sapiens
gtgtcacttttttcc

SEQ ID NO: 1958318 - DNA, 21 bp, Homo sapiens
gtgtcttttgttctctcttgg

SEQ ID NO: 1958319 - DNA, 15 bp, Homo sapiens
gtgtggcaaacattt

SEQ ID NO: 1958320 - DNA, 18 bp, Homo sapiens
gtgtggcttaaacatttt

SEQ ID NO: 1958321 - DNA, 16 bp, Homo sapiens
gtgtgtgcaatgttcc

SEQ ID NO: 1958322 - DNA, 12 bp, Homo sapiens
gtgtttaactga

SEQ ID NO: 1958323 - DNA, 17 bp, Homo sapiens
gttaaattattgataca

SEQ ID NO: 1958324 - DNA, 22 bp, Homo sapiens
gttaagcacaaccatgttcttg

SEQ ID NO: 1958325 - DNA, 23 bp, Homo sapiens
gttagcccggccaaggacactga

SEQ ID NO: 1958326 - DNA, 16 bp, Homo sapiens
gttagtaacttttagt

SEQ ID NO: 1958327 - DNA, 13 bp, Homo sapiens
gttataaaatctg

SEQ ID NO: 1958328 - DNA, 15 bp, Homo sapiens
gttatagttcatagt

SEQ ID NO: 1958329 - DNA, 22 bp, Homo sapiens
gttatcagtacaattctttgtt

SEQ ID NO: 1958330 - DNA, 14 bp, Homo sapiens
gttatctgtcttta

SEQ ID NO: 1958331 - DNA, 21 bp, Homo sapiens
gttattcaataactattgctg

SEQ ID NO: 1958332 - DNA, 16 bp, Homo sapiens
gttattcagaaatatc

SEQ ID NO: 1958333 - DNA, 16 bp, Homo sapiens
gttcaccttctgtgca

SEQ ID NO: 1958334 - DNA, 22 bp, Homo sapiens
gttcagaaaagcacctcttgaa

SEQ ID NO: 1958335 - DNA, 21 bp, Homo sapiens
gttccaagtgtgtgtgcaatg

SEQ ID NO: 1958336 - DNA, 16 bp, Homo sapiens
gttccctcagccctca

SEQ ID NO: 1958337 - DNA, 19 bp, Homo sapiens
gttcccttgattcaaataa

SEQ ID NO: 1958338 - DNA, 12 bp, Homo sapiens
gttcctcatggc

SEQ ID NO: 1958339 - DNA, 19 bp, Homo sapiens
gttctctcttggtctcttt

SEQ ID NO: 1958340 - DNA, 21 bp, Homo sapiens
gttctctcttggtctctttct

SEQ ID NO: 1958341 - DNA, 19 bp, Homo sapiens
gttcttcgcagctcatctt

SEQ ID NO: 1958342 - DNA, 16 bp, Homo sapiens
gttcttgtaaaactgt

SEQ ID NO: 1958343 - DNA, 17 bp, Homo sapiens
gttcttgtaaaactgtg

SEQ ID NO: 1958344 - DNA, 18 bp, Homo sapiens
gttcttgtaaaactgtga

SEQ ID NO: 1958345 - DNA, 21 bp, Homo sapiens
gttcttgtaaaactgtgacat

SEQ ID NO: 1958346 - DNA, 21 bp, Homo sapiens
gttcttttttaagactcaatc

SEQ ID NO: 1958347 - DNA, 14 bp, Homo sapiens
gttgattctttcaa

SEQ ID NO: 1958348 - DNA, 12 bp, Homo sapiens
gttgcaaagcta

SEQ ID NO: 1958349 - DNA, 14 bp, Homo sapiens
gttggaaatatttg

SEQ ID NO: 1958350 - DNA, 16 bp, Homo sapiens
gttggccggctggccg

SEQ ID NO: 1958351 - DNA, 21 bp, Homo sapiens
gttggccggctggccggtcca

SEQ ID NO: 1958352 - DNA, 18 bp, Homo sapiens
gttggttacctattgctg

SEQ ID NO: 1958353 - DNA, 15 bp, Homo sapiens
gttgtacatagtggt

SEQ ID NO: 1958354 - DNA, 17 bp, Homo sapiens
gttgtacatagtggtca

SEQ ID NO: 1958355 - DNA, 21 bp, Homo sapiens
gttgtcctgtgtcatctgtca

SEQ ID NO: 1958356 - DNA, 13 bp, Homo sapiens
gtttaaaattatt

SEQ ID NO: 1958357 - DNA, 21 bp, Homo sapiens
gtttcatttttcattttctct

SEQ ID NO: 1958358 - DNA, 15 bp, Homo sapiens
gtttccgtagcagtt

SEQ ID NO: 1958359 - DNA, 21 bp, Homo sapiens
gttttcctcctgattctctta

SEQ ID NO: 1958360 - DNA, 16 bp, Homo sapiens
gttttcttttaatttt

SEQ ID NO: 1958361 - DNA, 17 bp, Homo sapiens
gtttttccttttgttta

SEQ ID NO: 1958362 - DNA, 12 bp, Homo sapiens
gggcagcccctg

SEQ ID NO: 1958363 - DNA, 16 bp, Homo sapiens
gggcagcccctgctgg

SEQ ID NO: 1958364 - DNA, 17 bp, Homo sapiens
gggcccgctcaacctct

SEQ ID NO: 1958365 - DNA, 20 bp, Homo sapiens
gggcccgctcaacctctcag

SEQ ID NO: 1958366 - DNA, 22 bp, Homo sapiens
gggccctggggtctctgagcag

SEQ ID NO: 1958367 - DNA, 15 bp, Homo sapiens
gggccgcagggcgct

SEQ ID NO: 1958368 - DNA, 14 bp, Homo sapiens
gggccgcctcctcc

SEQ ID NO: 1958369 - DNA, 17 bp, Homo sapiens
gggccgcctcctccaga

SEQ ID NO: 1958370 - DNA, 20 bp, Homo sapiens
gggccgcctcctccagactc

SEQ ID NO: 1958371 - DNA, 13 bp, Homo sapiens
gggcctcccgtcc

SEQ ID NO: 1958372 - DNA, 20 bp, Homo sapiens
gggcctcccgtccgtccgcc

SEQ ID NO: 1958373 - DNA, 21 bp, Homo sapiens
gggcctcccgtccgtccgccc

SEQ ID NO: 1958374 - DNA, 19 bp, Homo sapiens
gggcgcctgcgctcctctg

SEQ ID NO: 1958375 - DNA, 16 bp, Homo sapiens
gggctaacgggcgcct

SEQ ID NO: 1958376 - DNA, 15 bp, Homo sapiens
gtttttttgttcata

SEQ ID NO: 1958377 - DNA, 20 bp, Homo sapiens
gtttttttgttcatactttg

SEQ ID NO: 1958378 - DNA, 14 bp, Homo sapiens
taaaaaaataatat

SEQ ID NO: 1958379 - DNA, 19 bp, Homo sapiens
taaaaaatgttattactga

SEQ ID NO: 1958380 - DNA, 16 bp, Homo sapiens
taaaaatagctataaa

SEQ ID NO: 1958381 - DNA, 18 bp, Homo sapiens
taaaaattatctttaaaa

SEQ ID NO: 1958382 - DNA, 11 bp, Homo sapiens
taaaactgtga

SEQ ID NO: 1958383 - DNA, 12 bp, Homo sapiens
taaaactgtgac

SEQ ID NO: 1958384 - DNA, 18 bp, Homo sapiens
taaaactgtgacattcca

SEQ ID NO: 1958385 - DNA, 20 bp, Homo sapiens
taaaactgtgacattccaca

SEQ ID NO: 1958386 - DNA, 17 bp, Homo sapiens
taaaatctgtattgcta

SEQ ID NO: 1958387 - DNA, 23 bp, Homo sapiens
taaaatgattcacttttattgta

SEQ ID NO: 1958388 - DNA, 18 bp, Homo sapiens
taaaatttgcacacaaaa

SEQ ID NO: 1958389 - DNA, 22 bp, Homo sapiens
taaaattttcctttatgattct

SEQ ID NO: 1958390 - DNA, 22 bp, Homo sapiens
taaacaaagagtagaactttaa

SEQ ID NO: 1958391 - DNA, 12 bp, Homo sapiens
taaactgtgaga

SEQ ID NO: 1958392 - DNA, 14 bp, Homo sapiens
taaactgtgagata

SEQ ID NO: 1958393 - DNA, 15 bp, Homo sapiens
taaataaaaatagct

SEQ ID NO: 1958394 - DNA, 14 bp, Homo sapiens
taaatcataatcat

SEQ ID NO: 1958395 - DNA, 13 bp, Homo sapiens
taaatgaaatact

SEQ ID NO: 1958396 - DNA, 12 bp, Homo sapiens
taaatgaatgaa

SEQ ID NO: 1958397 - DNA, 15 bp, Homo sapiens
taaatggttttcaac

SEQ ID NO: 1958398 - DNA, 17 bp, Homo sapiens
taaatggttttcaacaa

SEQ ID NO: 1958399 - DNA, 14 bp, Homo sapiens
taaatgtatattga

SEQ ID NO: 1958400 - DNA, 21 bp, Homo sapiens
taaattcctcctgtctcctct

SEQ ID NO: 1958401 - DNA, 19 bp, Homo sapiens
taacattctatttcaactt

SEQ ID NO: 1958402 - DNA, 20 bp, Homo sapiens
taaccattgctaatttaaag

SEQ ID NO: 1958403 - DNA, 15 bp, Homo sapiens
taactggccccaggc

SEQ ID NO: 1958404 - DNA, 16 bp, Homo sapiens
taactggccccaggcg

SEQ ID NO: 1958405 - DNA, 23 bp, Homo sapiens
taactgtcctttttcttccctta

SEQ ID NO: 1958406 - DNA, 16 bp, Homo sapiens
taacttgctgtgaaat

SEQ ID NO: 1958407 - DNA, 18 bp, Homo sapiens
taacttgctgtgaaatga

SEQ ID NO: 1958408 - DNA, 20 bp, Homo sapiens
taagaaatggctttccacat

SEQ ID NO: 1958409 - DNA, 20 bp, Homo sapiens
taagataattaaatgaaata

SEQ ID NO: 1958410 - DNA, 22 bp, Homo sapiens
taagataattaaatgaaatact

SEQ ID NO: 1958411 - DNA, 17 bp, Homo sapiens
taagtgcttgaggccaa

SEQ ID NO: 1958412 - DNA, 15 bp, Homo sapiens
taagttataccagca

SEQ ID NO: 1958413 - DNA, 16 bp, Homo sapiens
taataaatcaaaattg

SEQ ID NO: 1958414 - DNA, 13 bp, Homo sapiens
taatataaatgaa

SEQ ID NO: 1958415 - DNA, 16 bp, Homo sapiens
taatataaatgaatga

SEQ ID NO: 1958416 - DNA, 12 bp, Homo sapiens
taatattaaatt

SEQ ID NO: 1958417 - DNA, 16 bp, Homo sapiens
taatccatgtgctgct

SEQ ID NO: 1958418 - DNA, 21 bp, Homo sapiens
taatctagagctatgcacacc

SEQ ID NO: 1958419 - DNA, 22 bp, Homo sapiens
taatctagagctatgcacacca

SEQ ID NO: 1958420 - DNA, 15 bp, Homo sapiens
taatgtctcaaaata

SEQ ID NO: 1958421 - DNA, 13 bp, Homo sapiens
taattaaactgat

SEQ ID NO: 1958422 - DNA, 16 bp, Homo sapiens
taattaacatatcaag

SEQ ID NO: 1958423 - DNA, 13 bp, Homo sapiens
taattaatttcag

SEQ ID NO: 1958424 - DNA, 19 bp, Homo sapiens
taattactttcagaatgtt

SEQ ID NO: 1958425 - DNA, 13 bp, Homo sapiens
taatttcaagaat

SEQ ID NO: 1958426 - DNA, 22 bp, Homo sapiens
taatttcaagaatgtttcagtt

SEQ ID NO: 1958427 - DNA, 23 bp, Homo sapiens
taatttcaagaatgtttcagtta

SEQ ID NO: 1958428 - DNA, 11 bp, Homo sapiens
taatttttcct

SEQ ID NO: 1958429 - DNA, 19 bp, Homo sapiens
tacaaataatttagaaata

SEQ ID NO: 1958430 - DNA, 20 bp, Homo sapiens
tacaacaggattttcaagtt

SEQ ID NO: 1958431 - DNA, 17 bp, Homo sapiens
tacaacattagaatatt

SEQ ID NO: 1958432 - DNA, 17 bp, Homo sapiens
tacaattactttgaaca

SEQ ID NO: 1958433 - DNA, 18 bp, Homo sapiens
tacaattctttgttgctt

SEQ ID NO: 1958434 - DNA, 21 bp, Homo sapiens
tacaattctttgttgcttaat

SEQ ID NO: 1958435 - DNA, 20 bp, Homo sapiens
tacagaaccagcactcccag

SEQ ID NO: 1958436 - DNA, 23 bp, Homo sapiens
tacagaaccagcactcccagggc

SEQ ID NO: 1958437 - DNA, 21 bp, Homo sapiens
tacagatgatgtaaaaatatg

SEQ ID NO: 1958438 - DNA, 21 bp, Homo sapiens
tacataccacacttaaaagat

SEQ ID NO: 1958439 - DNA, 15 bp, Homo sapiens
tacatagtggtcatt

SEQ ID NO: 1958440 - DNA, 16 bp, Homo sapiens
tacatagtggtcattt

SEQ ID NO: 1958441 - DNA, 18 bp, Homo sapiens
tacattattagaatataa

SEQ ID NO: 1958442 - DNA, 18 bp, Homo sapiens
taccacacttaaaagatg

SEQ ID NO: 1958443 - DNA, 22 bp, Homo sapiens
taccagaaatatttgctcaata

SEQ ID NO: 1958444 - DNA, 15 bp, Homo sapiens
taccattttgaaata

SEQ ID NO: 1958445 - DNA, 15 bp, Homo sapiens
tacccttctacaaaa

SEQ ID NO: 1958446 - DNA, 18 bp, Homo sapiens
tacctattgctgtaaata

SEQ ID NO: 1958447 - DNA, 15 bp, Homo sapiens
tactaaccaccattt

SEQ ID NO: 1958448 - DNA, 19 bp, Homo sapiens
tactaatgaaatttacagt

SEQ ID NO: 1958449 - DNA, 22 bp, Homo sapiens
tactagaaccttctaatccatg

SEQ ID NO: 1958450 - DNA, 17 bp, Homo sapiens
tactctgagtcctcatt

SEQ ID NO: 1958451 - DNA, 18 bp, Homo sapiens
tactgaaggtgccagacg

SEQ ID NO: 1958452 - DNA, 19 bp, Homo sapiens
tactgttcttcgcagctca

SEQ ID NO: 1958453 - DNA, 17 bp, Homo sapiens
tacttaaacaaaaactt

SEQ ID NO: 1958454 - DNA, 22 bp, Homo sapiens
tacttaaacaaaaactttccat

SEQ ID NO: 1958455 - DNA, 14 bp, Homo sapiens
tagaacaaaagagg

SEQ ID NO: 1958456 - DNA, 13 bp, Homo sapiens
tagaatataaaaa

SEQ ID NO: 1958457 - DNA, 16 bp, Homo sapiens
tagaatataaaaaatg

SEQ ID NO: 1958458 - DNA, 18 bp, Homo sapiens
tagaatattgtaactcac

SEQ ID NO: 1958459 - DNA, 17 bp, Homo sapiens
tagaatcaagtctgtga

SEQ ID NO: 1958460 - DNA, 15 bp, Homo sapiens
tagaggtaaaatttg

SEQ ID NO: 1958461 - DNA, 14 bp, Homo sapiens
tagataaaaggaga

SEQ ID NO: 1958462 - DNA, 19 bp, Homo sapiens
tagataaaaggagagaaag

SEQ ID NO: 1958463 - DNA, 17 bp, Homo sapiens
tagataccattttgaaa

SEQ ID NO: 1958464 - DNA, 20 bp, Homo sapiens
tagataccattttgaaatat

SEQ ID NO: 1958465 - DNA, 16 bp, Homo sapiens
tagatatgagaaatat

SEQ ID NO: 1958466 - DNA, 17 bp, Homo sapiens
tagattcctacttaaac

SEQ ID NO: 1958467 - DNA, 21 bp, Homo sapiens
tagattcctacttaaacaaaa

SEQ ID NO: 1958468 - DNA, 18 bp, Homo sapiens
tagattgttttagagtta

SEQ ID NO: 1958469 - DNA, 13 bp, Homo sapiens
tagatttttagat

SEQ ID NO: 1958470 - DNA, 14 bp, Homo sapiens
tagatttttagatt

SEQ ID NO: 1958471 - DNA, 14 bp, Homo sapiens
tagcagttttgaaa

SEQ ID NO: 1958472 - DNA, 19 bp, Homo sapiens
tagcatactgatgagacaa

SEQ ID NO: 1958473 - DNA, 17 bp, Homo sapiens
tagcatgtaatattaaa

SEQ ID NO: 1958474 - DNA, 18 bp, Homo sapiens
tagcatgtaatattaaat

SEQ ID NO: 1958475 - DNA, 12 bp, Homo sapiens
tagcatttaaag

SEQ ID NO: 1958476 - DNA, 24 bp, Homo sapiens
tagccctctttctctctgtgtggc

SEQ ID NO: 1958477 - DNA, 19 bp, Homo sapiens
tagctagtttaaaattatt

SEQ ID NO: 1958478 - DNA, 20 bp, Homo sapiens
tagctgataaagaaaccttt

SEQ ID NO: 1958479 - DNA, 18 bp, Homo sapiens
taggaatgctcaatgtgc

SEQ ID NO: 1958480 - DNA, 22 bp, Homo sapiens
taggacatctctgtaaaaagca

SEQ ID NO: 1958481 - DNA, 23 bp, Homo sapiens
taggcactttttaacattctcaa

SEQ ID NO: 1958482 - DNA, 17 bp, Homo sapiens
taggggcatagccagtt

SEQ ID NO: 1958483 - DNA, 12 bp, Homo sapiens
taggtaaagagg

SEQ ID NO: 1958484 - DNA, 14 bp, Homo sapiens
taggtctgcacaca

SEQ ID NO: 1958485 - DNA, 20 bp, Homo sapiens
tagtaacttttagtggttct

SEQ ID NO: 1958486 - DNA, 13 bp, Homo sapiens
tagtagaaaatac

SEQ ID NO: 1958487 - DNA, 16 bp, Homo sapiens
tagtagctgataaaga

SEQ ID NO: 1958488 - DNA, 12 bp, Homo sapiens
tagtcagaaatg

SEQ ID NO: 1958489 - DNA, 19 bp, Homo sapiens
tagtgaaaattttattgaa

SEQ ID NO: 1958490 - DNA, 21 bp, Homo sapiens
tagtgtcacttttttcctgtc

SEQ ID NO: 1958491 - DNA, 22 bp, Homo sapiens
tagttcatagttggaaatattt

SEQ ID NO: 1958492 - DNA, 11 bp, Homo sapiens
tataaactgtg

SEQ ID NO: 1958493 - DNA, 14 bp, Homo sapiens
tataaatgaatgaa

SEQ ID NO: 1958494 - DNA, 19 bp, Homo sapiens
tataacattgtaaatgata

SEQ ID NO: 1958495 - DNA, 17 bp, Homo sapiens
tatagggtttgtttgct

SEQ ID NO: 1958496 - DNA, 20 bp, Homo sapiens
tatatatctgagttgtgcct

SEQ ID NO: 1958497 - DNA, 17 bp, Homo sapiens
tatatattttgaaagga

SEQ ID NO: 1958498 - DNA, 21 bp, Homo sapiens
tatatcagactgctttgagaa

SEQ ID NO: 1958499 - DNA, 20 bp, Homo sapiens
tatcagtacaattctttgtt

SEQ ID NO: 1958500 - DNA, 16 bp, Homo sapiens
tatcattatagcatgt

SEQ ID NO: 1958501 - DNA, 17 bp, Homo sapiens
tatcattatagcatgta

SEQ ID NO: 1958502 - DNA, 23 bp, Homo sapiens
tatccttcacaatttcaatgctt

SEQ ID NO: 1958503 - DNA, 20 bp, Homo sapiens
tatctcgctagccatatatt

SEQ ID NO: 1958504 - DNA, 23 bp, Homo sapiens
tatctgagttgtgcctcatttat

SEQ ID NO: 1958505 - DNA, 16 bp, Homo sapiens
tatctgtctttatgat

SEQ ID NO: 1958506 - DNA, 18 bp, Homo sapiens
tatgaagaactattatat

SEQ ID NO: 1958507 - DNA, 23 bp, Homo sapiens
tatgaagccctaagtaaatctaa

SEQ ID NO: 1958508 - DNA, 20 bp, Homo sapiens
tatgagaaatataaaaataa

SEQ ID NO: 1958509 - DNA, 20 bp, Homo sapiens
tatgagattggaaaaaatta

SEQ ID NO: 1958510 - DNA, 16 bp, Homo sapiens
tatgagcatgctccct

SEQ ID NO: 1958511 - DNA, 18 bp, Homo sapiens
tatgagcatgctccctca

SEQ ID NO: 1958512 - DNA, 19 bp, Homo sapiens
tatgattcttactgttctt

SEQ ID NO: 1958513 - DNA, 18 bp, Homo sapiens
tatgatttcatgattaga

SEQ ID NO: 1958514 - DNA, 18 bp, Homo sapiens
tatgcatgagaactaaat

SEQ ID NO: 1958515 - DNA, 13 bp, Homo sapiens
tatgcatttatgc

SEQ ID NO: 1958516 - DNA, 14 bp, Homo sapiens
tatgcatttatgca

SEQ ID NO: 1958517 - DNA, 23 bp, Homo sapiens
tatggcaagtttttggtaatgat

SEQ ID NO: 1958518 - DNA, 13 bp, Homo sapiens
tatgtacacagac

SEQ ID NO: 1958519 - DNA, 20 bp, Homo sapiens
tatgtcaaatggatgtaata

SEQ ID NO: 1958520 - DNA, 14 bp, Homo sapiens
tatgtctagataaa

SEQ ID NO: 1958521 - DNA, 12 bp, Homo sapiens
tatgtctttaaa

SEQ ID NO: 1958522 - DNA, 20 bp, Homo sapiens
tatgtttggctgaaattatg

SEQ ID NO: 1958523 - DNA, 17 bp, Homo sapiens
tattaaaaattatagac

SEQ ID NO: 1958524 - DNA, 21 bp, Homo sapiens
tattatccttcacaatttcaa

SEQ ID NO: 1958525 - DNA, 15 bp, Homo sapiens
tattatctagtaggt

SEQ ID NO: 1958526 - DNA, 14 bp, Homo sapiens
tattgaatataatg

SEQ ID NO: 1958527 - DNA, 17 bp, Homo sapiens
tattgagacactgtcaa

SEQ ID NO: 1958528 - DNA, 18 bp, Homo sapiens
tattgagacactgtcaag

SEQ ID NO: 1958529 - DNA, 20 bp, Homo sapiens
tattgccaaatattaagaag

SEQ ID NO: 1958530 - DNA, 18 bp, Homo sapiens
tatttgcgtaaatggttt

SEQ ID NO: 1958531 - DNA, 11 bp, Homo sapiens
tatttttcaat

SEQ ID NO: 1958532 - DNA, 14 bp, Homo sapiens
tcaaaataaaacca

SEQ ID NO: 1958533 - DNA, 17 bp, Homo sapiens
tcaaaataaaaccagaa

SEQ ID NO: 1958534 - DNA, 11 bp, Homo sapiens
tcaaaatgtgc

SEQ ID NO: 1958535 - DNA, 23 bp, Homo sapiens
tcaaagaatcacctaattaattt

SEQ ID NO: 1958536 - DNA, 21 bp, Homo sapiens
tcaaataaccctgaatcagag

SEQ ID NO: 1958537 - DNA, 12 bp, Homo sapiens
tcaaatgaagat

SEQ ID NO: 1958538 - DNA, 15 bp, Homo sapiens
tcaaatgaagattca

SEQ ID NO: 1958539 - DNA, 21 bp, Homo sapiens
tcaaatgaagattcagcagtg

SEQ ID NO: 1958540 - DNA, 18 bp, Homo sapiens
tcaaatgttattcaataa

SEQ ID NO: 1958541 - DNA, 24 bp, Homo sapiens
tcaagaatagttgtcagaatatgt

SEQ ID NO: 1958542 - DNA, 14 bp, Homo sapiens
tcaagaatgtttca

SEQ ID NO: 1958543 - DNA, 16 bp, Homo sapiens
tcaagaatgtttcagt

SEQ ID NO: 1958544 - DNA, 13 bp, Homo sapiens
tcaaggctgcagt

SEQ ID NO: 1958545 - DNA, 14 bp, Homo sapiens
tcaagtctgtgaaa

SEQ ID NO: 1958546 - DNA, 16 bp, Homo sapiens
tcaagtggaaaccttg

SEQ ID NO: 1958547 - DNA, 14 bp, Homo sapiens
tcaagtgttacaga

SEQ ID NO: 1958548 - DNA, 19 bp, Homo sapiens
tcaagtgttacagaggaca

SEQ ID NO: 1958549 - DNA, 17 bp, Homo sapiens
tcaagttattcagaaat

SEQ ID NO: 1958550 - DNA, 18 bp, Homo sapiens
tcaatccacagtattgtt

SEQ ID NO: 1958551 - DNA, 20 bp, Homo sapiens
tcaatgtgctgttgattctt

SEQ ID NO: 1958552 - DNA, 19 bp, Homo sapiens
tcaattatgtttgaaaata

SEQ ID NO: 1958553 - DNA, 15 bp, Homo sapiens
tcacaatttcaatgc

SEQ ID NO: 1958554 - DNA, 18 bp, Homo sapiens
tcacatgcccctcttaga

SEQ ID NO: 1958555 - DNA, 20 bp, Homo sapiens
tcacatgcccctcttagaag

SEQ ID NO: 1958556 - DNA, 20 bp, Homo sapiens
tcaccatttaatcatttcca

SEQ ID NO: 1958557 - DNA, 21 bp, Homo sapiens
tcaccatttaatcatttccag

SEQ ID NO: 1958558 - DNA, 23 bp, Homo sapiens
tcaccatttaatcatttccagca

SEQ ID NO: 1958559 - DNA, 16 bp, Homo sapiens
tcacctaattaatttc

SEQ ID NO: 1958560 - DNA, 17 bp, Homo sapiens
tcacctaattaatttca

SEQ ID NO: 1958561 - DNA, 15 bp, Homo sapiens
tcaccttctgtgcat

SEQ ID NO: 1958562 - DNA, 16 bp, Homo sapiens
tcaccttctgtgcatc

SEQ ID NO: 1958563 - DNA, 21 bp, Homo sapiens
tcacttttttcctgtcaatat

SEQ ID NO: 1958564 - DNA, 14 bp, Homo sapiens
tcagaaaagcacct

SEQ ID NO: 1958565 - DNA, 24 bp, Homo sapiens
tcagaaacaaagcatttgactttc

SEQ ID NO: 1958566 - DNA, 16 bp, Homo sapiens
tcagaaacaatttctg

SEQ ID NO: 1958567 - DNA, 17 bp, Homo sapiens
tcagaaatgattcaggg

SEQ ID NO: 1958568 - DNA, 18 bp, Homo sapiens
tcagaaatgattcagggt

SEQ ID NO: 1958569 - DNA, 14 bp, Homo sapiens
tcagaagtgaaaaa

SEQ ID NO: 1958570 - DNA, 17 bp, Homo sapiens
tcagaagtgaaaaagac

SEQ ID NO: 1958571 - DNA, 13 bp, Homo sapiens
tcagaatgttgtg

SEQ ID NO: 1958572 - DNA, 19 bp, Homo sapiens
tcagacacctagactctaa

SEQ ID NO: 1958573 - DNA, 16 bp, Homo sapiens
tcagactgctttgaga

SEQ ID NO: 1958574 - DNA, 16 bp, Homo sapiens
tcagaggagaggagca

SEQ ID NO: 1958575 - DNA, 18 bp, Homo sapiens
tcagaggcagagacctcc

SEQ ID NO: 1958576 - DNA, 16 bp, Homo sapiens
tcagatccctcggtca

SEQ ID NO: 1958577 - DNA, 23 bp, Homo sapiens
tcagcaccgtggtgtgaggcccc

SEQ ID NO: 1958578 - DNA, 19 bp, Homo sapiens
tcagcagcggcagcagcag

SEQ ID NO: 1958579 - DNA, 12 bp, Homo sapiens
tcagctccactc

SEQ ID NO: 1958580 - DNA, 14 bp, Homo sapiens
tcagctccactctg

SEQ ID NO: 1958581 - DNA, 16 bp, Homo sapiens
tcagctccactctgaa

SEQ ID NO: 1958582 - DNA, 13 bp, Homo sapiens
tcagcttcccaac

SEQ ID NO: 1958583 - DNA, 22 bp, Homo sapiens
tcaggaaaggaagatgtaagaa

SEQ ID NO: 1958584 - DNA, 16 bp, Homo sapiens
tcagggttatttgagg

SEQ ID NO: 1958585 - DNA, 15 bp, Homo sapiens
tcaggtaaactgatg

SEQ ID NO: 1958586 - DNA, 18 bp, Homo sapiens
tcagtattgagacactgt

SEQ ID NO: 1958587 - DNA, 22 bp, Homo sapiens
tcagtattgagacactgtcaag

SEQ ID NO: 1958588 - DNA, 18 bp, Homo sapiens
tcagtgaggtatgatgtg

SEQ ID NO: 1958589 - DNA, 15 bp, Homo sapiens
tcagtgttataaaat

SEQ ID NO: 1958590 - DNA, 24 bp, Homo sapiens
tcataaattcaaacctaagttgct

SEQ ID NO: 1958591 - DNA, 11 bp, Homo sapiens
tcatacacaga

SEQ ID NO: 1958592 - DNA, 16 bp, Homo sapiens
tcatagttattaatgt

SEQ ID NO: 1958593 - DNA, 23 bp, Homo sapiens
tcatatctgtatgcctcatttta

SEQ ID NO: 1958594 - DNA, 20 bp, Homo sapiens
tcatattctaaaagtaataa

SEQ ID NO: 1958595 - DNA, 18 bp, Homo sapiens
tcatctgaggagtccaaa

SEQ ID NO: 1958596 - DNA, 11 bp, Homo sapiens
tcatcttttcc

SEQ ID NO: 1958597 - DNA, 19 bp, Homo sapiens
tgaaattatgtcaaatgga

SEQ ID NO: 1958598 - DNA, 14 bp, Homo sapiens
tgaaattcacaaag

SEQ ID NO: 1958599 - DNA, 17 bp, Homo sapiens
tgaactgaagcagagtc

SEQ ID NO: 1958600 - DNA, 22 bp, Homo sapiens
tgaagattcagcagtgtctgtt

SEQ ID NO: 1958601 - DNA, 13 bp, Homo sapiens
tgaagcagagtca

SEQ ID NO: 1958602 - DNA, 20 bp, Homo sapiens
tgaagcagagtcaagctgat

SEQ ID NO: 1958603 - DNA, 18 bp, Homo sapiens
tgaagtgattgacatttt

SEQ ID NO: 1958604 - DNA, 22 bp, Homo sapiens
tgaagttaagcacaaccatgtt

SEQ ID NO: 1958605 - DNA, 12 bp, Homo sapiens
tgaataacaaca

SEQ ID NO: 1958606 - DNA, 15 bp, Homo sapiens
tgaataacaacaatt

SEQ ID NO: 1958607 - DNA, 14 bp, Homo sapiens
tgaatatcaagaat

SEQ ID NO: 1958608 - DNA, 21 bp, Homo sapiens
tgaatctctcaaaatgtgccg

SEQ ID NO: 1958609 - DNA, 16 bp, Homo sapiens
tgaatgaaatataaac

SEQ ID NO: 1958610 - DNA, 20 bp, Homo sapiens
tgaatgaaatataaactgtg

SEQ ID NO: 1958611 - DNA, 19 bp, Homo sapiens
tgaatgcttaaatgatcaa

SEQ ID NO: 1958612 - DNA, 17 bp, Homo sapiens
tgacaagtttaaaggct

SEQ ID NO: 1958613 - DNA, 16 bp, Homo sapiens
tgacaccatgtgcaaa

SEQ ID NO: 1958614 - DNA, 16 bp, Homo sapiens
tgacaccttttcaggt

SEQ ID NO: 1958615 - DNA, 18 bp, Homo sapiens
tgacatcaagggaggaag

SEQ ID NO: 1958616 - DNA, 22 bp, Homo sapiens
tgacatgctaacctctctgaac

SEQ ID NO: 1958617 - DNA, 17 bp, Homo sapiens
tgaccggcccgccacct

SEQ ID NO: 1958618 - DNA, 18 bp, Homo sapiens
tgaccggcccgccacctt

SEQ ID NO: 1958619 - DNA, 22 bp, Homo sapiens
tgacctccagggaatcagaaag

SEQ ID NO: 1958620 - DNA, 23 bp, Homo sapiens
tgacctccagggaatcagaaagg

SEQ ID NO: 1958621 - DNA, 17 bp, Homo sapiens
tgaccttctgcggctcc

SEQ ID NO: 1958622 - DNA, 23 bp, Homo sapiens
tgactgtagtttttgttcacctt

SEQ ID NO: 1958623 - DNA, 14 bp, Homo sapiens
tgacttcccagctg

SEQ ID NO: 1958624 - DNA, 23 bp, Homo sapiens
tgacttctttactaacactggct

SEQ ID NO: 1958625 - DNA, 16 bp, Homo sapiens
tgactttcctatgaca

SEQ ID NO: 1958626 - DNA, 15 bp, Homo sapiens
tgagaactaaataga

SEQ ID NO: 1958627 - DNA, 13 bp, Homo sapiens
tgagagcagcctc

SEQ ID NO: 1958628 - DNA, 20 bp, Homo sapiens
tgagcacatctcttcatgcg

SEQ ID NO: 1958629 - DNA, 14 bp, Homo sapiens
tgagctccaccctc

SEQ ID NO: 1958630 - DNA, 17 bp, Homo sapiens
tgagctccaccctcccc

SEQ ID NO: 1958631 - DNA, 13 bp, Homo sapiens
tgaggaaaggagg

SEQ ID NO: 1958632 - DNA, 12 bp, Homo sapiens
tgaggagtccaa

SEQ ID NO: 1958633 - DNA, 15 bp, Homo sapiens
tgaggagtccaaaat

SEQ ID NO: 1958634 - DNA, 22 bp, Homo sapiens
tgaggccaaatgagttcccttg

SEQ ID NO: 1958635 - DNA, 23 bp, Homo sapiens
tgaggcccccggaggcgcccacc

SEQ ID NO: 1958636 - DNA, 14 bp, Homo sapiens
tgaggcctgtcctc

SEQ ID NO: 1958637 - DNA, 12 bp, Homo sapiens
tgagggaagccc

SEQ ID NO: 1958638 - DNA, 13 bp, Homo sapiens
tgagggaagccca

SEQ ID NO: 1958639 - DNA, 20 bp, Homo sapiens
tgagggaagcccacccgccc

SEQ ID NO: 1958640 - DNA, 16 bp, Homo sapiens
tgagtcggctgggcag

SEQ ID NO: 1958641 - DNA, 13 bp, Homo sapiens
tgagttgtgcctc

SEQ ID NO: 1958642 - DNA, 19 bp, Homo sapiens
tgatacaacaggattttca

SEQ ID NO: 1958643 - DNA, 22 bp, Homo sapiens
tgatacaacaggattttcaagt

SEQ ID NO: 1958644 - DNA, 15 bp, Homo sapiens
tgatatctgtttgct

SEQ ID NO: 1958645 - DNA, 19 bp, Homo sapiens
tgatatctgtttgcttcta

SEQ ID NO: 1958646 - DNA, 15 bp, Homo sapiens
tgatatgtctttaaa

SEQ ID NO: 1958647 - DNA, 19 bp, Homo sapiens
tgatccatcctgtttttcc

SEQ ID NO: 1958648 - DNA, 22 bp, Homo sapiens
tgatctggtgcgtgtggccctg

SEQ ID NO: 1958649 - DNA, 13 bp, Homo sapiens
tgatctgtccttc

SEQ ID NO: 1958650 - DNA, 17 bp, Homo sapiens
tgatgagacaacacaca

SEQ ID NO: 1958651 - DNA, 15 bp, Homo sapiens
tgatgatgttctgaa

SEQ ID NO: 1958652 - DNA, 23 bp, Homo sapiens
tgatggggaagggtggatgtccc

SEQ ID NO: 1958653 - DNA, 13 bp, Homo sapiens
tgatgtcacagtt

SEQ ID NO: 1958654 - DNA, 16 bp, Homo sapiens
tgatgtgatttatgca

SEQ ID NO: 1958655 - DNA, 17 bp, Homo sapiens
tgatgtgatttatgcat

SEQ ID NO: 1958656 - DNA, 18 bp, Homo sapiens
tgatgtgatttatgcatt

SEQ ID NO: 1958657 - DNA, 18 bp, Homo sapiens
tgatgtgctcatcagaaa

SEQ ID NO: 1958658 - DNA, 14 bp, Homo sapiens
tgattcacttttat

SEQ ID NO: 1958659 - DNA, 19 bp, Homo sapiens
tgattcagggttatttgag

SEQ ID NO: 1958660 - DNA, 12 bp, Homo sapiens
tgattgacattt

SEQ ID NO: 1958661 - DNA, 13 bp, Homo sapiens
tgatttatgcatt

SEQ ID NO: 1958662 - DNA, 15 bp, Homo sapiens
tgatttatgcattta

SEQ ID NO: 1958663 - DNA, 16 bp, Homo sapiens
tgcaacaaactcaaaa

SEQ ID NO: 1958664 - DNA, 17 bp, Homo sapiens
tgcacacataacacaca

SEQ ID NO: 1958665 - DNA, 19 bp, Homo sapiens
tgcacaccaaattgctgag

SEQ ID NO: 1958666 - DNA, 21 bp, Homo sapiens
tgcacaccaaattgctgagat

SEQ ID NO: 1958667 - DNA, 15 bp, Homo sapiens
tgcactaaaagtgat

SEQ ID NO: 1958668 - DNA, 21 bp, Homo sapiens
tgcactaaaagtgatgtgatt

SEQ ID NO: 1958669 - DNA, 18 bp, Homo sapiens
tgcactgctttattttag

SEQ ID NO: 1958670 - DNA, 14 bp, Homo sapiens
tgcagaccctcaga

SEQ ID NO: 1958671 - DNA, 19 bp, Homo sapiens
tgcagcccagaacgggcct

SEQ ID NO: 1958672 - DNA, 23 bp, Homo sapiens
tgcagcccagaacgggcctcccc

SEQ ID NO: 1958673 - DNA, 19 bp, Homo sapiens
tgcaggcgcgcaccgccca

SEQ ID NO: 1958674 - DNA, 16 bp, Homo sapiens
tgcagtagtgtcactt

SEQ ID NO: 1958675 - DNA, 15 bp, Homo sapiens
tgcatattttgttat

SEQ ID NO: 1958676 - DNA, 13 bp, Homo sapiens
tgcatctggcctg

SEQ ID NO: 1958677 - DNA, 15 bp, Homo sapiens
tgcatctggcctggg

SEQ ID NO: 1958678 - DNA, 20 bp, Homo sapiens
tgcattcattcatcctctta

SEQ ID NO: 1958679 - DNA, 15 bp, Homo sapiens
tgcatttatgcatga

SEQ ID NO: 1958680 - DNA, 16 bp, Homo sapiens
tgcatttatgcatgag

SEQ ID NO: 1958681 - DNA, 16 bp, Homo sapiens
tgccaaatattaagaa

SEQ ID NO: 1958682 - DNA, 21 bp, Homo sapiens
tgccaaatattaagaagctca

SEQ ID NO: 1958683 - DNA, 17 bp, Homo sapiens
tgccagacgtgctcctg

SEQ ID NO: 1958684 - DNA, 13 bp, Homo sapiens
tgccatgaagaca

SEQ ID NO: 1958685 - DNA, 17 bp, Homo sapiens
tgccatttcctcctggg

SEQ ID NO: 1958686 - DNA, 12 bp, Homo sapiens
tgcccaccctgg

SEQ ID NO: 1958687 - DNA, 14 bp, Homo sapiens
tgcccaccctgggc

SEQ ID NO: 1958688 - DNA, 16 bp, Homo sapiens
tgcccagttagcccgg

SEQ ID NO: 1958689 - DNA, 11 bp, Homo sapiens
tgccccctccc

SEQ ID NO: 1958690 - DNA, 15 bp, Homo sapiens
tgccccctcccccgc

SEQ ID NO: 1958691 - DNA, 16 bp, Homo sapiens
tgccccctcccccgca

SEQ ID NO: 1958692 - DNA, 17 bp, Homo sapiens
tgggtcgcccctcctcg

SEQ ID NO: 1958693 - DNA, 14 bp, Homo sapiens
tgggtgtcagtgtc

SEQ ID NO: 1958694 - DNA, 16 bp, Homo sapiens
tggtaacttgctgtga

SEQ ID NO: 1958695 - DNA, 13 bp, Homo sapiens
tggtctctttctt

SEQ ID NO: 1958696 - DNA, 17 bp, Homo sapiens
tggtctctttctttcca

SEQ ID NO: 1958697 - DNA, 19 bp, Homo sapiens
tggtcttgtttaatatttg

SEQ ID NO: 1958698 - DNA, 18 bp, Homo sapiens
tggtgaactgaagcagag

SEQ ID NO: 1958699 - DNA, 21 bp, Homo sapiens
tggtgaactgaagcagagtca

SEQ ID NO: 1958700 - DNA, 18 bp, Homo sapiens
tggtgatgcctaaaggaa

SEQ ID NO: 1958701 - DNA, 19 bp, Homo sapiens
tggtgcgtgtggccctgtg

SEQ ID NO: 1958702 - DNA, 18 bp, Homo sapiens
tggtgtgaggcccccgga

SEQ ID NO: 1958703 - DNA, 13 bp, Homo sapiens
tggttctgtgcct

SEQ ID NO: 1958704 - DNA, 21 bp, Homo sapiens
tggtttccatcaaagccctcc

SEQ ID NO: 1958705 - DNA, 16 bp, Homo sapiens
tgtaaaactgtgacat

SEQ ID NO: 1958706 - DNA, 19 bp, Homo sapiens
tgtaaaactgtgacattcc

SEQ ID NO: 1958707 - DNA, 17 bp, Homo sapiens
tgtaaataaaaatagct

SEQ ID NO: 1958708 - DNA, 16 bp, Homo sapiens
tgtaaatgatatgtct

SEQ ID NO: 1958709 - DNA, 22 bp, Homo sapiens
tgtaaatgatatgtctttaaaa

SEQ ID NO: 1958710 - DNA, 18 bp, Homo sapiens
tgtaacagagttgaggtt

SEQ ID NO: 1958711 - DNA, 23 bp, Homo sapiens
tgtaactcacatgccttctaaac

SEQ ID NO: 1958712 - DNA, 17 bp, Homo sapiens
tgtaatattaaattcct

SEQ ID NO: 1958713 - DNA, 19 bp, Homo sapiens
tgtacaaaatatccaagcc

SEQ ID NO: 1958714 - DNA, 16 bp, Homo sapiens
tgtacatagtggtcat

SEQ ID NO: 1958715 - DNA, 20 bp, Homo sapiens
tgtacatagtggtcatttgg

SEQ ID NO: 1958716 - DNA, 23 bp, Homo sapiens
tgtacatagtggtcatttggtgg

SEQ ID NO: 1958717 - DNA, 19 bp, Homo sapiens
ttatactatttattaaaac

SEQ ID NO: 1958718 - DNA, 19 bp, Homo sapiens
ttatagcatgtaatattaa

SEQ ID NO: 1958719 - DNA, 18 bp, Homo sapiens
ttatagttcatagttgga

SEQ ID NO: 1958720 - DNA, 22 bp, Homo sapiens
ttatatcagactgctttgagaa

SEQ ID NO: 1958721 - DNA, 14 bp, Homo sapiens
ttatgatttcatga

SEQ ID NO: 1958722 - DNA, 16 bp, Homo sapiens
ttatgatttcatgatt

SEQ ID NO: 1958723 - DNA, 20 bp, Homo sapiens
ttatgcatgagaactaaata

SEQ ID NO: 1958724 - DNA, 21 bp, Homo sapiens
ttatggtactaatgaaattta

SEQ ID NO: 1958725 - DNA, 16 bp, Homo sapiens
ttatgtcaaatggatg

SEQ ID NO: 1958726 - DNA, 23 bp, Homo sapiens
ttattagaatataaaaaatgtta

SEQ ID NO: 1958727 - DNA, 22 bp, Homo sapiens
ttcaaataaccctgaatcagag

SEQ ID NO: 1958728 - DNA, 13 bp, Homo sapiens
ttcaaatgaagat

SEQ ID NO: 1958729 - DNA, 15 bp, Homo sapiens
ttcaaatgaagattc

SEQ ID NO: 1958730 - DNA, 17 bp, Homo sapiens
ttcaaattctctatgta

SEQ ID NO: 1958731 - DNA, 23 bp, Homo sapiens
ttcaaattctctatgtacagatg

SEQ ID NO: 1958732 - DNA, 15 bp, Homo sapiens
ttcaaattgcctttc

SEQ ID NO: 1958733 - DNA, 16 bp, Homo sapiens
ttcaagaatgtttcag

SEQ ID NO: 1958734 - DNA, 19 bp, Homo sapiens
ttcaatcattttgggaaat

SEQ ID NO: 1958735 - DNA, 16 bp, Homo sapiens
ttcaatgcttctttta

SEQ ID NO: 1958736 - DNA, 16 bp, Homo sapiens
ttcaattatgtttgaa

SEQ ID NO: 1958737 - DNA, 18 bp, Homo sapiens
ttcacaatttcaatgctt

SEQ ID NO: 1958738 - DNA, 21 bp, Homo sapiens
ttcaccttctgtgcatctggc

SEQ ID NO: 1958739 - DNA, 21 bp, Homo sapiens
ttcactacaacattagaatat

SEQ ID NO: 1958740 - DNA, 14 bp, Homo sapiens
ttcagaatgttgtg

SEQ ID NO: 1958741 - DNA, 19 bp, Homo sapiens
ttcagcagtgtctgttctt

SEQ ID NO: 1958742 - DNA, 23 bp, Homo sapiens
ttcatagataccattttgaaata

SEQ ID NO: 1958743 - DNA, 18 bp, Homo sapiens
ttcatagttggaaatatt

SEQ ID NO: 1958744 - DNA, 22 bp, Homo sapiens
ttcatttctatagccaaagctg

SEQ ID NO: 1958745 - DNA, 13 bp, Homo sapiens
ttcattttctctc

SEQ ID NO: 1958746 - DNA, 17 bp, Homo sapiens
ttcattttctctcctcg

SEQ ID NO: 1958747 - DNA, 16 bp, Homo sapiens
ttccagcagtttcatg

SEQ ID NO: 1958748 - DNA, 21 bp, Homo sapiens
ttccatcaaagccctccctgt

SEQ ID NO: 1958749 - DNA, 18 bp, Homo sapiens
ttccatgacagtagcata

SEQ ID NO: 1958750 - DNA, 15 bp, Homo sapiens
ttcccaaatctcaaa

SEQ ID NO: 1958751 - DNA, 18 bp, Homo sapiens
ttcccagctggcagcgcc

SEQ ID NO: 1958752 - DNA, 22 bp, Homo sapiens
ttcccagctggcagcgcctccc

SEQ ID NO: 1958753 - DNA, 15 bp, Homo sapiens
ttcccgcagcaccag

SEQ ID NO: 1958754 - DNA, 18 bp, Homo sapiens
ttccctcagccctcatta

SEQ ID NO: 1958755 - DNA, 16 bp, Homo sapiens
ttcccttgattcaaat

SEQ ID NO: 1958756 - DNA, 18 bp, Homo sapiens
ttcccttgattcaaataa

SEQ ID NO: 1958757 - DNA, 14 bp, Homo sapiens
ttccgtagcagttt

SEQ ID NO: 1958758 - DNA, 13 bp, Homo sapiens
ttccgttcatctg

SEQ ID NO: 1958759 - DNA, 14 bp, Homo sapiens
ttcctacttaaaca

SEQ ID NO: 1958760 - DNA, 22 bp, Homo sapiens
ttcctacttaaacaaaaacttt

SEQ ID NO: 1958761 - DNA, 15 bp, Homo sapiens
ttcctcccctggaag

SEQ ID NO: 1958762 - DNA, 16 bp, Homo sapiens
ttcctggaattagttg

SEQ ID NO: 1958763 - DNA, 16 bp, Homo sapiens
ttcctgtcctgctcac

SEQ ID NO: 1958764 - DNA, 21 bp, Homo sapiens
ttcctgtcctgctcacgtctg

SEQ ID NO: 1958765 - DNA, 15 bp, Homo sapiens
ttctaaaagtaataa

SEQ ID NO: 1958766 - DNA, 19 bp, Homo sapiens
ttctaaacgtgaactaaga

SEQ ID NO: 1958767 - DNA, 22 bp, Homo sapiens
ttctaaacgtgaactaagattt

SEQ ID NO: 1958768 - DNA, 12 bp, Homo sapiens
ttctacaaaaga

SEQ ID NO: 1958769 - DNA, 21 bp, Homo sapiens
ttctacaaaagaagtgtgact

SEQ ID NO: 1958770 - DNA, 14 bp, Homo sapiens
ttctagcaattgct

SEQ ID NO: 1958771 - DNA, 23 bp, Homo sapiens
ttctagctaaatgaccatccagt

SEQ ID NO: 1958772 - DNA, 21 bp, Homo sapiens
ttctagtgggtttaatgttta

SEQ ID NO: 1958773 - DNA, 17 bp, Homo sapiens
ttctatagccaaagctg

SEQ ID NO: 1958774 - DNA, 14 bp, Homo sapiens
ttctcagctccact

SEQ ID NO: 1958775 - DNA, 18 bp, Homo sapiens
ttctcagctccactctga

SEQ ID NO: 1958776 - DNA, 16 bp, Homo sapiens
ttctcccctccaagtg

SEQ ID NO: 1958777 - DNA, 22 bp, Homo sapiens
ttctcccctttcaaattgcctt

SEQ ID NO: 1958778 - DNA, 15 bp, Homo sapiens
ttctcctccaaatgc

SEQ ID NO: 1958779 - DNA, 17 bp, Homo sapiens
ttctcctccaaatgctg

SEQ ID NO: 1958780 - DNA, 14 bp, Homo sapiens
ttctctatgtacag

SEQ ID NO: 1958781 - DNA, 11 bp, Homo sapiens
ttctctctgtg

SEQ ID NO: 1958782 - DNA, 16 bp, Homo sapiens
ttctctctgtgtggca

SEQ ID NO: 1958783 - DNA, 12 bp, Homo sapiens
ttctctcttggt

SEQ ID NO: 1958784 - DNA, 14 bp, Homo sapiens
ttctgacagtgttt

SEQ ID NO: 1958785 - DNA, 15 bp, Homo sapiens
ttctgacagtgtttt

SEQ ID NO: 1958786 - DNA, 16 bp, Homo sapiens
ttctgatcctctcttc

SEQ ID NO: 1958787 - DNA, 14 bp, Homo sapiens
ttttagtcagaaat

SEQ ID NO: 1958788 - DNA, 15 bp, Homo sapiens
ttttagtcagaaatg

SEQ ID NO: 1958789 - DNA, 23 bp, Homo sapiens
ttttagtcagaaatgattcaggg

SEQ ID NO: 1958790 - DNA, 19 bp, Homo sapiens
ttttataaggctgactctt

SEQ ID NO: 1958791 - DNA, 20 bp, Homo sapiens
ttttataaggctgactctta

SEQ ID NO: 1958792 - DNA, 18 bp, Homo sapiens
ttttcaacaagcctgaaa

SEQ ID NO: 1958793 - DNA, 13 bp, Homo sapiens
ttttcaattatgt

SEQ ID NO: 1958794 - DNA, 21 bp, Homo sapiens
ttttcaattatgtttgaaaat

SEQ ID NO: 1958795 - DNA, 20 bp, Homo sapiens
ttttcaggttaaattattga

SEQ ID NO: 1958796 - DNA, 14 bp, Homo sapiens
ttttgatggctatg

SEQ ID NO: 1958797 - DNA, 22 bp, Homo sapiens
ttttggaaaacgatttaattta

SEQ ID NO: 1958798 - DNA, 18 bp, Homo sapiens
ttttgggatttgttgaaa

SEQ ID NO: 1958799 - DNA, 21 bp, Homo sapiens
ttttgttcaccttctgtgcat

SEQ ID NO: 1958800 - DNA, 15 bp, Homo sapiens
tttttcaattatgtt

SEQ ID NO: 1958801 - DNA, 13 bp, Homo sapiens
tttttttcaggtt

SEQ ID NO: 1958802 - DNA, 12 bp, Homo sapiens
ttttttttcagg

SEQ ID NO: 1958803 - DNA, 19 bp, Homo sapiens
aatttaggaatgctcaatg

SEQ ID NO: 1958804 - DNA, 20 bp, Homo sapiens
aatttcaagaatgtttcagt

SEQ ID NO: 1958805 - DNA, 14 bp, Homo sapiens
aatttcaatgcttc

SEQ ID NO: 1958806 - DNA, 18 bp, Homo sapiens
aatttcaatgcttctttt

SEQ ID NO: 1958807 - DNA, 23 bp, Homo sapiens
aatttcaatgcttcttttagtca

SEQ ID NO: 1958808 - DNA, 23 bp, Homo sapiens
aatttctcttaagtactgaaata

SEQ ID NO: 1958809 - DNA, 16 bp, Homo sapiens
aatttgcacacaaaac

SEQ ID NO: 1958810 - DNA, 21 bp, Homo sapiens
aattttaaaaaagatggattt

SEQ ID NO: 1958811 - DNA, 13 bp, Homo sapiens
aattttaactttt

SEQ ID NO: 1958812 - DNA, 21 bp, Homo sapiens
aattttataaggctgactctt

SEQ ID NO: 1958813 - DNA, 18 bp, Homo sapiens
acaaaacaacagcaacaa

SEQ ID NO: 1958814 - DNA, 21 bp, Homo sapiens
acaaaacaacagcaacaacaa

SEQ ID NO: 1958815 - DNA, 21 bp, Homo sapiens
acaaaacatcttaggcacttt

SEQ ID NO: 1958816 - DNA, 17 bp, Homo sapiens
acaaaagatatgaagaa

SEQ ID NO: 1958817 - DNA, 20 bp, Homo sapiens
acaaaatccttgccttcaaa

SEQ ID NO: 1958818 - DNA, 16 bp, Homo sapiens
acaaagaaaaaagaag

SEQ ID NO: 1958819 - DNA, 12 bp, Homo sapiens
acaaagcatgct

SEQ ID NO: 1958820 - DNA, 21 bp, Homo sapiens
acaaagcatgctcagtattga

SEQ ID NO: 1958821 - DNA, 11 bp, Homo sapiens
acaaataattt

SEQ ID NO: 1958822 - DNA, 14 bp, Homo sapiens
acaaataatttaga

SEQ ID NO: 1958823 - DNA, 19 bp, Homo sapiens
acaacaaagcatgctcagt

SEQ ID NO: 1958824 - DNA, 23 bp, Homo sapiens
acaacaaagcatgctcagtattg

SEQ ID NO: 1958825 - DNA, 15 bp, Homo sapiens
acaacaacaaagcat

SEQ ID NO: 1958826 - DNA, 22 bp, Homo sapiens
acaacaatttaggaatgctcaa

SEQ ID NO: 1958827 - DNA, 23 bp, Homo sapiens
acaacaatttaggaatgctcaat

SEQ ID NO: 1958828 - DNA, 23 bp, Homo sapiens
acaacacacacacacacaaaaca

SEQ ID NO: 1958829 - DNA, 12 bp, Homo sapiens
acaacagcaaca

SEQ ID NO: 1958830 - DNA, 15 bp, Homo sapiens
acaacattagaatat

SEQ ID NO: 1958831 - DNA, 15 bp, Homo sapiens
acaaccatgttcttg

SEQ ID NO: 1958832 - DNA, 16 bp, Homo sapiens
acaaccatgttcttga

SEQ ID NO: 1958833 - DNA, 23 bp, Homo sapiens
acaaccatgttcttgagcagctg

SEQ ID NO: 1958834 - DNA, 22 bp, Homo sapiens
acaagcctgaaagtaatttcaa

SEQ ID NO: 1958835 - DNA, 22 bp, Homo sapiens
acaaggttgctggcatttgctg

SEQ ID NO: 1958836 - DNA, 20 bp, Homo sapiens
acaagttacatacatttaaa

SEQ ID NO: 1958837 - DNA, 19 bp, Homo sapiens
acaagtttttttgttcata

SEQ ID NO: 1958838 - DNA, 19 bp, Homo sapiens
acaatactttgtgtctttt

SEQ ID NO: 1958839 - DNA, 12 bp, Homo sapiens
acaattctttgt

SEQ ID NO: 1958840 - DNA, 13 bp, Homo sapiens
acaattctttgtt

SEQ ID NO: 1958841 - DNA, 13 bp, Homo sapiens
acaatttctgtgt

SEQ ID NO: 1958842 - DNA, 12 bp, Homo sapiens
acacacaaaaca

SEQ ID NO: 1958843 - DNA, 21 bp, Homo sapiens
acacacaaaacaacagcaaca

SEQ ID NO: 1958844 - DNA, 15 bp, Homo sapiens
acacacacacacaaa

SEQ ID NO: 1958845 - DNA, 21 bp, Homo sapiens
acacagctgagctggcctatt

SEQ ID NO: 1958846 - DNA, 12 bp, Homo sapiens
acacagtagtgt

SEQ ID NO: 1958847 - DNA, 18 bp, Homo sapiens
acacagtagtgttctgtt

SEQ ID NO: 1958848 - DNA, 16 bp, Homo sapiens
acaccaaattgctgag

SEQ ID NO: 1958849 - DNA, 18 bp, Homo sapiens
acaccaaattgctgagat

SEQ ID NO: 1958850 - DNA, 20 bp, Homo sapiens
acaccaaattgctgagatgt

SEQ ID NO: 1958851 - DNA, 18 bp, Homo sapiens
acacgccggggctggccc

SEQ ID NO: 1958852 - DNA, 22 bp, Homo sapiens
acacgccggggctggccctgcc

SEQ ID NO: 1958853 - DNA, 17 bp, Homo sapiens
acactcaccgagaggaa

SEQ ID NO: 1958854 - DNA, 16 bp, Homo sapiens
acactcatcaggtaaa

SEQ ID NO: 1958855 - DNA, 23 bp, Homo sapiens
acactgatgggtcctgctgctcg

SEQ ID NO: 1958856 - DNA, 18 bp, Homo sapiens
acactgtcaagattaagt

SEQ ID NO: 1958857 - DNA, 22 bp, Homo sapiens
acactgtcaagattaagttata

SEQ ID NO: 1958858 - DNA, 14 bp, Homo sapiens
acagaaccagcact

SEQ ID NO: 1958859 - DNA, 21 bp, Homo sapiens
acagatcacatgcccctctta

SEQ ID NO: 1958860 - DNA, 17 bp, Homo sapiens
acagatgatgtaaaaat

SEQ ID NO: 1958861 - DNA, 21 bp, Homo sapiens
acagcaacaaagcataagaca

SEQ ID NO: 1958862 - DNA, 23 bp, Homo sapiens
acagcatgtgggtgtcagtgtca

SEQ ID NO: 1958863 - DNA, 20 bp, Homo sapiens
acagcggcccggcccacgca

SEQ ID NO: 1958864 - DNA, 23 bp, Homo sapiens
acaggattttcaagttattcaga

SEQ ID NO: 1958865 - DNA, 17 bp, Homo sapiens
acagggacacagtctgg

SEQ ID NO: 1958866 - DNA, 13 bp, Homo sapiens
acagtagtgttct

SEQ ID NO: 1958867 - DNA, 20 bp, Homo sapiens
acagtagtgttctgttcact

SEQ ID NO: 1958868 - DNA, 22 bp, Homo sapiens
acagtattgttcttgtaaaact

SEQ ID NO: 1958869 - DNA, 18 bp, Homo sapiens
acagtggggcccatggcc

SEQ ID NO: 1958870 - DNA, 20 bp, Homo sapiens
acagtgtggcttaaacattt

SEQ ID NO: 1958871 - DNA, 21 bp, Homo sapiens
acagtgtggcttaaacatttt

SEQ ID NO: 1958872 - DNA, 15 bp, Homo sapiens
acagtttgttcagtg

SEQ ID NO: 1958873 - DNA, 22 bp, Homo sapiens
acatattcccatggtagactgt

SEQ ID NO: 1958874 - DNA, 22 bp, Homo sapiens
acatcttaggcactttttaaca

SEQ ID NO: 1958875 - DNA, 16 bp, Homo sapiens
acatgatgatttcaga

SEQ ID NO: 1958876 - DNA, 22 bp, Homo sapiens
acattattagaatataaaaaat

SEQ ID NO: 1958877 - DNA, 14 bp, Homo sapiens
acattgccttatat

SEQ ID NO: 1958878 - DNA, 20 bp, Homo sapiens
acattttgtatgctgcatga

SEQ ID NO: 1958879 - DNA, 13 bp, Homo sapiens
accaaagaaaatt

SEQ ID NO: 1958880 - DNA, 13 bp, Homo sapiens
accaaattgctga

SEQ ID NO: 1958881 - DNA, 14 bp, Homo sapiens
accaaattgctgag

SEQ ID NO: 1958882 - DNA, 23 bp, Homo sapiens
accacggggtcgggggaggagca

SEQ ID NO: 1958883 - DNA, 21 bp, Homo sapiens
accagaaagaggaataaaatg

SEQ ID NO: 1958884 - DNA, 13 bp, Homo sapiens
accagcactccca

SEQ ID NO: 1958885 - DNA, 15 bp, Homo sapiens
accagcactcccagg

SEQ ID NO: 1958886 - DNA, 23 bp, Homo sapiens
accagcactcccagggcccgagc

SEQ ID NO: 1958887 - DNA, 12 bp, Homo sapiens
accagcctgagc

SEQ ID NO: 1958888 - DNA, 13 bp, Homo sapiens
accagcctgagcc

SEQ ID NO: 1958889 - DNA, 14 bp, Homo sapiens
accagcctgagcca

SEQ ID NO: 1958890 - DNA, 17 bp, Homo sapiens
accagttccctcagccc

SEQ ID NO: 1958891 - DNA, 13 bp, Homo sapiens
accatcccactga

SEQ ID NO: 1958892 - DNA, 15 bp, Homo sapiens
accatcccactgata

SEQ ID NO: 1958893 - DNA, 21 bp, Homo sapiens
accatcttgggattcctcccc

SEQ ID NO: 1958894 - DNA, 23 bp, Homo sapiens
accatgttcttgagcagctgaat

SEQ ID NO: 1958895 - DNA, 18 bp, Homo sapiens
accatttaatcatttcca

SEQ ID NO: 1958896 - DNA, 11 bp, Homo sapiens
acccagcctgg

SEQ ID NO: 1958897 - DNA, 19 bp, Homo sapiens
accccacacgccggggctg

SEQ ID NO: 1958898 - DNA, 20 bp, Homo sapiens
accccacacgccggggctgg

SEQ ID NO: 1958899 - DNA, 16 bp, Homo sapiens
acccccacctcccggt

SEQ ID NO: 1958900 - DNA, 20 bp, Homo sapiens
acccccagcctcccccaggc

SEQ ID NO: 1958901 - DNA, 14 bp, Homo sapiens
acccccattgtgaa

SEQ ID NO: 1958902 - DNA, 15 bp, Homo sapiens
accccgtcccggccc

SEQ ID NO: 1958903 - DNA, 14 bp, Homo sapiens
accccgtctgcccc

SEQ ID NO: 1958904 - DNA, 17 bp, Homo sapiens
acccgcccgcccccgcc

SEQ ID NO: 1958905 - DNA, 13 bp, Homo sapiens
accctcccctctc

SEQ ID NO: 1958906 - DNA, 14 bp, Homo sapiens
accctcccctctcc

SEQ ID NO: 1958907 - DNA, 20 bp, Homo sapiens
accctcttctcagctccact

SEQ ID NO: 1958908 - DNA, 13 bp, Homo sapiens
accctgccctgca

SEQ ID NO: 1958909 - DNA, 15 bp, Homo sapiens
accctgccctgcacc

SEQ ID NO: 1958910 - DNA, 14 bp, Homo sapiens
accctgggcctccc

SEQ ID NO: 1958911 - DNA, 18 bp, Homo sapiens
acccttctacaaaagaag

SEQ ID NO: 1958912 - DNA, 21 bp, Homo sapiens
accgagaggaaaaaggcttct

SEQ ID NO: 1958913 - DNA, 16 bp, Homo sapiens
accgcccaacccccac

SEQ ID NO: 1958914 - DNA, 20 bp, Homo sapiens
atctggaaaaaaaaaaatat

SEQ ID NO: 1958915 - DNA, 14 bp, Homo sapiens
atctgtcagcttcc

SEQ ID NO: 1958916 - DNA, 22 bp, Homo sapiens
atctgtcagcttcccaacaata

SEQ ID NO: 1958917 - DNA, 11 bp, Homo sapiens
atctgtcttta

SEQ ID NO: 1958918 - DNA, 21 bp, Homo sapiens
atctgtctttatgatttcatg

SEQ ID NO: 1958919 - DNA, 14 bp, Homo sapiens
atctgtttgcttct

SEQ ID NO: 1958920 - DNA, 15 bp, Homo sapiens
atctgtttgcttcta

SEQ ID NO: 1958921 - DNA, 16 bp, Homo sapiens
atctgtttgcttctaa

SEQ ID NO: 1958922 - DNA, 21 bp, Homo sapiens
atcttaggcactttttaacat

SEQ ID NO: 1958923 - DNA, 23 bp, Homo sapiens
atcttaggcactttttaacattc

SEQ ID NO: 1958924 - DNA, 24 bp, Homo sapiens
atcttaggcactttttaacattct

SEQ ID NO: 1958925 - DNA, 16 bp, Homo sapiens
atcttgaagtcattgt

SEQ ID NO: 1958926 - DNA, 19 bp, Homo sapiens
atcttggccctgttaaggc

SEQ ID NO: 1958927 - DNA, 23 bp, Homo sapiens
atcttgggattcctcccctggaa

SEQ ID NO: 1958928 - DNA, 18 bp, Homo sapiens
atgaaatataaactgtga

SEQ ID NO: 1958929 - DNA, 21 bp, Homo sapiens
atgaagccctaagtaaatcta

SEQ ID NO: 1958930 - DNA, 19 bp, Homo sapiens
atgaatatcaagaatagtt

SEQ ID NO: 1958931 - DNA, 22 bp, Homo sapiens
atgaatgaaatataaactgtga

SEQ ID NO: 1958932 - DNA, 14 bp, Homo sapiens
atgacagtagcata

SEQ ID NO: 1958933 - DNA, 15 bp, Homo sapiens
atgacctgaggaaag

SEQ ID NO: 1958934 - DNA, 16 bp, Homo sapiens
atgagaaatataaaaa

SEQ ID NO: 1958935 - DNA, 17 bp, Homo sapiens
atgagaactaaatagat

SEQ ID NO: 1958936 - DNA, 19 bp, Homo sapiens
atgagattggaaaaaatta

SEQ ID NO: 1958937 - DNA, 20 bp, Homo sapiens
atgaggcacgcctgccttct

SEQ ID NO: 1958938 - DNA, 15 bp, Homo sapiens
atgatatgtctttaa

SEQ ID NO: 1958939 - DNA, 20 bp, Homo sapiens
atgatatgtctttaaaatga

SEQ ID NO: 1958940 - DNA, 16 bp, Homo sapiens
atgatcaaggagggag

SEQ ID NO: 1958941 - DNA, 18 bp, Homo sapiens
atgatcaaggagggagaa

SEQ ID NO: 1958942 - DNA, 14 bp, Homo sapiens
atgatgatttcaga

SEQ ID NO: 1958943 - DNA, 22 bp, Homo sapiens
atgatggaagggccttctccac

SEQ ID NO: 1958944 - DNA, 22 bp, Homo sapiens
atgattaagtgcttgaggccaa

SEQ ID NO: 1958945 - DNA, 19 bp, Homo sapiens
atgattagacaatgtggaa

SEQ ID NO: 1958946 - DNA, 17 bp, Homo sapiens
atgattcacttttattg

SEQ ID NO: 1958947 - DNA, 18 bp, Homo sapiens
atgattcacttttattgt

SEQ ID NO: 1958948 - DNA, 15 bp, Homo sapiens
atgatttcagaaaca

SEQ ID NO: 1958949 - DNA, 13 bp, Homo sapiens
atgatttcatgat

SEQ ID NO: 1958950 - DNA, 19 bp, Homo sapiens
atgcaatttacttggaatt

SEQ ID NO: 1958951 - DNA, 18 bp, Homo sapiens
atgcacaccaaattgctg

SEQ ID NO: 1958952 - DNA, 19 bp, Homo sapiens
atgcacaccaaattgctga

SEQ ID NO: 1958953 - DNA, 21 bp, Homo sapiens
atgcacaccaaattgctgaga

SEQ ID NO: 1958954 - DNA, 23 bp, Homo sapiens
atgcagtattgagtgttctagtt

SEQ ID NO: 1958955 - DNA, 17 bp, Homo sapiens
atgcatgagaactaaat

SEQ ID NO: 1958956 - DNA, 21 bp, Homo sapiens
atgcatgagaactaaatagat

SEQ ID NO: 1958957 - DNA, 12 bp, Homo sapiens
atgcatttatgc

SEQ ID NO: 1958958 - DNA, 20 bp, Homo sapiens
atgcatttatgcatgagaac

SEQ ID NO: 1958959 - DNA, 16 bp, Homo sapiens
atgctcaatgtgctgt

SEQ ID NO: 1958960 - DNA, 17 bp, Homo sapiens
atgctcaatgtgctgtt

SEQ ID NO: 1958961 - DNA, 21 bp, Homo sapiens
atgctcaatgtgctgttgatt

SEQ ID NO: 1958962 - DNA, 13 bp, Homo sapiens
atgctcagtattg

SEQ ID NO: 1958963 - DNA, 14 bp, Homo sapiens
atgctgctgagcac

SEQ ID NO: 1958964 - DNA, 23 bp, Homo sapiens
atgcttcttttagtcagaaatga

SEQ ID NO: 1958965 - DNA, 13 bp, Homo sapiens
atgcttttctcat

SEQ ID NO: 1958966 - DNA, 14 bp, Homo sapiens
atgcttttctcatg

SEQ ID NO: 1958967 - DNA, 20 bp, Homo sapiens
atggagtagagtcaggagaa

SEQ ID NO: 1958968 - DNA, 18 bp, Homo sapiens
atggattcccctggacat

SEQ ID NO: 1958969 - DNA, 17 bp, Homo sapiens
atggcccattaagagtt

SEQ ID NO: 1958970 - DNA, 13 bp, Homo sapiens
atggccccagctg

SEQ ID NO: 1958971 - DNA, 14 bp, Homo sapiens
atggccccagctgg

SEQ ID NO: 1958972 - DNA, 17 bp, Homo sapiens
atggccccagctggctg

SEQ ID NO: 1958973 - DNA, 17 bp, Homo sapiens
atggctgttatctgtct

SEQ ID NO: 1958974 - DNA, 14 bp, Homo sapiens
atgggtcctgctgc

SEQ ID NO: 1958975 - DNA, 17 bp, Homo sapiens
atggtatatattttgaa

SEQ ID NO: 1958976 - DNA, 14 bp, Homo sapiens
atgtaaaaatatgt

SEQ ID NO: 1958977 - DNA, 16 bp, Homo sapiens
atgtaatattaaattc

SEQ ID NO: 1958978 - DNA, 12 bp, Homo sapiens
atgtacagatga

SEQ ID NO: 1958979 - DNA, 15 bp, Homo sapiens
atgtacctgagcata

SEQ ID NO: 1958980 - DNA, 14 bp, Homo sapiens
atgtctcaaaataa

SEQ ID NO: 1958981 - DNA, 15 bp, Homo sapiens
atgtctttaaaatga

SEQ ID NO: 1958982 - DNA, 20 bp, Homo sapiens
atgtgatcctaaaattgttt

SEQ ID NO: 1958983 - DNA, 13 bp, Homo sapiens
atgtgatttatgc

SEQ ID NO: 1958984 - DNA, 14 bp, Homo sapiens
atgtgatttatgca

SEQ ID NO: 1958985 - DNA, 16 bp, Homo sapiens
atgtgatttatgcatt

SEQ ID NO: 1958986 - DNA, 14 bp, Homo sapiens
atgtgccccttccc

SEQ ID NO: 1958987 - DNA, 12 bp, Homo sapiens
atgtgctgctgg

SEQ ID NO: 1958988 - DNA, 14 bp, Homo sapiens
atgtgctgctgtgg

SEQ ID NO: 1958989 - DNA, 16 bp, Homo sapiens
atgtgctgctgtggca

SEQ ID NO: 1958990 - DNA, 20 bp, Homo sapiens
atgtgctgttgattctttca

SEQ ID NO: 1958991 - DNA, 21 bp, Homo sapiens
atgtgctgttgattctttcaa

SEQ ID NO: 1958992 - DNA, 14 bp, Homo sapiens
atgtggaattacat

SEQ ID NO: 1958993 - DNA, 15 bp, Homo sapiens
atgtggaattacata

SEQ ID NO: 1958994 - DNA, 17 bp, Homo sapiens
atgtggaattacataac

SEQ ID NO: 1958995 - DNA, 16 bp, Homo sapiens
atgtgggtgtcagtgt

SEQ ID NO: 1958996 - DNA, 19 bp, Homo sapiens
atgttaattgatagaataa

SEQ ID NO: 1958997 - DNA, 14 bp, Homo sapiens
atgttagtaacttt

SEQ ID NO: 1958998 - DNA, 19 bp, Homo sapiens
atgttattactgaggaaag

SEQ ID NO: 1958999 - DNA, 14 bp, Homo sapiens
atgttatttctctg

SEQ ID NO: 1959000 - DNA, 18 bp, Homo sapiens
atgttcttgagcagctga

SEQ ID NO: 1959001 - DNA, 18 bp, Homo sapiens
atgttgaaaaagaaaaca

SEQ ID NO: 1959002 - DNA, 18 bp, Homo sapiens
atgttgtcctgtgtcatc

SEQ ID NO: 1959003 - DNA, 21 bp, Homo sapiens
atgttgtggaatatggcaata

SEQ ID NO: 1959004 - DNA, 18 bp, Homo sapiens
atgttgtgtgggttcaaa

SEQ ID NO: 1959005 - DNA, 14 bp, Homo sapiens
atgtttagtagctg

SEQ ID NO: 1959006 - DNA, 17 bp, Homo sapiens
atgttttggagagagca

SEQ ID NO: 1959007 - DNA, 19 bp, Homo sapiens
atgttttggagagagcaat

SEQ ID NO: 1959008 - DNA, 13 bp, Homo sapiens
attaaaaattata

SEQ ID NO: 1959009 - DNA, 13 bp, Homo sapiens
attaaaacaaaat

SEQ ID NO: 1959010 - DNA, 11 bp, Homo sapiens
attaaactaat

SEQ ID NO: 1959011 - DNA, 17 bp, Homo sapiens
attaaatgaaatacttg

SEQ ID NO: 1959012 - DNA, 23 bp, Homo sapiens
attaaattcctcctgtctcctct

SEQ ID NO: 1959013 - DNA, 16 bp, Homo sapiens
attaaccattgctaat

SEQ ID NO: 1959014 - DNA, 20 bp, Homo sapiens
attaatgtgatcctaaaatt

SEQ ID NO: 1959015 - DNA, 15 bp, Homo sapiens
attacataacaggca

SEQ ID NO: 1959016 - DNA, 20 bp, Homo sapiens
attacataacaggcattgca

SEQ ID NO: 1959017 - DNA, 13 bp, Homo sapiens
attactttgaaca

SEQ ID NO: 1959018 - DNA, 22 bp, Homo sapiens
attactttgaacattaatgttg

SEQ ID NO: 1959019 - DNA, 16 bp, Homo sapiens
attaggtttagaatca

SEQ ID NO: 1959020 - DNA, 18 bp, Homo sapiens
attatatcagactgcttt

SEQ ID NO: 1959021 - DNA, 19 bp, Homo sapiens
attatccttcacaatttca

SEQ ID NO: 1959022 - DNA, 22 bp, Homo sapiens
attatccttcacaatttcaatg

SEQ ID NO: 1959023 - DNA, 15 bp, Homo sapiens
attatctgatccttg

SEQ ID NO: 1959024 - DNA, 15 bp, Homo sapiens
attatgtcaaatgga

SEQ ID NO: 1959025 - DNA, 16 bp, Homo sapiens
attatgtcaaatggat

SEQ ID NO: 1959026 - DNA, 18 bp, Homo sapiens
ccatcttgaagtcattgt

SEQ ID NO: 1959027 - DNA, 12 bp, Homo sapiens
ccatcttgggat

SEQ ID NO: 1959028 - DNA, 23 bp, Homo sapiens
ccatcttgggattcctcccctgg

SEQ ID NO: 1959029 - DNA, 16 bp, Homo sapiens
ccatgacagtagcata

SEQ ID NO: 1959030 - DNA, 17 bp, Homo sapiens
ccatgccaatgtccagg

SEQ ID NO: 1959031 - DNA, 13 bp, Homo sapiens
ccatggccccagc

SEQ ID NO: 1959032 - DNA, 21 bp, Homo sapiens
ccatggccccagctggctggg

SEQ ID NO: 1959033 - DNA, 17 bp, Homo sapiens
ccatggtagactgtgac

SEQ ID NO: 1959034 - DNA, 18 bp, Homo sapiens
ccatggtagactgtgaca

SEQ ID NO: 1959035 - DNA, 17 bp, Homo sapiens
ccattgctaatttaaag

SEQ ID NO: 1959036 - DNA, 16 bp, Homo sapiens
ccatttaatcatttcc

SEQ ID NO: 1959037 - DNA, 21 bp, Homo sapiens
cccaacaatactttgtgtctt

SEQ ID NO: 1959038 - DNA, 19 bp, Homo sapiens
cccaacccccacctcccgg

SEQ ID NO: 1959039 - DNA, 22 bp, Homo sapiens
cccacaccccgtctgccccttg

SEQ ID NO: 1959040 - DNA, 17 bp, Homo sapiens
cccacacgccggggctg

SEQ ID NO: 1959041 - DNA, 21 bp, Homo sapiens
cccacacgccggggctggccc

SEQ ID NO: 1959042 - DNA, 22 bp, Homo sapiens
cccacacgccggggctggccct

SEQ ID NO: 1959043 - DNA, 22 bp, Homo sapiens
cccaccccgctgcctggcgggc

SEQ ID NO: 1959044 - DNA, 15 bp, Homo sapiens
cccacctcccggtgt

SEQ ID NO: 1959045 - DNA, 16 bp, Homo sapiens
cccacctgcccagtta

SEQ ID NO: 1959046 - DNA, 14 bp, Homo sapiens
cccacgcagagccc

SEQ ID NO: 1959047 - DNA, 16 bp, Homo sapiens
cccacgcagagccccg

SEQ ID NO: 1959048 - DNA, 13 bp, Homo sapiens
cccactagccctc

SEQ ID NO: 1959049 - DNA, 21 bp, Homo sapiens
cccactgatatcacgggcccg

SEQ ID NO: 1959050 - DNA, 20 bp, Homo sapiens
cccagaacgggcctccccgg

SEQ ID NO: 1959051 - DNA, 21 bp, Homo sapiens
cccagagactgcccaccctgg

SEQ ID NO: 1959052 - DNA, 22 bp, Homo sapiens
cccagagactgcccaccctggg

SEQ ID NO: 1959053 - DNA, 16 bp, Homo sapiens
cccagcctatctctct

SEQ ID NO: 1959054 - DNA, 11 bp, Homo sapiens
cccagcctccc

SEQ ID NO: 1959055 - DNA, 15 bp, Homo sapiens
cccagcctcccccag

SEQ ID NO: 1959056 - DNA, 21 bp, Homo sapiens
cccagctacaggggaggctga

SEQ ID NO: 1959057 - DNA, 13 bp, Homo sapiens
cccagctggcagc

SEQ ID NO: 1959058 - DNA, 16 bp, Homo sapiens
cccagctggcagcgcc

SEQ ID NO: 1959059 - DNA, 19 bp, Homo sapiens
cccagctggcagcgcctcc

SEQ ID NO: 1959060 - DNA, 15 bp, Homo sapiens
cccagctggctgggt

SEQ ID NO: 1959061 - DNA, 15 bp, Homo sapiens
cccaggcggaggggc

SEQ ID NO: 1959062 - DNA, 18 bp, Homo sapiens
cccaggcggaggggcttg

SEQ ID NO: 1959063 - DNA, 14 bp, Homo sapiens
cccaggctgcgcct

SEQ ID NO: 1959064 - DNA, 21 bp, Homo sapiens
cccaggctgcgcctgcccgcc

SEQ ID NO: 1959065 - DNA, 22 bp, Homo sapiens
cccatagtgccttgattttaat

SEQ ID NO: 1959066 - DNA, 18 bp, Homo sapiens
cccatccttcccgcagca

SEQ ID NO: 1959067 - DNA, 15 bp, Homo sapiens
cccatggccccagct

SEQ ID NO: 1959068 - DNA, 17 bp, Homo sapiens
cccatggccccagctgg

SEQ ID NO: 1959069 - DNA, 18 bp, Homo sapiens
cccatggccccagctggc

SEQ ID NO: 1959070 - DNA, 19 bp, Homo sapiens
cccattgtgaatgttgtcc

SEQ ID NO: 1959071 - DNA, 23 bp, Homo sapiens
cccattgtgaatgttgtcctgtg

SEQ ID NO: 1959072 - DNA, 19 bp, Homo sapiens
ccccacacgccggggctgg

SEQ ID NO: 1959073 - DNA, 21 bp, Homo sapiens
ccccacacgccggggctggcc

SEQ ID NO: 1959074 - DNA, 16 bp, Homo sapiens
ccccagcctcccccag

SEQ ID NO: 1959075 - DNA, 22 bp, Homo sapiens
ccccagctggctgggtcgcccc

SEQ ID NO: 1959076 - DNA, 14 bp, Homo sapiens
ccccaggctgcgcc

SEQ ID NO: 1959077 - DNA, 22 bp, Homo sapiens
ccccaggctgcgcctgcccgcc

SEQ ID NO: 1959078 - DNA, 16 bp, Homo sapiens
ccccagggtgcaggcg

SEQ ID NO: 1959079 - DNA, 13 bp, Homo sapiens
ccccatccttccc

SEQ ID NO: 1959080 - DNA, 21 bp, Homo sapiens
ccccatgaaacttgagcattc

SEQ ID NO: 1959081 - DNA, 19 bp, Homo sapiens
ccccatgccaatgtccagg

SEQ ID NO: 1959082 - DNA, 21 bp, Homo sapiens
cccccagcctcccccaggctg

SEQ ID NO: 1959083 - DNA, 20 bp, Homo sapiens
cccccaggctgcgcctgccc

SEQ ID NO: 1959084 - DNA, 13 bp, Homo sapiens
cccccattgtgaa

SEQ ID NO: 1959085 - DNA, 20 bp, Homo sapiens
cccccattgtgaatgttgtc

SEQ ID NO: 1959086 - DNA, 14 bp, Homo sapiens
ccccctcccccgca

SEQ ID NO: 1959087 - DNA, 23 bp, Homo sapiens
ccccgcccgccctcctctgcccc

SEQ ID NO: 1959088 - DNA, 19 bp, Homo sapiens
ccccgcgcgtgcccccagc

SEQ ID NO: 1959089 - DNA, 12 bp, Homo sapiens
ccccgctgcctg

SEQ ID NO: 1959090 - DNA, 15 bp, Homo sapiens
ccccgctgcctggcg

SEQ ID NO: 1959091 - DNA, 21 bp, Homo sapiens
ccccgctgcctggcgggcagc

SEQ ID NO: 1959092 - DNA, 20 bp, Homo sapiens
ccccggagcaccacggggtc

SEQ ID NO: 1959093 - DNA, 14 bp, Homo sapiens
ccccgtctgcccct

SEQ ID NO: 1959094 - DNA, 14 bp, Homo sapiens
ccccgtgcggcccg

SEQ ID NO: 1959095 - DNA, 14 bp, Homo sapiens
cccctcccccgcag

SEQ ID NO: 1959096 - DNA, 19 bp, Homo sapiens
cccctcctcgggcgcctgc

SEQ ID NO: 1959097 - DNA, 11 bp, Homo sapiens
cccctcctctc

SEQ ID NO: 1959098 - DNA, 21 bp, Homo sapiens
cccctctcgggctctctcacc

SEQ ID NO: 1959099 - DNA, 14 bp, Homo sapiens
cccctgctggacca

SEQ ID NO: 1959100 - DNA, 20 bp, Homo sapiens
cccgagcgcgtgccttcccc

SEQ ID NO: 1959101 - DNA, 16 bp, Homo sapiens
cccgcagacagacaga

SEQ ID NO: 1959102 - DNA, 12 bp, Homo sapiens
cccgcagcacca

SEQ ID NO: 1959103 - DNA, 15 bp, Homo sapiens
cccgcagcaccagcc

SEQ ID NO: 1959104 - DNA, 18 bp, Homo sapiens
cccgcagcaccagcctga

SEQ ID NO: 1959105 - DNA, 17 bp, Homo sapiens
cccgcccaccccgctgc

SEQ ID NO: 1959106 - DNA, 11 bp, Homo sapiens
cccgccccaga

SEQ ID NO: 1959107 - DNA, 20 bp, Homo sapiens
cccgccccagagactgccca

SEQ ID NO: 1959108 - DNA, 15 bp, Homo sapiens
cccgcccccgccctc

SEQ ID NO: 1959109 - DNA, 15 bp, Homo sapiens
cccgcccgccctcct

SEQ ID NO: 1959110 - DNA, 14 bp, Homo sapiens
cccgccctcctctg

SEQ ID NO: 1959111 - DNA, 17 bp, Homo sapiens
cccgccctcctctgccc

SEQ ID NO: 1959112 - DNA, 21 bp, Homo sapiens
cccgccctcctctgccccctc

SEQ ID NO: 1959113 - DNA, 21 bp, Homo sapiens
cccgccggttggccggctggc

SEQ ID NO: 1959114 - DNA, 22 bp, Homo sapiens
cccgccggttggccggctggcc

SEQ ID NO: 1959115 - DNA, 15 bp, Homo sapiens
cccgctgcctggcgg

SEQ ID NO: 1959116 - DNA, 20 bp, Homo sapiens
cccgctgcctggcgggcagc

SEQ ID NO: 1959117 - DNA, 16 bp, Homo sapiens
cccggaggcgcccacc

SEQ ID NO: 1959118 - DNA, 16 bp, Homo sapiens
cccggccaaggacact

SEQ ID NO: 1959119 - DNA, 13 bp, Homo sapiens
cccggcccacgca

SEQ ID NO: 1959120 - DNA, 15 bp, Homo sapiens
cccggcccacgcaga

SEQ ID NO: 1959121 - DNA, 13 bp, Homo sapiens
cccggccccgcgc

SEQ ID NO: 1959122 - DNA, 16 bp, Homo sapiens
cccgggggtccccgga

SEQ ID NO: 1959123 - DNA, 17 bp, Homo sapiens
cccggtgtatgcagtgg

SEQ ID NO: 1959124 - DNA, 14 bp, Homo sapiens
cccgtccgtccgcc

SEQ ID NO: 1959125 - DNA, 16 bp, Homo sapiens
cccgtgcgcagccgcg

SEQ ID NO: 1959126 - DNA, 13 bp, Homo sapiens
ccctcagccctca

SEQ ID NO: 1959127 - DNA, 14 bp, Homo sapiens
ccctcccccacggc

SEQ ID NO: 1959128 - DNA, 14 bp, Homo sapiens
ccctcccccgcaga

SEQ ID NO: 1959129 - DNA, 17 bp, Homo sapiens
ccctcccccgcagacag

SEQ ID NO: 1959130 - DNA, 22 bp, Homo sapiens
ccctcccctctcctgagcctgt

SEQ ID NO: 1959131 - DNA, 14 bp, Homo sapiens
ccctccgtccccag

SEQ ID NO: 1959132 - DNA, 19 bp, Homo sapiens
ccctccgtccccagggtgc

SEQ ID NO: 1959133 - DNA, 15 bp, Homo sapiens
ccctcggtcagcacc

SEQ ID NO: 1959134 - DNA, 20 bp, Homo sapiens
ccctcggtcagcaccgtggt

SEQ ID NO: 1959135 - DNA, 21 bp, Homo sapiens
ccctcggtcagcaccgtggtg

SEQ ID NO: 1959136 - DNA, 19 bp, Homo sapiens
ccctctcgggctctctcac

SEQ ID NO: 1959137 - DNA, 15 bp, Homo sapiens
ccctcttctcagctc

SEQ ID NO: 1959138 - DNA, 18 bp, Homo sapiens
ctcagtaaatcagtgcag

SEQ ID NO: 1959139 - DNA, 16 bp, Homo sapiens
ctcagtaacagtgcag

SEQ ID NO: 1959140 - DNA, 21 bp, Homo sapiens
ctcagtattgagacactgtca

SEQ ID NO: 1959141 - DNA, 23 bp, Homo sapiens
ctcagtattgagacactgtcaag

SEQ ID NO: 1959142 - DNA, 18 bp, Homo sapiens
ctcagttaggcagtgcag

SEQ ID NO: 1959143 - DNA, 20 bp, Homo sapiens
ctcatcagaaacaatttctg

SEQ ID NO: 1959144 - DNA, 15 bp, Homo sapiens
ctcatcttttcctgc

SEQ ID NO: 1959145 - DNA, 18 bp, Homo sapiens
ctcatggctgttatctgt

SEQ ID NO: 1959146 - DNA, 15 bp, Homo sapiens
ctcattgttcagaaa

SEQ ID NO: 1959147 - DNA, 15 bp, Homo sapiens
ctcatttcattattt

SEQ ID NO: 1959148 - DNA, 12 bp, Homo sapiens
ctcattttattc

SEQ ID NO: 1959149 - DNA, 23 bp, Homo sapiens
ctccacagggacacagtctggtg

SEQ ID NO: 1959150 - DNA, 14 bp, Homo sapiens
ctccaccctcccct

SEQ ID NO: 1959151 - DNA, 18 bp, Homo sapiens
ctccactctgaagtccct

SEQ ID NO: 1959152 - DNA, 15 bp, Homo sapiens
ctccagaagcagcag

SEQ ID NO: 1959153 - DNA, 22 bp, Homo sapiens
ctccagaagcagcagctagaaa

SEQ ID NO: 1959154 - DNA, 21 bp, Homo sapiens
ctccatggtgaactgaagcag

SEQ ID NO: 1959155 - DNA, 15 bp, Homo sapiens
ctcccagggcccgag

SEQ ID NO: 1959156 - DNA, 23 bp, Homo sapiens
ctcccagggcccgagcgcgtgcc

SEQ ID NO: 1959157 - DNA, 11 bp, Homo sapiens
ctcccccaggc

SEQ ID NO: 1959158 - DNA, 19 bp, Homo sapiens
ctccccgcccgccctcctc

SEQ ID NO: 1959159 - DNA, 19 bp, Homo sapiens
ctccccgggggtccccgga

SEQ ID NO: 1959160 - DNA, 14 bp, Homo sapiens
ctcccctctcctga

SEQ ID NO: 1959161 - DNA, 19 bp, Homo sapiens
ctcccctcttcttgcggca

SEQ ID NO: 1959162 - DNA, 12 bp, Homo sapiens
ctcccctttcaa

SEQ ID NO: 1959163 - DNA, 20 bp, Homo sapiens
ctcccgccgcctcgggccgc

SEQ ID NO: 1959164 - DNA, 19 bp, Homo sapiens
ctccctaccctcttctcag

SEQ ID NO: 1959165 - DNA, 14 bp, Homo sapiens
ctccctgtctgtct

SEQ ID NO: 1959166 - DNA, 13 bp, Homo sapiens
ctcccttttcaga

SEQ ID NO: 1959167 - DNA, 12 bp, Homo sapiens
ctccggcagagg

SEQ ID NO: 1959168 - DNA, 17 bp, Homo sapiens
ctccggcagaggcaggg

SEQ ID NO: 1959169 - DNA, 21 bp, Homo sapiens
ctccggcagaggcagggccct

SEQ ID NO: 1959170 - DNA, 23 bp, Homo sapiens
ctccggcagaggcagggccctgg

SEQ ID NO: 1959171 - DNA, 13 bp, Homo sapiens
ctccgtccccagg

SEQ ID NO: 1959172 - DNA, 14 bp, Homo sapiens
ctccgtccccaggg

SEQ ID NO: 1959173 - DNA, 14 bp, Homo sapiens
ctcctccagactcg

SEQ ID NO: 1959174 - DNA, 21 bp, Homo sapiens
ctcctccagactcgagagggc

SEQ ID NO: 1959175 - DNA, 17 bp, Homo sapiens
ctcctccagtacaataa

SEQ ID NO: 1959176 - DNA, 23 bp, Homo sapiens
ctcctccagtacaataaataaaa

SEQ ID NO: 1959177 - DNA, 20 bp, Homo sapiens
ctcctccagttctgatgagg

SEQ ID NO: 1959178 - DNA, 21 bp, Homo sapiens
ctcctcgggcgcctgcgctcc

SEQ ID NO: 1959179 - DNA, 20 bp, Homo sapiens
ctcctcggtggcatttgctg

SEQ ID NO: 1959180 - DNA, 22 bp, Homo sapiens
ctcctcggtggcatttgctgaa

SEQ ID NO: 1959181 - DNA, 20 bp, Homo sapiens
ctcctcgtccggcctgcagc

SEQ ID NO: 1959182 - DNA, 23 bp, Homo sapiens
ctcctcgtccggcctgcagccca

SEQ ID NO: 1959183 - DNA, 16 bp, Homo sapiens
ctcctctgcagcctga

SEQ ID NO: 1959184 - DNA, 18 bp, Homo sapiens
ctcctctgcagcctgagc

SEQ ID NO: 1959185 - DNA, 21 bp, Homo sapiens
ctcctctgcagcctgagctcc

SEQ ID NO: 1959186 - DNA, 12 bp, Homo sapiens
ctcctctgcccc

SEQ ID NO: 1959187 - DNA, 16 bp, Homo sapiens
ctcctgctgaccttct

SEQ ID NO: 1959188 - DNA, 13 bp, Homo sapiens
ctcctgtctcctc

SEQ ID NO: 1959189 - DNA, 18 bp, Homo sapiens
ctcctgtctcctctgtca

SEQ ID NO: 1959190 - DNA, 13 bp, Homo sapiens
ctccttcatgctt

SEQ ID NO: 1959191 - DNA, 14 bp, Homo sapiens
ctccttcatgcttt

SEQ ID NO: 1959192 - DNA, 15 bp, Homo sapiens
ctcgagagggctgag

SEQ ID NO: 1959193 - DNA, 18 bp, Homo sapiens
ctcgagagggctgagccc

SEQ ID NO: 1959194 - DNA, 20 bp, Homo sapiens
ctcgagagggctgagcccct

SEQ ID NO: 1959195 - DNA, 21 bp, Homo sapiens
ctcgagagggctgagcccctc

SEQ ID NO: 1959196 - DNA, 13 bp, Homo sapiens
ctcggacaccatc

SEQ ID NO: 1959197 - DNA, 20 bp, Homo sapiens
ctcggccgaggcctgcgccc

SEQ ID NO: 1959198 - DNA, 13 bp, Homo sapiens
ctcgggaaggcct

SEQ ID NO: 1959199 - DNA, 12 bp, Homo sapiens
ctcgggccgcct

SEQ ID NO: 1959200 - DNA, 21 bp, Homo sapiens
ctcgggccgcctcctccagac

SEQ ID NO: 1959201 - DNA, 22 bp, Homo sapiens
ctcgggccgcctcctccagact

SEQ ID NO: 1959202 - DNA, 16 bp, Homo sapiens
ctcgggcgcctgcgct

SEQ ID NO: 1959203 - DNA, 15 bp, Homo sapiens
ctcgggctctctcac

SEQ ID NO: 1959204 - DNA, 13 bp, Homo sapiens
ctcggtggcattt

SEQ ID NO: 1959205 - DNA, 14 bp, Homo sapiens
ctcgtgcatgtaat

SEQ ID NO: 1959206 - DNA, 22 bp, Homo sapiens
ctctaagaaatggctttccaca

SEQ ID NO: 1959207 - DNA, 18 bp, Homo sapiens
ctctcagatccctcggtc

SEQ ID NO: 1959208 - DNA, 12 bp, Homo sapiens
ctctcattccca

SEQ ID NO: 1959209 - DNA, 20 bp, Homo sapiens
ctctccctaccctcttctca

SEQ ID NO: 1959210 - DNA, 21 bp, Homo sapiens
ctctccctaccctcttctcag

SEQ ID NO: 1959211 - DNA, 22 bp, Homo sapiens
ctctccctaccctcttctcagc

SEQ ID NO: 1959212 - DNA, 16 bp, Homo sapiens
ctctcccttttcagat

SEQ ID NO: 1959213 - DNA, 13 bp, Homo sapiens
ctctcctcggtgg

SEQ ID NO: 1959214 - DNA, 22 bp, Homo sapiens
ctctcctcgtccggcctgcagc

SEQ ID NO: 1959215 - DNA, 16 bp, Homo sapiens
ctctcctgagcctgtc

SEQ ID NO: 1959216 - DNA, 14 bp, Homo sapiens
ctctctctctgttc

SEQ ID NO: 1959217 - DNA, 20 bp, Homo sapiens
ctctctgaactgcaacactg

SEQ ID NO: 1959218 - DNA, 24 bp, Homo sapiens
ctctctgttccaagtgtgtgtgca

SEQ ID NO: 1959219 - DNA, 13 bp, Homo sapiens
ctctcttggtctc

SEQ ID NO: 1959220 - DNA, 15 bp, Homo sapiens
ctctcttggtctctt

SEQ ID NO: 1959221 - DNA, 13 bp, Homo sapiens
ctctgaagtccct

SEQ ID NO: 1959222 - DNA, 24 bp, Homo sapiens
ctctgaagtcccttcctgtcctgc

SEQ ID NO: 1959223 - DNA, 21 bp, Homo sapiens
ctctgaatctctcaaaatgtg

SEQ ID NO: 1959224 - DNA, 22 bp, Homo sapiens
ctctgaatctctcaaaatgtgc

SEQ ID NO: 1959225 - DNA, 18 bp, Homo sapiens
ctctgagcagtggggagc

SEQ ID NO: 1959226 - DNA, 14 bp, Homo sapiens
ctctgccccctccc

SEQ ID NO: 1959227 - DNA, 15 bp, Homo sapiens
ctctgccccctcccc

SEQ ID NO: 1959228 - DNA, 17 bp, Homo sapiens
ctctgccccctcccccg

SEQ ID NO: 1959229 - DNA, 23 bp, Homo sapiens
ctctgcccctccgtccccagggt

SEQ ID NO: 1959230 - DNA, 17 bp, Homo sapiens
ctctgtcctctgctttg

SEQ ID NO: 1959231 - DNA, 12 bp, Homo sapiens
ctctgtgtggca

SEQ ID NO: 1959232 - DNA, 19 bp, Homo sapiens
ctctgtgtggcaaacattt

SEQ ID NO: 1959233 - DNA, 18 bp, Homo sapiens
ctctgttccaagtgtgtg

SEQ ID NO: 1959234 - DNA, 20 bp, Homo sapiens
ctctgttccaagtgtgtgtg

SEQ ID NO: 1959235 - DNA, 20 bp, Homo sapiens
ctcttcatgcgcagtcccca

SEQ ID NO: 1959236 - DNA, 15 bp, Homo sapiens
ctcttccttacaggt

SEQ ID NO: 1959237 - DNA, 16 bp, Homo sapiens
ctcttctcagctccac

SEQ ID NO: 1959238 - DNA, 19 bp, Homo sapiens
ctcttctcagctccactct

SEQ ID NO: 1959239 - DNA, 20 bp, Homo sapiens
ctcttctcagctccactctg

SEQ ID NO: 1959240 - DNA, 16 bp, Homo sapiens
ctcttcttttcccatt

SEQ ID NO: 1959241 - DNA, 16 bp, Homo sapiens
ctcttgaatgcttaaa

SEQ ID NO: 1959242 - DNA, 18 bp, Homo sapiens
ctcttggtctctttcttt

SEQ ID NO: 1959243 - DNA, 21 bp, Homo sapiens
ctcttggtctctttctttcca

SEQ ID NO: 1959244 - DNA, 15 bp, Homo sapiens
ctctttctctctgtg

SEQ ID NO: 1959245 - DNA, 12 bp, Homo sapiens
ctctttctttcc

SEQ ID NO: 1959246 - DNA, 18 bp, Homo sapiens
ctgaaattatgtcaaatg

SEQ ID NO: 1959247 - DNA, 20 bp, Homo sapiens
ctgaagcagagtcaagctga

SEQ ID NO: 1959248 - DNA, 16 bp, Homo sapiens
ctgaataacaacaatt

SEQ ID NO: 1959249 - DNA, 20 bp, Homo sapiens
gagggctgagcccctcctct

SEQ ID NO: 1959250 - DNA, 21 bp, Homo sapiens
gagggctgagcccctcctctc

SEQ ID NO: 1959251 - DNA, 21 bp, Homo sapiens
gaggggcttggagcagagacg

SEQ ID NO: 1959252 - DNA, 20 bp, Homo sapiens
gagtccactttcctctctct

SEQ ID NO: 1959253 - DNA, 22 bp, Homo sapiens
gagtcctcattgttcagaaaag

SEQ ID NO: 1959254 - DNA, 16 bp, Homo sapiens
gagtcggctgggcagg

SEQ ID NO: 1959255 - DNA, 17 bp, Homo sapiens
gagtcggctgggcaggg

SEQ ID NO: 1959256 - DNA, 19 bp, Homo sapiens
gagtcggctgggcagggcc

SEQ ID NO: 1959257 - DNA, 17 bp, Homo sapiens
gataaatatcattatag

SEQ ID NO: 1959258 - DNA, 19 bp, Homo sapiens
gataattaaatgaaatact

SEQ ID NO: 1959259 - DNA, 17 bp, Homo sapiens
gataccattttgaaata

SEQ ID NO: 1959260 - DNA, 13 bp, Homo sapiens
gatagctccttca

SEQ ID NO: 1959261 - DNA, 17 bp, Homo sapiens
gataggagaggaaaagg

SEQ ID NO: 1959262 - DNA, 16 bp, Homo sapiens
gatatcaatcagtaat

SEQ ID NO: 1959263 - DNA, 21 bp, Homo sapiens
gatatgaagaactattatatt

SEQ ID NO: 1959264 - DNA, 19 bp, Homo sapiens
gatcaaggagggagaaagg

SEQ ID NO: 1959265 - DNA, 14 bp, Homo sapiens
gatcactttctgaa

SEQ ID NO: 1959266 - DNA, 18 bp, Homo sapiens
gatcctaaaattgtttcc

SEQ ID NO: 1959267 - DNA, 16 bp, Homo sapiens
gatctcctgtgcacct

SEQ ID NO: 1959268 - DNA, 16 bp, Homo sapiens
gatctggtgcgtgtgg

SEQ ID NO: 1959269 - DNA, 17 bp, Homo sapiens
gatctggtgcgtgtggc

SEQ ID NO: 1959270 - DNA, 21 bp, Homo sapiens
gatctggtgcgtgtggccctg

SEQ ID NO: 1959271 - DNA, 22 bp, Homo sapiens
gatctggtgcgtgtggccctgt

SEQ ID NO: 1959272 - DNA, 14 bp, Homo sapiens
gatgagacaacaca

SEQ ID NO: 1959273 - DNA, 21 bp, Homo sapiens
gatgaggctggataggagagg

SEQ ID NO: 1959274 - DNA, 17 bp, Homo sapiens
gatggaaaaagaatata

SEQ ID NO: 1959275 - DNA, 15 bp, Homo sapiens
gatggatttgacaca

SEQ ID NO: 1959276 - DNA, 14 bp, Homo sapiens
gatgggtcctgctg

SEQ ID NO: 1959277 - DNA, 17 bp, Homo sapiens
gatgtacattaaatacc

SEQ ID NO: 1959278 - DNA, 19 bp, Homo sapiens
gatgtcacagtttgttcag

SEQ ID NO: 1959279 - DNA, 17 bp, Homo sapiens
gatgtgatttatgcatt

SEQ ID NO: 1959280 - DNA, 15 bp, Homo sapiens
gatgtttagtagctg

SEQ ID NO: 1959281 - DNA, 17 bp, Homo sapiens
gatgtttagtagctgat

SEQ ID NO: 1959282 - DNA, 20 bp, Homo sapiens
gattaagttataccagcaaa

SEQ ID NO: 1959283 - DNA, 22 bp, Homo sapiens
gattaagttataccagcaaaag

SEQ ID NO: 1959284 - DNA, 14 bp, Homo sapiens
gattagacaatgtg

SEQ ID NO: 1959285 - DNA, 19 bp, Homo sapiens
gattagtagaaaatacatt

SEQ ID NO: 1959286 - DNA, 18 bp, Homo sapiens
gattcaaataaccctgaa

SEQ ID NO: 1959287 - DNA, 20 bp, Homo sapiens
gattcaatcattttgggaaa

SEQ ID NO: 1959288 - DNA, 17 bp, Homo sapiens
gattcctacttaaacaa

SEQ ID NO: 1959289 - DNA, 18 bp, Homo sapiens
gattcctcccctggaagt

SEQ ID NO: 1959290 - DNA, 12 bp, Homo sapiens
gattgacatttt

SEQ ID NO: 1959291 - DNA, 18 bp, Homo sapiens
gattgacattttgtagct

SEQ ID NO: 1959292 - DNA, 21 bp, Homo sapiens
gattgacattttgtagctagt

SEQ ID NO: 1959293 - DNA, 16 bp, Homo sapiens
gattgcatattttgtt

SEQ ID NO: 1959294 - DNA, 13 bp, Homo sapiens
gatttatgcattt

SEQ ID NO: 1959295 - DNA, 15 bp, Homo sapiens
gatttgcactgcttt

SEQ ID NO: 1959296 - DNA, 16 bp, Homo sapiens
gattttaattcaggtg

SEQ ID NO: 1959297 - DNA, 18 bp, Homo sapiens
gcaaaatacatgatgatt

SEQ ID NO: 1959298 - DNA, 15 bp, Homo sapiens
gcaaacatttaaaaa

SEQ ID NO: 1959299 - DNA, 11 bp, Homo sapiens
gcaaggatcac

SEQ ID NO: 1959300 - DNA, 12 bp, Homo sapiens
gcaatagcattg

SEQ ID NO: 1959301 - DNA, 19 bp, Homo sapiens
gcaatatcatattctaaaa

SEQ ID NO: 1959302 - DNA, 15 bp, Homo sapiens
gcaatcttgctgtga

SEQ ID NO: 1959303 - DNA, 17 bp, Homo sapiens
gcaatcttgctgtgaaa

SEQ ID NO: 1959304 - DNA, 23 bp, Homo sapiens
gcaatgttccgttcatctgagga

SEQ ID NO: 1959305 - DNA, 17 bp, Homo sapiens
gcacaaccatgttcttg

SEQ ID NO: 1959306 - DNA, 21 bp, Homo sapiens
gcacaagtttttttgttcata

SEQ ID NO: 1959307 - DNA, 13 bp, Homo sapiens
gcacacataacac

SEQ ID NO: 1959308 - DNA, 14 bp, Homo sapiens
gcacacataacaca

SEQ ID NO: 1959309 - DNA, 23 bp, Homo sapiens
gcacacctcggccgaggcctgcg

SEQ ID NO: 1959310 - DNA, 15 bp, Homo sapiens
gcaccacggggtcgg

SEQ ID NO: 1959311 - DNA, 16 bp, Homo sapiens
gcaccagcctgagcca

SEQ ID NO: 1959312 - DNA, 19 bp, Homo sapiens
gcaccagcctgagccacag

SEQ ID NO: 1959313 - DNA, 11 bp, Homo sapiens
gcacccccagc

SEQ ID NO: 1959314 - DNA, 18 bp, Homo sapiens
gcacccccagcctccccc

SEQ ID NO: 1959315 - DNA, 20 bp, Homo sapiens
gcaccgcccaacccccacct

SEQ ID NO: 1959316 - DNA, 22 bp, Homo sapiens
gcaccgcccaacccccacctcc

SEQ ID NO: 1959317 - DNA, 13 bp, Homo sapiens
gcaccgcccaccc

SEQ ID NO: 1959318 - DNA, 14 bp, Homo sapiens
gcaccgcccaccca

SEQ ID NO: 1959319 - DNA, 19 bp, Homo sapiens
gcaccgcccacccacaccc

SEQ ID NO: 1959320 - DNA, 17 bp, Homo sapiens
gcaccgtggtgtgaggc

SEQ ID NO: 1959321 - DNA, 13 bp, Homo sapiens
gcacctttcctga

SEQ ID NO: 1959322 - DNA, 15 bp, Homo sapiens
gcacgcctgccttct

SEQ ID NO: 1959323 - DNA, 15 bp, Homo sapiens
gcacgggagagcgcc

SEQ ID NO: 1959324 - DNA, 22 bp, Homo sapiens
gcactaaaagtgatgtgattta

SEQ ID NO: 1959325 - DNA, 18 bp, Homo sapiens
gcactcccagggcccgag

SEQ ID NO: 1959326 - DNA, 21 bp, Homo sapiens
gcactttttaacattctcaat

SEQ ID NO: 1959327 - DNA, 15 bp, Homo sapiens
gcagagacggcagcc

SEQ ID NO: 1959328 - DNA, 22 bp, Homo sapiens
gcagagacggcagccccatcct

SEQ ID NO: 1959329 - DNA, 11 bp, Homo sapiens
gcagagccccg

SEQ ID NO: 1959330 - DNA, 20 bp, Homo sapiens
gcagagccccggagcaccac

SEQ ID NO: 1959331 - DNA, 22 bp, Homo sapiens
gcagagctgagtcggctgggca

SEQ ID NO: 1959332 - DNA, 12 bp, Homo sapiens
gcagaggcaggg

SEQ ID NO: 1959333 - DNA, 14 bp, Homo sapiens
gcagaggcagggcc

SEQ ID NO: 1959334 - DNA, 15 bp, Homo sapiens
gcagagtcaagctga

SEQ ID NO: 1959335 - DNA, 16 bp, Homo sapiens
gcagagtcaagctgat

SEQ ID NO: 1959336 - DNA, 14 bp, Homo sapiens
gcagcaccagcctg

SEQ ID NO: 1959337 - DNA, 15 bp, Homo sapiens
gcagcaccagcctga

SEQ ID NO: 1959338 - DNA, 15 bp, Homo sapiens
gcagcagcagcagca

SEQ ID NO: 1959339 - DNA, 16 bp, Homo sapiens
gcagcagtaccatccc

SEQ ID NO: 1959340 - DNA, 17 bp, Homo sapiens
gcagcagtaccatccca

SEQ ID NO: 1959341 - DNA, 20 bp, Homo sapiens
gcagcccagaacgggcctcc

SEQ ID NO: 1959342 - DNA, 21 bp, Homo sapiens
gcagcccagaacgggcctccc

SEQ ID NO: 1959343 - DNA, 22 bp, Homo sapiens
gcagcccagaacgggcctcccc

SEQ ID NO: 1959344 - DNA, 21 bp, Homo sapiens
gcagccccatccttcccgcag

SEQ ID NO: 1959345 - DNA, 15 bp, Homo sapiens
gcagccgcgctctgc

SEQ ID NO: 1959346 - DNA, 13 bp, Homo sapiens
gcagcctcttgaa

SEQ ID NO: 1959347 - DNA, 14 bp, Homo sapiens
gcagcctcttgaat

SEQ ID NO: 1959348 - DNA, 12 bp, Homo sapiens
gcagcctgagct

SEQ ID NO: 1959349 - DNA, 13 bp, Homo sapiens
gcagcctgagctc

SEQ ID NO: 1959350 - DNA, 17 bp, Homo sapiens
gcagcctgagctccacc

SEQ ID NO: 1959351 - DNA, 19 bp, Homo sapiens
gcagcctgagctccaccct

SEQ ID NO: 1959352 - DNA, 13 bp, Homo sapiens
gcagctagctgct

SEQ ID NO: 1959353 - DNA, 15 bp, Homo sapiens
gcagctagctgcttt

SEQ ID NO: 1959354 - DNA, 22 bp, Homo sapiens
gcaggaaagatcccaagtcaaa

SEQ ID NO: 1959355 - DNA, 15 bp, Homo sapiens
gcagggccctggggt

SEQ ID NO: 1959356 - DNA, 17 bp, Homo sapiens
gcagggccctggggtct

SEQ ID NO: 1959357 - DNA, 22 bp, Homo sapiens
gcagggccctggggtctctgag

SEQ ID NO: 1959358 - DNA, 23 bp, Homo sapiens
gcagggccctggggtctctgagc

SEQ ID NO: 1959359 - DNA, 12 bp, Homo sapiens
gcagtggggagc

SEQ ID NO: 1959360 - DNA, 21 bp, Homo sapiens
gcagtggtgatgcctaaagga

SEQ ID NO: 1959361 - DNA, 22 bp, Homo sapiens
ggctgggagttttgattgcata

SEQ ID NO: 1959362 - DNA, 17 bp, Homo sapiens
ggctgggcagggccgca

SEQ ID NO: 1959363 - DNA, 18 bp, Homo sapiens
ggctgggcagggccgcag

SEQ ID NO: 1959364 - DNA, 21 bp, Homo sapiens
ggctgggtcgcccctcctcgg

SEQ ID NO: 1959365 - DNA, 20 bp, Homo sapiens
ggctgtgtcctaaatgcaaa

SEQ ID NO: 1959366 - DNA, 20 bp, Homo sapiens
ggctgttagctcagaggaga

SEQ ID NO: 1959367 - DNA, 17 bp, Homo sapiens
ggcttggagcagagacg

SEQ ID NO: 1959368 - DNA, 14 bp, Homo sapiens
gggaaattcttgca

SEQ ID NO: 1959369 - DNA, 15 bp, Homo sapiens
gggaagcccacccgc

SEQ ID NO: 1959370 - DNA, 18 bp, Homo sapiens
gggaagcccacccgcccc

SEQ ID NO: 1959371 - DNA, 19 bp, Homo sapiens
gggaagcccacccgcccca

SEQ ID NO: 1959372 - DNA, 22 bp, Homo sapiens
gggaagcccacccgccccagag

SEQ ID NO: 1959373 - DNA, 23 bp, Homo sapiens
gggaagcccacccgccccagaga

SEQ ID NO: 1959374 - DNA, 22 bp, Homo sapiens
gggaaggcctgagggaagccca

SEQ ID NO: 1959375 - DNA, 15 bp, Homo sapiens
gggacagcggcccgg

SEQ ID NO: 1959376 - DNA, 18 bp, Homo sapiens
gggagagcgccacccgcc

SEQ ID NO: 1959377 - DNA, 12 bp, Homo sapiens
gggaggagcacc

SEQ ID NO: 1959378 - DNA, 12 bp, Homo sapiens
gggaggctgaga

SEQ ID NO: 1959379 - DNA, 23 bp, Homo sapiens
gggagtccactttcctctctctc

SEQ ID NO: 1959380 - DNA, 20 bp, Homo sapiens
gggattcctcccctggaagt

SEQ ID NO: 1959381 - DNA, 18 bp, Homo sapiens
gggcacgggagagcgcca

SEQ ID NO: 1959382 - DNA, 22 bp, Homo sapiens
gggcacgggagagcgccacccg

SEQ ID NO: 1959383 - DNA, 23 bp, Homo sapiens
gggcacgggagagcgccacccgc

SEQ ID NO: 1959384 - DNA, 16 bp, Homo sapiens
gggcagagctgagtcg

SEQ ID NO: 1959385 - DNA, 17 bp, Homo sapiens
gggcagggccgcagggc

SEQ ID NO: 1959386 - DNA, 15 bp, Homo sapiens
gggcccatggcccca

SEQ ID NO: 1959387 - DNA, 19 bp, Homo sapiens
gggcccatggccccagctg

SEQ ID NO: 1959388 - DNA, 13 bp, Homo sapiens
gggcccgagcgcg

SEQ ID NO: 1959389 - DNA, 16 bp, Homo sapiens
gggcccgagcgcgtgc

SEQ ID NO: 1959390 - DNA, 23 bp, Homo sapiens
gggccctggggtctctgagcagt

SEQ ID NO: 1959391 - DNA, 23 bp, Homo sapiens
gggccgcagggcgctccggcaga

SEQ ID NO: 1959392 - DNA, 13 bp, Homo sapiens
gggccgcctcctc

SEQ ID NO: 1959393 - DNA, 16 bp, Homo sapiens
gggccgcctcctccag

SEQ ID NO: 1959394 - DNA, 18 bp, Homo sapiens
gggccgcctcctccagac

SEQ ID NO: 1959395 - DNA, 17 bp, Homo sapiens
gggcgctccggcagagg

SEQ ID NO: 1959396 - DNA, 16 bp, Homo sapiens
gggcgctgcctgctct

SEQ ID NO: 1959397 - DNA, 21 bp, Homo sapiens
gggctaactggccccaggcgg

SEQ ID NO: 1959398 - DNA, 21 bp, Homo sapiens
gggctctctcacccagcctgg

SEQ ID NO: 1959399 - DNA, 17 bp, Homo sapiens
gggcttggagcagagac

SEQ ID NO: 1959400 - DNA, 17 bp, Homo sapiens
ggggcccatggccccag

SEQ ID NO: 1959401 - DNA, 15 bp, Homo sapiens
ggggctaactggccc

SEQ ID NO: 1959402 - DNA, 21 bp, Homo sapiens
ggggctggccctgccctcccc

SEQ ID NO: 1959403 - DNA, 22 bp, Homo sapiens
ggggctggccctgccctccccc

SEQ ID NO: 1959404 - DNA, 13 bp, Homo sapiens
ggggcttggagca

SEQ ID NO: 1959405 - DNA, 18 bp, Homo sapiens
ggggcttggagcagagac

SEQ ID NO: 1959406 - DNA, 14 bp, Homo sapiens
gggggaggagcacc

SEQ ID NO: 1959407 - DNA, 19 bp, Homo sapiens
gggggctaactggccccag

SEQ ID NO: 1959408 - DNA, 15 bp, Homo sapiens
ggggtctctgagcag

SEQ ID NO: 1959409 - DNA, 20 bp, Homo sapiens
ggggtctctgagcagtgggg

SEQ ID NO: 1959410 - DNA, 23 bp, Homo sapiens
gggtaagggactccagaagcagc

SEQ ID NO: 1959411 - DNA, 14 bp, Homo sapiens
gggtagggatttgg

SEQ ID NO: 1959412 - DNA, 16 bp, Homo sapiens
gggtatcatgcttcta

SEQ ID NO: 1959413 - DNA, 15 bp, Homo sapiens
gggtcgcccctcctc

SEQ ID NO: 1959414 - DNA, 14 bp, Homo sapiens
gggtctctgagcag

SEQ ID NO: 1959415 - DNA, 10 bp, Homo sapiens
gggtctgtga

SEQ ID NO: 1959416 - DNA, 18 bp, Homo sapiens
gggtgcgtgaccggcccg

SEQ ID NO: 1959417 - DNA, 21 bp, Homo sapiens
ggtaaactgatgctttcagat

SEQ ID NO: 1959418 - DNA, 16 bp, Homo sapiens
ggtaagggactccaga

SEQ ID NO: 1959419 - DNA, 20 bp, Homo sapiens
ggtaagggactccagaagca

SEQ ID NO: 1959420 - DNA, 12 bp, Homo sapiens
ggtatgatcatt

SEQ ID NO: 1959421 - DNA, 17 bp, Homo sapiens
ggtattatctagtaggt

SEQ ID NO: 1959422 - DNA, 23 bp, Homo sapiens
ggtcagcaccgtggtgtgaggcc

SEQ ID NO: 1959423 - DNA, 14 bp, Homo sapiens
ggtccaccccgtcc

SEQ ID NO: 1959424 - DNA, 12 bp, Homo sapiens
ggtccaggagat

SEQ ID NO: 1959425 - DNA, 21 bp, Homo sapiens
ggtccaggagatgaggctgga

SEQ ID NO: 1959426 - DNA, 21 bp, Homo sapiens
ggtcctgctgctcgggaaggc

SEQ ID NO: 1959427 - DNA, 12 bp, Homo sapiens
ggtcgcccctcc

SEQ ID NO: 1959428 - DNA, 23 bp, Homo sapiens
ggtcgggggaggagcacccccag

SEQ ID NO: 1959429 - DNA, 17 bp, Homo sapiens
ggtctctttctttccaa

SEQ ID NO: 1959430 - DNA, 12 bp, Homo sapiens
ggtctgcacaca

SEQ ID NO: 1959431 - DNA, 21 bp, Homo sapiens
ggtctgcacacataacacaca

SEQ ID NO: 1959432 - DNA, 19 bp, Homo sapiens
ggtctgctgcctcaggaat

SEQ ID NO: 1959433 - DNA, 18 bp, Homo sapiens
ggtgcggaccggagcggc

SEQ ID NO: 1959434 - DNA, 16 bp, Homo sapiens
ggtgcgtgaccggccc

SEQ ID NO: 1959435 - DNA, 19 bp, Homo sapiens
ggtgtgaggacataaatct

SEQ ID NO: 1959436 - DNA, 20 bp, Homo sapiens
ggtgtgaggcccccggaggc

SEQ ID NO: 1959437 - DNA, 19 bp, Homo sapiens
ggttgtacatagtggtcat

SEQ ID NO: 1959438 - DNA, 22 bp, Homo sapiens
ggttgtacatagtggtcatttg

SEQ ID NO: 1959439 - DNA, 18 bp, Homo sapiens
ggtttccatcaaagccct

SEQ ID NO: 1959440 - DNA, 19 bp, Homo sapiens
ggtttccatcaaagccctc

SEQ ID NO: 1959441 - DNA, 20 bp, Homo sapiens
ggtttccatcaaagccctcc

SEQ ID NO: 1959442 - DNA, 16 bp, Homo sapiens
ggtttccgtagcagtt

SEQ ID NO: 1959443 - DNA, 19 bp, Homo sapiens
ggtttgtgggtccaggaga

SEQ ID NO: 1959444 - DNA, 13 bp, Homo sapiens
gtaaaactgtgac

SEQ ID NO: 1959445 - DNA, 19 bp, Homo sapiens
gtaaaactgtgacattcca

SEQ ID NO: 1959446 - DNA, 20 bp, Homo sapiens
gtaaatggttttcaacaagc

SEQ ID NO: 1959447 - DNA, 12 bp, Homo sapiens
gtaacttttagt

SEQ ID NO: 1959448 - DNA, 16 bp, Homo sapiens
gtaataaatcaaaatt

SEQ ID NO: 1959449 - DNA, 12 bp, Homo sapiens
gtaatattaaat

SEQ ID NO: 1959450 - DNA, 15 bp, Homo sapiens
gtaattactttcaga

SEQ ID NO: 1959451 - DNA, 20 bp, Homo sapiens
gtacagaaccagcactccca

SEQ ID NO: 1959452 - DNA, 14 bp, Homo sapiens
gtacatttatgtgt

SEQ ID NO: 1959453 - DNA, 13 bp, Homo sapiens
gtaccatcccact

SEQ ID NO: 1959454 - DNA, 19 bp, Homo sapiens
gtaccatcccactgatatc

SEQ ID NO: 1959455 - DNA, 21 bp, Homo sapiens
gtactaatgaaatttacagtg

SEQ ID NO: 1959456 - DNA, 15 bp, Homo sapiens
gtagcagttttgaaa

SEQ ID NO: 1959457 - DNA, 17 bp, Homo sapiens
gtaggtctgcacacata

SEQ ID NO: 1959458 - DNA, 23 bp, Homo sapiens
gtatctgatatctgtttgcttct

SEQ ID NO: 1959459 - DNA, 23 bp, Homo sapiens
gtatctgatgatgttctgaaatg

SEQ ID NO: 1959460 - DNA, 22 bp, Homo sapiens
gtatgatgtgctgctgggaatg

SEQ ID NO: 1959461 - DNA, 18 bp, Homo sapiens
gtattgagacactgtcaa

SEQ ID NO: 1959462 - DNA, 14 bp, Homo sapiens
gtcaaacagtgtgg

SEQ ID NO: 1959463 - DNA, 16 bp, Homo sapiens
gtcaaacagtgtggct

SEQ ID NO: 1959464 - DNA, 22 bp, Homo sapiens
gtcaaacagtgtggcttaaaca

SEQ ID NO: 1959465 - DNA, 18 bp, Homo sapiens
gtcacttttttcctgtca

SEQ ID NO: 1959466 - DNA, 20 bp, Homo sapiens
gtcacttttttcctgtcaat

SEQ ID NO: 1959467 - DNA, 15 bp, Homo sapiens
gtcagaaatgattca

SEQ ID NO: 1959468 - DNA, 21 bp, Homo sapiens
gtcaggctctgaatctctcaa

SEQ ID NO: 1959469 - DNA, 21 bp, Homo sapiens
gtcaggggtttgcttacagtg

SEQ ID NO: 1959470 - DNA, 14 bp, Homo sapiens
gtcagtttgtgaag

SEQ ID NO: 1959471 - DNA, 19 bp, Homo sapiens
gtcagtttgtgaagtgatt

SEQ ID NO: 1959472 - DNA, 20 bp, Homo sapiens
tattgttcttgtaaaactgt

SEQ ID NO: 1959473 - DNA, 22 bp, Homo sapiens
tattgttcttgtaaaactgtga

SEQ ID NO: 1959474 - DNA, 14 bp, Homo sapiens
tatttgatctggtg

SEQ ID NO: 1959475 - DNA, 15 bp, Homo sapiens
tatttgatctggtgc

SEQ ID NO: 1959476 - DNA, 14 bp, Homo sapiens
tattttttgatgga

SEQ ID NO: 1959477 - DNA, 13 bp, Homo sapiens
tcaaaagaaaatg

SEQ ID NO: 1959478 - DNA, 12 bp, Homo sapiens
tcaaaatgtgcc

SEQ ID NO: 1959479 - DNA, 17 bp, Homo sapiens
tcaaaatgtggaccagt

SEQ ID NO: 1959480 - DNA, 22 bp, Homo sapiens
tcaaaattgacctcaaaagaaa

SEQ ID NO: 1959481 - DNA, 15 bp, Homo sapiens
tcaaacagtgtggct

SEQ ID NO: 1959482 - DNA, 23 bp, Homo sapiens
tcaaacagtgtggcttaaacatt

SEQ ID NO: 1959483 - DNA, 17 bp, Homo sapiens
tcaaattgcctttcttg

SEQ ID NO: 1959484 - DNA, 15 bp, Homo sapiens
tcaacaagcctgaaa

SEQ ID NO: 1959485 - DNA, 17 bp, Homo sapiens
tcaacaagcctgaaagt

SEQ ID NO: 1959486 - DNA, 17 bp, Homo sapiens
tcaacctctcagatccc

SEQ ID NO: 1959487 - DNA, 12 bp, Homo sapiens
tcaagaatgttt

SEQ ID NO: 1959488 - DNA, 12 bp, Homo sapiens
tcaagtctgtga

SEQ ID NO: 1959489 - DNA, 15 bp, Homo sapiens
tcaagtgttacagag

SEQ ID NO: 1959490 - DNA, 13 bp, Homo sapiens
tcaagttattcag

SEQ ID NO: 1959491 - DNA, 15 bp, Homo sapiens
tcaataactattgct

SEQ ID NO: 1959492 - DNA, 16 bp, Homo sapiens
tcaataactattgctg

SEQ ID NO: 1959493 - DNA, 22 bp, Homo sapiens
tcaatatatagagacttctaaa

SEQ ID NO: 1959494 - DNA, 21 bp, Homo sapiens
tcaatcattttgggaaattct

SEQ ID NO: 1959495 - DNA, 15 bp, Homo sapiens
tcaatgctacaaaat

SEQ ID NO: 1959496 - DNA, 16 bp, Homo sapiens
tcaatgctacaaaatg

SEQ ID NO: 1959497 - DNA, 15 bp, Homo sapiens
tcacagtttgttcag

SEQ ID NO: 1959498 - DNA, 14 bp, Homo sapiens
tcaccttctgtgca

SEQ ID NO: 1959499 - DNA, 14 bp, Homo sapiens
tcacgggcccgctc

SEQ ID NO: 1959500 - DNA, 14 bp, Homo sapiens
tcactgttcatgaa

SEQ ID NO: 1959501 - DNA, 13 bp, Homo sapiens
tcacttttttcct

SEQ ID NO: 1959502 - DNA, 15 bp, Homo sapiens
tcacttttttcctgt

SEQ ID NO: 1959503 - DNA, 17 bp, Homo sapiens
tcacttttttcctgtca

SEQ ID NO: 1959504 - DNA, 19 bp, Homo sapiens
tcacttttttcctgtcaat

SEQ ID NO: 1959505 - DNA, 22 bp, Homo sapiens
tcacttttttcctgtcaatata

SEQ ID NO: 1959506 - DNA, 12 bp, Homo sapiens
tcagaaaagcac

SEQ ID NO: 1959507 - DNA, 16 bp, Homo sapiens
tcagaaaagcacctct

SEQ ID NO: 1959508 - DNA, 22 bp, Homo sapiens
tcagaaacaaagcatttgactt

SEQ ID NO: 1959509 - DNA, 14 bp, Homo sapiens
tcagaaatgattca

SEQ ID NO: 1959510 - DNA, 15 bp, Homo sapiens
tcagaaatgattcag

SEQ ID NO: 1959511 - DNA, 18 bp, Homo sapiens
tcagaagtgaaaaagact

SEQ ID NO: 1959512 - DNA, 15 bp, Homo sapiens
tcagacacctagact

SEQ ID NO: 1959513 - DNA, 14 bp, Homo sapiens
tcagaggagaggag

SEQ ID NO: 1959514 - DNA, 18 bp, Homo sapiens
tcagatgacctgaggaaa

SEQ ID NO: 1959515 - DNA, 21 bp, Homo sapiens
tcagcagtgtctgttcttcat

SEQ ID NO: 1959516 - DNA, 15 bp, Homo sapiens
tcagctccactctga

SEQ ID NO: 1959517 - DNA, 16 bp, Homo sapiens
tcagcttcccaacaat

SEQ ID NO: 1959518 - DNA, 19 bp, Homo sapiens
tcagtaattaacatatcaa

SEQ ID NO: 1959519 - DNA, 22 bp, Homo sapiens
tcagtacaattctttgttgctt

SEQ ID NO: 1959520 - DNA, 19 bp, Homo sapiens
tcagtattgagacactgtc

SEQ ID NO: 1959521 - DNA, 21 bp, Homo sapiens
tcagtccacccccattgtgaa

SEQ ID NO: 1959522 - DNA, 22 bp, Homo sapiens
tcagtccacccccattgtgaat

SEQ ID NO: 1959523 - DNA, 20 bp, Homo sapiens
tcagtgtactctgagtcctc

SEQ ID NO: 1959524 - DNA, 14 bp, Homo sapiens
tcagtttgtgaagt

SEQ ID NO: 1959525 - DNA, 18 bp, Homo sapiens
tcagtttgtgaagtgatt

SEQ ID NO: 1959526 - DNA, 22 bp, Homo sapiens
tcatacacagaaatcctaacat

SEQ ID NO: 1959527 - DNA, 15 bp, Homo sapiens
tcatagataccattt

SEQ ID NO: 1959528 - DNA, 19 bp, Homo sapiens
tcataggggcatagccagt

SEQ ID NO: 1959529 - DNA, 13 bp, Homo sapiens
tcatattctaaaa

SEQ ID NO: 1959530 - DNA, 22 bp, Homo sapiens
tcatctgaggagtccaaaatat

SEQ ID NO: 1959531 - DNA, 14 bp, Homo sapiens
tcatgcttttctca

SEQ ID NO: 1959532 - DNA, 18 bp, Homo sapiens
tcatgttaattgatagaa

SEQ ID NO: 1959533 - DNA, 18 bp, Homo sapiens
tcatgttggtaccctgga

SEQ ID NO: 1959534 - DNA, 23 bp, Homo sapiens
tcattaaactaattaaactgatg

SEQ ID NO: 1959535 - DNA, 22 bp, Homo sapiens
tcattaaccttatcataaattc

SEQ ID NO: 1959536 - DNA, 16 bp, Homo sapiens
tcattatttttcaatt

SEQ ID NO: 1959537 - DNA, 15 bp, Homo sapiens
tcattgttaaagtaa

SEQ ID NO: 1959538 - DNA, 12 bp, Homo sapiens
tcatttccagca

SEQ ID NO: 1959539 - DNA, 15 bp, Homo sapiens
tcatttggtggctct

SEQ ID NO: 1959540 - DNA, 13 bp, Homo sapiens
tcattttctctcc

SEQ ID NO: 1959541 - DNA, 15 bp, Homo sapiens
tcattttctctcctc

SEQ ID NO: 1959542 - DNA, 20 bp, Homo sapiens
tcattttgggaaattcttgc

SEQ ID NO: 1959543 - DNA, 22 bp, Homo sapiens
tccaagttatttgatctggtgc

SEQ ID NO: 1959544 - DNA, 18 bp, Homo sapiens
tccacaatcatctattga

SEQ ID NO: 1959545 - DNA, 23 bp, Homo sapiens
tccacagggacacagtctggtgc

SEQ ID NO: 1959546 - DNA, 12 bp, Homo sapiens
tccacagtattg

SEQ ID NO: 1959547 - DNA, 17 bp, Homo sapiens
tccacagtattgttctt

SEQ ID NO: 1959548 - DNA, 17 bp, Homo sapiens
tccacatccccaccctc

SEQ ID NO: 1959549 - DNA, 13 bp, Homo sapiens
tccaccctcccct

SEQ ID NO: 1959550 - DNA, 22 bp, Homo sapiens
tccagccccttcaattatttcc

SEQ ID NO: 1959551 - DNA, 16 bp, Homo sapiens
tccaggagatgaggct

SEQ ID NO: 1959552 - DNA, 14 bp, Homo sapiens
tccagttctgatga

SEQ ID NO: 1959553 - DNA, 23 bp, Homo sapiens
tccatggtgaactgaagcagagt

SEQ ID NO: 1959554 - DNA, 14 bp, Homo sapiens
tcccaagtcaaaca

SEQ ID NO: 1959555 - DNA, 22 bp, Homo sapiens
tcccaagtcaaacagtgtggct

SEQ ID NO: 1959556 - DNA, 21 bp, Homo sapiens
tcccactgatatcacgggccc

SEQ ID NO: 1959557 - DNA, 14 bp, Homo sapiens
tcccagctacaggg

SEQ ID NO: 1959558 - DNA, 17 bp, Homo sapiens
tcccagctggcagcgcc

SEQ ID NO: 1959559 - DNA, 18 bp, Homo sapiens
tcccagctggcagcgcct

SEQ ID NO: 1959560 - DNA, 23 bp, Homo sapiens
tcccagggcccgagcgcgtgcct

SEQ ID NO: 1959561 - DNA, 20 bp, Homo sapiens
tcccccacggccgtccctga

SEQ ID NO: 1959562 - DNA, 15 bp, Homo sapiens
tccccgcccgccctc

SEQ ID NO: 1959563 - DNA, 19 bp, Homo sapiens
tccccgcccgccctcctct

SEQ ID NO: 1959564 - DNA, 23 bp, Homo sapiens
tccccgcccgccctcctctgccc

SEQ ID NO: 1959565 - DNA, 20 bp, Homo sapiens
tcccctggaagttgtccttt

SEQ ID NO: 1959566 - DNA, 15 bp, Homo sapiens
tcccgcagcaccagc

SEQ ID NO: 1959567 - DNA, 17 bp, Homo sapiens
tcccgcagcaccagcct

SEQ ID NO: 1959568 - DNA, 22 bp, Homo sapiens
tcccgcagcaccagcctgagcc

SEQ ID NO: 1959569 - DNA, 13 bp, Homo sapiens
tcccgccgcctcg

SEQ ID NO: 1959570 - DNA, 23 bp, Homo sapiens
tcccggccccgcgcgtgccccca

SEQ ID NO: 1959571 - DNA, 18 bp, Homo sapiens
tccctaccctcttctcag

SEQ ID NO: 1959572 - DNA, 14 bp, Homo sapiens
tccctcagccctca

SEQ ID NO: 1959573 - DNA, 18 bp, Homo sapiens
tccctcagccctcattaa

SEQ ID NO: 1959574 - DNA, 15 bp, Homo sapiens
tccctcatgcagata

SEQ ID NO: 1959575 - DNA, 23 bp, Homo sapiens
tccctcatttcattatttttcaa

SEQ ID NO: 1959576 - DNA, 12 bp, Homo sapiens
tccctcggtcag

SEQ ID NO: 1959577 - DNA, 17 bp, Homo sapiens
tccctcggtcagcaccg

SEQ ID NO: 1959578 - DNA, 13 bp, Homo sapiens
tccctgacttccc

SEQ ID NO: 1959579 - DNA, 18 bp, Homo sapiens
tccctgacttcccagctg

SEQ ID NO: 1959580 - DNA, 14 bp, Homo sapiens
tcccttcctgtcct

SEQ ID NO: 1959581 - DNA, 14 bp, Homo sapiens
tccgcccgcccacc

SEQ ID NO: 1959582 - DNA, 18 bp, Homo sapiens
tccgctgcgctcccacct

SEQ ID NO: 1959583 - DNA, 21 bp, Homo sapiens
tccggcagaggcagggccctg

SEQ ID NO: 1959584 - DNA, 15 bp, Homo sapiens
tggcgggcagcccct

SEQ ID NO: 1959585 - DNA, 17 bp, Homo sapiens
tggctacaattactttg

SEQ ID NO: 1959586 - DNA, 16 bp, Homo sapiens
tggctgggtcgcccct

SEQ ID NO: 1959587 - DNA, 19 bp, Homo sapiens
tggctgttatctgtcttta

SEQ ID NO: 1959588 - DNA, 15 bp, Homo sapiens
tggcttaaacatttt

SEQ ID NO: 1959589 - DNA, 22 bp, Homo sapiens
tggctttccacatccccaccct

SEQ ID NO: 1959590 - DNA, 23 bp, Homo sapiens
tgggaaatgctgatttaaacttc

SEQ ID NO: 1959591 - DNA, 17 bp, Homo sapiens
tgggaaattcttgcact

SEQ ID NO: 1959592 - DNA, 23 bp, Homo sapiens
tgggaatggattttttttttcag

SEQ ID NO: 1959593 - DNA, 20 bp, Homo sapiens
tgggagtccactttcctctc

SEQ ID NO: 1959594 - DNA, 21 bp, Homo sapiens
tgggagtccactttcctctct

SEQ ID NO: 1959595 - DNA, 20 bp, Homo sapiens
tgggattcctcccctggaag

SEQ ID NO: 1959596 - DNA, 19 bp, Homo sapiens
tgggatttgttgaaatctt

SEQ ID NO: 1959597 - DNA, 15 bp, Homo sapiens
tgggcacgggagagc

SEQ ID NO: 1959598 - DNA, 21 bp, Homo sapiens
tgggcacgggagagcgccacc

SEQ ID NO: 1959599 - DNA, 13 bp, Homo sapiens
tgggcagggccgc

SEQ ID NO: 1959600 - DNA, 21 bp, Homo sapiens
tgggcagggccgcagggcgct

SEQ ID NO: 1959601 - DNA, 21 bp, Homo sapiens
tgggcctcccgtccgtccgcc

SEQ ID NO: 1959602 - DNA, 23 bp, Homo sapiens
tggggagcgggggctaactggcc

SEQ ID NO: 1959603 - DNA, 16 bp, Homo sapiens
tggggcccatggcccc

SEQ ID NO: 1959604 - DNA, 12 bp, Homo sapiens
tgggtccaggag

SEQ ID NO: 1959605 - DNA, 14 bp, Homo sapiens
tgggtccaggagat

SEQ ID NO: 1959606 - DNA, 11 bp, Homo sapiens
tgggtcctgct

SEQ ID NO: 1959607 - DNA, 15 bp, Homo sapiens
tgggtcgcccctcct

SEQ ID NO: 1959608 - DNA, 19 bp, Homo sapiens
tggtactaatgaaatttac

SEQ ID NO: 1959609 - DNA, 18 bp, Homo sapiens
tggtcatttggtggctct

SEQ ID NO: 1959610 - DNA, 18 bp, Homo sapiens
tggtctctttctttccaa

SEQ ID NO: 1959611 - DNA, 14 bp, Homo sapiens
tggtgcgtgtggcc

SEQ ID NO: 1959612 - DNA, 13 bp, Homo sapiens
tggtgtgaggccc

SEQ ID NO: 1959613 - DNA, 20 bp, Homo sapiens
tggtgtgaggcccccggagg

SEQ ID NO: 1959614 - DNA, 19 bp, Homo sapiens
tggtgttgttatggcaagt

SEQ ID NO: 1959615 - DNA, 16 bp, Homo sapiens
tggttacctattgctg

SEQ ID NO: 1959616 - DNA, 19 bp, Homo sapiens
tggttacctattgctgtaa

SEQ ID NO: 1959617 - DNA, 14 bp, Homo sapiens
tggttcctcatggc

SEQ ID NO: 1959618 - DNA, 12 bp, Homo sapiens
tgtaaaactgtg

SEQ ID NO: 1959619 - DNA, 15 bp, Homo sapiens
tgtaaaactgtgaca

SEQ ID NO: 1959620 - DNA, 23 bp, Homo sapiens
tgtaaaactgtgacattccacag

SEQ ID NO: 1959621 - DNA, 19 bp, Homo sapiens
tgtaaataaaaatagctat

SEQ ID NO: 1959622 - DNA, 17 bp, Homo sapiens
tgtaacattctatttca

SEQ ID NO: 1959623 - DNA, 17 bp, Homo sapiens
tgtaatttcctgctcct

SEQ ID NO: 1959624 - DNA, 21 bp, Homo sapiens
tgtacagaaccagcactccca

SEQ ID NO: 1959625 - DNA, 24 bp, Homo sapiens
tgtacagaaccagcactcccaggg

SEQ ID NO: 1959626 - DNA, 16 bp, Homo sapiens
tgtacagatgatgtaa

SEQ ID NO: 1959627 - DNA, 18 bp, Homo sapiens
tgtagctagtttaaaatt

SEQ ID NO: 1959628 - DNA, 21 bp, Homo sapiens
tgtagtttttgttcaccttct

SEQ ID NO: 1959629 - DNA, 14 bp, Homo sapiens
tgtatatgtctaga

SEQ ID NO: 1959630 - DNA, 19 bp, Homo sapiens
tgtatatgtctagataaaa

SEQ ID NO: 1959631 - DNA, 21 bp, Homo sapiens
tgtatattgatgtaactgtgt

SEQ ID NO: 1959632 - DNA, 19 bp, Homo sapiens
tgtcaatatatagagactt

SEQ ID NO: 1959633 - DNA, 15 bp, Homo sapiens
tgtcacttttttcct

SEQ ID NO: 1959634 - DNA, 19 bp, Homo sapiens
tgtcacttttttcctgtca

SEQ ID NO: 1959635 - DNA, 22 bp, Homo sapiens
tgtcacttttttcctgtcaata

SEQ ID NO: 1959636 - DNA, 15 bp, Homo sapiens
tgtcagcttcccaac

SEQ ID NO: 1959637 - DNA, 15 bp, Homo sapiens
tgtcaggctctgaat

SEQ ID NO: 1959638 - DNA, 19 bp, Homo sapiens
tgtcagtttgtgaagtgat

SEQ ID NO: 1959639 - DNA, 14 bp, Homo sapiens
tgtcatctgtcagc

SEQ ID NO: 1959640 - DNA, 18 bp, Homo sapiens
tgtccaaacttaacagat

SEQ ID NO: 1959641 - DNA, 13 bp, Homo sapiens
tgtccaggtcaca

SEQ ID NO: 1959642 - DNA, 12 bp, Homo sapiens
tgtcccttcccc

SEQ ID NO: 1959643 - DNA, 22 bp, Homo sapiens
tgtcctaaatgcaaagcacacc

SEQ ID NO: 1959644 - DNA, 15 bp, Homo sapiens
tgtcctctgctttgc

SEQ ID NO: 1959645 - DNA, 16 bp, Homo sapiens
tgtcctctgctttgct

SEQ ID NO: 1959646 - DNA, 17 bp, Homo sapiens
tgtcctgctcacgtctg

SEQ ID NO: 1959647 - DNA, 14 bp, Homo sapiens
tgtctcaaaataaa

SEQ ID NO: 1959648 - DNA, 14 bp, Homo sapiens
tgtctcctctgtca

SEQ ID NO: 1959649 - DNA, 16 bp, Homo sapiens
tgtctctccctaccct

SEQ ID NO: 1959650 - DNA, 18 bp, Homo sapiens
tgtcttcaaccctgccct

SEQ ID NO: 1959651 - DNA, 19 bp, Homo sapiens
tgtcttcaaccctgccctg

SEQ ID NO: 1959652 - DNA, 21 bp, Homo sapiens
tgtcttcaaccctgccctgca

SEQ ID NO: 1959653 - DNA, 14 bp, Homo sapiens
tgtctttatgattt

SEQ ID NO: 1959654 - DNA, 17 bp, Homo sapiens
tgtcttttgttctctct

SEQ ID NO: 1959655 - DNA, 13 bp, Homo sapiens
tgtgaaacagtgt

SEQ ID NO: 1959656 - DNA, 14 bp, Homo sapiens
tgtgaactatgttt

SEQ ID NO: 1959657 - DNA, 23 bp, Homo sapiens
tgtgaatgttgtcctgtgtcatc

SEQ ID NO: 1959658 - DNA, 16 bp, Homo sapiens
tgtgacattccacaga

SEQ ID NO: 1959659 - DNA, 15 bp, Homo sapiens
tgtgagataaatatc

SEQ ID NO: 1959660 - DNA, 20 bp, Homo sapiens
tgtgagtctgtcctttccca

SEQ ID NO: 1959661 - DNA, 14 bp, Homo sapiens
tgtgatttatgcat

SEQ ID NO: 1959662 - DNA, 16 bp, Homo sapiens
tgtgatttatgcattt

SEQ ID NO: 1959663 - DNA, 19 bp, Homo sapiens
tgtgatttatgcatttatg

SEQ ID NO: 1959664 - DNA, 13 bp, Homo sapiens
tgtgcacctgact

SEQ ID NO: 1959665 - DNA, 20 bp, Homo sapiens
tgtgcatctggcctgggggc

SEQ ID NO: 1959666 - DNA, 13 bp, Homo sapiens
tgtgccccttccc

SEQ ID NO: 1959667 - DNA, 15 bp, Homo sapiens
tgtgccccttcccca

SEQ ID NO: 1959668 - DNA, 20 bp, Homo sapiens
tgtgcctcttatcaagtgtt

SEQ ID NO: 1959669 - DNA, 14 bp, Homo sapiens
tgtgctgctgggaa

SEQ ID NO: 1959670 - DNA, 17 bp, Homo sapiens
tgtggaattacataaca

SEQ ID NO: 1959671 - DNA, 13 bp, Homo sapiens
tgtggcaaacatt

SEQ ID NO: 1959672 - DNA, 17 bp, Homo sapiens
tgtggcatcaggaaagg

SEQ ID NO: 1959673 - DNA, 13 bp, Homo sapiens
tgtgggagtccac

SEQ ID NO: 1959674 - DNA, 18 bp, Homo sapiens
tgtgtcctaaatgcaaag

SEQ ID NO: 1959675 - DNA, 10 bp, Homo sapiens
tgtgtccttt

SEQ ID NO: 1959676 - DNA, 16 bp, Homo sapiens
tgtgtgcaatgttccg

SEQ ID NO: 1959677 - DNA, 9 bp, Homo sapiens
tgtgtggca

SEQ ID NO: 1959678 - DNA, 16 bp, Homo sapiens
tgtgtggcaaacattt

SEQ ID NO: 1959679 - DNA, 17 bp, Homo sapiens
tgtgtggcaaacattta

SEQ ID NO: 1959680 - DNA, 21 bp, Homo sapiens
tgtgtggcaaacatttaaaaa

SEQ ID NO: 1959681 - DNA, 13 bp, Homo sapiens
tgttataaaatct

SEQ ID NO: 1959682 - DNA, 14 bp, Homo sapiens
tgttataaaatctg

SEQ ID NO: 1959683 - DNA, 13 bp, Homo sapiens
tgttatctgtctt

SEQ ID NO: 1959684 - DNA, 23 bp, Homo sapiens
tgttatctgtctttatgatttca

SEQ ID NO: 1959685 - DNA, 19 bp, Homo sapiens
tgttattcaataactattg

SEQ ID NO: 1959686 - DNA, 20 bp, Homo sapiens
tgttattcaataactattgc

SEQ ID NO: 1959687 - DNA, 17 bp, Homo sapiens
tgttcaccttctgtgca

SEQ ID NO: 1959688 - DNA, 19 bp, Homo sapiens
tgttcaccttctgtgcatc

SEQ ID NO: 1959689 - DNA, 14 bp, Homo sapiens
tgttcagaaaagca

SEQ ID NO: 1959690 - DNA, 15 bp, Homo sapiens
tgttcagaaaagcac

SEQ ID NO: 1959691 - DNA, 23 bp, Homo sapiens
tgttcatactttggctgtgatgt

SEQ ID NO: 1959692 - DNA, 15 bp, Homo sapiens
tgttccgttcatctg

SEQ ID NO: 1959693 - DNA, 21 bp, Homo sapiens
tgttccgttcatctgaggagt

SEQ ID NO: 1959694 - DNA, 11 bp, Homo sapiens
tgttctcctcc

SEQ ID NO: 1959695 - DNA, 15 bp, Homo sapiens
tgttctgttcacttt

SEQ ID NO: 1959696 - DNA, 19 bp, Homo sapiens
aataacaacaatttaggaa

SEQ ID NO: 1959697 - DNA, 18 bp, Homo sapiens
aataaccctgaatcagag

SEQ ID NO: 1959698 - DNA, 13 bp, Homo sapiens
aataactattgct

SEQ ID NO: 1959699 - DNA, 23 bp, Homo sapiens
aataagttcctctgaagactgct

SEQ ID NO: 1959700 - DNA, 12 bp, Homo sapiens
aataattaaaac

SEQ ID NO: 1959701 - DNA, 21 bp, Homo sapiens
aataattaaaacaaaatcctt

SEQ ID NO: 1959702 - DNA, 22 bp, Homo sapiens
aatacaagttacatacatttaa

SEQ ID NO: 1959703 - DNA, 17 bp, Homo sapiens
aatacatgatgatttca

SEQ ID NO: 1959704 - DNA, 15 bp, Homo sapiens
aatacttgacaacat

SEQ ID NO: 1959705 - DNA, 14 bp, Homo sapiens
aatactttgtgtct

SEQ ID NO: 1959706 - DNA, 18 bp, Homo sapiens
aatagatttttagattcc

SEQ ID NO: 1959707 - DNA, 19 bp, Homo sapiens
aatagcattgttcttctcc

SEQ ID NO: 1959708 - DNA, 11 bp, Homo sapiens
aataggatttg

SEQ ID NO: 1959709 - DNA, 13 bp, Homo sapiens
aataggcttgtgt

SEQ ID NO: 1959710 - DNA, 19 bp, Homo sapiens
aatagtcgggggaaaaaat

SEQ ID NO: 1959711 - DNA, 19 bp, Homo sapiens
aatagtgaaaattttattg

SEQ ID NO: 1959712 - DNA, 16 bp, Homo sapiens
aatagttgtcagaata

SEQ ID NO: 1959713 - DNA, 17 bp, Homo sapiens
aatagttgtcagaatat

SEQ ID NO: 1959714 - DNA, 16 bp, Homo sapiens
aatataaaaaatgtta

SEQ ID NO: 1959715 - DNA, 16 bp, Homo sapiens
aatataaaaataatta

SEQ ID NO: 1959716 - DNA, 17 bp, Homo sapiens
aatataaaaataattaa

SEQ ID NO: 1959717 - DNA, 19 bp, Homo sapiens
ctcttgaatgcttaaatga

SEQ ID NO: 1959718 - DNA, 15 bp, Homo sapiens
ctcttggtctctttc

SEQ ID NO: 1959719 - DNA, 13 bp, Homo sapiens
ctctttctctctg

SEQ ID NO: 1959720 - DNA, 13 bp, Homo sapiens
ctgaaagtaattt

SEQ ID NO: 1959721 - DNA, 15 bp, Homo sapiens
ctgaaagtaatttca

SEQ ID NO: 1959722 - DNA, 18 bp, Homo sapiens
ctgaaagtaatttcaaga

SEQ ID NO: 1959723 - DNA, 22 bp, Homo sapiens
ctgaaagtaatttcaagaatgt

SEQ ID NO: 1959724 - DNA, 11 bp, Homo sapiens
ctgaaattatg

SEQ ID NO: 1959725 - DNA, 18 bp, Homo sapiens
ctgaactgcaacactgga

SEQ ID NO: 1959726 - DNA, 23 bp, Homo sapiens
ctgaagactgctatcagtctctt

SEQ ID NO: 1959727 - DNA, 16 bp, Homo sapiens
ctgaagcagagtcaag

SEQ ID NO: 1959728 - DNA, 21 bp, Homo sapiens
ctgaagtcccttcctgtcctg

SEQ ID NO: 1959729 - DNA, 15 bp, Homo sapiens
ctgaataacaacaat

SEQ ID NO: 1959730 - DNA, 20 bp, Homo sapiens
ctgaatctctcaaaatgtgc

SEQ ID NO: 1959731 - DNA, 20 bp, Homo sapiens
ctgacaccatgtgcaaactg

SEQ ID NO: 1959732 - DNA, 12 bp, Homo sapiens
ctgacagtgttt

SEQ ID NO: 1959733 - DNA, 13 bp, Homo sapiens
ctgacatgctaac

SEQ ID NO: 1959734 - DNA, 14 bp, Homo sapiens
ctgacttcccagct

SEQ ID NO: 1959735 - DNA, 17 bp, Homo sapiens
ctgacttcccagctggc

SEQ ID NO: 1959736 - DNA, 19 bp, Homo sapiens
ctgacttcccagctggcag

SEQ ID NO: 1959737 - DNA, 24 bp, Homo sapiens
ctgacttcccagctggcagcgcct

SEQ ID NO: 1959738 - DNA, 17 bp, Homo sapiens
ctgagatgggaggatca

SEQ ID NO: 1959739 - DNA, 18 bp, Homo sapiens
ctgagcacatctcttcat

SEQ ID NO: 1959740 - DNA, 13 bp, Homo sapiens
ctgagcagtgggg

SEQ ID NO: 1959741 - DNA, 13 bp, Homo sapiens
ctgagcccctcct

SEQ ID NO: 1959742 - DNA, 15 bp, Homo sapiens
ctgagcctgtctctc

SEQ ID NO: 1959743 - DNA, 16 bp, Homo sapiens
ctgagcctgtctctcc

SEQ ID NO: 1959744 - DNA, 15 bp, Homo sapiens
ctgagctccaccctc

SEQ ID NO: 1959745 - DNA, 20 bp, Homo sapiens
ctgagctccaccctcccctc

SEQ ID NO: 1959746 - DNA, 17 bp, Homo sapiens
ctgaggacggggcagag

SEQ ID NO: 1959747 - DNA, 14 bp, Homo sapiens
ctgaggagtccaaa

SEQ ID NO: 1959748 - DNA, 14 bp, Homo sapiens
ctgagggaagccca

SEQ ID NO: 1959749 - DNA, 22 bp, Homo sapiens
ctgagtcctcattgttcagaaa

SEQ ID NO: 1959750 - DNA, 14 bp, Homo sapiens
ctgagtcggctggg

SEQ ID NO: 1959751 - DNA, 22 bp, Homo sapiens
ctgagtcggctgggcagggccg

SEQ ID NO: 1959752 - DNA, 19 bp, Homo sapiens
ctgatatctgtttgcttct

SEQ ID NO: 1959753 - DNA, 20 bp, Homo sapiens
ctgatatctgtttgcttcta

SEQ ID NO: 1959754 - DNA, 13 bp, Homo sapiens
ctgatcctctctt

SEQ ID NO: 1959755 - DNA, 19 bp, Homo sapiens
ctgatgagacaacacacac

SEQ ID NO: 1959756 - DNA, 15 bp, Homo sapiens
ctgatgatgttctga

SEQ ID NO: 1959757 - DNA, 17 bp, Homo sapiens
ctgatgggtcctgctgc

SEQ ID NO: 1959758 - DNA, 12 bp, Homo sapiens
ctgcaacactgg

SEQ ID NO: 1959759 - DNA, 18 bp, Homo sapiens
cgggacagcggcccggcc

SEQ ID NO: 1959760 - DNA, 19 bp, Homo sapiens
cgggacagcggcccggccc

SEQ ID NO: 1959761 - DNA, 18 bp, Homo sapiens
cgggagagcgccacccgc

SEQ ID NO: 1959762 - DNA, 17 bp, Homo sapiens
cgggcagcccctgctgg

SEQ ID NO: 1959763 - DNA, 21 bp, Homo sapiens
cgggcagcccctgctggacca

SEQ ID NO: 1959764 - DNA, 15 bp, Homo sapiens
cgggccgcctcctcc

SEQ ID NO: 1959765 - DNA, 19 bp, Homo sapiens
cgggccgcctcctccagac

SEQ ID NO: 1959766 - DNA, 14 bp, Homo sapiens
cgggcctccccggg

SEQ ID NO: 1959767 - DNA, 23 bp, Homo sapiens
cgggcctccccgggggtccccgg

SEQ ID NO: 1959768 - DNA, 17 bp, Homo sapiens
cgggcgcctgcgctcct

SEQ ID NO: 1959769 - DNA, 17 bp, Homo sapiens
cgggctctctcacccag

SEQ ID NO: 1959770 - DNA, 15 bp, Homo sapiens
cggggcagagctgag

SEQ ID NO: 1959771 - DNA, 15 bp, Homo sapiens
cgggggaggagcacc

SEQ ID NO: 1959772 - DNA, 22 bp, Homo sapiens
cgggggctaactggccccaggc

SEQ ID NO: 1959773 - DNA, 15 bp, Homo sapiens
cggggtcgggggagg

SEQ ID NO: 1959774 - DNA, 15 bp, Homo sapiens
cggtccaccccgtcc

SEQ ID NO: 1959775 - DNA, 16 bp, Homo sapiens
cggtttccgtagcagt

SEQ ID NO: 1959776 - DNA, 13 bp, Homo sapiens
cgtccccagggtg

SEQ ID NO: 1959777 - DNA, 14 bp, Homo sapiens
cgtccccagggtgc

SEQ ID NO: 1959778 - DNA, 19 bp, Homo sapiens
cgtccccagggtgcaggcg

SEQ ID NO: 1959779 - DNA, 14 bp, Homo sapiens
cgtcccggccccgc

SEQ ID NO: 1959780 - DNA, 22 bp, Homo sapiens
cgtccctgacttcccagctggc

SEQ ID NO: 1959781 - DNA, 17 bp, Homo sapiens
cgtccgcccgcccaccc

SEQ ID NO: 1959782 - DNA, 20 bp, Homo sapiens
cgtccgcccgcccaccccgc

SEQ ID NO: 1959783 - DNA, 15 bp, Homo sapiens
cgtccggcctgcagc

SEQ ID NO: 1959784 - DNA, 18 bp, Homo sapiens
cgtgaccggcccgccacc

SEQ ID NO: 1959785 - DNA, 12 bp, Homo sapiens
cgtgcggcccgt

SEQ ID NO: 1959786 - DNA, 21 bp, Homo sapiens
cgtgcggcccgtgcgcagccg

SEQ ID NO: 1959787 - DNA, 23 bp, Homo sapiens
cgtgggagtatgttatttctctg

SEQ ID NO: 1959788 - DNA, 19 bp, Homo sapiens
cgtggggctaacgggcgcc

SEQ ID NO: 1959789 - DNA, 16 bp, Homo sapiens
cgtggtgtgaggcccc

SEQ ID NO: 1959790 - DNA, 16 bp, Homo sapiens
cgtgtggccctgtggg

SEQ ID NO: 1959791 - DNA, 17 bp, Homo sapiens
cgtgtggccctgtggga

SEQ ID NO: 1959792 - DNA, 20 bp, Homo sapiens
cgtgtggccctgtgggagtc

SEQ ID NO: 1959793 - DNA, 14 bp, Homo sapiens
cgttcatctgagga

SEQ ID NO: 1959794 - DNA, 20 bp, Homo sapiens
ctaaaagtgatgtgatttat

SEQ ID NO: 1959795 - DNA, 22 bp, Homo sapiens
ctaaaagtgatgtgatttatgc

SEQ ID NO: 1959796 - DNA, 14 bp, Homo sapiens
ctaaactgtttact

SEQ ID NO: 1959797 - DNA, 20 bp, Homo sapiens
ctaaatagatttttagattc

SEQ ID NO: 1959798 - DNA, 15 bp, Homo sapiens
ctaaatcataatcat

SEQ ID NO: 1959799 - DNA, 13 bp, Homo sapiens
ctaaattaacttc

SEQ ID NO: 1959800 - DNA, 13 bp, Homo sapiens
ctaacaaaagata

SEQ ID NO: 1959801 - DNA, 19 bp, Homo sapiens
ctaactccttgaggtcttg

SEQ ID NO: 1959802 - DNA, 13 bp, Homo sapiens
ctaactggcccca

SEQ ID NO: 1959803 - DNA, 14 bp, Homo sapiens
ctaactggccccag

SEQ ID NO: 1959804 - DNA, 16 bp, Homo sapiens
ctaactggccccaggc

SEQ ID NO: 1959805 - DNA, 18 bp, Homo sapiens
ctaagatttcctttggca

SEQ ID NO: 1959806 - DNA, 17 bp, Homo sapiens
ctaagtaaatctaaatt

SEQ ID NO: 1959807 - DNA, 15 bp, Homo sapiens
ctaattaaactgatg

SEQ ID NO: 1959808 - DNA, 17 bp, Homo sapiens
ctaattaatttcagtaa

SEQ ID NO: 1959809 - DNA, 16 bp, Homo sapiens
ctacaaaatgtgtgct

SEQ ID NO: 1959810 - DNA, 16 bp, Homo sapiens
ctacaacattagaata

SEQ ID NO: 1959811 - DNA, 20 bp, Homo sapiens
ctacctttggcttaattcca

SEQ ID NO: 1959812 - DNA, 21 bp, Homo sapiens
ctacctttggcttaattccaa

SEQ ID NO: 1959813 - DNA, 13 bp, Homo sapiens
ctacttaaacaaa

SEQ ID NO: 1959814 - DNA, 22 bp, Homo sapiens
ctacttaaacaaaaactttcca

SEQ ID NO: 1959815 - DNA, 20 bp, Homo sapiens
ctagaaagagaaaaagccct

SEQ ID NO: 1959816 - DNA, 20 bp, Homo sapiens
ctagataaaaggagagaaag

SEQ ID NO: 1959817 - DNA, 23 bp, Homo sapiens
ctagatatcaatcagtaattaac

SEQ ID NO: 1959818 - DNA, 19 bp, Homo sapiens
ctagccctctttctctctg

SEQ ID NO: 1959819 - DNA, 21 bp, Homo sapiens
ctagccctctttctctctgtg

SEQ ID NO: 1959820 - DNA, 23 bp, Homo sapiens
ctagccctctttctctctgtgtg

SEQ ID NO: 1959821 - DNA, 16 bp, Homo sapiens
ctagtaggtctgcaca

SEQ ID NO: 1959822 - DNA, 21 bp, Homo sapiens
ctagtttaaaattattaaaaa

SEQ ID NO: 1959823 - DNA, 14 bp, Homo sapiens
ctatagcatttaaa

SEQ ID NO: 1959824 - DNA, 21 bp, Homo sapiens
ctatcagcagcggcagcagca

SEQ ID NO: 1959825 - DNA, 19 bp, Homo sapiens
ctatctcgctagccatata

SEQ ID NO: 1959826 - DNA, 20 bp, Homo sapiens
ctatctggaaaaaaaaaaat

SEQ ID NO: 1959827 - DNA, 19 bp, Homo sapiens
ctatgatgtccaaacttaa

SEQ ID NO: 1959828 - DNA, 13 bp, Homo sapiens
ctatgcacaccaa

SEQ ID NO: 1959829 - DNA, 15 bp, Homo sapiens
ctatgctgttcattg

SEQ ID NO: 1959830 - DNA, 16 bp, Homo sapiens
ctatgtacagatgatg

SEQ ID NO: 1959831 - DNA, 18 bp, Homo sapiens
ctatttcaacttcaggaa

SEQ ID NO: 1959832 - DNA, 15 bp, Homo sapiens
ctattttgcagcagt

SEQ ID NO: 1959833 - DNA, 17 bp, Homo sapiens
ctcaaaagaaaatgtgt

SEQ ID NO: 1959834 - DNA, 14 bp, Homo sapiens
ctcaaaagatctcc

SEQ ID NO: 1959835 - DNA, 17 bp, Homo sapiens
ctcaaaataaaaccaga

SEQ ID NO: 1959836 - DNA, 12 bp, Homo sapiens
ctcaaaatgtgc

SEQ ID NO: 1959837 - DNA, 22 bp, Homo sapiens
ctcaatgtgctgttgattcttt

SEQ ID NO: 1959838 - DNA, 22 bp, Homo sapiens
ctcaattccagggaaccagagc

SEQ ID NO: 1959839 - DNA, 19 bp, Homo sapiens
ctcagaagtgaaaaagact

SEQ ID NO: 1959840 - DNA, 15 bp, Homo sapiens
ctcagatccctcggt

SEQ ID NO: 1959841 - DNA, 22 bp, Homo sapiens
ctcagatccctcggtcagcacc

SEQ ID NO: 1959842 - DNA, 23 bp, Homo sapiens
ctcagatccctcggtcagcaccg

SEQ ID NO: 1959843 - DNA, 18 bp, Homo sapiens
ctcagatgacctgaggaa

SEQ ID NO: 1959844 - DNA, 15 bp, Homo sapiens
ctcagctccactctg

SEQ ID NO: 1959845 - DNA, 22 bp, Homo sapiens
ctcagtattgagacactgtcaa

SEQ ID NO: 1959846 - DNA, 23 bp, Homo sapiens
ctcatggctgttatctgtcttta

SEQ ID NO: 1959847 - DNA, 14 bp, Homo sapiens
ctccactctgaagt

SEQ ID NO: 1959848 - DNA, 12 bp, Homo sapiens
ctccagaagcag

SEQ ID NO: 1959849 - DNA, 13 bp, Homo sapiens
ctccagaagcagc

SEQ ID NO: 1959850 - DNA, 14 bp, Homo sapiens
ctccagaagcagca

SEQ ID NO: 1959851 - DNA, 23 bp, Homo sapiens
ctccagactcgagagggctgagc

SEQ ID NO: 1959852 - DNA, 18 bp, Homo sapiens
ctccagccacttatttcc

SEQ ID NO: 1959853 - DNA, 19 bp, Homo sapiens
ctccagtacaataaataaa

SEQ ID NO: 1959854 - DNA, 22 bp, Homo sapiens
ctccatggtgaactgaagcaga

SEQ ID NO: 1959855 - DNA, 16 bp, Homo sapiens
ctcccagggcccgagc

SEQ ID NO: 1959856 - DNA, 16 bp, Homo sapiens
ctcccccaggctgcgc

SEQ ID NO: 1959857 - DNA, 18 bp, Homo sapiens
ctcccccaggctgcgcct

SEQ ID NO: 1959858 - DNA, 15 bp, Homo sapiens
ctcccccgcagacag

SEQ ID NO: 1959859 - DNA, 19 bp, Homo sapiens
ctcccggtgtatgcagtgg

SEQ ID NO: 1959860 - DNA, 23 bp, Homo sapiens
ctcccgtccgtccgcccgcccac

SEQ ID NO: 1959861 - DNA, 18 bp, Homo sapiens
ctccggcagaggcagggc

SEQ ID NO: 1959862 - DNA, 20 bp, Homo sapiens
ctccggcagaggcagggccc

SEQ ID NO: 1959863 - DNA, 23 bp, Homo sapiens
ctcctcaattccagggaaccaga

SEQ ID NO: 1959864 - DNA, 13 bp, Homo sapiens
ctcctccaaatgc

SEQ ID NO: 1959865 - DNA, 22 bp, Homo sapiens
ctcctccagactcgagagggct

SEQ ID NO: 1959866 - DNA, 13 bp, Homo sapiens
ctcctcctccagt

SEQ ID NO: 1959867 - DNA, 23 bp, Homo sapiens
ctcctcgggcgcctgcgctcctc

SEQ ID NO: 1959868 - DNA, 15 bp, Homo sapiens
ctcctcgtccggcct

SEQ ID NO: 1959869 - DNA, 17 bp, Homo sapiens
ctcctcgtccggcctgc

SEQ ID NO: 1959870 - DNA, 19 bp, Homo sapiens
ctcctcgtccggcctgcag

SEQ ID NO: 1959871 - DNA, 14 bp, Homo sapiens
cctcgggcgcctgc

SEQ ID NO: 1959872 - DNA, 17 bp, Homo sapiens
cctcgggcgcctgcgct

SEQ ID NO: 1959873 - DNA, 20 bp, Homo sapiens
cctcgggcgcctgcgctcct

SEQ ID NO: 1959874 - DNA, 18 bp, Homo sapiens
cctctaggtaaactagca

SEQ ID NO: 1959875 - DNA, 19 bp, Homo sapiens
cctctcagatccctcggtc

SEQ ID NO: 1959876 - DNA, 16 bp, Homo sapiens
cctctcctcgtccggc

SEQ ID NO: 1959877 - DNA, 19 bp, Homo sapiens
cctctcctcgtccggcctg

SEQ ID NO: 1959878 - DNA, 23 bp, Homo sapiens
cctctcctcgtccggcctgcagc

SEQ ID NO: 1959879 - DNA, 13 bp, Homo sapiens
cctctctctctct

SEQ ID NO: 1959880 - DNA, 15 bp, Homo sapiens
cctctgccccctccc

SEQ ID NO: 1959881 - DNA, 19 bp, Homo sapiens
cctctgccccctcccccgc

SEQ ID NO: 1959882 - DNA, 21 bp, Homo sapiens
cctctgccccctcccccgcag

SEQ ID NO: 1959883 - DNA, 14 bp, Homo sapiens
cctcttagaagaaa

SEQ ID NO: 1959884 - DNA, 14 bp, Homo sapiens
cctctttctctctg

SEQ ID NO: 1959885 - DNA, 17 bp, Homo sapiens
cctctttctctctgtgt

SEQ ID NO: 1959886 - DNA, 21 bp, Homo sapiens
cctctttctctctgtgtggca

SEQ ID NO: 1959887 - DNA, 22 bp, Homo sapiens
cctctttctctctgtgtggcaa

SEQ ID NO: 1959888 - DNA, 23 bp, Homo sapiens
cctctttctctctgtgtggcaaa

SEQ ID NO: 1959889 - DNA, 21 bp, Homo sapiens
cctgaaagtaatttcaagaat

SEQ ID NO: 1959890 - DNA, 15 bp, Homo sapiens
cctgaactcccagtc

SEQ ID NO: 1959891 - DNA, 20 bp, Homo sapiens
cctgaactcccagtcatgtt

SEQ ID NO: 1959892 - DNA, 12 bp, Homo sapiens
cctgaatcagag

SEQ ID NO: 1959893 - DNA, 22 bp, Homo sapiens
cctgacatgctaacctctctga

SEQ ID NO: 1959894 - DNA, 15 bp, Homo sapiens
cctgacttcccagct

SEQ ID NO: 1959895 - DNA, 18 bp, Homo sapiens
cctgacttcccagctggc

SEQ ID NO: 1959896 - DNA, 21 bp, Homo sapiens
cctgacttcccagctggcagc

SEQ ID NO: 1959897 - DNA, 17 bp, Homo sapiens
cctgagcatatgtacac

SEQ ID NO: 1959898 - DNA, 17 bp, Homo sapiens
cctgagccacagtgggg

SEQ ID NO: 1959899 - DNA, 15 bp, Homo sapiens
cctgagcctgtctct

SEQ ID NO: 1959900 - DNA, 19 bp, Homo sapiens
cctgagctccaccctcccc

SEQ ID NO: 1959901 - DNA, 19 bp, Homo sapiens
cctgatgtcttggtttcca

SEQ ID NO: 1959902 - DNA, 13 bp, Homo sapiens
cctgcagcccaga

SEQ ID NO: 1959903 - DNA, 15 bp, Homo sapiens
cctgcagcccagaac

SEQ ID NO: 1959904 - DNA, 14 bp, Homo sapiens
cctgccctccccca

SEQ ID NO: 1959905 - DNA, 21 bp, Homo sapiens
cctgcgccctgacatgctaac

SEQ ID NO: 1959906 - DNA, 12 bp, Homo sapiens
cctgcgctcctc

SEQ ID NO: 1959907 - DNA, 17 bp, Homo sapiens
cctgcgctcctctgcag

SEQ ID NO: 1959908 - DNA, 19 bp, Homo sapiens
cctgcgctcctctgcagcc

SEQ ID NO: 1959909 - DNA, 17 bp, Homo sapiens
cctgctgctcgggaagg

SEQ ID NO: 1959910 - DNA, 19 bp, Homo sapiens
cctgctgctcgggaaggcc

SEQ ID NO: 1959911 - DNA, 22 bp, Homo sapiens
cctggaagttgtcctttctgat

SEQ ID NO: 1959912 - DNA, 18 bp, Homo sapiens
cctggacagtgcctaact

SEQ ID NO: 1959913 - DNA, 19 bp, Homo sapiens
cctggaggagaaggaggaa

SEQ ID NO: 1959914 - DNA, 13 bp, Homo sapiens
cctggcgggcagc

SEQ ID NO: 1959915 - DNA, 15 bp, Homo sapiens
cctggcgggcagccc

SEQ ID NO: 1959916 - DNA, 17 bp, Homo sapiens
cctggcgggcagcccct

SEQ ID NO: 1959917 - DNA, 19 bp, Homo sapiens
cctggcgggcagcccctgc

SEQ ID NO: 1959918 - DNA, 15 bp, Homo sapiens
cctgggcctcccgtc

SEQ ID NO: 1959919 - DNA, 22 bp, Homo sapiens
cctgggcctcccgtccgtccgc

SEQ ID NO: 1959920 - DNA, 16 bp, Homo sapiens
cctggggtctctgagc

SEQ ID NO: 1959921 - DNA, 23 bp, Homo sapiens
cctggggtctctgagcagtgggg

SEQ ID NO: 1959922 - DNA, 13 bp, Homo sapiens
cctgtcaatatat

SEQ ID NO: 1959923 - DNA, 16 bp, Homo sapiens
cctgtctcctctgtca

SEQ ID NO: 1959924 - DNA, 13 bp, Homo sapiens
cctgtctctccct

SEQ ID NO: 1959925 - DNA, 14 bp, Homo sapiens
cctgtctctcccta

SEQ ID NO: 1959926 - DNA, 13 bp, Homo sapiens
cctgtgggagtcc

SEQ ID NO: 1959927 - DNA, 16 bp, Homo sapiens
cctgtgggagtccact

SEQ ID NO: 1959928 - DNA, 21 bp, Homo sapiens
cctgtggtttgttatcagtac

SEQ ID NO: 1959929 - DNA, 17 bp, Homo sapiens
cctgtgtcatctgtcag

SEQ ID NO: 1959930 - DNA, 19 bp, Homo sapiens
ccttagtacctttttaaca

SEQ ID NO: 1959931 - DNA, 12 bp, Homo sapiens
ccttcaattatt

SEQ ID NO: 1959932 - DNA, 13 bp, Homo sapiens
ccttcacaatttc

SEQ ID NO: 1959933 - DNA, 16 bp, Homo sapiens
ccttccaacctgttca

SEQ ID NO: 1959934 - DNA, 22 bp, Homo sapiens
ccttcccgcagcaccagcctga

SEQ ID NO: 1959935 - DNA, 17 bp, Homo sapiens
ccttcctgtcctgctca

SEQ ID NO: 1959936 - DNA, 17 bp, Homo sapiens
ccttctgtgcatctggc

SEQ ID NO: 1959937 - DNA, 14 bp, Homo sapiens
ccttgaccccacac

SEQ ID NO: 1959938 - DNA, 21 bp, Homo sapiens
ccttgattcaaataaccctga

SEQ ID NO: 1959939 - DNA, 19 bp, Homo sapiens
ccttgattttaattcaggt

SEQ ID NO: 1959940 - DNA, 16 bp, Homo sapiens
cctttggcaatatcat

SEQ ID NO: 1959941 - DNA, 23 bp, Homo sapiens
ccttttaaaaaaataatataaat

SEQ ID NO: 1959942 - DNA, 17 bp, Homo sapiens
ccttttgtttacaacac

SEQ ID NO: 1959943 - DNA, 12 bp, Homo sapiens
cgagagggctga

SEQ ID NO: 1959944 - DNA, 20 bp, Homo sapiens
cgagagggctgagcccctcc

SEQ ID NO: 1959945 - DNA, 22 bp, Homo sapiens
cgagagggctgagcccctcctc

SEQ ID NO: 1959946 - DNA, 18 bp, Homo sapiens
cgagcgcgtgccttcccc

SEQ ID NO: 1959947 - DNA, 13 bp, Homo sapiens
cgcaccgcccaac

SEQ ID NO: 1959948 - DNA, 14 bp, Homo sapiens
cgcagagccccgga

SEQ ID NO: 1959949 - DNA, 20 bp, Homo sapiens
cgcagagccccggagcacca

SEQ ID NO: 1959950 - DNA, 13 bp, Homo sapiens
cgcagcaccagcc

SEQ ID NO: 1959951 - DNA, 18 bp, Homo sapiens
cgcagccgcgctctgccc

SEQ ID NO: 1959952 - DNA, 19 bp, Homo sapiens
cgcagccgcgctctgcccc

SEQ ID NO: 1959953 - DNA, 20 bp, Homo sapiens
cgccaccttgtacagaacca

SEQ ID NO: 1959954 - DNA, 19 bp, Homo sapiens
cgcccaacccccacctccc

SEQ ID NO: 1959955 - DNA, 13 bp, Homo sapiens
cgcccacccacac

SEQ ID NO: 1959956 - DNA, 22 bp, Homo sapiens
cgcccacccacaccccgtctgc

SEQ ID NO: 1959957 - DNA, 14 bp, Homo sapiens
cgcccaccccgctg

SEQ ID NO: 1959958 - DNA, 18 bp, Homo sapiens
cgcccaccccgctgcctg

SEQ ID NO: 1959959 - DNA, 11 bp, Homo sapiens
cgcccacctgc

SEQ ID NO: 1959960 - DNA, 12 bp, Homo sapiens
cgcccacctgcc

SEQ ID NO: 1959961 - DNA, 18 bp, Homo sapiens
cgcccacctgcccagtta

SEQ ID NO: 1959962 - DNA, 16 bp, Homo sapiens
cgccccagagactgcc

SEQ ID NO: 1959963 - DNA, 17 bp, Homo sapiens
cgccccagagactgccc

SEQ ID NO: 1959964 - DNA, 11 bp, Homo sapiens
cgcccctcctc

SEQ ID NO: 1959965 - DNA, 14 bp, Homo sapiens
cgcccgcccccgcc

SEQ ID NO: 1959966 - DNA, 21 bp, Homo sapiens
cgcccgccctcctctgccccc

SEQ ID NO: 1959967 - DNA, 10 bp, Homo sapiens
cgccctcctc

SEQ ID NO: 1959968 - DNA, 13 bp, Homo sapiens
cgccctcctctgc

SEQ ID NO: 1959969 - DNA, 16 bp, Homo sapiens
cgccctcctctgcccc

SEQ ID NO: 1959970 - DNA, 23 bp, Homo sapiens
cgccctcctctgccccctccccc

SEQ ID NO: 1959971 - DNA, 15 bp, Homo sapiens
cgccggggctggccc

SEQ ID NO: 1959972 - DNA, 16 bp, Homo sapiens
cgccggggctggccct

SEQ ID NO: 1959973 - DNA, 22 bp, Homo sapiens
cgccggggctggccctgccctc

SEQ ID NO: 1959974 - DNA, 23 bp, Homo sapiens
cgccggggctggccctgccctcc

SEQ ID NO: 1959975 - DNA, 14 bp, Homo sapiens
cgcctcccgccgcc

SEQ ID NO: 1959976 - DNA, 20 bp, Homo sapiens
cgcctcccgccgcctcgggc

SEQ ID NO: 1959977 - DNA, 21 bp, Homo sapiens
cgcctcgggccgcctcctcca

SEQ ID NO: 1959978 - DNA, 22 bp, Homo sapiens
cgcctcgggccgcctcctccag

SEQ ID NO: 1959979 - DNA, 16 bp, Homo sapiens
cgcgcgtgcccccagc

SEQ ID NO: 1959980 - DNA, 16 bp, Homo sapiens
cgcgctctgcccctcc

SEQ ID NO: 1959981 - DNA, 13 bp, Homo sapiens
cgcgtgcccccag

SEQ ID NO: 1959982 - DNA, 15 bp, Homo sapiens
cgctccggcagaggc

SEQ ID NO: 1959983 - DNA, 21 bp, Homo sapiens
cctattgctgtaaataaaaat

SEQ ID NO: 1959984 - DNA, 23 bp, Homo sapiens
cctattgctgtaaataaaaatag

SEQ ID NO: 1959985 - DNA, 20 bp, Homo sapiens
cctattttggacgtgtgagg

SEQ ID NO: 1959986 - DNA, 16 bp, Homo sapiens
cctcaaaagaaaatgt

SEQ ID NO: 1959987 - DNA, 12 bp, Homo sapiens
cctcatggctgt

SEQ ID NO: 1959988 - DNA, 17 bp, Homo sapiens
cctcatggctgttatct

SEQ ID NO: 1959989 - DNA, 16 bp, Homo sapiens
cctccaaatgctgtcg

SEQ ID NO: 1959990 - DNA, 21 bp, Homo sapiens
cctccagactcgagagggctg

SEQ ID NO: 1959991 - DNA, 20 bp, Homo sapiens
cctccagccacttatttcca

SEQ ID NO: 1959992 - DNA, 12 bp, Homo sapiens
cctcccccaggc

SEQ ID NO: 1959993 - DNA, 13 bp, Homo sapiens
cctcccccaggct

SEQ ID NO: 1959994 - DNA, 21 bp, Homo sapiens
cctcccccaggctgcgcctgc

SEQ ID NO: 1959995 - DNA, 22 bp, Homo sapiens
cctcccccaggctgcgcctgcc

SEQ ID NO: 1959996 - DNA, 23 bp, Homo sapiens
cctcccccaggctgcgcctgccc

SEQ ID NO: 1959997 - DNA, 13 bp, Homo sapiens
cctcccccgcaga

SEQ ID NO: 1959998 - DNA, 18 bp, Homo sapiens
cctccccgggggtccccg

SEQ ID NO: 1959999 - DNA, 14 bp, Homo sapiens
cctcccctggaagt

SEQ ID NO: 1960000 - DNA, 14 bp, Homo sapiens
cctccgtccccagg

SEQ ID NO: 1960001 - DNA, 15 bp, Homo sapiens
cctccgtccccaggg

SEQ ID NO: 1960002 - DNA, 14 bp, Homo sapiens
cctcctccagactc

SEQ ID NO: 1960003 - DNA, 20 bp, Homo sapiens
cctcctcgggcgcctgcgct

SEQ ID NO: 1960004 - DNA, 21 bp, Homo sapiens
cctcctcgggcgcctgcgctc

SEQ ID NO: 1960005 - DNA, 13 bp, Homo sapiens
cctcctctcctcg

SEQ ID NO: 1960006 - DNA, 14 bp, Homo sapiens
cctcctctcctcgt

SEQ ID NO: 1960007 - DNA, 23 bp, Homo sapiens
cctcctctcctcgtccggcctgc

SEQ ID NO: 1960008 - DNA, 15 bp, Homo sapiens
cctcctctgccccct

SEQ ID NO: 1960009 - DNA, 10 bp, Homo sapiens
cctcctgtct

SEQ ID NO: 1960010 - DNA, 21 bp, Homo sapiens
cctcctgtctcctctgtcagt

SEQ ID NO: 1960011 - DNA, 12 bp, Homo sapiens
cctcgggccgcc

SEQ ID NO: 1960012 - DNA, 16 bp, Homo sapiens
cctcgggcgcctgcgc

SEQ ID NO: 1960013 - DNA, 23 bp, Homo sapiens
cctcgggcgcctgcgctcctctg

SEQ ID NO: 1960014 - DNA, 18 bp, Homo sapiens
cctcggtcagcaccgtgg

SEQ ID NO: 1960015 - DNA, 19 bp, Homo sapiens
cctcgtccggcctgcagcc

SEQ ID NO: 1960016 - DNA, 12 bp, Homo sapiens
cctctcctcgtc

SEQ ID NO: 1960017 - DNA, 21 bp, Homo sapiens
cctctcctcgtccggcctgca

SEQ ID NO: 1960018 - DNA, 17 bp, Homo sapiens
cctctcgggctctctca

SEQ ID NO: 1960019 - DNA, 21 bp, Homo sapiens
cctctctctctctctctctgt

SEQ ID NO: 1960020 - DNA, 22 bp, Homo sapiens
cctctctctctctctctctgtt

SEQ ID NO: 1960021 - DNA, 12 bp, Homo sapiens
cctctgcagcct

SEQ ID NO: 1960022 - DNA, 13 bp, Homo sapiens
cctctgcagcctg

SEQ ID NO: 1960023 - DNA, 16 bp, Homo sapiens
cctctgcataaatatt

SEQ ID NO: 1960024 - DNA, 15 bp, Homo sapiens
cctctgtcagtttgt

SEQ ID NO: 1960025 - DNA, 13 bp, Homo sapiens
cctcttatcaagt

SEQ ID NO: 1960026 - DNA, 14 bp, Homo sapiens
cctcttcaatcccc

SEQ ID NO: 1960027 - DNA, 17 bp, Homo sapiens
cctcttctcagctccac

SEQ ID NO: 1960028 - DNA, 18 bp, Homo sapiens
cctcttctcagctccact

SEQ ID NO: 1960029 - DNA, 22 bp, Homo sapiens
cctcttctcagctccactctga

SEQ ID NO: 1960030 - DNA, 19 bp, Homo sapiens
cctgaaagtaatttcaaga

SEQ ID NO: 1960031 - DNA, 23 bp, Homo sapiens
cctgaaagtaatttcaagaatgt

SEQ ID NO: 1960032 - DNA, 15 bp, Homo sapiens
cctgaatcagaggca

SEQ ID NO: 1960033 - DNA, 16 bp, Homo sapiens
cctgaatcagaggcag

SEQ ID NO: 1960034 - DNA, 16 bp, Homo sapiens
cctgacttcccagctg

SEQ ID NO: 1960035 - DNA, 19 bp, Homo sapiens
cctgacttcccagctggca

SEQ ID NO: 1960036 - DNA, 13 bp, Homo sapiens
cctgagcctgtct

SEQ ID NO: 1960037 - DNA, 14 bp, Homo sapiens
cctgagctccaccc

SEQ ID NO: 1960038 - DNA, 17 bp, Homo sapiens
cctgagctccaccctcc

SEQ ID NO: 1960039 - DNA, 22 bp, Homo sapiens
cctgagctccaccctcccctct

SEQ ID NO: 1960040 - DNA, 12 bp, Homo sapiens
cctgagggaagc

SEQ ID NO: 1960041 - DNA, 16 bp, Homo sapiens
cctgagggaagcccac

SEQ ID NO: 1960042 - DNA, 18 bp, Homo sapiens
cctgagggaagcccaccc

SEQ ID NO: 1960043 - DNA, 20 bp, Homo sapiens
cctgagggaagcccacccgc

SEQ ID NO: 1960044 - DNA, 16 bp, Homo sapiens
cctgcagcccagaacg

SEQ ID NO: 1960045 - DNA, 13 bp, Homo sapiens
cctgccctccccc

SEQ ID NO: 1960046 - DNA, 14 bp, Homo sapiens
cctgccctgcacct

SEQ ID NO: 1960047 - DNA, 19 bp, Homo sapiens
cctgcctggaggagaagga

SEQ ID NO: 1960048 - DNA, 13 bp, Homo sapiens
cctgcgctcctct

SEQ ID NO: 1960049 - DNA, 14 bp, Homo sapiens
cctgcgctcctctg

SEQ ID NO: 1960050 - DNA, 20 bp, Homo sapiens
cctgcgctcctctgcagcct

SEQ ID NO: 1960051 - DNA, 21 bp, Homo sapiens
cctgcgctcctctgcagcctg

SEQ ID NO: 1960052 - DNA, 16 bp, Homo sapiens
cctgctcacgtctgtg

SEQ ID NO: 1960053 - DNA, 11 bp, Homo sapiens
cctgctcctcc

SEQ ID NO: 1960054 - DNA, 13 bp, Homo sapiens
cctgctcctccag

SEQ ID NO: 1960055 - DNA, 23 bp, Homo sapiens
cctgctgctcgggaaggcctgag

SEQ ID NO: 1960056 - DNA, 12 bp, Homo sapiens
cctggcgggcag

SEQ ID NO: 1960057 - DNA, 16 bp, Homo sapiens
cctggcgggcagcccc

SEQ ID NO: 1960058 - DNA, 18 bp, Homo sapiens
cctggcgggcagcccctg

SEQ ID NO: 1960059 - DNA, 14 bp, Homo sapiens
cctgggcctcccgt

SEQ ID NO: 1960060 - DNA, 20 bp, Homo sapiens
cctgggggctgttagctcag

SEQ ID NO: 1960061 - DNA, 14 bp, Homo sapiens
cctggggtctctga

SEQ ID NO: 1960062 - DNA, 21 bp, Homo sapiens
cctgggtaacaaagtgagacc

SEQ ID NO: 1960063 - DNA, 14 bp, Homo sapiens
cctgtctcctctgt

SEQ ID NO: 1960064 - DNA, 21 bp, Homo sapiens
cctgtctctacaaaaaaaatc

SEQ ID NO: 1960065 - DNA, 20 bp, Homo sapiens
cctgtctgtctgtctctctt

SEQ ID NO: 1960066 - DNA, 17 bp, Homo sapiens
cctgtggtttgttatca

SEQ ID NO: 1960067 - DNA, 20 bp, Homo sapiens
cctgttcacgtgactcctca

SEQ ID NO: 1960068 - DNA, 15 bp, Homo sapiens
ccttcccgcagcacc

SEQ ID NO: 1960069 - DNA, 13 bp, Homo sapiens
ccttcctgtcctg

SEQ ID NO: 1960070 - DNA, 22 bp, Homo sapiens
ccttctaatccatgtgctgctg

SEQ ID NO: 1960071 - DNA, 17 bp, Homo sapiens
ccttctacaaaagaagt

SEQ ID NO: 1960072 - DNA, 12 bp, Homo sapiens
ccttctccacag

SEQ ID NO: 1960073 - DNA, 14 bp, Homo sapiens
ccttgggcacggga

SEQ ID NO: 1960074 - DNA, 19 bp, Homo sapiens
ccttgtacagaaccagcac

SEQ ID NO: 1960075 - DNA, 16 bp, Homo sapiens
cctttctagcaattgc

SEQ ID NO: 1960076 - DNA, 18 bp, Homo sapiens
cgagagggctgagcccct

SEQ ID NO: 1960077 - DNA, 13 bp, Homo sapiens
cgatgtgttcttt

SEQ ID NO: 1960078 - DNA, 17 bp, Homo sapiens
cgcagagccccggagca

SEQ ID NO: 1960079 - DNA, 15 bp, Homo sapiens
cgcagcaccagcctg

SEQ ID NO: 1960080 - DNA, 19 bp, Homo sapiens
cgcagcaccagcctgagcc

SEQ ID NO: 1960081 - DNA, 22 bp, Homo sapiens
cgcagcaccagcctgagccaca

SEQ ID NO: 1960082 - DNA, 17 bp, Homo sapiens
cgcagccgcgctctgcc

SEQ ID NO: 1960083 - DNA, 22 bp, Homo sapiens
cgcagccgcgctctgcccctcc

SEQ ID NO: 1960084 - DNA, 18 bp, Homo sapiens
cgcagggcgctccggcag

SEQ ID NO: 1960085 - DNA, 15 bp, Homo sapiens
cgcccacccacaccc

SEQ ID NO: 1960086 - DNA, 20 bp, Homo sapiens
cgcccaccccgctgcctggc

SEQ ID NO: 1960087 - DNA, 13 bp, Homo sapiens
attcctacttaaa

SEQ ID NO: 1960088 - DNA, 14 bp, Homo sapiens
attcctacttaaac

SEQ ID NO: 1960089 - DNA, 22 bp, Homo sapiens
attcctacttaaacaaaaactt

SEQ ID NO: 1960090 - DNA, 14 bp, Homo sapiens
attcctcccctgga

SEQ ID NO: 1960091 - DNA, 13 bp, Homo sapiens
attcctcctgtct

SEQ ID NO: 1960092 - DNA, 21 bp, Homo sapiens
attctatttcaacttcaggaa

SEQ ID NO: 1960093 - DNA, 19 bp, Homo sapiens
attctcaatcatgggaatt

SEQ ID NO: 1960094 - DNA, 21 bp, Homo sapiens
attctcaatcatgggaatttt

SEQ ID NO: 1960095 - DNA, 22 bp, Homo sapiens
attctcaatcatgggaatttta

SEQ ID NO: 1960096 - DNA, 16 bp, Homo sapiens
attctctatgtacaga

SEQ ID NO: 1960097 - DNA, 22 bp, Homo sapiens
attcttgcactgtatccaagtt

SEQ ID NO: 1960098 - DNA, 18 bp, Homo sapiens
attctttcaatccacagt

SEQ ID NO: 1960099 - DNA, 21 bp, Homo sapiens
attctttcaatccacagtatt

SEQ ID NO: 1960100 - DNA, 16 bp, Homo sapiens
attgagacactgtcaa

SEQ ID NO: 1960101 - DNA, 22 bp, Homo sapiens
attgagttggttacctattgct

SEQ ID NO: 1960102 - DNA, 13 bp, Homo sapiens
attgcactaaaag

SEQ ID NO: 1960103 - DNA, 16 bp, Homo sapiens
attgcactaaaagtga

SEQ ID NO: 1960104 - DNA, 15 bp, Homo sapiens
attgccaaatattaa

SEQ ID NO: 1960105 - DNA, 23 bp, Homo sapiens
attgccttatattggatcaggaa

SEQ ID NO: 1960106 - DNA, 20 bp, Homo sapiens
attgctgtaaataaaaatag

SEQ ID NO: 1960107 - DNA, 17 bp, Homo sapiens
attgcttctctaaaaca

SEQ ID NO: 1960108 - DNA, 15 bp, Homo sapiens
attggaaaaaattag

SEQ ID NO: 1960109 - DNA, 20 bp, Homo sapiens
atttaaaaaacattttacag

SEQ ID NO: 1960110 - DNA, 16 bp, Homo sapiens
atttaagaatttacca

SEQ ID NO: 1960111 - DNA, 22 bp, Homo sapiens
atttaatcatttccagcaaaat

SEQ ID NO: 1960112 - DNA, 16 bp, Homo sapiens
atttaccagaaatatt

SEQ ID NO: 1960113 - DNA, 19 bp, Homo sapiens
atttaggaatgctcaatgt

SEQ ID NO: 1960114 - DNA, 22 bp, Homo sapiens
atttaggaatgctcaatgtgct

SEQ ID NO: 1960115 - DNA, 15 bp, Homo sapiens
atttatgcatgagaa

SEQ ID NO: 1960116 - DNA, 16 bp, Homo sapiens
atttatgcatttatgc

SEQ ID NO: 1960117 - DNA, 15 bp, Homo sapiens
atttatgtgtgaagc

SEQ ID NO: 1960118 - DNA, 20 bp, Homo sapiens
atttcaagaatgtttcagtt

SEQ ID NO: 1960119 - DNA, 19 bp, Homo sapiens
atttcattatttttcaatt

SEQ ID NO: 1960120 - DNA, 17 bp, Homo sapiens
atttccagcaaaatata

SEQ ID NO: 1960121 - DNA, 18 bp, Homo sapiens
atttccagcaaaatatat

SEQ ID NO: 1960122 - DNA, 14 bp, Homo sapiens
atttcctgctcctc

SEQ ID NO: 1960123 - DNA, 21 bp, Homo sapiens
atttcctttggcaatatcata

SEQ ID NO: 1960124 - DNA, 23 bp, Homo sapiens
atttctagatatgagaaatataa

SEQ ID NO: 1960125 - DNA, 19 bp, Homo sapiens
atttctatagccaaagctg

SEQ ID NO: 1960126 - DNA, 18 bp, Homo sapiens
atttctattttgcagcag

SEQ ID NO: 1960127 - DNA, 19 bp, Homo sapiens
atttcttggtatgatcatt

SEQ ID NO: 1960128 - DNA, 18 bp, Homo sapiens
atttgactttctgtctgt

SEQ ID NO: 1960129 - DNA, 21 bp, Homo sapiens
atttgcgtaaatggttttcaa

SEQ ID NO: 1960130 - DNA, 16 bp, Homo sapiens
atttgctgaataacaa

SEQ ID NO: 1960131 - DNA, 20 bp, Homo sapiens
atttgctgaataacaacaat

SEQ ID NO: 1960132 - DNA, 21 bp, Homo sapiens
atttgctgaataacaacaatt

SEQ ID NO: 1960133 - DNA, 17 bp, Homo sapiens
atttggctatgccttca

SEQ ID NO: 1960134 - DNA, 14 bp, Homo sapiens
atttgggttgcaaa

SEQ ID NO: 1960135 - DNA, 22 bp, Homo sapiens
atttgtcagtgtagatcaactc

SEQ ID NO: 1960136 - DNA, 23 bp, Homo sapiens
attttaaaacttcatctgtctgt

SEQ ID NO: 1960137 - DNA, 15 bp, Homo sapiens
attttaattcaggtg

SEQ ID NO: 1960138 - DNA, 15 bp, Homo sapiens
attttcaagttattc

SEQ ID NO: 1960139 - DNA, 21 bp, Homo sapiens
attttcaagttattcagaaat

SEQ ID NO: 1960140 - DNA, 14 bp, Homo sapiens
attttctctcctcg

SEQ ID NO: 1960141 - DNA, 18 bp, Homo sapiens
attttctgagtagcatat

SEQ ID NO: 1960142 - DNA, 19 bp, Homo sapiens
attttgaaaggagaaaaaa

SEQ ID NO: 1960143 - DNA, 16 bp, Homo sapiens
attttggacgtgtgag

SEQ ID NO: 1960144 - DNA, 18 bp, Homo sapiens
attttggacgtgtgagga

SEQ ID NO: 1960145 - DNA, 14 bp, Homo sapiens
attttgtagctagt

SEQ ID NO: 1960146 - DNA, 18 bp, Homo sapiens
attttgttatagttcata

SEQ ID NO: 1960147 - DNA, 18 bp, Homo sapiens
atttttctactgctcttt

SEQ ID NO: 1960148 - DNA, 20 bp, Homo sapiens
atttttctttagtcatttaa

SEQ ID NO: 1960149 - DNA, 23 bp, Homo sapiens
atttttctttagtcatttaagaa

SEQ ID NO: 1960150 - DNA, 17 bp, Homo sapiens
attttttttttcaggtt

SEQ ID NO: 1960151 - DNA, 23 bp, Homo sapiens
attttttttttcaggttaaatta

SEQ ID NO: 1960152 - DNA, 18 bp, Homo sapiens
caaaaactttccatgaca

SEQ ID NO: 1960153 - DNA, 21 bp, Homo sapiens
caaaaactttccatgacagta

SEQ ID NO: 1960154 - DNA, 23 bp, Homo sapiens
caaaaactttccatgacagtagc

SEQ ID NO: 1960155 - DNA, 12 bp, Homo sapiens
caaaacaacagc

SEQ ID NO: 1960156 - DNA, 16 bp, Homo sapiens
caaaacaacagcaaca

SEQ ID NO: 1960157 - DNA, 12 bp, Homo sapiens
caaaagatatga

SEQ ID NO: 1960158 - DNA, 15 bp, Homo sapiens
caaaagatctcctgt

SEQ ID NO: 1960159 - DNA, 21 bp, Homo sapiens
caaaaggatgatttaacatta

SEQ ID NO: 1960160 - DNA, 16 bp, Homo sapiens
caaaataaaaccagaa

SEQ ID NO: 1960161 - DNA, 15 bp, Homo sapiens
caaaatatatgtttg

SEQ ID NO: 1960162 - DNA, 18 bp, Homo sapiens
caaaatatatgtttggct

SEQ ID NO: 1960163 - DNA, 23 bp, Homo sapiens
caaaatatatgtttggctgaaat

SEQ ID NO: 1960164 - DNA, 21 bp, Homo sapiens
caaaatgtgccgtctttggtt

SEQ ID NO: 1960165 - DNA, 14 bp, Homo sapiens
caaacagtgtggct

SEQ ID NO: 1960166 - DNA, 15 bp, Homo sapiens
caaaccaatttgttc

SEQ ID NO: 1960167 - DNA, 18 bp, Homo sapiens
caaaccaatttgttctgt

SEQ ID NO: 1960168 - DNA, 20 bp, Homo sapiens
caaaccaatttgttctgtgc

SEQ ID NO: 1960169 - DNA, 15 bp, Homo sapiens
caaagaaaaaagaag

SEQ ID NO: 1960170 - DNA, 22 bp, Homo sapiens
caaagaaaattggtacttaccc

SEQ ID NO: 1960171 - DNA, 20 bp, Homo sapiens
caaagcatgctcagtattga

SEQ ID NO: 1960172 - DNA, 20 bp, Homo sapiens
caaagcatttgactttctgt

SEQ ID NO: 1960173 - DNA, 23 bp, Homo sapiens
caaagccctccctgtctgtctgt

SEQ ID NO: 1960174 - DNA, 17 bp, Homo sapiens
caaaggttgtacatagt

SEQ ID NO: 1960175 - DNA, 20 bp, Homo sapiens
caaataaccctgaatcagag

SEQ ID NO: 1960176 - DNA, 13 bp, Homo sapiens
caaataatttaga

SEQ ID NO: 1960177 - DNA, 17 bp, Homo sapiens
caaataatttagaaata

SEQ ID NO: 1960178 - DNA, 22 bp, Homo sapiens
caaatgaagattcagcagtgtc

SEQ ID NO: 1960179 - DNA, 18 bp, Homo sapiens
caaatggatgtaatatag

SEQ ID NO: 1960180 - DNA, 12 bp, Homo sapiens
caacaacaaagc

SEQ ID NO: 1960181 - DNA, 14 bp, Homo sapiens
caacagaacaacaa

SEQ ID NO: 1960182 - DNA, 20 bp, Homo sapiens
caacagaacaacaacaaagc

SEQ ID NO: 1960183 - DNA, 18 bp, Homo sapiens
caacagcaacaacaacag

SEQ ID NO: 1960184 - DNA, 22 bp, Homo sapiens
caacagcaacaacaacagaaca

SEQ ID NO: 1960185 - DNA, 15 bp, Homo sapiens
caacaggattttcaa

SEQ ID NO: 1960186 - DNA, 13 bp, Homo sapiens
caaccatgttctt

SEQ ID NO: 1960187 - DNA, 13 bp, Homo sapiens
caacccccacctc

SEQ ID NO: 1960188 - DNA, 17 bp, Homo sapiens
caacccccacctcccgg

SEQ ID NO: 1960189 - DNA, 18 bp, Homo sapiens
caacccccacctcccggt

SEQ ID NO: 1960190 - DNA, 13 bp, Homo sapiens
caaccctgccctg

SEQ ID NO: 1960191 - DNA, 18 bp, Homo sapiens
caaccctgccctgcacct

SEQ ID NO: 1960192 - DNA, 16 bp, Homo sapiens
caacctctcagatccc

SEQ ID NO: 1960193 - DNA, 23 bp, Homo sapiens
caacctgttcacgtgactcctca

SEQ ID NO: 1960194 - DNA, 23 bp, Homo sapiens
caagaatagttgtcagaatatgt

SEQ ID NO: 1960195 - DNA, 15 bp, Homo sapiens
caagaatgtttcagt

SEQ ID NO: 1960196 - DNA, 22 bp, Homo sapiens
caagatagctccttcatgcttt

SEQ ID NO: 1960197 - DNA, 23 bp, Homo sapiens
caagattaagttataccagcaaa

SEQ ID NO: 1960198 - DNA, 18 bp, Homo sapiens
caagctcacttgctttag

SEQ ID NO: 1960199 - DNA, 13 bp, Homo sapiens
agttccagcagtt

SEQ ID NO: 1960200 - DNA, 18 bp, Homo sapiens
agttcccttgattcaaat

SEQ ID NO: 1960201 - DNA, 21 bp, Homo sapiens
agttcctggaattagttggca

SEQ ID NO: 1960202 - DNA, 12 bp, Homo sapiens
agttctgatgag

SEQ ID NO: 1960203 - DNA, 13 bp, Homo sapiens
agttcttaagact

SEQ ID NO: 1960204 - DNA, 20 bp, Homo sapiens
agttggcagagaaaatgctg

SEQ ID NO: 1960205 - DNA, 21 bp, Homo sapiens
agttgtaacattctatttcaa

SEQ ID NO: 1960206 - DNA, 15 bp, Homo sapiens
agttgtgcctcattt

SEQ ID NO: 1960207 - DNA, 20 bp, Homo sapiens
agtttcatttttcattttct

SEQ ID NO: 1960208 - DNA, 22 bp, Homo sapiens
agtttcatttttcattttctct

SEQ ID NO: 1960209 - DNA, 12 bp, Homo sapiens
agtttgtgaagt

SEQ ID NO: 1960210 - DNA, 22 bp, Homo sapiens
agtttgtgaagtgattgacatt

SEQ ID NO: 1960211 - DNA, 12 bp, Homo sapiens
agtttgttcagt

SEQ ID NO: 1960212 - DNA, 17 bp, Homo sapiens
agttttcttttaatttt

SEQ ID NO: 1960213 - DNA, 14 bp, Homo sapiens
agtttttttgttca

SEQ ID NO: 1960214 - DNA, 11 bp, Homo sapiens
ataaactgtga

SEQ ID NO: 1960215 - DNA, 12 bp, Homo sapiens
ataaactgtgag

SEQ ID NO: 1960216 - DNA, 14 bp, Homo sapiens
ataaagaaaccttt

SEQ ID NO: 1960217 - DNA, 15 bp, Homo sapiens
ataacaggcattgca

SEQ ID NO: 1960218 - DNA, 23 bp, Homo sapiens
ataacaggcattgcactaaaagt

SEQ ID NO: 1960219 - DNA, 13 bp, Homo sapiens
ataacattgtaaa

SEQ ID NO: 1960220 - DNA, 24 bp, Homo sapiens
ataaccctgaatcagaggcagaga

SEQ ID NO: 1960221 - DNA, 17 bp, Homo sapiens
ataagttcctctgaaga

SEQ ID NO: 1960222 - DNA, 21 bp, Homo sapiens
ataatgcttctttcctcttaa

SEQ ID NO: 1960223 - DNA, 17 bp, Homo sapiens
ataatggcctcttaaaa

SEQ ID NO: 1960224 - DNA, 19 bp, Homo sapiens
ataatggcctcttaaaaat

SEQ ID NO: 1960225 - DNA, 14 bp, Homo sapiens
ataattaaatgaaa

SEQ ID NO: 1960226 - DNA, 15 bp, Homo sapiens
ataattaaatgaaat

SEQ ID NO: 1960227 - DNA, 13 bp, Homo sapiens
ataatttagaaat

SEQ ID NO: 1960228 - DNA, 20 bp, Homo sapiens
ataatttagaaataaaagat

SEQ ID NO: 1960229 - DNA, 17 bp, Homo sapiens
ataattttattgctgga

SEQ ID NO: 1960230 - DNA, 18 bp, Homo sapiens
atacaacaggattttcaa

SEQ ID NO: 1960231 - DNA, 19 bp, Homo sapiens
atacaacaggattttcaag

SEQ ID NO: 1960232 - DNA, 20 bp, Homo sapiens
atacaagttacatacattta

SEQ ID NO: 1960233 - DNA, 19 bp, Homo sapiens
atacatgatgatttcagaa

SEQ ID NO: 1960234 - DNA, 18 bp, Homo sapiens
atacattattagaatata

SEQ ID NO: 1960235 - DNA, 21 bp, Homo sapiens
ataccacacttaaaagatggt

SEQ ID NO: 1960236 - DNA, 14 bp, Homo sapiens
ataccattttgaaa

SEQ ID NO: 1960237 - DNA, 24 bp, Homo sapiens
atacctagtgatacggatttagct

SEQ ID NO: 1960238 - DNA, 16 bp, Homo sapiens
atactatttattaaaa

SEQ ID NO: 1960239 - DNA, 17 bp, Homo sapiens
atactatttattaaaac

SEQ ID NO: 1960240 - DNA, 21 bp, Homo sapiens
atactgatgagacaacacaca

SEQ ID NO: 1960241 - DNA, 22 bp, Homo sapiens
atactgatgagacaacacacac

SEQ ID NO: 1960242 - DNA, 13 bp, Homo sapiens
atagaacaaaaga

SEQ ID NO: 1960243 - DNA, 20 bp, Homo sapiens
atagataccattttgaaata

SEQ ID NO: 1960244 - DNA, 20 bp, Homo sapiens
atagcatgtaatattaaatt

SEQ ID NO: 1960245 - DNA, 16 bp, Homo sapiens
atagcattgttcttct

SEQ ID NO: 1960246 - DNA, 17 bp, Homo sapiens
atagctataaatagtga

SEQ ID NO: 1960247 - DNA, 13 bp, Homo sapiens
ataggagaggaaa

SEQ ID NO: 1960248 - DNA, 19 bp, Homo sapiens
ataggatttgcactgcttt

SEQ ID NO: 1960249 - DNA, 17 bp, Homo sapiens
ataggcttgtgtaattt

SEQ ID NO: 1960250 - DNA, 18 bp, Homo sapiens
atagtgccttgattttaa

SEQ ID NO: 1960251 - DNA, 23 bp, Homo sapiens
atagtgccttgattttaattcag

SEQ ID NO: 1960252 - DNA, 17 bp, Homo sapiens
atagtggtcatttggtg

SEQ ID NO: 1960253 - DNA, 13 bp, Homo sapiens
atagttggaaata

SEQ ID NO: 1960254 - DNA, 13 bp, Homo sapiens
atataaaaataat

SEQ ID NO: 1960255 - DNA, 20 bp, Homo sapiens
atataaaaataattaaaaca

SEQ ID NO: 1960256 - DNA, 15 bp, Homo sapiens
atataaactgtgaga

SEQ ID NO: 1960257 - DNA, 14 bp, Homo sapiens
atataaatgaatga

SEQ ID NO: 1960258 - DNA, 18 bp, Homo sapiens
atataatggcctcttaaa

SEQ ID NO: 1960259 - DNA, 14 bp, Homo sapiens
atatagggtttgtt

SEQ ID NO: 1960260 - DNA, 22 bp, Homo sapiens
atatattgccaaatattaagaa

SEQ ID NO: 1960261 - DNA, 22 bp, Homo sapiens
atatcaaggagctcttctagct

SEQ ID NO: 1960262 - DNA, 13 bp, Homo sapiens
atatcattatagc

SEQ ID NO: 1960263 - DNA, 18 bp, Homo sapiens
atatctgagttgtgcctc

SEQ ID NO: 1960264 - DNA, 16 bp, Homo sapiens
atatgaaaactaagtt

SEQ ID NO: 1960265 - DNA, 17 bp, Homo sapiens
atatgtctagataaaag

SEQ ID NO: 1960266 - DNA, 20 bp, Homo sapiens
atatgtctagataaaaggag

SEQ ID NO: 1960267 - DNA, 14 bp, Homo sapiens
atatgtctttaaaa

SEQ ID NO: 1960268 - DNA, 14 bp, Homo sapiens
atattgatgtaact

SEQ ID NO: 1960269 - DNA, 21 bp, Homo sapiens
atattgccaaatattaagaag

SEQ ID NO: 1960270 - DNA, 23 bp, Homo sapiens
atattgtaactcacatgccttct

SEQ ID NO: 1960271 - DNA, 19 bp, Homo sapiens
atatttgcgtaaatggttt

SEQ ID NO: 1960272 - DNA, 19 bp, Homo sapiens
atattttctgagtagcata

SEQ ID NO: 1960273 - DNA, 20 bp, Homo sapiens
atattttgttatagttcata

SEQ ID NO: 1960274 - DNA, 16 bp, Homo sapiens
atattttttgatggaa

SEQ ID NO: 1960275 - DNA, 11 bp, Homo sapiens
atcaaagccct

SEQ ID NO: 1960276 - DNA, 17 bp, Homo sapiens
atcaagaatagttgtca

SEQ ID NO: 1960277 - DNA, 14 bp, Homo sapiens
atcaagtctgtgaa

SEQ ID NO: 1960278 - DNA, 15 bp, Homo sapiens
atcaatcagtaatta

SEQ ID NO: 1960279 - DNA, 21 bp, Homo sapiens
atcacatgcccctcttagaag

SEQ ID NO: 1960280 - DNA, 20 bp, Homo sapiens
atcacctaattaatttcagt

SEQ ID NO: 1960281 - DNA, 20 bp, Homo sapiens
atcacgggcccgctcaacct

SEQ ID NO: 1960282 - DNA, 13 bp, Homo sapiens
atcagaggcagag

SEQ ID NO: 1960283 - DNA, 18 bp, Homo sapiens
atcaggtaaactgatgct

SEQ ID NO: 1960284 - DNA, 20 bp, Homo sapiens
atcatattctaaaagtaata

SEQ ID NO: 1960285 - DNA, 12 bp, Homo sapiens
atcatgcttcta

SEQ ID NO: 1960286 - DNA, 17 bp, Homo sapiens
atcatgggaattttaac

SEQ ID NO: 1960287 - DNA, 19 bp, Homo sapiens
atcattatagcatgtaata

SEQ ID NO: 1960288 - DNA, 20 bp, Homo sapiens
atcattatagcatgtaatat

SEQ ID NO: 1960289 - DNA, 19 bp, Homo sapiens
atcattggtatctgatatc

SEQ ID NO: 1960290 - DNA, 22 bp, Homo sapiens
atcattggtatctgatatctgt

SEQ ID NO: 1960291 - DNA, 17 bp, Homo sapiens
atcatttccagcaaaat

SEQ ID NO: 1960292 - DNA, 21 bp, Homo sapiens
atcatttccagcaaaatatat

SEQ ID NO: 1960293 - DNA, 19 bp, Homo sapiens
atccatcggtttatactat

SEQ ID NO: 1960294 - DNA, 21 bp, Homo sapiens
atcccaaatctatagcattta

SEQ ID NO: 1960295 - DNA, 11 bp, Homo sapiens
atcccaagtca

SEQ ID NO: 1960296 - DNA, 20 bp, Homo sapiens
atcccaagtcaaacagtgtg

SEQ ID NO: 1960297 - DNA, 18 bp, Homo sapiens
atccccataatgcttctt

SEQ ID NO: 1960298 - DNA, 15 bp, Homo sapiens
atccctcatttcatt

SEQ ID NO: 1960299 - DNA, 17 bp, Homo sapiens
atccctcatttcattat

SEQ ID NO: 1960300 - DNA, 21 bp, Homo sapiens
atcctctcttcttttcccatt

SEQ ID NO: 1960301 - DNA, 22 bp, Homo sapiens
atccttcacaatttcaatgctt

SEQ ID NO: 1960302 - DNA, 15 bp, Homo sapiens
atccttcccgcagca

SEQ ID NO: 1960303 - DNA, 23 bp, Homo sapiens
atccttcccgcagcaccagcctg

SEQ ID NO: 1960304 - DNA, 24 bp, Homo sapiens
atccttcccgcagcaccagcctga

SEQ ID NO: 1960305 - DNA, 19 bp, Homo sapiens
atctactagaaccttctaa

SEQ ID NO: 1960306 - DNA, 20 bp, Homo sapiens
atctagtaggtctgcacaca

SEQ ID NO: 1960307 - DNA, 15 bp, Homo sapiens
atctctcaaaatgtg

SEQ ID NO: 1960308 - DNA, 18 bp, Homo sapiens
atctcttccttacaggtg

SEQ ID NO: 1960309 - DNA, 15 bp, Homo sapiens
atctgaggagtccaa

SEQ ID NO: 1960310 - DNA, 17 bp, Homo sapiens
atctgatgatgttctga

SEQ ID NO: 1960311 - DNA, 19 bp, Homo sapiens
atctgatgatgttctgaaa

SEQ ID NO: 1960312 - DNA, 17 bp, Homo sapiens
cataacaggcattgcac

SEQ ID NO: 1960313 - DNA, 21 bp, Homo sapiens
cataacaggcattgcactaaa

SEQ ID NO: 1960314 - DNA, 20 bp, Homo sapiens
catacacagaaatcctaaca

SEQ ID NO: 1960315 - DNA, 18 bp, Homo sapiens
catactgatgagacaaca

SEQ ID NO: 1960316 - DNA, 20 bp, Homo sapiens
catactgatgagacaacaca

SEQ ID NO: 1960317 - DNA, 22 bp, Homo sapiens
catactgatgagacaacacaca

SEQ ID NO: 1960318 - DNA, 16 bp, Homo sapiens
catactttggctgtga

SEQ ID NO: 1960319 - DNA, 18 bp, Homo sapiens
catagataccattttgaa

SEQ ID NO: 1960320 - DNA, 20 bp, Homo sapiens
catagataccattttgaaat

SEQ ID NO: 1960321 - DNA, 21 bp, Homo sapiens
catagataccattttgaaata

SEQ ID NO: 1960322 - DNA, 22 bp, Homo sapiens
catagataccattttgaaatat

SEQ ID NO: 1960323 - DNA, 18 bp, Homo sapiens
cataggggcatagccagt

SEQ ID NO: 1960324 - DNA, 18 bp, Homo sapiens
catagtgccttgatttta

SEQ ID NO: 1960325 - DNA, 13 bp, Homo sapiens
catagttggaaat

SEQ ID NO: 1960326 - DNA, 17 bp, Homo sapiens
catagttggaaatattt

SEQ ID NO: 1960327 - DNA, 23 bp, Homo sapiens
catattatatcagactgctttga

SEQ ID NO: 1960328 - DNA, 14 bp, Homo sapiens
catattctaaaagt

SEQ ID NO: 1960329 - DNA, 18 bp, Homo sapiens
catccagtagagatttcc

SEQ ID NO: 1960330 - DNA, 18 bp, Homo sapiens
catccgctgcgctcccac

SEQ ID NO: 1960331 - DNA, 11 bp, Homo sapiens
catcctcttat

SEQ ID NO: 1960332 - DNA, 14 bp, Homo sapiens
catccttcccgcag

SEQ ID NO: 1960333 - DNA, 15 bp, Homo sapiens
catccttcccgcagc

SEQ ID NO: 1960334 - DNA, 17 bp, Homo sapiens
catccttcccgcagcac

SEQ ID NO: 1960335 - DNA, 13 bp, Homo sapiens
catctgaggagtc

SEQ ID NO: 1960336 - DNA, 15 bp, Homo sapiens
catctgaggagtcca

SEQ ID NO: 1960337 - DNA, 13 bp, Homo sapiens
ccctcccccgcag

SEQ ID NO: 1960338 - DNA, 18 bp, Homo sapiens
ccctcccccgcagacaga

SEQ ID NO: 1960339 - DNA, 16 bp, Homo sapiens
ccctccgtccccaggg

SEQ ID NO: 1960340 - DNA, 21 bp, Homo sapiens
ccctcctcgggcgcctgcgct

SEQ ID NO: 1960341 - DNA, 15 bp, Homo sapiens
ccctcctctcctcgt

SEQ ID NO: 1960342 - DNA, 13 bp, Homo sapiens
ccctcctctgccc

SEQ ID NO: 1960343 - DNA, 16 bp, Homo sapiens
ccctcctctgccccct

SEQ ID NO: 1960344 - DNA, 22 bp, Homo sapiens
ccctctcctgagcctgtctctc

SEQ ID NO: 1960345 - DNA, 17 bp, Homo sapiens
ccctcttctcagctcca

SEQ ID NO: 1960346 - DNA, 22 bp, Homo sapiens
ccctcttcttgcggcaccgccc

SEQ ID NO: 1960347 - DNA, 16 bp, Homo sapiens
ccctctttctctctgt

SEQ ID NO: 1960348 - DNA, 17 bp, Homo sapiens
ccctctttctctctgtg

SEQ ID NO: 1960349 - DNA, 19 bp, Homo sapiens
ccctctttctctctgtgtg

SEQ ID NO: 1960350 - DNA, 20 bp, Homo sapiens
ccctgacatgctaacctctc

SEQ ID NO: 1960351 - DNA, 15 bp, Homo sapiens
ccctgacttcccagc

SEQ ID NO: 1960352 - DNA, 22 bp, Homo sapiens
ccctgacttcccagctggcagc

SEQ ID NO: 1960353 - DNA, 19 bp, Homo sapiens
ccctgcaccttgggcacgg

SEQ ID NO: 1960354 - DNA, 14 bp, Homo sapiens
ccctgccccatgaa

SEQ ID NO: 1960355 - DNA, 15 bp, Homo sapiens
ccctgccctccccca

SEQ ID NO: 1960356 - DNA, 13 bp, Homo sapiens
ccctgccctgcac

SEQ ID NO: 1960357 - DNA, 23 bp, Homo sapiens
ccctggaagttgtcctttctgat

SEQ ID NO: 1960358 - DNA, 17 bp, Homo sapiens
ccctgggcctcccgtcc

SEQ ID NO: 1960359 - DNA, 15 bp, Homo sapiens
ccctggggtctctga

SEQ ID NO: 1960360 - DNA, 21 bp, Homo sapiens
ccctgtctgtctgtctctctt

SEQ ID NO: 1960361 - DNA, 12 bp, Homo sapiens
ccctgtgggagt

SEQ ID NO: 1960362 - DNA, 16 bp, Homo sapiens
ccctgtgggagtccac

SEQ ID NO: 1960363 - DNA, 20 bp, Homo sapiens
ccctgtgggagtccactttc

SEQ ID NO: 1960364 - DNA, 13 bp, Homo sapiens
cccttcctgtcct

SEQ ID NO: 1960365 - DNA, 17 bp, Homo sapiens
ccctttcaaattgcctt

SEQ ID NO: 1960366 - DNA, 14 bp, Homo sapiens
ccgagcgcgtgcct

SEQ ID NO: 1960367 - DNA, 21 bp, Homo sapiens
gattcctacttaaacaaaaac

SEQ ID NO: 1960368 - DNA, 13 bp, Homo sapiens
gattctcttaaat

SEQ ID NO: 1960369 - DNA, 17 bp, Homo sapiens
gattcttactgttcttc

SEQ ID NO: 1960370 - DNA, 12 bp, Homo sapiens
gatttcagaaac

SEQ ID NO: 1960371 - DNA, 16 bp, Homo sapiens
gatttgttgaaatctt

SEQ ID NO: 1960372 - DNA, 14 bp, Homo sapiens
gattttttttttca

SEQ ID NO: 1960373 - DNA, 18 bp, Homo sapiens
gattttttttttcaggtt

SEQ ID NO: 1960374 - DNA, 21 bp, Homo sapiens
gcaaaatacatgatgatttca

SEQ ID NO: 1960375 - DNA, 21 bp, Homo sapiens
gcaaaatatatgtttggctga

SEQ ID NO: 1960376 - DNA, 19 bp, Homo sapiens
gcaaaccaatttgttctgt

SEQ ID NO: 1960377 - DNA, 21 bp, Homo sapiens
gcaaagcatgccaatttctct

SEQ ID NO: 1960378 - DNA, 24 bp, Homo sapiens
gcaaatttctagatatgagaaata

SEQ ID NO: 1960379 - DNA, 17 bp, Homo sapiens
gcaacaacaacagaaca

SEQ ID NO: 1960380 - DNA, 16 bp, Homo sapiens
gcaatttacttggaat

SEQ ID NO: 1960381 - DNA, 21 bp, Homo sapiens
gcacaccaaattgctgagatg

SEQ ID NO: 1960382 - DNA, 14 bp, Homo sapiens
gcaccagcctgagc

SEQ ID NO: 1960383 - DNA, 17 bp, Homo sapiens
gcaccagcctgagccac

SEQ ID NO: 1960384 - DNA, 22 bp, Homo sapiens
gcacccccagcctcccccaggc

SEQ ID NO: 1960385 - DNA, 15 bp, Homo sapiens
gcaccgcccaacccc

SEQ ID NO: 1960386 - DNA, 23 bp, Homo sapiens
gcaccgcccaacccccacctccc

SEQ ID NO: 1960387 - DNA, 15 bp, Homo sapiens
gcaccgcccacccac

SEQ ID NO: 1960388 - DNA, 13 bp, Homo sapiens
gcacctcttgaag

SEQ ID NO: 1960389 - DNA, 21 bp, Homo sapiens
gcaccttgggcacgggagagc

SEQ ID NO: 1960390 - DNA, 15 bp, Homo sapiens
gcactaaaagtgatg

SEQ ID NO: 1960391 - DNA, 13 bp, Homo sapiens
gcactcccagggc

SEQ ID NO: 1960392 - DNA, 15 bp, Homo sapiens
gcactcccagggccc

SEQ ID NO: 1960393 - DNA, 16 bp, Homo sapiens
gcactcccagggcccg

SEQ ID NO: 1960394 - DNA, 19 bp, Homo sapiens
gcactcttttgagcagtaa

SEQ ID NO: 1960395 - DNA, 16 bp, Homo sapiens
gcactttgggaggctg

SEQ ID NO: 1960396 - DNA, 17 bp, Homo sapiens
gcagacagacagacaga

SEQ ID NO: 1960397 - DNA, 16 bp, Homo sapiens
gcagagacggcagccc

SEQ ID NO: 1960398 - DNA, 19 bp, Homo sapiens
gcagagacggcagccccat

SEQ ID NO: 1960399 - DNA, 15 bp, Homo sapiens
gcagagccccggagc

SEQ ID NO: 1960400 - DNA, 13 bp, Homo sapiens
gcagagctgagtc

SEQ ID NO: 1960401 - DNA, 20 bp, Homo sapiens
gcagagctgagtcggctggg

SEQ ID NO: 1960402 - DNA, 11 bp, Homo sapiens
gcagaggcagg

SEQ ID NO: 1960403 - DNA, 18 bp, Homo sapiens
gcagaggcagggccctgg

SEQ ID NO: 1960404 - DNA, 13 bp, Homo sapiens
gcagcaccagcct

SEQ ID NO: 1960405 - DNA, 17 bp, Homo sapiens
gcagcaccagcctgagc

SEQ ID NO: 1960406 - DNA, 17 bp, Homo sapiens
gcagcagcagcagcagt

SEQ ID NO: 1960407 - DNA, 19 bp, Homo sapiens
gcagcccagaacgggcctc

SEQ ID NO: 1960408 - DNA, 17 bp, Homo sapiens
gcagccccatccttccc

SEQ ID NO: 1960409 - DNA, 15 bp, Homo sapiens
gcagcccctgctgga

SEQ ID NO: 1960410 - DNA, 19 bp, Homo sapiens
gcagccgcgctctgcccct

SEQ ID NO: 1960411 - DNA, 21 bp, Homo sapiens
gcagccgcgctctgcccctcc

SEQ ID NO: 1960412 - DNA, 21 bp, Homo sapiens
gcccgccctcctctgccccct

SEQ ID NO: 1960413 - DNA, 22 bp, Homo sapiens
gcccgccctcctctgccccctc

SEQ ID NO: 1960414 - DNA, 23 bp, Homo sapiens
gcccgccggttggccggctggcc

SEQ ID NO: 1960415 - DNA, 18 bp, Homo sapiens
gcccgctcaacctctcag

SEQ ID NO: 1960416 - DNA, 14 bp, Homo sapiens
gcccggccaaggac

SEQ ID NO: 1960417 - DNA, 17 bp, Homo sapiens
gcccggccaaggacact

SEQ ID NO: 1960418 - DNA, 19 bp, Homo sapiens
gcccggcccacgcagagcc

SEQ ID NO: 1960419 - DNA, 21 bp, Homo sapiens
gcccggcccacgcagagcccc

SEQ ID NO: 1960420 - DNA, 22 bp, Homo sapiens
gcccggcccacgcagagccccg

SEQ ID NO: 1960421 - DNA, 14 bp, Homo sapiens
gcccgtgcgcagcc

SEQ ID NO: 1960422 - DNA, 15 bp, Homo sapiens
gcccgtgcgcagccg

SEQ ID NO: 1960423 - DNA, 10 bp, Homo sapiens
gccctccccc

SEQ ID NO: 1960424 - DNA, 16 bp, Homo sapiens
gccctcctctgccccc

SEQ ID NO: 1960425 - DNA, 17 bp, Homo sapiens
gccctcctctgccccct

SEQ ID NO: 1960426 - DNA, 18 bp, Homo sapiens
gccctcctctgccccctc

SEQ ID NO: 1960427 - DNA, 15 bp, Homo sapiens
gccctctttctctct

SEQ ID NO: 1960428 - DNA, 17 bp, Homo sapiens
gccctctttctctctgt

SEQ ID NO: 1960429 - DNA, 18 bp, Homo sapiens
gccctctttctctctgtg

SEQ ID NO: 1960430 - DNA, 21 bp, Homo sapiens
gccctctttctctctgtgtgg

SEQ ID NO: 1960431 - DNA, 22 bp, Homo sapiens
gccctctttctctctgtgtggc

SEQ ID NO: 1960432 - DNA, 16 bp, Homo sapiens
gccctgcaccttgggc

SEQ ID NO: 1960433 - DNA, 12 bp, Homo sapiens
gccctgccctcc

SEQ ID NO: 1960434 - DNA, 15 bp, Homo sapiens
gccctgccctccccc

SEQ ID NO: 1960435 - DNA, 17 bp, Homo sapiens
gccctggggtctctgag

SEQ ID NO: 1960436 - DNA, 17 bp, Homo sapiens
gccctgtgggagtccac

SEQ ID NO: 1960437 - DNA, 23 bp, Homo sapiens
gccctgtgggagtccactttcct

SEQ ID NO: 1960438 - DNA, 20 bp, Homo sapiens
gccgcagggcgctccggcag

SEQ ID NO: 1960439 - DNA, 21 bp, Homo sapiens
gccgcagggcgctccggcaga

SEQ ID NO: 1960440 - DNA, 13 bp, Homo sapiens
gccgcctcctcca

SEQ ID NO: 1960441 - DNA, 23 bp, Homo sapiens
gccgcctcgggccgcctcctcca

SEQ ID NO: 1960442 - DNA, 21 bp, Homo sapiens
gccggctggccggtccacccc

SEQ ID NO: 1960443 - DNA, 17 bp, Homo sapiens
gccggggctggccctgc

SEQ ID NO: 1960444 - DNA, 18 bp, Homo sapiens
gccggggctggccctgcc

SEQ ID NO: 1960445 - DNA, 19 bp, Homo sapiens
gccggggctggccctgccc

SEQ ID NO: 1960446 - DNA, 15 bp, Homo sapiens
gccggttggccggct

SEQ ID NO: 1960447 - DNA, 19 bp, Homo sapiens
gccggttggccggctggcc

SEQ ID NO: 1960448 - DNA, 17 bp, Homo sapiens
gccgtccctgacttccc

SEQ ID NO: 1960449 - DNA, 22 bp, Homo sapiens
gccgtccctgacttcccagctg

SEQ ID NO: 1960450 - DNA, 12 bp, Homo sapiens
gcctcccccagg

SEQ ID NO: 1960451 - DNA, 14 bp, Homo sapiens
gcctcccccaggct

SEQ ID NO: 1960452 - DNA, 15 bp, Homo sapiens
gcctcccccaggctg

SEQ ID NO: 1960453 - DNA, 15 bp, Homo sapiens
gcctccccgggggtc

SEQ ID NO: 1960454 - DNA, 20 bp, Homo sapiens
gctgctcgggaaggcctgag

SEQ ID NO: 1960455 - DNA, 21 bp, Homo sapiens
gctgctcgggaaggcctgagg

SEQ ID NO: 1960456 - DNA, 22 bp, Homo sapiens
gctgctcgggaaggcctgaggg

SEQ ID NO: 1960457 - DNA, 15 bp, Homo sapiens
gctgctgtggcatca

SEQ ID NO: 1960458 - DNA, 13 bp, Homo sapiens
gctgcttttgatg

SEQ ID NO: 1960459 - DNA, 18 bp, Homo sapiens
gctggataggagaggaaa

SEQ ID NO: 1960460 - DNA, 15 bp, Homo sapiens
gctggcagcgcctcc

SEQ ID NO: 1960461 - DNA, 18 bp, Homo sapiens
gctggcagcgcctcccgc

SEQ ID NO: 1960462 - DNA, 12 bp, Homo sapiens
gctggccctgcc

SEQ ID NO: 1960463 - DNA, 16 bp, Homo sapiens
gctggccctgccctcc

SEQ ID NO: 1960464 - DNA, 19 bp, Homo sapiens
gctggccggtccaccccgt

SEQ ID NO: 1960465 - DNA, 20 bp, Homo sapiens
gctggccggtccaccccgtc

SEQ ID NO: 1960466 - DNA, 22 bp, Homo sapiens
gctggccggtccaccccgtccc

SEQ ID NO: 1960467 - DNA, 14 bp, Homo sapiens
gctgggcagggccg

SEQ ID NO: 1960468 - DNA, 15 bp, Homo sapiens
gctgggcagggccgc

SEQ ID NO: 1960469 - DNA, 16 bp, Homo sapiens
gctgggcagggccgca

SEQ ID NO: 1960470 - DNA, 17 bp, Homo sapiens
gctgggcagggccgcag

SEQ ID NO: 1960471 - DNA, 16 bp, Homo sapiens
gctgggtcgcccctcc

SEQ ID NO: 1960472 - DNA, 17 bp, Homo sapiens
gctgggtcgcccctcct

SEQ ID NO: 1960473 - DNA, 19 bp, Homo sapiens
gctgggtcgcccctcctcg

SEQ ID NO: 1960474 - DNA, 16 bp, Homo sapiens
gctgtaaataaaaata

SEQ ID NO: 1960475 - DNA, 15 bp, Homo sapiens
gctgtgaaacagtgt

SEQ ID NO: 1960476 - DNA, 14 bp, Homo sapiens
gctgtgaaatgact

SEQ ID NO: 1960477 - DNA, 20 bp, Homo sapiens
gctgtgaaatgactgcatca

SEQ ID NO: 1960478 - DNA, 17 bp, Homo sapiens
gctgttatctgtcttta

SEQ ID NO: 1960479 - DNA, 14 bp, Homo sapiens
gcttaatctagagc

SEQ ID NO: 1960480 - DNA, 19 bp, Homo sapiens
gcttaatctagagctatgc

SEQ ID NO: 1960481 - DNA, 13 bp, Homo sapiens
gcttaattccaat

SEQ ID NO: 1960482 - DNA, 23 bp, Homo sapiens
gcttctccacaacctcctcctcc

SEQ ID NO: 1960483 - DNA, 22 bp, Homo sapiens
gcttcttttagtcagaaatgat

SEQ ID NO: 1960484 - DNA, 19 bp, Homo sapiens
gcttgaggccaaatgagtt

SEQ ID NO: 1960485 - DNA, 15 bp, Homo sapiens
gcttggagcagagac

SEQ ID NO: 1960486 - DNA, 22 bp, Homo sapiens
gcttggagcagagacggcagcc

SEQ ID NO: 1960487 - DNA, 22 bp, Homo sapiens
gcttgtgtaatttcctgctcct

SEQ ID NO: 1960488 - DNA, 21 bp, Homo sapiens
gctttactctgaatttccagt

SEQ ID NO: 1960489 - DNA, 13 bp, Homo sapiens
ggaaaaggcttga

SEQ ID NO: 1960490 - DNA, 20 bp, Homo sapiens
ggaaaaggcttgagtctgga

SEQ ID NO: 1960491 - DNA, 21 bp, Homo sapiens
ggaaatatttgcgtaaatggt

SEQ ID NO: 1960492 - DNA, 21 bp, Homo sapiens
ggaacagtaattactttcaga

SEQ ID NO: 1960493 - DNA, 12 bp, Homo sapiens
ggaagcccaccc

SEQ ID NO: 1960494 - DNA, 14 bp, Homo sapiens
ggaagcccacccgc

SEQ ID NO: 1960495 - DNA, 24 bp, Homo sapiens
ggaagcccacccgccccagagact

SEQ ID NO: 1960496 - DNA, 19 bp, Homo sapiens
ggaaggcctgagggaagcc

SEQ ID NO: 1960497 - DNA, 21 bp, Homo sapiens
ggaaggcctgagggaagccca

SEQ ID NO: 1960498 - DNA, 11 bp, Homo sapiens
ggaatgctcaa

SEQ ID NO: 1960499 - DNA, 22 bp, Homo sapiens
ggacactgatgggtcctgctgc

SEQ ID NO: 1960500 - DNA, 23 bp, Homo sapiens
ggacactgatgggtcctgctgct

SEQ ID NO: 1960501 - DNA, 20 bp, Homo sapiens
ggacagcggcccggcccacg

SEQ ID NO: 1960502 - DNA, 22 bp, Homo sapiens
ggaccaaggtgcggaccggagc

SEQ ID NO: 1960503 - DNA, 20 bp, Homo sapiens
ggaccggagcggctgaggac

SEQ ID NO: 1960504 - DNA, 15 bp, Homo sapiens
ggacggggcagagct

SEQ ID NO: 1960505 - DNA, 16 bp, Homo sapiens
ggactccagaagcagc

SEQ ID NO: 1960506 - DNA, 19 bp, Homo sapiens
ggactgtcttcaaccctgc

SEQ ID NO: 1960507 - DNA, 22 bp, Homo sapiens
ggactgtcttcaaccctgccct

SEQ ID NO: 1960508 - DNA, 23 bp, Homo sapiens
ggactgtcttcaaccctgccctg

SEQ ID NO: 1960509 - DNA, 14 bp, Homo sapiens
ggagaaggaggaac

SEQ ID NO: 1960510 - DNA, 15 bp, Homo sapiens
ggagcaaacaggaaa

SEQ ID NO: 1960511 - DNA, 15 bp, Homo sapiens
ggagcacccccagcc

SEQ ID NO: 1960512 - DNA, 17 bp, Homo sapiens
ggagcacccccagcctc

SEQ ID NO: 1960513 - DNA, 22 bp, Homo sapiens
ggagcacccccagcctccccca

SEQ ID NO: 1960514 - DNA, 18 bp, Homo sapiens
ggagcagagacggcagcc

SEQ ID NO: 1960515 - DNA, 19 bp, Homo sapiens
ggagcagctagctgctttt

SEQ ID NO: 1960516 - DNA, 13 bp, Homo sapiens
ggagcggctgagg

SEQ ID NO: 1960517 - DNA, 20 bp, Homo sapiens
ggagcgggggctaactggcc

SEQ ID NO: 1960518 - DNA, 13 bp, Homo sapiens
ggaggagcacccc

SEQ ID NO: 1960519 - DNA, 18 bp, Homo sapiens
ggaggagcacccccagcc

SEQ ID NO: 1960520 - DNA, 12 bp, Homo sapiens
ggaggcgcccac

SEQ ID NO: 1960521 - DNA, 20 bp, Homo sapiens
ggaggcgcccacctgcccag

SEQ ID NO: 1960522 - DNA, 20 bp, Homo sapiens
ggaggctgagatgggaggat

SEQ ID NO: 1960523 - DNA, 15 bp, Homo sapiens
ggagtccactttcct

SEQ ID NO: 1960524 - DNA, 16 bp, Homo sapiens
ggagtccactttcctc

SEQ ID NO: 1960525 - DNA, 16 bp, Homo sapiens
ggattcccctggacat

SEQ ID NO: 1960526 - DNA, 14 bp, Homo sapiens
ggattcctcccctg

SEQ ID NO: 1960527 - DNA, 21 bp, Homo sapiens
ggccccgcgcgtgcccccagc

SEQ ID NO: 1960528 - DNA, 17 bp, Homo sapiens
ggcccgctcaacctctc

SEQ ID NO: 1960529 - DNA, 19 bp, Homo sapiens
ggcccgctcaacctctcag

SEQ ID NO: 1960530 - DNA, 20 bp, Homo sapiens
ggcccgctcaacctctcaga

SEQ ID NO: 1960531 - DNA, 17 bp, Homo sapiens
ggcccggcccacgcaga

SEQ ID NO: 1960532 - DNA, 19 bp, Homo sapiens
ggcccggcccacgcagagc

SEQ ID NO: 1960533 - DNA, 21 bp, Homo sapiens
ggcccggcccacgcagagccc

SEQ ID NO: 1960534 - DNA, 20 bp, Homo sapiens
ggcccgtgcgcagccgcgct

SEQ ID NO: 1960535 - DNA, 11 bp, Homo sapiens
ggccctgccct

SEQ ID NO: 1960536 - DNA, 16 bp, Homo sapiens
ggccctggggtctctg

SEQ ID NO: 1960537 - DNA, 20 bp, Homo sapiens
ggccctggggtctctgagca

SEQ ID NO: 1960538 - DNA, 21 bp, Homo sapiens
ggccctggggtctctgagcag

SEQ ID NO: 1960539 - DNA, 12 bp, Homo sapiens
ggccgcagggcg

SEQ ID NO: 1960540 - DNA, 17 bp, Homo sapiens
ggccgcagggcgctccg

SEQ ID NO: 1960541 - DNA, 13 bp, Homo sapiens
ggccgcctcctcc

SEQ ID NO: 1960542 - DNA, 23 bp, Homo sapiens
ggccggtccaccccgtcccggcc

SEQ ID NO: 1960543 - DNA, 12 bp, Homo sapiens
ggccgtccctga

SEQ ID NO: 1960544 - DNA, 10 bp, Homo sapiens
ggcctccccg

SEQ ID NO: 1960545 - DNA, 16 bp, Homo sapiens
ggcctgagggaagccc

SEQ ID NO: 1960546 - DNA, 21 bp, Homo sapiens
ggcctgagggaagcccacccg

SEQ ID NO: 1960547 - DNA, 17 bp, Homo sapiens
ggcgcccacctgcccag

SEQ ID NO: 1960548 - DNA, 17 bp, Homo sapiens
ggcgcctgcgctcctct

SEQ ID NO: 1960549 - DNA, 15 bp, Homo sapiens
ggcgcgcaccgccca

SEQ ID NO: 1960550 - DNA, 17 bp, Homo sapiens
ggcgctccggcagaggc

SEQ ID NO: 1960551 - DNA, 20 bp, Homo sapiens
ggcggaggggcttggagcag

SEQ ID NO: 1960552 - DNA, 13 bp, Homo sapiens
ggcgggcagcccc

SEQ ID NO: 1960553 - DNA, 18 bp, Homo sapiens
ggcgggcagcccctgctg

SEQ ID NO: 1960554 - DNA, 15 bp, Homo sapiens
ggctaactggcccca

SEQ ID NO: 1960555 - DNA, 17 bp, Homo sapiens
ggctaactggccccagg

SEQ ID NO: 1960556 - DNA, 16 bp, Homo sapiens
ggctcagacacctaga

SEQ ID NO: 1960557 - DNA, 12 bp, Homo sapiens
ggctgagcccct

SEQ ID NO: 1960558 - DNA, 13 bp, Homo sapiens
ggctgagcccctc

SEQ ID NO: 1960559 - DNA, 18 bp, Homo sapiens
ggctgagcccctcctctc

SEQ ID NO: 1960560 - DNA, 17 bp, Homo sapiens
ggctgaggacggggcag

SEQ ID NO: 1960561 - DNA, 19 bp, Homo sapiens
ggctgaggacggggcagag

SEQ ID NO: 1960562 - DNA, 21 bp, Homo sapiens
ggctgaggacggggcagagct

SEQ ID NO: 1960563 - DNA, 14 bp, Homo sapiens
ggctgcgcctgccc

SEQ ID NO: 1960564 - DNA, 19 bp, Homo sapiens
ggctggataggagaggaaa

SEQ ID NO: 1960565 - DNA, 10 bp, Homo sapiens
ggctggccct

SEQ ID NO: 1960566 - DNA, 17 bp, Homo sapiens
ggctggccctgccctcc

SEQ ID NO: 1960567 - DNA, 18 bp, Homo sapiens
ggctggccctgccctccc

SEQ ID NO: 1960568 - DNA, 22 bp, Homo sapiens
ggctggccctgccctcccccac

SEQ ID NO: 1960569 - DNA, 13 bp, Homo sapiens
ggctgggcagggc

SEQ ID NO: 1960570 - DNA, 19 bp, Homo sapiens
ggctgggcagggccgcagg

SEQ ID NO: 1960571 - DNA, 16 bp, Homo sapiens
ggctgggtcgcccctc

SEQ ID NO: 1960572 - DNA, 17 bp, Homo sapiens
ggctgggtcgcccctcc

SEQ ID NO: 1960573 - DNA, 13 bp, Homo sapiens
ggctgttatctgt

SEQ ID NO: 1960574 - DNA, 18 bp, Homo sapiens
ggctgttatctgtcttta

SEQ ID NO: 1960575 - DNA, 13 bp, Homo sapiens
ggcttggagcaga

SEQ ID NO: 1960576 - DNA, 23 bp, Homo sapiens
ggcttggagcagagacggcagcc

SEQ ID NO: 1960577 - DNA, 15 bp, Homo sapiens
gggaaagttccagca

SEQ ID NO: 1960578 - DNA, 20 bp, Homo sapiens
gggaagcccacccgccccag

SEQ ID NO: 1960579 - DNA, 19 bp, Homo sapiens
gggaaggcctgagggaagc

SEQ ID NO: 1960580 - DNA, 17 bp, Homo sapiens
gggaattttaacttttg

SEQ ID NO: 1960581 - DNA, 12 bp, Homo sapiens
gggacagcggcc

SEQ ID NO: 1960582 - DNA, 13 bp, Homo sapiens
gggacagcggccc

SEQ ID NO: 1960583 - DNA, 16 bp, Homo sapiens
gggactccagaagcag

SEQ ID NO: 1960584 - DNA, 22 bp, Homo sapiens
gggactccagaagcagcagcta

SEQ ID NO: 1960585 - DNA, 22 bp, Homo sapiens
gggactgtcttcaaccctgccc

SEQ ID NO: 1960586 - DNA, 13 bp, Homo sapiens
gggagagcgccac

SEQ ID NO: 1960587 - DNA, 17 bp, Homo sapiens
gggagagcgccacccgc

SEQ ID NO: 1960588 - DNA, 23 bp, Homo sapiens
gggagagcgccacccgcccgccc

SEQ ID NO: 1960589 - DNA, 19 bp, Homo sapiens
gggaggagcacccccagcc

SEQ ID NO: 1960590 - DNA, 20 bp, Homo sapiens
gggagtccactttcctctct

SEQ ID NO: 1960591 - DNA, 13 bp, Homo sapiens
gggcacgggagag

SEQ ID NO: 1960592 - DNA, 16 bp, Homo sapiens
gggcacgggagagcgc

SEQ ID NO: 1960593 - DNA, 17 bp, Homo sapiens
gggcacgggagagcgcc

SEQ ID NO: 1960594 - DNA, 15 bp, Homo sapiens
gggcagagctgagtc

SEQ ID NO: 1960595 - DNA, 20 bp, Homo sapiens
gggcagagctgagtcggctg

SEQ ID NO: 1960596 - DNA, 11 bp, Homo sapiens
gggcagcccct

SEQ ID NO: 1960597 - DNA, 13 bp, Homo sapiens
gggcagcccctgc

SEQ ID NO: 1960598 - DNA, 20 bp, Homo sapiens
gggcagcccctgctggacca

SEQ ID NO: 1960599 - DNA, 14 bp, Homo sapiens
gggcccatggcccc

SEQ ID NO: 1960600 - DNA, 18 bp, Homo sapiens
gggcccatggccccagct

SEQ ID NO: 1960601 - DNA, 19 bp, Homo sapiens
gggccctggggtctctgag

SEQ ID NO: 1960602 - DNA, 13 bp, Homo sapiens
gggccgcagggcg

SEQ ID NO: 1960603 - DNA, 14 bp, Homo sapiens
gggccgcagggcgc

SEQ ID NO: 1960604 - DNA, 16 bp, Homo sapiens
gggccgcagggcgctc

SEQ ID NO: 1960605 - DNA, 11 bp, Homo sapiens
gggccgcctcc

SEQ ID NO: 1960606 - DNA, 18 bp, Homo sapiens
gggcgcctgcgctcctct

SEQ ID NO: 1960607 - DNA, 16 bp, Homo sapiens
gggcgctccggcagag

SEQ ID NO: 1960608 - DNA, 18 bp, Homo sapiens
gggcgctccggcagaggc

SEQ ID NO: 1960609 - DNA, 23 bp, Homo sapiens
gggcgctccggcagaggcagggc

SEQ ID NO: 1960610 - DNA, 11 bp, Homo sapiens
gggctgagccc

SEQ ID NO: 1960611 - DNA, 14 bp, Homo sapiens
gggctgagcccctc

SEQ ID NO: 1960612 - DNA, 18 bp, Homo sapiens
gggctgagcccctcctct

SEQ ID NO: 1960613 - DNA, 15 bp, Homo sapiens
gggctggccctgccc

SEQ ID NO: 1960614 - DNA, 17 bp, Homo sapiens
gggctggccctgccctc

SEQ ID NO: 1960615 - DNA, 19 bp, Homo sapiens
gggctggccctgccctccc

SEQ ID NO: 1960616 - DNA, 18 bp, Homo sapiens
gggctgttagctcagagg

SEQ ID NO: 1960617 - DNA, 13 bp, Homo sapiens
gggcttggagcag

SEQ ID NO: 1960618 - DNA, 13 bp, Homo sapiens
ggggaagggtgga

SEQ ID NO: 1960619 - DNA, 13 bp, Homo sapiens
ggggaggagcacc

SEQ ID NO: 1960620 - DNA, 15 bp, Homo sapiens
ggggaggagcacccc

SEQ ID NO: 1960621 - DNA, 12 bp, Homo sapiens
ggggaggctgag

SEQ ID NO: 1960622 - DNA, 16 bp, Homo sapiens
ggggaggctgagacgc

SEQ ID NO: 1960623 - DNA, 16 bp, Homo sapiens
ggggcccatggcccca

SEQ ID NO: 1960624 - DNA, 20 bp, Homo sapiens
ggggcccatggccccagctg

SEQ ID NO: 1960625 - DNA, 17 bp, Homo sapiens
ggggctaacgggcgcct

SEQ ID NO: 1960626 - DNA, 16 bp, Homo sapiens
ggggctaactggcccc

SEQ ID NO: 1960627 - DNA, 18 bp, Homo sapiens
ggggctaactggccccag

SEQ ID NO: 1960628 - DNA, 13 bp, Homo sapiens
ggggctggccctg

SEQ ID NO: 1960629 - DNA, 14 bp, Homo sapiens
ggggctggccctgc

SEQ ID NO: 1960630 - DNA, 18 bp, Homo sapiens
ggggctggccctgccctc

SEQ ID NO: 1960631 - DNA, 19 bp, Homo sapiens
ggggctggccctgccctcc

SEQ ID NO: 1960632 - DNA, 20 bp, Homo sapiens
ggggctggccctgccctccc

SEQ ID NO: 1960633 - DNA, 23 bp, Homo sapiens
ggggctggccctgccctccccca

SEQ ID NO: 1960634 - DNA, 16 bp, Homo sapiens
ggggcttggagcagag

SEQ ID NO: 1960635 - DNA, 17 bp, Homo sapiens
gggggctaactggcccc

SEQ ID NO: 1960636 - DNA, 22 bp, Homo sapiens
ggggtcgggggaggagcacccc

SEQ ID NO: 1960637 - DNA, 17 bp, Homo sapiens
gggtaacaaagtgagac

SEQ ID NO: 1960638 - DNA, 22 bp, Homo sapiens
gggtaagggactccagaagcag

SEQ ID NO: 1960639 - DNA, 23 bp, Homo sapiens
gggtccccggacgctggctcggg

SEQ ID NO: 1960640 - DNA, 14 bp, Homo sapiens
gggtcctgctgctc

SEQ ID NO: 1960641 - DNA, 21 bp, Homo sapiens
gggtcgggggaggagcacccc

SEQ ID NO: 1960642 - DNA, 22 bp, Homo sapiens
gggtctctgagcagtggggagc

SEQ ID NO: 1960643 - DNA, 15 bp, Homo sapiens
gggtgcaggcgcgca

SEQ ID NO: 1960644 - DNA, 20 bp, Homo sapiens
gggtgcgtgaccggcccgcc

SEQ ID NO: 1960645 - DNA, 18 bp, Homo sapiens
ggtacaaataatttagaa

SEQ ID NO: 1960646 - DNA, 17 bp, Homo sapiens
ggtcatttggtggctct

SEQ ID NO: 1960647 - DNA, 22 bp, Homo sapiens
ggtccaccccgtcccggccccg

SEQ ID NO: 1960648 - DNA, 23 bp, Homo sapiens
ggtccaccccgtcccggccccgc

SEQ ID NO: 1960649 - DNA, 20 bp, Homo sapiens
ggtccccggacgctggctcg

SEQ ID NO: 1960650 - DNA, 21 bp, Homo sapiens
ggtccccggacgctggctcgg

SEQ ID NO: 1960651 - DNA, 13 bp, Homo sapiens
ggtcctgctgctc

SEQ ID NO: 1960652 - DNA, 13 bp, Homo sapiens
ggtcgcccctcct

SEQ ID NO: 1960653 - DNA, 15 bp, Homo sapiens
ggtcgggggaggagc

SEQ ID NO: 1960654 - DNA, 22 bp, Homo sapiens
ggtcgggggaggagcaccccca

SEQ ID NO: 1960655 - DNA, 19 bp, Homo sapiens
ggtctctgagcagtgggga

SEQ ID NO: 1960656 - DNA, 22 bp, Homo sapiens
ggtctgcacacataacacacat

SEQ ID NO: 1960657 - DNA, 12 bp, Homo sapiens
ggtgcaggcgcg

SEQ ID NO: 1960658 - DNA, 21 bp, Homo sapiens
ggtgcaggcgcgcaccgccca

SEQ ID NO: 1960659 - DNA, 14 bp, Homo sapiens
ggtgcggaccggag

SEQ ID NO: 1960660 - DNA, 20 bp, Homo sapiens
ggtgcggaccggagcggctg

SEQ ID NO: 1960661 - DNA, 13 bp, Homo sapiens
ggtgcgtgtggcc

SEQ ID NO: 1960662 - DNA, 15 bp, Homo sapiens
ggtggcatttgctga

SEQ ID NO: 1960663 - DNA, 16 bp, Homo sapiens
ggtggcatttgctgaa

SEQ ID NO: 1960664 - DNA, 13 bp, Homo sapiens
ggttctgtgcctc

SEQ ID NO: 1960665 - DNA, 13 bp, Homo sapiens
ggttgcaaagcta

SEQ ID NO: 1960666 - DNA, 14 bp, Homo sapiens
ggttggccggctgg

SEQ ID NO: 1960667 - DNA, 14 bp, Homo sapiens
ggtttgtttgctgc

SEQ ID NO: 1960668 - DNA, 16 bp, Homo sapiens
gtaaaatttgcacaca

SEQ ID NO: 1960669 - DNA, 20 bp, Homo sapiens
gtaaagaggtcaggggaatg

SEQ ID NO: 1960670 - DNA, 14 bp, Homo sapiens
gtaaataaaaatag

SEQ ID NO: 1960671 - DNA, 16 bp, Homo sapiens
gtaaatggttttcaac

SEQ ID NO: 1960672 - DNA, 17 bp, Homo sapiens
gtaagacagtgcagtgc

SEQ ID NO: 1960673 - DNA, 20 bp, Homo sapiens
gtaagggactccagaagcag

SEQ ID NO: 1960674 - DNA, 23 bp, Homo sapiens
gtaatatagggtttgtttgctgc

SEQ ID NO: 1960675 - DNA, 13 bp, Homo sapiens
gtaatattaaatt

SEQ ID NO: 1960676 - DNA, 14 bp, Homo sapiens
gtaatattaaattc

SEQ ID NO: 1960677 - DNA, 22 bp, Homo sapiens
gtacaaataatttagaaataaa

SEQ ID NO: 1960678 - DNA, 13 bp, Homo sapiens
gtacaattctttg

SEQ ID NO: 1960679 - DNA, 18 bp, Homo sapiens
gtacaattctttgttgct

SEQ ID NO: 1960680 - DNA, 17 bp, Homo sapiens
gtacagaaccagcactc

SEQ ID NO: 1960681 - DNA, 17 bp, Homo sapiens
gtaccatcccactgata

SEQ ID NO: 1960682 - DNA, 14 bp, Homo sapiens
gtactggatttaac

SEQ ID NO: 1960683 - DNA, 17 bp, Homo sapiens
gtagaactttaaaagaa

SEQ ID NO: 1960684 - DNA, 16 bp, Homo sapiens
gtagagtcaggagaaa

SEQ ID NO: 1960685 - DNA, 19 bp, Homo sapiens
gtagcagttttgaaacctt

SEQ ID NO: 1960686 - DNA, 15 bp, Homo sapiens
gtaggtctgcacaca

SEQ ID NO: 1960687 - DNA, 21 bp, Homo sapiens
gtagtttttgttcaccttctg

SEQ ID NO: 1960688 - DNA, 13 bp, Homo sapiens
gtataattatgaa

SEQ ID NO: 1960689 - DNA, 21 bp, Homo sapiens
gtattgttcttgtaaaactgt

SEQ ID NO: 1960690 - DNA, 20 bp, Homo sapiens
gtcaaatggatgtaatatag

SEQ ID NO: 1960691 - DNA, 18 bp, Homo sapiens
gtcacagtttgttcagtg

SEQ ID NO: 1960692 - DNA, 22 bp, Homo sapiens
gtcacagtttgttcagtgaggt

SEQ ID NO: 1960693 - DNA, 20 bp, Homo sapiens
gtcaggggtttgcttacagt

SEQ ID NO: 1960694 - DNA, 22 bp, Homo sapiens
gtcagtgtactctgagtcctca

SEQ ID NO: 1960695 - DNA, 11 bp, Homo sapiens
gtcatctgtca

SEQ ID NO: 1960696 - DNA, 12 bp, Homo sapiens
gtcatctgtcag

SEQ ID NO: 1960697 - DNA, 20 bp, Homo sapiens
gtcatctgtcagcttcccaa

SEQ ID NO: 1960698 - DNA, 19 bp, Homo sapiens
gtcatgttggtaccctgga

SEQ ID NO: 1960699 - DNA, 17 bp, Homo sapiens
gtccacccccattgtga

SEQ ID NO: 1960700 - DNA, 23 bp, Homo sapiens
gtccacccccattgtgaatgttg

SEQ ID NO: 1960701 - DNA, 16 bp, Homo sapiens
gtccccggacgctggc

SEQ ID NO: 1960702 - DNA, 19 bp, Homo sapiens
gtccccggacgctggctcg

SEQ ID NO: 1960703 - DNA, 21 bp, Homo sapiens
gtcccggccccgcgcgtgccc

SEQ ID NO: 1960704 - DNA, 17 bp, Homo sapiens
gtccctgacttcccagc

SEQ ID NO: 1960705 - DNA, 13 bp, Homo sapiens
gtcccttcctgtc

SEQ ID NO: 1960706 - DNA, 15 bp, Homo sapiens
gtccgcccgcccacc

SEQ ID NO: 1960707 - DNA, 17 bp, Homo sapiens
gtccgcccgcccacccc

SEQ ID NO: 1960708 - DNA, 15 bp, Homo sapiens
gtccgtccgcccgcc

SEQ ID NO: 1960709 - DNA, 23 bp, Homo sapiens
gtccgtccgcccgcccaccccgc

SEQ ID NO: 1960710 - DNA, 16 bp, Homo sapiens
gtcctcattgttcaga

SEQ ID NO: 1960711 - DNA, 23 bp, Homo sapiens
gtcctcattgttcagaaaagcac

SEQ ID NO: 1960712 - DNA, 13 bp, Homo sapiens
gtcctgctgctcg

SEQ ID NO: 1960713 - DNA, 16 bp, Homo sapiens
gtcctgtgtcatctgt

SEQ ID NO: 1960714 - DNA, 20 bp, Homo sapiens
gtcgcccctcctcgggcgcc

SEQ ID NO: 1960715 - DNA, 11 bp, Homo sapiens
gtcggctgggc

SEQ ID NO: 1960716 - DNA, 13 bp, Homo sapiens
gtcggctgggcag

SEQ ID NO: 1960717 - DNA, 16 bp, Homo sapiens
gtcggctgggcagggc

SEQ ID NO: 1960718 - DNA, 17 bp, Homo sapiens
gtcggctgggcagggcc

SEQ ID NO: 1960719 - DNA, 18 bp, Homo sapiens
gtcgggggaggagcaccc

SEQ ID NO: 1960720 - DNA, 21 bp, Homo sapiens
gtctatgatgtccaaacttaa

SEQ ID NO: 1960721 - DNA, 15 bp, Homo sapiens
gtctcaaaataaaac

SEQ ID NO: 1960722 - DNA, 10 bp, Homo sapiens
tgaaatataa

SEQ ID NO: 1960723 - DNA, 18 bp, Homo sapiens
tgaaatataaactgtgag

SEQ ID NO: 1960724 - DNA, 20 bp, Homo sapiens
tgaaattatgtcaaatggat

SEQ ID NO: 1960725 - DNA, 12 bp, Homo sapiens
tgaaatttacag

SEQ ID NO: 1960726 - DNA, 16 bp, Homo sapiens
tgaacattaatgttga

SEQ ID NO: 1960727 - DNA, 18 bp, Homo sapiens
tgaacattaatgttgaaa

SEQ ID NO: 1960728 - DNA, 14 bp, Homo sapiens
tgaactgaagcaga

SEQ ID NO: 1960729 - DNA, 15 bp, Homo sapiens
tgaactgaagcagag

SEQ ID NO: 1960730 - DNA, 17 bp, Homo sapiens
tgaactgcaacactgga

SEQ ID NO: 1960731 - DNA, 18 bp, Homo sapiens
tgaagaactattatattg

SEQ ID NO: 1960732 - DNA, 17 bp, Homo sapiens
tgaagactgctatcagt

SEQ ID NO: 1960733 - DNA, 21 bp, Homo sapiens
tgaagcagagtcaagctgatg

SEQ ID NO: 1960734 - DNA, 15 bp, Homo sapiens
tgaagccctaagtaa

SEQ ID NO: 1960735 - DNA, 15 bp, Homo sapiens
tgaaggtgccagacg

SEQ ID NO: 1960736 - DNA, 14 bp, Homo sapiens
tgaagtcccttcct

SEQ ID NO: 1960737 - DNA, 19 bp, Homo sapiens
tgaagtcccttcctgtcct

SEQ ID NO: 1960738 - DNA, 15 bp, Homo sapiens
tgaagtgattgacat

SEQ ID NO: 1960739 - DNA, 15 bp, Homo sapiens
tgaagttaagcacaa

SEQ ID NO: 1960740 - DNA, 14 bp, Homo sapiens
tgaataacaacaat

SEQ ID NO: 1960741 - DNA, 16 bp, Homo sapiens
tgaatcagaggcagag

SEQ ID NO: 1960742 - DNA, 18 bp, Homo sapiens
tgaatctctcaaaatgtg

SEQ ID NO: 1960743 - DNA, 15 bp, Homo sapiens
tgaatgaaatataaa

SEQ ID NO: 1960744 - DNA, 22 bp, Homo sapiens
tgaatgaaatataaactgtgag

SEQ ID NO: 1960745 - DNA, 22 bp, Homo sapiens
tgaattggctgccaagagtcca

SEQ ID NO: 1960746 - DNA, 12 bp, Homo sapiens
tgacaacatttt

SEQ ID NO: 1960747 - DNA, 23 bp, Homo sapiens
tgacagcaacaaagcataagaca

SEQ ID NO: 1960748 - DNA, 12 bp, Homo sapiens
tgacattccaca

SEQ ID NO: 1960749 - DNA, 23 bp, Homo sapiens
tgacattttgtagctagtttaaa

SEQ ID NO: 1960750 - DNA, 14 bp, Homo sapiens
tgaccccacacgcc

SEQ ID NO: 1960751 - DNA, 21 bp, Homo sapiens
tgaccggcccgccaccttgta

SEQ ID NO: 1960752 - DNA, 21 bp, Homo sapiens
tgacctccagggaatcagaaa

SEQ ID NO: 1960753 - DNA, 14 bp, Homo sapiens
tgacctgaggaaag

SEQ ID NO: 1960754 - DNA, 16 bp, Homo sapiens
tgactgtagtttttgt

SEQ ID NO: 1960755 - DNA, 20 bp, Homo sapiens
tgactttggagacgatgctt

SEQ ID NO: 1960756 - DNA, 15 bp, Homo sapiens
tgagacaacacacac

SEQ ID NO: 1960757 - DNA, 13 bp, Homo sapiens
tgagacactgtca

SEQ ID NO: 1960758 - DNA, 14 bp, Homo sapiens
tgagacactgtcaa

SEQ ID NO: 1960759 - DNA, 16 bp, Homo sapiens
tgagacactgtcaaga

SEQ ID NO: 1960760 - DNA, 16 bp, Homo sapiens
tgagataaatatcatt

SEQ ID NO: 1960761 - DNA, 17 bp, Homo sapiens
tgagatgtttagtagct

SEQ ID NO: 1960762 - DNA, 17 bp, Homo sapiens
tgagcacatctcttcat

SEQ ID NO: 1960763 - DNA, 12 bp, Homo sapiens
tgagcagctgaa

SEQ ID NO: 1960764 - DNA, 13 bp, Homo sapiens
tgagcagctgaat

SEQ ID NO: 1960765 - DNA, 14 bp, Homo sapiens
tgagcatgctccct

SEQ ID NO: 1960766 - DNA, 15 bp, Homo sapiens
tgagcatgctccctc

SEQ ID NO: 1960767 - DNA, 23 bp, Homo sapiens
tgagcatgctccctcatgcagat

SEQ ID NO: 1960768 - DNA, 16 bp, Homo sapiens
tgagccacagtggggc

SEQ ID NO: 1960769 - DNA, 12 bp, Homo sapiens
tgagcccctcct

SEQ ID NO: 1960770 - DNA, 11 bp, Homo sapiens
tgagcctgtct

SEQ ID NO: 1960771 - DNA, 12 bp, Homo sapiens
tgagcctgtctc

SEQ ID NO: 1960772 - DNA, 15 bp, Homo sapiens
tgagctccaccctcc

SEQ ID NO: 1960773 - DNA, 16 bp, Homo sapiens
tgagctccaccctccc

SEQ ID NO: 1960774 - DNA, 20 bp, Homo sapiens
tgagctccaccctcccctct

SEQ ID NO: 1960775 - DNA, 18 bp, Homo sapiens
tgaggacggggcagagct

SEQ ID NO: 1960776 - DNA, 19 bp, Homo sapiens
tgaggacggggcagagctg

SEQ ID NO: 1960777 - DNA, 20 bp, Homo sapiens
tgaggacggggcagagctga

SEQ ID NO: 1960778 - DNA, 15 bp, Homo sapiens
tgaggccaaatgagt

SEQ ID NO: 1960779 - DNA, 20 bp, Homo sapiens
tgaggccaaatgagttccct

SEQ ID NO: 1960780 - DNA, 15 bp, Homo sapiens
tgaggcccccggagg

SEQ ID NO: 1960781 - DNA, 15 bp, Homo sapiens
tgagggaagcccacc

SEQ ID NO: 1960782 - DNA, 20 bp, Homo sapiens
tgagtcggctgggcagggcc

SEQ ID NO: 1960783 - DNA, 12 bp, Homo sapiens
tgagtctgtcct

SEQ ID NO: 1960784 - DNA, 21 bp, Homo sapiens
tgagttggttacctattgctg

SEQ ID NO: 1960785 - DNA, 23 bp, Homo sapiens
tgatacaacaggattttcaagtt

SEQ ID NO: 1960786 - DNA, 20 bp, Homo sapiens
tgatatgtctttaaaatgat

SEQ ID NO: 1960787 - DNA, 23 bp, Homo sapiens
tgatcaaggagggagaaaggcaa

SEQ ID NO: 1960788 - DNA, 21 bp, Homo sapiens
tgatcataggggcatagccag

SEQ ID NO: 1960789 - DNA, 22 bp, Homo sapiens
tgatcataggggcatagccagt

SEQ ID NO: 1960790 - DNA, 19 bp, Homo sapiens
tgatctggtgcgtgtggcc

SEQ ID NO: 1960791 - DNA, 14 bp, Homo sapiens
tgatgatggaaggg

SEQ ID NO: 1960792 - DNA, 15 bp, Homo sapiens
tgatgatttcagaaa

SEQ ID NO: 1960793 - DNA, 17 bp, Homo sapiens
tgatggaaaaagaatat

SEQ ID NO: 1960794 - DNA, 21 bp, Homo sapiens
tgatggaaaaagaatatattg

SEQ ID NO: 1960795 - DNA, 17 bp, Homo sapiens
tgatggaacagtaatta

SEQ ID NO: 1960796 - DNA, 17 bp, Homo sapiens
tgatggctatgttttgg

SEQ ID NO: 1960797 - DNA, 14 bp, Homo sapiens
tgatgtaaaaatat

SEQ ID NO: 1960798 - DNA, 23 bp, Homo sapiens
tgatgtcacagtttgttcagtga

SEQ ID NO: 1960799 - DNA, 16 bp, Homo sapiens
tgatgtccaaacttaa

SEQ ID NO: 1960800 - DNA, 19 bp, Homo sapiens
tgatgtgatttatgcattt

SEQ ID NO: 1960801 - DNA, 13 bp, Homo sapiens
tgatgttctgaaa

SEQ ID NO: 1960802 - DNA, 19 bp, Homo sapiens
tgattcaaataaccctgaa

SEQ ID NO: 1960803 - DNA, 18 bp, Homo sapiens
tgattcagggttatttga

SEQ ID NO: 1960804 - DNA, 22 bp, Homo sapiens
tgattgacattttgtagctagt

SEQ ID NO: 1960805 - DNA, 11 bp, Homo sapiens
tgattgcatat

SEQ ID NO: 1960806 - DNA, 15 bp, Homo sapiens
tgattgcatattttg

SEQ ID NO: 1960807 - DNA, 21 bp, Homo sapiens
tgattgcatattttgttatag

SEQ ID NO: 1960808 - DNA, 13 bp, Homo sapiens
tgatttaaacttc

SEQ ID NO: 1960809 - DNA, 21 bp, Homo sapiens
tgatttaaacttcttaactgg

SEQ ID NO: 1960810 - DNA, 13 bp, Homo sapiens
tgatttcagaaac

SEQ ID NO: 1960811 - DNA, 14 bp, Homo sapiens
tgattttaattcag

SEQ ID NO: 1960812 - DNA, 12 bp, Homo sapiens
tgcaacactgga

SEQ ID NO: 1960813 - DNA, 20 bp, Homo sapiens
tgcaatgttccgttcatctg

SEQ ID NO: 1960814 - DNA, 20 bp, Homo sapiens
tgcacacataacacacatca

SEQ ID NO: 1960815 - DNA, 17 bp, Homo sapiens
tgcacaccaaattgctg

SEQ ID NO: 1960816 - DNA, 22 bp, Homo sapiens
tgcacaccaaattgctgagatg

SEQ ID NO: 1960817 - DNA, 18 bp, Homo sapiens
tgcactaaaagtgatgtg

SEQ ID NO: 1960818 - DNA, 18 bp, Homo sapiens
tgcactcttttgagcagt

SEQ ID NO: 1960819 - DNA, 12 bp, Homo sapiens
tgcactgcttta

SEQ ID NO: 1960820 - DNA, 22 bp, Homo sapiens
tgcagcagtaccatcccactga

SEQ ID NO: 1960821 - DNA, 22 bp, Homo sapiens
tgcagcccagaacgggcctccc

SEQ ID NO: 1960822 - DNA, 13 bp, Homo sapiens
tgcagcctgagct

SEQ ID NO: 1960823 - DNA, 16 bp, Homo sapiens
tgcagcctgagctcca

SEQ ID NO: 1960824 - DNA, 20 bp, Homo sapiens
tgcagcctgagctccaccct

SEQ ID NO: 1960825 - DNA, 13 bp, Homo sapiens
gtctcctctgtca

SEQ ID NO: 1960826 - DNA, 14 bp, Homo sapiens
gtctcctctgtcag

SEQ ID NO: 1960827 - DNA, 17 bp, Homo sapiens
gtctcctctgtcagttt

SEQ ID NO: 1960828 - DNA, 21 bp, Homo sapiens
gtctcctctgtcagtttgtga

SEQ ID NO: 1960829 - DNA, 23 bp, Homo sapiens
gtctcctctgtcagtttgtgaag

SEQ ID NO: 1960830 - DNA, 14 bp, Homo sapiens
gtctctgagcagtg

SEQ ID NO: 1960831 - DNA, 11 bp, Homo sapiens
gtctgcacaca

SEQ ID NO: 1960832 - DNA, 11 bp, Homo sapiens
gtctgcccctt

SEQ ID NO: 1960833 - DNA, 17 bp, Homo sapiens
gtctgccccttgacccc

SEQ ID NO: 1960834 - DNA, 19 bp, Homo sapiens
gtctgccccttgaccccac

SEQ ID NO: 1960835 - DNA, 11 bp, Homo sapiens
gtctgtctctc

SEQ ID NO: 1960836 - DNA, 21 bp, Homo sapiens
gtctgtctctcttttgctctc

SEQ ID NO: 1960837 - DNA, 22 bp, Homo sapiens
gtctgtctctcttttgctctct

SEQ ID NO: 1960838 - DNA, 15 bp, Homo sapiens
gtcttcaaccctgcc

SEQ ID NO: 1960839 - DNA, 18 bp, Homo sapiens
gtctttctgcagaaaatt

SEQ ID NO: 1960840 - DNA, 16 bp, Homo sapiens
gtctttggttcctcat

SEQ ID NO: 1960841 - DNA, 15 bp, Homo sapiens
gtgaagtgattgaca

SEQ ID NO: 1960842 - DNA, 17 bp, Homo sapiens
gtgaatgttgtcctgtg

SEQ ID NO: 1960843 - DNA, 14 bp, Homo sapiens
gtgagtctgtcctt

SEQ ID NO: 1960844 - DNA, 14 bp, Homo sapiens
gtgatctgtccttc

SEQ ID NO: 1960845 - DNA, 18 bp, Homo sapiens
gtgatctgtccttccaac

SEQ ID NO: 1960846 - DNA, 14 bp, Homo sapiens
gtgatgtgatttat

SEQ ID NO: 1960847 - DNA, 15 bp, Homo sapiens
gtgatttatgcattt

SEQ ID NO: 1960848 - DNA, 14 bp, Homo sapiens
gtgcaggcgcgcac

SEQ ID NO: 1960849 - DNA, 18 bp, Homo sapiens
gtgcccccagcgtggggc

SEQ ID NO: 1960850 - DNA, 20 bp, Homo sapiens
gtgcctaactccttacagaa

SEQ ID NO: 1960851 - DNA, 14 bp, Homo sapiens
gtgccttccccgtg

SEQ ID NO: 1960852 - DNA, 20 bp, Homo sapiens
gtgccttccccgtgcggccc

SEQ ID NO: 1960853 - DNA, 14 bp, Homo sapiens
tcggccgaggcctg

SEQ ID NO: 1960854 - DNA, 21 bp, Homo sapiens
tcggctgggcagggccgcagg

SEQ ID NO: 1960855 - DNA, 15 bp, Homo sapiens
tcgggaaggcctgag

SEQ ID NO: 1960856 - DNA, 21 bp, Homo sapiens
tcgggaaggcctgagggaagc

SEQ ID NO: 1960857 - DNA, 22 bp, Homo sapiens
tcgggctctctcacccagcctg

SEQ ID NO: 1960858 - DNA, 11 bp, Homo sapiens
tcgggggagga

SEQ ID NO: 1960859 - DNA, 13 bp, Homo sapiens
tcggtcagcaccg

SEQ ID NO: 1960860 - DNA, 14 bp, Homo sapiens
tcgtccggcctgca

SEQ ID NO: 1960861 - DNA, 16 bp, Homo sapiens
tcgtccggcctgcagc

SEQ ID NO: 1960862 - DNA, 18 bp, Homo sapiens
tcgtccggcctgcagccc

SEQ ID NO: 1960863 - DNA, 13 bp, Homo sapiens
tcgtgcatgtaat

SEQ ID NO: 1960864 - DNA, 13 bp, Homo sapiens
tctaaaagtaata

SEQ ID NO: 1960865 - DNA, 14 bp, Homo sapiens
tctaaaagtaataa

SEQ ID NO: 1960866 - DNA, 19 bp, Homo sapiens
tctaactccttgaggtctt

SEQ ID NO: 1960867 - DNA, 21 bp, Homo sapiens
tctaagaaatggctttccaca

SEQ ID NO: 1960868 - DNA, 12 bp, Homo sapiens
tctacaaaagaa

SEQ ID NO: 1960869 - DNA, 22 bp, Homo sapiens
tctacataccacacttaaaaga

SEQ ID NO: 1960870 - DNA, 22 bp, Homo sapiens
tctacctggctacaattacttt

SEQ ID NO: 1960871 - DNA, 16 bp, Homo sapiens
tctagagctatgcaca

SEQ ID NO: 1960872 - DNA, 18 bp, Homo sapiens
tctagagctatgcacacc

SEQ ID NO: 1960873 - DNA, 16 bp, Homo sapiens
tctatagcatttaaag

SEQ ID NO: 1960874 - DNA, 16 bp, Homo sapiens
tctatagccaaagctg

SEQ ID NO: 1960875 - DNA, 18 bp, Homo sapiens
tctattagcttactgatt

SEQ ID NO: 1960876 - DNA, 15 bp, Homo sapiens
tctattttgcagcag

SEQ ID NO: 1960877 - DNA, 18 bp, Homo sapiens
tctcaaaataaaaccaga

SEQ ID NO: 1960878 - DNA, 15 bp, Homo sapiens
tctcacccagcctgg

SEQ ID NO: 1960879 - DNA, 15 bp, Homo sapiens
tctccctaccctctt

SEQ ID NO: 1960880 - DNA, 19 bp, Homo sapiens
tctccctaccctcttctca

SEQ ID NO: 1960881 - DNA, 20 bp, Homo sapiens
tctccctaccctcttctcag

SEQ ID NO: 1960882 - DNA, 21 bp, Homo sapiens
tctccctaccctcttctcagc

SEQ ID NO: 1960883 - DNA, 24 bp, Homo sapiens
tctcctcggtggcatttgctgaat

SEQ ID NO: 1960884 - DNA, 17 bp, Homo sapiens
tctcctcgtccggcctg

SEQ ID NO: 1960885 - DNA, 18 bp, Homo sapiens
tctcctcgtccggcctgc

SEQ ID NO: 1960886 - DNA, 17 bp, Homo sapiens
tctcctgagcctgtctc

SEQ ID NO: 1960887 - DNA, 19 bp, Homo sapiens
tctcctgagcctgtctctc

SEQ ID NO: 1960888 - DNA, 15 bp, Homo sapiens
tctcctgtatcattt

SEQ ID NO: 1960889 - DNA, 14 bp, Homo sapiens
tctctcaaaatgtg

SEQ ID NO: 1960890 - DNA, 17 bp, Homo sapiens
tctctcacccagcctgg

SEQ ID NO: 1960891 - DNA, 13 bp, Homo sapiens
tctctctctctgt

SEQ ID NO: 1960892 - DNA, 13 bp, Homo sapiens
tctctctctgttc

SEQ ID NO: 1960893 - DNA, 15 bp, Homo sapiens
tctctctctgttcca

SEQ ID NO: 1960894 - DNA, 14 bp, Homo sapiens
tctctctgtgtggc

SEQ ID NO: 1960895 - DNA, 16 bp, Homo sapiens
tctctctgtgtggcaa

SEQ ID NO: 1960896 - DNA, 20 bp, Homo sapiens
tctctgtaaaaagcaggtga

SEQ ID NO: 1960897 - DNA, 18 bp, Homo sapiens
tctctgtgtggcaaacat

SEQ ID NO: 1960898 - DNA, 19 bp, Homo sapiens
tctctgtgtggcaaacatt

SEQ ID NO: 1960899 - DNA, 12 bp, Homo sapiens
tctctgttccaa

SEQ ID NO: 1960900 - DNA, 22 bp, Homo sapiens
tctctgttccaagtgtgtgtgc

SEQ ID NO: 1960901 - DNA, 19 bp, Homo sapiens
tctcttcatgcgcagtccc

SEQ ID NO: 1960902 - DNA, 19 bp, Homo sapiens
tctgaactgcaacactgga

SEQ ID NO: 1960903 - DNA, 16 bp, Homo sapiens
tctgaataatgaagat

SEQ ID NO: 1960904 - DNA, 19 bp, Homo sapiens
tctgaatctctcaaaatgt

SEQ ID NO: 1960905 - DNA, 20 bp, Homo sapiens
tctgaatctctcaaaatgtg

SEQ ID NO: 1960906 - DNA, 22 bp, Homo sapiens
tctgacagcatttcagctgtga

SEQ ID NO: 1960907 - DNA, 14 bp, Homo sapiens
tctgagcagtgggg

SEQ ID NO: 1960908 - DNA, 15 bp, Homo sapiens
tctgagcagtgggga

SEQ ID NO: 1960909 - DNA, 21 bp, Homo sapiens
tctgatacttatttataacat

SEQ ID NO: 1960910 - DNA, 14 bp, Homo sapiens
tctgatcctctctt

SEQ ID NO: 1960911 - DNA, 18 bp, Homo sapiens
tctgatgatgttctgaaa

SEQ ID NO: 1960912 - DNA, 13 bp, Homo sapiens
tctgcacacataa

SEQ ID NO: 1960913 - DNA, 22 bp, Homo sapiens
tctgcacacataacacacatca

SEQ ID NO: 1960914 - DNA, 19 bp, Homo sapiens
tctgcagcctgagctccac

SEQ ID NO: 1960915 - DNA, 13 bp, Homo sapiens
tctgccccctccc

SEQ ID NO: 1960916 - DNA, 24 bp, Homo sapiens
tctgccccctcccccgcagacaga

SEQ ID NO: 1960917 - DNA, 16 bp, Homo sapiens
tctgcccctccgtccc

SEQ ID NO: 1960918 - DNA, 22 bp, Homo sapiens
tctgcccctccgtccccagggt

SEQ ID NO: 1960919 - DNA, 19 bp, Homo sapiens
tctgccccttgaccccaca

SEQ ID NO: 1960920 - DNA, 21 bp, Homo sapiens
tctgccccttgaccccacacg

SEQ ID NO: 1960921 - DNA, 18 bp, Homo sapiens
tctggaaaaaaaaaaata

SEQ ID NO: 1960922 - DNA, 13 bp, Homo sapiens
tctgtattgctaa

SEQ ID NO: 1960923 - DNA, 15 bp, Homo sapiens
tctgtcagtttgtga

SEQ ID NO: 1960924 - DNA, 16 bp, Homo sapiens
tctgtcctctgctttg

SEQ ID NO: 1960925 - DNA, 23 bp, Homo sapiens
tctgtctttatgatttcatgatt

SEQ ID NO: 1960926 - DNA, 22 bp, Homo sapiens
tctgtgaaagtctcctgtatca

SEQ ID NO: 1960927 - DNA, 18 bp, Homo sapiens
tctgtgcatctggcctgg

SEQ ID NO: 1960928 - DNA, 18 bp, Homo sapiens
tctgtgtggcaaacattt

SEQ ID NO: 1960929 - DNA, 15 bp, Homo sapiens
tcttaatgtctcaaa

SEQ ID NO: 1960930 - DNA, 16 bp, Homo sapiens
tcttcaaccctgccct

SEQ ID NO: 1960931 - DNA, 16 bp, Homo sapiens
tcttccttacaggtgt

SEQ ID NO: 1960932 - DNA, 15 bp, Homo sapiens
tcttctacttcttgt

SEQ ID NO: 1960933 - DNA, 18 bp, Homo sapiens
tcttctcccctttcaaat

SEQ ID NO: 1960934 - DNA, 23 bp, Homo sapiens
tcttcttgcggcaccgcccaccc

SEQ ID NO: 1960935 - DNA, 18 bp, Homo sapiens
tcttcttttcccatttac

SEQ ID NO: 1960936 - DNA, 22 bp, Homo sapiens
tcttgaatgttgaagaactcat

SEQ ID NO: 1960937 - DNA, 23 bp, Homo sapiens
tcttgaccttatgccattccata

SEQ ID NO: 1960938 - DNA, 15 bp, Homo sapiens
tcttgagcagctgaa

SEQ ID NO: 1960939 - DNA, 17 bp, Homo sapiens
tcttgcggcaccgccca

SEQ ID NO: 1960940 - DNA, 20 bp, Homo sapiens
tcttggtctctttctttcca

SEQ ID NO: 1960941 - DNA, 15 bp, Homo sapiens
tcttgtaaaactgtg

SEQ ID NO: 1960942 - DNA, 16 bp, Homo sapiens
tcttgtaaaactgtga

SEQ ID NO: 1960943 - DNA, 20 bp, Homo sapiens
tcttgtaaaactgtgacatt

SEQ ID NO: 1960944 - DNA, 21 bp, Homo sapiens
tcttgtaaaactgtgacattc

SEQ ID NO: 1960945 - DNA, 18 bp, Homo sapiens
tctttagtcatttaagaa

SEQ ID NO: 1960946 - DNA, 19 bp, Homo sapiens
tctttccaaaggttgtaca

SEQ ID NO: 1960947 - DNA, 20 bp, Homo sapiens
tctttccaaaggttgtacat

SEQ ID NO: 1960948 - DNA, 14 bp, Homo sapiens
tctttctgcagaaa

SEQ ID NO: 1960949 - DNA, 15 bp, Homo sapiens
tctttctgcagaaaa

SEQ ID NO: 1960950 - DNA, 17 bp, Homo sapiens
tctttctgcagaaaatt

SEQ ID NO: 1960951 - DNA, 21 bp, Homo sapiens
tgccagacgtgctcctgctga

SEQ ID NO: 1960952 - DNA, 21 bp, Homo sapiens
tgcccacccgtgttctcctcc

SEQ ID NO: 1960953 - DNA, 11 bp, Homo sapiens
tgcccaccctg

SEQ ID NO: 1960954 - DNA, 19 bp, Homo sapiens
tgcccaccctgggcctccc

SEQ ID NO: 1960955 - DNA, 23 bp, Homo sapiens
tgcccagttagcccggccaagga

SEQ ID NO: 1960956 - DNA, 18 bp, Homo sapiens
tgcccctccgtccccagg

SEQ ID NO: 1960957 - DNA, 20 bp, Homo sapiens
tgcccctccgtccccagggt

SEQ ID NO: 1960958 - DNA, 18 bp, Homo sapiens
tgccccttgaccccacac

SEQ ID NO: 1960959 - DNA, 20 bp, Homo sapiens
tgccccttgaccccacacgc

SEQ ID NO: 1960960 - DNA, 21 bp, Homo sapiens
tgccccttgaccccacacgcc

SEQ ID NO: 1960961 - DNA, 12 bp, Homo sapiens
tgccctccccca

SEQ ID NO: 1960962 - DNA, 17 bp, Homo sapiens
tgccctcccccacggcc

SEQ ID NO: 1960963 - DNA, 18 bp, Homo sapiens
tgccctgcaccttgggca

SEQ ID NO: 1960964 - DNA, 14 bp, Homo sapiens
tgccgtggcaactg

SEQ ID NO: 1960965 - DNA, 17 bp, Homo sapiens
tgcctaactccttacag

SEQ ID NO: 1960966 - DNA, 14 bp, Homo sapiens
tgcctcatttattt

SEQ ID NO: 1960967 - DNA, 18 bp, Homo sapiens
tgcctcatttatttattg

SEQ ID NO: 1960968 - DNA, 18 bp, Homo sapiens
tgcctctttgctgctttg

SEQ ID NO: 1960969 - DNA, 22 bp, Homo sapiens
tgcctggaggagaaggaggaac

SEQ ID NO: 1960970 - DNA, 15 bp, Homo sapiens
tgcctggatattttt

SEQ ID NO: 1960971 - DNA, 23 bp, Homo sapiens
tgcctggatattttttgatggaa

SEQ ID NO: 1960972 - DNA, 12 bp, Homo sapiens
tgccttgatttt

SEQ ID NO: 1960973 - DNA, 18 bp, Homo sapiens
tgccttgattttaattca

SEQ ID NO: 1960974 - DNA, 22 bp, Homo sapiens
tgcgcagccgcgctctgcccct

SEQ ID NO: 1960975 - DNA, 17 bp, Homo sapiens
tgcgccctgacatgcta

SEQ ID NO: 1960976 - DNA, 12 bp, Homo sapiens
tgcgcctgcccg

SEQ ID NO: 1960977 - DNA, 14 bp, Homo sapiens
tgcgcctgcccgcc

SEQ ID NO: 1960978 - DNA, 12 bp, Homo sapiens
tgcgctcctctg

SEQ ID NO: 1960979 - DNA, 14 bp, Homo sapiens
tgcgctcctctgca

SEQ ID NO: 1960980 - DNA, 15 bp, Homo sapiens
tgcgctcctctgcag

SEQ ID NO: 1960981 - DNA, 18 bp, Homo sapiens
tgcggaccggagcggctg

SEQ ID NO: 1960982 - DNA, 13 bp, Homo sapiens
tgcggcaccgccc

SEQ ID NO: 1960983 - DNA, 15 bp, Homo sapiens
tgcggcaccgcccac

SEQ ID NO: 1960984 - DNA, 17 bp, Homo sapiens
tgcggcaccgcccaccc

SEQ ID NO: 1960985 - DNA, 22 bp, Homo sapiens
tgcgtaaatggttttcaacaag

SEQ ID NO: 1960986 - DNA, 17 bp, Homo sapiens
tgcgtgaccggcccgcc

SEQ ID NO: 1960987 - DNA, 16 bp, Homo sapiens
tgcgtgtggccctgtg

SEQ ID NO: 1960988 - DNA, 17 bp, Homo sapiens
tgcgtgtggccctgtgg

SEQ ID NO: 1960989 - DNA, 19 bp, Homo sapiens
tgcgtgtggccctgtggga

SEQ ID NO: 1960990 - DNA, 14 bp, Homo sapiens
tgctcaatgtgctg

SEQ ID NO: 1960991 - DNA, 16 bp, Homo sapiens
tgctcaatgtgctgtt

SEQ ID NO: 1960992 - DNA, 22 bp, Homo sapiens
tgctcaatgtgctgttgattct

SEQ ID NO: 1960993 - DNA, 22 bp, Homo sapiens
tgctcacgtctgtgagtctgtc

SEQ ID NO: 1960994 - DNA, 16 bp, Homo sapiens
tgctgaataacaacaa

SEQ ID NO: 1960995 - DNA, 19 bp, Homo sapiens
tgctgaataacaacaattt

SEQ ID NO: 1960996 - DNA, 14 bp, Homo sapiens
tgctgaccttctgc

SEQ ID NO: 1960997 - DNA, 21 bp, Homo sapiens
tgctgagatgtttagtagctg

SEQ ID NO: 1960998 - DNA, 14 bp, Homo sapiens
tgctgcatgaaagc

SEQ ID NO: 1960999 - DNA, 23 bp, Homo sapiens
tgctgcctagtgctacagatgta

SEQ ID NO: 1961000 - DNA, 22 bp, Homo sapiens
tgctgctgagcacatctcttca

SEQ ID NO: 1961001 - DNA, 13 bp, Homo sapiens
tgctgctgtggca

SEQ ID NO: 1961002 - DNA, 16 bp, Homo sapiens
tgctgtaaataaaaat

SEQ ID NO: 1961003 - DNA, 18 bp, Homo sapiens
tgctgtaaataaaaatag

SEQ ID NO: 1961004 - DNA, 20 bp, Homo sapiens
tgctgtaaataaaaatagct

SEQ ID NO: 1961005 - DNA, 15 bp, Homo sapiens
tgctgtgaaatgact

SEQ ID NO: 1961006 - DNA, 16 bp, Homo sapiens
tgctgtgaaatgactg

SEQ ID NO: 1961007 - DNA, 21 bp, Homo sapiens
tgcttaatctagagctatgca

SEQ ID NO: 1961008 - DNA, 16 bp, Homo sapiens
tgcttctactccatgg

SEQ ID NO: 1961009 - DNA, 16 bp, Homo sapiens
tgcttttgatggctat

SEQ ID NO: 1961010 - DNA, 20 bp, Homo sapiens
tgcttttgatggctatgttt

SEQ ID NO: 1961011 - DNA, 12 bp, Homo sapiens
tggaaaaagaat

SEQ ID NO: 1961012 - DNA, 18 bp, Homo sapiens
tggaagggccttctccac

SEQ ID NO: 1961013 - DNA, 18 bp, Homo sapiens
tggaatctactagaacct

SEQ ID NO: 1961014 - DNA, 20 bp, Homo sapiens
tggaattacataacaggcat

SEQ ID NO: 1961015 - DNA, 14 bp, Homo sapiens
tggaccagttccct

SEQ ID NO: 1961016 - DNA, 19 bp, Homo sapiens
tggaccagttccctcagcc

SEQ ID NO: 1961017 - DNA, 14 bp, Homo sapiens
tggacgtgtgagga

SEQ ID NO: 1961018 - DNA, 23 bp, Homo sapiens
tggactggaggtacaaataattt

SEQ ID NO: 1961019 - DNA, 21 bp, Homo sapiens
tggagctgaggactctcacga

SEQ ID NO: 1961020 - DNA, 13 bp, Homo sapiens
tggaggagaagga

SEQ ID NO: 1961021 - DNA, 17 bp, Homo sapiens
tggaggagaaggaggaa

SEQ ID NO: 1961022 - DNA, 14 bp, Homo sapiens
tggagtagagtcag

SEQ ID NO: 1961023 - DNA, 16 bp, Homo sapiens
tggatagattgtttta

SEQ ID NO: 1961024 - DNA, 14 bp, Homo sapiens
tggataggagagga

SEQ ID NO: 1961025 - DNA, 18 bp, Homo sapiens
tggatccttgtcagttgt

SEQ ID NO: 1961026 - DNA, 17 bp, Homo sapiens
tggatgtaatatagggt

SEQ ID NO: 1961027 - DNA, 18 bp, Homo sapiens
tggattttttttttcagg

SEQ ID NO: 1961028 - DNA, 14 bp, Homo sapiens
tggcaatagcattg

SEQ ID NO: 1961029 - DNA, 15 bp, Homo sapiens
tggcagcgcctcccg

SEQ ID NO: 1961030 - DNA, 15 bp, Homo sapiens
tggcatttgctgaat

SEQ ID NO: 1961031 - DNA, 20 bp, Homo sapiens
tggcccaacatacgcactgg

SEQ ID NO: 1961032 - DNA, 12 bp, Homo sapiens
tggccccagctg

SEQ ID NO: 1961033 - DNA, 17 bp, Homo sapiens
tggccccagctggctgg

SEQ ID NO: 1961034 - DNA, 20 bp, Homo sapiens
tggccccagctggctgggtc

SEQ ID NO: 1961035 - DNA, 12 bp, Homo sapiens
tggccccaggcg

SEQ ID NO: 1961036 - DNA, 16 bp, Homo sapiens
tggccctgccctcccc

SEQ ID NO: 1961037 - DNA, 17 bp, Homo sapiens
tggccctgccctccccc

SEQ ID NO: 1961038 - DNA, 12 bp, Homo sapiens
tggccctgtggg

SEQ ID NO: 1961039 - DNA, 13 bp, Homo sapiens
tggccctgtggga

SEQ ID NO: 1961040 - DNA, 14 bp, Homo sapiens
tggccctgtgggag

SEQ ID NO: 1961041 - DNA, 20 bp, Homo sapiens
tggccctgtgggagtccact

SEQ ID NO: 1961042 - DNA, 22 bp, Homo sapiens
tggccctgtgggagtccacttt

SEQ ID NO: 1961043 - DNA, 12 bp, Homo sapiens
tggccggctggc

SEQ ID NO: 1961044 - DNA, 16 bp, Homo sapiens
tggccggtccaccccg

SEQ ID NO: 1961045 - DNA, 17 bp, Homo sapiens
tggcgggcagcccctgc

SEQ ID NO: 1961046 - DNA, 13 bp, Homo sapiens
tggctgccaagag

SEQ ID NO: 1961047 - DNA, 19 bp, Homo sapiens
tggctgggtcgcccctcct

SEQ ID NO: 1961048 - DNA, 14 bp, Homo sapiens
tggcttaaacattt

SEQ ID NO: 1961049 - DNA, 13 bp, Homo sapiens
tgggaatggattt

SEQ ID NO: 1961050 - DNA, 16 bp, Homo sapiens
tgggcagggccgcagg

SEQ ID NO: 1961051 - DNA, 22 bp, Homo sapiens
tgggcagggccgcagggcgctc

SEQ ID NO: 1961052 - DNA, 15 bp, Homo sapiens
tggggcccatggccc

SEQ ID NO: 1961053 - DNA, 18 bp, Homo sapiens
tggggcccatggccccag

SEQ ID NO: 1961054 - DNA, 20 bp, Homo sapiens
tggggcccatggccccagct

SEQ ID NO: 1961055 - DNA, 13 bp, Homo sapiens
tgggtccaggaga

SEQ ID NO: 1961056 - DNA, 13 bp, Homo sapiens
tgggtcctgctgc

SEQ ID NO: 1961057 - DNA, 14 bp, Homo sapiens
tgggtcctgctgct

SEQ ID NO: 1961058 - DNA, 15 bp, Homo sapiens
tgggtcctgctgctc

SEQ ID NO: 1961059 - DNA, 16 bp, Homo sapiens
tgggtcctgctgctcg

SEQ ID NO: 1961060 - DNA, 21 bp, Homo sapiens
tggtactaatgaaatttacag

SEQ ID NO: 1961061 - DNA, 15 bp, Homo sapiens
tggtctctttctttc

SEQ ID NO: 1961062 - DNA, 20 bp, Homo sapiens
ttggcaatatcatattctaa

SEQ ID NO: 1961063 - DNA, 13 bp, Homo sapiens
ttggccggctggc

SEQ ID NO: 1961064 - DNA, 15 bp, Homo sapiens
ttggccggctggccg

SEQ ID NO: 1961065 - DNA, 20 bp, Homo sapiens
ttggctcagacacctagact

SEQ ID NO: 1961066 - DNA, 15 bp, Homo sapiens
ttggctgaaattatg

SEQ ID NO: 1961067 - DNA, 19 bp, Homo sapiens
ttggctgccaagagtccaa

SEQ ID NO: 1961068 - DNA, 22 bp, Homo sapiens
ttgggattcctcccctggaagt

SEQ ID NO: 1961069 - DNA, 16 bp, Homo sapiens
tggtctctttctttcc

SEQ ID NO: 1961070 - DNA, 22 bp, Homo sapiens
tggtgcccagactcaaggcctc

SEQ ID NO: 1961071 - DNA, 14 bp, Homo sapiens
tggtgtgaggcccc

SEQ ID NO: 1961072 - DNA, 14 bp, Homo sapiens
tgtaaaactgtgac

SEQ ID NO: 1961073 - DNA, 15 bp, Homo sapiens
tgtaaataaaaatag

SEQ ID NO: 1961074 - DNA, 20 bp, Homo sapiens
tgtaaatgatatgtctttaa

SEQ ID NO: 1961075 - DNA, 21 bp, Homo sapiens
tgtaaatgatatgtctttaaa

SEQ ID NO: 1961076 - DNA, 12 bp, Homo sapiens
tgtaactcacat

SEQ ID NO: 1961077 - DNA, 22 bp, Homo sapiens
tgtaagaagctaaaatgaaaaa

SEQ ID NO: 1961078 - DNA, 22 bp, Homo sapiens
tgtacagaaccagcactcccag

SEQ ID NO: 1961079 - DNA, 23 bp, Homo sapiens
tgtacagaaccagcactcccagg

SEQ ID NO: 1961080 - DNA, 15 bp, Homo sapiens
tgtacagatgatgta

SEQ ID NO: 1961081 - DNA, 17 bp, Homo sapiens
tgtacatagtggtcatt

SEQ ID NO: 1961082 - DNA, 16 bp, Homo sapiens
tgtacatttatgtgtg

SEQ ID NO: 1961083 - DNA, 18 bp, Homo sapiens
tgtacatttatgtgtgaa

SEQ ID NO: 1961084 - DNA, 22 bp, Homo sapiens
tgtataagatgctgctgagcac

SEQ ID NO: 1961085 - DNA, 13 bp, Homo sapiens
tgtcaaatggatg

SEQ ID NO: 1961086 - DNA, 19 bp, Homo sapiens
tgtcaaatggatgtaatat

SEQ ID NO: 1961087 - DNA, 20 bp, Homo sapiens
tgtcacttttttcctgtcaa

SEQ ID NO: 1961088 - DNA, 13 bp, Homo sapiens
tgtcagcttccca

SEQ ID NO: 1961089 - DNA, 14 bp, Homo sapiens
tgtcaggctctgaa

SEQ ID NO: 1961090 - DNA, 15 bp, Homo sapiens
tgtcatctgtcagct

SEQ ID NO: 1961091 - DNA, 16 bp, Homo sapiens
tgtcatctgtcagctt

SEQ ID NO: 1961092 - DNA, 13 bp, Homo sapiens
tgtcccttcccca

SEQ ID NO: 1961093 - DNA, 12 bp, Homo sapiens
tgtcctctacat

SEQ ID NO: 1961094 - DNA, 18 bp, Homo sapiens
tgtcctctgctttgctgt

SEQ ID NO: 1961095 - DNA, 19 bp, Homo sapiens
tgtcctgtgtcatctgtca

SEQ ID NO: 1961096 - DNA, 14 bp, Homo sapiens
tgtctagataaaag

SEQ ID NO: 1961097 - DNA, 21 bp, Homo sapiens
tgtctctacaaaaaaaatcaa

SEQ ID NO: 1961098 - DNA, 19 bp, Homo sapiens
tgtctctccctaccctctt

SEQ ID NO: 1961099 - DNA, 23 bp, Homo sapiens
tgtctctccctaccctcttctca

SEQ ID NO: 1961100 - DNA, 18 bp, Homo sapiens
tgtctctcttttgctctc

SEQ ID NO: 1961101 - DNA, 16 bp, Homo sapiens
tgtctgtcccagttaa

SEQ ID NO: 1961102 - DNA, 18 bp, Homo sapiens
tgtctgttcttcatttct

SEQ ID NO: 1961103 - DNA, 23 bp, Homo sapiens
tgtcttcaaccctgccctgcacc

SEQ ID NO: 1961104 - DNA, 16 bp, Homo sapiens
tgtctttctgcagaaa

SEQ ID NO: 1961105 - DNA, 14 bp, Homo sapiens
tgtgaagtgattga

SEQ ID NO: 1961106 - DNA, 16 bp, Homo sapiens
tgtgaagtgattgaca

SEQ ID NO: 1961107 - DNA, 17 bp, Homo sapiens
tgtgaagtgattgacat

SEQ ID NO: 1961108 - DNA, 19 bp, Homo sapiens
tgtgaggatgtggatggag

SEQ ID NO: 1961109 - DNA, 14 bp, Homo sapiens
tgtgatgtcacagt

SEQ ID NO: 1961110 - DNA, 22 bp, Homo sapiens
tgtgatgtcacagtttgttcag

SEQ ID NO: 1961111 - DNA, 13 bp, Homo sapiens
tgtgatttatgca

SEQ ID NO: 1961112 - DNA, 22 bp, Homo sapiens
tgtgcccacccgtgttctcctc

SEQ ID NO: 1961113 - DNA, 14 bp, Homo sapiens
tgtgccccttcccc

SEQ ID NO: 1961114 - DNA, 18 bp, Homo sapiens
tgtgccccttccccatgc

SEQ ID NO: 1961115 - DNA, 21 bp, Homo sapiens
tgtgctgctgggaatggattt

SEQ ID NO: 1961116 - DNA, 15 bp, Homo sapiens
tgtgctgctgtggca

SEQ ID NO: 1961117 - DNA, 19 bp, Homo sapiens
tgtgctgttgattctttca

SEQ ID NO: 1961118 - DNA, 23 bp, Homo sapiens
tgtggaattacataacaggcatt

SEQ ID NO: 1961119 - DNA, 14 bp, Homo sapiens
tgtggcaaacattt

SEQ ID NO: 1961120 - DNA, 15 bp, Homo sapiens
tgtggccctgtggga

SEQ ID NO: 1961121 - DNA, 17 bp, Homo sapiens
tgtggccctgtgggagt

SEQ ID NO: 1961122 - DNA, 15 bp, Homo sapiens
tgtggcttaaacatt

SEQ ID NO: 1961123 - DNA, 17 bp, Homo sapiens
tgtgggtgtcagtgtca

SEQ ID NO: 1961124 - DNA, 18 bp, Homo sapiens
tgtgtcatctgtcagctt

SEQ ID NO: 1961125 - DNA, 18 bp, Homo sapiens
tgtgtcttttgttctctc

SEQ ID NO: 1961126 - DNA, 13 bp, Homo sapiens
tgtgtgcaatgtt

SEQ ID NO: 1961127 - DNA, 14 bp, Homo sapiens
tgtgtggcaaacat

SEQ ID NO: 1961128 - DNA, 22 bp, Homo sapiens
tgttaataaagtgcactgccac

SEQ ID NO: 1961129 - DNA, 15 bp, Homo sapiens
tgttagctcagagga

SEQ ID NO: 1961130 - DNA, 18 bp, Homo sapiens
tgttcacgtgactcctca

SEQ ID NO: 1961131 - DNA, 13 bp, Homo sapiens
tgttcatactttg

SEQ ID NO: 1961132 - DNA, 16 bp, Homo sapiens
tgttctgacagcattt

SEQ ID NO: 1961133 - DNA, 13 bp, Homo sapiens
tgttctgtgcaac

SEQ ID NO: 1961134 - DNA, 16 bp, Homo sapiens
tgttcttgagcagctg

SEQ ID NO: 1961135 - DNA, 12 bp, Homo sapiens
tgttcttgtaaa

SEQ ID NO: 1961136 - DNA, 17 bp, Homo sapiens
tgttcttgtaaaactgt

SEQ ID NO: 1961137 - DNA, 21 bp, Homo sapiens
tgttcttgtaaaactgtgaca

SEQ ID NO: 1961138 - DNA, 15 bp, Homo sapiens
tgttgaaaaagaaaa

SEQ ID NO: 1961139 - DNA, 16 bp, Homo sapiens
tgttgaaaaagaaaac

SEQ ID NO: 1961140 - DNA, 15 bp, Homo sapiens
tgttgattctttcaa

SEQ ID NO: 1961141 - DNA, 14 bp, Homo sapiens
tgttgcttaatcta

SEQ ID NO: 1961142 - DNA, 20 bp, Homo sapiens
tgttgcttaatctagagcta

SEQ ID NO: 1961143 - DNA, 19 bp, Homo sapiens
tgtttacaacacagtagtg

SEQ ID NO: 1961144 - DNA, 13 bp, Homo sapiens
tgtttactcacat

SEQ ID NO: 1961145 - DNA, 16 bp, Homo sapiens
tgtttactcacattgt

SEQ ID NO: 1961146 - DNA, 16 bp, Homo sapiens
tgtttagtagctgata

SEQ ID NO: 1961147 - DNA, 19 bp, Homo sapiens
tgtttagtcagtgtactct

SEQ ID NO: 1961148 - DNA, 22 bp, Homo sapiens
tgtttagtcagtgtactctgag

SEQ ID NO: 1961149 - DNA, 20 bp, Homo sapiens
tgtttcctaaatcagcattt

SEQ ID NO: 1961150 - DNA, 11 bp, Homo sapiens
tgtttcttggt

SEQ ID NO: 1961151 - DNA, 15 bp, Homo sapiens
ttaaaaaaataatat

SEQ ID NO: 1961152 - DNA, 19 bp, Homo sapiens
ttaaaaaaataatataaat

SEQ ID NO: 1961153 - DNA, 20 bp, Homo sapiens
ttaaaaaaataatataaatg

SEQ ID NO: 1961154 - DNA, 21 bp, Homo sapiens
ttaaaaaaataatataaatga

SEQ ID NO: 1961155 - DNA, 15 bp, Homo sapiens
ttaaaaaagatggat

SEQ ID NO: 1961156 - DNA, 13 bp, Homo sapiens
ttaaaaattatag

SEQ ID NO: 1961157 - DNA, 14 bp, Homo sapiens
ttaaaacttcatct

SEQ ID NO: 1961158 - DNA, 13 bp, Homo sapiens
ttaaaattattaa

SEQ ID NO: 1961159 - DNA, 18 bp, Homo sapiens
ttaaactaattaaactga

SEQ ID NO: 1961160 - DNA, 12 bp, Homo sapiens
ttaaagatacca

SEQ ID NO: 1961161 - DNA, 23 bp, Homo sapiens
ttaaaggagcagctagctgcttt

SEQ ID NO: 1961162 - DNA, 13 bp, Homo sapiens
ttaaatgaaatac

SEQ ID NO: 1961163 - DNA, 17 bp, Homo sapiens
ttaacttctattttcaa

SEQ ID NO: 1961164 - DNA, 20 bp, Homo sapiens
ttaagaatttaccagaaata

SEQ ID NO: 1961165 - DNA, 21 bp, Homo sapiens
ttaagtgcttgaggccaaatg

SEQ ID NO: 1961166 - DNA, 17 bp, Homo sapiens
ttaataggcttgtgtaa

SEQ ID NO: 1961167 - DNA, 22 bp, Homo sapiens
ttaatcatttccagcaaaatat

SEQ ID NO: 1961168 - DNA, 13 bp, Homo sapiens
ttaatctagagct

SEQ ID NO: 1961169 - DNA, 14 bp, Homo sapiens
ttaatctagagcta

SEQ ID NO: 1961170 - DNA, 20 bp, Homo sapiens
ttaatctagagctatgcaca

SEQ ID NO: 1961171 - DNA, 14 bp, Homo sapiens
ttaatttcagtaag

SEQ ID NO: 1961172 - DNA, 15 bp, Homo sapiens
ttacataacaggcat

SEQ ID NO: 1961173 - DNA, 12 bp, Homo sapiens
ttaccagaaata

SEQ ID NO: 1961174 - DNA, 22 bp, Homo sapiens
ttactcagatgacctgaggaaa

SEQ ID NO: 1961175 - DNA, 15 bp, Homo sapiens
ttagaaataaaagat

SEQ ID NO: 1961176 - DNA, 19 bp, Homo sapiens
ttagaaataaaagatgata

SEQ ID NO: 1961177 - DNA, 13 bp, Homo sapiens
ttagaatgttgaa

SEQ ID NO: 1961178 - DNA, 13 bp, Homo sapiens
ttagacaatgtgg

SEQ ID NO: 1961179 - DNA, 19 bp, Homo sapiens
ttaggaatgctcaatgtgc

SEQ ID NO: 1961180 - DNA, 18 bp, Homo sapiens
ttaggcactttttaacat

SEQ ID NO: 1961181 - DNA, 16 bp, Homo sapiens
ttagtaacttttagtg

SEQ ID NO: 1961182 - DNA, 20 bp, Homo sapiens
ttagtaacttttagtggttc

SEQ ID NO: 1961183 - DNA, 13 bp, Homo sapiens
aaaaaaaaatatg

SEQ ID NO: 1961184 - DNA, 13 bp, Homo sapiens
aaaaaatatgaga

SEQ ID NO: 1961185 - DNA, 15 bp, Homo sapiens
aaaaactttccatga

SEQ ID NO: 1961186 - DNA, 17 bp, Homo sapiens
aaaaactttccatgaca

SEQ ID NO: 1961187 - DNA, 20 bp, Homo sapiens
aaaaactttccatgacagta

SEQ ID NO: 1961188 - DNA, 14 bp, Homo sapiens
aaaaagacttcaaa

SEQ ID NO: 1961189 - DNA, 12 bp, Homo sapiens
aaaaagccctct

SEQ ID NO: 1961190 - DNA, 16 bp, Homo sapiens
aaaaataatataaatg

SEQ ID NO: 1961191 - DNA, 14 bp, Homo sapiens
aaaacaaaatcctt

SEQ ID NO: 1961192 - DNA, 19 bp, Homo sapiens
aaaacaaccaaagaaaatt

SEQ ID NO: 1961193 - DNA, 12 bp, Homo sapiens
aaaacattttac

SEQ ID NO: 1961194 - DNA, 11 bp, Homo sapiens
aaaactgtgac

SEQ ID NO: 1961195 - DNA, 12 bp, Homo sapiens
aaaactgtgaca

SEQ ID NO: 1961196 - DNA, 15 bp, Homo sapiens
aaaactttccatgac

SEQ ID NO: 1961197 - DNA, 22 bp, Homo sapiens
aaaactttccatgacagtagca

SEQ ID NO: 1961198 - DNA, 11 bp, Homo sapiens
aaaagaatata

SEQ ID NO: 1961199 - DNA, 14 bp, Homo sapiens
aaaataaaaccaga

SEQ ID NO: 1961200 - DNA, 12 bp, Homo sapiens
aaaataggattt

SEQ ID NO: 1961201 - DNA, 23 bp, Homo sapiens
aaaatcccaaatctatagcattt

SEQ ID NO: 1961202 - DNA, 19 bp, Homo sapiens
aaaatcccatttatgcaat

SEQ ID NO: 1961203 - DNA, 18 bp, Homo sapiens
aaaatccttgccttcaaa

SEQ ID NO: 1961204 - DNA, 16 bp, Homo sapiens
aaaattatctttaaaa

SEQ ID NO: 1961205 - DNA, 22 bp, Homo sapiens
aaaattatctttaaaacttact

SEQ ID NO: 1961206 - DNA, 19 bp, Homo sapiens
aaaattttattgaatataa

SEQ ID NO: 1961207 - DNA, 18 bp, Homo sapiens
aaacaaaaactttccatg

SEQ ID NO: 1961208 - DNA, 21 bp, Homo sapiens
aaacaaaaactttccatgaca

SEQ ID NO: 1961209 - DNA, 23 bp, Homo sapiens
aaacaaaaactttccatgacagt

SEQ ID NO: 1961210 - DNA, 12 bp, Homo sapiens
aaacaacagcaa

SEQ ID NO: 1961211 - DNA, 15 bp, Homo sapiens
aaacagaaaaggttc

SEQ ID NO: 1961212 - DNA, 20 bp, Homo sapiens
aaacagaaaaggttctgaat

SEQ ID NO: 1961213 - DNA, 14 bp, Homo sapiens
aaacattttacaga

SEQ ID NO: 1961214 - DNA, 17 bp, Homo sapiens
aaaccaatttgttctgt

SEQ ID NO: 1961215 - DNA, 19 bp, Homo sapiens
aaaccttgctgctatgctg

SEQ ID NO: 1961216 - DNA, 13 bp, Homo sapiens
aaactgatgcttt

SEQ ID NO: 1961217 - DNA, 14 bp, Homo sapiens
aaactgtgacattc

SEQ ID NO: 1961218 - DNA, 10 bp, Homo sapiens
aaactgtgag

SEQ ID NO: 1961219 - DNA, 18 bp, Homo sapiens
aaactgtgagataaatat

SEQ ID NO: 1961220 - DNA, 20 bp, Homo sapiens
aaactgtgagataaatatca

SEQ ID NO: 1961221 - DNA, 21 bp, Homo sapiens
aaactgtgagataaatatcat

SEQ ID NO: 1961222 - DNA, 13 bp, Homo sapiens
aaagaaaaaagaa

SEQ ID NO: 1961223 - DNA, 22 bp, Homo sapiens
aaagaatcacctaattaatttc

SEQ ID NO: 1961224 - DNA, 22 bp, Homo sapiens
aaagagtagaactttaaaagaa

SEQ ID NO: 1961225 - DNA, 14 bp, Homo sapiens
aaagatctcctgtg

SEQ ID NO: 1961226 - DNA, 18 bp, Homo sapiens
aaagatctcctgtgcacc

SEQ ID NO: 1961227 - DNA, 20 bp, Homo sapiens
aaagatggatttgacacact

SEQ ID NO: 1961228 - DNA, 21 bp, Homo sapiens
aaagatggatttgacacactc

SEQ ID NO: 1961229 - DNA, 22 bp, Homo sapiens
aaagcatgctcagtattgagac

SEQ ID NO: 1961230 - DNA, 14 bp, Homo sapiens
aaaggcttctccac

SEQ ID NO: 1961231 - DNA, 16 bp, Homo sapiens
aaagtaatttcaagaa

SEQ ID NO: 1961232 - DNA, 19 bp, Homo sapiens
aaagttccagcagtttcat

SEQ ID NO: 1961233 - DNA, 14 bp, Homo sapiens
aaataaaagaaaga

SEQ ID NO: 1961234 - DNA, 13 bp, Homo sapiens
aaataaccctgaa

SEQ ID NO: 1961235 - DNA, 13 bp, Homo sapiens
aaataatataaat

SEQ ID NO: 1961236 - DNA, 14 bp, Homo sapiens
aaataatataaatg

SEQ ID NO: 1961237 - DNA, 15 bp, Homo sapiens
aaataattaaaacaa

SEQ ID NO: 1961238 - DNA, 12 bp, Homo sapiens
aaatacattatt

SEQ ID NO: 1961239 - DNA, 13 bp, Homo sapiens
aaatacttgacaa

SEQ ID NO: 1961240 - DNA, 21 bp, Homo sapiens
aaatagctataaatagtgaaa

SEQ ID NO: 1961241 - DNA, 14 bp, Homo sapiens
aaataggatttgca

SEQ ID NO: 1961242 - DNA, 16 bp, Homo sapiens
aaatataaactgtgag

SEQ ID NO: 1961243 - DNA, 18 bp, Homo sapiens
aaatataaactgtgagat

SEQ ID NO: 1961244 - DNA, 19 bp, Homo sapiens
aaatatatgtttggctgaa

SEQ ID NO: 1961245 - DNA, 19 bp, Homo sapiens
aaatatcattatagcatgt

SEQ ID NO: 1961246 - DNA, 20 bp, Homo sapiens
aaatatccctcatttcatta

SEQ ID NO: 1961247 - DNA, 22 bp, Homo sapiens
aaatatccctcatttcattatt

SEQ ID NO: 1961248 - DNA, 20 bp, Homo sapiens
aaatatttgcgtaaatggtt

SEQ ID NO: 1961249 - DNA, 12 bp, Homo sapiens
aaatcagcattt

SEQ ID NO: 1961250 - DNA, 15 bp, Homo sapiens
aaatctaaattaact

SEQ ID NO: 1961251 - DNA, 22 bp, Homo sapiens
aaatctaaattaacttctattt

SEQ ID NO: 1961252 - DNA, 21 bp, Homo sapiens
caagcccagcctatctctctt

SEQ ID NO: 1961253 - DNA, 15 bp, Homo sapiens
caaggagggagaaag

SEQ ID NO: 1961254 - DNA, 17 bp, Homo sapiens
caagtcaaacagtgtgg

SEQ ID NO: 1961255 - DNA, 19 bp, Homo sapiens
caagtcaaacagtgtggct

SEQ ID NO: 1961256 - DNA, 17 bp, Homo sapiens
caagtgtgtgtgcaatg

SEQ ID NO: 1961257 - DNA, 12 bp, Homo sapiens
caagttattcag

SEQ ID NO: 1961258 - DNA, 15 bp, Homo sapiens
caagttattcagaaa

SEQ ID NO: 1961259 - DNA, 20 bp, Homo sapiens
caagtttttggtaatgatga

SEQ ID NO: 1961260 - DNA, 17 bp, Homo sapiens
caagtttttttgttcat

SEQ ID NO: 1961261 - DNA, 13 bp, Homo sapiens
caataaagcaatg

SEQ ID NO: 1961262 - DNA, 16 bp, Homo sapiens
caatactttgtgtctt

SEQ ID NO: 1961263 - DNA, 22 bp, Homo sapiens
aactggccccaggcggaggggc

SEQ ID NO: 1961264 - DNA, 13 bp, Homo sapiens
aactttccatgac

SEQ ID NO: 1961265 - DNA, 19 bp, Homo sapiens
aactttccatgacagtagc

SEQ ID NO: 1961266 - DNA, 12 bp, Homo sapiens
aagaaaatgtgt

SEQ ID NO: 1961267 - DNA, 13 bp, Homo sapiens
aagaaaattggta

SEQ ID NO: 1961268 - DNA, 17 bp, Homo sapiens
aagaaaccttttaaaaa

SEQ ID NO: 1961269 - DNA, 19 bp, Homo sapiens
aagaagctaaaatgaaaaa

SEQ ID NO: 1961270 - DNA, 16 bp, Homo sapiens
aagaatagttgtcaga

SEQ ID NO: 1961271 - DNA, 21 bp, Homo sapiens
aagaatagttgtcagaatatg

SEQ ID NO: 1961272 - DNA, 22 bp, Homo sapiens
aagaatagttgtcagaatatgt

SEQ ID NO: 1961273 - DNA, 21 bp, Homo sapiens
aagaatcacctaattaatttc

SEQ ID NO: 1961274 - DNA, 20 bp, Homo sapiens
aagaatttaccagaaatatt

SEQ ID NO: 1961275 - DNA, 22 bp, Homo sapiens
aagacttcaaatgttattcaat

SEQ ID NO: 1961276 - DNA, 13 bp, Homo sapiens
aagacttctctgt

SEQ ID NO: 1961277 - DNA, 15 bp, Homo sapiens
aagagaaaaagccct

SEQ ID NO: 1961278 - DNA, 21 bp, Homo sapiens
aagataattaaatgaaatact

SEQ ID NO: 1961279 - DNA, 15 bp, Homo sapiens
aagataccaaataga

SEQ ID NO: 1961280 - DNA, 12 bp, Homo sapiens
aagatagctcct

SEQ ID NO: 1961281 - DNA, 16 bp, Homo sapiens
aagatcccaagtcaaa

SEQ ID NO: 1961282 - DNA, 20 bp, Homo sapiens
aagatgctgctgagcacatc

SEQ ID NO: 1961283 - DNA, 19 bp, Homo sapiens
aagatggatttgacacact

SEQ ID NO: 1961284 - DNA, 23 bp, Homo sapiens
aagatttcctttggcaatatcat

SEQ ID NO: 1961285 - DNA, 15 bp, Homo sapiens
aagcaaaacattttg

SEQ ID NO: 1961286 - DNA, 22 bp, Homo sapiens
aagcaccagctgcctctttgct

SEQ ID NO: 1961287 - DNA, 18 bp, Homo sapiens
aagcacctcttgaagaac

SEQ ID NO: 1961288 - DNA, 22 bp, Homo sapiens
aagcagagtcaagctgatgaag

SEQ ID NO: 1961289 - DNA, 13 bp, Homo sapiens
aagcagcagctag

SEQ ID NO: 1961290 - DNA, 20 bp, Homo sapiens
aagcaggaaagatcccaagt

SEQ ID NO: 1961291 - DNA, 21 bp, Homo sapiens
aagcaggaaagatcccaagtc

SEQ ID NO: 1961292 - DNA, 17 bp, Homo sapiens
aagcatgctcagtattg

SEQ ID NO: 1961293 - DNA, 18 bp, Homo sapiens
aagcatgctcagtattga

SEQ ID NO: 1961294 - DNA, 21 bp, Homo sapiens
aagcccacccgccccagagac

SEQ ID NO: 1961295 - DNA, 22 bp, Homo sapiens
aagcccacccgccccagagact

SEQ ID NO: 1961296 - DNA, 23 bp, Homo sapiens
aagcccacccgccccagagactg

SEQ ID NO: 1961297 - DNA, 20 bp, Homo sapiens
aagcccagcctatctctctt

SEQ ID NO: 1961298 - DNA, 21 bp, Homo sapiens
cagagctgagtcggctgggca

SEQ ID NO: 1961299 - DNA, 23 bp, Homo sapiens
cagagctgagtcggctgggcagg

SEQ ID NO: 1961300 - DNA, 16 bp, Homo sapiens
cagagtcaagctgatg

SEQ ID NO: 1961301 - DNA, 23 bp, Homo sapiens
cagatcacatgcccctcttagaa

SEQ ID NO: 1961302 - DNA, 20 bp, Homo sapiens
cagatccctcggtcagcacc

SEQ ID NO: 1961303 - DNA, 17 bp, Homo sapiens
cagatgatgtaaaaata

SEQ ID NO: 1961304 - DNA, 19 bp, Homo sapiens
cagatgatgtaaaaatatg

SEQ ID NO: 1961305 - DNA, 17 bp, Homo sapiens
cagcaaaatatatgttt

SEQ ID NO: 1961306 - DNA, 13 bp, Homo sapiens
cagcaacaaagca

SEQ ID NO: 1961307 - DNA, 15 bp, Homo sapiens
cagcaacaaagcata

SEQ ID NO: 1961308 - DNA, 12 bp, Homo sapiens
cagcaacaacaa

SEQ ID NO: 1961309 - DNA, 14 bp, Homo sapiens
cagcaacaacaaca

SEQ ID NO: 1961310 - DNA, 17 bp, Homo sapiens
cagcaacaacaacagaa

SEQ ID NO: 1961311 - DNA, 16 bp, Homo sapiens
cagcaccagcctgagc

SEQ ID NO: 1961312 - DNA, 19 bp, Homo sapiens
cagcaccagcctgagccac

SEQ ID NO: 1961313 - DNA, 14 bp, Homo sapiens
cagcactcccaggg

SEQ ID NO: 1961314 - DNA, 18 bp, Homo sapiens
cagcagcggcagcagcag

SEQ ID NO: 1961315 - DNA, 20 bp, Homo sapiens
cagcagtaccatcccactga

SEQ ID NO: 1961316 - DNA, 22 bp, Homo sapiens
cagcagtgtctgttcttcattt

SEQ ID NO: 1961317 - DNA, 13 bp, Homo sapiens
cagcagtttcatg

SEQ ID NO: 1961318 - DNA, 23 bp, Homo sapiens
cagcatttttctttagtcattta

SEQ ID NO: 1961319 - DNA, 19 bp, Homo sapiens
cagcccagaacgggcctcc

SEQ ID NO: 1961320 - DNA, 20 bp, Homo sapiens
cagcccagaacgggcctccc

SEQ ID NO: 1961321 - DNA, 12 bp, Homo sapiens
cagccccatcct

SEQ ID NO: 1961322 - DNA, 17 bp, Homo sapiens
cagcccctgctggacca

SEQ ID NO: 1961323 - DNA, 14 bp, Homo sapiens
cagccgcgctctgc

SEQ ID NO: 1961324 - DNA, 17 bp, Homo sapiens
cagccgcgctctgcccc

SEQ ID NO: 1961325 - DNA, 19 bp, Homo sapiens
cagccgcgctctgcccctc

SEQ ID NO: 1961326 - DNA, 22 bp, Homo sapiens
cagccgcgctctgcccctccgt

SEQ ID NO: 1961327 - DNA, 11 bp, Homo sapiens
cagcctccccc

SEQ ID NO: 1961328 - DNA, 12 bp, Homo sapiens
cagcctccccca

SEQ ID NO: 1961329 - DNA, 21 bp, Homo sapiens
cagcctcccccaggctgcgcc

SEQ ID NO: 1961330 - DNA, 15 bp, Homo sapiens
cagcctgagccacag

SEQ ID NO: 1961331 - DNA, 17 bp, Homo sapiens
cagcctgagctccaccc

SEQ ID NO: 1961332 - DNA, 19 bp, Homo sapiens
cagcctgagctccaccctc

SEQ ID NO: 1961333 - DNA, 20 bp, Homo sapiens
cagcctgagctccaccctcc

SEQ ID NO: 1961334 - DNA, 13 bp, Homo sapiens
cagcgcctcccgc

SEQ ID NO: 1961335 - DNA, 14 bp, Homo sapiens
cagcgcctcccgcc

SEQ ID NO: 1961336 - DNA, 17 bp, Homo sapiens
cagcgcctcccgccgcc

SEQ ID NO: 1961337 - DNA, 15 bp, Homo sapiens
cagcggcccggccca

SEQ ID NO: 1961338 - DNA, 17 bp, Homo sapiens
cagctaagcctgatgat

SEQ ID NO: 1961339 - DNA, 18 bp, Homo sapiens
cagctaagcctgatgatg

SEQ ID NO: 1961340 - DNA, 19 bp, Homo sapiens
cagctacaggggaggctga

SEQ ID NO: 1961341 - DNA, 23 bp, Homo sapiens
cagctagaaagagaaaaagccct

SEQ ID NO: 1961342 - DNA, 17 bp, Homo sapiens
cagctcagcattgtgta

SEQ ID NO: 1961343 - DNA, 18 bp, Homo sapiens
cagctcagcattgtgtac

SEQ ID NO: 1961344 - DNA, 22 bp, Homo sapiens
cagctcatcttttcctgcttag

SEQ ID NO: 1961345 - DNA, 13 bp, Homo sapiens
cagctccactctg

SEQ ID NO: 1961346 - DNA, 22 bp, Homo sapiens
cagctgcctctttgctgctttg

SEQ ID NO: 1961347 - DNA, 16 bp, Homo sapiens
cagctggcagcgcctc

SEQ ID NO: 1961348 - DNA, 17 bp, Homo sapiens
cagctggcagcgcctcc

SEQ ID NO: 1961349 - DNA, 19 bp, Homo sapiens
cagctggcagcgcctcccg

SEQ ID NO: 1961350 - DNA, 17 bp, Homo sapiens
caggaaagatcccaagt

SEQ ID NO: 1961351 - DNA, 16 bp, Homo sapiens
caggagatgaggctgg

SEQ ID NO: 1961352 - DNA, 15 bp, Homo sapiens
caggattttcaagtt

SEQ ID NO: 1961353 - DNA, 13 bp, Homo sapiens
caggcgcgcaccg

SEQ ID NO: 1961354 - DNA, 14 bp, Homo sapiens
caggcgcgcaccgc

SEQ ID NO: 1961355 - DNA, 20 bp, Homo sapiens
caggcggaggggcttggagc

SEQ ID NO: 1961356 - DNA, 21 bp, Homo sapiens
caggcggaggggcttggagca

SEQ ID NO: 1961357 - DNA, 17 bp, Homo sapiens
caggctgcgcctgcccg

SEQ ID NO: 1961358 - DNA, 15 bp, Homo sapiens
cagggaatcagaaag

SEQ ID NO: 1961359 - DNA, 19 bp, Homo sapiens
cagggcccgagcgcgtgcc

SEQ ID NO: 1961360 - DNA, 17 bp, Homo sapiens
cagggccctggggtctc

SEQ ID NO: 1961361 - DNA, 23 bp, Homo sapiens
cagggccctggggtctctgagca

SEQ ID NO: 1961362 - DNA, 19 bp, Homo sapiens
cagggccgcagggcgctcc

SEQ ID NO: 1961363 - DNA, 17 bp, Homo sapiens
cagggcgctccggcaga

SEQ ID NO: 1961364 - DNA, 21 bp, Homo sapiens
cagggcgctccggcagaggca

SEQ ID NO: 1961365 - DNA, 22 bp, Homo sapiens
cagggcgctccggcagaggcag

SEQ ID NO: 1961366 - DNA, 19 bp, Homo sapiens
caggggaggctgagacgca

SEQ ID NO: 1961367 - DNA, 23 bp, Homo sapiens
caggggtttgcttacagtgatgc

SEQ ID NO: 1961368 - DNA, 11 bp, Homo sapiens
cagggtgcagg

SEQ ID NO: 1961369 - DNA, 17 bp, Homo sapiens
cagggtgcaggcgcgca

SEQ ID NO: 1961370 - DNA, 19 bp, Homo sapiens
cagggtgcaggcgcgcacc

SEQ ID NO: 1961371 - DNA, 21 bp, Homo sapiens
caggtatctgatgatgttctg

SEQ ID NO: 1961372 - DNA, 22 bp, Homo sapiens
caggtatctgatgatgttctga

SEQ ID NO: 1961373 - DNA, 17 bp, Homo sapiens
cagtaattactttcaga

SEQ ID NO: 1961374 - DNA, 21 bp, Homo sapiens
cagtaattactttcagaatgt

SEQ ID NO: 1961375 - DNA, 22 bp, Homo sapiens
cagtacaataaataaaagaaag

SEQ ID NO: 1961376 - DNA, 23 bp, Homo sapiens
cagtacaattctttgttgcttaa

SEQ ID NO: 1961377 - DNA, 16 bp, Homo sapiens
cagtaccatcccactg

SEQ ID NO: 1961378 - DNA, 18 bp, Homo sapiens
cagtagcatactgatgag

SEQ ID NO: 1961379 - DNA, 19 bp, Homo sapiens
cagtagcatactgatgaga

SEQ ID NO: 1961380 - DNA, 13 bp, Homo sapiens
cagtagtgttctg

SEQ ID NO: 1961381 - DNA, 20 bp, Homo sapiens
cagtattgagacactgtcaa

SEQ ID NO: 1961382 - DNA, 22 bp, Homo sapiens
cagtccacccccattgtgaatg

SEQ ID NO: 1961383 - DNA, 22 bp, Homo sapiens
cagtgaggtatgatgtgctgct

SEQ ID NO: 1961384 - DNA, 18 bp, Homo sapiens
cagtgatgccatgaagac

SEQ ID NO: 1961385 - DNA, 13 bp, Homo sapiens
cagtggggcccat

SEQ ID NO: 1961386 - DNA, 17 bp, Homo sapiens
cagtggggcccatggcc

SEQ ID NO: 1961387 - DNA, 20 bp, Homo sapiens
cagtggggcccatggcccca

SEQ ID NO: 1961388 - DNA, 23 bp, Homo sapiens
cagtggggcccatggccccagct

SEQ ID NO: 1961389 - DNA, 14 bp, Homo sapiens
cagtggtgatgcct

SEQ ID NO: 1961390 - DNA, 21 bp, Homo sapiens
cagtgtactctgagtcctcat

SEQ ID NO: 1961391 - DNA, 18 bp, Homo sapiens
cagttagcccggccaagg

SEQ ID NO: 1961392 - DNA, 21 bp, Homo sapiens
cagttccctcagccctcatta

SEQ ID NO: 1961393 - DNA, 22 bp, Homo sapiens
cagtttgtgaagtgattgacat

SEQ ID NO: 1961394 - DNA, 16 bp, Homo sapiens
cataaatcttccaaag

SEQ ID NO: 1961395 - DNA, 14 bp, Homo sapiens
cataacacacatca

SEQ ID NO: 1961396 - DNA, 13 bp, Homo sapiens
cataacaggcatt

SEQ ID NO: 1961397 - DNA, 17 bp, Homo sapiens
cataatcatcctttttt

SEQ ID NO: 1961398 - DNA, 21 bp, Homo sapiens
cataatcatccttttttaaaa

SEQ ID NO: 1961399 - DNA, 22 bp, Homo sapiens
cataatcatccttttttaaaaa

SEQ ID NO: 1961400 - DNA, 13 bp, Homo sapiens
cataatgcttctt

SEQ ID NO: 1961401 - DNA, 21 bp, Homo sapiens
catacacagaaatcctaacat

SEQ ID NO: 1961402 - DNA, 17 bp, Homo sapiens
catacatttaaaaaaca

SEQ ID NO: 1961403 - DNA, 15 bp, Homo sapiens
catacgcactgggca

SEQ ID NO: 1961404 - DNA, 16 bp, Homo sapiens
catactgatgagacaa

SEQ ID NO: 1961405 - DNA, 21 bp, Homo sapiens
catactgatgagacaacacac

SEQ ID NO: 1961406 - DNA, 18 bp, Homo sapiens
catagccagttctgacag

SEQ ID NO: 1961407 - DNA, 16 bp, Homo sapiens
catagtggtcatttgg

SEQ ID NO: 1961408 - DNA, 15 bp, Homo sapiens
catagttggaaatat

SEQ ID NO: 1961409 - DNA, 14 bp, Homo sapiens
catatactttgtct

SEQ ID NO: 1961410 - DNA, 14 bp, Homo sapiens
catattatatcaga

SEQ ID NO: 1961411 - DNA, 20 bp, Homo sapiens
catattttgttatagttcat

SEQ ID NO: 1961412 - DNA, 13 bp, Homo sapiens
catcccactgata

SEQ ID NO: 1961413 - DNA, 18 bp, Homo sapiens
catcccactgatatcacg

SEQ ID NO: 1961414 - DNA, 22 bp, Homo sapiens
catcctgtttttccttttgttt

SEQ ID NO: 1961415 - DNA, 13 bp, Homo sapiens
catccttcccgca

SEQ ID NO: 1961416 - DNA, 19 bp, Homo sapiens
catccttcccgcagcacca

SEQ ID NO: 1961417 - DNA, 23 bp, Homo sapiens
catccttcccgcagcaccagcct

SEQ ID NO: 1961418 - DNA, 18 bp, Homo sapiens
catccttttttaaaaaaa

SEQ ID NO: 1961419 - DNA, 12 bp, Homo sapiens
catctctgtaaa

SEQ ID NO: 1961420 - DNA, 15 bp, Homo sapiens
catctcttcatgcgc

SEQ ID NO: 1961421 - DNA, 11 bp, Homo sapiens
catctggcctg

SEQ ID NO: 1961422 - DNA, 21 bp, Homo sapiens
catcttaggcactttttaaca

SEQ ID NO: 1961423 - DNA, 15 bp, Homo sapiens
catcttgaagtcatt

SEQ ID NO: 1961424 - DNA, 21 bp, Homo sapiens
catgaatacgtaaactgcgta

SEQ ID NO: 1961425 - DNA, 19 bp, Homo sapiens
ccagcctatctctcttctg

SEQ ID NO: 1961426 - DNA, 13 bp, Homo sapiens
ccagcctccccca

SEQ ID NO: 1961427 - DNA, 14 bp, Homo sapiens
ccagcctcccccag

SEQ ID NO: 1961428 - DNA, 17 bp, Homo sapiens
ccagcctcccccaggct

SEQ ID NO: 1961429 - DNA, 13 bp, Homo sapiens
ccagcctgagcca

SEQ ID NO: 1961430 - DNA, 15 bp, Homo sapiens
ccagcctgagccaca

SEQ ID NO: 1961431 - DNA, 17 bp, Homo sapiens
ccagcctgagccacagt

SEQ ID NO: 1961432 - DNA, 14 bp, Homo sapiens
ccagctggcagcgc

SEQ ID NO: 1961433 - DNA, 18 bp, Homo sapiens
ccagctggcagcgcctcc

SEQ ID NO: 1961434 - DNA, 14 bp, Homo sapiens
ccagctggctgggt

SEQ ID NO: 1961435 - DNA, 19 bp, Homo sapiens
ccaggagatgaggctggat

SEQ ID NO: 1961436 - DNA, 14 bp, Homo sapiens
ccaggctgcgcctg

SEQ ID NO: 1961437 - DNA, 14 bp, Homo sapiens
ccagggaaccagag

SEQ ID NO: 1961438 - DNA, 17 bp, Homo sapiens
ccagggaaccagagcga

SEQ ID NO: 1961439 - DNA, 17 bp, Homo sapiens
ccagtacaataaataaa

SEQ ID NO: 1961440 - DNA, 23 bp, Homo sapiens
ccagttagcccggccaaggacac

SEQ ID NO: 1961441 - DNA, 14 bp, Homo sapiens
ccagttctgatgag

SEQ ID NO: 1961442 - DNA, 13 bp, Homo sapiens
ccataatgcttct

SEQ ID NO: 1961443 - DNA, 19 bp, Homo sapiens
ccatatatatctgagttgt

SEQ ID NO: 1961444 - DNA, 22 bp, Homo sapiens
ccatcaaagccctccctgtctg

SEQ ID NO: 1961445 - DNA, 16 bp, Homo sapiens
ccatccttcccgcagc

SEQ ID NO: 1961446 - DNA, 22 bp, Homo sapiens
ccatgaaacttgagcattcaaa

SEQ ID NO: 1961447 - DNA, 13 bp, Homo sapiens
ccatgccaatgtc

SEQ ID NO: 1961448 - DNA, 16 bp, Homo sapiens
ccatgctcagctcagc

SEQ ID NO: 1961449 - DNA, 13 bp, Homo sapiens
cctgacttcccag

SEQ ID NO: 1961450 - DNA, 14 bp, Homo sapiens
cctgacttcccagc

SEQ ID NO: 1961451 - DNA, 20 bp, Homo sapiens
cctgacttcccagctggcag

SEQ ID NO: 1961452 - DNA, 16 bp, Homo sapiens
cctgagccacagtggg

SEQ ID NO: 1961453 - DNA, 21 bp, Homo sapiens
cctgagccacagtggggccca

SEQ ID NO: 1961454 - DNA, 14 bp, Homo sapiens
cctgagcctgtctc

SEQ ID NO: 1961455 - DNA, 16 bp, Homo sapiens
cctgagcctgtctctc

SEQ ID NO: 1961456 - DNA, 15 bp, Homo sapiens
cctgagctccaccct

SEQ ID NO: 1961457 - DNA, 16 bp, Homo sapiens
cctgagctccaccctc

SEQ ID NO: 1961458 - DNA, 22 bp, Homo sapiens
cctgagggaagcccacccgccc

SEQ ID NO: 1961459 - DNA, 15 bp, Homo sapiens
cctgcccgcccgccg

SEQ ID NO: 1961460 - DNA, 16 bp, Homo sapiens
cctgccctcccccacg

SEQ ID NO: 1961461 - DNA, 19 bp, Homo sapiens
cctgccctcccccacggcc

SEQ ID NO: 1961462 - DNA, 13 bp, Homo sapiens
cctgccctgcacc

SEQ ID NO: 1961463 - DNA, 18 bp, Homo sapiens
cctgcgctcctctgcagc

SEQ ID NO: 1961464 - DNA, 19 bp, Homo sapiens
cctgctcacgtctgtgagt

SEQ ID NO: 1961465 - DNA, 20 bp, Homo sapiens
cctgctgctcgggaaggcct

SEQ ID NO: 1961466 - DNA, 20 bp, Homo sapiens
cctggaagttgtcctttctg

SEQ ID NO: 1961467 - DNA, 16 bp, Homo sapiens
cctggacatattccca

SEQ ID NO: 1961468 - DNA, 14 bp, Homo sapiens
cctggcgggcagcc

SEQ ID NO: 1961469 - DNA, 22 bp, Homo sapiens
cctggcgggcagcccctgctgg

SEQ ID NO: 1961470 - DNA, 23 bp, Homo sapiens
cctggcgggcagcccctgctgga

SEQ ID NO: 1961471 - DNA, 21 bp, Homo sapiens
cctgggcaacagagtgagacc

SEQ ID NO: 1961472 - DNA, 13 bp, Homo sapiens
cctgggcctcccg

SEQ ID NO: 1961473 - DNA, 22 bp, Homo sapiens
cctgggggctgttagctcagag

SEQ ID NO: 1961474 - DNA, 17 bp, Homo sapiens
cctggggtctctgagca

SEQ ID NO: 1961475 - DNA, 18 bp, Homo sapiens
cctggggtctctgagcag

SEQ ID NO: 1961476 - DNA, 20 bp, Homo sapiens
cctggggtctctgagcagtg

SEQ ID NO: 1961477 - DNA, 14 bp, Homo sapiens
cctgtcctgctcac

SEQ ID NO: 1961478 - DNA, 12 bp, Homo sapiens
cctgtctcctct

SEQ ID NO: 1961479 - DNA, 21 bp, Homo sapiens
cctgtctctccctaccctctt

SEQ ID NO: 1961480 - DNA, 15 bp, Homo sapiens
cctgtgcacctgact

SEQ ID NO: 1961481 - DNA, 15 bp, Homo sapiens
cctgtgggagtccac

SEQ ID NO: 1961482 - DNA, 17 bp, Homo sapiens
cctgtgggagtccactt

SEQ ID NO: 1961483 - DNA, 19 bp, Homo sapiens
cctgtgggagtccactttc

SEQ ID NO: 1961484 - DNA, 21 bp, Homo sapiens
cctgtgggagtccactttcct

SEQ ID NO: 1961485 - DNA, 22 bp, Homo sapiens
cctgtgggagtccactttcctc

SEQ ID NO: 1961486 - DNA, 23 bp, Homo sapiens
cctgtgggagtccactttcctct

SEQ ID NO: 1961487 - DNA, 13 bp, Homo sapiens
cctgtggtttgtt

SEQ ID NO: 1961488 - DNA, 13 bp, Homo sapiens
cctgtgtcatctg

SEQ ID NO: 1961489 - DNA, 14 bp, Homo sapiens
ccttatcataaatt

SEQ ID NO: 1961490 - DNA, 21 bp, Homo sapiens
ccttcacaatttcaatgcttc

SEQ ID NO: 1961491 - DNA, 15 bp, Homo sapiens
ccttcactacaacat

SEQ ID NO: 1961492 - DNA, 17 bp, Homo sapiens
ccttcatgcttttctca

SEQ ID NO: 1961493 - DNA, 18 bp, Homo sapiens
ccttcatgcttttctcat

SEQ ID NO: 1961494 - DNA, 21 bp, Homo sapiens
ccttcatgcttttctcatggt

SEQ ID NO: 1961495 - DNA, 21 bp, Homo sapiens
ccttcccgcagcaccagcctg

SEQ ID NO: 1961496 - DNA, 14 bp, Homo sapiens
ccttcctgtcctgc

SEQ ID NO: 1961497 - DNA, 18 bp, Homo sapiens
ccttcctgtcctgctcac

SEQ ID NO: 1961498 - DNA, 21 bp, Homo sapiens
ccttctacaaaagaagtgtga

SEQ ID NO: 1961499 - DNA, 13 bp, Homo sapiens
ccttctgtgcatc

SEQ ID NO: 1961500 - DNA, 20 bp, Homo sapiens
ccttctgtgcatctggcctg

SEQ ID NO: 1961501 - DNA, 23 bp, Homo sapiens
ccttctgtgcatctggcctgggg

SEQ ID NO: 1961502 - DNA, 17 bp, Homo sapiens
ccttgaccccacacgcc

SEQ ID NO: 1961503 - DNA, 21 bp, Homo sapiens
ccttgcattttagctaattta

SEQ ID NO: 1961504 - DNA, 17 bp, Homo sapiens
ccttgggcacgggagag

SEQ ID NO: 1961505 - DNA, 22 bp, Homo sapiens
ccttgtacagaaccagcactcc

SEQ ID NO: 1961506 - DNA, 22 bp, Homo sapiens
cctttcccacccactagccctc

SEQ ID NO: 1961507 - DNA, 16 bp, Homo sapiens
ccttttcagataatga

SEQ ID NO: 1961508 - DNA, 17 bp, Homo sapiens
cgagagggctgagcccc

SEQ ID NO: 1961509 - DNA, 19 bp, Homo sapiens
cgagagggctgagcccctc

SEQ ID NO: 1961510 - DNA, 18 bp, Homo sapiens
cgatcatatctgtatgcc

SEQ ID NO: 1961511 - DNA, 14 bp, Homo sapiens
cgcaccgcccaacc

SEQ ID NO: 1961512 - DNA, 16 bp, Homo sapiens
cgcagagccccggagc

SEQ ID NO: 1961513 - DNA, 19 bp, Homo sapiens
cggaggcgcccacctgccc

SEQ ID NO: 1961514 - DNA, 20 bp, Homo sapiens
cggaggcgcccacctgccca

SEQ ID NO: 1961515 - DNA, 15 bp, Homo sapiens
cggaggggcttggag

SEQ ID NO: 1961516 - DNA, 19 bp, Homo sapiens
cggaggggcttggagcaga

SEQ ID NO: 1961517 - DNA, 12 bp, Homo sapiens
cggcaccgccca

SEQ ID NO: 1961518 - DNA, 14 bp, Homo sapiens
cggcaccgcccacc

SEQ ID NO: 1961519 - DNA, 14 bp, Homo sapiens
cggcagaggcaggg

SEQ ID NO: 1961520 - DNA, 17 bp, Homo sapiens
cggcagaggcagggccc

SEQ ID NO: 1961521 - DNA, 24 bp, Homo sapiens
cggcagaggcagggccctggggtc

SEQ ID NO: 1961522 - DNA, 19 bp, Homo sapiens
cggccaggcacggaggctc

SEQ ID NO: 1961523 - DNA, 16 bp, Homo sapiens
cggcccacgcagagcc

SEQ ID NO: 1961524 - DNA, 17 bp, Homo sapiens
cggcccacgcagagccc

SEQ ID NO: 1961525 - DNA, 18 bp, Homo sapiens
cggccccgcgcgtgcccc

SEQ ID NO: 1961526 - DNA, 19 bp, Homo sapiens
cggccccgcgcgtgccccc

SEQ ID NO: 1961527 - DNA, 17 bp, Homo sapiens
cggcccggcccacgcag

SEQ ID NO: 1961528 - DNA, 20 bp, Homo sapiens
cggcccggcccacgcagagc

SEQ ID NO: 1961529 - DNA, 14 bp, Homo sapiens
cggcctgcagccca

SEQ ID NO: 1961530 - DNA, 15 bp, Homo sapiens
cggcctgcagcccag

SEQ ID NO: 1961531 - DNA, 20 bp, Homo sapiens
cggctgaggacggggcagag

SEQ ID NO: 1961532 - DNA, 18 bp, Homo sapiens
cggctggccggtccaccc

SEQ ID NO: 1961533 - DNA, 12 bp, Homo sapiens
cggctgggcagg

SEQ ID NO: 1961534 - DNA, 17 bp, Homo sapiens
cggctgggcagggccgc

SEQ ID NO: 1961535 - DNA, 20 bp, Homo sapiens
cggctgggcagggccgcagg

SEQ ID NO: 1961536 - DNA, 22 bp, Homo sapiens
cgggactgtcttcaaccctgcc

SEQ ID NO: 1961537 - DNA, 17 bp, Homo sapiens
cgggagagcgccacccg

SEQ ID NO: 1961538 - DNA, 14 bp, Homo sapiens
cgggcagcccctgc

SEQ ID NO: 1961539 - DNA, 14 bp, Homo sapiens
cgggccgcctcctc

SEQ ID NO: 1961540 - DNA, 17 bp, Homo sapiens
cgggccgcctcctccag

SEQ ID NO: 1961541 - DNA, 18 bp, Homo sapiens
cgggccgcctcctccaga

SEQ ID NO: 1961542 - DNA, 20 bp, Homo sapiens
cgggccgcctcctccagact

SEQ ID NO: 1961543 - DNA, 12 bp, Homo sapiens
cgggcgcctgcg

SEQ ID NO: 1961544 - DNA, 22 bp, Homo sapiens
cgggcgcctgcgctcctctgca

SEQ ID NO: 1961545 - DNA, 21 bp, Homo sapiens
cgggctctctcacccagcctg

SEQ ID NO: 1961546 - DNA, 14 bp, Homo sapiens
cggggcagagctga

SEQ ID NO: 1961547 - DNA, 13 bp, Homo sapiens
cggggctggccct

SEQ ID NO: 1961548 - DNA, 19 bp, Homo sapiens
cgggggaggagcaccccca

SEQ ID NO: 1961549 - DNA, 16 bp, Homo sapiens
cgggggctaactggcc

SEQ ID NO: 1961550 - DNA, 19 bp, Homo sapiens
cgggggctaactggcccca

SEQ ID NO: 1961551 - DNA, 20 bp, Homo sapiens
cgggggctaactggccccag

SEQ ID NO: 1961552 - DNA, 21 bp, Homo sapiens
cggggtcgggggaggagcacc

SEQ ID NO: 1961553 - DNA, 19 bp, Homo sapiens
cgggtgcgtgaccggcccg

SEQ ID NO: 1961554 - DNA, 22 bp, Homo sapiens
cggtccaccccgtcccggcccc

SEQ ID NO: 1961555 - DNA, 16 bp, Homo sapiens
cggtggcatttgctga

SEQ ID NO: 1961556 - DNA, 17 bp, Homo sapiens
cggtggcatttgctgaa

SEQ ID NO: 1961557 - DNA, 17 bp, Homo sapiens
cggttggccggctggcc

SEQ ID NO: 1961558 - DNA, 20 bp, Homo sapiens
cgtccctgacttcccagctg

SEQ ID NO: 1961559 - DNA, 14 bp, Homo sapiens
cgtccgcccgccca

SEQ ID NO: 1961560 - DNA, 19 bp, Homo sapiens
cgtccgcccgcccaccccg

SEQ ID NO: 1961561 - DNA, 18 bp, Homo sapiens
cgtccggcctgcagccca

SEQ ID NO: 1961562 - DNA, 16 bp, Homo sapiens
cgtccgtccgcccgcc

SEQ ID NO: 1961563 - DNA, 14 bp, Homo sapiens
cgtctaaactgttt

SEQ ID NO: 1961564 - DNA, 22 bp, Homo sapiens
cgtctgccccttgaccccacac

SEQ ID NO: 1961565 - DNA, 18 bp, Homo sapiens
cgtctttggttcctcatg

SEQ ID NO: 1961566 - DNA, 19 bp, Homo sapiens
cgtctttggttcctcatgg

SEQ ID NO: 1961567 - DNA, 20 bp, Homo sapiens
cgtctttggttcctcatggc

SEQ ID NO: 1961568 - DNA, 22 bp, Homo sapiens
cgtgaccggcccgccaccttgt

SEQ ID NO: 1961569 - DNA, 13 bp, Homo sapiens
cgtgcccccagcg

SEQ ID NO: 1961570 - DNA, 13 bp, Homo sapiens
cgtgcgcagccgc

SEQ ID NO: 1961571 - DNA, 19 bp, Homo sapiens
cgtgcggcccgtgcgcagc

SEQ ID NO: 1961572 - DNA, 14 bp, Homo sapiens
cgtggtgtgaggcc

SEQ ID NO: 1961573 - DNA, 19 bp, Homo sapiens
cgtggtgtgaggcccccgg

SEQ ID NO: 1961574 - DNA, 18 bp, Homo sapiens
cgtgtggccctgtgggag

SEQ ID NO: 1961575 - DNA, 17 bp, Homo sapiens
ctaaaagtgatgtgatt

SEQ ID NO: 1961576 - DNA, 18 bp, Homo sapiens
ctaaatagatttttagat

SEQ ID NO: 1961577 - DNA, 13 bp, Homo sapiens
ctaaatcataatc

SEQ ID NO: 1961578 - DNA, 21 bp, Homo sapiens
ctaaatgaccatccagtagag

SEQ ID NO: 1961579 - DNA, 12 bp, Homo sapiens
ctaaatgcaaag

SEQ ID NO: 1961580 - DNA, 14 bp, Homo sapiens
ctaaatgcaaagca

SEQ ID NO: 1961581 - DNA, 20 bp, Homo sapiens
ctaacaaaagatatgaagaa

SEQ ID NO: 1961582 - DNA, 12 bp, Homo sapiens
ctaacactggct

SEQ ID NO: 1961583 - DNA, 13 bp, Homo sapiens
ctaacctctctga

SEQ ID NO: 1961584 - DNA, 14 bp, Homo sapiens
ctaacgggcgcctt

SEQ ID NO: 1961585 - DNA, 15 bp, Homo sapiens
ctaactggccccagg

SEQ ID NO: 1961586 - DNA, 21 bp, Homo sapiens
ctaaggtcagtgttataaaat

SEQ ID NO: 1961587 - DNA, 18 bp, Homo sapiens
ctaagtaaatctaaatta

SEQ ID NO: 1961588 - DNA, 18 bp, Homo sapiens
ctaatccatgtgctgctg

SEQ ID NO: 1961589 - DNA, 13 bp, Homo sapiens
ctaatgcagaatt

SEQ ID NO: 1961590 - DNA, 13 bp, Homo sapiens
ctaattaatttca

SEQ ID NO: 1961591 - DNA, 15 bp, Homo sapiens
ctacaaaatgtgtgc

SEQ ID NO: 1961592 - DNA, 19 bp, Homo sapiens
ctaccctcttctcagctcc

SEQ ID NO: 1961593 - DNA, 22 bp, Homo sapiens
ctaccctcttctcagctccact

SEQ ID NO: 1961594 - DNA, 15 bp, Homo sapiens
ctacttaaacaaaaa

SEQ ID NO: 1961595 - DNA, 23 bp, Homo sapiens
ctagaaagagaaaaagccctctt

SEQ ID NO: 1961596 - DNA, 14 bp, Homo sapiens
ctagataaaaggag

SEQ ID NO: 1961597 - DNA, 21 bp, Homo sapiens
ctagataaaaggagagaaagc

SEQ ID NO: 1961598 - DNA, 22 bp, Homo sapiens
ctagataaaaggagagaaagca

SEQ ID NO: 1961599 - DNA, 19 bp, Homo sapiens
ctagatatcaatcagtaat

SEQ ID NO: 1961600 - DNA, 15 bp, Homo sapiens
ctagatatgagaaat

SEQ ID NO: 1961601 - DNA, 16 bp, Homo sapiens
ctagatatgagaaata

SEQ ID NO: 1961602 - DNA, 13 bp, Homo sapiens
ctagcaaaaggat

SEQ ID NO: 1961603 - DNA, 13 bp, Homo sapiens
ctagccatatatt

SEQ ID NO: 1961604 - DNA, 20 bp, Homo sapiens
ctagccctctttctctctgt

SEQ ID NO: 1961605 - DNA, 15 bp, Homo sapiens
ctagctgcttttctg

SEQ ID NO: 1961606 - DNA, 23 bp, Homo sapiens
ctagtaggtctgcacacataaca

SEQ ID NO: 1961607 - DNA, 24 bp, Homo sapiens
ctagtaggtctgcacacataacac

SEQ ID NO: 1961608 - DNA, 20 bp, Homo sapiens
ctagtgctacagatgtacat

SEQ ID NO: 1961609 - DNA, 15 bp, Homo sapiens
ctatagcatttaaag

SEQ ID NO: 1961610 - DNA, 15 bp, Homo sapiens
ctatagccaaagctg

SEQ ID NO: 1961611 - DNA, 12 bp, Homo sapiens
ctatctggaaaa

SEQ ID NO: 1961612 - DNA, 22 bp, Homo sapiens
ctatctggaaaaaaaaaaatat

SEQ ID NO: 1961613 - DNA, 16 bp, Homo sapiens
ctatgatgtccaaact

SEQ ID NO: 1961614 - DNA, 15 bp, Homo sapiens
ctatgcacaccaaat

SEQ ID NO: 1961615 - DNA, 22 bp, Homo sapiens
ctatgcacaccaaattgctgag

SEQ ID NO: 1961616 - DNA, 13 bp, Homo sapiens
ctatgtacagatg

SEQ ID NO: 1961617 - DNA, 14 bp, Homo sapiens
ctatgtgtgtgctt

SEQ ID NO: 1961618 - DNA, 13 bp, Homo sapiens
ctattgctgtaaa

SEQ ID NO: 1961619 - DNA, 20 bp, Homo sapiens
ctattgctgtaaataaaaat

SEQ ID NO: 1961620 - DNA, 14 bp, Homo sapiens
ctatttattaaaac

SEQ ID NO: 1961621 - DNA, 23 bp, Homo sapiens
ctcaaaataaaaccagaaagagg

SEQ ID NO: 1961622 - DNA, 13 bp, Homo sapiens
ctcaaaatgtgcc

SEQ ID NO: 1961623 - DNA, 12 bp, Homo sapiens
ctcaacctctca

SEQ ID NO: 1961624 - DNA, 14 bp, Homo sapiens
ctcaacctctcaga

SEQ ID NO: 1961625 - DNA, 21 bp, Homo sapiens
ctcaaggctgcagtgagccaa

SEQ ID NO: 1961626 - DNA, 18 bp, Homo sapiens
ctcaatatgatcttgata

SEQ ID NO: 1961627 - DNA, 16 bp, Homo sapiens
ctcaatcatgacttct

SEQ ID NO: 1961628 - DNA, 19 bp, Homo sapiens
ctcaatcatgggaatttta

SEQ ID NO: 1961629 - DNA, 20 bp, Homo sapiens
ctcaatgccaggcagtgcag

SEQ ID NO: 1961630 - DNA, 12 bp, Homo sapiens
ctcaatgtgctg

SEQ ID NO: 1961631 - DNA, 21 bp, Homo sapiens
ctcaccatttaatcatttcca

SEQ ID NO: 1961632 - DNA, 14 bp, Homo sapiens
ctcacgtctgtgag

SEQ ID NO: 1961633 - DNA, 21 bp, Homo sapiens
ctcacgtctgtgagtctgtcc

SEQ ID NO: 1961634 - DNA, 22 bp, Homo sapiens
ctcagaagtgaaaaagacttca

SEQ ID NO: 1961635 - DNA, 16 bp, Homo sapiens
ctcagccctcattaaa

SEQ ID NO: 1961636 - DNA, 20 bp, Homo sapiens
ctcagtaagacagtgcagtg

SEQ ID NO: 1961637 - DNA, 18 bp, Homo sapiens
ctcagtaaggcagtgcag

SEQ ID NO: 1961638 - DNA, 12 bp, Homo sapiens
ctcatggctgtt

SEQ ID NO: 1961639 - DNA, 22 bp, Homo sapiens
ctcatggctgttatctgtcttt

SEQ ID NO: 1961640 - DNA, 22 bp, Homo sapiens
ctcattgttcagaaaagcacct

SEQ ID NO: 1961641 - DNA, 19 bp, Homo sapiens
ctcatttcattatttttca

SEQ ID NO: 1961642 - DNA, 16 bp, Homo sapiens
ctccagaagcagcagc

SEQ ID NO: 1961643 - DNA, 18 bp, Homo sapiens
ctccagactcgagagggc

SEQ ID NO: 1961644 - DNA, 19 bp, Homo sapiens
ctccagactcgagagggct

SEQ ID NO: 1961645 - DNA, 21 bp, Homo sapiens
ctccagactcgagagggctga

SEQ ID NO: 1961646 - DNA, 12 bp, Homo sapiens
ctcccagggccc

SEQ ID NO: 1961647 - DNA, 13 bp, Homo sapiens
ctcccagggcccg

SEQ ID NO: 1961648 - DNA, 19 bp, Homo sapiens
ctcccagggcccgagcgcg

SEQ ID NO: 1961649 - DNA, 21 bp, Homo sapiens
ctcccccacggccgtccctga

SEQ ID NO: 1961650 - DNA, 17 bp, Homo sapiens
ctcccccaggctgcgcc

SEQ ID NO: 1961651 - DNA, 22 bp, Homo sapiens
ctcccccaggctgcgcctgccc

SEQ ID NO: 1961652 - DNA, 22 bp, Homo sapiens
ctccccgcccgccctcctctgc

SEQ ID NO: 1961653 - DNA, 13 bp, Homo sapiens
ctcccctccaagt

SEQ ID NO: 1961654 - DNA, 15 bp, Homo sapiens
ctcccctctcctgag

SEQ ID NO: 1961655 - DNA, 18 bp, Homo sapiens
ctcccctctcctgagcct

SEQ ID NO: 1961656 - DNA, 13 bp, Homo sapiens
ctcccctggaagt

SEQ ID NO: 1961657 - DNA, 16 bp, Homo sapiens
ctcccgccgcctcggg

SEQ ID NO: 1961658 - DNA, 17 bp, Homo sapiens
ctcccgccgcctcgggc

SEQ ID NO: 1961659 - DNA, 22 bp, Homo sapiens
ctcccgtccgtccgcccgccca

SEQ ID NO: 1961660 - DNA, 14 bp, Homo sapiens
ctcccttttcagat

SEQ ID NO: 1961661 - DNA, 19 bp, Homo sapiens
ctccggcagaggcagggcc

SEQ ID NO: 1961662 - DNA, 15 bp, Homo sapiens
ctccgtccccagggt

SEQ ID NO: 1961663 - DNA, 20 bp, Homo sapiens
ctccgtccccagggtgcagg

SEQ ID NO: 1961664 - DNA, 12 bp, Homo sapiens
ctcctccaaatg

SEQ ID NO: 1961665 - DNA, 13 bp, Homo sapiens
ctcctccagactc

SEQ ID NO: 1961666 - DNA, 16 bp, Homo sapiens
ctcctcgggcgcctgc

SEQ ID NO: 1961667 - DNA, 20 bp, Homo sapiens
ctcctctgcagcctgagctc

SEQ ID NO: 1961668 - DNA, 13 bp, Homo sapiens
ctcctctgccccc

SEQ ID NO: 1961669 - DNA, 14 bp, Homo sapiens
ctcctctgccccct

SEQ ID NO: 1961670 - DNA, 13 bp, Homo sapiens
ctcctgagcctgt

SEQ ID NO: 1961671 - DNA, 14 bp, Homo sapiens
ctcctgattctctt

SEQ ID NO: 1961672 - DNA, 18 bp, Homo sapiens
ctcctgctgaccttctgc

SEQ ID NO: 1961673 - DNA, 21 bp, Homo sapiens
ctcctgctgaccttctgcggc

SEQ ID NO: 1961674 - DNA, 22 bp, Homo sapiens
ctccttacagaagggagtgaaa

SEQ ID NO: 1961675 - DNA, 19 bp, Homo sapiens
ctccttcatgcttttctca

SEQ ID NO: 1961676 - DNA, 16 bp, Homo sapiens
ctcgagagggctgagc

SEQ ID NO: 1961677 - DNA, 20 bp, Homo sapiens
ctcgggcgcctgcgctcctc

SEQ ID NO: 1961678 - DNA, 22 bp, Homo sapiens
ctcgggcgcctgcgctcctctg

SEQ ID NO: 1961679 - DNA, 13 bp, Homo sapiens
ctcgtccggcctg

SEQ ID NO: 1961680 - DNA, 14 bp, Homo sapiens
ctcgtccggcctgc

SEQ ID NO: 1961681 - DNA, 15 bp, Homo sapiens
ctcgtccggcctgca

SEQ ID NO: 1961682 - DNA, 21 bp, Homo sapiens
ctctaagaaatggctttccac

SEQ ID NO: 1961683 - DNA, 15 bp, Homo sapiens
ctctacaaaaaaaat

SEQ ID NO: 1961684 - DNA, 16 bp, Homo sapiens
ctctcacccagcctgg

SEQ ID NO: 1961685 - DNA, 17 bp, Homo sapiens
ctctcagatccctcggt

SEQ ID NO: 1961686 - DNA, 16 bp, Homo sapiens
ctctcattcccaggca

SEQ ID NO: 1961687 - DNA, 17 bp, Homo sapiens
ctctcctcgtccggcct

SEQ ID NO: 1961688 - DNA, 20 bp, Homo sapiens
ctctcctcgtccggcctgca

SEQ ID NO: 1961689 - DNA, 16 bp, Homo sapiens
ctctcgggctctctca

SEQ ID NO: 1961690 - DNA, 19 bp, Homo sapiens
ctctcgggctctctcaccc

SEQ ID NO: 1961691 - DNA, 15 bp, Homo sapiens
ctctctcacccagcc

SEQ ID NO: 1961692 - DNA, 9 bp, Homo sapiens
ctctctctc

SEQ ID NO: 1961693 - DNA, 15 bp, Homo sapiens
ctctctctctctctg

SEQ ID NO: 1961694 - DNA, 15 bp, Homo sapiens
ctctctctctctgtt

SEQ ID NO: 1961695 - DNA, 16 bp, Homo sapiens
ctctctctctgttcca

SEQ ID NO: 1961696 - DNA, 9 bp, Homo sapiens
ctctctctg

SEQ ID NO: 1961697 - DNA, 10 bp, Homo sapiens
ctctctctgt

SEQ ID NO: 1961698 - DNA, 13 bp, Homo sapiens
ctctctctgttcc

SEQ ID NO: 1961699 - DNA, 15 bp, Homo sapiens
ctctctgaactgcaa

SEQ ID NO: 1961700 - DNA, 14 bp, Homo sapiens
ctctctgtgtggca

SEQ ID NO: 1961701 - DNA, 21 bp, Homo sapiens
ctctctgtgtggcaaacattt

SEQ ID NO: 1961702 - DNA, 24 bp, Homo sapiens
ctctcttggtctctttctttccaa

SEQ ID NO: 1961703 - DNA, 18 bp, Homo sapiens
ctctgaactgcaacactg

SEQ ID NO: 1961704 - DNA, 20 bp, Homo sapiens
ctctgaactgcaacactgga

SEQ ID NO: 1961705 - DNA, 17 bp, Homo sapiens
ctctgaagtcccttcct

SEQ ID NO: 1961706 - DNA, 20 bp, Homo sapiens
ctctgaagtcccttcctgtc

SEQ ID NO: 1961707 - DNA, 15 bp, Homo sapiens
ctctgaatctctcaa

SEQ ID NO: 1961708 - DNA, 20 bp, Homo sapiens
ctctgaatctctcaaaatgt

SEQ ID NO: 1961709 - DNA, 12 bp, Homo sapiens
ctctgagcagtg

SEQ ID NO: 1961710 - DNA, 16 bp, Homo sapiens
ctctgagcagtgggga

SEQ ID NO: 1961711 - DNA, 14 bp, Homo sapiens
ctctgcagcctgag

SEQ ID NO: 1961712 - DNA, 15 bp, Homo sapiens
ctctgcagcctgagc

SEQ ID NO: 1961713 - DNA, 10 bp, Homo sapiens
ctctgcccct

SEQ ID NO: 1961714 - DNA, 13 bp, Homo sapiens
ctctgcccctccg

SEQ ID NO: 1961715 - DNA, 22 bp, Homo sapiens
ctctgcccctccgtccccaggg

SEQ ID NO: 1961716 - DNA, 16 bp, Homo sapiens
ctctgtcagtttgtga

SEQ ID NO: 1961717 - DNA, 20 bp, Homo sapiens
ctctgtgtggcaaacattta

SEQ ID NO: 1961718 - DNA, 12 bp, Homo sapiens
ctctgttccaag

SEQ ID NO: 1961719 - DNA, 13 bp, Homo sapiens
ctctgttccaagt

SEQ ID NO: 1961720 - DNA, 19 bp, Homo sapiens
ctctgttccaagtgtgtgt

SEQ ID NO: 1961721 - DNA, 21 bp, Homo sapiens
ctcttaatgtctcaaaataaa

SEQ ID NO: 1961722 - DNA, 15 bp, Homo sapiens
ctcttcaatccccat

SEQ ID NO: 1961723 - DNA, 23 bp, Homo sapiens
ctcttcttgcggcaccgcccacc

SEQ ID NO: 1961724 - DNA, 12 bp, Homo sapiens
ctcttggtctct

SEQ ID NO: 1961725 - DNA, 13 bp, Homo sapiens
ctcttggtctctt

SEQ ID NO: 1961726 - DNA, 23 bp, Homo sapiens
ctcttggtctctttctttccaaa

SEQ ID NO: 1961727 - DNA, 15 bp, Homo sapiens
ctctttcggaaatga

SEQ ID NO: 1961728 - DNA, 17 bp, Homo sapiens
ctctttcggaaatgatt

SEQ ID NO: 1961729 - DNA, 14 bp, Homo sapiens
ctctttctctctgt

SEQ ID NO: 1961730 - DNA, 17 bp, Homo sapiens
ctctttctctctgtgtg

SEQ ID NO: 1961731 - DNA, 14 bp, Homo sapiens
ctctttctttccaa

SEQ ID NO: 1961732 - DNA, 14 bp, Homo sapiens
ctcttttgctctct

SEQ ID NO: 1961733 - DNA, 22 bp, Homo sapiens
ctcttttgctctctcattccca

SEQ ID NO: 1961734 - DNA, 23 bp, Homo sapiens
ctgaaattatgtcaaatggatgt

SEQ ID NO: 1961735 - DNA, 12 bp, Homo sapiens
ctgaagcagagt

SEQ ID NO: 1961736 - DNA, 14 bp, Homo sapiens
ctgaagcagagtca

SEQ ID NO: 1961737 - DNA, 17 bp, Homo sapiens
ctgaagtcccttcctgt

SEQ ID NO: 1961738 - DNA, 20 bp, Homo sapiens
ctgaagtcccttcctgtcct

SEQ ID NO: 1961739 - DNA, 14 bp, Homo sapiens
ctgaataacaacaa

SEQ ID NO: 1961740 - DNA, 22 bp, Homo sapiens
cccgtgcgcagccgcgctctgc

SEQ ID NO: 1961741 - DNA, 20 bp, Homo sapiens
cccgtgcggcccgtgcgcag

SEQ ID NO: 1961742 - DNA, 14 bp, Homo sapiens
ccctaccctcttct

SEQ ID NO: 1961743 - DNA, 17 bp, Homo sapiens
ccctaccctcttctcag

SEQ ID NO: 1961744 - DNA, 17 bp, Homo sapiens
ccctcccctctcctgag

SEQ ID NO: 1961745 - DNA, 17 bp, Homo sapiens
ccctccgtccccagggt

SEQ ID NO: 1961746 - DNA, 18 bp, Homo sapiens
ccctcctctgccccctcc

SEQ ID NO: 1961747 - DNA, 14 bp, Homo sapiens
ccctcggtcagcac

SEQ ID NO: 1961748 - DNA, 19 bp, Homo sapiens
ccctctcctgagcctgtct

SEQ ID NO: 1961749 - DNA, 20 bp, Homo sapiens
ccctctcctgagcctgtctc

SEQ ID NO: 1961750 - DNA, 11 bp, Homo sapiens
ccctcttcaat

SEQ ID NO: 1961751 - DNA, 18 bp, Homo sapiens
ccctcttctcagctccac

SEQ ID NO: 1961752 - DNA, 14 bp, Homo sapiens
ccctctttctctct

SEQ ID NO: 1961753 - DNA, 15 bp, Homo sapiens
ccctgacatgctaac

SEQ ID NO: 1961754 - DNA, 17 bp, Homo sapiens
ccctgacttcccagctg

SEQ ID NO: 1961755 - DNA, 12 bp, Homo sapiens
ccctgccctccc

SEQ ID NO: 1961756 - DNA, 12 bp, Homo sapiens
ccctgccctgca

SEQ ID NO: 1961757 - DNA, 13 bp, Homo sapiens
ccctgctggacca

SEQ ID NO: 1961758 - DNA, 14 bp, Homo sapiens
ccctggggtctctg

SEQ ID NO: 1961759 - DNA, 19 bp, Homo sapiens
ccctggggtctctgagcag

SEQ ID NO: 1961760 - DNA, 22 bp, Homo sapiens
ccctggggtctctgagcagtgg

SEQ ID NO: 1961761 - DNA, 22 bp, Homo sapiens
ccctgtgggagtccactttcct

SEQ ID NO: 1961762 - DNA, 16 bp, Homo sapiens
cccttcctgtcctgct

SEQ ID NO: 1961763 - DNA, 17 bp, Homo sapiens
cccttctacaaaagaag

SEQ ID NO: 1961764 - DNA, 14 bp, Homo sapiens
cccttgaccccaca

SEQ ID NO: 1961765 - DNA, 15 bp, Homo sapiens
cccttgaccccacac

SEQ ID NO: 1961766 - DNA, 17 bp, Homo sapiens
ccgagcgcgtgccttcc

SEQ ID NO: 1961767 - DNA, 19 bp, Homo sapiens
ccgagcgcgtgccttcccc

SEQ ID NO: 1961768 - DNA, 12 bp, Homo sapiens
ccgcagcaccag

SEQ ID NO: 1961769 - DNA, 20 bp, Homo sapiens
ccgcagcaccagcctgagcc

SEQ ID NO: 1961770 - DNA, 21 bp, Homo sapiens
ccgcagcaccagcctgagcca

SEQ ID NO: 1961771 - DNA, 20 bp, Homo sapiens
ccgcagggcgctccggcaga

SEQ ID NO: 1961772 - DNA, 16 bp, Homo sapiens
ccgcccaccccgctgc

SEQ ID NO: 1961773 - DNA, 14 bp, Homo sapiens
ccgccccagagact

SEQ ID NO: 1961774 - DNA, 14 bp, Homo sapiens
ccgcccccgccctc

SEQ ID NO: 1961775 - DNA, 15 bp, Homo sapiens
ccgcccgcccccgcc

SEQ ID NO: 1961776 - DNA, 11 bp, Homo sapiens
ccgcccgccct

SEQ ID NO: 1961777 - DNA, 11 bp, Homo sapiens
ccgccctcctc

SEQ ID NO: 1961778 - DNA, 17 bp, Homo sapiens
ccgccctcctctgcccc

SEQ ID NO: 1961779 - DNA, 15 bp, Homo sapiens
ccgccgcctcgggcc

SEQ ID NO: 1961780 - DNA, 16 bp, Homo sapiens
ccgccggttggccggc

SEQ ID NO: 1961781 - DNA, 22 bp, Homo sapiens
ccgccggttggccggctggccg

SEQ ID NO: 1961782 - DNA, 14 bp, Homo sapiens
ccgcctcctccaga

SEQ ID NO: 1961783 - DNA, 18 bp, Homo sapiens
ccgcctcgggccgcctcc

SEQ ID NO: 1961784 - DNA, 14 bp, Homo sapiens
ccgcgctctgcccc

SEQ ID NO: 1961785 - DNA, 15 bp, Homo sapiens
ccgcgctctgcccct

SEQ ID NO: 1961786 - DNA, 20 bp, Homo sapiens
ccgcgctctgcccctccgtc

SEQ ID NO: 1961787 - DNA, 19 bp, Homo sapiens
ccgctgcctggcgggcagc

SEQ ID NO: 1961788 - DNA, 12 bp, Homo sapiens
ccggagcaccac

SEQ ID NO: 1961789 - DNA, 20 bp, Homo sapiens
ccggagcggctgaggacggg

SEQ ID NO: 1961790 - DNA, 17 bp, Homo sapiens
ccggaggcgcccacctg

SEQ ID NO: 1961791 - DNA, 19 bp, Homo sapiens
ccggaggcgcccacctgcc

SEQ ID NO: 1961792 - DNA, 16 bp, Homo sapiens
ccggcagaggcagggc

SEQ ID NO: 1961793 - DNA, 17 bp, Homo sapiens
ccggcagaggcagggcc

SEQ ID NO: 1961794 - DNA, 17 bp, Homo sapiens
ccggccaaggacactga

SEQ ID NO: 1961795 - DNA, 20 bp, Homo sapiens
ccggcccccctctcgggctc

SEQ ID NO: 1961796 - DNA, 16 bp, Homo sapiens
ccggctggccggtcca

SEQ ID NO: 1961797 - DNA, 14 bp, Homo sapiens
ccggggctggccct

SEQ ID NO: 1961798 - DNA, 15 bp, Homo sapiens
ccggggctggccctg

SEQ ID NO: 1961799 - DNA, 19 bp, Homo sapiens
ccgggtgcgtgaccggccc

SEQ ID NO: 1961800 - DNA, 13 bp, Homo sapiens
ccgtccccagggt

SEQ ID NO: 1961801 - DNA, 15 bp, Homo sapiens
ccgtcccggccccgc

SEQ ID NO: 1961802 - DNA, 22 bp, Homo sapiens
ccgtccctgacttcccagctgg

SEQ ID NO: 1961803 - DNA, 21 bp, Homo sapiens
ccgtctttggttcctcatggc

SEQ ID NO: 1961804 - DNA, 19 bp, Homo sapiens
ccgtgcgcagccgcgctct

SEQ ID NO: 1961805 - DNA, 14 bp, Homo sapiens
ccgtgcggcccgtg

SEQ ID NO: 1961806 - DNA, 13 bp, Homo sapiens
cctaaatgcaaag

SEQ ID NO: 1961807 - DNA, 14 bp, Homo sapiens
cctaaatgcaaagc

SEQ ID NO: 1961808 - DNA, 13 bp, Homo sapiens
cctacaaagaaaa

SEQ ID NO: 1961809 - DNA, 15 bp, Homo sapiens
cctaccctcttctca

SEQ ID NO: 1961810 - DNA, 18 bp, Homo sapiens
cctacttaaacaaaaact

SEQ ID NO: 1961811 - DNA, 21 bp, Homo sapiens
cctagcactttgggaggctga

SEQ ID NO: 1961812 - DNA, 21 bp, Homo sapiens
cctagtgctacagatgtacat

SEQ ID NO: 1961813 - DNA, 24 bp, Homo sapiens
cctattgctgtaaataaaaatagc

SEQ ID NO: 1961814 - DNA, 13 bp, Homo sapiens
cctcatggctgtt

SEQ ID NO: 1961815 - DNA, 16 bp, Homo sapiens
ctgaataatgaagatt

SEQ ID NO: 1961816 - DNA, 19 bp, Homo sapiens
ctgaataatgaagattaac

SEQ ID NO: 1961817 - DNA, 16 bp, Homo sapiens
ctgaatcagaggcaga

SEQ ID NO: 1961818 - DNA, 17 bp, Homo sapiens
ctgaatctctcaaaatg

SEQ ID NO: 1961819 - DNA, 22 bp, Homo sapiens
ctgaccttctgcggctccgggc

SEQ ID NO: 1961820 - DNA, 13 bp, Homo sapiens
ctgacttcccagc

SEQ ID NO: 1961821 - DNA, 16 bp, Homo sapiens
ctgacttcccagctgg

SEQ ID NO: 1961822 - DNA, 18 bp, Homo sapiens
ctgacttcccagctggca

SEQ ID NO: 1961823 - DNA, 12 bp, Homo sapiens
ctgagcctgtct

SEQ ID NO: 1961824 - DNA, 14 bp, Homo sapiens
ctgagctccaccct

SEQ ID NO: 1961825 - DNA, 16 bp, Homo sapiens
ctgagctccaccctcc

SEQ ID NO: 1961826 - DNA, 17 bp, Homo sapiens
ctgagctccaccctccc

SEQ ID NO: 1961827 - DNA, 19 bp, Homo sapiens
ctgagctccaccctcccct

SEQ ID NO: 1961828 - DNA, 13 bp, Homo sapiens
ctgagctggccta

SEQ ID NO: 1961829 - DNA, 20 bp, Homo sapiens
ctgaggacggggcagagctg

SEQ ID NO: 1961830 - DNA, 16 bp, Homo sapiens
ctgagggaagcccacc

SEQ ID NO: 1961831 - DNA, 18 bp, Homo sapiens
ctgagggaagcccacccg

SEQ ID NO: 1961832 - DNA, 22 bp, Homo sapiens
ctgagggaagcccacccgcccc

SEQ ID NO: 1961833 - DNA, 16 bp, Homo sapiens
ctgagtcggctgggca

SEQ ID NO: 1961834 - DNA, 18 bp, Homo sapiens
ctgagtcggctgggcagg

SEQ ID NO: 1961835 - DNA, 21 bp, Homo sapiens
ctgagtcggctgggcagggcc

SEQ ID NO: 1961836 - DNA, 14 bp, Homo sapiens
ctgagttgtgcctc

SEQ ID NO: 1961837 - DNA, 17 bp, Homo sapiens
ctgataaagaaaccttt

SEQ ID NO: 1961838 - DNA, 15 bp, Homo sapiens
ctgatatcacgggcc

SEQ ID NO: 1961839 - DNA, 20 bp, Homo sapiens
ctgatatcacgggcccgctc

SEQ ID NO: 1961840 - DNA, 13 bp, Homo sapiens
ctgatgagacaac

SEQ ID NO: 1961841 - DNA, 18 bp, Homo sapiens
ctgatgagacaacacaca

SEQ ID NO: 1961842 - DNA, 21 bp, Homo sapiens
ctgatgatgttctgaaatgga

SEQ ID NO: 1961843 - DNA, 14 bp, Homo sapiens
ctgatgggtcctgc

SEQ ID NO: 1961844 - DNA, 16 bp, Homo sapiens
ctgatgggtcctgctg

SEQ ID NO: 1961845 - DNA, 14 bp, Homo sapiens
ctgcacacataaca

SEQ ID NO: 1961846 - DNA, 19 bp, Homo sapiens
ctgcacacataacacacat

SEQ ID NO: 1961847 - DNA, 11 bp, Homo sapiens
ctgcaccttgg

SEQ ID NO: 1961848 - DNA, 14 bp, Homo sapiens
ctgcaccttgggca

SEQ ID NO: 1961849 - DNA, 23 bp, Homo sapiens
ctgcagcccagaacgggcctccc

SEQ ID NO: 1961850 - DNA, 13 bp, Homo sapiens
ctgcagcctgagc

SEQ ID NO: 1961851 - DNA, 20 bp, Homo sapiens
cttcttgcggcaccgcccac

SEQ ID NO: 1961852 - DNA, 21 bp, Homo sapiens
cttcttgcggcaccgcccacc

SEQ ID NO: 1961853 - DNA, 13 bp, Homo sapiens
cttcttttagtca

SEQ ID NO: 1961854 - DNA, 18 bp, Homo sapiens
cttcttttagtcagaaat

SEQ ID NO: 1961855 - DNA, 22 bp, Homo sapiens
cttgaagaactgacttcctgaa

SEQ ID NO: 1961856 - DNA, 16 bp, Homo sapiens
cttgagcagctgaatt

SEQ ID NO: 1961857 - DNA, 20 bp, Homo sapiens
cttgaggccaaatgagttcc

SEQ ID NO: 1961858 - DNA, 14 bp, Homo sapiens
cttgagtttcattt

SEQ ID NO: 1961859 - DNA, 19 bp, Homo sapiens
cttgagtttcatttttcat

SEQ ID NO: 1961860 - DNA, 16 bp, Homo sapiens
cttgattttaattcag

SEQ ID NO: 1961861 - DNA, 14 bp, Homo sapiens
cttgcactgtatcc

SEQ ID NO: 1961862 - DNA, 20 bp, Homo sapiens
cttgcattttagctaattta

SEQ ID NO: 1961863 - DNA, 19 bp, Homo sapiens
cttgcggcaccgcccaccc

SEQ ID NO: 1961864 - DNA, 13 bp, Homo sapiens
cttgctgtgaaac

SEQ ID NO: 1961865 - DNA, 18 bp, Homo sapiens
cttgctgtgaaatgactg

SEQ ID NO: 1961866 - DNA, 16 bp, Homo sapiens
cttggagcagagacgg

SEQ ID NO: 1961867 - DNA, 22 bp, Homo sapiens
cttggagcagagacggcagccc

SEQ ID NO: 1961868 - DNA, 11 bp, Homo sapiens
cttggtctctt

SEQ ID NO: 1961869 - DNA, 18 bp, Homo sapiens
cttggtctctttctttcc

SEQ ID NO: 1961870 - DNA, 21 bp, Homo sapiens
cttggtctctttctttccaaa

SEQ ID NO: 1961871 - DNA, 22 bp, Homo sapiens
cttggtctctttctttccaaag

SEQ ID NO: 1961872 - DNA, 19 bp, Homo sapiens
cttggtgcctaatgttcca

SEQ ID NO: 1961873 - DNA, 15 bp, Homo sapiens
cttgtaaaactgtga

SEQ ID NO: 1961874 - DNA, 20 bp, Homo sapiens
cttgtaaaactgtgacattc

SEQ ID NO: 1961875 - DNA, 22 bp, Homo sapiens
cttgtaaaactgtgacattcca

SEQ ID NO: 1961876 - DNA, 14 bp, Homo sapiens
ctttatgatttcat

SEQ ID NO: 1961877 - DNA, 17 bp, Homo sapiens
ctttcaatccacagtat

SEQ ID NO: 1961878 - DNA, 23 bp, Homo sapiens
ctttcaatccacagtattgttct

SEQ ID NO: 1961879 - DNA, 13 bp, Homo sapiens
ctttcagaatgtt

SEQ ID NO: 1961880 - DNA, 15 bp, Homo sapiens
ctttcctgaaattct

SEQ ID NO: 1961881 - DNA, 13 bp, Homo sapiens
ctttctctctgtg

SEQ ID NO: 1961882 - DNA, 18 bp, Homo sapiens
ctttctctctgtgtggca

SEQ ID NO: 1961883 - DNA, 14 bp, Homo sapiens
ctttctgcagaaaa

SEQ ID NO: 1961884 - DNA, 12 bp, Homo sapiens
ctttctttccaa

SEQ ID NO: 1961885 - DNA, 15 bp, Homo sapiens
ctttctttccaaagg

SEQ ID NO: 1961886 - DNA, 19 bp, Homo sapiens
ctttctttccaaaggttgt

SEQ ID NO: 1961887 - DNA, 19 bp, Homo sapiens
ctttgaacattaatgttga

SEQ ID NO: 1961888 - DNA, 17 bp, Homo sapiens
ctttgagtgtcaggctc

SEQ ID NO: 1961889 - DNA, 13 bp, Homo sapiens
ctttgctgctttg

SEQ ID NO: 1961890 - DNA, 16 bp, Homo sapiens
ctttggcttaattcca

SEQ ID NO: 1961891 - DNA, 13 bp, Homo sapiens
ctttgggaggctg

SEQ ID NO: 1961892 - DNA, 14 bp, Homo sapiens
ctttgggaggctga

SEQ ID NO: 1961893 - DNA, 22 bp, Homo sapiens
ctttgtgtcttttgttctctct

SEQ ID NO: 1961894 - DNA, 12 bp, Homo sapiens
cttttaaaaaaa

SEQ ID NO: 1961895 - DNA, 12 bp, Homo sapiens
cttttagtcaga

SEQ ID NO: 1961896 - DNA, 20 bp, Homo sapiens
cttttcatggagtagagtca

SEQ ID NO: 1961897 - DNA, 14 bp, Homo sapiens
cttttctcatggta

SEQ ID NO: 1961898 - DNA, 17 bp, Homo sapiens
cttttgatggctatgtt

SEQ ID NO: 1961899 - DNA, 22 bp, Homo sapiens
cttttggtttgtgggtccagga

SEQ ID NO: 1961900 - DNA, 12 bp, Homo sapiens
cttttgttctct

SEQ ID NO: 1961901 - DNA, 14 bp, Homo sapiens
cttttgttctctct

SEQ ID NO: 1961902 - DNA, 16 bp, Homo sapiens
cttttgttctctcttg

SEQ ID NO: 1961903 - DNA, 17 bp, Homo sapiens
cttttgttctctcttgg

SEQ ID NO: 1961904 - DNA, 16 bp, Homo sapiens
cttttgtttacaacac

SEQ ID NO: 1961905 - DNA, 14 bp, Homo sapiens
ctttttaacattct

SEQ ID NO: 1961906 - DNA, 22 bp, Homo sapiens
cttttttcctgtcaatatatag

SEQ ID NO: 1961907 - DNA, 11 bp, Homo sapiens
gaaaaaagaag

SEQ ID NO: 1961908 - DNA, 16 bp, Homo sapiens
gaaaaagccctcttca

SEQ ID NO: 1961909 - DNA, 13 bp, Homo sapiens
gaaaatacattat

SEQ ID NO: 1961910 - DNA, 20 bp, Homo sapiens
gaaaatacattattagaata

SEQ ID NO: 1961911 - DNA, 21 bp, Homo sapiens
gaaaatacattattagaatat

SEQ ID NO: 1961912 - DNA, 17 bp, Homo sapiens
gaaacccctgacacctt

SEQ ID NO: 1961913 - DNA, 15 bp, Homo sapiens
gaaaccttagtacct

SEQ ID NO: 1961914 - DNA, 17 bp, Homo sapiens
gaaaccttttaaaaaaa

SEQ ID NO: 1961915 - DNA, 16 bp, Homo sapiens
gaaactgacttgctgt

SEQ ID NO: 1961916 - DNA, 11 bp, Homo sapiens
gaaagaggaat

SEQ ID NO: 1961917 - DNA, 22 bp, Homo sapiens
gaaagaggaataaaatgattaa

SEQ ID NO: 1961918 - DNA, 14 bp, Homo sapiens
gaaagatcccaagt

SEQ ID NO: 1961919 - DNA, 14 bp, Homo sapiens
gaaagcaaaacatt

SEQ ID NO: 1961920 - DNA, 21 bp, Homo sapiens
gaaaggaagatgtaagaagct

SEQ ID NO: 1961921 - DNA, 13 bp, Homo sapiens
gaaaggagggaaa

SEQ ID NO: 1961922 - DNA, 13 bp, Homo sapiens
gaaagtaatttca

SEQ ID NO: 1961923 - DNA, 21 bp, Homo sapiens
gaaagtaatttcaagaatgtt

SEQ ID NO: 1961924 - DNA, 10 bp, Homo sapiens
gaaagttcca

SEQ ID NO: 1961925 - DNA, 17 bp, Homo sapiens
gaaagttccagcagttt

SEQ ID NO: 1961926 - DNA, 16 bp, Homo sapiens
gaaatataaaaataat

SEQ ID NO: 1961927 - DNA, 14 bp, Homo sapiens
gaaatataaactgt

SEQ ID NO: 1961928 - DNA, 19 bp, Homo sapiens
gaaatatccctcatttcat

SEQ ID NO: 1961929 - DNA, 21 bp, Homo sapiens
gaaatatccctcatttcatta

SEQ ID NO: 1961930 - DNA, 12 bp, Homo sapiens
gagtcggctggg

SEQ ID NO: 1961931 - DNA, 12 bp, Homo sapiens
gagttgtgcctc

SEQ ID NO: 1961932 - DNA, 19 bp, Homo sapiens
gataaatatcattatagca

SEQ ID NO: 1961933 - DNA, 19 bp, Homo sapiens
gataactcaccatcttgaa

SEQ ID NO: 1961934 - DNA, 14 bp, Homo sapiens
gataattaaatgaa

SEQ ID NO: 1961935 - DNA, 18 bp, Homo sapiens
gataattaaatgaaatac

SEQ ID NO: 1961936 - DNA, 20 bp, Homo sapiens
gatattcctacaaagaaaaa

SEQ ID NO: 1961937 - DNA, 20 bp, Homo sapiens
gatcattggtatctgatatc

SEQ ID NO: 1961938 - DNA, 18 bp, Homo sapiens
gatccctcggtcagcacc

SEQ ID NO: 1961939 - DNA, 19 bp, Homo sapiens
gatccctcggtcagcaccg

SEQ ID NO: 1961940 - DNA, 21 bp, Homo sapiens
gatcctctcttcttttcccat

SEQ ID NO: 1961941 - DNA, 23 bp, Homo sapiens
gatctggtgcgtgtggccctgtg

SEQ ID NO: 1961942 - DNA, 12 bp, Homo sapiens
gatctgtccttc

SEQ ID NO: 1961943 - DNA, 17 bp, Homo sapiens
gatgagacaacacacac

SEQ ID NO: 1961944 - DNA, 15 bp, Homo sapiens
gatgatgttctgaaa

SEQ ID NO: 1961945 - DNA, 22 bp, Homo sapiens
gatgattcaatcattttgggaa

SEQ ID NO: 1961946 - DNA, 18 bp, Homo sapiens
gatggatttgacacactc

SEQ ID NO: 1961947 - DNA, 19 bp, Homo sapiens
gatggatttgacacactca

SEQ ID NO: 1961948 - DNA, 16 bp, Homo sapiens
gatggcccattaagag

SEQ ID NO: 1961949 - DNA, 16 bp, Homo sapiens
gatgggtcctgctgct

SEQ ID NO: 1961950 - DNA, 18 bp, Homo sapiens
gatgtacattaaatacca

SEQ ID NO: 1961951 - DNA, 18 bp, Homo sapiens
gatgtcacagtttgttca

SEQ ID NO: 1961952 - DNA, 22 bp, Homo sapiens
gatgtccaaacttaacagatca

SEQ ID NO: 1961953 - DNA, 19 bp, Homo sapiens
gatgtggatggaggtgatg

SEQ ID NO: 1961954 - DNA, 14 bp, Homo sapiens
gccccctcccccgc

SEQ ID NO: 1961955 - DNA, 14 bp, Homo sapiens
gccccgcgcgtgcc

SEQ ID NO: 1961956 - DNA, 19 bp, Homo sapiens
gccccgcgcgtgcccccag

SEQ ID NO: 1961957 - DNA, 20 bp, Homo sapiens
gccccgcgcgtgcccccagc

SEQ ID NO: 1961958 - DNA, 13 bp, Homo sapiens
gccccggagcacc

SEQ ID NO: 1961959 - DNA, 14 bp, Homo sapiens
gccccggagcacca

SEQ ID NO: 1961960 - DNA, 19 bp, Homo sapiens
gcccctccgtccccagggt

SEQ ID NO: 1961961 - DNA, 12 bp, Homo sapiens
gcccctcctcgg

SEQ ID NO: 1961962 - DNA, 19 bp, Homo sapiens
gcccctcctcgggcgcctg

SEQ ID NO: 1961963 - DNA, 22 bp, Homo sapiens
gcccctcctcgggcgcctgcgc

SEQ ID NO: 1961964 - DNA, 17 bp, Homo sapiens
gcccctgctggaccaag

SEQ ID NO: 1961965 - DNA, 12 bp, Homo sapiens
gcccgcccaccc

SEQ ID NO: 1961966 - DNA, 13 bp, Homo sapiens
gcccgcccacccc

SEQ ID NO: 1961967 - DNA, 15 bp, Homo sapiens
gcccgcccaccccgc

SEQ ID NO: 1961968 - DNA, 21 bp, Homo sapiens
gcccgcccaccccgctgcctg

SEQ ID NO: 1961969 - DNA, 16 bp, Homo sapiens
gcccgcccccgccctc

SEQ ID NO: 1961970 - DNA, 17 bp, Homo sapiens
gcccgccctcctctgcc

SEQ ID NO: 1961971 - DNA, 15 bp, Homo sapiens
gcccgctcaacctct

SEQ ID NO: 1961972 - DNA, 16 bp, Homo sapiens
gcccggcccacgcaga

SEQ ID NO: 1961973 - DNA, 18 bp, Homo sapiens
gcccggcccacgcagagc

SEQ ID NO: 1961974 - DNA, 23 bp, Homo sapiens
gcccggcccacgcagagccccgg

SEQ ID NO: 1961975 - DNA, 14 bp, Homo sapiens
gccctcccccacgg

SEQ ID NO: 1961976 - DNA, 15 bp, Homo sapiens
gccctcccccacggc

SEQ ID NO: 1961977 - DNA, 13 bp, Homo sapiens
gccctcctctgcc

SEQ ID NO: 1961978 - DNA, 14 bp, Homo sapiens
gccctcctctgccc

SEQ ID NO: 1961979 - DNA, 21 bp, Homo sapiens
gccctcctctgccccctcccc

SEQ ID NO: 1961980 - DNA, 11 bp, Homo sapiens
gccctcttcaa

SEQ ID NO: 1961981 - DNA, 15 bp, Homo sapiens
gccctcttcaatccc

SEQ ID NO: 1961982 - DNA, 13 bp, Homo sapiens
gccctctttctct

SEQ ID NO: 1961983 - DNA, 16 bp, Homo sapiens
gccctctttctctctg

SEQ ID NO: 1961984 - DNA, 14 bp, Homo sapiens
gccctgccctcccc

SEQ ID NO: 1961985 - DNA, 19 bp, Homo sapiens
gccctgccctcccccacgg

SEQ ID NO: 1961986 - DNA, 12 bp, Homo sapiens
gccctggggtct

SEQ ID NO: 1961987 - DNA, 18 bp, Homo sapiens
gccctggggtctctgagc

SEQ ID NO: 1961988 - DNA, 16 bp, Homo sapiens
gccctgtgggagtcca

SEQ ID NO: 1961989 - DNA, 23 bp, Homo sapiens
gccgcagggcgctccggcagagg

SEQ ID NO: 1961990 - DNA, 13 bp, Homo sapiens
gccgcctcgggcc

SEQ ID NO: 1961991 - DNA, 24 bp, Homo sapiens
gccgcctcgggccgcctcctccag

SEQ ID NO: 1961992 - DNA, 15 bp, Homo sapiens
gccgcgctctgcccc

SEQ ID NO: 1961993 - DNA, 17 bp, Homo sapiens
gccgcgctctgcccctc

SEQ ID NO: 1961994 - DNA, 18 bp, Homo sapiens
gccgcgctctgcccctcc

SEQ ID NO: 1961995 - DNA, 12 bp, Homo sapiens
gccggctggccg

SEQ ID NO: 1961996 - DNA, 16 bp, Homo sapiens
gccggctggccggtcc

SEQ ID NO: 1961997 - DNA, 13 bp, Homo sapiens
gccggggctggcc

SEQ ID NO: 1961998 - DNA, 15 bp, Homo sapiens
gccggggctggccct

SEQ ID NO: 1961999 - DNA, 13 bp, Homo sapiens
gccggtccacccc

SEQ ID NO: 1962000 - DNA, 18 bp, Homo sapiens
gccggtccaccccgtccc

SEQ ID NO: 1962001 - DNA, 23 bp, Homo sapiens
gccggtccaccccgtcccggccc

SEQ ID NO: 1962002 - DNA, 20 bp, Homo sapiens
gccggttggccggctggccg

SEQ ID NO: 1962003 - DNA, 19 bp, Homo sapiens
gccgtccctgacttcccag

SEQ ID NO: 1962004 - DNA, 21 bp, Homo sapiens
gccgtctttggttcctcatgg

SEQ ID NO: 1962005 - DNA, 16 bp, Homo sapiens
gcctatcctaagagct

SEQ ID NO: 1962006 - DNA, 15 bp, Homo sapiens
gcctcccgccgcctc

SEQ ID NO: 1962007 - DNA, 16 bp, Homo sapiens
gcctcctccagactcg

SEQ ID NO: 1962008 - DNA, 15 bp, Homo sapiens
gcctcgggccgcctc

SEQ ID NO: 1962009 - DNA, 13 bp, Homo sapiens
gcctcttaaaaat

SEQ ID NO: 1962010 - DNA, 22 bp, Homo sapiens
gcctcttaaaaattatctttaa

SEQ ID NO: 1962011 - DNA, 18 bp, Homo sapiens
gcctgaaagtaatttcaa

SEQ ID NO: 1962012 - DNA, 13 bp, Homo sapiens
gcctgagccacag

SEQ ID NO: 1962013 - DNA, 22 bp, Homo sapiens
gcctgagccacagtggggccca

SEQ ID NO: 1962014 - DNA, 17 bp, Homo sapiens
gcctgagctccaccctc

SEQ ID NO: 1962015 - DNA, 19 bp, Homo sapiens
gcctgagctccaccctccc

SEQ ID NO: 1962016 - DNA, 21 bp, Homo sapiens
gcctgagctccaccctcccct

SEQ ID NO: 1962017 - DNA, 22 bp, Homo sapiens
gcctgagctccaccctcccctc

SEQ ID NO: 1962018 - DNA, 23 bp, Homo sapiens
gcctgagctccaccctcccctct

SEQ ID NO: 1962019 - DNA, 15 bp, Homo sapiens
gcctgcagcccagaa

SEQ ID NO: 1962020 - DNA, 16 bp, Homo sapiens
gcctgcagcccagaac

SEQ ID NO: 1962021 - DNA, 13 bp, Homo sapiens
gcctgcccgcccg

SEQ ID NO: 1962022 - DNA, 17 bp, Homo sapiens
gcctgcccgcccgccgg

SEQ ID NO: 1962023 - DNA, 17 bp, Homo sapiens
gcctgcgctcctctgca

SEQ ID NO: 1962024 - DNA, 15 bp, Homo sapiens
gcctggcgggcagcc

SEQ ID NO: 1962025 - DNA, 17 bp, Homo sapiens
gcctggcgggcagcccc

SEQ ID NO: 1962026 - DNA, 21 bp, Homo sapiens
gcctggcgggcagcccctgct

SEQ ID NO: 1962027 - DNA, 23 bp, Homo sapiens
gccttgtctgtgtatttctattt

SEQ ID NO: 1962028 - DNA, 22 bp, Homo sapiens
gcgatgtgttctttgtacctgt

SEQ ID NO: 1962029 - DNA, 22 bp, Homo sapiens
gcgcaccgcccaacccccacct

SEQ ID NO: 1962030 - DNA, 19 bp, Homo sapiens
gcgcagccgcgctctgccc

SEQ ID NO: 1962031 - DNA, 23 bp, Homo sapiens
gcgcagccgcgctctgcccctcc

SEQ ID NO: 1962032 - DNA, 12 bp, Homo sapiens
gcgccacccgcc

SEQ ID NO: 1962033 - DNA, 13 bp, Homo sapiens
gcgcccacctgcc

SEQ ID NO: 1962034 - DNA, 16 bp, Homo sapiens
gcgcctcccgccgcct

SEQ ID NO: 1962035 - DNA, 18 bp, Homo sapiens
gcgcctgcgctcctctgc

SEQ ID NO: 1962036 - DNA, 20 bp, Homo sapiens
gcgcctgcgctcctctgcag

SEQ ID NO: 1962037 - DNA, 14 bp, Homo sapiens
gcgcgcaccgccca

SEQ ID NO: 1962038 - DNA, 15 bp, Homo sapiens
gcgcgtgcccccagc

SEQ ID NO: 1962039 - DNA, 16 bp, Homo sapiens
gcgctccggcagaggc

SEQ ID NO: 1962040 - DNA, 12 bp, Homo sapiens
gcgctcctctgc

SEQ ID NO: 1962041 - DNA, 14 bp, Homo sapiens
gcgctcctctgcag

SEQ ID NO: 1962042 - DNA, 15 bp, Homo sapiens
gcgctctgcccctcc

SEQ ID NO: 1962043 - DNA, 18 bp, Homo sapiens
gcggaccggagcggctga

SEQ ID NO: 1962044 - DNA, 20 bp, Homo sapiens
gcggaggggcttggagcaga

SEQ ID NO: 1962045 - DNA, 21 bp, Homo sapiens
gcggaggggcttggagcagag

SEQ ID NO: 1962046 - DNA, 18 bp, Homo sapiens
gcggcaccgcccacccac

SEQ ID NO: 1962047 - DNA, 22 bp, Homo sapiens
gcggcccggcccacgcagagcc

SEQ ID NO: 1962048 - DNA, 23 bp, Homo sapiens
gcggcccggcccacgcagagccc

SEQ ID NO: 1962049 - DNA, 22 bp, Homo sapiens
gcggctgaggacggggcagagc

SEQ ID NO: 1962050 - DNA, 23 bp, Homo sapiens
gcggctgaggacggggcagagct

SEQ ID NO: 1962051 - DNA, 18 bp, Homo sapiens
gcgggcagcccctgctgg

SEQ ID NO: 1962052 - DNA, 22 bp, Homo sapiens
gcgggcagcccctgctggacca

SEQ ID NO: 1962053 - DNA, 17 bp, Homo sapiens
gcgggggctaactggcc

SEQ ID NO: 1962054 - DNA, 20 bp, Homo sapiens
gcgggggctaactggcccca

SEQ ID NO: 1962055 - DNA, 22 bp, Homo sapiens
gcgggggctaactggccccagg

SEQ ID NO: 1962056 - DNA, 23 bp, Homo sapiens
gcgggggctaactggccccaggc

SEQ ID NO: 1962057 - DNA, 12 bp, Homo sapiens
gcgtaggagaga

SEQ ID NO: 1962058 - DNA, 16 bp, Homo sapiens
gcgtgtggccctgtgg

SEQ ID NO: 1962059 - DNA, 21 bp, Homo sapiens
gcgtgtggccctgtgggagtc

SEQ ID NO: 1962060 - DNA, 17 bp, Homo sapiens
gcgttatctcttcctta

SEQ ID NO: 1962061 - DNA, 20 bp, Homo sapiens
gctacagatgtacattaaat

SEQ ID NO: 1962062 - DNA, 17 bp, Homo sapiens
gctacaggggaggctga

SEQ ID NO: 1962063 - DNA, 14 bp, Homo sapiens
ggcacactgagcaa

SEQ ID NO: 1962064 - DNA, 15 bp, Homo sapiens
ggcaccgcccaccca

SEQ ID NO: 1962065 - DNA, 21 bp, Homo sapiens
ggcaccgcccacccacacccc

SEQ ID NO: 1962066 - DNA, 22 bp, Homo sapiens
ggcaccgcccacccacaccccg

SEQ ID NO: 1962067 - DNA, 15 bp, Homo sapiens
ggcacgggagagcgc

SEQ ID NO: 1962068 - DNA, 16 bp, Homo sapiens
ggcacgggagagcgcc

SEQ ID NO: 1962069 - DNA, 18 bp, Homo sapiens
ggcacgggagagcgccac

SEQ ID NO: 1962070 - DNA, 14 bp, Homo sapiens
ggcagaggcagggc

SEQ ID NO: 1962071 - DNA, 15 bp, Homo sapiens
ggcagccccatcctt

SEQ ID NO: 1962072 - DNA, 21 bp, Homo sapiens
ggcagccccatccttcccgca

SEQ ID NO: 1962073 - DNA, 21 bp, Homo sapiens
ggcagcccctgctggaccaag

SEQ ID NO: 1962074 - DNA, 21 bp, Homo sapiens
ggcagcgcctcccgccgcctc

SEQ ID NO: 1962075 - DNA, 11 bp, Homo sapiens
ggcagggccct

SEQ ID NO: 1962076 - DNA, 15 bp, Homo sapiens
ggcatccacttcaca

SEQ ID NO: 1962077 - DNA, 21 bp, Homo sapiens
ggcatttgctgaataacaaca

SEQ ID NO: 1962078 - DNA, 12 bp, Homo sapiens
ggccaaggacac

SEQ ID NO: 1962079 - DNA, 20 bp, Homo sapiens
ggccaaggacactgatgggt

SEQ ID NO: 1962080 - DNA, 21 bp, Homo sapiens
ggcccacgcagagccccggag

SEQ ID NO: 1962081 - DNA, 22 bp, Homo sapiens
ggcccacgcagagccccggagc

SEQ ID NO: 1962082 - DNA, 16 bp, Homo sapiens
ggcccatggccccagc

SEQ ID NO: 1962083 - DNA, 20 bp, Homo sapiens
ggcccatggccccagctggc

SEQ ID NO: 1962084 - DNA, 13 bp, Homo sapiens
ggccccagctggc

SEQ ID NO: 1962085 - DNA, 16 bp, Homo sapiens
ggccccagctggctgg

SEQ ID NO: 1962086 - DNA, 18 bp, Homo sapiens
ggccccagctggctgggt

SEQ ID NO: 1962087 - DNA, 19 bp, Homo sapiens
ggccccagctggctgggtc

SEQ ID NO: 1962088 - DNA, 14 bp, Homo sapiens
ggccccgcgcgtgc

SEQ ID NO: 1962089 - DNA, 19 bp, Homo sapiens
ggccccgcgcgtgccccca

SEQ ID NO: 1962090 - DNA, 20 bp, Homo sapiens
ggccccgcgcgtgcccccag

SEQ ID NO: 1962091 - DNA, 22 bp, Homo sapiens
ggccccgcgcgtgcccccagcg

SEQ ID NO: 1962092 - DNA, 21 bp, Homo sapiens
ggcccgagcgcgtgccttccc

SEQ ID NO: 1962093 - DNA, 13 bp, Homo sapiens
ggcccggcccacg

SEQ ID NO: 1962094 - DNA, 15 bp, Homo sapiens
ggcccggcccacgca

SEQ ID NO: 1962095 - DNA, 22 bp, Homo sapiens
ggcccggcccacgcagagcccc

SEQ ID NO: 1962096 - DNA, 14 bp, Homo sapiens
ggcccgtgcgcagc

SEQ ID NO: 1962097 - DNA, 15 bp, Homo sapiens
ggcccgtgcgcagcc

SEQ ID NO: 1962098 - DNA, 17 bp, Homo sapiens
ggcccgtgcgcagccgc

SEQ ID NO: 1962099 - DNA, 13 bp, Homo sapiens
ggccctgccctcc

SEQ ID NO: 1962100 - DNA, 17 bp, Homo sapiens
ggccctggggtctctga

SEQ ID NO: 1962101 - DNA, 19 bp, Homo sapiens
ggccctggggtctctgagc

SEQ ID NO: 1962102 - DNA, 13 bp, Homo sapiens
ggccgaggcctgc

SEQ ID NO: 1962103 - DNA, 14 bp, Homo sapiens
ggccgcagggcgct

SEQ ID NO: 1962104 - DNA, 18 bp, Homo sapiens
ggccgcagggcgctccgg

SEQ ID NO: 1962105 - DNA, 14 bp, Homo sapiens
ggccgcctcctcca

SEQ ID NO: 1962106 - DNA, 19 bp, Homo sapiens
ggccgcctcctccagactc

SEQ ID NO: 1962107 - DNA, 12 bp, Homo sapiens
ggccggctggcc

SEQ ID NO: 1962108 - DNA, 22 bp, Homo sapiens
ggccggctggccggtccacccc

SEQ ID NO: 1962109 - DNA, 22 bp, Homo sapiens
ggcctccccgggggtccccgga

SEQ ID NO: 1962110 - DNA, 22 bp, Homo sapiens
ggcctgagggaagcccacccgc

SEQ ID NO: 1962111 - DNA, 23 bp, Homo sapiens
ggcctgagggaagcccacccgcc

SEQ ID NO: 1962112 - DNA, 13 bp, Homo sapiens
ggcctgcagccca

SEQ ID NO: 1962113 - DNA, 23 bp, Homo sapiens
ggcctgggggctgttagctcaga

SEQ ID NO: 1962114 - DNA, 16 bp, Homo sapiens
ggcgcccacctgccca

SEQ ID NO: 1962115 - DNA, 24 bp, Homo sapiens
ggcgcctgcgctcctctgcagcct

SEQ ID NO: 1962116 - DNA, 13 bp, Homo sapiens
ggcgcgcaccgcc

SEQ ID NO: 1962117 - DNA, 20 bp, Homo sapiens
ggcgcgcaccgcccaacccc

SEQ ID NO: 1962118 - DNA, 20 bp, Homo sapiens
ggcgctccggcagaggcagg

SEQ ID NO: 1962119 - DNA, 21 bp, Homo sapiens
ggcgctccggcagaggcaggg

SEQ ID NO: 1962120 - DNA, 15 bp, Homo sapiens
ggcggaggggcttgg

SEQ ID NO: 1962121 - DNA, 19 bp, Homo sapiens
ggcggaggggcttggagca

SEQ ID NO: 1962122 - DNA, 11 bp, Homo sapiens
ggcgggcagcc

SEQ ID NO: 1962123 - DNA, 16 bp, Homo sapiens
ggcgggcagcccctgc

SEQ ID NO: 1962124 - DNA, 23 bp, Homo sapiens
ggcgggcagcccctgctggacca

SEQ ID NO: 1962125 - DNA, 16 bp, Homo sapiens
ggctaactggccccag

SEQ ID NO: 1962126 - DNA, 17 bp, Homo sapiens
ggctacaattactttga

SEQ ID NO: 1962127 - DNA, 13 bp, Homo sapiens
ggctctaatttcc

SEQ ID NO: 1962128 - DNA, 19 bp, Homo sapiens
ggctctctcacccagcctg

SEQ ID NO: 1962129 - DNA, 20 bp, Homo sapiens
ggctctctcacccagcctgg

SEQ ID NO: 1962130 - DNA, 13 bp, Homo sapiens
ggctgaaattatg

SEQ ID NO: 1962131 - DNA, 14 bp, Homo sapiens
ggctgaaattatgt

SEQ ID NO: 1962132 - DNA, 14 bp, Homo sapiens
ggctgcagtgagcc

SEQ ID NO: 1962133 - DNA, 15 bp, Homo sapiens
ggctgcgcctgcccg

SEQ ID NO: 1962134 - DNA, 17 bp, Homo sapiens
ggctgcgcctgcccgcc

SEQ ID NO: 1962135 - DNA, 11 bp, Homo sapiens
ggctggccctg

SEQ ID NO: 1962136 - DNA, 13 bp, Homo sapiens
ggctggccctgcc

SEQ ID NO: 1962137 - DNA, 14 bp, Homo sapiens
ggctggccctgccc

SEQ ID NO: 1962138 - DNA, 15 bp, Homo sapiens
ggctgggcagggccg

SEQ ID NO: 1962139 - DNA, 14 bp, Homo sapiens
ggctgggtcgcccc

SEQ ID NO: 1962140 - DNA, 19 bp, Homo sapiens
ggctgggtcgcccctcctc

SEQ ID NO: 1962141 - DNA, 15 bp, Homo sapiens
ggctgttagctcaga

SEQ ID NO: 1962142 - DNA, 13 bp, Homo sapiens
ggcttaaacattt

SEQ ID NO: 1962143 - DNA, 15 bp, Homo sapiens
ggcttggagcagaga

SEQ ID NO: 1962144 - DNA, 16 bp, Homo sapiens
ggcttggagcagagac

SEQ ID NO: 1962145 - DNA, 18 bp, Homo sapiens
gggaaatgctgatttaaa

SEQ ID NO: 1962146 - DNA, 13 bp, Homo sapiens
gggaagcccaccc

SEQ ID NO: 1962147 - DNA, 16 bp, Homo sapiens
gggaagcccacccgcc

SEQ ID NO: 1962148 - DNA, 21 bp, Homo sapiens
gggaagcccacccgccccaga

SEQ ID NO: 1962149 - DNA, 13 bp, Homo sapiens
gggaaggcctgag

SEQ ID NO: 1962150 - DNA, 23 bp, Homo sapiens
gggaaggcctgagggaagcccac

SEQ ID NO: 1962151 - DNA, 16 bp, Homo sapiens
gggacagcggcccggc

SEQ ID NO: 1962152 - DNA, 18 bp, Homo sapiens
gggacagcggcccggccc

SEQ ID NO: 1962153 - DNA, 21 bp, Homo sapiens
gggactgtcttcaaccctgcc

SEQ ID NO: 1962154 - DNA, 23 bp, Homo sapiens
gggactgtcttcaaccctgccct

SEQ ID NO: 1962155 - DNA, 21 bp, Homo sapiens
gggaggagcacccccagcctc

SEQ ID NO: 1962156 - DNA, 21 bp, Homo sapiens
gggagtccactttcctctctc

SEQ ID NO: 1962157 - DNA, 22 bp, Homo sapiens
gggcacaagtttttttgttcat

SEQ ID NO: 1962158 - DNA, 16 bp, Homo sapiens
gggctaactggcccca

SEQ ID NO: 1962159 - DNA, 18 bp, Homo sapiens
gggctaactggccccagg

SEQ ID NO: 1962160 - DNA, 20 bp, Homo sapiens
gggctaactggccccaggcg

SEQ ID NO: 1962161 - DNA, 20 bp, Homo sapiens
gggctctctcacccagcctg

SEQ ID NO: 1962162 - DNA, 11 bp, Homo sapiens
gggctggccct

SEQ ID NO: 1962163 - DNA, 14 bp, Homo sapiens
gggctggccctgcc

SEQ ID NO: 1962164 - DNA, 16 bp, Homo sapiens
gggctggccctgccct

SEQ ID NO: 1962165 - DNA, 21 bp, Homo sapiens
gggctggccctgccctccccc

SEQ ID NO: 1962166 - DNA, 20 bp, Homo sapiens
gggctgttagctcagaggag

SEQ ID NO: 1962167 - DNA, 14 bp, Homo sapiens
gggcttggagcaga

SEQ ID NO: 1962168 - DNA, 16 bp, Homo sapiens
ggggaggagcaccccc

SEQ ID NO: 1962169 - DNA, 13 bp, Homo sapiens
ggggcagagctga

SEQ ID NO: 1962170 - DNA, 14 bp, Homo sapiens
ggggcccatggccc

SEQ ID NO: 1962171 - DNA, 17 bp, Homo sapiens
ggggctaactggcccca

SEQ ID NO: 1962172 - DNA, 11 bp, Homo sapiens
ggggctggccc

SEQ ID NO: 1962173 - DNA, 12 bp, Homo sapiens
ggggctggccct

SEQ ID NO: 1962174 - DNA, 17 bp, Homo sapiens
ggggctggccctgccct

SEQ ID NO: 1962175 - DNA, 22 bp, Homo sapiens
ggggctgttagctcagaggaga

SEQ ID NO: 1962176 - DNA, 16 bp, Homo sapiens
gggggctaactggccc

SEQ ID NO: 1962177 - DNA, 15 bp, Homo sapiens
ggggtccccggacgc

SEQ ID NO: 1962178 - DNA, 21 bp, Homo sapiens
ggggtcgggggaggagcaccc

SEQ ID NO: 1962179 - DNA, 12 bp, Homo sapiens
gggtccccggac

SEQ ID NO: 1962180 - DNA, 20 bp, Homo sapiens
gggtccccggacgctggctc

SEQ ID NO: 1962181 - DNA, 16 bp, Homo sapiens
gggtcgggggaggagc

SEQ ID NO: 1962182 - DNA, 13 bp, Homo sapiens
gggtctctgagca

SEQ ID NO: 1962183 - DNA, 15 bp, Homo sapiens
gggtctctgagcagt

SEQ ID NO: 1962184 - DNA, 23 bp, Homo sapiens
gggtgcgtgaccggcccgccacc

SEQ ID NO: 1962185 - DNA, 17 bp, Homo sapiens
ggtaacttgctgtgaaa

SEQ ID NO: 1962186 - DNA, 11 bp, Homo sapiens
ggtcacaggca

SEQ ID NO: 1962187 - DNA, 19 bp, Homo sapiens
ggtcagtgttataaaatct

SEQ ID NO: 1962188 - DNA, 15 bp, Homo sapiens
ggtccaccccgtccc

SEQ ID NO: 1962189 - DNA, 18 bp, Homo sapiens
ggtccaccccgtcccggc

SEQ ID NO: 1962190 - DNA, 20 bp, Homo sapiens
ggtccaccccgtcccggccc

SEQ ID NO: 1962191 - DNA, 14 bp, Homo sapiens
ggtcctgctgctcg

SEQ ID NO: 1962192 - DNA, 20 bp, Homo sapiens
ggtcctgctgctcgggaagg

SEQ ID NO: 1962193 - DNA, 21 bp, Homo sapiens
ggtcgcccctcctcgggcgcc

SEQ ID NO: 1962194 - DNA, 13 bp, Homo sapiens
ggtctctgagcag

SEQ ID NO: 1962195 - DNA, 15 bp, Homo sapiens
ggtctctttctttcc

SEQ ID NO: 1962196 - DNA, 15 bp, Homo sapiens
ggtgaactgaagcag

SEQ ID NO: 1962197 - DNA, 17 bp, Homo sapiens
ggtgaactgaagcagag

SEQ ID NO: 1962198 - DNA, 20 bp, Homo sapiens
ggtgaactgaagcagagtca

SEQ ID NO: 1962199 - DNA, 20 bp, Homo sapiens
ggtgcaggcgcgcaccgccc

SEQ ID NO: 1962200 - DNA, 15 bp, Homo sapiens
ggtgcggaccggagc

SEQ ID NO: 1962201 - DNA, 16 bp, Homo sapiens
ggtgcggaccggagcg

SEQ ID NO: 1962202 - DNA, 24 bp, Homo sapiens
ggtgcggaccggagcggctgagga

SEQ ID NO: 1962203 - DNA, 16 bp, Homo sapiens
ggttcaaattctctat

SEQ ID NO: 1962204 - DNA, 23 bp, Homo sapiens
ggttcaaattctctatgtacaga

SEQ ID NO: 1962205 - DNA, 18 bp, Homo sapiens
ggttgacagcaacaaagc

SEQ ID NO: 1962206 - DNA, 17 bp, Homo sapiens
ggttggccggctggccg

SEQ ID NO: 1962207 - DNA, 19 bp, Homo sapiens
ggtttccgtagcagttttg

SEQ ID NO: 1962208 - DNA, 12 bp, Homo sapiens
gtaaaactgtga

SEQ ID NO: 1962209 - DNA, 15 bp, Homo sapiens
gtaaataaaaatagc

SEQ ID NO: 1962210 - DNA, 15 bp, Homo sapiens
gtaaatggttttcaa

SEQ ID NO: 1962211 - DNA, 21 bp, Homo sapiens
gtaagggactccagaagcagc

SEQ ID NO: 1962212 - DNA, 23 bp, Homo sapiens
gtaatattaaattcctcctgtct

SEQ ID NO: 1962213 - DNA, 20 bp, Homo sapiens
gtacaaataatttagaaata

SEQ ID NO: 1962214 - DNA, 17 bp, Homo sapiens
gtacaataaataaaaga

SEQ ID NO: 1962215 - DNA, 18 bp, Homo sapiens
gtacaataaataaaagaa

SEQ ID NO: 1962216 - DNA, 14 bp, Homo sapiens
gtacaattctttgt

SEQ ID NO: 1962217 - DNA, 19 bp, Homo sapiens
gtacaattctttgttgctt

SEQ ID NO: 1962218 - DNA, 21 bp, Homo sapiens
gtacaattctttgttgcttaa

SEQ ID NO: 1962219 - DNA, 23 bp, Homo sapiens
gtacagaaccagcactcccaggg

SEQ ID NO: 1962220 - DNA, 15 bp, Homo sapiens
gtacatttatgtgtg

SEQ ID NO: 1962221 - DNA, 21 bp, Homo sapiens
gtacatttatgtgtgaagcaa

SEQ ID NO: 1962222 - DNA, 18 bp, Homo sapiens
gtacctgagcatatgtac

SEQ ID NO: 1962223 - DNA, 15 bp, Homo sapiens
gtactctgagtcctc

SEQ ID NO: 1962224 - DNA, 18 bp, Homo sapiens
gtactctgagtcctcatt

SEQ ID NO: 1962225 - DNA, 19 bp, Homo sapiens
gtagaaaatacattattag

SEQ ID NO: 1962226 - DNA, 13 bp, Homo sapiens
gtagactgtgaca

SEQ ID NO: 1962227 - DNA, 15 bp, Homo sapiens
gtagagtcaggagaa

SEQ ID NO: 1962228 - DNA, 13 bp, Homo sapiens
gtagcatatataa

SEQ ID NO: 1962229 - DNA, 17 bp, Homo sapiens
gtagctagtttaaaatt

SEQ ID NO: 1962230 - DNA, 20 bp, Homo sapiens
gtagctagtttaaaattatt

SEQ ID NO: 1962231 - DNA, 14 bp, Homo sapiens
gtatatattttgaa

SEQ ID NO: 1962232 - DNA, 21 bp, Homo sapiens
gtatattgatgtaactgtgtc

SEQ ID NO: 1962233 - DNA, 14 bp, Homo sapiens
gtatcatgcttcta

SEQ ID NO: 1962234 - DNA, 15 bp, Homo sapiens
gtatgatgtgctgct

SEQ ID NO: 1962235 - DNA, 19 bp, Homo sapiens
gtattgagacactgtcaag

SEQ ID NO: 1962236 - DNA, 22 bp, Homo sapiens
gtattgagacactgtcaagatt

SEQ ID NO: 1962237 - DNA, 20 bp, Homo sapiens
gtattgttcttgtaaaactg

SEQ ID NO: 1962238 - DNA, 20 bp, Homo sapiens
gtcaagattaagttatacca

SEQ ID NO: 1962239 - DNA, 11 bp, Homo sapiens
gtcaatatata

SEQ ID NO: 1962240 - DNA, 16 bp, Homo sapiens
gtcaatatatagagac

SEQ ID NO: 1962241 - DNA, 16 bp, Homo sapiens
gtcacagtttgttcag

SEQ ID NO: 1962242 - DNA, 17 bp, Homo sapiens
gtcacagtttgttcagt

SEQ ID NO: 1962243 - DNA, 22 bp, Homo sapiens
gtcagcaccgtggtgtgaggcc

SEQ ID NO: 1962244 - DNA, 18 bp, Homo sapiens
gtcagcttcccaacaata

SEQ ID NO: 1962245 - DNA, 16 bp, Homo sapiens
gtcagtgtagatcaac

SEQ ID NO: 1962246 - DNA, 21 bp, Homo sapiens
gtccacccccattgtgaatgt

SEQ ID NO: 1962247 - DNA, 17 bp, Homo sapiens
gtccaccccgtcccggc

SEQ ID NO: 1962248 - DNA, 18 bp, Homo sapiens
gtccaccccgtcccggcc

SEQ ID NO: 1962249 - DNA, 19 bp, Homo sapiens
gtccaccccgtcccggccc

SEQ ID NO: 1962250 - DNA, 16 bp, Homo sapiens
gtccactttcctctct

SEQ ID NO: 1962251 - DNA, 19 bp, Homo sapiens
gtccactttcctctctctc

SEQ ID NO: 1962252 - DNA, 14 bp, Homo sapiens
gtccaggtcacagg

SEQ ID NO: 1962253 - DNA, 23 bp, Homo sapiens
gtcccagctacaggggaggctga

SEQ ID NO: 1962254 - DNA, 12 bp, Homo sapiens
gtccccagggtg

SEQ ID NO: 1962255 - DNA, 18 bp, Homo sapiens
gtccccggacgctggctc

SEQ ID NO: 1962256 - DNA, 15 bp, Homo sapiens
gtcccttcctgtcct

SEQ ID NO: 1962257 - DNA, 22 bp, Homo sapiens
tcgagagggctgagcccctcct

SEQ ID NO: 1962258 - DNA, 14 bp, Homo sapiens
tcgcccctcctcgg

SEQ ID NO: 1962259 - DNA, 13 bp, Homo sapiens
tcggctgggcagg

SEQ ID NO: 1962260 - DNA, 16 bp, Homo sapiens
tcggctgggcagggcc

SEQ ID NO: 1962261 - DNA, 17 bp, Homo sapiens
tcggctgggcagggccg

SEQ ID NO: 1962262 - DNA, 16 bp, Homo sapiens
tcgggaaggcctgagg

SEQ ID NO: 1962263 - DNA, 15 bp, Homo sapiens
tcgggccgcctcctc

SEQ ID NO: 1962264 - DNA, 17 bp, Homo sapiens
tctttcaatccacagta

SEQ ID NO: 1962265 - DNA, 21 bp, Homo sapiens
tctttcaatccacagtattgt

SEQ ID NO: 1962266 - DNA, 12 bp, Homo sapiens
tctttcctctta

SEQ ID NO: 1962267 - DNA, 12 bp, Homo sapiens
tctttctctctg

SEQ ID NO: 1962268 - DNA, 13 bp, Homo sapiens
tctttctctctgt

SEQ ID NO: 1962269 - DNA, 17 bp, Homo sapiens
tctttctctctgtgtgg

SEQ ID NO: 1962270 - DNA, 13 bp, Homo sapiens
tctttgctgcttt

SEQ ID NO: 1962271 - DNA, 12 bp, Homo sapiens
tctttgttgctt

SEQ ID NO: 1962272 - DNA, 15 bp, Homo sapiens
tctttgttgcttaat

SEQ ID NO: 1962273 - DNA, 16 bp, Homo sapiens
tcttttagtcagaaat

SEQ ID NO: 1962274 - DNA, 21 bp, Homo sapiens
tcttttcatggagtagagtca

SEQ ID NO: 1962275 - DNA, 12 bp, Homo sapiens
tcttttgttctc

SEQ ID NO: 1962276 - DNA, 18 bp, Homo sapiens
tgaaaaagacttcaaatg

SEQ ID NO: 1962277 - DNA, 18 bp, Homo sapiens
tgaaacttgagcattcaa

SEQ ID NO: 1962278 - DNA, 23 bp, Homo sapiens
tgaaatataaactgtgagataaa

SEQ ID NO: 1962279 - DNA, 23 bp, Homo sapiens
tgcctggcgggcagcccctgctg

SEQ ID NO: 1962280 - DNA, 19 bp, Homo sapiens
tgccttgattttaattcag

SEQ ID NO: 1962281 - DNA, 15 bp, Homo sapiens
tgcctttctagcaat

SEQ ID NO: 1962282 - DNA, 21 bp, Homo sapiens
tgcgcagccgcgctctgcccc

SEQ ID NO: 1962283 - DNA, 17 bp, Homo sapiens
tgcgcctgcccgcccgc

SEQ ID NO: 1962284 - DNA, 19 bp, Homo sapiens
tgcgctcctctgcagcctg

SEQ ID NO: 1962285 - DNA, 20 bp, Homo sapiens
tgcgctcctctgcagcctga

SEQ ID NO: 1962286 - DNA, 19 bp, Homo sapiens
tgcggaccggagcggctga

SEQ ID NO: 1962287 - DNA, 20 bp, Homo sapiens
tgcggaccggagcggctgag

SEQ ID NO: 1962288 - DNA, 22 bp, Homo sapiens
tgcggaccggagcggctgagga

SEQ ID NO: 1962289 - DNA, 19 bp, Homo sapiens
tgcggcaccgcccacccac

SEQ ID NO: 1962290 - DNA, 20 bp, Homo sapiens
tgcggcaccgcccacccaca

SEQ ID NO: 1962291 - DNA, 18 bp, Homo sapiens
tgcgtaaatggttttcaa

SEQ ID NO: 1962292 - DNA, 20 bp, Homo sapiens
tgcgtaaatggttttcaaca

SEQ ID NO: 1962293 - DNA, 22 bp, Homo sapiens
tgcgtgaccggcccgccacctt

SEQ ID NO: 1962294 - DNA, 23 bp, Homo sapiens
tgcgtgaccggcccgccaccttg

SEQ ID NO: 1962295 - DNA, 12 bp, Homo sapiens
tgcgtgtggccc

SEQ ID NO: 1962296 - DNA, 20 bp, Homo sapiens
tgcgtgtggccctgtgggag

SEQ ID NO: 1962297 - DNA, 17 bp, Homo sapiens
tgctaatttaaaggagc

SEQ ID NO: 1962298 - DNA, 15 bp, Homo sapiens
tgctacaaaatgtgt

SEQ ID NO: 1962299 - DNA, 14 bp, Homo sapiens
tgctaggtaaagag

SEQ ID NO: 1962300 - DNA, 17 bp, Homo sapiens
tgctatctcgctagcca

SEQ ID NO: 1962301 - DNA, 12 bp, Homo sapiens
tgctcaatgtgc

SEQ ID NO: 1962302 - DNA, 19 bp, Homo sapiens
tgctcaatgtgctgttgat

SEQ ID NO: 1962303 - DNA, 23 bp, Homo sapiens
tgctcacgtctgtgagtctgtcc

SEQ ID NO: 1962304 - DNA, 13 bp, Homo sapiens
tgctccctcatgc

SEQ ID NO: 1962305 - DNA, 20 bp, Homo sapiens
tgctcctccagtacaataaa

SEQ ID NO: 1962306 - DNA, 21 bp, Homo sapiens
tgctcctccagtacaataaat

SEQ ID NO: 1962307 - DNA, 19 bp, Homo sapiens
tgctcgggaaggcctgagg

SEQ ID NO: 1962308 - DNA, 20 bp, Homo sapiens
tgctctctcattcccaggca

SEQ ID NO: 1962309 - DNA, 20 bp, Homo sapiens
tgctgagatgtttagtagct

SEQ ID NO: 1962310 - DNA, 13 bp, Homo sapiens
tgctgcctcagga

SEQ ID NO: 1962311 - DNA, 19 bp, Homo sapiens
tgctgctcgggaaggcctg

SEQ ID NO: 1962312 - DNA, 15 bp, Homo sapiens
tgctgctttgttttc

SEQ ID NO: 1962313 - DNA, 13 bp, Homo sapiens
tgctgcttttgat

SEQ ID NO: 1962314 - DNA, 20 bp, Homo sapiens
tgctgcttttgatggctatg

SEQ ID NO: 1962315 - DNA, 14 bp, Homo sapiens
tgctgtgaaacagt

SEQ ID NO: 1962316 - DNA, 17 bp, Homo sapiens
tgctgtgaaacagtgtg

SEQ ID NO: 1962317 - DNA, 18 bp, Homo sapiens
tgcttaaatgatcaagga

SEQ ID NO: 1962318 - DNA, 17 bp, Homo sapiens
tgcttaatctagagcta

SEQ ID NO: 1962319 - DNA, 23 bp, Homo sapiens
tgcttaatctagagctatgcaca

SEQ ID NO: 1962320 - DNA, 16 bp, Homo sapiens
tgcttctctaaaacag

SEQ ID NO: 1962321 - DNA, 15 bp, Homo sapiens
tgcttcttttagtca

SEQ ID NO: 1962322 - DNA, 14 bp, Homo sapiens
tgcttttctcatgg

SEQ ID NO: 1962323 - DNA, 14 bp, Homo sapiens
tgcttttctgtcag

SEQ ID NO: 1962324 - DNA, 19 bp, Homo sapiens
tgcttttgatggctatgtt

SEQ ID NO: 1962325 - DNA, 17 bp, Homo sapiens
tggaaaaaaaaaaatat

SEQ ID NO: 1962326 - DNA, 20 bp, Homo sapiens
tggaagttgtcctttctgat

SEQ ID NO: 1962327 - DNA, 21 bp, Homo sapiens
tggaattacataacaggcatt

SEQ ID NO: 1962328 - DNA, 23 bp, Homo sapiens
tggaattagttggcagagaaaat

SEQ ID NO: 1962329 - DNA, 16 bp, Homo sapiens
tggacagtgcctaact

SEQ ID NO: 1962330 - DNA, 24 bp, Homo sapiens
tggaccagttccctcagccctcat

SEQ ID NO: 1962331 - DNA, 18 bp, Homo sapiens
tggagcagagacggcagc

SEQ ID NO: 1962332 - DNA, 22 bp, Homo sapiens
tggagcagagacggcagcccca

SEQ ID NO: 1962333 - DNA, 15 bp, Homo sapiens
tggaggagaaggagg

SEQ ID NO: 1962334 - DNA, 20 bp, Homo sapiens
tggaggagaaggaggaaccc

SEQ ID NO: 1962335 - DNA, 13 bp, Homo sapiens
tggagtagagtca

SEQ ID NO: 1962336 - DNA, 13 bp, Homo sapiens
tggagtgcagtgg

SEQ ID NO: 1962337 - DNA, 14 bp, Homo sapiens
tggatgtcccttcc

SEQ ID NO: 1962338 - DNA, 16 bp, Homo sapiens
tggatttgacacactc

SEQ ID NO: 1962339 - DNA, 17 bp, Homo sapiens
tggatttgacacactca

SEQ ID NO: 1962340 - DNA, 23 bp, Homo sapiens
tggatttgacacactcaccattt

SEQ ID NO: 1962341 - DNA, 12 bp, Homo sapiens
tggcaaacattt

SEQ ID NO: 1962342 - DNA, 13 bp, Homo sapiens
tggcaagtttttg

SEQ ID NO: 1962343 - DNA, 15 bp, Homo sapiens
tggcagagaaaatgc

SEQ ID NO: 1962344 - DNA, 14 bp, Homo sapiens
tggcagcgcctccc

SEQ ID NO: 1962345 - DNA, 19 bp, Homo sapiens
tggccccagctggctgggt

SEQ ID NO: 1962346 - DNA, 18 bp, Homo sapiens
tggccctgccctccccca

SEQ ID NO: 1962347 - DNA, 13 bp, Homo sapiens
tggcctgggggct

SEQ ID NO: 1962348 - DNA, 16 bp, Homo sapiens
tggcgggcagcccctg

SEQ ID NO: 1962349 - DNA, 18 bp, Homo sapiens
tggcgggcagcccctgct

SEQ ID NO: 1962350 - DNA, 21 bp, Homo sapiens
tggctgaaattatgtcaaatg

SEQ ID NO: 1962351 - DNA, 20 bp, Homo sapiens
tggctgggtcgcccctcctc

SEQ ID NO: 1962352 - DNA, 23 bp, Homo sapiens
tggctgttatctgtctttatgat

SEQ ID NO: 1962353 - DNA, 15 bp, Homo sapiens
tgggaaattcttgca

SEQ ID NO: 1962354 - DNA, 19 bp, Homo sapiens
tgggaaattcttgcactgt

SEQ ID NO: 1962355 - DNA, 20 bp, Homo sapiens
tgggaaattcttgcactgta

SEQ ID NO: 1962356 - DNA, 14 bp, Homo sapiens
tgggagtccacttt

SEQ ID NO: 1962357 - DNA, 16 bp, Homo sapiens
tgggagtccactttcc

SEQ ID NO: 1962358 - DNA, 18 bp, Homo sapiens
tgggagtccactttcctc

SEQ ID NO: 1962359 - DNA, 16 bp, Homo sapiens
tgggattcctcccctg

SEQ ID NO: 1962360 - DNA, 12 bp, Homo sapiens
tgggcagggccg

SEQ ID NO: 1962361 - DNA, 18 bp, Homo sapiens
tgggcagggccgcagggc

SEQ ID NO: 1962362 - DNA, 17 bp, Homo sapiens
tggggcccatggcccca

SEQ ID NO: 1962363 - DNA, 16 bp, Homo sapiens
tggggtctctgagcag

SEQ ID NO: 1962364 - DNA, 17 bp, Homo sapiens
tggggtctctgagcagt

SEQ ID NO: 1962365 - DNA, 13 bp, Homo sapiens
tgggtcgcccctc

SEQ ID NO: 1962366 - DNA, 11 bp, Homo sapiens
ttaaacatttt

SEQ ID NO: 1962367 - DNA, 18 bp, Homo sapiens
ttaaatttgggttgcaaa

SEQ ID NO: 1962368 - DNA, 21 bp, Homo sapiens
ttaaatttgggttgcaaagct

SEQ ID NO: 1962369 - DNA, 14 bp, Homo sapiens
ttaagaatttacca

SEQ ID NO: 1962370 - DNA, 16 bp, Homo sapiens
ttaatcatttccagca

SEQ ID NO: 1962371 - DNA, 20 bp, Homo sapiens
ttaatcatttccagcaaaat

SEQ ID NO: 1962372 - DNA, 13 bp, Homo sapiens
ttaatgtctcaaa

SEQ ID NO: 1962373 - DNA, 22 bp, Homo sapiens
ttaatgtgatcctaaaattgtt

SEQ ID NO: 1962374 - DNA, 17 bp, Homo sapiens
ttaatgttgaaaaagaa

SEQ ID NO: 1962375 - DNA, 18 bp, Homo sapiens
ttaatgtttagtcagtgt

SEQ ID NO: 1962376 - DNA, 20 bp, Homo sapiens
ttacaaatgatttcgtgact

SEQ ID NO: 1962377 - DNA, 23 bp, Homo sapiens
ttacccttctacaaaagaagtgt

SEQ ID NO: 1962378 - DNA, 17 bp, Homo sapiens
ttacctattgctgtaaa

SEQ ID NO: 1962379 - DNA, 21 bp, Homo sapiens
ttactcagatgacctgaggaa

SEQ ID NO: 1962380 - DNA, 19 bp, Homo sapiens
ttagaattaaccattgcta

SEQ ID NO: 1962381 - DNA, 12 bp, Homo sapiens
ttagacaatgtg

SEQ ID NO: 1962382 - DNA, 20 bp, Homo sapiens
ttagattcctacttaaacaa

SEQ ID NO: 1962383 - DNA, 13 bp, Homo sapiens
ttaggcacttttt

SEQ ID NO: 1962384 - DNA, 17 bp, Homo sapiens
ttaggcactttttaaca

SEQ ID NO: 1962385 - DNA, 15 bp, Homo sapiens
ttagggctctaattt

SEQ ID NO: 1962386 - DNA, 22 bp, Homo sapiens
ttaggtgcctggatattttttg

SEQ ID NO: 1962387 - DNA, 17 bp, Homo sapiens
ttagtacctttttaaca

SEQ ID NO: 1962388 - DNA, 13 bp, Homo sapiens
ttagtagctgata

SEQ ID NO: 1962389 - DNA, 16 bp, Homo sapiens
ttagtagctgataaag

SEQ ID NO: 1962390 - DNA, 13 bp, Homo sapiens
ttagtcagaaatg

SEQ ID NO: 1962391 - DNA, 19 bp, Homo sapiens
ttagtcagaaatgattcag

SEQ ID NO: 1962392 - DNA, 15 bp, Homo sapiens
ttagtgcttggctca

SEQ ID NO: 1962393 - DNA, 15 bp, Homo sapiens
ttagtggttctgtgc

SEQ ID NO: 1962394 - DNA, 19 bp, Homo sapiens
ttagtggttctgtgcctct

SEQ ID NO: 1962395 - DNA, 20 bp, Homo sapiens
ttagtggttctgtgcctctt

SEQ ID NO: 1962396 - DNA, 17 bp, Homo sapiens
ttagttggcagagaaaa

SEQ ID NO: 1962397 - DNA, 15 bp, Homo sapiens
ttataacattgtaaa

SEQ ID NO: 1962398 - DNA, 17 bp, Homo sapiens
ttataacattgtaaatg

SEQ ID NO: 1962399 - DNA, 15 bp, Homo sapiens
ttataccagcaaaag

SEQ ID NO: 1962400 - DNA, 19 bp, Homo sapiens
ttgtctttctgcagaaaat

SEQ ID NO: 1962401 - DNA, 13 bp, Homo sapiens
ttgtgaagtgatt

SEQ ID NO: 1962402 - DNA, 20 bp, Homo sapiens
ttgtgaagtgattgacattt

SEQ ID NO: 1962403 - DNA, 21 bp, Homo sapiens
ttgtgaagtgattgacatttt

SEQ ID NO: 1962404 - DNA, 18 bp, Homo sapiens
ttgttatagttcatagtt

SEQ ID NO: 1962405 - DNA, 23 bp, Homo sapiens
ttgtttacaacacagtagtgttc

SEQ ID NO: 1962406 - DNA, 14 bp, Homo sapiens
ttgtttgctgcttt

SEQ ID NO: 1962407 - DNA, 19 bp, Homo sapiens
ttgtttgttaataaagtgc

SEQ ID NO: 1962408 - DNA, 23 bp, Homo sapiens
tttaaaaaaataatataaatgaa

SEQ ID NO: 1962409 - DNA, 23 bp, Homo sapiens
tttaacttttgggatttgttgaa

SEQ ID NO: 1962410 - DNA, 18 bp, Homo sapiens
tttaagtgtactggattt

SEQ ID NO: 1962411 - DNA, 10 bp, Homo sapiens
tttaatcatt

SEQ ID NO: 1962412 - DNA, 13 bp, Homo sapiens
tttaatcatttcc

SEQ ID NO: 1962413 - DNA, 23 bp, Homo sapiens
tttacaacacagtagtgttctgt

SEQ ID NO: 1962414 - DNA, 16 bp, Homo sapiens
tttagaaataaaagat

SEQ ID NO: 1962415 - DNA, 19 bp, Homo sapiens
tttagaatcaagtctgtga

SEQ ID NO: 1962416 - DNA, 16 bp, Homo sapiens
tttaggaatgctcaat

SEQ ID NO: 1962417 - DNA, 13 bp, Homo sapiens
tttagtagctgat

SEQ ID NO: 1962418 - DNA, 17 bp, Homo sapiens
tttataaggctgactct

SEQ ID NO: 1962419 - DNA, 21 bp, Homo sapiens
tttatgcatgagaactaaata

SEQ ID NO: 1962420 - DNA, 15 bp, Homo sapiens
tttatgcatttatgc

SEQ ID NO: 1962421 - DNA, 19 bp, Homo sapiens
tttcaaattgcctttcttg

SEQ ID NO: 1962422 - DNA, 20 bp, Homo sapiens
tttcaaattgcctttcttga

SEQ ID NO: 1962423 - DNA, 19 bp, Homo sapiens
tttcaacaagcctgaaagt

SEQ ID NO: 1962424 - DNA, 22 bp, Homo sapiens
tttcaagaatgtttcagttata

SEQ ID NO: 1962425 - DNA, 18 bp, Homo sapiens
tttcaagttattcagaaa

SEQ ID NO: 1962426 - DNA, 19 bp, Homo sapiens
tttcaagttattcagaaat

SEQ ID NO: 1962427 - DNA, 18 bp, Homo sapiens
tttcaatccacagtattg

SEQ ID NO: 1962428 - DNA, 19 bp, Homo sapiens
tttcaatgcttcttttagt

SEQ ID NO: 1962429 - DNA, 20 bp, Homo sapiens
tttcaattatgtttgaaaat

SEQ ID NO: 1962430 - DNA, 14 bp, Homo sapiens
tttcatgattagac

SEQ ID NO: 1962431 - DNA, 19 bp, Homo sapiens
tttcatgattagacaatgt

SEQ ID NO: 1962432 - DNA, 15 bp, Homo sapiens
tttcattttctctcc

SEQ ID NO: 1962433 - DNA, 17 bp, Homo sapiens
tttccagcaaaatatat

SEQ ID NO: 1962434 - DNA, 23 bp, Homo sapiens
tttccatgacagtagcatactga

SEQ ID NO: 1962435 - DNA, 17 bp, Homo sapiens
tttccgtagcagttttg

SEQ ID NO: 1962436 - DNA, 20 bp, Homo sapiens
tttccgtagcagttttgaaa

SEQ ID NO: 1962437 - DNA, 14 bp, Homo sapiens
tttcctctctctct

SEQ ID NO: 1962438 - DNA, 23 bp, Homo sapiens
tttcctctctctctctctctctg

SEQ ID NO: 1962439 - DNA, 24 bp, Homo sapiens
tttcctctctctctctctctctgt

SEQ ID NO: 1962440 - DNA, 24 bp, Homo sapiens
tttcctcttaatgtctcaaaataa

SEQ ID NO: 1962441 - DNA, 12 bp, Homo sapiens
tttcctgtcaat

SEQ ID NO: 1962442 - DNA, 15 bp, Homo sapiens
tttcctgtcaatata

SEQ ID NO: 1962443 - DNA, 13 bp, Homo sapiens
tttctgcagaaaa

SEQ ID NO: 1962444 - DNA, 20 bp, Homo sapiens
tttgaacattaatgttgaaa

SEQ ID NO: 1962445 - DNA, 12 bp, Homo sapiens
tttgcacacaaa

SEQ ID NO: 1962446 - DNA, 22 bp, Homo sapiens
tttggcaatatcatattctaaa

SEQ ID NO: 1962447 - DNA, 19 bp, Homo sapiens
tttggctgaaattatgtca

SEQ ID NO: 1962448 - DNA, 17 bp, Homo sapiens
tttgggttgcaaagcta

SEQ ID NO: 1962449 - DNA, 18 bp, Homo sapiens
tttgtgaagtgattgaca

SEQ ID NO: 1962450 - DNA, 20 bp, Homo sapiens
tttgtgatctgtccttccaa

SEQ ID NO: 1962451 - DNA, 17 bp, Homo sapiens
tttgttaataaagtgca

SEQ ID NO: 1962452 - DNA, 19 bp, Homo sapiens
tttgttatagttcatagtt

SEQ ID NO: 1962453 - DNA, 20 bp, Homo sapiens
tttgttcaccttctgtgcat

SEQ ID NO: 1962454 - DNA, 21 bp, Homo sapiens
tttgttcaccttctgtgcatc

SEQ ID NO: 1962455 - DNA, 15 bp, Homo sapiens
tttgttctctcttgg

SEQ ID NO: 1962456 - DNA, 20 bp, Homo sapiens
tttgtttacaacacagtagt

SEQ ID NO: 1962457 - DNA, 18 bp, Homo sapiens
ttttaaaaaaataatata

SEQ ID NO: 1962458 - DNA, 15 bp, Homo sapiens
ttttaattcaggtga

SEQ ID NO: 1962459 - DNA, 23 bp, Homo sapiens
ttttaggtggctgggagttttga

SEQ ID NO: 1962460 - DNA, 14 bp, Homo sapiens
ttctgttcactttt

SEQ ID NO: 1962461 - DNA, 18 bp, Homo sapiens
ttcttcgcagctcatctt

SEQ ID NO: 1962462 - DNA, 19 bp, Homo sapiens
ttcttgcactgtatccaag

SEQ ID NO: 1962463 - DNA, 21 bp, Homo sapiens
ttcttgcggcaccgcccaccc

SEQ ID NO: 1962464 - DNA, 14 bp, Homo sapiens
ttcttggtatgatc

SEQ ID NO: 1962465 - DNA, 16 bp, Homo sapiens
ttcttggtatgatcat

SEQ ID NO: 1962466 - DNA, 16 bp, Homo sapiens
ttcttgtaaaactgtg

SEQ ID NO: 1962467 - DNA, 20 bp, Homo sapiens
ttcttttagtcagaaatgat

SEQ ID NO: 1962468 - DNA, 14 bp, Homo sapiens
ttcttttcccattt

SEQ ID NO: 1962469 - DNA, 15 bp, Homo sapiens
ttgaaaataggattt

SEQ ID NO: 1962470 - DNA, 19 bp, Homo sapiens
ttgaacattaatgttgaaa

SEQ ID NO: 1962471 - DNA, 17 bp, Homo sapiens
ttgacacactcaccatt

SEQ ID NO: 1962472 - DNA, 14 bp, Homo sapiens
ttgacattttgtag

SEQ ID NO: 1962473 - DNA, 16 bp, Homo sapiens
ttgacattttgtagct

SEQ ID NO: 1962474 - DNA, 19 bp, Homo sapiens
ttgacctcaaaagaaaatg

SEQ ID NO: 1962475 - DNA, 15 bp, Homo sapiens
ttgagacactgtcaa

SEQ ID NO: 1962476 - DNA, 22 bp, Homo sapiens
ttgagcagtaaatgtatattga

SEQ ID NO: 1962477 - DNA, 11 bp, Homo sapiens
ttgagtgttct

SEQ ID NO: 1962478 - DNA, 19 bp, Homo sapiens
ttgatctggtgcgtgtggc

SEQ ID NO: 1962479 - DNA, 14 bp, Homo sapiens
ttgatggaaaaaga

SEQ ID NO: 1962480 - DNA, 15 bp, Homo sapiens
ttgatggaaaaagaa

SEQ ID NO: 1962481 - DNA, 13 bp, Homo sapiens
ttgattcaaataa

SEQ ID NO: 1962482 - DNA, 19 bp, Homo sapiens
ttgattttaattcaggtga

SEQ ID NO: 1962483 - DNA, 22 bp, Homo sapiens
ttgcactaaaagtgatgtgatt

SEQ ID NO: 1962484 - DNA, 19 bp, Homo sapiens
ttgctaagataattaaatg

SEQ ID NO: 1962485 - DNA, 23 bp, Homo sapiens
ttgctaagataattaaatgaaat

SEQ ID NO: 1962486 - DNA, 18 bp, Homo sapiens
ttgctctctcattcccag

SEQ ID NO: 1962487 - DNA, 14 bp, Homo sapiens
ttgctgtgaaacag

SEQ ID NO: 1962488 - DNA, 17 bp, Homo sapiens
ttgctgtgaaacagtgt

SEQ ID NO: 1962489 - DNA, 22 bp, Homo sapiens
ttggaaaatgttctgacagcat

SEQ ID NO: 1962490 - DNA, 14 bp, Homo sapiens
ttggaatttgctta

SEQ ID NO: 1962491 - DNA, 22 bp, Homo sapiens
ttggactggaggtacaaataat

SEQ ID NO: 1962492 - DNA, 14 bp, Homo sapiens
ttggccggctggcc

SEQ ID NO: 1962493 - DNA, 22 bp, Homo sapiens
ttggctgtgatgtcacagtttg

SEQ ID NO: 1962494 - DNA, 21 bp, Homo sapiens
ttgggaaattcttgcactgta

SEQ ID NO: 1962495 - DNA, 20 bp, Homo sapiens
ttgggcacgggagagcgcca

SEQ ID NO: 1962496 - DNA, 21 bp, Homo sapiens
ttggtaccctggacagtgcct

SEQ ID NO: 1962497 - DNA, 23 bp, Homo sapiens
ttggttccacaatcatctattga

SEQ ID NO: 1962498 - DNA, 15 bp, Homo sapiens
ttggttcctcatggc

SEQ ID NO: 1962499 - DNA, 13 bp, Homo sapiens
ttgtaaaactgtg

SEQ ID NO: 1962500 - DNA, 16 bp, Homo sapiens
ttgtagctagtttaaa

SEQ ID NO: 1962501 - DNA, 21 bp, Homo sapiens
ttgtagctagtttaaaattat

SEQ ID NO: 1962502 - DNA, 21 bp, Homo sapiens
ttgtctgtgtatttctatttt

SEQ ID NO: 1962503 - DNA, 19 bp, Homo sapiens
aaaatgtgtgcttggaaaa

SEQ ID NO: 1962504 - DNA, 14 bp, Homo sapiens
aaacaaaaactttc

SEQ ID NO: 1962505 - DNA, 13 bp, Homo sapiens
aaacaacagcaac

SEQ ID NO: 1962506 - DNA, 20 bp, Homo sapiens
aaacagtgtggatgtaaatt

SEQ ID NO: 1962507 - DNA, 22 bp, Homo sapiens
aaacagtgtggcttaaacattt

SEQ ID NO: 1962508 - DNA, 23 bp, Homo sapiens
aaacattttgtatgctgcatgaa

SEQ ID NO: 1962509 - DNA, 18 bp, Homo sapiens
aaacattttttgtttctt

SEQ ID NO: 1962510 - DNA, 20 bp, Homo sapiens
aaaccagaaagaggaataaa

SEQ ID NO: 1962511 - DNA, 12 bp, Homo sapiens
aaacccctgaca

SEQ ID NO: 1962512 - DNA, 22 bp, Homo sapiens
aaaccttagtacctttttaaca

SEQ ID NO: 1962513 - DNA, 13 bp, Homo sapiens
aaactaattaaac

SEQ ID NO: 1962514 - DNA, 17 bp, Homo sapiens
aaactgatgctttcaga

SEQ ID NO: 1962515 - DNA, 10 bp, Homo sapiens
aaactgtgac

SEQ ID NO: 1962516 - DNA, 12 bp, Homo sapiens
aaactgtgacat

SEQ ID NO: 1962517 - DNA, 15 bp, Homo sapiens
aaacttaacagatca

SEQ ID NO: 1962518 - DNA, 23 bp, Homo sapiens
aaacttactatggtatatatttt

SEQ ID NO: 1962519 - DNA, 14 bp, Homo sapiens
aaactttccatgac

SEQ ID NO: 1962520 - DNA, 16 bp, Homo sapiens
aaactttccatgacag

SEQ ID NO: 1962521 - DNA, 14 bp, Homo sapiens
aaagaaaaaagaag

SEQ ID NO: 1962522 - DNA, 22 bp, Homo sapiens
aaagaaattagggctctaattt

SEQ ID NO: 1962523 - DNA, 19 bp, Homo sapiens
aaagaagtgtgactagata

SEQ ID NO: 1962524 - DNA, 18 bp, Homo sapiens
aaagacttcaaatgttat

SEQ ID NO: 1962525 - DNA, 17 bp, Homo sapiens
aaagaggattagtagaa

SEQ ID NO: 1962526 - DNA, 21 bp, Homo sapiens
aaagaggattagtagaaaata

SEQ ID NO: 1962527 - DNA, 12 bp, Homo sapiens
aaagatggattt

SEQ ID NO: 1962528 - DNA, 14 bp, Homo sapiens
aaagcaaaacattt

SEQ ID NO: 1962529 - DNA, 19 bp, Homo sapiens
aaagcatgctcagtattga

SEQ ID NO: 1962530 - DNA, 12 bp, Homo sapiens
aaagccctccct

SEQ ID NO: 1962531 - DNA, 13 bp, Homo sapiens
aaaggcttctcca

SEQ ID NO: 1962532 - DNA, 19 bp, Homo sapiens
aaaggtttcactgttcatg

SEQ ID NO: 1962533 - DNA, 12 bp, Homo sapiens
aaagtaataaat

SEQ ID NO: 1962534 - DNA, 13 bp, Homo sapiens
aaagtaatttcaa

SEQ ID NO: 1962535 - DNA, 15 bp, Homo sapiens
aaagtaatttcaaga

SEQ ID NO: 1962536 - DNA, 17 bp, Homo sapiens
aaagtctcctgtatcat

SEQ ID NO: 1962537 - DNA, 17 bp, Homo sapiens
aaataaaaccagaaaga

SEQ ID NO: 1962538 - DNA, 22 bp, Homo sapiens
aaataaaaccagaaagaggaat

SEQ ID NO: 1962539 - DNA, 11 bp, Homo sapiens
aaataaaagaa

SEQ ID NO: 1962540 - DNA, 18 bp, Homo sapiens
aaataaccctgaatcaga

SEQ ID NO: 1962541 - DNA, 19 bp, Homo sapiens
aaataaccctgaatcagag

SEQ ID NO: 1962542 - DNA, 18 bp, Homo sapiens
aaataatataaatgaatg

SEQ ID NO: 1962543 - DNA, 13 bp, Homo sapiens
aaataatttagaa

SEQ ID NO: 1962544 - DNA, 16 bp, Homo sapiens
aaataatttagaaata

SEQ ID NO: 1962545 - DNA, 14 bp, Homo sapiens
aaatacatgatgat

SEQ ID NO: 1962546 - DNA, 19 bp, Homo sapiens
aaatacattattagaatat

SEQ ID NO: 1962547 - DNA, 14 bp, Homo sapiens
aaatagctataaat

SEQ ID NO: 1962548 - DNA, 18 bp, Homo sapiens
aaatagtgtgtccatgca

SEQ ID NO: 1962549 - DNA, 12 bp, Homo sapiens
aaatataaaaat

SEQ ID NO: 1962550 - DNA, 14 bp, Homo sapiens
aaatataaactgtg

SEQ ID NO: 1962551 - DNA, 15 bp, Homo sapiens
aaatataaactgtga

SEQ ID NO: 1962552 - DNA, 17 bp, Homo sapiens
aaatataaactgtgaga

SEQ ID NO: 1962553 - DNA, 17 bp, Homo sapiens
aaatatatgtttggctg

SEQ ID NO: 1962554 - DNA, 23 bp, Homo sapiens
aaatatatgtttggctgaaatta

SEQ ID NO: 1962555 - DNA, 14 bp, Homo sapiens
aaatatcattatag

SEQ ID NO: 1962556 - DNA, 17 bp, Homo sapiens
aaatatcattatagcat

SEQ ID NO: 1962557 - DNA, 22 bp, Homo sapiens
aaatatcattatagcatgtaat

SEQ ID NO: 1962558 - DNA, 15 bp, Homo sapiens
aaatatccctcattt

SEQ ID NO: 1962559 - DNA, 19 bp, Homo sapiens
aaatatttgcgtaaatggt

SEQ ID NO: 1962560 - DNA, 21 bp, Homo sapiens
aaatatttgcgtaaatggttt

SEQ ID NO: 1962561 - DNA, 23 bp, Homo sapiens
aaatcagcatttttctttagtca

SEQ ID NO: 1962562 - DNA, 17 bp, Homo sapiens
aaatccttgccttcaaa

SEQ ID NO: 1962563 - DNA, 13 bp, Homo sapiens
aaatgaaatactt

SEQ ID NO: 1962564 - DNA, 17 bp, Homo sapiens
aaatgaaatacttgaca

SEQ ID NO: 1962565 - DNA, 13 bp, Homo sapiens
aaatgaatgaaat

SEQ ID NO: 1962566 - DNA, 14 bp, Homo sapiens
aaatgaatgaaata

SEQ ID NO: 1962567 - DNA, 23 bp, Homo sapiens
aaatgaccatccagtagagattt

SEQ ID NO: 1962568 - DNA, 17 bp, Homo sapiens
aaatgatatgtctttaa

SEQ ID NO: 1962569 - DNA, 18 bp, Homo sapiens
aaatgatatgtctttaaa

SEQ ID NO: 1962570 - DNA, 21 bp, Homo sapiens
aaatgatcaaggagggagaaa

SEQ ID NO: 1962571 - DNA, 21 bp, Homo sapiens
aaatgattcacttttattgta

SEQ ID NO: 1962572 - DNA, 13 bp, Homo sapiens
aaatggatgtaat

SEQ ID NO: 1962573 - DNA, 17 bp, Homo sapiens
aaatgtgtgcttggaaa

SEQ ID NO: 1962574 - DNA, 18 bp, Homo sapiens
aaatgtgtgcttggaaaa

SEQ ID NO: 1962575 - DNA, 19 bp, Homo sapiens
aaattagggctctaatttc

SEQ ID NO: 1962576 - DNA, 21 bp, Homo sapiens
aaattagggctctaatttcct

SEQ ID NO: 1962577 - DNA, 13 bp, Homo sapiens
aaattatctttaa

SEQ ID NO: 1962578 - DNA, 14 bp, Homo sapiens
aaattatctttaaa

SEQ ID NO: 1962579 - DNA, 17 bp, Homo sapiens
aaattatctttaaaact

SEQ ID NO: 1962580 - DNA, 19 bp, Homo sapiens
aaattatgtcaaatggatg

SEQ ID NO: 1962581 - DNA, 18 bp, Homo sapiens
aaattctctatgtacaga

SEQ ID NO: 1962582 - DNA, 14 bp, Homo sapiens
aaattcttgcactg

SEQ ID NO: 1962583 - DNA, 23 bp, Homo sapiens
aaattcttgcactgtatccaagt

SEQ ID NO: 1962584 - DNA, 18 bp, Homo sapiens
aaattgctgagatgttta

SEQ ID NO: 1962585 - DNA, 20 bp, Homo sapiens
aaatttctagatatgagaaa

SEQ ID NO: 1962586 - DNA, 19 bp, Homo sapiens
aaatttgcacacaaaacat

SEQ ID NO: 1962587 - DNA, 12 bp, Homo sapiens
aaattttattga

SEQ ID NO: 1962588 - DNA, 16 bp, Homo sapiens
aaattttattgaatat

SEQ ID NO: 1962589 - DNA, 19 bp, Homo sapiens
aaattttattgaatataat

SEQ ID NO: 1962590 - DNA, 20 bp, Homo sapiens
aaattttcctttatgattct

SEQ ID NO: 1962591 - DNA, 15 bp, Homo sapiens
aacaaaagatatgaa

SEQ ID NO: 1962592 - DNA, 16 bp, Homo sapiens
aacaaagcatgctcag

SEQ ID NO: 1962593 - DNA, 13 bp, Homo sapiens
aacaacaaagcat

SEQ ID NO: 1962594 - DNA, 22 bp, Homo sapiens
aacaacaaagcatgctcagtat

SEQ ID NO: 1962595 - DNA, 14 bp, Homo sapiens
aacaacaacaaagc

SEQ ID NO: 1962596 - DNA, 15 bp, Homo sapiens
aacaacaacagaaca

SEQ ID NO: 1962597 - DNA, 15 bp, Homo sapiens
aacaacagcaacaac

SEQ ID NO: 1962598 - DNA, 12 bp, Homo sapiens
aacaaccaaaga

SEQ ID NO: 1962599 - DNA, 17 bp, Homo sapiens
aacaaccaaagaaaatt

SEQ ID NO: 1962600 - DNA, 19 bp, Homo sapiens
aacagtaattactttcaga

SEQ ID NO: 1962601 - DNA, 20 bp, Homo sapiens
aacatcttaggcacttttta

SEQ ID NO: 1962602 - DNA, 14 bp, Homo sapiens
aacattagaatatt

SEQ ID NO: 1962603 - DNA, 18 bp, Homo sapiens
aacattagaatattgtaa

SEQ ID NO: 1962604 - DNA, 13 bp, Homo sapiens
aacattttacaga

SEQ ID NO: 1962605 - DNA, 22 bp, Homo sapiens
aacattttgtatgctgcatgaa

SEQ ID NO: 1962606 - DNA, 13 bp, Homo sapiens
aaccaaagaaaat

SEQ ID NO: 1962607 - DNA, 17 bp, Homo sapiens
aaccagcactcccaggg

SEQ ID NO: 1962608 - DNA, 18 bp, Homo sapiens
aaccagcactcccagggc

SEQ ID NO: 1962609 - DNA, 22 bp, Homo sapiens
aaccatgttcttgagcagctga

SEQ ID NO: 1962610 - DNA, 20 bp, Homo sapiens
aaccattgctaatttaaagg

SEQ ID NO: 1962611 - DNA, 15 bp, Homo sapiens
aaccctgaatcagag

SEQ ID NO: 1962612 - DNA, 19 bp, Homo sapiens
aacctctcagatccctcgg

SEQ ID NO: 1962613 - DNA, 19 bp, Homo sapiens
aacctctctgaactgcaac

SEQ ID NO: 1962614 - DNA, 15 bp, Homo sapiens
aacgtgaactaagat

SEQ ID NO: 1962615 - DNA, 15 bp, Homo sapiens
aactgaagcagagtc

SEQ ID NO: 1962616 - DNA, 13 bp, Homo sapiens
aactggccccagg

SEQ ID NO: 1962617 - DNA, 12 bp, Homo sapiens
aaaaaaatcaaa

SEQ ID NO: 1962618 - DNA, 12 bp, Homo sapiens
aaaaaataatat

SEQ ID NO: 1962619 - DNA, 22 bp, Homo sapiens
aaaaagcaggaaagatcccaag

SEQ ID NO: 1962620 - DNA, 23 bp, Homo sapiens
aaaaagcaggaaagatcccaagt

SEQ ID NO: 1962621 - DNA, 20 bp, Homo sapiens
aaaaagcttaaacattgcct

SEQ ID NO: 1962622 - DNA, 20 bp, Homo sapiens
aaaaataatataaatgaatg

SEQ ID NO: 1962623 - DNA, 18 bp, Homo sapiens
aaaaatcaaaaaattatc

SEQ ID NO: 1962624 - DNA, 16 bp, Homo sapiens
aaaaattatagactcc

SEQ ID NO: 1962625 - DNA, 15 bp, Homo sapiens
aaaaattatctttaa

SEQ ID NO: 1962626 - DNA, 20 bp, Homo sapiens
aaaaattatctttaaaactt

SEQ ID NO: 1962627 - DNA, 15 bp, Homo sapiens
aaaacaacagcaaca

SEQ ID NO: 1962628 - DNA, 20 bp, Homo sapiens
aaaacatcttaggcactttt

SEQ ID NO: 1962629 - DNA, 15 bp, Homo sapiens
aaaaccagaaagagg

SEQ ID NO: 1962630 - DNA, 17 bp, Homo sapiens
aaaaccattctgcttgg

SEQ ID NO: 1962631 - DNA, 16 bp, Homo sapiens
aaaacgatttaattta

SEQ ID NO: 1962632 - DNA, 17 bp, Homo sapiens
aaaacgatttaatttat

SEQ ID NO: 1962633 - DNA, 16 bp, Homo sapiens
aaaactatcagcagcg

SEQ ID NO: 1962634 - DNA, 17 bp, Homo sapiens
aaaactgtgacattcca

SEQ ID NO: 1962635 - DNA, 19 bp, Homo sapiens
aaaactgtgacattccaca

SEQ ID NO: 1962636 - DNA, 22 bp, Homo sapiens
aaaactgtgacattccacagag

SEQ ID NO: 1962637 - DNA, 18 bp, Homo sapiens
aaaactttccatgacagt

SEQ ID NO: 1962638 - DNA, 13 bp, Homo sapiens
aaaagacttcaaa

SEQ ID NO: 1962639 - DNA, 21 bp, Homo sapiens
aaaagaggattagtagaaaat

SEQ ID NO: 1962640 - DNA, 22 bp, Homo sapiens
aaaagatggatttgacacactc

SEQ ID NO: 1962641 - DNA, 14 bp, Homo sapiens
aaaagcacctcttg

SEQ ID NO: 1962642 - DNA, 16 bp, Homo sapiens
aaaagcacctcttgaa

SEQ ID NO: 1962643 - DNA, 15 bp, Homo sapiens
aaaagtgatgtgatt

SEQ ID NO: 1962644 - DNA, 17 bp, Homo sapiens
aaaagtgatgtgattta

SEQ ID NO: 1962645 - DNA, 19 bp, Homo sapiens
aaaagtgatgtgatttatg

SEQ ID NO: 1962646 - DNA, 16 bp, Homo sapiens
aaaagtgcagtagtgt

SEQ ID NO: 1962647 - DNA, 12 bp, Homo sapiens
aaaatacttctt

SEQ ID NO: 1962648 - DNA, 16 bp, Homo sapiens
aaaatagctataaata

SEQ ID NO: 1962649 - DNA, 15 bp, Homo sapiens
aaaataggatttgca

SEQ ID NO: 1962650 - DNA, 11 bp, Homo sapiens
aaaatatatgt

SEQ ID NO: 1962651 - DNA, 19 bp, Homo sapiens
aaaatatgagattggaaaa

SEQ ID NO: 1962652 - DNA, 18 bp, Homo sapiens
aaaatgtgccgtctttgg

SEQ ID NO: 1962653 - DNA, 15 bp, Homo sapiens
aaaatgtgtgcttgg

SEQ ID NO: 1962654 - DNA, 17 bp, Homo sapiens
aaagccctccctgtctg

SEQ ID NO: 1962655 - DNA, 16 bp, Homo sapiens
aaaggagcagctagct

SEQ ID NO: 1962656 - DNA, 16 bp, Homo sapiens
aaaggatgatttaaca

SEQ ID NO: 1962657 - DNA, 18 bp, Homo sapiens
aaaggcttgagtctggat

SEQ ID NO: 1962658 - DNA, 19 bp, Homo sapiens
aaaggcttgagtctggata

SEQ ID NO: 1962659 - DNA, 22 bp, Homo sapiens
aaaggtttcactgttcatgaat

SEQ ID NO: 1962660 - DNA, 22 bp, Homo sapiens
aaagtaatttcaagaatgtttc

SEQ ID NO: 1962661 - DNA, 14 bp, Homo sapiens
aaagtctcctgtat

SEQ ID NO: 1962662 - DNA, 18 bp, Homo sapiens
aaagttccagcagtttca

SEQ ID NO: 1962663 - DNA, 21 bp, Homo sapiens
aaagttccagcagtttcatga

SEQ ID NO: 1962664 - DNA, 14 bp, Homo sapiens
aaataaaaccagaa

SEQ ID NO: 1962665 - DNA, 18 bp, Homo sapiens
aaataatcatacacagaa

SEQ ID NO: 1962666 - DNA, 20 bp, Homo sapiens
aaatacatgatgatttcaga

SEQ ID NO: 1962667 - DNA, 23 bp, Homo sapiens
aaatagaaacaccttccagcttt

SEQ ID NO: 1962668 - DNA, 17 bp, Homo sapiens
aaatagatttttagatt

SEQ ID NO: 1962669 - DNA, 20 bp, Homo sapiens
aaatagctataaatagtgaa

SEQ ID NO: 1962670 - DNA, 13 bp, Homo sapiens
aaatagtgaaaat

SEQ ID NO: 1962671 - DNA, 17 bp, Homo sapiens
aaatatccctcatttca

SEQ ID NO: 1962672 - DNA, 17 bp, Homo sapiens
aaatatgagattggaaa

SEQ ID NO: 1962673 - DNA, 14 bp, Homo sapiens
aaatattagcaaag

SEQ ID NO: 1962674 - DNA, 19 bp, Homo sapiens
aaatcagcatttttcttta

SEQ ID NO: 1962675 - DNA, 15 bp, Homo sapiens
aaatcataatcatcc

SEQ ID NO: 1962676 - DNA, 21 bp, Homo sapiens
aaatctcaaaagatctcctgt

SEQ ID NO: 1962677 - DNA, 15 bp, Homo sapiens
aaatctgtattgcta

SEQ ID NO: 1962678 - DNA, 23 bp, Homo sapiens
aaatgaatgaaatataaactgtg

SEQ ID NO: 1962679 - DNA, 19 bp, Homo sapiens
aaatgatatgtctttaaaa

SEQ ID NO: 1962680 - DNA, 20 bp, Homo sapiens
aaatgatatgtctttaaaat

SEQ ID NO: 1962681 - DNA, 16 bp, Homo sapiens
aaatgattcagggtta

SEQ ID NO: 1962682 - DNA, 14 bp, Homo sapiens
aaatgctgatttaa

SEQ ID NO: 1962683 - DNA, 14 bp, Homo sapiens
aaatggatgtaata

SEQ ID NO: 1962684 - DNA, 18 bp, Homo sapiens
aaatggatgtaatatagg

SEQ ID NO: 1962685 - DNA, 14 bp, Homo sapiens
aaatggttttcaac

SEQ ID NO: 1962686 - DNA, 16 bp, Homo sapiens
aaatggttttcaacaa

SEQ ID NO: 1962687 - DNA, 18 bp, Homo sapiens
aaatgttattcaataact

SEQ ID NO: 1962688 - DNA, 15 bp, Homo sapiens
aaattatctttaaaa

SEQ ID NO: 1962689 - DNA, 18 bp, Homo sapiens
aaattatgtcaaatggat

SEQ ID NO: 1962690 - DNA, 19 bp, Homo sapiens
aaattattaaaaattatag

SEQ ID NO: 1962691 - DNA, 21 bp, Homo sapiens
aaattcttgcactgtatccaa

SEQ ID NO: 1962692 - DNA, 21 bp, Homo sapiens
aaattgacctcaaaagaaaat

SEQ ID NO: 1962693 - DNA, 13 bp, Homo sapiens
aaattgctgagat

SEQ ID NO: 1962694 - DNA, 20 bp, Homo sapiens
aaattgctgagatgtttagt

SEQ ID NO: 1962695 - DNA, 12 bp, Homo sapiens
aacaaaaacttt

SEQ ID NO: 1962696 - DNA, 16 bp, Homo sapiens
aacaaaaactttccat

SEQ ID NO: 1962697 - DNA, 21 bp, Homo sapiens
aacaaaaactttccatgacag

SEQ ID NO: 1962698 - DNA, 11 bp, Homo sapiens
aacaaaagata

SEQ ID NO: 1962699 - DNA, 14 bp, Homo sapiens
aacaaagcatgctc

SEQ ID NO: 1962700 - DNA, 15 bp, Homo sapiens
aacaaagcatgctca

SEQ ID NO: 1962701 - DNA, 17 bp, Homo sapiens
aacaacaaagcatgctc

SEQ ID NO: 1962702 - DNA, 20 bp, Homo sapiens
aacaattcaaagaatcacct

SEQ ID NO: 1962703 - DNA, 20 bp, Homo sapiens
aacaatttaggaatgctcaa

SEQ ID NO: 1962704 - DNA, 16 bp, Homo sapiens
aacacagtagtgttct

SEQ ID NO: 1962705 - DNA, 19 bp, Homo sapiens
aacacagtagtgttctgtt

SEQ ID NO: 1962706 - DNA, 18 bp, Homo sapiens
aacagaaaaggttctgaa

SEQ ID NO: 1962707 - DNA, 17 bp, Homo sapiens
aacagtaattactttca

SEQ ID NO: 1962708 - DNA, 22 bp, Homo sapiens
aacatcttaggcactttttaac

SEQ ID NO: 1962709 - DNA, 15 bp, Homo sapiens
aacattctatttcaa

SEQ ID NO: 1962710 - DNA, 20 bp, Homo sapiens
aacattttttgtttcttggt

SEQ ID NO: 1962711 - DNA, 21 bp, Homo sapiens
aacattttttgtttcttggtg

SEQ ID NO: 1962712 - DNA, 18 bp, Homo sapiens
aaccaaagaaaattggta

SEQ ID NO: 1962713 - DNA, 16 bp, Homo sapiens
aaccaatttgttctgt

SEQ ID NO: 1962714 - DNA, 15 bp, Homo sapiens
aaccagcactcccag

SEQ ID NO: 1962715 - DNA, 20 bp, Homo sapiens
aaccagcactcccagggccc

SEQ ID NO: 1962716 - DNA, 14 bp, Homo sapiens
aaccatgttcttga

SEQ ID NO: 1962717 - DNA, 12 bp, Homo sapiens
aacccccacctc

SEQ ID NO: 1962718 - DNA, 16 bp, Homo sapiens
aacccccacctcccgg

SEQ ID NO: 1962719 - DNA, 11 bp, Homo sapiens
aaccctgccct

SEQ ID NO: 1962720 - DNA, 11 bp, Homo sapiens
aacccttacag

SEQ ID NO: 1962721 - DNA, 16 bp, Homo sapiens
aacctaatgcagaatt

SEQ ID NO: 1962722 - DNA, 14 bp, Homo sapiens
aacgggcctccccg

SEQ ID NO: 1962723 - DNA, 16 bp, Homo sapiens
aactaattaaactgat

SEQ ID NO: 1962724 - DNA, 14 bp, Homo sapiens
aactattatattga

SEQ ID NO: 1962725 - DNA, 15 bp, Homo sapiens
aactattatattgag

SEQ ID NO: 1962726 - DNA, 13 bp, Homo sapiens
aactgacttgctg

SEQ ID NO: 1962727 - DNA, 15 bp, Homo sapiens
aactgcaacactgga

SEQ ID NO: 1962728 - DNA, 18 bp, Homo sapiens
aactgtgacattccacag

SEQ ID NO: 1962729 - DNA, 13 bp, Homo sapiens
aactgtgagataa

SEQ ID NO: 1962730 - DNA, 20 bp, Homo sapiens
aacttactatggtatatatt

SEQ ID NO: 1962731 - DNA, 12 bp, Homo sapiens
aacttgctgtga

SEQ ID NO: 1962732 - DNA, 14 bp, Homo sapiens
aacttgctgtgaaa

SEQ ID NO: 1962733 - DNA, 10 bp, Homo sapiens
aactttccat

SEQ ID NO: 1962734 - DNA, 14 bp, Homo sapiens
aactttccatgaca

SEQ ID NO: 1962735 - DNA, 16 bp, Homo sapiens
aactttccatgacagt

SEQ ID NO: 1962736 - DNA, 20 bp, Homo sapiens
aactttccatgacagtagca

SEQ ID NO: 1962737 - DNA, 21 bp, Homo sapiens
aactttccatgacagtagcat

SEQ ID NO: 1962738 - DNA, 17 bp, Homo sapiens
aacttttgggatttgtt

SEQ ID NO: 1962739 - DNA, 17 bp, Homo sapiens
aagaaaatgtgtaacag

SEQ ID NO: 1962740 - DNA, 14 bp, Homo sapiens
aagaaagatgctga

SEQ ID NO: 1962741 - DNA, 19 bp, Homo sapiens
aagaatttaccagaaatat

SEQ ID NO: 1962742 - DNA, 14 bp, Homo sapiens
aagaattttaaaaa

SEQ ID NO: 1962743 - DNA, 13 bp, Homo sapiens
aagacttcaaatg

SEQ ID NO: 1962744 - DNA, 18 bp, Homo sapiens
aagagaaaaagccctctt

SEQ ID NO: 1962745 - DNA, 19 bp, Homo sapiens
aagaggaaaatattgacaa

SEQ ID NO: 1962746 - DNA, 21 bp, Homo sapiens
aagatagctccttcatgcttt

SEQ ID NO: 1962747 - DNA, 17 bp, Homo sapiens
aagatatgaagaactat

SEQ ID NO: 1962748 - DNA, 14 bp, Homo sapiens
aagatgctgctgag

SEQ ID NO: 1962749 - DNA, 18 bp, Homo sapiens
aagatgctgctgagcaca

SEQ ID NO: 1962750 - DNA, 21 bp, Homo sapiens
aagatggatttgacacactca

SEQ ID NO: 1962751 - DNA, 22 bp, Homo sapiens
aagatttcctttggcaatatca

SEQ ID NO: 1962752 - DNA, 12 bp, Homo sapiens
aagcaaaacatt

SEQ ID NO: 1962753 - DNA, 20 bp, Homo sapiens
aagcaaatttctagatatga

SEQ ID NO: 1962754 - DNA, 15 bp, Homo sapiens
aagcaccagctgcct

SEQ ID NO: 1962755 - DNA, 21 bp, Homo sapiens
aagcacctcttgaagaactga

SEQ ID NO: 1962756 - DNA, 19 bp, Homo sapiens
aagcagagtcaagctgatg

SEQ ID NO: 1962757 - DNA, 22 bp, Homo sapiens
aagcagcagctagaaagagaaa

SEQ ID NO: 1962758 - DNA, 16 bp, Homo sapiens
aagcatgccaatttct

SEQ ID NO: 1962759 - DNA, 15 bp, Homo sapiens
aagcatgctcagtat

SEQ ID NO: 1962760 - DNA, 13 bp, Homo sapiens
aagcccacccgcc

SEQ ID NO: 1962761 - DNA, 18 bp, Homo sapiens
aagcccacccgccccaga

SEQ ID NO: 1962762 - DNA, 21 bp, Homo sapiens
aagccctccctgtctgtctgt

SEQ ID NO: 1962763 - DNA, 16 bp, Homo sapiens
aagcgttatctcttcc

SEQ ID NO: 1962764 - DNA, 18 bp, Homo sapiens
aagctgttagttaaaatc

SEQ ID NO: 1962765 - DNA, 13 bp, Homo sapiens
aaggacactgatg

SEQ ID NO: 1962766 - DNA, 17 bp, Homo sapiens
agtggaagaggtagtaa

SEQ ID NO: 1962767 - DNA, 20 bp, Homo sapiens
agtggggcccatggccccag

SEQ ID NO: 1962768 - DNA, 21 bp, Homo sapiens
agtgtcacttttttcctgtca

SEQ ID NO: 1962769 - DNA, 22 bp, Homo sapiens
agtgtcacttttttcctgtcaa

SEQ ID NO: 1962770 - DNA, 23 bp, Homo sapiens
agtgtcacttttttcctgtcaat

SEQ ID NO: 1962771 - DNA, 14 bp, Homo sapiens
agtgtcattattag

SEQ ID NO: 1962772 - DNA, 18 bp, Homo sapiens
agtgtggcttaaacattt

SEQ ID NO: 1962773 - DNA, 19 bp, Homo sapiens
agtgtggcttaaacatttt

SEQ ID NO: 1962774 - DNA, 13 bp, Homo sapiens
agtgtgtgtgcaa

SEQ ID NO: 1962775 - DNA, 17 bp, Homo sapiens
agtgtgtgtgcaatgtt

SEQ ID NO: 1962776 - DNA, 18 bp, Homo sapiens
agtgtgtgtgcaatgttc

SEQ ID NO: 1962777 - DNA, 19 bp, Homo sapiens
agtgttataaaatctgtat

SEQ ID NO: 1962778 - DNA, 22 bp, Homo sapiens
agttacatacatttaaaaaaca

SEQ ID NO: 1962779 - DNA, 23 bp, Homo sapiens
agttagcccggccaaggacactg

SEQ ID NO: 1962780 - DNA, 16 bp, Homo sapiens
agttcatagttggaaa

SEQ ID NO: 1962781 - DNA, 14 bp, Homo sapiens
agttccagcagttt

SEQ ID NO: 1962782 - DNA, 16 bp, Homo sapiens
agttccctcagccctc

SEQ ID NO: 1962783 - DNA, 22 bp, Homo sapiens
agttgccgcatattatatcaga

SEQ ID NO: 1962784 - DNA, 18 bp, Homo sapiens
agttgccgtggcaactgt

SEQ ID NO: 1962785 - DNA, 14 bp, Homo sapiens
agttggaaatattt

SEQ ID NO: 1962786 - DNA, 17 bp, Homo sapiens
agttggcagagaaaatg

SEQ ID NO: 1962787 - DNA, 23 bp, Homo sapiens
agttgtgcctcatttatttattg

SEQ ID NO: 1962788 - DNA, 12 bp, Homo sapiens
ataaaaccagaa

SEQ ID NO: 1962789 - DNA, 12 bp, Homo sapiens
ataaaagaaaga

SEQ ID NO: 1962790 - DNA, 10 bp, Homo sapiens
ataaactgtg

SEQ ID NO: 1962791 - DNA, 17 bp, Homo sapiens
ataaactgtgagataaa

SEQ ID NO: 1962792 - DNA, 20 bp, Homo sapiens
ataaactgtgagataaatat

SEQ ID NO: 1962793 - DNA, 16 bp, Homo sapiens
ataaataaaagaaaga

SEQ ID NO: 1962794 - DNA, 22 bp, Homo sapiens
ataaatagtgaaaattttattg

SEQ ID NO: 1962795 - DNA, 13 bp, Homo sapiens
ataaatcaaaatt

SEQ ID NO: 1962796 - DNA, 12 bp, Homo sapiens
ataacaacaatt

SEQ ID NO: 1962797 - DNA, 14 bp, Homo sapiens
ataacaacaattta

SEQ ID NO: 1962798 - DNA, 12 bp, Homo sapiens
ataacattgtaa

SEQ ID NO: 1962799 - DNA, 17 bp, Homo sapiens
ataactcaccatcttga

SEQ ID NO: 1962800 - DNA, 14 bp, Homo sapiens
ataatataaatgaa

SEQ ID NO: 1962801 - DNA, 15 bp, Homo sapiens
ataatataaatgaat

SEQ ID NO: 1962802 - DNA, 17 bp, Homo sapiens
ataatataaatgaatga

SEQ ID NO: 1962803 - DNA, 19 bp, Homo sapiens
ataatataaatgaatgaaa

SEQ ID NO: 1962804 - DNA, 21 bp, Homo sapiens
ataatcatccttttttaaaaa

SEQ ID NO: 1962805 - DNA, 12 bp, Homo sapiens
ataattaaaaca

SEQ ID NO: 1962806 - DNA, 13 bp, Homo sapiens
ataattaaaacaa

SEQ ID NO: 1962807 - DNA, 16 bp, Homo sapiens
atacatgatgatttca

SEQ ID NO: 1962808 - DNA, 20 bp, Homo sapiens
atacatttaaaaaacatttt

SEQ ID NO: 1962809 - DNA, 21 bp, Homo sapiens
atacatttaaaaaacatttta

SEQ ID NO: 1962810 - DNA, 12 bp, Homo sapiens
ataccagcaaaa

SEQ ID NO: 1962811 - DNA, 17 bp, Homo sapiens
ataccagcaaaagtgca

SEQ ID NO: 1962812 - DNA, 17 bp, Homo sapiens
atactgatgagacaaca

SEQ ID NO: 1962813 - DNA, 20 bp, Homo sapiens
atactgatgagacaacacac

SEQ ID NO: 1962814 - DNA, 18 bp, Homo sapiens
atacttgacaacattttt

SEQ ID NO: 1962815 - DNA, 17 bp, Homo sapiens
atagataccattttgaa

SEQ ID NO: 1962816 - DNA, 18 bp, Homo sapiens
atagctataaatagtgaa

SEQ ID NO: 1962817 - DNA, 19 bp, Homo sapiens
atagctccttcatgctttt

SEQ ID NO: 1962818 - DNA, 23 bp, Homo sapiens
ataggcttgtgtaatttcctgct

SEQ ID NO: 1962819 - DNA, 12 bp, Homo sapiens
atagtgaaaatt

SEQ ID NO: 1962820 - DNA, 19 bp, Homo sapiens
atagtgaaaattttattga

SEQ ID NO: 1962821 - DNA, 14 bp, Homo sapiens
atagtgtgtccatg

SEQ ID NO: 1962822 - DNA, 21 bp, Homo sapiens
atagttcatagttggaaatat

SEQ ID NO: 1962823 - DNA, 19 bp, Homo sapiens
atagttggaaatatttgcg

SEQ ID NO: 1962824 - DNA, 15 bp, Homo sapiens
atagttgtcagaata

SEQ ID NO: 1962825 - DNA, 14 bp, Homo sapiens
atataaaaaatgtt

SEQ ID NO: 1962826 - DNA, 12 bp, Homo sapiens
atataaaaataa

SEQ ID NO: 1962827 - DNA, 16 bp, Homo sapiens
atataaactgtgagat

SEQ ID NO: 1962828 - DNA, 15 bp, Homo sapiens
atataaatgaatgaa

SEQ ID NO: 1962829 - DNA, 21 bp, Homo sapiens
atataatggcctcttaaaaat

SEQ ID NO: 1962830 - DNA, 12 bp, Homo sapiens
atatatatctga

SEQ ID NO: 1962831 - DNA, 18 bp, Homo sapiens
atatattttgaaaggaga

SEQ ID NO: 1962832 - DNA, 19 bp, Homo sapiens
atatcaagaatagttgtca

SEQ ID NO: 1962833 - DNA, 18 bp, Homo sapiens
atatcaaggagctcttct

SEQ ID NO: 1962834 - DNA, 18 bp, Homo sapiens
atatcattatagcatgta

SEQ ID NO: 1962835 - DNA, 15 bp, Homo sapiens
atatctgagttgtgc

SEQ ID NO: 1962836 - DNA, 22 bp, Homo sapiens
atatgaagaactattatattga

SEQ ID NO: 1962837 - DNA, 16 bp, Homo sapiens
atatgagattggaaaa

SEQ ID NO: 1962838 - DNA, 18 bp, Homo sapiens
atatgagattggaaaaaa

SEQ ID NO: 1962839 - DNA, 12 bp, Homo sapiens
atatgtgcccct

SEQ ID NO: 1962840 - DNA, 21 bp, Homo sapiens
atatgtttggctgaaattatg

SEQ ID NO: 1962841 - DNA, 13 bp, Homo sapiens
atattatatcaga

SEQ ID NO: 1962842 - DNA, 14 bp, Homo sapiens
atattcccatggta

SEQ ID NO: 1962843 - DNA, 23 bp, Homo sapiens
atattcctacaaagaaaaaagaa

SEQ ID NO: 1962844 - DNA, 14 bp, Homo sapiens
atattgtaactcac

SEQ ID NO: 1962845 - DNA, 13 bp, Homo sapiens
atcaactcatgtt

SEQ ID NO: 1962846 - DNA, 24 bp, Homo sapiens
atcaagaatagttgtcagaatatg

SEQ ID NO: 1962847 - DNA, 15 bp, Homo sapiens
atcaaggagggagaa

SEQ ID NO: 1962848 - DNA, 15 bp, Homo sapiens
atcaagggaggaagg

SEQ ID NO: 1962849 - DNA, 14 bp, Homo sapiens
atcacgggcccgct

SEQ ID NO: 1962850 - DNA, 15 bp, Homo sapiens
atcacgggcccgctc

SEQ ID NO: 1962851 - DNA, 22 bp, Homo sapiens
atcaggaaaggaagatgtaaga

SEQ ID NO: 1962852 - DNA, 13 bp, Homo sapiens
atcagtacaattc

SEQ ID NO: 1962853 - DNA, 14 bp, Homo sapiens
atcagtacaattct

SEQ ID NO: 1962854 - DNA, 19 bp, Homo sapiens
atcatctattgagtgtaca

SEQ ID NO: 1962855 - DNA, 18 bp, Homo sapiens
atcatgacttctttacta

SEQ ID NO: 1962856 - DNA, 16 bp, Homo sapiens
atcatgggaattttaa

SEQ ID NO: 1962857 - DNA, 20 bp, Homo sapiens
atcatgggaattttaacttt

SEQ ID NO: 1962858 - DNA, 20 bp, Homo sapiens
atcatttccagcaaaatata

SEQ ID NO: 1962859 - DNA, 14 bp, Homo sapiens
atcattttgggaaa

SEQ ID NO: 1962860 - DNA, 17 bp, Homo sapiens
atccacagtattgttct

SEQ ID NO: 1962861 - DNA, 19 bp, Homo sapiens
atccagtagagatttccca

SEQ ID NO: 1962862 - DNA, 18 bp, Homo sapiens
atcccaagtcaaacagtg

SEQ ID NO: 1962863 - DNA, 21 bp, Homo sapiens
atcccactgatatcacgggcc

SEQ ID NO: 1962864 - DNA, 22 bp, Homo sapiens
atccccaccctcccctctcctg

SEQ ID NO: 1962865 - DNA, 21 bp, Homo sapiens
atccctcggtcagcaccgtgg

SEQ ID NO: 1962866 - DNA, 23 bp, Homo sapiens
atcctagcactttgggaggctga

SEQ ID NO: 1962867 - DNA, 17 bp, Homo sapiens
atccttcacaatttcaa

SEQ ID NO: 1962868 - DNA, 19 bp, Homo sapiens
atccttcacaatttcaatg

SEQ ID NO: 1962869 - DNA, 17 bp, Homo sapiens
atccttcccgcagcacc

SEQ ID NO: 1962870 - DNA, 18 bp, Homo sapiens
atccttcccgcagcacca

SEQ ID NO: 1962871 - DNA, 19 bp, Homo sapiens
atccttcccgcagcaccag

SEQ ID NO: 1962872 - DNA, 15 bp, Homo sapiens
atccttgtcagttgt

SEQ ID NO: 1962873 - DNA, 18 bp, Homo sapiens
atctagagctatgcacac

SEQ ID NO: 1962874 - DNA, 20 bp, Homo sapiens
atctagagctatgcacacca

SEQ ID NO: 1962875 - DNA, 17 bp, Homo sapiens
atctatagcatttaaag

SEQ ID NO: 1962876 - DNA, 23 bp, Homo sapiens
atctcaaaagatctcctgtgcac

SEQ ID NO: 1962877 - DNA, 12 bp, Homo sapiens
atctctgtaaaa

SEQ ID NO: 1962878 - DNA, 13 bp, Homo sapiens
attattagaatat

SEQ ID NO: 1962879 - DNA, 13 bp, Homo sapiens
attatttttcaat

SEQ ID NO: 1962880 - DNA, 14 bp, Homo sapiens
attatttttcaatt

SEQ ID NO: 1962881 - DNA, 22 bp, Homo sapiens
attatttttcaattatgtttga

SEQ ID NO: 1962882 - DNA, 15 bp, Homo sapiens
attcacttttattgt

SEQ ID NO: 1962883 - DNA, 17 bp, Homo sapiens
attcacttttattgtat

SEQ ID NO: 1962884 - DNA, 12 bp, Homo sapiens
attcagaaatat

SEQ ID NO: 1962885 - DNA, 20 bp, Homo sapiens
attcccatggtagactgtga

SEQ ID NO: 1962886 - DNA, 21 bp, Homo sapiens
attcccatggtagactgtgac

SEQ ID NO: 1962887 - DNA, 18 bp, Homo sapiens
attcccttcaatgcaaaa

SEQ ID NO: 1962888 - DNA, 17 bp, Homo sapiens
attcctcccctggaagt

SEQ ID NO: 1962889 - DNA, 23 bp, Homo sapiens
attctacctggctacaattactt

SEQ ID NO: 1962890 - DNA, 14 bp, Homo sapiens
attctcttaaattt

SEQ ID NO: 1962891 - DNA, 17 bp, Homo sapiens
attctgtcaatgaaaag

SEQ ID NO: 1962892 - DNA, 14 bp, Homo sapiens
attgacaagtttaa

SEQ ID NO: 1962893 - DNA, 10 bp, Homo sapiens
attgacattt

SEQ ID NO: 1962894 - DNA, 16 bp, Homo sapiens
attgacctcaaaagaa

SEQ ID NO: 1962895 - DNA, 17 bp, Homo sapiens
attgaggcctgtcctct

SEQ ID NO: 1962896 - DNA, 16 bp, Homo sapiens
attgagtgttctagtt

SEQ ID NO: 1962897 - DNA, 21 bp, Homo sapiens
attgatacaacaggattttca

SEQ ID NO: 1962898 - DNA, 22 bp, Homo sapiens
attgatacaacaggattttcaa

SEQ ID NO: 1962899 - DNA, 14 bp, Homo sapiens
attgccaaatatta

SEQ ID NO: 1962900 - DNA, 21 bp, Homo sapiens
attgccaaatattaagaagct

SEQ ID NO: 1962901 - DNA, 13 bp, Homo sapiens
attgctgagatgt

SEQ ID NO: 1962902 - DNA, 21 bp, Homo sapiens
attgctgagatgtttagtagc

SEQ ID NO: 1962903 - DNA, 14 bp, Homo sapiens
attgctgtaaataa

SEQ ID NO: 1962904 - DNA, 14 bp, Homo sapiens
attgcttctctaaa

SEQ ID NO: 1962905 - DNA, 14 bp, Homo sapiens
attggatcaggaac

SEQ ID NO: 1962906 - DNA, 20 bp, Homo sapiens
attggcaatacctagtgata

SEQ ID NO: 1962907 - DNA, 23 bp, Homo sapiens
attgggtaagggactccagaagc

SEQ ID NO: 1962908 - DNA, 22 bp, Homo sapiens
attggtacttacccttctacaa

SEQ ID NO: 1962909 - DNA, 23 bp, Homo sapiens
attgtgaatgttgtcctgtgtca

SEQ ID NO: 1962910 - DNA, 16 bp, Homo sapiens
attgttcagaaaagca

SEQ ID NO: 1962911 - DNA, 23 bp, Homo sapiens
attgttcagaaaagcacctcttg

SEQ ID NO: 1962912 - DNA, 20 bp, Homo sapiens
attgttcttgtaaaactgtg

SEQ ID NO: 1962913 - DNA, 22 bp, Homo sapiens
attgttcttgtaaaactgtgac

SEQ ID NO: 1962914 - DNA, 22 bp, Homo sapiens
attgtttcctaaatcagcattt

SEQ ID NO: 1962915 - DNA, 16 bp, Homo sapiens
atttaaaaaacatttt

SEQ ID NO: 1962916 - DNA, 22 bp, Homo sapiens
atttaagaatttaccagaaata

SEQ ID NO: 1962917 - DNA, 12 bp, Homo sapiens
atttacagtgat

SEQ ID NO: 1962918 - DNA, 23 bp, Homo sapiens
atttacagtgatagaacaaaaga

SEQ ID NO: 1962919 - DNA, 13 bp, Homo sapiens
atttaccagaaat

SEQ ID NO: 1962920 - DNA, 14 bp, Homo sapiens
atttaccagaaata

SEQ ID NO: 1962921 - DNA, 17 bp, Homo sapiens
atttagctaacaaaaga

SEQ ID NO: 1962922 - DNA, 17 bp, Homo sapiens
atttataacattgtaaa

SEQ ID NO: 1962923 - DNA, 16 bp, Homo sapiens
atttatgcatgagaac

SEQ ID NO: 1962924 - DNA, 22 bp, Homo sapiens
atttatgcatgagaactaaata

SEQ ID NO: 1962925 - DNA, 16 bp, Homo sapiens
atttcaagaatgtttc

SEQ ID NO: 1962926 - DNA, 17 bp, Homo sapiens
atttcaagaatgtttca

SEQ ID NO: 1962927 - DNA, 19 bp, Homo sapiens
atttcaagaatgtttcagt

SEQ ID NO: 1962928 - DNA, 12 bp, Homo sapiens
atttcaatgctt

SEQ ID NO: 1962929 - DNA, 18 bp, Homo sapiens
atttcagctgtgagcttt

SEQ ID NO: 1962930 - DNA, 16 bp, Homo sapiens
atttcatgattagaca

SEQ ID NO: 1962931 - DNA, 17 bp, Homo sapiens
atttcatgattagacaa

SEQ ID NO: 1962932 - DNA, 23 bp, Homo sapiens
atttcatgattagacaatgtgga

SEQ ID NO: 1962933 - DNA, 16 bp, Homo sapiens
atttcattatttttca

SEQ ID NO: 1962934 - DNA, 17 bp, Homo sapiens
atttcattatttttcaa

SEQ ID NO: 1962935 - DNA, 16 bp, Homo sapiens
atttcccctgtggttt

SEQ ID NO: 1962936 - DNA, 14 bp, Homo sapiens
atttgacacactca

SEQ ID NO: 1962937 - DNA, 17 bp, Homo sapiens
atttgaggggaaaaaac

SEQ ID NO: 1962938 - DNA, 20 bp, Homo sapiens
atttgcacacaaaacatctt

SEQ ID NO: 1962939 - DNA, 15 bp, Homo sapiens
atttgcactgcttta

SEQ ID NO: 1962940 - DNA, 22 bp, Homo sapiens
atttgcgtaaatggttttcaac

SEQ ID NO: 1962941 - DNA, 13 bp, Homo sapiens
atttgctgaataa

SEQ ID NO: 1962942 - DNA, 19 bp, Homo sapiens
atttgctgaataacaacaa

SEQ ID NO: 1962943 - DNA, 18 bp, Homo sapiens
atttgttgaaatcttttt

SEQ ID NO: 1962944 - DNA, 24 bp, Homo sapiens
attttaaaaaagatggatttgaca

SEQ ID NO: 1962945 - DNA, 14 bp, Homo sapiens
attttaattcaggt

SEQ ID NO: 1962946 - DNA, 17 bp, Homo sapiens
attttaattcaggtgat

SEQ ID NO: 1962947 - DNA, 16 bp, Homo sapiens
attttagctaatttag

SEQ ID NO: 1962948 - DNA, 20 bp, Homo sapiens
attttataaggctgactctt

SEQ ID NO: 1962949 - DNA, 15 bp, Homo sapiens
attttattgaatata

SEQ ID NO: 1962950 - DNA, 11 bp, Homo sapiens
attttcaagtt

SEQ ID NO: 1962951 - DNA, 18 bp, Homo sapiens
attttcaagttattcaga

SEQ ID NO: 1962952 - DNA, 20 bp, Homo sapiens
attttcaagttattcagaaa

SEQ ID NO: 1962953 - DNA, 12 bp, Homo sapiens
attttgtagcta

SEQ ID NO: 1962954 - DNA, 21 bp, Homo sapiens
attttgttatagttcatagtt

SEQ ID NO: 1962955 - DNA, 16 bp, Homo sapiens
atttttcaattatgtt

SEQ ID NO: 1962956 - DNA, 16 bp, Homo sapiens
attttttttttcaggt

SEQ ID NO: 1962957 - DNA, 18 bp, Homo sapiens
caaaacaacagcaacaac

SEQ ID NO: 1962958 - DNA, 20 bp, Homo sapiens
caaaacaacagcaacaacaa

SEQ ID NO: 1962959 - DNA, 23 bp, Homo sapiens
caaaagaggattagtagaaaata

SEQ ID NO: 1962960 - DNA, 16 bp, Homo sapiens
caaaagatatgaagaa

SEQ ID NO: 1962961 - DNA, 14 bp, Homo sapiens
caaaaggatgattt

SEQ ID NO: 1962962 - DNA, 15 bp, Homo sapiens
caaaataaaaccaga

SEQ ID NO: 1962963 - DNA, 19 bp, Homo sapiens
caaaatacatgatgatttc

SEQ ID NO: 1962964 - DNA, 23 bp, Homo sapiens
caaacagtgtggcttaaacattt

SEQ ID NO: 1962965 - DNA, 10 bp, Homo sapiens
caaacattta

SEQ ID NO: 1962966 - DNA, 14 bp, Homo sapiens
caaacgaaatggct

SEQ ID NO: 1962967 - DNA, 14 bp, Homo sapiens
caaacttaacagat

SEQ ID NO: 1962968 - DNA, 22 bp, Homo sapiens
caaagaatcacctaattaattt

SEQ ID NO: 1962969 - DNA, 13 bp, Homo sapiens
caaagagtagaac

SEQ ID NO: 1962970 - DNA, 18 bp, Homo sapiens
caaagagtagaactttaa

SEQ ID NO: 1962971 - DNA, 16 bp, Homo sapiens
caaagcatgctcagta

SEQ ID NO: 1962972 - DNA, 16 bp, Homo sapiens
caaagccctccctgtc

SEQ ID NO: 1962973 - DNA, 16 bp, Homo sapiens
caaaggttgtacatag

SEQ ID NO: 1962974 - DNA, 13 bp, Homo sapiens
caaataaccctga

SEQ ID NO: 1962975 - DNA, 14 bp, Homo sapiens
caaataatttagaa

SEQ ID NO: 1962976 - DNA, 16 bp, Homo sapiens
caaatgatttcgtgac

SEQ ID NO: 1962977 - DNA, 12 bp, Homo sapiens
caaattgctgag

SEQ ID NO: 1962978 - DNA, 17 bp, Homo sapiens
caacaaagcatgctcag

SEQ ID NO: 1962979 - DNA, 19 bp, Homo sapiens
caacaaagcatgctcagta

SEQ ID NO: 1962980 - DNA, 22 bp, Homo sapiens
caacaaagcatgctcagtattg

SEQ ID NO: 1962981 - DNA, 13 bp, Homo sapiens
caacaacagaaca

SEQ ID NO: 1962982 - DNA, 19 bp, Homo sapiens
caacaacagaacaacaaca

SEQ ID NO: 1962983 - DNA, 23 bp, Homo sapiens
caacaagcctgaaagtaatttca

SEQ ID NO: 1962984 - DNA, 20 bp, Homo sapiens
caacaatactttgtgtcttt

SEQ ID NO: 1962985 - DNA, 20 bp, Homo sapiens
caacaatttaggaatgctca

SEQ ID NO: 1962986 - DNA, 13 bp, Homo sapiens
caacacacacaca

SEQ ID NO: 1962987 - DNA, 15 bp, Homo sapiens
caaccaaagaaaatt

SEQ ID NO: 1962988 - DNA, 12 bp, Homo sapiens
caacccccacct

SEQ ID NO: 1962989 - DNA, 17 bp, Homo sapiens
caaccctgccctgcacc

SEQ ID NO: 1962990 - DNA, 13 bp, Homo sapiens
cctgagctccacc

SEQ ID NO: 1962991 - DNA, 13 bp, Homo sapiens
cctgagggaagcc

SEQ ID NO: 1962992 - DNA, 15 bp, Homo sapiens
cctgagggaagccca

SEQ ID NO: 1962993 - DNA, 17 bp, Homo sapiens
cctgagggaagcccacc

SEQ ID NO: 1962994 - DNA, 19 bp, Homo sapiens
cctgagggaagcccacccg

SEQ ID NO: 1962995 - DNA, 18 bp, Homo sapiens
cctgcaccttgggcacgg

SEQ ID NO: 1962996 - DNA, 18 bp, Homo sapiens
cctgcccagttagcccgg

SEQ ID NO: 1962997 - DNA, 20 bp, Homo sapiens
cctgcccagttagcccggcc

SEQ ID NO: 1962998 - DNA, 15 bp, Homo sapiens
cctgccccatgaaac

SEQ ID NO: 1962999 - DNA, 13 bp, Homo sapiens
cctgcccgcccgc

SEQ ID NO: 1963000 - DNA, 17 bp, Homo sapiens
cctgccctcccccacgg

SEQ ID NO: 1963001 - DNA, 23 bp, Homo sapiens
cctgcctggaggagaaggaggaa

SEQ ID NO: 1963002 - DNA, 15 bp, Homo sapiens
cctgcgctcctctgc

SEQ ID NO: 1963003 - DNA, 16 bp, Homo sapiens
cctgcgctcctctgca

SEQ ID NO: 1963004 - DNA, 18 bp, Homo sapiens
cctgctcacgtctgtgag

SEQ ID NO: 1963005 - DNA, 18 bp, Homo sapiens
cctgctgctcgggaaggc

SEQ ID NO: 1963006 - DNA, 15 bp, Homo sapiens
cctggaggagaagga

SEQ ID NO: 1963007 - DNA, 21 bp, Homo sapiens
cctggcgggcagcccctgctg

SEQ ID NO: 1963008 - DNA, 12 bp, Homo sapiens
cctgggcctccc

SEQ ID NO: 1963009 - DNA, 16 bp, Homo sapiens
cctgggcctcccgtcc

SEQ ID NO: 1963010 - DNA, 21 bp, Homo sapiens
cctgtaggtctatgatgtcca

SEQ ID NO: 1963011 - DNA, 23 bp, Homo sapiens
cctgtcaatatatagagacttct

SEQ ID NO: 1963012 - DNA, 13 bp, Homo sapiens
cctgtcctgctca

SEQ ID NO: 1963013 - DNA, 17 bp, Homo sapiens
cctgtctcctctgtcag

SEQ ID NO: 1963014 - DNA, 20 bp, Homo sapiens
cctgtctctccctaccctct

SEQ ID NO: 1963015 - DNA, 14 bp, Homo sapiens
cctgtgggagtcca

SEQ ID NO: 1963016 - DNA, 14 bp, Homo sapiens
cctgtgtcatctgt

SEQ ID NO: 1963017 - DNA, 16 bp, Homo sapiens
cctgtgtcatctgtca

SEQ ID NO: 1963018 - DNA, 15 bp, Homo sapiens
cctgtttttcctttt

SEQ ID NO: 1963019 - DNA, 17 bp, Homo sapiens
ccttagtacctttttaa

SEQ ID NO: 1963020 - DNA, 16 bp, Homo sapiens
ccttatcataaattca

SEQ ID NO: 1963021 - DNA, 16 bp, Homo sapiens
ccttcaattatttccc

SEQ ID NO: 1963022 - DNA, 19 bp, Homo sapiens
ccttcccgcagcaccagcc

SEQ ID NO: 1963023 - DNA, 15 bp, Homo sapiens
ccttcctgtcctgct

SEQ ID NO: 1963024 - DNA, 16 bp, Homo sapiens
ccttcctgtcctgctc

SEQ ID NO: 1963025 - DNA, 12 bp, Homo sapiens
ccttctcccctc

SEQ ID NO: 1963026 - DNA, 21 bp, Homo sapiens
ccttctgtgcatctggcctgg

SEQ ID NO: 1963027 - DNA, 22 bp, Homo sapiens
ccttctgtgcatctggcctggg

SEQ ID NO: 1963028 - DNA, 20 bp, Homo sapiens
ccttgattttaattcaggtg

SEQ ID NO: 1963029 - DNA, 18 bp, Homo sapiens
ccttgggcacgggagagc

SEQ ID NO: 1963030 - DNA, 18 bp, Homo sapiens
ccttgtgatcactttctg

SEQ ID NO: 1963031 - DNA, 20 bp, Homo sapiens
ccttgtgatcactttctgaa

SEQ ID NO: 1963032 - DNA, 18 bp, Homo sapiens
ccttttttaaaaaaaaga

SEQ ID NO: 1963033 - DNA, 15 bp, Homo sapiens
cgagagggctgagcc

SEQ ID NO: 1963034 - DNA, 16 bp, Homo sapiens
cgagagggctgagccc

SEQ ID NO: 1963035 - DNA, 21 bp, Homo sapiens
cgagagggctgagcccctcct

SEQ ID NO: 1963036 - DNA, 17 bp, Homo sapiens
cgagcgcgtgccttccc

SEQ ID NO: 1963037 - DNA, 22 bp, Homo sapiens
cgcaaggatcacttgagcccag

SEQ ID NO: 1963038 - DNA, 16 bp, Homo sapiens
cgcagacagacagaca

SEQ ID NO: 1963039 - DNA, 19 bp, Homo sapiens
cgcagagccccggagcacc

SEQ ID NO: 1963040 - DNA, 16 bp, Homo sapiens
cgcagcaccagcctga

SEQ ID NO: 1963041 - DNA, 18 bp, Homo sapiens
cgcagcaccagcctgagc

SEQ ID NO: 1963042 - DNA, 16 bp, Homo sapiens
cgcagccgcgctctgc

SEQ ID NO: 1963043 - DNA, 20 bp, Homo sapiens
cgcagggcgctccggcagag

SEQ ID NO: 1963044 - DNA, 21 bp, Homo sapiens
cgcagggcgctccggcagagg

SEQ ID NO: 1963045 - DNA, 23 bp, Homo sapiens
cgcagggcgctccggcagaggca

SEQ ID NO: 1963046 - DNA, 11 bp, Homo sapiens
cgccacccgcc

SEQ ID NO: 1963047 - DNA, 17 bp, Homo sapiens
cgcccaacccccacctc

SEQ ID NO: 1963048 - DNA, 14 bp, Homo sapiens
cgcccacccacacc

SEQ ID NO: 1963049 - DNA, 10 bp, Homo sapiens
cgcccacccc

SEQ ID NO: 1963050 - DNA, 19 bp, Homo sapiens
cgcccaccccgctgcctgg

SEQ ID NO: 1963051 - DNA, 15 bp, Homo sapiens
cgcccacctgcccag

SEQ ID NO: 1963052 - DNA, 17 bp, Homo sapiens
cgcccacctgcccagtt

SEQ ID NO: 1963053 - DNA, 20 bp, Homo sapiens
cgccccagagactgcccacc

SEQ ID NO: 1963054 - DNA, 21 bp, Homo sapiens
cgccccagagactgcccaccc

SEQ ID NO: 1963055 - DNA, 14 bp, Homo sapiens
cgcccctcctcggg

SEQ ID NO: 1963056 - DNA, 12 bp, Homo sapiens
cgcccgcccacc

SEQ ID NO: 1963057 - DNA, 23 bp, Homo sapiens
cgcccgcccaccccgctgcctgg

SEQ ID NO: 1963058 - DNA, 15 bp, Homo sapiens
cgcccgccctcctct

SEQ ID NO: 1963059 - DNA, 22 bp, Homo sapiens
cgcccgccctcctctgccccct

SEQ ID NO: 1963060 - DNA, 12 bp, Homo sapiens
cgccctcctctg

SEQ ID NO: 1963061 - DNA, 16 bp, Homo sapiens
cgccgcctcgggccgc

SEQ ID NO: 1963062 - DNA, 18 bp, Homo sapiens
cgccggggctggccctgc

SEQ ID NO: 1963063 - DNA, 19 bp, Homo sapiens
cgccggttggccggctggc

SEQ ID NO: 1963064 - DNA, 16 bp, Homo sapiens
cgcctcccgccgcctc

SEQ ID NO: 1963065 - DNA, 15 bp, Homo sapiens
cgcctcctccagact

SEQ ID NO: 1963066 - DNA, 20 bp, Homo sapiens
cgcctcgggccgcctcctcc

SEQ ID NO: 1963067 - DNA, 23 bp, Homo sapiens
cgcctcgggccgcctcctccaga

SEQ ID NO: 1963068 - DNA, 18 bp, Homo sapiens
cgcctgcgctcctctgca

SEQ ID NO: 1963069 - DNA, 23 bp, Homo sapiens
cgcctgcgctcctctgcagcctg

SEQ ID NO: 1963070 - DNA, 21 bp, Homo sapiens
cgcgcaccgcccaacccccac

SEQ ID NO: 1963071 - DNA, 17 bp, Homo sapiens
cgcgcgtgcccccagcg

SEQ ID NO: 1963072 - DNA, 14 bp, Homo sapiens
cgcgctctgcccct

SEQ ID NO: 1963073 - DNA, 17 bp, Homo sapiens
cgcgctctgcccctccg

SEQ ID NO: 1963074 - DNA, 14 bp, Homo sapiens
cgcgtgcccccagc

SEQ ID NO: 1963075 - DNA, 16 bp, Homo sapiens
cgcgtgcccccagcgt

SEQ ID NO: 1963076 - DNA, 13 bp, Homo sapiens
cgcgtgccttccc

SEQ ID NO: 1963077 - DNA, 15 bp, Homo sapiens
cgctcaacctctcag

SEQ ID NO: 1963078 - DNA, 17 bp, Homo sapiens
cgctccggcagaggcag

SEQ ID NO: 1963079 - DNA, 22 bp, Homo sapiens
cgctccggcagaggcagggccc

SEQ ID NO: 1963080 - DNA, 23 bp, Homo sapiens
cgctccgggtgcgtgaccggccc

SEQ ID NO: 1963081 - DNA, 12 bp, Homo sapiens
cgctcctctgca

SEQ ID NO: 1963082 - DNA, 15 bp, Homo sapiens
cgctcctctgcagcc

SEQ ID NO: 1963083 - DNA, 17 bp, Homo sapiens
cgctcctctgcagcctg

SEQ ID NO: 1963084 - DNA, 17 bp, Homo sapiens
cgctgcctggcgggcag

SEQ ID NO: 1963085 - DNA, 22 bp, Homo sapiens
cgctgcctggcgggcagcccct

SEQ ID NO: 1963086 - DNA, 15 bp, Homo sapiens
cggaccggagcggct

SEQ ID NO: 1963087 - DNA, 19 bp, Homo sapiens
cggaccggagcggctgagg

SEQ ID NO: 1963088 - DNA, 13 bp, Homo sapiens
cggacgctggctc

SEQ ID NO: 1963089 - DNA, 14 bp, Homo sapiens
cggagcggctgagg

SEQ ID NO: 1963090 - DNA, 16 bp, Homo sapiens
cggagcggctgaggac

SEQ ID NO: 1963091 - DNA, 16 bp, Homo sapiens
cggaggcgcccacctg

SEQ ID NO: 1963092 - DNA, 18 bp, Homo sapiens
cggaggcgcccacctgcc

SEQ ID NO: 1963093 - DNA, 17 bp, Homo sapiens
cggaggggcttggagca

SEQ ID NO: 1963094 - DNA, 13 bp, Homo sapiens
cggcaccgcccac

SEQ ID NO: 1963095 - DNA, 17 bp, Homo sapiens
cggcaccgcccacccac

SEQ ID NO: 1963096 - DNA, 21 bp, Homo sapiens
cggcaccgcccacccacaccc

SEQ ID NO: 1963097 - DNA, 19 bp, Homo sapiens
cggcagaggcagggccctg

SEQ ID NO: 1963098 - DNA, 22 bp, Homo sapiens
cggcagaggcagggccctgggg

SEQ ID NO: 1963099 - DNA, 12 bp, Homo sapiens
cggcagccccat

SEQ ID NO: 1963100 - DNA, 19 bp, Homo sapiens
cggcagccccatccttccc

SEQ ID NO: 1963101 - DNA, 15 bp, Homo sapiens
cggccaaggacactg

SEQ ID NO: 1963102 - DNA, 13 bp, Homo sapiens
cttcccaacaata

SEQ ID NO: 1963103 - DNA, 21 bp, Homo sapiens
cttcccaacaatactttgtgt

SEQ ID NO: 1963104 - DNA, 15 bp, Homo sapiens
cttcccagctggcag

SEQ ID NO: 1963105 - DNA, 13 bp, Homo sapiens
cttccccatgctc

SEQ ID NO: 1963106 - DNA, 20 bp, Homo sapiens
cttcccgcagcaccagcctg

SEQ ID NO: 1963107 - DNA, 22 bp, Homo sapiens
cttcccgcagcaccagcctgag

SEQ ID NO: 1963108 - DNA, 18 bp, Homo sapiens
cttcctgaactcccagtc

SEQ ID NO: 1963109 - DNA, 12 bp, Homo sapiens
cttcctgtcctg

SEQ ID NO: 1963110 - DNA, 22 bp, Homo sapiens
cttctaaacgtgaactaagatt

SEQ ID NO: 1963111 - DNA, 20 bp, Homo sapiens
cttctaatccatgtgctgct

SEQ ID NO: 1963112 - DNA, 14 bp, Homo sapiens
cttctactccatgg

SEQ ID NO: 1963113 - DNA, 19 bp, Homo sapiens
cttctcagctccactctga

SEQ ID NO: 1963114 - DNA, 16 bp, Homo sapiens
cttctcccctttcaaa

SEQ ID NO: 1963115 - DNA, 12 bp, Homo sapiens
cttctgtgcatc

SEQ ID NO: 1963116 - DNA, 18 bp, Homo sapiens
cttctgtgcatctggcct

SEQ ID NO: 1963117 - DNA, 19 bp, Homo sapiens
cttctgtgcatctggcctg

SEQ ID NO: 1963118 - DNA, 22 bp, Homo sapiens
cttcttgcggcaccgcccaccc

SEQ ID NO: 1963119 - DNA, 17 bp, Homo sapiens
cttctttactaacactg

SEQ ID NO: 1963120 - DNA, 13 bp, Homo sapiens
cttctttcctctt

SEQ ID NO: 1963121 - DNA, 14 bp, Homo sapiens
cttctttcctctta

SEQ ID NO: 1963122 - DNA, 23 bp, Homo sapiens
cttcttttagtcagaaatgattc

SEQ ID NO: 1963123 - DNA, 13 bp, Homo sapiens
cttgaagaactga

SEQ ID NO: 1963124 - DNA, 18 bp, Homo sapiens
cttgaatgcttaaatgat

SEQ ID NO: 1963125 - DNA, 20 bp, Homo sapiens
cttgatattcctacaaagaa

SEQ ID NO: 1963126 - DNA, 22 bp, Homo sapiens
cttgatattcctacaaagaaaa

SEQ ID NO: 1963127 - DNA, 14 bp, Homo sapiens
cttgattcaaataa

SEQ ID NO: 1963128 - DNA, 18 bp, Homo sapiens
cttgcactgtatccaagt

SEQ ID NO: 1963129 - DNA, 16 bp, Homo sapiens
cttgcattttagctaa

SEQ ID NO: 1963130 - DNA, 17 bp, Homo sapiens
cttgcggcaccgcccac

SEQ ID NO: 1963131 - DNA, 21 bp, Homo sapiens
cttgcggcaccgcccacccac

SEQ ID NO: 1963132 - DNA, 12 bp, Homo sapiens
cttggaaaatgt

SEQ ID NO: 1963133 - DNA, 19 bp, Homo sapiens
cttggctcagacacctaga

SEQ ID NO: 1963134 - DNA, 20 bp, Homo sapiens
cttggctcagacacctagac

SEQ ID NO: 1963135 - DNA, 23 bp, Homo sapiens
cttgggcacgggagagcgccacc

SEQ ID NO: 1963136 - DNA, 19 bp, Homo sapiens
cttggtctctttctttcca

SEQ ID NO: 1963137 - DNA, 20 bp, Homo sapiens
cttggtctctttctttccaa

SEQ ID NO: 1963138 - DNA, 17 bp, Homo sapiens
cttggtgttgttatggc

SEQ ID NO: 1963139 - DNA, 23 bp, Homo sapiens
cttggtttccatcaaagccctcc

SEQ ID NO: 1963140 - DNA, 21 bp, Homo sapiens
cttgtacagaaccagcactcc

SEQ ID NO: 1963141 - DNA, 16 bp, Homo sapiens
cttgtctgtgtatttc

SEQ ID NO: 1963142 - DNA, 17 bp, Homo sapiens
cttgtgtaatttcctgc

SEQ ID NO: 1963143 - DNA, 18 bp, Homo sapiens
cttgtgtaatttcctgct

SEQ ID NO: 1963144 - DNA, 19 bp, Homo sapiens
cttgtgtaatttcctgctc

SEQ ID NO: 1963145 - DNA, 16 bp, Homo sapiens
ctttaaaaaaatccca

SEQ ID NO: 1963146 - DNA, 21 bp, Homo sapiens
ctttaaaagaaggtaaataat

SEQ ID NO: 1963147 - DNA, 16 bp, Homo sapiens
ctttactaacactggc

SEQ ID NO: 1963148 - DNA, 18 bp, Homo sapiens
ctttagtcatttaagaat

SEQ ID NO: 1963149 - DNA, 12 bp, Homo sapiens
ctttatgattct

SEQ ID NO: 1963150 - DNA, 19 bp, Homo sapiens
ctttatgattcttactgtt

SEQ ID NO: 1963151 - DNA, 13 bp, Homo sapiens
ctttatgatttca

SEQ ID NO: 1963152 - DNA, 16 bp, Homo sapiens
ctttcaatccacagta

SEQ ID NO: 1963153 - DNA, 19 bp, Homo sapiens
ctttcaatccacagtattg

SEQ ID NO: 1963154 - DNA, 20 bp, Homo sapiens
ctttcaatccacagtattgt

SEQ ID NO: 1963155 - DNA, 15 bp, Homo sapiens
ctttccaaaggttgt

SEQ ID NO: 1963156 - DNA, 12 bp, Homo sapiens
ctttccatgaca

SEQ ID NO: 1963157 - DNA, 14 bp, Homo sapiens
ctttccatgacagt

SEQ ID NO: 1963158 - DNA, 18 bp, Homo sapiens
ctttccatgacagtagca

SEQ ID NO: 1963159 - DNA, 21 bp, Homo sapiens
ctttcccacccactagccctc

SEQ ID NO: 1963160 - DNA, 14 bp, Homo sapiens
ctttctctctgtgt

SEQ ID NO: 1963161 - DNA, 11 bp, Homo sapiens
ctttctttcca

SEQ ID NO: 1963162 - DNA, 13 bp, Homo sapiens
ctttctttccaaa

SEQ ID NO: 1963163 - DNA, 21 bp, Homo sapiens
ctttgaacattaatgttgaaa

SEQ ID NO: 1963164 - DNA, 20 bp, Homo sapiens
ctttgagtgtcaggctctga

SEQ ID NO: 1963165 - DNA, 21 bp, Homo sapiens
ctttgagtgtcaggctctgaa

SEQ ID NO: 1963166 - DNA, 17 bp, Homo sapiens
ctttggctgtgatgtca

SEQ ID NO: 1963167 - DNA, 21 bp, Homo sapiens
ctttggcttaattccaatcat

SEQ ID NO: 1963168 - DNA, 17 bp, Homo sapiens
ctttggttcctcatggc

SEQ ID NO: 1963169 - DNA, 22 bp, Homo sapiens
ctttgtctttctgcagaaaatt

SEQ ID NO: 1963170 - DNA, 20 bp, Homo sapiens
ctttgtgtcttttgttctct

SEQ ID NO: 1963171 - DNA, 11 bp, Homo sapiens
cttttaatttt

SEQ ID NO: 1963172 - DNA, 17 bp, Homo sapiens
cttttattgtataatta

SEQ ID NO: 1963173 - DNA, 22 bp, Homo sapiens
cttttccggggcacaagttttt

SEQ ID NO: 1963174 - DNA, 13 bp, Homo sapiens
cttttctcatggt

SEQ ID NO: 1963175 - DNA, 13 bp, Homo sapiens
cttttctgtcagt

SEQ ID NO: 1963176 - DNA, 20 bp, Homo sapiens
cttttgatggctatgttttg

SEQ ID NO: 1963177 - DNA, 15 bp, Homo sapiens
cttttgggaaatgct

SEQ ID NO: 1963178 - DNA, 11 bp, Homo sapiens
gaaaaaattag

SEQ ID NO: 1963179 - DNA, 16 bp, Homo sapiens
gaaaacaaccaaagaa

SEQ ID NO: 1963180 - DNA, 18 bp, Homo sapiens
gaaaacaaccaaagaaaa

SEQ ID NO: 1963181 - DNA, 12 bp, Homo sapiens
gaaaactaagtt

SEQ ID NO: 1963182 - DNA, 21 bp, Homo sapiens
gaaaataggatttgcactgct

SEQ ID NO: 1963183 - DNA, 17 bp, Homo sapiens
gaaaattctacctggct

SEQ ID NO: 1963184 - DNA, 14 bp, Homo sapiens
gaaacaatttctgt

SEQ ID NO: 1963185 - DNA, 15 bp, Homo sapiens
gaaacagtgtggatg

SEQ ID NO: 1963186 - DNA, 13 bp, Homo sapiens
gaaagagaaaaag

SEQ ID NO: 1963187 - DNA, 18 bp, Homo sapiens
gaaagatcccaagtcaaa

SEQ ID NO: 1963188 - DNA, 18 bp, Homo sapiens
gaaagggaggagaggaca

SEQ ID NO: 1963189 - DNA, 15 bp, Homo sapiens
gaaatataaactgtg

SEQ ID NO: 1963190 - DNA, 16 bp, Homo sapiens
gaaatataaactgtga

SEQ ID NO: 1963191 - DNA, 18 bp, Homo sapiens
gaaatataaactgtgaga

SEQ ID NO: 1963192 - DNA, 18 bp, Homo sapiens
gaaatatccctcatttca

SEQ ID NO: 1963193 - DNA, 15 bp, Homo sapiens
gaaatatttgcgtaa

SEQ ID NO: 1963194 - DNA, 21 bp, Homo sapiens
gaaatatttgcgtaaatggtt

SEQ ID NO: 1963195 - DNA, 21 bp, Homo sapiens
gaaatgattgagagcagcctc

SEQ ID NO: 1963196 - DNA, 22 bp, Homo sapiens
gaaatgctgatttaaacttctt

SEQ ID NO: 1963197 - DNA, 21 bp, Homo sapiens
gaaattatgtcaaatggatgt

SEQ ID NO: 1963198 - DNA, 17 bp, Homo sapiens
gaaattcttgcactgta

SEQ ID NO: 1963199 - DNA, 22 bp, Homo sapiens
gaacattaatgttgaaaaagaa

SEQ ID NO: 1963200 - DNA, 23 bp, Homo sapiens
gaacattaatgttgaaaaagaaa

SEQ ID NO: 1963201 - DNA, 14 bp, Homo sapiens
gaacgggcctcccc

SEQ ID NO: 1963202 - DNA, 15 bp, Homo sapiens
gaactgaagcagagt

SEQ ID NO: 1963203 - DNA, 14 bp, Homo sapiens
gaactgcaacactg

SEQ ID NO: 1963204 - DNA, 16 bp, Homo sapiens
gaagcccacccgcccc

SEQ ID NO: 1963205 - DNA, 19 bp, Homo sapiens
gaagcccacccgccccaga

SEQ ID NO: 1963206 - DNA, 23 bp, Homo sapiens
gaaggcctgagggaagcccaccc

SEQ ID NO: 1963207 - DNA, 17 bp, Homo sapiens
gaaggggtagggatttg

SEQ ID NO: 1963208 - DNA, 18 bp, Homo sapiens
gaagtcccttcctgtcct

SEQ ID NO: 1963209 - DNA, 14 bp, Homo sapiens
gaatagttgtcaga

SEQ ID NO: 1963210 - DNA, 19 bp, Homo sapiens
gaatataaaaaatgttatt

SEQ ID NO: 1963211 - DNA, 17 bp, Homo sapiens
gaatatcaagaatagtt

SEQ ID NO: 1963212 - DNA, 23 bp, Homo sapiens
gaatatggcaatagcattgttct

SEQ ID NO: 1963213 - DNA, 14 bp, Homo sapiens
gcttcccaacaata

SEQ ID NO: 1963214 - DNA, 15 bp, Homo sapiens
gcttcttttagtcag

SEQ ID NO: 1963215 - DNA, 23 bp, Homo sapiens
gcttcttttagtcagaaatgatt

SEQ ID NO: 1963216 - DNA, 19 bp, Homo sapiens
gcttgtgtaatttcctgct

SEQ ID NO: 1963217 - DNA, 13 bp, Homo sapiens
gcttttctcatgg

SEQ ID NO: 1963218 - DNA, 21 bp, Homo sapiens
ggaaaaggcttgagtctggat

SEQ ID NO: 1963219 - DNA, 20 bp, Homo sapiens
ggaaagatcccaagtcaaac

SEQ ID NO: 1963220 - DNA, 21 bp, Homo sapiens
ggaaattcttgcactgtatcc

SEQ ID NO: 1963221 - DNA, 13 bp, Homo sapiens
ggaagcccacccg

SEQ ID NO: 1963222 - DNA, 15 bp, Homo sapiens
ggaagcccacccgcc

SEQ ID NO: 1963223 - DNA, 23 bp, Homo sapiens
ggaaggcctgagggaagcccacc

SEQ ID NO: 1963224 - DNA, 16 bp, Homo sapiens
ggaatgctcaatgtgc

SEQ ID NO: 1963225 - DNA, 17 bp, Homo sapiens
ggaatgctcaatgtgct

SEQ ID NO: 1963226 - DNA, 21 bp, Homo sapiens
ggaatggattttttttttcag

SEQ ID NO: 1963227 - DNA, 12 bp, Homo sapiens
ggaattttaact

SEQ ID NO: 1963228 - DNA, 22 bp, Homo sapiens
ggaattttaacttttgggattt

SEQ ID NO: 1963229 - DNA, 21 bp, Homo sapiens
ggacactgatgggtcctgctg

SEQ ID NO: 1963230 - DNA, 18 bp, Homo sapiens
ggacagcggcccggccca

SEQ ID NO: 1963231 - DNA, 19 bp, Homo sapiens
ggacagcggcccggcccac

SEQ ID NO: 1963232 - DNA, 22 bp, Homo sapiens
ggacagcggcccggcccacgca

SEQ ID NO: 1963233 - DNA, 16 bp, Homo sapiens
ggaccggagcggctga

SEQ ID NO: 1963234 - DNA, 19 bp, Homo sapiens
ggaccggagcggctgagga

SEQ ID NO: 1963235 - DNA, 22 bp, Homo sapiens
ggaccggagcggctgaggacgg

SEQ ID NO: 1963236 - DNA, 20 bp, Homo sapiens
ggactgtcttcaaccctgcc

SEQ ID NO: 1963237 - DNA, 21 bp, Homo sapiens
ggactgtcttcaaccctgccc

SEQ ID NO: 1963238 - DNA, 13 bp, Homo sapiens
ggagaaggaggaa

SEQ ID NO: 1963239 - DNA, 15 bp, Homo sapiens
ggagagcgccacccg

SEQ ID NO: 1963240 - DNA, 16 bp, Homo sapiens
ggagagcgccacccgc

SEQ ID NO: 1963241 - DNA, 17 bp, Homo sapiens
ggagagcgccacccgcc

SEQ ID NO: 1963242 - DNA, 21 bp, Homo sapiens
ggagaggagcaaacaggaaaa

SEQ ID NO: 1963243 - DNA, 16 bp, Homo sapiens
ggagcacccccagcct

SEQ ID NO: 1963244 - DNA, 18 bp, Homo sapiens
ggagcacccccagcctcc

SEQ ID NO: 1963245 - DNA, 20 bp, Homo sapiens
ggagcacccccagcctcccc

SEQ ID NO: 1963246 - DNA, 21 bp, Homo sapiens
ggagcagagacggcagcccca

SEQ ID NO: 1963247 - DNA, 23 bp, Homo sapiens
ggagcagagacggcagccccatc

SEQ ID NO: 1963248 - DNA, 14 bp, Homo sapiens
ggagcggctgagga

SEQ ID NO: 1963249 - DNA, 15 bp, Homo sapiens
ggagcggctgaggac

SEQ ID NO: 1963250 - DNA, 23 bp, Homo sapiens
ggagcggctgaggacggggcaga

SEQ ID NO: 1963251 - DNA, 22 bp, Homo sapiens
ggagcgggggctaactggcccc

SEQ ID NO: 1963252 - DNA, 23 bp, Homo sapiens
ggagcgggggctaactggcccca

SEQ ID NO: 1963253 - DNA, 17 bp, Homo sapiens
ggaggagaaggaggaac

SEQ ID NO: 1963254 - DNA, 19 bp, Homo sapiens
ggaggagaaggaggaaccc

SEQ ID NO: 1963255 - DNA, 11 bp, Homo sapiens
ggaggagcacc

SEQ ID NO: 1963256 - DNA, 14 bp, Homo sapiens
ggaggcgcccacct

SEQ ID NO: 1963257 - DNA, 15 bp, Homo sapiens
ggaggcgcccacctg

SEQ ID NO: 1963258 - DNA, 17 bp, Homo sapiens
ggaggcgcccacctgcc

SEQ ID NO: 1963259 - DNA, 18 bp, Homo sapiens
ggaggcgcccacctgccc

SEQ ID NO: 1963260 - DNA, 23 bp, Homo sapiens
ggaggcgcccacctgcccagtta

SEQ ID NO: 1963261 - DNA, 19 bp, Homo sapiens
ggagtccactttcctctct

SEQ ID NO: 1963262 - DNA, 14 bp, Homo sapiens
ggatgtaatatagg

SEQ ID NO: 1963263 - DNA, 16 bp, Homo sapiens
ggatttgacacactca

SEQ ID NO: 1963264 - DNA, 16 bp, Homo sapiens
ggcaacagagtgagac

SEQ ID NO: 1963265 - DNA, 14 bp, Homo sapiens
ggcaactgtggaag

SEQ ID NO: 1963266 - DNA, 14 bp, Homo sapiens
ggcaccgcccaccc

SEQ ID NO: 1963267 - DNA, 13 bp, Homo sapiens
ggcacggaggctc

SEQ ID NO: 1963268 - DNA, 13 bp, Homo sapiens
ggcacgggagagc

SEQ ID NO: 1963269 - DNA, 23 bp, Homo sapiens
ggcacgggagagcgccacccgcc

SEQ ID NO: 1963270 - DNA, 15 bp, Homo sapiens
ggcactttttaacat

SEQ ID NO: 1963271 - DNA, 21 bp, Homo sapiens
ggcagagctgagtcggctggg

SEQ ID NO: 1963272 - DNA, 22 bp, Homo sapiens
ggcagagctgagtcggctgggc

SEQ ID NO: 1963273 - DNA, 15 bp, Homo sapiens
ggcagcagcagcagc

SEQ ID NO: 1963274 - DNA, 14 bp, Homo sapiens
ggcagcccctgctg

SEQ ID NO: 1963275 - DNA, 15 bp, Homo sapiens
ggcagcccctgctgg

SEQ ID NO: 1963276 - DNA, 15 bp, Homo sapiens
ggcagcgcctcccgc

SEQ ID NO: 1963277 - DNA, 17 bp, Homo sapiens
ggcagggccgcagggcg

SEQ ID NO: 1963278 - DNA, 13 bp, Homo sapiens
ggcagtgcagtgc

SEQ ID NO: 1963279 - DNA, 16 bp, Homo sapiens
ggcattgcactaaaag

SEQ ID NO: 1963280 - DNA, 13 bp, Homo sapiens
ggcatttgctgaa

SEQ ID NO: 1963281 - DNA, 16 bp, Homo sapiens
ggcccacgcagagccc

SEQ ID NO: 1963282 - DNA, 20 bp, Homo sapiens
ggcccacgcagagccccgga

SEQ ID NO: 1963283 - DNA, 13 bp, Homo sapiens
ggcccatggcccc

SEQ ID NO: 1963284 - DNA, 19 bp, Homo sapiens
ggcccatggccccagctgg

SEQ ID NO: 1963285 - DNA, 22 bp, Homo sapiens
ggccccaggcggaggggcttgg

SEQ ID NO: 1963286 - DNA, 21 bp, Homo sapiens
ggcccccggaggcgcccacct

SEQ ID NO: 1963287 - DNA, 15 bp, Homo sapiens
ggcccgagcgcgtgc

SEQ ID NO: 1963288 - DNA, 22 bp, Homo sapiens
ggcccgagcgcgtgccttcccc

SEQ ID NO: 1963289 - DNA, 14 bp, Homo sapiens
ggcccggcccacgc

SEQ ID NO: 1963290 - DNA, 14 bp, Homo sapiens
ggccctgccctccc

SEQ ID NO: 1963291 - DNA, 17 bp, Homo sapiens
ggccctgccctccccca

SEQ ID NO: 1963292 - DNA, 19 bp, Homo sapiens
ggccctgccctcccccacg

SEQ ID NO: 1963293 - DNA, 23 bp, Homo sapiens
ggccctgccctcccccacggccg

SEQ ID NO: 1963294 - DNA, 12 bp, Homo sapiens
ggccctgtggga

SEQ ID NO: 1963295 - DNA, 15 bp, Homo sapiens
ggccgcctcctccag

SEQ ID NO: 1963296 - DNA, 16 bp, Homo sapiens
ggccgcctcctccaga

SEQ ID NO: 1963297 - DNA, 18 bp, Homo sapiens
ggccgcctcctccagact

SEQ ID NO: 1963298 - DNA, 19 bp, Homo sapiens
ggccgtccctgacttccca

SEQ ID NO: 1963299 - DNA, 23 bp, Homo sapiens
ggccgtccctgacttcccagctg

SEQ ID NO: 1963300 - DNA, 23 bp, Homo sapiens
ggcctccccgggggtccccggac

SEQ ID NO: 1963301 - DNA, 17 bp, Homo sapiens
ggcctgagggaagccca

SEQ ID NO: 1963302 - DNA, 19 bp, Homo sapiens
ggcctgagggaagcccacc

SEQ ID NO: 1963303 - DNA, 14 bp, Homo sapiens
ggcctgcagcccag

SEQ ID NO: 1963304 - DNA, 15 bp, Homo sapiens
ggcctgcagcccaga

SEQ ID NO: 1963305 - DNA, 17 bp, Homo sapiens
ggcctgcagcccagaac

SEQ ID NO: 1963306 - DNA, 12 bp, Homo sapiens
ggcgcccacctg

SEQ ID NO: 1963307 - DNA, 14 bp, Homo sapiens
ggcgcccacctgcc

SEQ ID NO: 1963308 - DNA, 15 bp, Homo sapiens
ggcgcccacctgccc

SEQ ID NO: 1963309 - DNA, 14 bp, Homo sapiens
ggcgcctgcgctcc

SEQ ID NO: 1963310 - DNA, 20 bp, Homo sapiens
ggcgcctgcgctcctctgca

SEQ ID NO: 1963311 - DNA, 21 bp, Homo sapiens
ggcggaggggcttggagcaga

SEQ ID NO: 1963312 - DNA, 12 bp, Homo sapiens
ggcgggcagccc

SEQ ID NO: 1963313 - DNA, 14 bp, Homo sapiens
ggcgggcagcccct

SEQ ID NO: 1963314 - DNA, 22 bp, Homo sapiens
ggcgggcagcccctgctggacc

SEQ ID NO: 1963315 - DNA, 13 bp, Homo sapiens
ggctaactggccc

SEQ ID NO: 1963316 - DNA, 19 bp, Homo sapiens
ggctaactggccccaggcg

SEQ ID NO: 1963317 - DNA, 22 bp, Homo sapiens
ggctgaaattatgtcaaatgga

SEQ ID NO: 1963318 - DNA, 14 bp, Homo sapiens
ggctgagcccctcc

SEQ ID NO: 1963319 - DNA, 22 bp, Homo sapiens
ggctgaggacggggcagagctg

SEQ ID NO: 1963320 - DNA, 22 bp, Homo sapiens
ggctgccaagagtccaagccat

SEQ ID NO: 1963321 - DNA, 12 bp, Homo sapiens
ggctggccctgc

SEQ ID NO: 1963322 - DNA, 21 bp, Homo sapiens
ggctggccctgccctccccca

SEQ ID NO: 1963323 - DNA, 18 bp, Homo sapiens
ggctggccggtccacccc

SEQ ID NO: 1963324 - DNA, 19 bp, Homo sapiens
taccctcttctcagctcca

SEQ ID NO: 1963325 - DNA, 21 bp, Homo sapiens
taccctcttctcagctccact

SEQ ID NO: 1963326 - DNA, 22 bp, Homo sapiens
taccctcttctcagctccactc

SEQ ID NO: 1963327 - DNA, 20 bp, Homo sapiens
taccctggacagtgcctaac

SEQ ID NO: 1963328 - DNA, 14 bp, Homo sapiens
tacctgtaggtcta

SEQ ID NO: 1963329 - DNA, 13 bp, Homo sapiens
tacctttttaaca

SEQ ID NO: 1963330 - DNA, 23 bp, Homo sapiens
tacggatttagctaacaaaagat

SEQ ID NO: 1963331 - DNA, 16 bp, Homo sapiens
tactaaccaccatttc

SEQ ID NO: 1963332 - DNA, 16 bp, Homo sapiens
tactagaaccttctaa

SEQ ID NO: 1963333 - DNA, 20 bp, Homo sapiens
tactatggtatatattttga

SEQ ID NO: 1963334 - DNA, 21 bp, Homo sapiens
tactcagatgacctgaggaaa

SEQ ID NO: 1963335 - DNA, 22 bp, Homo sapiens
tactccagccccttcaattatt

SEQ ID NO: 1963336 - DNA, 20 bp, Homo sapiens
tactgatgagacaacacaca

SEQ ID NO: 1963337 - DNA, 23 bp, Homo sapiens
tacttaaacaaaaactttccatg

SEQ ID NO: 1963338 - DNA, 16 bp, Homo sapiens
tacttacccttctaca

SEQ ID NO: 1963339 - DNA, 22 bp, Homo sapiens
tacttacccttctacaaaagaa

SEQ ID NO: 1963340 - DNA, 20 bp, Homo sapiens
tacttatttataacattgta

SEQ ID NO: 1963341 - DNA, 15 bp, Homo sapiens
tactttcagaatgtt

SEQ ID NO: 1963342 - DNA, 23 bp, Homo sapiens
tactttgaacattaatgttgaaa

SEQ ID NO: 1963343 - DNA, 22 bp, Homo sapiens
tactttgtctttctgcagaaaa

SEQ ID NO: 1963344 - DNA, 13 bp, Homo sapiens
tagaacaaaagag

SEQ ID NO: 1963345 - DNA, 11 bp, Homo sapiens
tagaatattgt

SEQ ID NO: 1963346 - DNA, 17 bp, Homo sapiens
tagacaatgtggaatta

SEQ ID NO: 1963347 - DNA, 22 bp, Homo sapiens
tagacaatgtggaattacataa

SEQ ID NO: 1963348 - DNA, 22 bp, Homo sapiens
tagatcaactcatgttaattga

SEQ ID NO: 1963349 - DNA, 16 bp, Homo sapiens
tagattcctacttaaa

SEQ ID NO: 1963350 - DNA, 23 bp, Homo sapiens
tagcaaaaggatgatttaacatt

SEQ ID NO: 1963351 - DNA, 19 bp, Homo sapiens
tagcactttgggaggctga

SEQ ID NO: 1963352 - DNA, 22 bp, Homo sapiens
tagcatactgatgagacaacac

SEQ ID NO: 1963353 - DNA, 22 bp, Homo sapiens
tagcatgtaatattaaattcct

SEQ ID NO: 1963354 - DNA, 12 bp, Homo sapiens
tagcattgttct

SEQ ID NO: 1963355 - DNA, 17 bp, Homo sapiens
tagcatttaaagatacc

SEQ ID NO: 1963356 - DNA, 15 bp, Homo sapiens
tagcccggccaagga

SEQ ID NO: 1963357 - DNA, 23 bp, Homo sapiens
tagcccggccaaggacactgatg

SEQ ID NO: 1963358 - DNA, 22 bp, Homo sapiens
tagctagtttaaaattattaaa

SEQ ID NO: 1963359 - DNA, 22 bp, Homo sapiens
tagctccttcatgcttttctca

SEQ ID NO: 1963360 - DNA, 15 bp, Homo sapiens
tagctgcttttctgt

SEQ ID NO: 1963361 - DNA, 22 bp, Homo sapiens
taggaatgctcaatgtgctgtt

SEQ ID NO: 1963362 - DNA, 17 bp, Homo sapiens
taggacatctctgtaaa

SEQ ID NO: 1963363 - DNA, 18 bp, Homo sapiens
taggacatctctgtaaaa

SEQ ID NO: 1963364 - DNA, 23 bp, Homo sapiens
taggacatctctgtaaaaagcag

SEQ ID NO: 1963365 - DNA, 19 bp, Homo sapiens
tagggtttgtttgctgctt

SEQ ID NO: 1963366 - DNA, 23 bp, Homo sapiens
tagggtttgtttgctgcttttga

SEQ ID NO: 1963367 - DNA, 19 bp, Homo sapiens
taggtctatgatgtccaaa

SEQ ID NO: 1963368 - DNA, 16 bp, Homo sapiens
taggtctgcacacata

SEQ ID NO: 1963369 - DNA, 21 bp, Homo sapiens
taggtttagaatcaagtctgt

SEQ ID NO: 1963370 - DNA, 23 bp, Homo sapiens
taggtttagaatcaagtctgtga

SEQ ID NO: 1963371 - DNA, 19 bp, Homo sapiens
tagtagctgataaagaaac

SEQ ID NO: 1963372 - DNA, 18 bp, Homo sapiens
tagtgaaaattttattga

SEQ ID NO: 1963373 - DNA, 15 bp, Homo sapiens
tagtgccttgatttt

SEQ ID NO: 1963374 - DNA, 23 bp, Homo sapiens
tagtgccttgattttaattcagg

SEQ ID NO: 1963375 - DNA, 14 bp, Homo sapiens
tagtgctacagatg

SEQ ID NO: 1963376 - DNA, 21 bp, Homo sapiens
tagtggtcatttggtggctct

SEQ ID NO: 1963377 - DNA, 22 bp, Homo sapiens
tagtgtcacttttttcctgtca

SEQ ID NO: 1963378 - DNA, 15 bp, Homo sapiens
tagtgttctgttcac

SEQ ID NO: 1963379 - DNA, 21 bp, Homo sapiens
tagttcatagttggaaatatt

SEQ ID NO: 1963380 - DNA, 18 bp, Homo sapiens
tagttcctggaattagtt

SEQ ID NO: 1963381 - DNA, 16 bp, Homo sapiens
tagttgtcagaatatg

SEQ ID NO: 1963382 - DNA, 11 bp, Homo sapiens
tataaaaataa

SEQ ID NO: 1963383 - DNA, 12 bp, Homo sapiens
tataaactgtga

SEQ ID NO: 1963384 - DNA, 18 bp, Homo sapiens
tataaactgtgagataaa

SEQ ID NO: 1963385 - DNA, 16 bp, Homo sapiens
tataaatgaatgaaat

SEQ ID NO: 1963386 - DNA, 17 bp, Homo sapiens
tataacattgtaaatga

SEQ ID NO: 1963387 - DNA, 19 bp, Homo sapiens
tataattttattgctggaa

SEQ ID NO: 1963388 - DNA, 13 bp, Homo sapiens
tataccagcaaaa

SEQ ID NO: 1963389 - DNA, 17 bp, Homo sapiens
tatagagacttctaaat

SEQ ID NO: 1963390 - DNA, 13 bp, Homo sapiens
tatagcatgtaat

SEQ ID NO: 1963391 - DNA, 18 bp, Homo sapiens
tatagcatttaaagatac

SEQ ID NO: 1963392 - DNA, 22 bp, Homo sapiens
tatagttcatagttggaaatat

SEQ ID NO: 1963393 - DNA, 14 bp, Homo sapiens
tatatattttgaaa

SEQ ID NO: 1963394 - DNA, 19 bp, Homo sapiens
tatatattttgaaaggaga

SEQ ID NO: 1963395 - DNA, 22 bp, Homo sapiens
tatatgtttggctgaaattatg

SEQ ID NO: 1963396 - DNA, 14 bp, Homo sapiens
tatattgccaaata

SEQ ID NO: 1963397 - DNA, 21 bp, Homo sapiens
tatattgccaaatattaagaa

SEQ ID NO: 1963398 - DNA, 15 bp, Homo sapiens
tatattttgaaagga

SEQ ID NO: 1963399 - DNA, 16 bp, Homo sapiens
tatcaatcagtaatta

SEQ ID NO: 1963400 - DNA, 14 bp, Homo sapiens
tatcatattctaaa

SEQ ID NO: 1963401 - DNA, 18 bp, Homo sapiens
tatcatattctaaaagta

SEQ ID NO: 1963402 - DNA, 13 bp, Homo sapiens
tatcatgcttcta

SEQ ID NO: 1963403 - DNA, 19 bp, Homo sapiens
tatcatgcttctactccat

SEQ ID NO: 1963404 - DNA, 14 bp, Homo sapiens
tatccctcatttca

SEQ ID NO: 1963405 - DNA, 18 bp, Homo sapiens
tatccttcacaatttcaa

SEQ ID NO: 1963406 - DNA, 21 bp, Homo sapiens
tatctagtaggtctgcacaca

SEQ ID NO: 1963407 - DNA, 13 bp, Homo sapiens
tatctcttcctta

SEQ ID NO: 1963408 - DNA, 18 bp, Homo sapiens
tatctgatgatgttctga

SEQ ID NO: 1963409 - DNA, 22 bp, Homo sapiens
tatctggaaaaaaaaaaatatg

SEQ ID NO: 1963410 - DNA, 20 bp, Homo sapiens
tatctgtctttatgatttca

SEQ ID NO: 1963411 - DNA, 21 bp, Homo sapiens
tatctgtctttatgatttcat

SEQ ID NO: 1963412 - DNA, 13 bp, Homo sapiens
tatgataaatttg

SEQ ID NO: 1963413 - DNA, 21 bp, Homo sapiens
tatgatttcatgattagacaa

SEQ ID NO: 1963414 - DNA, 22 bp, Homo sapiens
tatgcacaccaaattgctgaga

SEQ ID NO: 1963415 - DNA, 23 bp, Homo sapiens
tatgcacaccaaattgctgagat

SEQ ID NO: 1963416 - DNA, 15 bp, Homo sapiens
tatgcatgagaacta

SEQ ID NO: 1963417 - DNA, 12 bp, Homo sapiens
tatgcatttatg

SEQ ID NO: 1963418 - DNA, 16 bp, Homo sapiens
tatgcatttatgcatg

SEQ ID NO: 1963419 - DNA, 17 bp, Homo sapiens
tatgcatttatgcatga

SEQ ID NO: 1963420 - DNA, 18 bp, Homo sapiens
tatgcatttatgcatgag

SEQ ID NO: 1963421 - DNA, 15 bp, Homo sapiens
tatgctgttcattga

SEQ ID NO: 1963422 - DNA, 16 bp, Homo sapiens
tatgtatatgtctaga

SEQ ID NO: 1963423 - DNA, 20 bp, Homo sapiens
tatgtttgaaaataggattt

SEQ ID NO: 1963424 - DNA, 19 bp, Homo sapiens
tatgttttggagagagcaa

SEQ ID NO: 1963425 - DNA, 15 bp, Homo sapiens
tattaaattcctcct

SEQ ID NO: 1963426 - DNA, 18 bp, Homo sapiens
tattactgaggaaaggga

SEQ ID NO: 1963427 - DNA, 19 bp, Homo sapiens
tattatccttcacaatttc

SEQ ID NO: 1963428 - DNA, 15 bp, Homo sapiens
tattcctacaaagaa

SEQ ID NO: 1963429 - DNA, 23 bp, Homo sapiens
tattcctacaaagaaaaaagaag

SEQ ID NO: 1963430 - DNA, 20 bp, Homo sapiens
tattgctgtaaataaaaata

SEQ ID NO: 1963431 - DNA, 22 bp, Homo sapiens
tattgctgtaaataaaaatagc

SEQ ID NO: 1963432 - DNA, 20 bp, Homo sapiens
tattgtaactcacatgcctt

SEQ ID NO: 1963433 - DNA, 14 bp, Homo sapiens
tattgttcttgtaa

SEQ ID NO: 1963434 - DNA, 17 bp, Homo sapiens
tgatcctaaaattgttt

SEQ ID NO: 1963435 - DNA, 18 bp, Homo sapiens
tgatctggtgcgtgtggc

SEQ ID NO: 1963436 - DNA, 20 bp, Homo sapiens
tgatctgtccttccaacctg

SEQ ID NO: 1963437 - DNA, 14 bp, Homo sapiens
tgatgagacaacac

SEQ ID NO: 1963438 - DNA, 18 bp, Homo sapiens
tgatgagacaacacacac

SEQ ID NO: 1963439 - DNA, 14 bp, Homo sapiens
tgatgatgttctga

SEQ ID NO: 1963440 - DNA, 16 bp, Homo sapiens
tgatgattcaatcatt

SEQ ID NO: 1963441 - DNA, 16 bp, Homo sapiens
tgatgatttcagaaac

SEQ ID NO: 1963442 - DNA, 15 bp, Homo sapiens
tgatggaagggcctt

SEQ ID NO: 1963443 - DNA, 14 bp, Homo sapiens
tgatggctatgttt

SEQ ID NO: 1963444 - DNA, 20 bp, Homo sapiens
tgatgtcacagtttgttcag

SEQ ID NO: 1963445 - DNA, 19 bp, Homo sapiens
tgatgtgctcatcagaaac

SEQ ID NO: 1963446 - DNA, 16 bp, Homo sapiens
tgattagacaatgtgg

SEQ ID NO: 1963447 - DNA, 13 bp, Homo sapiens
tgattcaaataac

SEQ ID NO: 1963448 - DNA, 22 bp, Homo sapiens
tgattcaaataaccctgaatca

SEQ ID NO: 1963449 - DNA, 23 bp, Homo sapiens
tgattgagagcagcctcttgaat

SEQ ID NO: 1963450 - DNA, 13 bp, Homo sapiens
tgattgcatattt

SEQ ID NO: 1963451 - DNA, 12 bp, Homo sapiens
tgatttaacatt

SEQ ID NO: 1963452 - DNA, 14 bp, Homo sapiens
tgatttatgcattt

SEQ ID NO: 1963453 - DNA, 18 bp, Homo sapiens
tgatttcatgattagaca

SEQ ID NO: 1963454 - DNA, 22 bp, Homo sapiens
tgatttcatgattagacaatgt

SEQ ID NO: 1963455 - DNA, 16 bp, Homo sapiens
tgattttaattcaggt

SEQ ID NO: 1963456 - DNA, 23 bp, Homo sapiens
tgcaaaatacatgatgatttcag

SEQ ID NO: 1963457 - DNA, 14 bp, Homo sapiens
tgcaaagcacacct

SEQ ID NO: 1963458 - DNA, 21 bp, Homo sapiens
tgcaatgttccgttcatctga

SEQ ID NO: 1963459 - DNA, 17 bp, Homo sapiens
tgcacacaaaacatctt

SEQ ID NO: 1963460 - DNA, 13 bp, Homo sapiens
tgcacacataaca

SEQ ID NO: 1963461 - DNA, 18 bp, Homo sapiens
tgcacaccaaattgctga

SEQ ID NO: 1963462 - DNA, 20 bp, Homo sapiens
tgcacaccaaattgctgaga

SEQ ID NO: 1963463 - DNA, 16 bp, Homo sapiens
tgcactaaaagtgatg

SEQ ID NO: 1963464 - DNA, 21 bp, Homo sapiens
tgcactcttttgagcagtaaa

SEQ ID NO: 1963465 - DNA, 21 bp, Homo sapiens
tgcagcagtaccatcccactg

SEQ ID NO: 1963466 - DNA, 20 bp, Homo sapiens
tgcagcccagaacgggcctc

SEQ ID NO: 1963467 - DNA, 14 bp, Homo sapiens
tgcatgaaagcgtt

SEQ ID NO: 1963468 - DNA, 16 bp, Homo sapiens
tgcatgagaactaaat

SEQ ID NO: 1963469 - DNA, 22 bp, Homo sapiens
tgcattcattcatcctcttata

SEQ ID NO: 1963470 - DNA, 16 bp, Homo sapiens
tgccaagagtccaagc

SEQ ID NO: 1963471 - DNA, 22 bp, Homo sapiens
tgcccacccgtgttctcctcca

SEQ ID NO: 1963472 - DNA, 16 bp, Homo sapiens
tgcccaccctgggcct

SEQ ID NO: 1963473 - DNA, 17 bp, Homo sapiens
tgcccaccctgggcctc

SEQ ID NO: 1963474 - DNA, 20 bp, Homo sapiens
tgcccaccctgggcctcccg

SEQ ID NO: 1963475 - DNA, 11 bp, Homo sapiens
tgcccccagcg

SEQ ID NO: 1963476 - DNA, 18 bp, Homo sapiens
tgccccctcccccgcaga

SEQ ID NO: 1963477 - DNA, 21 bp, Homo sapiens
tgccccctcccccgcagacag

SEQ ID NO: 1963478 - DNA, 22 bp, Homo sapiens
tgccccctcccccgcagacaga

SEQ ID NO: 1963479 - DNA, 14 bp, Homo sapiens
tgcccctcttagaa

SEQ ID NO: 1963480 - DNA, 19 bp, Homo sapiens
tgccccttccccatgctca

SEQ ID NO: 1963481 - DNA, 19 bp, Homo sapiens
tgccgtctttggttcctca

SEQ ID NO: 1963482 - DNA, 19 bp, Homo sapiens
tgcctagtgctacagatgt

SEQ ID NO: 1963483 - DNA, 17 bp, Homo sapiens
tgcctctttgctgcttt

SEQ ID NO: 1963484 - DNA, 19 bp, Homo sapiens
tgcctctttgctgctttgt

SEQ ID NO: 1963485 - DNA, 14 bp, Homo sapiens
tgcctggcgggcag

SEQ ID NO: 1963486 - DNA, 17 bp, Homo sapiens
tgcctggcgggcagccc

SEQ ID NO: 1963487 - DNA, 19 bp, Homo sapiens
tgcctggcgggcagcccct

SEQ ID NO: 1963488 - DNA, 22 bp, Homo sapiens
tgccttgattttaattcaggtg

SEQ ID NO: 1963489 - DNA, 18 bp, Homo sapiens
tgcgcctgcccgcccgcc

SEQ ID NO: 1963490 - DNA, 16 bp, Homo sapiens
tgcgctcctctgcagc

SEQ ID NO: 1963491 - DNA, 17 bp, Homo sapiens
tgcgctcctctgcagcc

SEQ ID NO: 1963492 - DNA, 23 bp, Homo sapiens
tgcgctcctctgcagcctgagct

SEQ ID NO: 1963493 - DNA, 16 bp, Homo sapiens
tgcggaccggagcggc

SEQ ID NO: 1963494 - DNA, 16 bp, Homo sapiens
tgcggcaccgcccacc

SEQ ID NO: 1963495 - DNA, 18 bp, Homo sapiens
tgcggcaccgcccaccca

SEQ ID NO: 1963496 - DNA, 19 bp, Homo sapiens
tgcggcccgtgcgcagccg

SEQ ID NO: 1963497 - DNA, 23 bp, Homo sapiens
tgcggcccgtgcgcagccgcgct

SEQ ID NO: 1963498 - DNA, 21 bp, Homo sapiens
tgcgtgtggccctgtgggagt

SEQ ID NO: 1963499 - DNA, 18 bp, Homo sapiens
tgctatgctgttcattga

SEQ ID NO: 1963500 - DNA, 17 bp, Homo sapiens
tgctcaatgtgctgttg

SEQ ID NO: 1963501 - DNA, 18 bp, Homo sapiens
tgctcaatgtgctgttga

SEQ ID NO: 1963502 - DNA, 17 bp, Homo sapiens
tgctcacgtctgtgagt

SEQ ID NO: 1963503 - DNA, 22 bp, Homo sapiens
tgctcagtattgagacactgtc

SEQ ID NO: 1963504 - DNA, 15 bp, Homo sapiens
tgctctctcattccc

SEQ ID NO: 1963505 - DNA, 18 bp, Homo sapiens
tgctgaataacaacaatt

SEQ ID NO: 1963506 - DNA, 15 bp, Homo sapiens
tgctgcctcaggaat

SEQ ID NO: 1963507 - DNA, 16 bp, Homo sapiens
tgctgctcgggaaggc

SEQ ID NO: 1963508 - DNA, 17 bp, Homo sapiens
tgctgctcgggaaggcc

SEQ ID NO: 1963509 - DNA, 20 bp, Homo sapiens
tgctgctcgggaaggcctga

SEQ ID NO: 1963510 - DNA, 13 bp, Homo sapiens
tgctgttcattga

SEQ ID NO: 1963511 - DNA, 16 bp, Homo sapiens
tgctgttgattctttc

SEQ ID NO: 1963512 - DNA, 17 bp, Homo sapiens
tgctgttgattctttca

SEQ ID NO: 1963513 - DNA, 18 bp, Homo sapiens
tgctgttgattctttcaa

SEQ ID NO: 1963514 - DNA, 23 bp, Homo sapiens
tgcttctactccatggtgaactg

SEQ ID NO: 1963515 - DNA, 17 bp, Homo sapiens
tgcttctttcctcttaa

SEQ ID NO: 1963516 - DNA, 19 bp, Homo sapiens
tgcttcttttagtcagaaa

SEQ ID NO: 1963517 - DNA, 13 bp, Homo sapiens
tgctttattttag

SEQ ID NO: 1963518 - DNA, 15 bp, Homo sapiens
tgcttttctcatggt

SEQ ID NO: 1963519 - DNA, 15 bp, Homo sapiens
tgcttttctgtcagt

SEQ ID NO: 1963520 - DNA, 23 bp, Homo sapiens
tggaaaaagaatatattgccaaa

SEQ ID NO: 1963521 - DNA, 13 bp, Homo sapiens
tggaacagtaatt

SEQ ID NO: 1963522 - DNA, 19 bp, Homo sapiens
tggaatatggcaatagcat

SEQ ID NO: 1963523 - DNA, 21 bp, Homo sapiens
tggaatatggcaatagcattg

SEQ ID NO: 1963524 - DNA, 13 bp, Homo sapiens
tggaattacataa

SEQ ID NO: 1963525 - DNA, 18 bp, Homo sapiens
tggaattacataacaggc

SEQ ID NO: 1963526 - DNA, 19 bp, Homo sapiens
tggaattacataacaggca

SEQ ID NO: 1963527 - DNA, 13 bp, Homo sapiens
tggagcagagacg

SEQ ID NO: 1963528 - DNA, 14 bp, Homo sapiens
tggaggagaaggag

SEQ ID NO: 1963529 - DNA, 14 bp, Homo sapiens
tggattcccctgga

SEQ ID NO: 1963530 - DNA, 15 bp, Homo sapiens
tggatttgacacact

SEQ ID NO: 1963531 - DNA, 20 bp, Homo sapiens
tggcaatatcatattctaaa

SEQ ID NO: 1963532 - DNA, 17 bp, Homo sapiens
tggcagcgcctcccgcc

SEQ ID NO: 1963533 - DNA, 22 bp, Homo sapiens
tggcagcgcctcccgccgcctc

SEQ ID NO: 1963534 - DNA, 24 bp, Homo sapiens
tggcagcgcctcccgccgcctcgg

SEQ ID NO: 1963535 - DNA, 14 bp, Homo sapiens
tggcatttgctgaa

SEQ ID NO: 1963536 - DNA, 21 bp, Homo sapiens
tggcatttgctgaataacaac

SEQ ID NO: 1963537 - DNA, 14 bp, Homo sapiens
tggccccagctggc

SEQ ID NO: 1963538 - DNA, 12 bp, Homo sapiens
tggccctgccct

SEQ ID NO: 1963539 - DNA, 15 bp, Homo sapiens
tggccctgccctccc

SEQ ID NO: 1963540 - DNA, 21 bp, Homo sapiens
tggccctgtgggagtccactt

SEQ ID NO: 1963541 - DNA, 13 bp, Homo sapiens
tggccggctggcc

SEQ ID NO: 1963542 - DNA, 23 bp, Homo sapiens
tggcctattttggacgtgtgagg

SEQ ID NO: 1963543 - DNA, 12 bp, Homo sapiens
tggcgggcagcc

SEQ ID NO: 1963544 - DNA, 14 bp, Homo sapiens
tggcgggcagcccc

SEQ ID NO: 1963545 - DNA, 14 bp, Homo sapiens
tttgcactgcttta

SEQ ID NO: 1963546 - DNA, 23 bp, Homo sapiens
tttgcgtaaatggttttcaacaa

SEQ ID NO: 1963547 - DNA, 17 bp, Homo sapiens
tttgctcaatatgatct

SEQ ID NO: 1963548 - DNA, 12 bp, Homo sapiens
tttgctgttatc

SEQ ID NO: 1963549 - DNA, 15 bp, Homo sapiens
tttggctgaaattat

SEQ ID NO: 1963550 - DNA, 21 bp, Homo sapiens
tttggctgtgatgtcacagtt

SEQ ID NO: 1963551 - DNA, 13 bp, Homo sapiens
tttggtggctcta

SEQ ID NO: 1963552 - DNA, 15 bp, Homo sapiens
tttggttcctcatgg

SEQ ID NO: 1963553 - DNA, 23 bp, Homo sapiens
tttgtagctagtttaaaattatt

SEQ ID NO: 1963554 - DNA, 18 bp, Homo sapiens
tttgtctttctgcagaaa

SEQ ID NO: 1963555 - DNA, 14 bp, Homo sapiens
tttgtgaagtgatt

SEQ ID NO: 1963556 - DNA, 20 bp, Homo sapiens
tttgtgaagtgattgacatt

SEQ ID NO: 1963557 - DNA, 21 bp, Homo sapiens
tttgtgaagtgattgacattt

SEQ ID NO: 1963558 - DNA, 15 bp, Homo sapiens
tttgtgtcctttaaa

SEQ ID NO: 1963559 - DNA, 12 bp, Homo sapiens
tttgtgtctttt

SEQ ID NO: 1963560 - DNA, 13 bp, Homo sapiens
tttgttatagttc

SEQ ID NO: 1963561 - DNA, 17 bp, Homo sapiens
tttgtttacaacacagt

SEQ ID NO: 1963562 - DNA, 20 bp, Homo sapiens
ttttaattcaggtgataact

SEQ ID NO: 1963563 - DNA, 18 bp, Homo sapiens
ttttagattcctacttaa

SEQ ID NO: 1963564 - DNA, 21 bp, Homo sapiens
ttttagtcagaaatgattcag

SEQ ID NO: 1963565 - DNA, 22 bp, Homo sapiens
ttttatggtactaatgaaattt

SEQ ID NO: 1963566 - DNA, 20 bp, Homo sapiens
ttttcaagttattcagaaat

SEQ ID NO: 1963567 - DNA, 16 bp, Homo sapiens
ttttcattttctctcc

SEQ ID NO: 1963568 - DNA, 17 bp, Homo sapiens
ttttccggggcacaagt

SEQ ID NO: 1963569 - DNA, 11 bp, Homo sapiens
ttttgatggaa

SEQ ID NO: 1963570 - DNA, 22 bp, Homo sapiens
ttttgggaaattcttgcactgt

SEQ ID NO: 1963571 - DNA, 21 bp, Homo sapiens
ttttgggatttgttgaaatct

SEQ ID NO: 1963572 - DNA, 23 bp, Homo sapiens
ttttgggatttgttgaaatcttt

SEQ ID NO: 1963573 - DNA, 12 bp, Homo sapiens
ttttgtagctag

SEQ ID NO: 1963574 - DNA, 14 bp, Homo sapiens
tttttagattccta

SEQ ID NO: 1963575 - DNA, 15 bp, Homo sapiens
tttttcattttctct

SEQ ID NO: 1963576 - DNA, 22 bp, Homo sapiens
tttttcctatgaccataaaatt

SEQ ID NO: 1963577 - DNA, 22 bp, Homo sapiens
tttttgttcaccttctgtgcat

SEQ ID NO: 1963578 - DNA, 13 bp, Homo sapiens
caacaaacactgt

SEQ ID NO: 1963579 - DNA, 22 bp, Homo sapiens
caacatgcttcatgaaaatcct

SEQ ID NO: 1963580 - DNA, 21 bp, Homo sapiens
caacatggattccaaagcatt

SEQ ID NO: 1963581 - DNA, 16 bp, Homo sapiens
caactgaatacttgaa

SEQ ID NO: 1963582 - DNA, 23 bp, Homo sapiens
caagaaatcgccttatgagaaca

SEQ ID NO: 1963583 - DNA, 21 bp, Homo sapiens
caatgtacaaggtatgtacag

SEQ ID NO: 1963584 - DNA, 22 bp, Homo sapiens
caatttactttttaaacagtgt

SEQ ID NO: 1963585 - DNA, 15 bp, Homo sapiens
caattttttaaacca

SEQ ID NO: 1963586 - DNA, 16 bp, Homo sapiens
cacaaaagctgtgtct

SEQ ID NO: 1963587 - DNA, 21 bp, Homo sapiens
cacaaatgtgtcccagtgaac

SEQ ID NO: 1963588 - DNA, 17 bp, Homo sapiens
cacaatgttgcactgaa

SEQ ID NO: 1963589 - DNA, 20 bp, Homo sapiens
cacaatgttgcactgaaaac

SEQ ID NO: 1963590 - DNA, 13 bp, Homo sapiens
cacagctcttgtt

SEQ ID NO: 1963591 - DNA, 17 bp, Homo sapiens
cacatctaaattgatca

SEQ ID NO: 1963592 - DNA, 14 bp, Homo sapiens
cacgtgtatgcaag

SEQ ID NO: 1963593 - DNA, 22 bp, Homo sapiens
cactggatccatccgtccagcc

SEQ ID NO: 1963594 - DNA, 15 bp, Homo sapiens
cactgtgatgttggg

SEQ ID NO: 1963595 - DNA, 12 bp, Homo sapiens
cagagttctttg

SEQ ID NO: 1963596 - DNA, 14 bp, Homo sapiens
cagagttctttgca

SEQ ID NO: 1963597 - DNA, 14 bp, Homo sapiens
cagatcctccattt

SEQ ID NO: 1963598 - DNA, 20 bp, Homo sapiens
cagatcctccatttttgttg

SEQ ID NO: 1963599 - DNA, 12 bp, Homo sapiens
cagatgtccctg

SEQ ID NO: 1963600 - DNA, 13 bp, Homo sapiens
cagatgtccctga

SEQ ID NO: 1963601 - DNA, 20 bp, Homo sapiens
cagatgtccctgaagtcttg

SEQ ID NO: 1963602 - DNA, 22 bp, Homo sapiens
cagatgtccctgaagtcttgca

SEQ ID NO: 1963603 - DNA, 22 bp, Homo sapiens
cagcatcaaacatgaaaacatt

SEQ ID NO: 1963604 - DNA, 13 bp, Homo sapiens
cagctcttgtttg

SEQ ID NO: 1963605 - DNA, 14 bp, Homo sapiens
cagctggtggatgg

SEQ ID NO: 1963606 - DNA, 18 bp, Homo sapiens
cagctggtggatggtgac

SEQ ID NO: 1963607 - DNA, 19 bp, Homo sapiens
caggttggaaaagaaatca

SEQ ID NO: 1963608 - DNA, 24 bp, Homo sapiens
caggttttcttctaatcataacat

SEQ ID NO: 1963609 - DNA, 18 bp, Homo sapiens
cagtaagtataacaaact

SEQ ID NO: 1963610 - DNA, 18 bp, Homo sapiens
cagtagtcacctctgggc

SEQ ID NO: 1963611 - DNA, 23 bp, Homo sapiens
cagtatcctgctggttcactcta

SEQ ID NO: 1963612 - DNA, 22 bp, Homo sapiens
cagtcattgtaacctcgtgtct

SEQ ID NO: 1963613 - DNA, 16 bp, Homo sapiens
cagtgaacagtttgga

SEQ ID NO: 1963614 - DNA, 15 bp, Homo sapiens
cagtgaatttaagca

SEQ ID NO: 1963615 - DNA, 14 bp, Homo sapiens
cagtgtatctaatt

SEQ ID NO: 1963616 - DNA, 13 bp, Homo sapiens
cagtgtttatgac

SEQ ID NO: 1963617 - DNA, 12 bp, Homo sapiens
cagtgtttgtat

SEQ ID NO: 1963618 - DNA, 22 bp, Homo sapiens
cataaaactcatgactgagtct

SEQ ID NO: 1963619 - DNA, 21 bp, Homo sapiens
cataaatttgttgtcatgtgt

SEQ ID NO: 1963620 - DNA, 17 bp, Homo sapiens
catagagatatttaaaa

SEQ ID NO: 1963621 - DNA, 23 bp, Homo sapiens
catagttgaaaaaagaagtttgg

SEQ ID NO: 1963622 - DNA, 18 bp, Homo sapiens
catatctctagtccctgt

SEQ ID NO: 1963623 - DNA, 20 bp, Homo sapiens
catattaagaatagtctctg

SEQ ID NO: 1963624 - DNA, 13 bp, Homo sapiens
catcaaacatgaa

SEQ ID NO: 1963625 - DNA, 17 bp, Homo sapiens
catcaaacatgaaaaca

SEQ ID NO: 1963626 - DNA, 16 bp, Homo sapiens
catcaaataaaccttg

SEQ ID NO: 1963627 - DNA, 12 bp, Homo sapiens
catccgtccagc

SEQ ID NO: 1963628 - DNA, 14 bp, Homo sapiens
catcgatatgaaaa

SEQ ID NO: 1963629 - DNA, 13 bp, Homo sapiens
catgaaaacattg

SEQ ID NO: 1963630 - DNA, 15 bp, Homo sapiens
catgaaaacattgat

SEQ ID NO: 1963631 - DNA, 18 bp, Homo sapiens
catgaaaacattgatgaa

SEQ ID NO: 1963632 - DNA, 12 bp, Homo sapiens
catgaagaagct

SEQ ID NO: 1963633 - DNA, 13 bp, Homo sapiens
catgcaggtctcc

SEQ ID NO: 1963634 - DNA, 18 bp, Homo sapiens
catgcaggtctccatgaa

SEQ ID NO: 1963635 - DNA, 21 bp, Homo sapiens
catgcaggtctccatgaagaa

SEQ ID NO: 1963636 - DNA, 15 bp, Homo sapiens
catggagtgtttgac

SEQ ID NO: 1963637 - DNA, 21 bp, Homo sapiens
catggagtgtttgacgaagaa

SEQ ID NO: 1963638 - DNA, 18 bp, Homo sapiens
catggtgtgtgtctctga

SEQ ID NO: 1963639 - DNA, 16 bp, Homo sapiens
catgtaaaatcttcag

SEQ ID NO: 1963640 - DNA, 20 bp, Homo sapiens
catgtattagccagtcattg

SEQ ID NO: 1963641 - DNA, 17 bp, Homo sapiens
catgtgcaactcttgta

SEQ ID NO: 1963642 - DNA, 18 bp, Homo sapiens
catgtgcaactcttgtat

SEQ ID NO: 1963643 - DNA, 13 bp, Homo sapiens
catgtgtatgaga

SEQ ID NO: 1963644 - DNA, 14 bp, Homo sapiens
catgtgtatgagaa

SEQ ID NO: 1963645 - DNA, 17 bp, Homo sapiens
cattagattatcaaaaa

SEQ ID NO: 1963646 - DNA, 21 bp, Homo sapiens
cattagattatcaaaaagtat

SEQ ID NO: 1963647 - DNA, 21 bp, Homo sapiens
cattatttgataacattttgt

SEQ ID NO: 1963648 - DNA, 12 bp, Homo sapiens
cattcacatttc

SEQ ID NO: 1963649 - DNA, 13 bp, Homo sapiens
cattgatgaatga

SEQ ID NO: 1963650 - DNA, 22 bp, Homo sapiens
cattgtaacctcgtgtctagta

SEQ ID NO: 1963651 - DNA, 18 bp, Homo sapiens
catttaggagaagttggt

SEQ ID NO: 1963652 - DNA, 16 bp, Homo sapiens
catttcgtgtaatatt

SEQ ID NO: 1963653 - DNA, 21 bp, Homo sapiens
catttgaaagtgggtttcaat

SEQ ID NO: 1963654 - DNA, 20 bp, Homo sapiens
cattttcagcatcaaacatg

SEQ ID NO: 1963655 - DNA, 20 bp, Homo sapiens
cattttgaatgtgatcatct

SEQ ID NO: 1963656 - DNA, 22 bp, Homo sapiens
ccacaaatgtgtcccagtgaac

SEQ ID NO: 1963657 - DNA, 14 bp, Homo sapiens
ccaggttggaaaag

SEQ ID NO: 1963658 - DNA, 18 bp, Homo sapiens
ccagtggaagaagaaaac

SEQ ID NO: 1963659 - DNA, 13 bp, Homo sapiens
ccatccgtccagc

SEQ ID NO: 1963660 - DNA, 15 bp, Homo sapiens
ccatccgtccagcca

SEQ ID NO: 1963661 - DNA, 22 bp, Homo sapiens
ccccttaaatttctgccctgag

SEQ ID NO: 1963662 - DNA, 15 bp, Homo sapiens
ccctcgtttgatagt

SEQ ID NO: 1963663 - DNA, 15 bp, Homo sapiens
ccctgaagtcttgca

SEQ ID NO: 1963664 - DNA, 16 bp, Homo sapiens
ccctgaagtcttgcat

SEQ ID NO: 1963665 - DNA, 11 bp, Homo sapiens
ccctgagccct

SEQ ID NO: 1963666 - DNA, 23 bp, Homo sapiens
ccctgagttgcaccattctttct

SEQ ID NO: 1963667 - DNA, 19 bp, Homo sapiens
cccttaaatttctgccctg

SEQ ID NO: 1963668 - DNA, 22 bp, Homo sapiens
ccggtgcatgcaggtctccatg

SEQ ID NO: 1963669 - DNA, 18 bp, Homo sapiens
cctaatgagaagtcaaca

SEQ ID NO: 1963670 - DNA, 17 bp, Homo sapiens
cctactgcttcctctga

SEQ ID NO: 1963671 - DNA, 15 bp, Homo sapiens
cctatgtctcagtgc

SEQ ID NO: 1963672 - DNA, 15 bp, Homo sapiens
cctcagatgtgttga

SEQ ID NO: 1963673 - DNA, 19 bp, Homo sapiens
cctcatctccagtatcctg

SEQ ID NO: 1963674 - DNA, 15 bp, Homo sapiens
cctcgtttgatagtg

SEQ ID NO: 1963675 - DNA, 16 bp, Homo sapiens
cctgaactctgcaact

SEQ ID NO: 1963676 - DNA, 21 bp, Homo sapiens
cctgcatatctctagtccctg

SEQ ID NO: 1963677 - DNA, 15 bp, Homo sapiens
ccttcaccacctcat

SEQ ID NO: 1963678 - DNA, 16 bp, Homo sapiens
ccttcagatcctaccc

SEQ ID NO: 1963679 - DNA, 15 bp, Homo sapiens
cctttcccatttcgt

SEQ ID NO: 1963680 - DNA, 14 bp, Homo sapiens
cgaagaaacaaaaa

SEQ ID NO: 1963681 - DNA, 23 bp, Homo sapiens
cgccagaactgctttatcccacg

SEQ ID NO: 1963682 - DNA, 16 bp, Homo sapiens
cgtgtaatattctctg

SEQ ID NO: 1963683 - DNA, 15 bp, Homo sapiens
cgtttttgctgcaga

SEQ ID NO: 1963684 - DNA, 16 bp, Homo sapiens
cgtttttgctgcagag

SEQ ID NO: 1963685 - DNA, 21 bp, Homo sapiens
ctaaatattggtttgttattc

SEQ ID NO: 1963686 - DNA, 19 bp, Homo sapiens
ctaaattgatcattcataa

SEQ ID NO: 1963687 - DNA, 17 bp, Homo sapiens
ctaacatttaggagaag

SEQ ID NO: 1963688 - DNA, 21 bp, Homo sapiens
ctaatgcttgccaagaaatcg

SEQ ID NO: 1963689 - DNA, 22 bp, Homo sapiens
ctacaaccaggtcttgacctga

SEQ ID NO: 1963690 - DNA, 13 bp, Homo sapiens
ctacacaacatgt

SEQ ID NO: 1963691 - DNA, 17 bp, Homo sapiens
ctactgcttcctctgaa

SEQ ID NO: 1963692 - DNA, 21 bp, Homo sapiens
ctagctatttctatgtatgtg

SEQ ID NO: 1963693 - DNA, 20 bp, Homo sapiens
ctatagataacggctctcca

SEQ ID NO: 1963694 - DNA, 15 bp, Homo sapiens
ctatctgcaatgttt

SEQ ID NO: 1963695 - DNA, 22 bp, Homo sapiens
ctatctgcaatgtttttgtgta

SEQ ID NO: 1963696 - DNA, 22 bp, Homo sapiens
ctatgtaatgcttatgtgttgc

SEQ ID NO: 1963697 - DNA, 18 bp, Homo sapiens
ctatttcctttgcgcaaa

SEQ ID NO: 1963698 - DNA, 16 bp, Homo sapiens
atattaagaaacaatt

SEQ ID NO: 1963699 - DNA, 21 bp, Homo sapiens
atattcatcaaataaaccttg

SEQ ID NO: 1963700 - DNA, 15 bp, Homo sapiens
atattctctgatgtt

SEQ ID NO: 1963701 - DNA, 17 bp, Homo sapiens
atattctgataatgtat

SEQ ID NO: 1963702 - DNA, 16 bp, Homo sapiens
atattgaccatgtgat

SEQ ID NO: 1963703 - DNA, 22 bp, Homo sapiens
atattgaccatgtgattatgga

SEQ ID NO: 1963704 - DNA, 19 bp, Homo sapiens
atatttcttcaagtgagtg

SEQ ID NO: 1963705 - DNA, 12 bp, Homo sapiens
atcaaacatgaa

SEQ ID NO: 1963706 - DNA, 14 bp, Homo sapiens
atcaaacatgaaaa

SEQ ID NO: 1963707 - DNA, 21 bp, Homo sapiens
atcacaaaagctgtgtctctg

SEQ ID NO: 1963708 - DNA, 23 bp, Homo sapiens
atcacaaaagctgtgtctctgta

SEQ ID NO: 1963709 - DNA, 12 bp, Homo sapiens
atcatctttgct

SEQ ID NO: 1963710 - DNA, 13 bp, Homo sapiens
atcatctttgctg

SEQ ID NO: 1963711 - DNA, 22 bp, Homo sapiens
atcatctttgctgaatgtcatt

SEQ ID NO: 1963712 - DNA, 15 bp, Homo sapiens
atcattcataatttt

SEQ ID NO: 1963713 - DNA, 20 bp, Homo sapiens
atccaaatgctgtgcaaaca

SEQ ID NO: 1963714 - DNA, 22 bp, Homo sapiens
atccaaatgctgtgcaaacagt

SEQ ID NO: 1963715 - DNA, 16 bp, Homo sapiens
atccagtagggaaaat

SEQ ID NO: 1963716 - DNA, 17 bp, Homo sapiens
atccagtagggaaaata

SEQ ID NO: 1963717 - DNA, 21 bp, Homo sapiens
atcgccttatgagaacatggt

SEQ ID NO: 1963718 - DNA, 18 bp, Homo sapiens
atctgcatgtaaaatctt

SEQ ID NO: 1963719 - DNA, 21 bp, Homo sapiens
atctgcatgtaaaatcttcag

SEQ ID NO: 1963720 - DNA, 22 bp, Homo sapiens
atctgcatgtaaaatcttcagc

SEQ ID NO: 1963721 - DNA, 19 bp, Homo sapiens
atctgtggattcagcttct

SEQ ID NO: 1963722 - DNA, 14 bp, Homo sapiens
atcttcagctggtg

SEQ ID NO: 1963723 - DNA, 19 bp, Homo sapiens
atcttcagctggtggatgg

SEQ ID NO: 1963724 - DNA, 12 bp, Homo sapiens
atgaaaacctgc

SEQ ID NO: 1963725 - DNA, 14 bp, Homo sapiens
atgaaaacctgcat

SEQ ID NO: 1963726 - DNA, 15 bp, Homo sapiens
atgaaaatcctacca

SEQ ID NO: 1963727 - DNA, 17 bp, Homo sapiens
atgaaaatcctaccaac

SEQ ID NO: 1963728 - DNA, 14 bp, Homo sapiens
atgaatttgactgg

SEQ ID NO: 1963729 - DNA, 15 bp, Homo sapiens
atgaatttgactggt

SEQ ID NO: 1963730 - DNA, 23 bp, Homo sapiens
atgacgagacctcagatgtgttg

SEQ ID NO: 1963731 - DNA, 23 bp, Homo sapiens
atgactgagtctggcaaacatgt

SEQ ID NO: 1963732 - DNA, 13 bp, Homo sapiens
atgagaacatggt

SEQ ID NO: 1963733 - DNA, 23 bp, Homo sapiens
atgagaagtactttgtgctgatc

SEQ ID NO: 1963734 - DNA, 15 bp, Homo sapiens
atgatgcatggagtg

SEQ ID NO: 1963735 - DNA, 21 bp, Homo sapiens
atgatgcatggagtgtttgac

SEQ ID NO: 1963736 - DNA, 13 bp, Homo sapiens
atgatggaaagga

SEQ ID NO: 1963737 - DNA, 14 bp, Homo sapiens
atgatttttgtgta

SEQ ID NO: 1963738 - DNA, 14 bp, Homo sapiens
atgcaggtctccat

SEQ ID NO: 1963739 - DNA, 15 bp, Homo sapiens
atgcgggcattttga

SEQ ID NO: 1963740 - DNA, 19 bp, Homo sapiens
atgctgtgcaaacagtgta

SEQ ID NO: 1963741 - DNA, 15 bp, Homo sapiens
atgcttcatgaaaat

SEQ ID NO: 1963742 - DNA, 22 bp, Homo sapiens
atggatttggttatgatggaaa

SEQ ID NO: 1963743 - DNA, 14 bp, Homo sapiens
atggtgacttttga

SEQ ID NO: 1963744 - DNA, 15 bp, Homo sapiens
atggtgacttttgaa

SEQ ID NO: 1963745 - DNA, 18 bp, Homo sapiens
atgtaaaatcttcagctg

SEQ ID NO: 1963746 - DNA, 21 bp, Homo sapiens
atgtaatgcttatgtgttgca

SEQ ID NO: 1963747 - DNA, 15 bp, Homo sapiens
atgtacaaggtatgt

SEQ ID NO: 1963748 - DNA, 17 bp, Homo sapiens
atgtacaaggtatgtac

SEQ ID NO: 1963749 - DNA, 19 bp, Homo sapiens
atgtacaaggtatgtacag

SEQ ID NO: 1963750 - DNA, 15 bp, Homo sapiens
atgtacagttcataa

SEQ ID NO: 1963751 - DNA, 23 bp, Homo sapiens
atgtacagttcataaatttgttg

SEQ ID NO: 1963752 - DNA, 17 bp, Homo sapiens
atgtatgtgccaatttt

SEQ ID NO: 1963753 - DNA, 18 bp, Homo sapiens
atgtatgtgccaattttg

SEQ ID NO: 1963754 - DNA, 19 bp, Homo sapiens
atgtatgtgccaattttgt

SEQ ID NO: 1963755 - DNA, 17 bp, Homo sapiens
atgtatgtggatacagt

SEQ ID NO: 1963756 - DNA, 21 bp, Homo sapiens
atgtatgtggatacagtcatt

SEQ ID NO: 1963757 - DNA, 18 bp, Homo sapiens
atgtattagccagtcatt

SEQ ID NO: 1963758 - DNA, 20 bp, Homo sapiens
atgtccctgaagtcttgcat

SEQ ID NO: 1963759 - DNA, 17 bp, Homo sapiens
atgtgatcatctttgct

SEQ ID NO: 1963760 - DNA, 20 bp, Homo sapiens
atgtgccaattttgtcacag

SEQ ID NO: 1963761 - DNA, 18 bp, Homo sapiens
atgtggatacagtcatta

SEQ ID NO: 1963762 - DNA, 13 bp, Homo sapiens
atgtgtatgagaa

SEQ ID NO: 1963763 - DNA, 22 bp, Homo sapiens
atgtgtcccagtgaacagtttg

SEQ ID NO: 1963764 - DNA, 18 bp, Homo sapiens
atgtgtctgcaacatgga

SEQ ID NO: 1963765 - DNA, 14 bp, Homo sapiens
atgttacttaaaca

SEQ ID NO: 1963766 - DNA, 12 bp, Homo sapiens
atgttggtgcaa

SEQ ID NO: 1963767 - DNA, 21 bp, Homo sapiens
atgttggtgcaattaactctg

SEQ ID NO: 1963768 - DNA, 17 bp, Homo sapiens
atgtttttgtgtagagt

SEQ ID NO: 1963769 - DNA, 17 bp, Homo sapiens
attaaattctctctaac

SEQ ID NO: 1963770 - DNA, 16 bp, Homo sapiens
attaactctggacctc

SEQ ID NO: 1963771 - DNA, 14 bp, Homo sapiens
attaagaaacaatt

SEQ ID NO: 1963772 - DNA, 17 bp, Homo sapiens
attaagaatagtctctg

SEQ ID NO: 1963773 - DNA, 22 bp, Homo sapiens
attatggacatcgatatgaaaa

SEQ ID NO: 1963774 - DNA, 18 bp, Homo sapiens
attatttgataacatttt

SEQ ID NO: 1963775 - DNA, 12 bp, Homo sapiens
attcatcaaata

SEQ ID NO: 1963776 - DNA, 21 bp, Homo sapiens
attctaaacagatgtccctga

SEQ ID NO: 1963777 - DNA, 19 bp, Homo sapiens
attctgttctacttgatat

SEQ ID NO: 1963778 - DNA, 20 bp, Homo sapiens
attcttttccagaaagaaaa

SEQ ID NO: 1963779 - DNA, 21 bp, Homo sapiens
attcttttccagaaagaaaat

SEQ ID NO: 1963780 - DNA, 11 bp, Homo sapiens
attgaatttag

SEQ ID NO: 1963781 - DNA, 16 bp, Homo sapiens
attgaccatgtgatta

SEQ ID NO: 1963782 - DNA, 21 bp, Homo sapiens
attgcagtgcggctcacatca

SEQ ID NO: 1963783 - DNA, 14 bp, Homo sapiens
atttaaaagacaaa

SEQ ID NO: 1963784 - DNA, 15 bp, Homo sapiens
atttaaaagacaaac

SEQ ID NO: 1963785 - DNA, 19 bp, Homo sapiens
atttaaaagacaaacacct

SEQ ID NO: 1963786 - DNA, 13 bp, Homo sapiens
atttaaagcacat

SEQ ID NO: 1963787 - DNA, 19 bp, Homo sapiens
atttaaattgttataactt

SEQ ID NO: 1963788 - DNA, 14 bp, Homo sapiens
atttaagcatgagt

SEQ ID NO: 1963789 - DNA, 17 bp, Homo sapiens
atttaagcatgagtggc

SEQ ID NO: 1963790 - DNA, 24 bp, Homo sapiens
atttaatgatttttgtgtatccag

SEQ ID NO: 1963791 - DNA, 19 bp, Homo sapiens
atttactttttaaacagtg

SEQ ID NO: 1963792 - DNA, 15 bp, Homo sapiens
atttaggagaagttg

SEQ ID NO: 1963793 - DNA, 16 bp, Homo sapiens
atttcaagatccaaat

SEQ ID NO: 1963794 - DNA, 14 bp, Homo sapiens
atttcgatgtacag

SEQ ID NO: 1963795 - DNA, 15 bp, Homo sapiens
atttcgatgtacagt

SEQ ID NO: 1963796 - DNA, 18 bp, Homo sapiens
atttgttgtcatgtgtat

SEQ ID NO: 1963797 - DNA, 20 bp, Homo sapiens
attttatctacccagtcatg

SEQ ID NO: 1963798 - DNA, 16 bp, Homo sapiens
attttctgtaaatgaa

SEQ ID NO: 1963799 - DNA, 14 bp, Homo sapiens
attttgaatgtgat

SEQ ID NO: 1963800 - DNA, 15 bp, Homo sapiens
attttgaatgtgatc

SEQ ID NO: 1963801 - DNA, 17 bp, Homo sapiens
attttgtcacagctctt

SEQ ID NO: 1963802 - DNA, 21 bp, Homo sapiens
atttttaaaggacaaacagtg

SEQ ID NO: 1963803 - DNA, 22 bp, Homo sapiens
caaaaattgcgagcctttaccc

SEQ ID NO: 1963804 - DNA, 15 bp, Homo sapiens
caaaagctgtgtctc

SEQ ID NO: 1963805 - DNA, 17 bp, Homo sapiens
caaaagctgtgtctctg

SEQ ID NO: 1963806 - DNA, 23 bp, Homo sapiens
caaaagctgtgtctctgtatata

SEQ ID NO: 1963807 - DNA, 15 bp, Homo sapiens
caaaagtctgaggca

SEQ ID NO: 1963808 - DNA, 18 bp, Homo sapiens
caaacactgtgatgttgg

SEQ ID NO: 1963809 - DNA, 13 bp, Homo sapiens
caaacagtgaatt

SEQ ID NO: 1963810 - DNA, 14 bp, Homo sapiens
caaacatgtgcaac

SEQ ID NO: 1963811 - DNA, 21 bp, Homo sapiens
caaacatgtgcaactcttgta

SEQ ID NO: 1963812 - DNA, 14 bp, Homo sapiens
caaactatgtaatg

SEQ ID NO: 1963813 - DNA, 13 bp, Homo sapiens
caaagaagtggtt

SEQ ID NO: 1963814 - DNA, 14 bp, Homo sapiens
caaataaaccttgt

SEQ ID NO: 1963815 - DNA, 18 bp, Homo sapiens
caaataaaccttgtttct

SEQ ID NO: 1963816 - DNA, 15 bp, Homo sapiens
caaatgctgtgcaaa

SEQ ID NO: 1963817 - DNA, 21 bp, Homo sapiens
caaatgctgtgcaaacagtgt

SEQ ID NO: 1963818 - DNA, 19 bp, Homo sapiens
caaattttgaggtctttta

SEQ ID NO: 1963819 - DNA, 23 bp, Homo sapiens
aaactaccagtgggcatgtatta

SEQ ID NO: 1963820 - DNA, 23 bp, Homo sapiens
aaactcctactgcttcctctgaa

SEQ ID NO: 1963821 - DNA, 17 bp, Homo sapiens
aaagaccaaattttgag

SEQ ID NO: 1963822 - DNA, 19 bp, Homo sapiens
aaaggctttggcaacagaa

SEQ ID NO: 1963823 - DNA, 22 bp, Homo sapiens
aaaggctttggcaacagaaaac

SEQ ID NO: 1963824 - DNA, 16 bp, Homo sapiens
aaagttccagttttgt

SEQ ID NO: 1963825 - DNA, 21 bp, Homo sapiens
aaataaaccttgtttctttct

SEQ ID NO: 1963826 - DNA, 16 bp, Homo sapiens
aaatagggtccttgaa

SEQ ID NO: 1963827 - DNA, 22 bp, Homo sapiens
aaatatagttgtctttctttgc

SEQ ID NO: 1963828 - DNA, 12 bp, Homo sapiens
aaatcaattttt

SEQ ID NO: 1963829 - DNA, 19 bp, Homo sapiens
aaatcctaccaacctctga

SEQ ID NO: 1963830 - DNA, 22 bp, Homo sapiens
aaatcgccttatgagaacatgg

SEQ ID NO: 1963831 - DNA, 13 bp, Homo sapiens
aaatcttcagctg

SEQ ID NO: 1963832 - DNA, 19 bp, Homo sapiens
aaatcttcagctggtggat

SEQ ID NO: 1963833 - DNA, 11 bp, Homo sapiens
aaatgcattca

SEQ ID NO: 1963834 - DNA, 14 bp, Homo sapiens
aaatgcattcatgt

SEQ ID NO: 1963835 - DNA, 14 bp, Homo sapiens
aaattgatcattca

SEQ ID NO: 1963836 - DNA, 11 bp, Homo sapiens
aacaatcacaa

SEQ ID NO: 1963837 - DNA, 15 bp, Homo sapiens
aacagatgtccctga

SEQ ID NO: 1963838 - DNA, 15 bp, Homo sapiens
aacataacaaccttt

SEQ ID NO: 1963839 - DNA, 15 bp, Homo sapiens
aacatagttgaaaaa

SEQ ID NO: 1963840 - DNA, 12 bp, Homo sapiens
aacatgaaaaca

SEQ ID NO: 1963841 - DNA, 20 bp, Homo sapiens
aacatgaaaacattgatgaa

SEQ ID NO: 1963842 - DNA, 13 bp, Homo sapiens
aacatgcagctct

SEQ ID NO: 1963843 - DNA, 20 bp, Homo sapiens
aacatggtgtgtgtctctga

SEQ ID NO: 1963844 - DNA, 12 bp, Homo sapiens
aacatgtatgtg

SEQ ID NO: 1963845 - DNA, 20 bp, Homo sapiens
aacatttaggagaagttggt

SEQ ID NO: 1963846 - DNA, 13 bp, Homo sapiens
aaccaacccatgt

SEQ ID NO: 1963847 - DNA, 20 bp, Homo sapiens
aactaccagtgggcatgtat

SEQ ID NO: 1963848 - DNA, 21 bp, Homo sapiens
aactatgtaatgcttatgtgt

SEQ ID NO: 1963849 - DNA, 23 bp, Homo sapiens
aactccatgggattttatctgtg

SEQ ID NO: 1963850 - DNA, 14 bp, Homo sapiens
aactcttgtattgc

SEQ ID NO: 1963851 - DNA, 23 bp, Homo sapiens
aactttaacaggttttcttctaa

SEQ ID NO: 1963852 - DNA, 19 bp, Homo sapiens
aagaaaatgaatttgactg

SEQ ID NO: 1963853 - DNA, 15 bp, Homo sapiens
aagaaaatgtgtctg

SEQ ID NO: 1963854 - DNA, 19 bp, Homo sapiens
aagaaatcgccttatgaga

SEQ ID NO: 1963855 - DNA, 21 bp, Homo sapiens
aagaacatttgaatcttggga

SEQ ID NO: 1963856 - DNA, 15 bp, Homo sapiens
aagaaccgcattttg

SEQ ID NO: 1963857 - DNA, 20 bp, Homo sapiens
aagacaaacaccttatttgt

SEQ ID NO: 1963858 - DNA, 17 bp, Homo sapiens
aagatactcaagcaggt

SEQ ID NO: 1963859 - DNA, 20 bp, Homo sapiens
aagatccaaatgctgtgcaa

SEQ ID NO: 1963860 - DNA, 21 bp, Homo sapiens
aagatccaaatgctgtgcaaa

SEQ ID NO: 1963861 - DNA, 23 bp, Homo sapiens
aagatccaaatgctgtgcaaaca

SEQ ID NO: 1963862 - DNA, 16 bp, Homo sapiens
aagcacatgccaggga

SEQ ID NO: 1963863 - DNA, 15 bp, Homo sapiens
aagcagagttctttg

SEQ ID NO: 1963864 - DNA, 16 bp, Homo sapiens
aagcagagttctttgc

SEQ ID NO: 1963865 - DNA, 15 bp, Homo sapiens
aagcatgagtggcct

SEQ ID NO: 1963866 - DNA, 16 bp, Homo sapiens
aagctgggactcattc

SEQ ID NO: 1963867 - DNA, 14 bp, Homo sapiens
aagctgtgtctctg

SEQ ID NO: 1963868 - DNA, 16 bp, Homo sapiens
aaggaggaggctccca

SEQ ID NO: 1963869 - DNA, 14 bp, Homo sapiens
aaggtatctggtat

SEQ ID NO: 1963870 - DNA, 12 bp, Homo sapiens
aagtataacaaa

SEQ ID NO: 1963871 - DNA, 12 bp, Homo sapiens
aagtcttgcatt

SEQ ID NO: 1963872 - DNA, 22 bp, Homo sapiens
aagtgacagatcctccattttt

SEQ ID NO: 1963873 - DNA, 13 bp, Homo sapiens
aagtgagtggcat

SEQ ID NO: 1963874 - DNA, 15 bp, Homo sapiens
aagtgagtggcatgt

SEQ ID NO: 1963875 - DNA, 18 bp, Homo sapiens
aagtgggagatgaaaacc

SEQ ID NO: 1963876 - DNA, 15 bp, Homo sapiens
aagttggtcttactt

SEQ ID NO: 1963877 - DNA, 18 bp, Homo sapiens
aagtttgtcctttaacta

SEQ ID NO: 1963878 - DNA, 15 bp, Homo sapiens
aataaaccttgtttc

SEQ ID NO: 1963879 - DNA, 21 bp, Homo sapiens
aataaaccttgtttctttctg

SEQ ID NO: 1963880 - DNA, 21 bp, Homo sapiens
aataaatatagttgtctttct

SEQ ID NO: 1963881 - DNA, 17 bp, Homo sapiens
aatagcaacatgcttca

SEQ ID NO: 1963882 - DNA, 22 bp, Homo sapiens
aatagtctctgggtttacaaca

SEQ ID NO: 1963883 - DNA, 18 bp, Homo sapiens
aatattctgataatgtat

SEQ ID NO: 1963884 - DNA, 14 bp, Homo sapiens
aatcaattttttaa

SEQ ID NO: 1963885 - DNA, 14 bp, Homo sapiens
aatcataacatagt

SEQ ID NO: 1963886 - DNA, 21 bp, Homo sapiens
aatcataacatagttgaaaaa

SEQ ID NO: 1963887 - DNA, 16 bp, Homo sapiens
aatcgccttatgagaa

SEQ ID NO: 1963888 - DNA, 18 bp, Homo sapiens
aatcgccttatgagaaca

SEQ ID NO: 1963889 - DNA, 21 bp, Homo sapiens
aatctcttctaaaaaaaaaca

SEQ ID NO: 1963890 - DNA, 11 bp, Homo sapiens
aatcttcagct

SEQ ID NO: 1963891 - DNA, 14 bp, Homo sapiens
aatcttcagctggt

SEQ ID NO: 1963892 - DNA, 16 bp, Homo sapiens
aatgaagggtcatttc

SEQ ID NO: 1963893 - DNA, 16 bp, Homo sapiens
aatgaatttgactggt

SEQ ID NO: 1963894 - DNA, 19 bp, Homo sapiens
aatgaggaacaatcacaaa

SEQ ID NO: 1963895 - DNA, 17 bp, Homo sapiens
aatgcagaggaggagaa

SEQ ID NO: 1963896 - DNA, 15 bp, Homo sapiens
aatgcattcatgttt

SEQ ID NO: 1963897 - DNA, 15 bp, Homo sapiens
aatgcttatgtgttg

SEQ ID NO: 1963898 - DNA, 13 bp, Homo sapiens
aatgtgatcatct

SEQ ID NO: 1963899 - DNA, 18 bp, Homo sapiens
aatgtgatcatctttgct

SEQ ID NO: 1963900 - DNA, 17 bp, Homo sapiens
aatgtgtctgcaacatg

SEQ ID NO: 1963901 - DNA, 20 bp, Homo sapiens
aatgtgtctgcaacatggat

SEQ ID NO: 1963902 - DNA, 16 bp, Homo sapiens
aatgttggtgcaatta

SEQ ID NO: 1963903 - DNA, 14 bp, Homo sapiens
aatgtttttgtgta

SEQ ID NO: 1963904 - DNA, 13 bp, Homo sapiens
aattgatcattca

SEQ ID NO: 1963905 - DNA, 14 bp, Homo sapiens
aattggtcattcct

SEQ ID NO: 1963906 - DNA, 13 bp, Homo sapiens
aatttaaattgtt

SEQ ID NO: 1963907 - DNA, 14 bp, Homo sapiens
aatttaaattgtta

SEQ ID NO: 1963908 - DNA, 22 bp, Homo sapiens
aatttactttttaaacagtgtt

SEQ ID NO: 1963909 - DNA, 13 bp, Homo sapiens
aatttagtcatta

SEQ ID NO: 1963910 - DNA, 18 bp, Homo sapiens
aatttctgccctgagccc

SEQ ID NO: 1963911 - DNA, 18 bp, Homo sapiens
aatttgttgtcatgtgta

SEQ ID NO: 1963912 - DNA, 17 bp, Homo sapiens
aattttgtcacagctct

SEQ ID NO: 1963913 - DNA, 16 bp, Homo sapiens
acaaaagctgtgtctc

SEQ ID NO: 1963914 - DNA, 22 bp, Homo sapiens
acaaaaggctttggcaacagaa

SEQ ID NO: 1963915 - DNA, 12 bp, Homo sapiens
acaaacagtgaa

SEQ ID NO: 1963916 - DNA, 13 bp, Homo sapiens
acaaacagtgaat

SEQ ID NO: 1963917 - DNA, 14 bp, Homo sapiens
acaacaaacactgt

SEQ ID NO: 1963918 - DNA, 13 bp, Homo sapiens
acaacatgtatgt

SEQ ID NO: 1963919 - DNA, 22 bp, Homo sapiens
acaacctttcccatttcgtgta

SEQ ID NO: 1963920 - DNA, 22 bp, Homo sapiens
acaactagcctcatctccagta

SEQ ID NO: 1963921 - DNA, 21 bp, Homo sapiens
acaatcacaaaagctgtgtct

SEQ ID NO: 1963922 - DNA, 20 bp, Homo sapiens
acaatgcgtggcacatctaa

SEQ ID NO: 1963923 - DNA, 21 bp, Homo sapiens
acaatgcgtggcacatctaaa

SEQ ID NO: 1963924 - DNA, 22 bp, Homo sapiens
acaatgtacaaggtatgtacag

SEQ ID NO: 1963925 - DNA, 20 bp, Homo sapiens
acaatgttgcactgaaaacc

SEQ ID NO: 1963926 - DNA, 15 bp, Homo sapiens
acaatttaaattgtt

SEQ ID NO: 1963927 - DNA, 13 bp, Homo sapiens
acacaacatgtat

SEQ ID NO: 1963928 - DNA, 16 bp, Homo sapiens
acacaacatgtatgtg

SEQ ID NO: 1963929 - DNA, 19 bp, Homo sapiens
acacacttgggagcagtcc

SEQ ID NO: 1963930 - DNA, 15 bp, Homo sapiens
acaccaaaaattgcg

SEQ ID NO: 1963931 - DNA, 17 bp, Homo sapiens
acagaaaacaattgttc

SEQ ID NO: 1963932 - DNA, 15 bp, Homo sapiens
acagatcctccattt

SEQ ID NO: 1963933 - DNA, 14 bp, Homo sapiens
acagatgtccctga

SEQ ID NO: 1963934 - DNA, 12 bp, Homo sapiens
acagctcttgtt

SEQ ID NO: 1963935 - DNA, 13 bp, Homo sapiens
acagtctcaattt

SEQ ID NO: 1963936 - DNA, 21 bp, Homo sapiens
acagtctcaattttgtattta

SEQ ID NO: 1963937 - DNA, 13 bp, Homo sapiens
acagtgtaagctt

SEQ ID NO: 1963938 - DNA, 22 bp, Homo sapiens
acagttcataaatttgttgtca

SEQ ID NO: 1963939 - DNA, 12 bp, Homo sapiens
acatacagtgat

SEQ ID NO: 1963940 - DNA, 21 bp, Homo sapiens
acatagttgaaaaaagaagtt

SEQ ID NO: 1963941 - DNA, 22 bp, Homo sapiens
acatctaaattgatcattcata

SEQ ID NO: 1963942 - DNA, 12 bp, Homo sapiens
acatgaaaacat

SEQ ID NO: 1963943 - DNA, 19 bp, Homo sapiens
acatggattccaaagcatt

SEQ ID NO: 1963944 - DNA, 11 bp, Homo sapiens
acatgtgcaac

SEQ ID NO: 1963945 - DNA, 18 bp, Homo sapiens
acatgtgcaactcttgta

SEQ ID NO: 1963946 - DNA, 16 bp, Homo sapiens
acatttaggagaagtt

SEQ ID NO: 1963947 - DNA, 18 bp, Homo sapiens
acattttgacacaatgtt

SEQ ID NO: 1963948 - DNA, 18 bp, Homo sapiens
accagtagtcacctctgg

SEQ ID NO: 1963949 - DNA, 20 bp, Homo sapiens
accagtagtcacctctgggc

SEQ ID NO: 1963950 - DNA, 19 bp, Homo sapiens
accattctttcttggtgca

SEQ ID NO: 1963951 - DNA, 15 bp, Homo sapiens
acctcatgtcatttc

SEQ ID NO: 1963952 - DNA, 19 bp, Homo sapiens
acctctcttgtgagccata

SEQ ID NO: 1963953 - DNA, 15 bp, Homo sapiens
acctctgaagtctct

SEQ ID NO: 1963954 - DNA, 16 bp, Homo sapiens
acctgaactctgcaac

SEQ ID NO: 1963955 - DNA, 15 bp, Homo sapiens
acctgcatttttaaa

SEQ ID NO: 1963956 - DNA, 15 bp, Homo sapiens
accttcagatcctac

SEQ ID NO: 1963957 - DNA, 19 bp, Homo sapiens
acggaaaatgccaatctct

SEQ ID NO: 1963958 - DNA, 13 bp, Homo sapiens
acggctctccaga

SEQ ID NO: 1963959 - DNA, 21 bp, Homo sapiens
actaatgcttgccaagaaatc

SEQ ID NO: 1963960 - DNA, 23 bp, Homo sapiens
actagtaccttcagatcctaccc

SEQ ID NO: 1963961 - DNA, 17 bp, Homo sapiens
actatgtaatgcttatg

SEQ ID NO: 1963962 - DNA, 23 bp, Homo sapiens
actatgtaatgcttatgtgttgc

SEQ ID NO: 1963963 - DNA, 14 bp, Homo sapiens
actcctactgcttc

SEQ ID NO: 1963964 - DNA, 22 bp, Homo sapiens
actcctactgcttcctctgaat

SEQ ID NO: 1963965 - DNA, 19 bp, Homo sapiens
actctggacctctcttgtg

SEQ ID NO: 1963966 - DNA, 19 bp, Homo sapiens
actgcttcctctgaatatt

SEQ ID NO: 1963967 - DNA, 15 bp, Homo sapiens
actggagagtggcaa

SEQ ID NO: 1963968 - DNA, 21 bp, Homo sapiens
actggatccatccgtccagcc

SEQ ID NO: 1963969 - DNA, 10 bp, Homo sapiens
acttaaacat

SEQ ID NO: 1963970 - DNA, 13 bp, Homo sapiens
acttaaacatcat

SEQ ID NO: 1963971 - DNA, 18 bp, Homo sapiens
acttaaacatcattggat

SEQ ID NO: 1963972 - DNA, 13 bp, Homo sapiens
acttcataaaact

SEQ ID NO: 1963973 - DNA, 12 bp, Homo sapiens
actttgtgcaaa

SEQ ID NO: 1963974 - DNA, 18 bp, Homo sapiens
actttttaaaatgttggt

SEQ ID NO: 1963975 - DNA, 13 bp, Homo sapiens
agaaaatgtgtct

SEQ ID NO: 1963976 - DNA, 23 bp, Homo sapiens
agaaaatgtgtctgcaacatgga

SEQ ID NO: 1963977 - DNA, 21 bp, Homo sapiens
agaacatggtgtgtgtctctg

SEQ ID NO: 1963978 - DNA, 14 bp, Homo sapiens
agaagtactttgtg

SEQ ID NO: 1963979 - DNA, 17 bp, Homo sapiens
agaagtcaacagtgaaa

SEQ ID NO: 1963980 - DNA, 21 bp, Homo sapiens
agaagttggtcttactttgtg

SEQ ID NO: 1963981 - DNA, 19 bp, Homo sapiens
agaagtttgggctaacatt

SEQ ID NO: 1963982 - DNA, 23 bp, Homo sapiens
agaatggtttttgttgagtctct

SEQ ID NO: 1963983 - DNA, 15 bp, Homo sapiens
agacctcagatgtgt

SEQ ID NO: 1963984 - DNA, 22 bp, Homo sapiens
agagcccctcctaacccagcag

SEQ ID NO: 1963985 - DNA, 19 bp, Homo sapiens
agataatcttagctgccaa

SEQ ID NO: 1963986 - DNA, 16 bp, Homo sapiens
agatactcaagcaggt

SEQ ID NO: 1963987 - DNA, 20 bp, Homo sapiens
agatatttaaaagacaaaca

SEQ ID NO: 1963988 - DNA, 11 bp, Homo sapiens
agatgaaaacc

SEQ ID NO: 1963989 - DNA, 18 bp, Homo sapiens
agatgaaaccgtccctga

SEQ ID NO: 1963990 - DNA, 18 bp, Homo sapiens
agatgtccctgaagtctt

SEQ ID NO: 1963991 - DNA, 20 bp, Homo sapiens
agcaacatgcttcatgaaaa

SEQ ID NO: 1963992 - DNA, 17 bp, Homo sapiens
agcacatgccagggaaa

SEQ ID NO: 1963993 - DNA, 23 bp, Homo sapiens
agcacatgccagggaaaaagacc

SEQ ID NO: 1963994 - DNA, 15 bp, Homo sapiens
agcatgagtggcctt

SEQ ID NO: 1963995 - DNA, 13 bp, Homo sapiens
agcattttcagca

SEQ ID NO: 1963996 - DNA, 21 bp, Homo sapiens
agcattttcagcatcaaacat

SEQ ID NO: 1963997 - DNA, 15 bp, Homo sapiens
agccaagagctcttc

SEQ ID NO: 1963998 - DNA, 22 bp, Homo sapiens
agccaagagctcttcatctgct

SEQ ID NO: 1963999 - DNA, 18 bp, Homo sapiens
agccatagagatatttaa

SEQ ID NO: 1964000 - DNA, 21 bp, Homo sapiens
agcccctcctaacccagcagt

SEQ ID NO: 1964001 - DNA, 18 bp, Homo sapiens
agccctccacgtcagtgc

SEQ ID NO: 1964002 - DNA, 22 bp, Homo sapiens
agcctttaccctcctctatttc

SEQ ID NO: 1964003 - DNA, 15 bp, Homo sapiens
agctatttctatgta

SEQ ID NO: 1964004 - DNA, 14 bp, Homo sapiens
agctccagtggaag

SEQ ID NO: 1964005 - DNA, 13 bp, Homo sapiens
agctctatctgca

SEQ ID NO: 1964006 - DNA, 17 bp, Homo sapiens
agctctatctgcaatgt

SEQ ID NO: 1964007 - DNA, 18 bp, Homo sapiens
agctctatctgcaatgtt

SEQ ID NO: 1964008 - DNA, 15 bp, Homo sapiens
agctctgcagcaata

SEQ ID NO: 1964009 - DNA, 12 bp, Homo sapiens
agctcttgtttg

SEQ ID NO: 1964010 - DNA, 15 bp, Homo sapiens
agctgccaagtaaat

SEQ ID NO: 1964011 - DNA, 20 bp, Homo sapiens
agctggtggatggtgacttt

SEQ ID NO: 1964012 - DNA, 11 bp, Homo sapiens
agctgtgtctc

SEQ ID NO: 1964013 - DNA, 16 bp, Homo sapiens
agcttagattttctgt

SEQ ID NO: 1964014 - DNA, 11 bp, Homo sapiens
aggacaaacag

SEQ ID NO: 1964015 - DNA, 16 bp, Homo sapiens
aggacaaacagtgaat

SEQ ID NO: 1964016 - DNA, 18 bp, Homo sapiens
aggctttggcaacagaaa

SEQ ID NO: 1964017 - DNA, 15 bp, Homo sapiens
aggtatctggtatct

SEQ ID NO: 1964018 - DNA, 18 bp, Homo sapiens
aggtatctggtatctgca

SEQ ID NO: 1964019 - DNA, 15 bp, Homo sapiens
aggtctccatgaaga

SEQ ID NO: 1964020 - DNA, 14 bp, Homo sapiens
aggtttcttgcttc

SEQ ID NO: 1964021 - DNA, 17 bp, Homo sapiens
agtaagtataacaaact

SEQ ID NO: 1964022 - DNA, 16 bp, Homo sapiens
agtaccttcagatcct

SEQ ID NO: 1964023 - DNA, 20 bp, Homo sapiens
agtaccttcagatcctaccc

SEQ ID NO: 1964024 - DNA, 22 bp, Homo sapiens
agtagggaaaatagggtccttg

SEQ ID NO: 1964025 - DNA, 19 bp, Homo sapiens
agtataaattcgctgtgag

SEQ ID NO: 1964026 - DNA, 14 bp, Homo sapiens
agtataacaaacta

SEQ ID NO: 1964027 - DNA, 23 bp, Homo sapiens
agtcatgtactggagagtggcaa

SEQ ID NO: 1964028 - DNA, 23 bp, Homo sapiens
agtcattattattactttttaaa

SEQ ID NO: 1964029 - DNA, 16 bp, Homo sapiens
agtccctgtgttctgc

SEQ ID NO: 1964030 - DNA, 18 bp, Homo sapiens
agtctcaattttgtattt

SEQ ID NO: 1964031 - DNA, 22 bp, Homo sapiens
agtctctgggtttacaacaaac

SEQ ID NO: 1964032 - DNA, 21 bp, Homo sapiens
agtctggcaaacatgtgcaac

SEQ ID NO: 1964033 - DNA, 18 bp, Homo sapiens
agtgaacagtttggatgt

SEQ ID NO: 1964034 - DNA, 20 bp, Homo sapiens
agtgacagatcctccatttt

SEQ ID NO: 1964035 - DNA, 21 bp, Homo sapiens
agtgccccttaaatttctgcc

SEQ ID NO: 1964036 - DNA, 14 bp, Homo sapiens
agtgcttcttgtaa

SEQ ID NO: 1964037 - DNA, 23 bp, Homo sapiens
agtggcatgtgggttgtgatatt

SEQ ID NO: 1964038 - DNA, 16 bp, Homo sapiens
agttaaggtatctggt

SEQ ID NO: 1964039 - DNA, 21 bp, Homo sapiens
agttcataaatttgttgtcat

SEQ ID NO: 1964040 - DNA, 18 bp, Homo sapiens
agttgaaaaaagaagttt

SEQ ID NO: 1964041 - DNA, 20 bp, Homo sapiens
agttgaaaaaagaagtttgg

SEQ ID NO: 1964042 - DNA, 19 bp, Homo sapiens
agttgcaccattctttctt

SEQ ID NO: 1964043 - DNA, 22 bp, Homo sapiens
agttggtcttactttgtgcaaa

SEQ ID NO: 1964044 - DNA, 13 bp, Homo sapiens
agttgtctttctt

SEQ ID NO: 1964045 - DNA, 14 bp, Homo sapiens
agttgtctttcttt

SEQ ID NO: 1964046 - DNA, 14 bp, Homo sapiens
ataaacaatccaaa

SEQ ID NO: 1964047 - DNA, 16 bp, Homo sapiens
ataaacaatccaaatg

SEQ ID NO: 1964048 - DNA, 21 bp, Homo sapiens
ataaaccttgtttctttctga

SEQ ID NO: 1964049 - DNA, 20 bp, Homo sapiens
ataaatttgaactccatggg

SEQ ID NO: 1964050 - DNA, 16 bp, Homo sapiens
ataacattttgtttat

SEQ ID NO: 1964051 - DNA, 19 bp, Homo sapiens
atagctagctatttctatg

SEQ ID NO: 1964052 - DNA, 22 bp, Homo sapiens
atagctctacacaacatgtatg

SEQ ID NO: 1964053 - DNA, 20 bp, Homo sapiens
atagggtccttgaaacagaa

SEQ ID NO: 1964054 - DNA, 18 bp, Homo sapiens
atagttgtctttctttgc

SEQ ID NO: 1964055 - DNA, 19 bp, Homo sapiens
atagttgtctttctttgct

SEQ ID NO: 1964056 - DNA, 22 bp, Homo sapiens
atatagttgtctttctttgctg

SEQ ID NO: 1964057 - DNA, 15 bp, Homo sapiens
atatctctagtccct

SEQ ID NO: 1964058 - DNA, 22 bp, Homo sapiens
atatggtactaaggagaattaa

SEQ ID NO: 1964059 - DNA, 13 bp, Homo sapiens
atattaagaaaca

SEQ ID NO: 1964060 - DNA, 12 bp, Homo sapiens
aaaatcttcagc

SEQ ID NO: 1964061 - DNA, 19 bp, Homo sapiens
aaaatcttcagctggtgga

SEQ ID NO: 1964062 - DNA, 18 bp, Homo sapiens
aaaatgtgtctgcaacat

SEQ ID NO: 1964063 - DNA, 21 bp, Homo sapiens
aaaatgtgtctgcaacatgga

SEQ ID NO: 1964064 - DNA, 22 bp, Homo sapiens
aaacaatccaaatgcattcatg

SEQ ID NO: 1964065 - DNA, 14 bp, Homo sapiens
aaacagatgtccct

SEQ ID NO: 1964066 - DNA, 16 bp, Homo sapiens
aaacatgaaaacattg

SEQ ID NO: 1964067 - DNA, 17 bp, Homo sapiens
aaacatgaaaacattga

SEQ ID NO: 1964068 - DNA, 21 bp, Homo sapiens
aaacatgtgcaactcttgtat

SEQ ID NO: 1964069 - DNA, 15 bp, Homo sapiens
aaacattgatgaatg

SEQ ID NO: 1964070 - DNA, 12 bp, Homo sapiens
aaaccttgtttc

SEQ ID NO: 1964071 - DNA, 23 bp, Homo sapiens
aaaagaagtttgggctaacattt

SEQ ID NO: 1964072 - DNA, 13 bp, Homo sapiens
aaaagacaaacac

SEQ ID NO: 1964073 - DNA, 13 bp, Homo sapiens
aaaagctgtgtct

SEQ ID NO: 1964074 - DNA, 12 bp, Homo sapiens
aaaagtttgtcc

SEQ ID NO: 1964075 - DNA, 23 bp, Homo sapiens
aaaagtttgtcctttaactatca

SEQ ID NO: 1964076 - DNA, 12 bp, Homo sapiens
aaaatcctacca

SEQ ID NO: 1964077 - DNA, 16 bp, Homo sapiens
aaaatcttcagctggt

SEQ ID NO: 1964078 - DNA, 18 bp, Homo sapiens
aaacagtgaatttaagca

SEQ ID NO: 1964079 - DNA, 13 bp, Homo sapiens
aaacagtgtttat

SEQ ID NO: 1964080 - DNA, 21 bp, Homo sapiens
aaacatcattggataaatttg

SEQ ID NO: 1964081 - DNA, 12 bp, Homo sapiens
aaacatgaaaac

SEQ ID NO: 1964082 - DNA, 13 bp, Homo sapiens
aaacatgaaaaca

SEQ ID NO: 1964083 - DNA, 17 bp, Homo sapiens
aaaccaacccatgtata

SEQ ID NO: 1964084 - DNA, 20 bp, Homo sapiens
aaactaccagtgggcatgta

SEQ ID NO: 1964085 - DNA, 16 bp, Homo sapiens
aaactcctactgcttc

SEQ ID NO: 1964086 - DNA, 19 bp, Homo sapiens
aaagcacatgccagggaaa

SEQ ID NO: 1964087 - DNA, 21 bp, Homo sapiens
aaagcaggcttgtgctttata

SEQ ID NO: 1964088 - DNA, 13 bp, Homo sapiens
aaagctgtgtctc

SEQ ID NO: 1964089 - DNA, 17 bp, Homo sapiens
aaagctgtgtctctgta

SEQ ID NO: 1964090 - DNA, 14 bp, Homo sapiens
aaagggaacatgca

SEQ ID NO: 1964091 - DNA, 16 bp, Homo sapiens
aaagtgggtttcaatt

SEQ ID NO: 1964092 - DNA, 21 bp, Homo sapiens
aaataaaactaaggaaccctg

SEQ ID NO: 1964093 - DNA, 21 bp, Homo sapiens
aaatacaagttaaggtatctg

SEQ ID NO: 1964094 - DNA, 18 bp, Homo sapiens
aaatagcaacatgcttca

SEQ ID NO: 1964095 - DNA, 22 bp, Homo sapiens
aaatagggtccttgaaacagaa

SEQ ID NO: 1964096 - DNA, 19 bp, Homo sapiens
aaatatagttgtctttctt

SEQ ID NO: 1964097 - DNA, 21 bp, Homo sapiens
aaatatccctttttcacatat

SEQ ID NO: 1964098 - DNA, 21 bp, Homo sapiens
aaatattactgatcttacctt

SEQ ID NO: 1964099 - DNA, 17 bp, Homo sapiens
aaatcctaccaacctct

SEQ ID NO: 1964100 - DNA, 11 bp, Homo sapiens
aaatcttcagc

SEQ ID NO: 1964101 - DNA, 15 bp, Homo sapiens
aaatcttcagctggt

SEQ ID NO: 1964102 - DNA, 21 bp, Homo sapiens
aaatcttcagctggtggatgg

SEQ ID NO: 1964103 - DNA, 15 bp, Homo sapiens
aaatgcattcatgtt

SEQ ID NO: 1964104 - DNA, 23 bp, Homo sapiens
aaatgtgtcccagtgaacagttt

SEQ ID NO: 1964105 - DNA, 20 bp, Homo sapiens
aaatgtgtctgcaacatgga

SEQ ID NO: 1964106 - DNA, 19 bp, Homo sapiens
aaatttctgccctgagccc

SEQ ID NO: 1964107 - DNA, 20 bp, Homo sapiens
aaatttctgccctgagccct

SEQ ID NO: 1964108 - DNA, 21 bp, Homo sapiens
aaatttgttgtcatgtgtatg

SEQ ID NO: 1964109 - DNA, 22 bp, Homo sapiens
aaatttgttgtcatgtgtatga

SEQ ID NO: 1964110 - DNA, 23 bp, Homo sapiens
aaatttttcttccttaaactcct

SEQ ID NO: 1964111 - DNA, 20 bp, Homo sapiens
aacaatcacaaaagctgtgt

SEQ ID NO: 1964112 - DNA, 22 bp, Homo sapiens
aacagcgtgtcaactttcattt

SEQ ID NO: 1964113 - DNA, 17 bp, Homo sapiens
aacagtgtttatgacga

SEQ ID NO: 1964114 - DNA, 19 bp, Homo sapiens
aacagtttggatgtcctca

SEQ ID NO: 1964115 - DNA, 16 bp, Homo sapiens
aacatgcttcatgaaa

SEQ ID NO: 1964116 - DNA, 15 bp, Homo sapiens
aacatggattccaaa

SEQ ID NO: 1964117 - DNA, 14 bp, Homo sapiens
aacatgtatgtgga

SEQ ID NO: 1964118 - DNA, 16 bp, Homo sapiens
aaccctggaaactacc

SEQ ID NO: 1964119 - DNA, 15 bp, Homo sapiens
aacctgcatttttaa

SEQ ID NO: 1964120 - DNA, 14 bp, Homo sapiens
aacctttcccattt

SEQ ID NO: 1964121 - DNA, 12 bp, Homo sapiens
aacggctctcca

SEQ ID NO: 1964122 - DNA, 14 bp, Homo sapiens
aacggctctccaga

SEQ ID NO: 1964123 - DNA, 19 bp, Homo sapiens
aactaccagtgggcatgta

SEQ ID NO: 1964124 - DNA, 14 bp, Homo sapiens
aactagcctcatct

SEQ ID NO: 1964125 - DNA, 19 bp, Homo sapiens
aactcatgactgagtctgg

SEQ ID NO: 1964126 - DNA, 22 bp, Homo sapiens
aactcctactgcttcctctgaa

SEQ ID NO: 1964127 - DNA, 23 bp, Homo sapiens
aactctgcaactgaatacttgaa

SEQ ID NO: 1964128 - DNA, 21 bp, Homo sapiens
aactcttgtattgctccattt

SEQ ID NO: 1964129 - DNA, 20 bp, Homo sapiens
aactgctttatcccacggaa

SEQ ID NO: 1964130 - DNA, 17 bp, Homo sapiens
aagaaatcgccttatga

SEQ ID NO: 1964131 - DNA, 14 bp, Homo sapiens
aagaccaaattttg

SEQ ID NO: 1964132 - DNA, 21 bp, Homo sapiens
aagataatcttagctgccaag

SEQ ID NO: 1964133 - DNA, 19 bp, Homo sapiens
aagatgaaaccgtccctga

SEQ ID NO: 1964134 - DNA, 17 bp, Homo sapiens
aagcagagttctttgca

SEQ ID NO: 1964135 - DNA, 19 bp, Homo sapiens
aagcatgagtggccttaat

SEQ ID NO: 1964136 - DNA, 16 bp, Homo sapiens
aagctgtgtctctgta

SEQ ID NO: 1964137 - DNA, 18 bp, Homo sapiens
aagcttagattttctgta

SEQ ID NO: 1964138 - DNA, 12 bp, Homo sapiens
aaggacaaacag

SEQ ID NO: 1964139 - DNA, 13 bp, Homo sapiens
aaggtatctggta

SEQ ID NO: 1964140 - DNA, 20 bp, Homo sapiens
aagttccagttttgttttga

SEQ ID NO: 1964141 - DNA, 23 bp, Homo sapiens
aagttggtcttactttgtgcaaa

SEQ ID NO: 1964142 - DNA, 14 bp, Homo sapiens
aataaatatagttg

SEQ ID NO: 1964143 - DNA, 13 bp, Homo sapiens
aatatagttgtct

SEQ ID NO: 1964144 - DNA, 15 bp, Homo sapiens
aatattaagaaacaa

SEQ ID NO: 1964145 - DNA, 18 bp, Homo sapiens
aatattaagaaacaattt

SEQ ID NO: 1964146 - DNA, 21 bp, Homo sapiens
aatattactgatcttaccttt

SEQ ID NO: 1964147 - DNA, 17 bp, Homo sapiens
aatattctctgatgttt

SEQ ID NO: 1964148 - DNA, 16 bp, Homo sapiens
aatatttcttcaagtg

SEQ ID NO: 1964149 - DNA, 13 bp, Homo sapiens
aatcacaaaagct

SEQ ID NO: 1964150 - DNA, 16 bp, Homo sapiens
aatccaaatgcattca

SEQ ID NO: 1964151 - DNA, 15 bp, Homo sapiens
aatctgttgtttgaa

SEQ ID NO: 1964152 - DNA, 17 bp, Homo sapiens
aatcttcagctggtgga

SEQ ID NO: 1964153 - DNA, 20 bp, Homo sapiens
aatcttcagctggtggatgg

SEQ ID NO: 1964154 - DNA, 21 bp, Homo sapiens
ctgaagtcttgcattgaattt

SEQ ID NO: 1964155 - DNA, 15 bp, Homo sapiens
ctgaatattaagaaa

SEQ ID NO: 1964156 - DNA, 20 bp, Homo sapiens
ctgaatattaagaaacaatt

SEQ ID NO: 1964157 - DNA, 15 bp, Homo sapiens
ctgaggcacctgcat

SEQ ID NO: 1964158 - DNA, 14 bp, Homo sapiens
ctgagtctggcaaa

SEQ ID NO: 1964159 - DNA, 18 bp, Homo sapiens
ctgagtctggcaaacatg

SEQ ID NO: 1964160 - DNA, 11 bp, Homo sapiens
ctgcaacatgg

SEQ ID NO: 1964161 - DNA, 20 bp, Homo sapiens
ctgcatgtaaaatcttcagc

SEQ ID NO: 1964162 - DNA, 23 bp, Homo sapiens
ctgcatgtaaaatcttcagctgg

SEQ ID NO: 1964163 - DNA, 22 bp, Homo sapiens
ctgcccagggtcagtgtatcta

SEQ ID NO: 1964164 - DNA, 13 bp, Homo sapiens
ctgctgtggaaag

SEQ ID NO: 1964165 - DNA, 13 bp, Homo sapiens
ctggacctctctt

SEQ ID NO: 1964166 - DNA, 18 bp, Homo sapiens
ctggctttgttcttgtca

SEQ ID NO: 1964167 - DNA, 22 bp, Homo sapiens
ctgggtttacaacaaacactgt

SEQ ID NO: 1964168 - DNA, 23 bp, Homo sapiens
ctgggtttacaacaaacactgtg

SEQ ID NO: 1964169 - DNA, 23 bp, Homo sapiens
ctggtatctgcatgtaaaatctt

SEQ ID NO: 1964170 - DNA, 16 bp, Homo sapiens
ctggtggatggtgact

SEQ ID NO: 1964171 - DNA, 22 bp, Homo sapiens
ctggttcactctaattggtcat

SEQ ID NO: 1964172 - DNA, 22 bp, Homo sapiens
ctgtaaatgaagggtcatttct

SEQ ID NO: 1964173 - DNA, 21 bp, Homo sapiens
ctgtgatgttgggaagctatt

SEQ ID NO: 1964174 - DNA, 15 bp, Homo sapiens
ctgtgcaaacagtgt

SEQ ID NO: 1964175 - DNA, 18 bp, Homo sapiens
ctgtgcaaacagtgtaag

SEQ ID NO: 1964176 - DNA, 21 bp, Homo sapiens
ctgtggattcagcttctgttg

SEQ ID NO: 1964177 - DNA, 15 bp, Homo sapiens
ctgtgtctctgtata

SEQ ID NO: 1964178 - DNA, 23 bp, Homo sapiens
cttaaatttctgccctgagccct

SEQ ID NO: 1964179 - DNA, 23 bp, Homo sapiens
cttactttgtgcaaaagcaggct

SEQ ID NO: 1964180 - DNA, 15 bp, Homo sapiens
cttatgagaacatgg

SEQ ID NO: 1964181 - DNA, 20 bp, Homo sapiens
cttatgagaacatggtgtgt

SEQ ID NO: 1964182 - DNA, 19 bp, Homo sapiens
cttcaccacctcatgtcat

SEQ ID NO: 1964183 - DNA, 19 bp, Homo sapiens
cttcagctggtggatggtg

SEQ ID NO: 1964184 - DNA, 17 bp, Homo sapiens
cttcatgaaaatcctac

SEQ ID NO: 1964185 - DNA, 18 bp, Homo sapiens
cttcatgaaaatcctacc

SEQ ID NO: 1964186 - DNA, 22 bp, Homo sapiens
cttctaatcataacatagttga

SEQ ID NO: 1964187 - DNA, 22 bp, Homo sapiens
cttctggctttgttcttgtcat

SEQ ID NO: 1964188 - DNA, 13 bp, Homo sapiens
cttcttgtaatat

SEQ ID NO: 1964189 - DNA, 14 bp, Homo sapiens
cttgccaagaaatc

SEQ ID NO: 1964190 - DNA, 20 bp, Homo sapiens
cttgggacctttaaagagcc

SEQ ID NO: 1964191 - DNA, 14 bp, Homo sapiens
cttgtttctttctg

SEQ ID NO: 1964192 - DNA, 19 bp, Homo sapiens
ctttaacaggttttcttct

SEQ ID NO: 1964193 - DNA, 22 bp, Homo sapiens
ctttaatctgttgtttgaagaa

SEQ ID NO: 1964194 - DNA, 20 bp, Homo sapiens
ctttataccccatttgattt

SEQ ID NO: 1964195 - DNA, 16 bp, Homo sapiens
ctttctttgctgctgt

SEQ ID NO: 1964196 - DNA, 16 bp, Homo sapiens
ctttgctgctgtggaa

SEQ ID NO: 1964197 - DNA, 18 bp, Homo sapiens
ctttgttcttgtcatcag

SEQ ID NO: 1964198 - DNA, 20 bp, Homo sapiens
ctttttaaaatgttggtgca

SEQ ID NO: 1964199 - DNA, 12 bp, Homo sapiens
ctttttaaacag

SEQ ID NO: 1964200 - DNA, 15 bp, Homo sapiens
ctttttaaacagtgt

SEQ ID NO: 1964201 - DNA, 14 bp, Homo sapiens
gaaaaaagaagttt

SEQ ID NO: 1964202 - DNA, 22 bp, Homo sapiens
gaaaacaattgttctgggtgat

SEQ ID NO: 1964203 - DNA, 20 bp, Homo sapiens
gaaaatagggtccttgaaac

SEQ ID NO: 1964204 - DNA, 13 bp, Homo sapiens
gaaaatgtgtctg

SEQ ID NO: 1964205 - DNA, 14 bp, Homo sapiens
gaaaccgtccctga

SEQ ID NO: 1964206 - DNA, 20 bp, Homo sapiens
gaaactaccagtgggcatgt

SEQ ID NO: 1964207 - DNA, 22 bp, Homo sapiens
gaaactaccagtgggcatgtat

SEQ ID NO: 1964208 - DNA, 18 bp, Homo sapiens
gaaagtgggtttcaattt

SEQ ID NO: 1964209 - DNA, 20 bp, Homo sapiens
gaacatggtgtgtgtctctg

SEQ ID NO: 1964210 - DNA, 21 bp, Homo sapiens
gaacatggtgtgtgtctctga

SEQ ID NO: 1964211 - DNA, 19 bp, Homo sapiens
gaagatgaaaccgtccctg

SEQ ID NO: 1964212 - DNA, 15 bp, Homo sapiens
gaagggtcatttctc

SEQ ID NO: 1964213 - DNA, 14 bp, Homo sapiens
gaagtactttgtgc

SEQ ID NO: 1964214 - DNA, 19 bp, Homo sapiens
gaatcgtttttgctgcaga

SEQ ID NO: 1964215 - DNA, 20 bp, Homo sapiens
gaatcgtttttgctgcagag

SEQ ID NO: 1964216 - DNA, 15 bp, Homo sapiens
gaatgaggaacaatc

SEQ ID NO: 1964217 - DNA, 16 bp, Homo sapiens
gaatggtttttgttga

SEQ ID NO: 1964218 - DNA, 21 bp, Homo sapiens
gaatgtgatcatctttgctga

SEQ ID NO: 1964219 - DNA, 14 bp, Homo sapiens
gaatttagtcatta

SEQ ID NO: 1964220 - DNA, 14 bp, Homo sapiens
gaatttgactggtt

SEQ ID NO: 1964221 - DNA, 17 bp, Homo sapiens
gacaatgcgtggcacat

SEQ ID NO: 1964222 - DNA, 14 bp, Homo sapiens
gaccatgtgattat

SEQ ID NO: 1964223 - DNA, 14 bp, Homo sapiens
gacttttgaagaac

SEQ ID NO: 1964224 - DNA, 23 bp, Homo sapiens
gacttttgaagaacaaaaggctt

SEQ ID NO: 1964225 - DNA, 18 bp, Homo sapiens
gagacctcagatgtgttg

SEQ ID NO: 1964226 - DNA, 23 bp, Homo sapiens
gagccctccacgtcagtgccatc

SEQ ID NO: 1964227 - DNA, 14 bp, Homo sapiens
gagctccagtggaa

SEQ ID NO: 1964228 - DNA, 17 bp, Homo sapiens
gagtctggcaaacatgt

SEQ ID NO: 1964229 - DNA, 22 bp, Homo sapiens
gagtctggcaaacatgtgcaac

SEQ ID NO: 1964230 - DNA, 17 bp, Homo sapiens
gatagtgcttcttgtaa

SEQ ID NO: 1964231 - DNA, 20 bp, Homo sapiens
gatatttaaaagacaaacac

SEQ ID NO: 1964232 - DNA, 13 bp, Homo sapiens
gatcatctttgct

SEQ ID NO: 1964233 - DNA, 15 bp, Homo sapiens
gatccaaatgctgtg

SEQ ID NO: 1964234 - DNA, 19 bp, Homo sapiens
gatccaaatgctgtgcaaa

SEQ ID NO: 1964235 - DNA, 23 bp, Homo sapiens
gatgcgggcattttgaatgtgat

SEQ ID NO: 1964236 - DNA, 18 bp, Homo sapiens
gattccaaagcattttca

SEQ ID NO: 1964237 - DNA, 15 bp, Homo sapiens
gcaacatggattcca

SEQ ID NO: 1964238 - DNA, 21 bp, Homo sapiens
gcaacatggattccaaagcat

SEQ ID NO: 1964239 - DNA, 19 bp, Homo sapiens
gcacatctaaattgatcat

SEQ ID NO: 1964240 - DNA, 18 bp, Homo sapiens
gcacattttgacacaatg

SEQ ID NO: 1964241 - DNA, 14 bp, Homo sapiens
gcagagttctttgc

SEQ ID NO: 1964242 - DNA, 13 bp, Homo sapiens
gcagtgtttgtat

SEQ ID NO: 1964243 - DNA, 19 bp, Homo sapiens
gcatatctctagtccctgt

SEQ ID NO: 1964244 - DNA, 22 bp, Homo sapiens
gcatatctctagtccctgtgtt

SEQ ID NO: 1964245 - DNA, 12 bp, Homo sapiens
gcatcaaacatg

SEQ ID NO: 1964246 - DNA, 14 bp, Homo sapiens
gcatcaaacatgaa

SEQ ID NO: 1964247 - DNA, 16 bp, Homo sapiens
gcatcaaacatgaaaa

SEQ ID NO: 1964248 - DNA, 19 bp, Homo sapiens
gcatcaaacatgaaaacat

SEQ ID NO: 1964249 - DNA, 22 bp, Homo sapiens
gcatcaaacatgaaaacattga

SEQ ID NO: 1964250 - DNA, 11 bp, Homo sapiens
gcatgagtggc

SEQ ID NO: 1964251 - DNA, 22 bp, Homo sapiens
gcatgagtggccttaataaata

SEQ ID NO: 1964252 - DNA, 19 bp, Homo sapiens
gcatgtaaaatcttcagct

SEQ ID NO: 1964253 - DNA, 21 bp, Homo sapiens
gcatttttaaaggacaaacag

SEQ ID NO: 1964254 - DNA, 11 bp, Homo sapiens
gccaattttgt

SEQ ID NO: 1964255 - DNA, 15 bp, Homo sapiens
gccacaaatgtgtcc

SEQ ID NO: 1964256 - DNA, 15 bp, Homo sapiens
gccaggttggaaaag

SEQ ID NO: 1964257 - DNA, 19 bp, Homo sapiens
gcccctcctaacccagcag

SEQ ID NO: 1964258 - DNA, 21 bp, Homo sapiens
gccccttaaatttctgccctg

SEQ ID NO: 1964259 - DNA, 22 bp, Homo sapiens
gcctttaccctcctctatttct

SEQ ID NO: 1964260 - DNA, 18 bp, Homo sapiens
gcgtgtcaactttcattt

SEQ ID NO: 1964261 - DNA, 17 bp, Homo sapiens
gctaacatttaggagaa

SEQ ID NO: 1964262 - DNA, 12 bp, Homo sapiens
gctacaagaaca

SEQ ID NO: 1964263 - DNA, 14 bp, Homo sapiens
gctatttctatgta

SEQ ID NO: 1964264 - DNA, 12 bp, Homo sapiens
gctccagtggaa

SEQ ID NO: 1964265 - DNA, 21 bp, Homo sapiens
gctccagtggaagaagaaaac

SEQ ID NO: 1964266 - DNA, 18 bp, Homo sapiens
gctctacacaacatgtat

SEQ ID NO: 1964267 - DNA, 16 bp, Homo sapiens
gctctatctgcaatgt

SEQ ID NO: 1964268 - DNA, 11 bp, Homo sapiens
gctgtgtctct

SEQ ID NO: 1964269 - DNA, 13 bp, Homo sapiens
gctgtgtctctgt

SEQ ID NO: 1964270 - DNA, 15 bp, Homo sapiens
gctgtgtctctgtat

SEQ ID NO: 1964271 - DNA, 20 bp, Homo sapiens
gcttatgtgttgcataaaca

SEQ ID NO: 1964272 - DNA, 22 bp, Homo sapiens
ttcaatttactttttaaacagt

SEQ ID NO: 1964273 - DNA, 18 bp, Homo sapiens
ttcagcatcaaacatgaa

SEQ ID NO: 1964274 - DNA, 17 bp, Homo sapiens
ttcatgaaaatcctacc

SEQ ID NO: 1964275 - DNA, 15 bp, Homo sapiens
ttccaaagcattttc

SEQ ID NO: 1964276 - DNA, 22 bp, Homo sapiens
ttccagaaagaaaatgaatttg

SEQ ID NO: 1964277 - DNA, 23 bp, Homo sapiens
ttccttcaccacctcatgtcatt

SEQ ID NO: 1964278 - DNA, 12 bp, Homo sapiens
ttcgatgtacag

SEQ ID NO: 1964279 - DNA, 22 bp, Homo sapiens
ttcgatgtacagtctcaatttt

SEQ ID NO: 1964280 - DNA, 11 bp, Homo sapiens
ttctaaacaga

SEQ ID NO: 1964281 - DNA, 22 bp, Homo sapiens
ttctatgtatgtgccaattttg

SEQ ID NO: 1964282 - DNA, 15 bp, Homo sapiens
ttctgggtgatttct

SEQ ID NO: 1964283 - DNA, 15 bp, Homo sapiens
ttcttggtgcattcg

SEQ ID NO: 1964284 - DNA, 13 bp, Homo sapiens
ttgaaacagaaaa

SEQ ID NO: 1964285 - DNA, 18 bp, Homo sapiens
ttgaagaacaaaaggctt

SEQ ID NO: 1964286 - DNA, 12 bp, Homo sapiens
ttgaatgtgatc

SEQ ID NO: 1964287 - DNA, 16 bp, Homo sapiens
ttgaatgtgatcatct

SEQ ID NO: 1964288 - DNA, 18 bp, Homo sapiens
ttgacctgaactctgcaa

SEQ ID NO: 1964289 - DNA, 21 bp, Homo sapiens
ttgacgaagaaacaaaaaaca

SEQ ID NO: 1964290 - DNA, 15 bp, Homo sapiens
ttgagcgtgattctg

SEQ ID NO: 1964291 - DNA, 12 bp, Homo sapiens
ttgagtctctga

SEQ ID NO: 1964292 - DNA, 15 bp, Homo sapiens
ttgataacattttgt

SEQ ID NO: 1964293 - DNA, 17 bp, Homo sapiens
ttgatagtgcttcttgt

SEQ ID NO: 1964294 - DNA, 19 bp, Homo sapiens
ttgatagtgcttcttgtaa

SEQ ID NO: 1964295 - DNA, 23 bp, Homo sapiens
ttgcattgaatttagtcattatt

SEQ ID NO: 1964296 - DNA, 16 bp, Homo sapiens
ttgctccattttcttg

SEQ ID NO: 1964297 - DNA, 20 bp, Homo sapiens
ttgctccattttcttgtcaa

SEQ ID NO: 1964298 - DNA, 13 bp, Homo sapiens
ttgctgctgtgga

SEQ ID NO: 1964299 - DNA, 14 bp, Homo sapiens
ttggaaaagaaatc

SEQ ID NO: 1964300 - DNA, 19 bp, Homo sapiens
ttggaaaagaaatcaattt

SEQ ID NO: 1964301 - DNA, 15 bp, Homo sapiens
ttggagggatcattt

SEQ ID NO: 1964302 - DNA, 19 bp, Homo sapiens
ttgggaagctatttccttt

SEQ ID NO: 1964303 - DNA, 22 bp, Homo sapiens
ttggtcattcctaatgcattag

SEQ ID NO: 1964304 - DNA, 20 bp, Homo sapiens
ttggtgcaattaactctgga

SEQ ID NO: 1964305 - DNA, 21 bp, Homo sapiens
ttggttatgatggaaaggaag

SEQ ID NO: 1964306 - DNA, 23 bp, Homo sapiens
ttggttatgatggaaaggaagaa

SEQ ID NO: 1964307 - DNA, 22 bp, Homo sapiens
ttgtaatatttcttcaagtgag

SEQ ID NO: 1964308 - DNA, 17 bp, Homo sapiens
ttgtcaatggaagaaac

SEQ ID NO: 1964309 - DNA, 11 bp, Homo sapiens
ttgtctttctt

SEQ ID NO: 1964310 - DNA, 13 bp, Homo sapiens
ttgtctttctttg

SEQ ID NO: 1964311 - DNA, 14 bp, Homo sapiens
ttgtgcaaaagcag

SEQ ID NO: 1964312 - DNA, 18 bp, Homo sapiens
ttgtgcaaaagcaggctt

SEQ ID NO: 1964313 - DNA, 13 bp, Homo sapiens
ttgttcttgtcat

SEQ ID NO: 1964314 - DNA, 16 bp, Homo sapiens
ttgttgagtctctgaa

SEQ ID NO: 1964315 - DNA, 20 bp, Homo sapiens
ttgtttggagggatcatttt

SEQ ID NO: 1964316 - DNA, 17 bp, Homo sapiens
tttaaaggacaaacagt

SEQ ID NO: 1964317 - DNA, 17 bp, Homo sapiens
tttaatctgttgtttga

SEQ ID NO: 1964318 - DNA, 18 bp, Homo sapiens
tttaatgatttttgtgta

SEQ ID NO: 1964319 - DNA, 14 bp, Homo sapiens
tttacaacaaacac

SEQ ID NO: 1964320 - DNA, 15 bp, Homo sapiens
tttacaacaaacact

SEQ ID NO: 1964321 - DNA, 21 bp, Homo sapiens
tttacatacagtgatatggta

SEQ ID NO: 1964322 - DNA, 11 bp, Homo sapiens
tttaggagaag

SEQ ID NO: 1964323 - DNA, 14 bp, Homo sapiens
tttaggagaagttg

SEQ ID NO: 1964324 - DNA, 16 bp, Homo sapiens
tttatattcatcaaat

SEQ ID NO: 1964325 - DNA, 23 bp, Homo sapiens
tttatattcatcaaataaacctt

SEQ ID NO: 1964326 - DNA, 15 bp, Homo sapiens
tttcaagatccaaat

SEQ ID NO: 1964327 - DNA, 20 bp, Homo sapiens
tttcagcatcaaacatgaaa

SEQ ID NO: 1964328 - DNA, 23 bp, Homo sapiens
tttcagcatcaaacatgaaaaca

SEQ ID NO: 1964329 - DNA, 17 bp, Homo sapiens
tttcccatttcgtgtaa

SEQ ID NO: 1964330 - DNA, 20 bp, Homo sapiens
tttcgtgtaatattctctga

SEQ ID NO: 1964331 - DNA, 16 bp, Homo sapiens
tttctagaatggtttt

SEQ ID NO: 1964332 - DNA, 18 bp, Homo sapiens
tttctatgtatgtgccaa

SEQ ID NO: 1964333 - DNA, 17 bp, Homo sapiens
tttctgccctgagccct

SEQ ID NO: 1964334 - DNA, 19 bp, Homo sapiens
tttctttgctgctgtggaa

SEQ ID NO: 1964335 - DNA, 21 bp, Homo sapiens
tttgaaagtgggtttcaattt

SEQ ID NO: 1964336 - DNA, 23 bp, Homo sapiens
tttgacacaatgttgcactgaaa

SEQ ID NO: 1964337 - DNA, 15 bp, Homo sapiens
tttgctgctgtggaa

SEQ ID NO: 1964338 - DNA, 21 bp, Homo sapiens
tttgctgctgtggaaaggatt

SEQ ID NO: 1964339 - DNA, 16 bp, Homo sapiens
tttgggctaacattta

SEQ ID NO: 1964340 - DNA, 16 bp, Homo sapiens
tttgttgagtctctga

SEQ ID NO: 1964341 - DNA, 17 bp, Homo sapiens
tttgttgagtctctgaa

SEQ ID NO: 1964342 - DNA, 15 bp, Homo sapiens
tttgttgtcatgtgt

SEQ ID NO: 1964343 - DNA, 19 bp, Homo sapiens
ttttaaacagtgtttatga

SEQ ID NO: 1964344 - DNA, 17 bp, Homo sapiens
ttttaaagaaaatgtgt

SEQ ID NO: 1964345 - DNA, 17 bp, Homo sapiens
ttttaaaggacaaacag

SEQ ID NO: 1964346 - DNA, 19 bp, Homo sapiens
ttttaaaggacaaacagtg

SEQ ID NO: 1964347 - DNA, 14 bp, Homo sapiens
ttttacatacagtg

SEQ ID NO: 1964348 - DNA, 21 bp, Homo sapiens
ttttcagcatcaaacatgaaa

SEQ ID NO: 1964349 - DNA, 17 bp, Homo sapiens
ttttccagaaagaaaat

SEQ ID NO: 1964350 - DNA, 19 bp, Homo sapiens
ttttctgcccaactttcat

SEQ ID NO: 1964351 - DNA, 22 bp, Homo sapiens
ttttctgcccaactttcattgg

SEQ ID NO: 1964352 - DNA, 21 bp, Homo sapiens
tttttaaagaaaatgtgtctg

SEQ ID NO: 1964353 - DNA, 18 bp, Homo sapiens
tttttaaaggacaaacag

SEQ ID NO: 1964354 - DNA, 23 bp, Homo sapiens
ttttttaaagaaaatgtgtctgc

SEQ ID NO: 1964355 - DNA, 18 bp, Homo sapiens
agtgagtggcatgtgggt

SEQ ID NO: 1964356 - DNA, 17 bp, Homo sapiens
agtgagtggtgttggca

SEQ ID NO: 1964357 - DNA, 13 bp, Homo sapiens
agtgcttcttgta

SEQ ID NO: 1964358 - DNA, 18 bp, Homo sapiens
agtgcttcttgtaatatt

SEQ ID NO: 1964359 - DNA, 16 bp, Homo sapiens
agtggaagaagaaaac

SEQ ID NO: 1964360 - DNA, 16 bp, Homo sapiens
agtgggagatgaaaac

SEQ ID NO: 1964361 - DNA, 17 bp, Homo sapiens
agtgggagatgaaaacc

SEQ ID NO: 1964362 - DNA, 21 bp, Homo sapiens
agtggtgttggcagtgtttgt

SEQ ID NO: 1964363 - DNA, 15 bp, Homo sapiens
agttcataaatttgt

SEQ ID NO: 1964364 - DNA, 18 bp, Homo sapiens
agttggtcttactttgtg

SEQ ID NO: 1964365 - DNA, 18 bp, Homo sapiens
agttgtctttctttgctg

SEQ ID NO: 1964366 - DNA, 20 bp, Homo sapiens
agttgtctttctttgctgct

SEQ ID NO: 1964367 - DNA, 13 bp, Homo sapiens
agtttgtccttta

SEQ ID NO: 1964368 - DNA, 20 bp, Homo sapiens
ataaaccttgtttctttctg

SEQ ID NO: 1964369 - DNA, 17 bp, Homo sapiens
ataaatatagttgtctt

SEQ ID NO: 1964370 - DNA, 15 bp, Homo sapiens
ataacattttgttta

SEQ ID NO: 1964371 - DNA, 18 bp, Homo sapiens
ataacattttgtttatgt

SEQ ID NO: 1964372 - DNA, 15 bp, Homo sapiens
ataccccatttgatt

SEQ ID NO: 1964373 - DNA, 14 bp, Homo sapiens
atagagatatttaa

SEQ ID NO: 1964374 - DNA, 21 bp, Homo sapiens
atagagatatttaaaagacaa

SEQ ID NO: 1964375 - DNA, 21 bp, Homo sapiens
atagctagctatttctatgta

SEQ ID NO: 1964376 - DNA, 15 bp, Homo sapiens
atagtgcttcttgta

SEQ ID NO: 1964377 - DNA, 15 bp, Homo sapiens
atagttgtctttctt

SEQ ID NO: 1964378 - DNA, 17 bp, Homo sapiens
atatagctctacacaac

SEQ ID NO: 1964379 - DNA, 22 bp, Homo sapiens
atatagctctacacaacatgta

SEQ ID NO: 1964380 - DNA, 17 bp, Homo sapiens
atatagttgtctttctt

SEQ ID NO: 1964381 - DNA, 21 bp, Homo sapiens
atatagttgtctttctttgct

SEQ ID NO: 1964382 - DNA, 14 bp, Homo sapiens
atattaagaaacaa

SEQ ID NO: 1964383 - DNA, 20 bp, Homo sapiens
atattctgataatgtattgc

SEQ ID NO: 1964384 - DNA, 17 bp, Homo sapiens
atattgaccatgtgatt

SEQ ID NO: 1964385 - DNA, 19 bp, Homo sapiens
atattgaccatgtgattat

SEQ ID NO: 1964386 - DNA, 15 bp, Homo sapiens
atatttaaaagacaa

SEQ ID NO: 1964387 - DNA, 21 bp, Homo sapiens
atatttaaaagacaaacacct

SEQ ID NO: 1964388 - DNA, 22 bp, Homo sapiens
atatttaaaagacaaacacctt

SEQ ID NO: 1964389 - DNA, 16 bp, Homo sapiens
atatttcttcaagtga

SEQ ID NO: 1964390 - DNA, 16 bp, Homo sapiens
atcaaacatgaaaaca

SEQ ID NO: 1964391 - DNA, 19 bp, Homo sapiens
atcaattttttaaaccact

SEQ ID NO: 1964392 - DNA, 18 bp, Homo sapiens
atcataacatagttgaaa

SEQ ID NO: 1964393 - DNA, 20 bp, Homo sapiens
atcataacatagttgaaaaa

SEQ ID NO: 1964394 - DNA, 17 bp, Homo sapiens
atcattggataaatttg

SEQ ID NO: 1964395 - DNA, 17 bp, Homo sapiens
atccaaatgcattcatg

SEQ ID NO: 1964396 - DNA, 14 bp, Homo sapiens
atccaaatgctgtg

SEQ ID NO: 1964397 - DNA, 23 bp, Homo sapiens
atccaaatgctgtgcaaacagtg

SEQ ID NO: 1964398 - DNA, 14 bp, Homo sapiens
atccagtagggaaa

SEQ ID NO: 1964399 - DNA, 20 bp, Homo sapiens
atcccacggaaaatgccaat

SEQ ID NO: 1964400 - DNA, 21 bp, Homo sapiens
atcccggtgcatgcaggtctc

SEQ ID NO: 1964401 - DNA, 13 bp, Homo sapiens
atccgtccagcca

SEQ ID NO: 1964402 - DNA, 15 bp, Homo sapiens
atcctaccaacctct

SEQ ID NO: 1964403 - DNA, 14 bp, Homo sapiens
atcgatatgaaaaa

SEQ ID NO: 1964404 - DNA, 13 bp, Homo sapiens
atctaaattgatc

SEQ ID NO: 1964405 - DNA, 21 bp, Homo sapiens
atctgcaatgtttttgtgtag

SEQ ID NO: 1964406 - DNA, 15 bp, Homo sapiens
atctggtatctgcat

SEQ ID NO: 1964407 - DNA, 22 bp, Homo sapiens
atctgtggattcagcttctgtt

SEQ ID NO: 1964408 - DNA, 15 bp, Homo sapiens
atcttacctttatga

SEQ ID NO: 1964409 - DNA, 15 bp, Homo sapiens
atcttagctgccaag

SEQ ID NO: 1964410 - DNA, 13 bp, Homo sapiens
atgaaaacattga

SEQ ID NO: 1964411 - DNA, 14 bp, Homo sapiens
atgaaaacattgat

SEQ ID NO: 1964412 - DNA, 20 bp, Homo sapiens
atgaaaacattgatgaatga

SEQ ID NO: 1964413 - DNA, 16 bp, Homo sapiens
atgaaaccgtccctga

SEQ ID NO: 1964414 - DNA, 17 bp, Homo sapiens
atgaagggtcatttctc

SEQ ID NO: 1964415 - DNA, 22 bp, Homo sapiens
atgaatgaggaacaatcacaaa

SEQ ID NO: 1964416 - DNA, 18 bp, Homo sapiens
atgactgagtctggcaaa

SEQ ID NO: 1964417 - DNA, 15 bp, Homo sapiens
atgagaagtactttg

SEQ ID NO: 1964418 - DNA, 16 bp, Homo sapiens
atgagaagtactttgt

SEQ ID NO: 1964419 - DNA, 20 bp, Homo sapiens
atgatgcatggagtgtttga

SEQ ID NO: 1964420 - DNA, 14 bp, Homo sapiens
atgatggaaaggaa

SEQ ID NO: 1964421 - DNA, 20 bp, Homo sapiens
atgcaagtgggagatgaaaa

SEQ ID NO: 1964422 - DNA, 21 bp, Homo sapiens
atgcaagtgggagatgaaaac

SEQ ID NO: 1964423 - DNA, 22 bp, Homo sapiens
atgcaagtgggagatgaaaacc

SEQ ID NO: 1964424 - DNA, 22 bp, Homo sapiens
atgcatggagtgtttgacgaag

SEQ ID NO: 1964425 - DNA, 19 bp, Homo sapiens
atgcattagattatcaaaa

SEQ ID NO: 1964426 - DNA, 13 bp, Homo sapiens
atgcattcatgtt

SEQ ID NO: 1964427 - DNA, 22 bp, Homo sapiens
atgctgcccagggtcagtgtat

SEQ ID NO: 1964428 - DNA, 12 bp, Homo sapiens
atgctgtgcaaa

SEQ ID NO: 1964429 - DNA, 21 bp, Homo sapiens
atgcttcatgaaaatcctacc

SEQ ID NO: 1964430 - DNA, 17 bp, Homo sapiens
atgcttgccaagaaatc

SEQ ID NO: 1964431 - DNA, 18 bp, Homo sapiens
atggacatcgatatgaaa

SEQ ID NO: 1964432 - DNA, 20 bp, Homo sapiens
atggacatcgatatgaaaaa

SEQ ID NO: 1964433 - DNA, 16 bp, Homo sapiens
atggattccaaagcat

SEQ ID NO: 1964434 - DNA, 17 bp, Homo sapiens
atggattccaaagcatt

SEQ ID NO: 1964435 - DNA, 19 bp, Homo sapiens
atggtgtgtgtctctgaca

SEQ ID NO: 1964436 - DNA, 13 bp, Homo sapiens
atgtaaaatcttc

SEQ ID NO: 1964437 - DNA, 15 bp, Homo sapiens
atgtaaaatcttcag

SEQ ID NO: 1964438 - DNA, 17 bp, Homo sapiens
atgtaaaatcttcagct

SEQ ID NO: 1964439 - DNA, 19 bp, Homo sapiens
atgtaaaatcttcagctgg

SEQ ID NO: 1964440 - DNA, 21 bp, Homo sapiens
atgtaaaatcttcagctggtg

SEQ ID NO: 1964441 - DNA, 18 bp, Homo sapiens
atgtacagtctcaatttt

SEQ ID NO: 1964442 - DNA, 20 bp, Homo sapiens
atgtactggagagtggcaaa

SEQ ID NO: 1964443 - DNA, 16 bp, Homo sapiens
atgtcattatttgata

SEQ ID NO: 1964444 - DNA, 12 bp, Homo sapiens
atgtcatttctc

SEQ ID NO: 1964445 - DNA, 16 bp, Homo sapiens
atgtgcaactcttgta

SEQ ID NO: 1964446 - DNA, 17 bp, Homo sapiens
atgtggatacagtcatt

SEQ ID NO: 1964447 - DNA, 16 bp, Homo sapiens
atgtgtcccagtgaac

SEQ ID NO: 1964448 - DNA, 16 bp, Homo sapiens
atgtgtctgcaacatg

SEQ ID NO: 1964449 - DNA, 20 bp, Homo sapiens
atgtgttgacgtaagctcta

SEQ ID NO: 1964450 - DNA, 19 bp, Homo sapiens
atgtgttgcataaacaatc

SEQ ID NO: 1964451 - DNA, 20 bp, Homo sapiens
atgttggtgcaattaactct

SEQ ID NO: 1964452 - DNA, 13 bp, Homo sapiens
attaagaaacaat

SEQ ID NO: 1964453 - DNA, 17 bp, Homo sapiens
attaagaaacaatttaa

SEQ ID NO: 1964454 - DNA, 15 bp, Homo sapiens
attatttaaagcaca

SEQ ID NO: 1964455 - DNA, 17 bp, Homo sapiens
attatttgataacattt

SEQ ID NO: 1964456 - DNA, 20 bp, Homo sapiens
attcatcaaataaaccttgt

SEQ ID NO: 1964457 - DNA, 17 bp, Homo sapiens
attcatgttttaaaagt

SEQ ID NO: 1964458 - DNA, 20 bp, Homo sapiens
attctaaacagatgtccctg

SEQ ID NO: 1964459 - DNA, 15 bp, Homo sapiens
attctgataatgtat

SEQ ID NO: 1964460 - DNA, 18 bp, Homo sapiens
attctgataatgtattgc

SEQ ID NO: 1964461 - DNA, 16 bp, Homo sapiens
attgaatttagtcatt

SEQ ID NO: 1964462 - DNA, 17 bp, Homo sapiens
attgaccatgtgattat

SEQ ID NO: 1964463 - DNA, 10 bp, Homo sapiens
attgttctgg

SEQ ID NO: 1964464 - DNA, 17 bp, Homo sapiens
attgttctgggtgattt

SEQ ID NO: 1964465 - DNA, 18 bp, Homo sapiens
attgttctgggtgatttc

SEQ ID NO: 1964466 - DNA, 20 bp, Homo sapiens
attgttctgggtgatttcta

SEQ ID NO: 1964467 - DNA, 13 bp, Homo sapiens
atttaaaagacaa

SEQ ID NO: 1964468 - DNA, 16 bp, Homo sapiens
atttaaaagacaaaca

SEQ ID NO: 1964469 - DNA, 17 bp, Homo sapiens
tgtattagccagtcatt

SEQ ID NO: 1964470 - DNA, 14 bp, Homo sapiens
tgtatttaatgatt

SEQ ID NO: 1964471 - DNA, 16 bp, Homo sapiens
tgtatttaatgatttt

SEQ ID NO: 1964472 - DNA, 16 bp, Homo sapiens
tgtcaactttcatttg

SEQ ID NO: 1964473 - DNA, 15 bp, Homo sapiens
tgtcacagctcttgt

SEQ ID NO: 1964474 - DNA, 17 bp, Homo sapiens
tgtcatgtgtatgagaa

SEQ ID NO: 1964475 - DNA, 12 bp, Homo sapiens
tctatgtatgtg

SEQ ID NO: 1964476 - DNA, 12 bp, Homo sapiens
tctcaattttgt

SEQ ID NO: 1964477 - DNA, 15 bp, Homo sapiens
tctcaattttgtatt

SEQ ID NO: 1964478 - DNA, 15 bp, Homo sapiens
tctccagacctgagc

SEQ ID NO: 1964479 - DNA, 17 bp, Homo sapiens
tctccagtatcctgctg

SEQ ID NO: 1964480 - DNA, 12 bp, Homo sapiens
tctccatgaaga

SEQ ID NO: 1964481 - DNA, 17 bp, Homo sapiens
tctctctaacataacaa

SEQ ID NO: 1964482 - DNA, 21 bp, Homo sapiens
tctctgacaatgcgtggcaca

SEQ ID NO: 1964483 - DNA, 19 bp, Homo sapiens
tctgcaacatggattccaa

SEQ ID NO: 1964484 - DNA, 22 bp, Homo sapiens
tctgcaacatggattccaaagc

SEQ ID NO: 1964485 - DNA, 19 bp, Homo sapiens
tctgccctgagccctccac

SEQ ID NO: 1964486 - DNA, 17 bp, Homo sapiens
tctggcaaacatgtgca

SEQ ID NO: 1964487 - DNA, 18 bp, Homo sapiens
tctggcaaacatgtgcaa

SEQ ID NO: 1964488 - DNA, 19 bp, Homo sapiens
tctggctttgttcttgtca

SEQ ID NO: 1964489 - DNA, 17 bp, Homo sapiens
tctgggtgatttctaga

SEQ ID NO: 1964490 - DNA, 18 bp, Homo sapiens
tctgggtttacaacaaac

SEQ ID NO: 1964491 - DNA, 23 bp, Homo sapiens
tctgggtttacaacaaacactgt

SEQ ID NO: 1964492 - DNA, 20 bp, Homo sapiens
tctgtatatagctctacaca

SEQ ID NO: 1964493 - DNA, 20 bp, Homo sapiens
tctgtggattcagcttctgt

SEQ ID NO: 1964494 - DNA, 17 bp, Homo sapiens
tctgttctacttgatat

SEQ ID NO: 1964495 - DNA, 22 bp, Homo sapiens
tctgttctacttgatatttcct

SEQ ID NO: 1964496 - DNA, 14 bp, Homo sapiens
tcttagctgccaag

SEQ ID NO: 1964497 - DNA, 14 bp, Homo sapiens
tcttcagctggtgg

SEQ ID NO: 1964498 - DNA, 18 bp, Homo sapiens
tcttgacctgaactctgc

SEQ ID NO: 1964499 - DNA, 16 bp, Homo sapiens
tcttgcattgaattta

SEQ ID NO: 1964500 - DNA, 12 bp, Homo sapiens
tctttctttgct

SEQ ID NO: 1964501 - DNA, 14 bp, Homo sapiens
tctttctttgctgc

SEQ ID NO: 1964502 - DNA, 21 bp, Homo sapiens
tctttgctgaatgtcattatt

SEQ ID NO: 1964503 - DNA, 15 bp, Homo sapiens
tcttttacatacagt

SEQ ID NO: 1964504 - DNA, 13 bp, Homo sapiens
tgaaaaataaata

SEQ ID NO: 1964505 - DNA, 21 bp, Homo sapiens
tgaacagtttggatgtcctca

SEQ ID NO: 1964506 - DNA, 22 bp, Homo sapiens
tgaacagtttggatgtcctcaa

SEQ ID NO: 1964507 - DNA, 17 bp, Homo sapiens
tgaactctgcaactgaa

SEQ ID NO: 1964508 - DNA, 23 bp, Homo sapiens
tgaataaagggaacatgcagctc

SEQ ID NO: 1964509 - DNA, 15 bp, Homo sapiens
tgaatacttgaagta

SEQ ID NO: 1964510 - DNA, 19 bp, Homo sapiens
tgaatattaagaaacaatt

SEQ ID NO: 1964511 - DNA, 21 bp, Homo sapiens
tgaatgaggaacaatcacaaa

SEQ ID NO: 1964512 - DNA, 19 bp, Homo sapiens
tgaatgtcattatttgata

SEQ ID NO: 1964513 - DNA, 17 bp, Homo sapiens
tgaatttaagcatgagt

SEQ ID NO: 1964514 - DNA, 19 bp, Homo sapiens
tgaatttaagcatgagtgg

SEQ ID NO: 1964515 - DNA, 13 bp, Homo sapiens
tgaatttagtcat

SEQ ID NO: 1964516 - DNA, 17 bp, Homo sapiens
tgaccatgtgattatgg

SEQ ID NO: 1964517 - DNA, 16 bp, Homo sapiens
tgacctgaactctgca

SEQ ID NO: 1964518 - DNA, 20 bp, Homo sapiens
tgacgtaagctctatctgca

SEQ ID NO: 1964519 - DNA, 21 bp, Homo sapiens
tgactgagtctggcaaacatg

SEQ ID NO: 1964520 - DNA, 14 bp, Homo sapiens
tgacttttgaagaa

SEQ ID NO: 1964521 - DNA, 22 bp, Homo sapiens
tgagccatagagatatttaaaa

SEQ ID NO: 1964522 - DNA, 17 bp, Homo sapiens
tgaggaacaatcacaaa

SEQ ID NO: 1964523 - DNA, 16 bp, Homo sapiens
tgaggtcttttacata

SEQ ID NO: 1964524 - DNA, 11 bp, Homo sapiens
tgagtctctga

SEQ ID NO: 1964525 - DNA, 12 bp, Homo sapiens
tgagtctctgaa

SEQ ID NO: 1964526 - DNA, 13 bp, Homo sapiens
tgagtggcatgtg

SEQ ID NO: 1964527 - DNA, 23 bp, Homo sapiens
tgagttgcaccattctttcttgg

SEQ ID NO: 1964528 - DNA, 20 bp, Homo sapiens
tgatagtgcttcttgtaata

SEQ ID NO: 1964529 - DNA, 21 bp, Homo sapiens
tgatatggtactaaggagaat

SEQ ID NO: 1964530 - DNA, 17 bp, Homo sapiens
tgatattgaccatgtga

SEQ ID NO: 1964531 - DNA, 15 bp, Homo sapiens
tgatgaatgaggaac

SEQ ID NO: 1964532 - DNA, 22 bp, Homo sapiens
tgattatggacatcgatatgaa

SEQ ID NO: 1964533 - DNA, 15 bp, Homo sapiens
tgatttcgatgtaca

SEQ ID NO: 1964534 - DNA, 18 bp, Homo sapiens
tgatttctagaatggttt

SEQ ID NO: 1964535 - DNA, 13 bp, Homo sapiens
tgatttttgtgta

SEQ ID NO: 1964536 - DNA, 15 bp, Homo sapiens
tgcaaaagcaggctt

SEQ ID NO: 1964537 - DNA, 15 bp, Homo sapiens
tgcaactcttgtatt

SEQ ID NO: 1964538 - DNA, 21 bp, Homo sapiens
tgcaagtgggagatgaaaacc

SEQ ID NO: 1964539 - DNA, 17 bp, Homo sapiens
tgcaatgtttttgtgta

SEQ ID NO: 1964540 - DNA, 18 bp, Homo sapiens
tgcaatgtttttgtgtag

SEQ ID NO: 1964541 - DNA, 21 bp, Homo sapiens
tgcacgttaacagcgtgtcaa

SEQ ID NO: 1964542 - DNA, 13 bp, Homo sapiens
tgcactgaaaacc

SEQ ID NO: 1964543 - DNA, 16 bp, Homo sapiens
tgcagaggaggagaaa

SEQ ID NO: 1964544 - DNA, 14 bp, Homo sapiens
tgcagcaatattct

SEQ ID NO: 1964545 - DNA, 19 bp, Homo sapiens
tgcaggtctccatgaagaa

SEQ ID NO: 1964546 - DNA, 14 bp, Homo sapiens
tgcagtgcggctca

SEQ ID NO: 1964547 - DNA, 23 bp, Homo sapiens
tgcataaacaatccaaatgcatt

SEQ ID NO: 1964548 - DNA, 14 bp, Homo sapiens
tgcatggagtgttt

SEQ ID NO: 1964549 - DNA, 16 bp, Homo sapiens
tgcatggagtgtttga

SEQ ID NO: 1964550 - DNA, 17 bp, Homo sapiens
tgcatgtaaaatcttca

SEQ ID NO: 1964551 - DNA, 20 bp, Homo sapiens
tgcatgtaaaatcttcagct

SEQ ID NO: 1964552 - DNA, 22 bp, Homo sapiens
tgcatgtaaaatcttcagctgg

SEQ ID NO: 1964553 - DNA, 22 bp, Homo sapiens
tgcattcatgttttaaaagttt

SEQ ID NO: 1964554 - DNA, 19 bp, Homo sapiens
tgcattgaatttagtcatt

SEQ ID NO: 1964555 - DNA, 22 bp, Homo sapiens
tgcatttttaaaggacaaacag

SEQ ID NO: 1964556 - DNA, 17 bp, Homo sapiens
tgcccagggtcagtgta

SEQ ID NO: 1964557 - DNA, 16 bp, Homo sapiens
tgccctgagccctcca

SEQ ID NO: 1964558 - DNA, 21 bp, Homo sapiens
tgcgcaaactttaacaggttt

SEQ ID NO: 1964559 - DNA, 17 bp, Homo sapiens
tgcgtggcacatctaaa

SEQ ID NO: 1964560 - DNA, 18 bp, Homo sapiens
tgctccattttcttgtca

SEQ ID NO: 1964561 - DNA, 20 bp, Homo sapiens
tgctgaatgtcattatttga

SEQ ID NO: 1964562 - DNA, 22 bp, Homo sapiens
tgcttatgtgttgcataaacaa

SEQ ID NO: 1964563 - DNA, 20 bp, Homo sapiens
tgcttcatgaaaatcctacc

SEQ ID NO: 1964564 - DNA, 12 bp, Homo sapiens
tgcttcttgtaa

SEQ ID NO: 1964565 - DNA, 20 bp, Homo sapiens
tgcttcttgtaatatttctt

SEQ ID NO: 1964566 - DNA, 13 bp, Homo sapiens
tggaaaagaaatc

SEQ ID NO: 1964567 - DNA, 19 bp, Homo sapiens
tggaaaagaaatcaatttt

SEQ ID NO: 1964568 - DNA, 23 bp, Homo sapiens
tggaaactaccagtgggcatgta

SEQ ID NO: 1964569 - DNA, 18 bp, Homo sapiens
tggagggatcattttctg

SEQ ID NO: 1964570 - DNA, 12 bp, Homo sapiens
tggagtgtttga

SEQ ID NO: 1964571 - DNA, 20 bp, Homo sapiens
tggattccaaagcattttca

SEQ ID NO: 1964572 - DNA, 19 bp, Homo sapiens
tggcatgtgggttgtgata

SEQ ID NO: 1964573 - DNA, 20 bp, Homo sapiens
tggcatgtgggttgtgatat

SEQ ID NO: 1964574 - DNA, 23 bp, Homo sapiens
tggcatgtgggttgtgatattga

SEQ ID NO: 1964575 - DNA, 16 bp, Homo sapiens
tggctttgttcttgtc

SEQ ID NO: 1964576 - DNA, 17 bp, Homo sapiens
tgggaagctatttcctt

SEQ ID NO: 1964577 - DNA, 14 bp, Homo sapiens
tgggagatgaaaac

SEQ ID NO: 1964578 - DNA, 22 bp, Homo sapiens
tgggagatgaaaacctgcattt

SEQ ID NO: 1964579 - DNA, 23 bp, Homo sapiens
tgggagatgaaaacctgcatttt

SEQ ID NO: 1964580 - DNA, 16 bp, Homo sapiens
tgggtgatttctagaa

SEQ ID NO: 1964581 - DNA, 13 bp, Homo sapiens
tgggtttcaattt

SEQ ID NO: 1964582 - DNA, 14 bp, Homo sapiens
tgggtttcaattta

SEQ ID NO: 1964583 - DNA, 17 bp, Homo sapiens
tggtgcaattaactctg

SEQ ID NO: 1964584 - DNA, 23 bp, Homo sapiens
tggtggatggtgacttttgaaga

SEQ ID NO: 1964585 - DNA, 19 bp, Homo sapiens
tggttagagaagtaagcag

SEQ ID NO: 1964586 - DNA, 15 bp, Homo sapiens
tgtaaaatcttcagc

SEQ ID NO: 1964587 - DNA, 22 bp, Homo sapiens
tgtaaatgaagggtcatttctc

SEQ ID NO: 1964588 - DNA, 13 bp, Homo sapiens
tgtaacctcgtgt

SEQ ID NO: 1964589 - DNA, 21 bp, Homo sapiens
tgtaatatttcttcaagtgag

SEQ ID NO: 1964590 - DNA, 18 bp, Homo sapiens
tgtacaaggtatgtacag

SEQ ID NO: 1964591 - DNA, 17 bp, Homo sapiens
tgtacagtctcaatttt

SEQ ID NO: 1964592 - DNA, 19 bp, Homo sapiens
tgtactggagagtggcaaa

SEQ ID NO: 1964593 - DNA, 21 bp, Homo sapiens
tgtatatagctctacacaaca

SEQ ID NO: 1964594 - DNA, 12 bp, Homo sapiens
tgtatctaattc

SEQ ID NO: 1964595 - DNA, 17 bp, Homo sapiens
taaaagtttgtccttta

SEQ ID NO: 1964596 - DNA, 18 bp, Homo sapiens
taaaagtttgtcctttaa

SEQ ID NO: 1964597 - DNA, 17 bp, Homo sapiens
taaacagatgtccctga

SEQ ID NO: 1964598 - DNA, 21 bp, Homo sapiens
taaaccttgtttctttctgaa

SEQ ID NO: 1964599 - DNA, 16 bp, Homo sapiens
taaagaaaatgtgtct

SEQ ID NO: 1964600 - DNA, 22 bp, Homo sapiens
taaaggacaaacagtgaattta

SEQ ID NO: 1964601 - DNA, 21 bp, Homo sapiens
taaatatagttgtctttcttt

SEQ ID NO: 1964602 - DNA, 21 bp, Homo sapiens
taaatattggtttgttattct

SEQ ID NO: 1964603 - DNA, 22 bp, Homo sapiens
taaatattggtttgttattctt

SEQ ID NO: 1964604 - DNA, 19 bp, Homo sapiens
taaattcgctgtgagtgag

SEQ ID NO: 1964605 - DNA, 16 bp, Homo sapiens
taaatttgaactccat

SEQ ID NO: 1964606 - DNA, 17 bp, Homo sapiens
taacaggttttcttcta

SEQ ID NO: 1964607 - DNA, 15 bp, Homo sapiens
taacataacaacctt

SEQ ID NO: 1964608 - DNA, 13 bp, Homo sapiens
taacttcataaaa

SEQ ID NO: 1964609 - DNA, 17 bp, Homo sapiens
taagaaacaatttaaat

SEQ ID NO: 1964610 - DNA, 16 bp, Homo sapiens
taagcagagttctttg

SEQ ID NO: 1964611 - DNA, 17 bp, Homo sapiens
taagcagagttctttgc

SEQ ID NO: 1964612 - DNA, 19 bp, Homo sapiens
taagcttagattttctgta

SEQ ID NO: 1964613 - DNA, 21 bp, Homo sapiens
taaggtatctggtatctgcat

SEQ ID NO: 1964614 - DNA, 16 bp, Homo sapiens
ttttgaagaacaaaag

SEQ ID NO: 1964615 - DNA, 20 bp, Homo sapiens
ttttgtgtatccagtatgca

SEQ ID NO: 1964616 - DNA, 12 bp, Homo sapiens
tttttaaagaaa

SEQ ID NO: 1964617 - DNA, 18 bp, Homo sapiens
aatgaagggtcatttctc

SEQ ID NO: 1964618 - DNA, 17 bp, Homo sapiens
aatgaatttgactggtt

SEQ ID NO: 1964619 - DNA, 16 bp, Homo sapiens
aatgatttttgtgtat

SEQ ID NO: 1964620 - DNA, 12 bp, Homo sapiens
aatgcattcatg

SEQ ID NO: 1964621 - DNA, 14 bp, Homo sapiens
aatgcattcatgtt

SEQ ID NO: 1964622 - DNA, 13 bp, Homo sapiens
aatgccaatctct

SEQ ID NO: 1964623 - DNA, 21 bp, Homo sapiens
aatgctgcccagggtcagtgt

SEQ ID NO: 1964624 - DNA, 20 bp, Homo sapiens
aatgctgtgcaaacagtgta

SEQ ID NO: 1964625 - DNA, 20 bp, Homo sapiens
aatgcttatgtgttgcataa

SEQ ID NO: 1964626 - DNA, 22 bp, Homo sapiens
aatgtcattatttgataacatt

SEQ ID NO: 1964627 - DNA, 18 bp, Homo sapiens
aatgtgtctgcaacatgg

SEQ ID NO: 1964628 - DNA, 13 bp, Homo sapiens
aatgttgcactga

SEQ ID NO: 1964629 - DNA, 18 bp, Homo sapiens
aatgttgcactgaaaacc

SEQ ID NO: 1964630 - DNA, 13 bp, Homo sapiens
aatttacttttta

SEQ ID NO: 1964631 - DNA, 17 bp, Homo sapiens
aatttctgccctgagcc

SEQ ID NO: 1964632 - DNA, 19 bp, Homo sapiens
aatttctgccctgagccct

SEQ ID NO: 1964633 - DNA, 23 bp, Homo sapiens
aattttatctacccagtcatgta

SEQ ID NO: 1964634 - DNA, 17 bp, Homo sapiens
aattttgaggtctttta

SEQ ID NO: 1964635 - DNA, 11 bp, Homo sapiens
aattttgtcac

SEQ ID NO: 1964636 - DNA, 16 bp, Homo sapiens
aattttttaaaccact

SEQ ID NO: 1964637 - DNA, 12 bp, Homo sapiens
acaaaaggcttt

SEQ ID NO: 1964638 - DNA, 17 bp, Homo sapiens
acaaacagtgaatttaa

SEQ ID NO: 1964639 - DNA, 20 bp, Homo sapiens
acagcgtgtcaactttcatt

SEQ ID NO: 1964640 - DNA, 15 bp, Homo sapiens
acagtcagcacagaa

SEQ ID NO: 1964641 - DNA, 14 bp, Homo sapiens
acagtcattattta

SEQ ID NO: 1964642 - DNA, 14 bp, Homo sapiens
acagtgtttatgac

SEQ ID NO: 1964643 - DNA, 16 bp, Homo sapiens
acatacagtgatatgg

SEQ ID NO: 1964644 - DNA, 16 bp, Homo sapiens
acatcgatatgaaaaa

SEQ ID NO: 1964645 - DNA, 13 bp, Homo sapiens
acatgaaaacatt

SEQ ID NO: 1964646 - DNA, 15 bp, Homo sapiens
acatgaaaacattga

SEQ ID NO: 1964647 - DNA, 16 bp, Homo sapiens
acatgcagctctgcag

SEQ ID NO: 1964648 - DNA, 23 bp, Homo sapiens
acatgcagctctgcagcaatatt

SEQ ID NO: 1964649 - DNA, 14 bp, Homo sapiens
acatgccagggaaa

SEQ ID NO: 1964650 - DNA, 20 bp, Homo sapiens
acatgcttcatgaaaatcct

SEQ ID NO: 1964651 - DNA, 23 bp, Homo sapiens
acatgcttcatgaaaatcctacc

SEQ ID NO: 1964652 - DNA, 15 bp, Homo sapiens
acatggattccaaag

SEQ ID NO: 1964653 - DNA, 16 bp, Homo sapiens
acatggtgtgtgtctc

SEQ ID NO: 1964654 - DNA, 19 bp, Homo sapiens
acatggtgtgtgtctctga

SEQ ID NO: 1964655 - DNA, 14 bp, Homo sapiens
acatgtatgtggat

SEQ ID NO: 1964656 - DNA, 15 bp, Homo sapiens
acatgtatgtggata

SEQ ID NO: 1964657 - DNA, 14 bp, Homo sapiens
acattgatgaatga

SEQ ID NO: 1964658 - DNA, 14 bp, Homo sapiens
acatttaggagaag

SEQ ID NO: 1964659 - DNA, 17 bp, Homo sapiens
accaggtcttgacctga

SEQ ID NO: 1964660 - DNA, 16 bp, Homo sapiens
accagtgggcatgtat

SEQ ID NO: 1964661 - DNA, 13 bp, Homo sapiens
accattctttctt

SEQ ID NO: 1964662 - DNA, 16 bp, Homo sapiens
acctcatgtcatttct

SEQ ID NO: 1964663 - DNA, 21 bp, Homo sapiens
acctgagctttccgcgtcagc

SEQ ID NO: 1964664 - DNA, 16 bp, Homo sapiens
accttcagatcctacc

SEQ ID NO: 1964665 - DNA, 18 bp, Homo sapiens
acggaaaatgccaatctc

SEQ ID NO: 1964666 - DNA, 19 bp, Homo sapiens
actaccagtgggcatgtat

SEQ ID NO: 1964667 - DNA, 16 bp, Homo sapiens
actctaattggtcatt

SEQ ID NO: 1964668 - DNA, 19 bp, Homo sapiens
actcttgtattgctccatt

SEQ ID NO: 1964669 - DNA, 16 bp, Homo sapiens
actgaatacttgaagt

SEQ ID NO: 1964670 - DNA, 21 bp, Homo sapiens
actgaatacttgaagtaggaa

SEQ ID NO: 1964671 - DNA, 21 bp, Homo sapiens
actgagtctggcaaacatgtg

SEQ ID NO: 1964672 - DNA, 20 bp, Homo sapiens
actgatcttacctttatgag

SEQ ID NO: 1964673 - DNA, 20 bp, Homo sapiens
actggatccatccgtccagc

SEQ ID NO: 1964674 - DNA, 15 bp, Homo sapiens
acttgggagcagtcc

SEQ ID NO: 1964675 - DNA, 17 bp, Homo sapiens
actttgtgcaaaagcag

SEQ ID NO: 1964676 - DNA, 14 bp, Homo sapiens
actttttaaacagt

SEQ ID NO: 1964677 - DNA, 16 bp, Homo sapiens
actttttaaacagtgt

SEQ ID NO: 1964678 - DNA, 17 bp, Homo sapiens
actttttaaacagtgtt

SEQ ID NO: 1964679 - DNA, 15 bp, Homo sapiens
agaaaatgaatttga

SEQ ID NO: 1964680 - DNA, 14 bp, Homo sapiens
agaaaatgtgtctg

SEQ ID NO: 1964681 - DNA, 14 bp, Homo sapiens
agaaagaaaatgaa

SEQ ID NO: 1964682 - DNA, 18 bp, Homo sapiens
agaaatcgccttatgaga

SEQ ID NO: 1964683 - DNA, 18 bp, Homo sapiens
agaacatggtgtgtgtct

SEQ ID NO: 1964684 - DNA, 20 bp, Homo sapiens
agaacatggtgtgtgtctct

SEQ ID NO: 1964685 - DNA, 12 bp, Homo sapiens
agaatagtctct

SEQ ID NO: 1964686 - DNA, 21 bp, Homo sapiens
agaccaaattttgaggtcttt

SEQ ID NO: 1964687 - DNA, 23 bp, Homo sapiens
agaccaaattttgaggtctttta

SEQ ID NO: 1964688 - DNA, 17 bp, Homo sapiens
agacctcagatgtgttg

SEQ ID NO: 1964689 - DNA, 15 bp, Homo sapiens
agacctgagctttcc

SEQ ID NO: 1964690 - DNA, 13 bp, Homo sapiens
agagttctttgca

SEQ ID NO: 1964691 - DNA, 14 bp, Homo sapiens
agataacggctctc

SEQ ID NO: 1964692 - DNA, 16 bp, Homo sapiens
agataacggctctcca

SEQ ID NO: 1964693 - DNA, 16 bp, Homo sapiens
agatatttaaaagaca

SEQ ID NO: 1964694 - DNA, 21 bp, Homo sapiens
agatatttaaaagacaaacac

SEQ ID NO: 1964695 - DNA, 19 bp, Homo sapiens
agatccaaatgctgtgcaa

SEQ ID NO: 1964696 - DNA, 15 bp, Homo sapiens
agatcctacccctga

SEQ ID NO: 1964697 - DNA, 15 bp, Homo sapiens
agcaacatgcttcat

SEQ ID NO: 1964698 - DNA, 15 bp, Homo sapiens
agcagagttctttgc

SEQ ID NO: 1964699 - DNA, 15 bp, Homo sapiens
agcatcaaacatgaa

SEQ ID NO: 1964700 - DNA, 17 bp, Homo sapiens
agcatcaaacatgaaaa

SEQ ID NO: 1964701 - DNA, 19 bp, Homo sapiens
agcatcaaacatgaaaaca

SEQ ID NO: 1964702 - DNA, 14 bp, Homo sapiens
agccaagagctctt

SEQ ID NO: 1964703 - DNA, 16 bp, Homo sapiens
agccaagagctcttca

SEQ ID NO: 1964704 - DNA, 17 bp, Homo sapiens
agccaagagctcttcat

SEQ ID NO: 1964705 - DNA, 20 bp, Homo sapiens
agccatagagatatttaaaa

SEQ ID NO: 1964706 - DNA, 14 bp, Homo sapiens
agccctccacgtca

SEQ ID NO: 1964707 - DNA, 15 bp, Homo sapiens
agctagctatttcta

SEQ ID NO: 1964708 - DNA, 16 bp, Homo sapiens
agctagctatttctat

SEQ ID NO: 1964709 - DNA, 23 bp, Homo sapiens
agctagctatttctatgtatgtg

SEQ ID NO: 1964710 - DNA, 20 bp, Homo sapiens
agctccagtggaagaagaaa

SEQ ID NO: 1964711 - DNA, 16 bp, Homo sapiens
agctctatctgcaatg

SEQ ID NO: 1964712 - DNA, 22 bp, Homo sapiens
agctgccaagtaaatagcaaca

SEQ ID NO: 1964713 - DNA, 21 bp, Homo sapiens
agctggtggatggtgactttt

SEQ ID NO: 1964714 - DNA, 19 bp, Homo sapiens
agcttagattttctgtaaa

SEQ ID NO: 1964715 - DNA, 19 bp, Homo sapiens
agcttatttagcacatttt

SEQ ID NO: 1964716 - DNA, 21 bp, Homo sapiens
agcttatttagcacattttga

SEQ ID NO: 1964717 - DNA, 19 bp, Homo sapiens
aggaaatccagtagggaaa

SEQ ID NO: 1964718 - DNA, 22 bp, Homo sapiens
aggaatcgtttttgctgcagag

SEQ ID NO: 1964719 - DNA, 18 bp, Homo sapiens
aggacaaacagtgaattt

SEQ ID NO: 1964720 - DNA, 13 bp, Homo sapiens
aggagaagttggt

SEQ ID NO: 1964721 - DNA, 11 bp, Homo sapiens
aggaggagaaa

SEQ ID NO: 1964722 - DNA, 12 bp, Homo sapiens
agggtcatttct

SEQ ID NO: 1964723 - DNA, 14 bp, Homo sapiens
aggtcttttacata

SEQ ID NO: 1964724 - DNA, 21 bp, Homo sapiens
aggtcttttacatacagtgat

SEQ ID NO: 1964725 - DNA, 23 bp, Homo sapiens
aggttggaaaagaaatcaatttt

SEQ ID NO: 1964726 - DNA, 20 bp, Homo sapiens
agtaagcagagttctttgca

SEQ ID NO: 1964727 - DNA, 11 bp, Homo sapiens
agtactttgtg

SEQ ID NO: 1964728 - DNA, 17 bp, Homo sapiens
agtcattgtaacctcgt

SEQ ID NO: 1964729 - DNA, 16 bp, Homo sapiens
agtctcaattttgtat

SEQ ID NO: 1964730 - DNA, 18 bp, Homo sapiens
agtctgaggcacctgcat

SEQ ID NO: 1964731 - DNA, 17 bp, Homo sapiens
agtctggcaaacatgtg

SEQ ID NO: 1964732 - DNA, 14 bp, Homo sapiens
agtgagtggcatgt

SEQ ID NO: 1964733 - DNA, 22 bp, Homo sapiens
agtgcttcttgtaatatttctt

SEQ ID NO: 1964734 - DNA, 19 bp, Homo sapiens
agttccagttttgttttga

SEQ ID NO: 1964735 - DNA, 15 bp, Homo sapiens
agttggtcttacttt

SEQ ID NO: 1964736 - DNA, 13 bp, Homo sapiens
gcttcctctgaat

SEQ ID NO: 1964737 - DNA, 16 bp, Homo sapiens
gctttgttcttgtcat

SEQ ID NO: 1964738 - DNA, 18 bp, Homo sapiens
ggaaaagaaatcaatttt

SEQ ID NO: 1964739 - DNA, 18 bp, Homo sapiens
ggaacaatcacaaaagct

SEQ ID NO: 1964740 - DNA, 15 bp, Homo sapiens
ggacctctcttgtga

SEQ ID NO: 1964741 - DNA, 13 bp, Homo sapiens
ggagatgaaaacc

SEQ ID NO: 1964742 - DNA, 13 bp, Homo sapiens
ggatggtgacttt

SEQ ID NO: 1964743 - DNA, 23 bp, Homo sapiens
ggattctaaacagatgtccctga

SEQ ID NO: 1964744 - DNA, 21 bp, Homo sapiens
ggcaacagaaaacaattgttc

SEQ ID NO: 1964745 - DNA, 23 bp, Homo sapiens
ggcacatctaaattgatcattca

SEQ ID NO: 1964746 - DNA, 19 bp, Homo sapiens
ggcatgtgggttgtgatat

SEQ ID NO: 1964747 - DNA, 13 bp, Homo sapiens
ggctcatcagaac

SEQ ID NO: 1964748 - DNA, 22 bp, Homo sapiens
gggaagatgaaaccgtccctga

SEQ ID NO: 1964749 - DNA, 19 bp, Homo sapiens
gggcatgtattagccagtc

SEQ ID NO: 1964750 - DNA, 15 bp, Homo sapiens
gggtgatttctagaa

SEQ ID NO: 1964751 - DNA, 22 bp, Homo sapiens
ggtcttttacatacagtgatat

SEQ ID NO: 1964752 - DNA, 16 bp, Homo sapiens
ggtttacaacaaacac

SEQ ID NO: 1964753 - DNA, 14 bp, Homo sapiens
gtaaaatcttcagc

SEQ ID NO: 1964754 - DNA, 18 bp, Homo sapiens
gtaaaatcttcagctggt

SEQ ID NO: 1964755 - DNA, 21 bp, Homo sapiens
gtaaaatcttcagctggtgga

SEQ ID NO: 1964756 - DNA, 18 bp, Homo sapiens
gtaatattctctgatgtt

SEQ ID NO: 1964757 - DNA, 14 bp, Homo sapiens
gtaatatttcttca

SEQ ID NO: 1964758 - DNA, 16 bp, Homo sapiens
gtaatgcttatgtgtt

SEQ ID NO: 1964759 - DNA, 16 bp, Homo sapiens
gtagtcacctctgggc

SEQ ID NO: 1964760 - DNA, 22 bp, Homo sapiens
gtatgcaagtgggagatgaaaa

SEQ ID NO: 1964761 - DNA, 15 bp, Homo sapiens
gtatgtacagttcat

SEQ ID NO: 1964762 - DNA, 20 bp, Homo sapiens
gtatgtacagttcataaatt

SEQ ID NO: 1964763 - DNA, 15 bp, Homo sapiens
gtatgtggatacagt

SEQ ID NO: 1964764 - DNA, 21 bp, Homo sapiens
gtatgtggatacagtcattat

SEQ ID NO: 1964765 - DNA, 15 bp, Homo sapiens
gtattgctccatttt

SEQ ID NO: 1964766 - DNA, 15 bp, Homo sapiens
gtcaactttcatttg

SEQ ID NO: 1964767 - DNA, 17 bp, Homo sapiens
gtcatgtgtatgagaag

SEQ ID NO: 1964768 - DNA, 22 bp, Homo sapiens
gtcattatttgataacattttg

SEQ ID NO: 1964769 - DNA, 18 bp, Homo sapiens
gtcattcctaatgcatta

SEQ ID NO: 1964770 - DNA, 12 bp, Homo sapiens
gtcccagtgaac

SEQ ID NO: 1964771 - DNA, 18 bp, Homo sapiens
gtccctgaagtcttgcat

SEQ ID NO: 1964772 - DNA, 14 bp, Homo sapiens
gtccctgtgttctg

SEQ ID NO: 1964773 - DNA, 18 bp, Homo sapiens
gtctcaattttgtattta

SEQ ID NO: 1964774 - DNA, 19 bp, Homo sapiens
gtctcaattttgtatttaa

SEQ ID NO: 1964775 - DNA, 19 bp, Homo sapiens
gtctcagtgccccttaaat

SEQ ID NO: 1964776 - DNA, 19 bp, Homo sapiens
gtctggcaaacatgtgcaa

SEQ ID NO: 1964777 - DNA, 17 bp, Homo sapiens
gtcttgacctgaactct

SEQ ID NO: 1964778 - DNA, 16 bp, Homo sapiens
gtcttggttagagaag

SEQ ID NO: 1964779 - DNA, 12 bp, Homo sapiens
gtctttctttgc

SEQ ID NO: 1964780 - DNA, 13 bp, Homo sapiens
gtctttctttgct

SEQ ID NO: 1964781 - DNA, 16 bp, Homo sapiens
gtctttctttgctgct

SEQ ID NO: 1964782 - DNA, 21 bp, Homo sapiens
gtctttctttgctgctgtgga

SEQ ID NO: 1964783 - DNA, 21 bp, Homo sapiens
gtgatatggtactaaggagaa

SEQ ID NO: 1964784 - DNA, 18 bp, Homo sapiens
gtgatgttgggaagctat

SEQ ID NO: 1964785 - DNA, 13 bp, Homo sapiens
gtgcaaacagtgt

SEQ ID NO: 1964786 - DNA, 12 bp, Homo sapiens
gtgccaattttg

SEQ ID NO: 1964787 - DNA, 14 bp, Homo sapiens
gtggatacagtcat

SEQ ID NO: 1964788 - DNA, 17 bp, Homo sapiens
gtggatggtgacttttg

SEQ ID NO: 1964789 - DNA, 23 bp, Homo sapiens
gtggcatgtgggttgtgatattg

SEQ ID NO: 1964790 - DNA, 15 bp, Homo sapiens
gtgggagatgaaaac

SEQ ID NO: 1964791 - DNA, 13 bp, Homo sapiens
gtgtaatattctc

SEQ ID NO: 1964792 - DNA, 22 bp, Homo sapiens
gtgtatgcaagtgggagatgaa

SEQ ID NO: 1964793 - DNA, 15 bp, Homo sapiens
gtgtcaactttcatt

SEQ ID NO: 1964794 - DNA, 13 bp, Homo sapiens
gtgtctctgtata

SEQ ID NO: 1964795 - DNA, 12 bp, Homo sapiens
gtgtgtctctga

SEQ ID NO: 1964796 - DNA, 17 bp, Homo sapiens
gttaccaaaaatatccc

SEQ ID NO: 1964797 - DNA, 12 bp, Homo sapiens
gttacttaaaca

SEQ ID NO: 1964798 - DNA, 20 bp, Homo sapiens
gttacttaaacatcattgga

SEQ ID NO: 1964799 - DNA, 17 bp, Homo sapiens
gttataacttcataaaa

SEQ ID NO: 1964800 - DNA, 17 bp, Homo sapiens
gttatgatggaaaggaa

SEQ ID NO: 1964801 - DNA, 22 bp, Homo sapiens
gttattcttttccagaaagaaa

SEQ ID NO: 1964802 - DNA, 23 bp, Homo sapiens
gttcataaatttgttgtcatgtg

SEQ ID NO: 1964803 - DNA, 15 bp, Homo sapiens
gttctacttgatatt

SEQ ID NO: 1964804 - DNA, 16 bp, Homo sapiens
gttctttgcaagctta

SEQ ID NO: 1964805 - DNA, 13 bp, Homo sapiens
gttgaaaaaagaa

SEQ ID NO: 1964806 - DNA, 14 bp, Homo sapiens
gttgcaccattctt

SEQ ID NO: 1964807 - DNA, 15 bp, Homo sapiens
gttgcactgaaaacc

SEQ ID NO: 1964808 - DNA, 20 bp, Homo sapiens
gttgcataaacaatccaaat

SEQ ID NO: 1964809 - DNA, 12 bp, Homo sapiens
gttgtctttctt

SEQ ID NO: 1964810 - DNA, 16 bp, Homo sapiens
gtttacaacaaacact

SEQ ID NO: 1964811 - DNA, 14 bp, Homo sapiens
gtttcttgcttctg

SEQ ID NO: 1964812 - DNA, 16 bp, Homo sapiens
gtttgacgaagaaaca

SEQ ID NO: 1964813 - DNA, 17 bp, Homo sapiens
gtttgatagtgcttctt

SEQ ID NO: 1964814 - DNA, 20 bp, Homo sapiens
gtttgatagtgcttcttgta

SEQ ID NO: 1964815 - DNA, 16 bp, Homo sapiens
gtttgtcctttaacta

SEQ ID NO: 1964816 - DNA, 17 bp, Homo sapiens
gtttgtcctttaactat

SEQ ID NO: 1964817 - DNA, 22 bp, Homo sapiens
gtttttgttgagtctctgaaca

SEQ ID NO: 1964818 - DNA, 23 bp, Homo sapiens
gtttttgttgagtctctgaacat

SEQ ID NO: 1964819 - DNA, 14 bp, Homo sapiens
taaaagacaaacac

SEQ ID NO: 1964820 - DNA, 17 bp, Homo sapiens
taaaatcttcagctggt

SEQ ID NO: 1964821 - DNA, 18 bp, Homo sapiens
taaaatcttcagctggtg

SEQ ID NO: 1964822 - DNA, 19 bp, Homo sapiens
taaaatgttggtgcaatta

SEQ ID NO: 1964823 - DNA, 18 bp, Homo sapiens
taaacagatgtccctgaa

SEQ ID NO: 1964824 - DNA, 16 bp, Homo sapiens
taaaccttgtttcttt

SEQ ID NO: 1964825 - DNA, 17 bp, Homo sapiens
taaaccttgtttctttc

SEQ ID NO: 1964826 - DNA, 18 bp, Homo sapiens
taaaccttgtttctttct

SEQ ID NO: 1964827 - DNA, 23 bp, Homo sapiens
taaactcctactgcttcctctga

SEQ ID NO: 1964828 - DNA, 23 bp, Homo sapiens
taaagaaaatgtgtctgcaacat

SEQ ID NO: 1964829 - DNA, 14 bp, Homo sapiens
taaaggacaaacag

SEQ ID NO: 1964830 - DNA, 16 bp, Homo sapiens
taaaggacaaacagtg

SEQ ID NO: 1964831 - DNA, 21 bp, Homo sapiens
taaaggacaaacagtgaattt

SEQ ID NO: 1964832 - DNA, 21 bp, Homo sapiens
taaatttgaactccatgggat

SEQ ID NO: 1964833 - DNA, 21 bp, Homo sapiens
taaatttgttgtcatgtgtat

SEQ ID NO: 1964834 - DNA, 22 bp, Homo sapiens
taaatttgttgtcatgtgtatg

SEQ ID NO: 1964835 - DNA, 22 bp, Homo sapiens
taacaacctttcccatttcgtg

SEQ ID NO: 1964836 - DNA, 16 bp, Homo sapiens
taacatttaggagaag

SEQ ID NO: 1964837 - DNA, 11 bp, Homo sapiens
taacattttgt

SEQ ID NO: 1964838 - DNA, 13 bp, Homo sapiens
taacggctctcca

SEQ ID NO: 1964839 - DNA, 14 bp, Homo sapiens
taacggctctccag

SEQ ID NO: 1964840 - DNA, 12 bp, Homo sapiens
taagaatagtct

SEQ ID NO: 1964841 - DNA, 20 bp, Homo sapiens
taagaatagtctctgggttt

SEQ ID NO: 1964842 - DNA, 21 bp, Homo sapiens
taagaatagtctctgggttta

SEQ ID NO: 1964843 - DNA, 18 bp, Homo sapiens
taagatactcaagcaggt

SEQ ID NO: 1964844 - DNA, 18 bp, Homo sapiens
taagcagagttctttgca

SEQ ID NO: 1964845 - DNA, 14 bp, Homo sapiens
taagcatgagtggc

SEQ ID NO: 1964846 - DNA, 17 bp, Homo sapiens
taatattctctgatgtt

SEQ ID NO: 1964847 - DNA, 12 bp, Homo sapiens
taatatttcttc

SEQ ID NO: 1964848 - DNA, 22 bp, Homo sapiens
taatcataacatagttgaaaaa

SEQ ID NO: 1964849 - DNA, 12 bp, Homo sapiens
taatctgttgtt

SEQ ID NO: 1964850 - DNA, 12 bp, Homo sapiens
tacaacaaacac

SEQ ID NO: 1964851 - DNA, 16 bp, Homo sapiens
tacaacaaacactgtg

SEQ ID NO: 1964852 - DNA, 14 bp, Homo sapiens
tacaaccaggtctt

SEQ ID NO: 1964853 - DNA, 14 bp, Homo sapiens
tacaaggtatgtac

SEQ ID NO: 1964854 - DNA, 17 bp, Homo sapiens
tacagtctcaattttgt

SEQ ID NO: 1964855 - DNA, 12 bp, Homo sapiens
aaaaaaaacaaa

SEQ ID NO: 1964856 - DNA, 10 bp, Homo sapiens
aaaacaaaat

SEQ ID NO: 1964857 - DNA, 20 bp, Homo sapiens
aaaacaattgttctgggtga

SEQ ID NO: 1964858 - DNA, 16 bp, Homo sapiens
aaaagctgtgtctctg

SEQ ID NO: 1964859 - DNA, 20 bp, Homo sapiens
aaaatagggtccttgaaaca

SEQ ID NO: 1964860 - DNA, 13 bp, Homo sapiens
aaaatatcccttt

SEQ ID NO: 1964861 - DNA, 15 bp, Homo sapiens
aaaatgccaatctct

SEQ ID NO: 1964862 - DNA, 20 bp, Homo sapiens
aaaatgtgtctgcaacatgg

SEQ ID NO: 1964863 - DNA, 22 bp, Homo sapiens
aaaatgtgtctgcaacatggat

SEQ ID NO: 1964864 - DNA, 15 bp, Homo sapiens
aaacaatttaaattg

SEQ ID NO: 1964865 - DNA, 20 bp, Homo sapiens
aaacaatttaaattgttata

SEQ ID NO: 1964866 - DNA, 15 bp, Homo sapiens
aaacagatgtccctg

SEQ ID NO: 1964867 - DNA, 15 bp, Homo sapiens
aaacagtgtttatga

SEQ ID NO: 1964868 - DNA, 23 bp, Homo sapiens
aaacatgtgcaactcttgtattg

SEQ ID NO: 1964869 - DNA, 12 bp, Homo sapiens
aaacctgcattt

SEQ ID NO: 1964870 - DNA, 14 bp, Homo sapiens
aaacctgcattttt

SEQ ID NO: 1964871 - DNA, 14 bp, Homo sapiens
aaaccttgtttctt

SEQ ID NO: 1964872 - DNA, 18 bp, Homo sapiens
aaaccttgtttctttctg

SEQ ID NO: 1964873 - DNA, 19 bp, Homo sapiens
aaactaccagtgggcatgt

SEQ ID NO: 1964874 - DNA, 21 bp, Homo sapiens
aaactaccagtgggcatgtat

SEQ ID NO: 1964875 - DNA, 20 bp, Homo sapiens
aaagaagtttgggctaacat

SEQ ID NO: 1964876 - DNA, 23 bp, Homo sapiens
aaagaagtttgggctaacattta

SEQ ID NO: 1964877 - DNA, 17 bp, Homo sapiens
aaagacaaacaccttat

SEQ ID NO: 1964878 - DNA, 16 bp, Homo sapiens
aaagaccaaattttga

SEQ ID NO: 1964879 - DNA, 15 bp, Homo sapiens
aaagctgtgtctctg

SEQ ID NO: 1964880 - DNA, 16 bp, Homo sapiens
aaagctgtgtctctgt

SEQ ID NO: 1964881 - DNA, 18 bp, Homo sapiens
aaagctgtgtctctgtat

SEQ ID NO: 1964882 - DNA, 13 bp, Homo sapiens
aaaggacaaacag

SEQ ID NO: 1964883 - DNA, 15 bp, Homo sapiens
aaaggacaaacagtg

SEQ ID NO: 1964884 - DNA, 16 bp, Homo sapiens
aaaggacaaacagtga

SEQ ID NO: 1964885 - DNA, 20 bp, Homo sapiens
aaagtataaattcgctgtga

SEQ ID NO: 1964886 - DNA, 17 bp, Homo sapiens
aaagtgggtttcaattt

SEQ ID NO: 1964887 - DNA, 14 bp, Homo sapiens
aaagtttgtccttt

SEQ ID NO: 1964888 - DNA, 15 bp, Homo sapiens
aaatagcaacatgct

SEQ ID NO: 1964889 - DNA, 19 bp, Homo sapiens
aaatagggtccttgaaaca

SEQ ID NO: 1964890 - DNA, 16 bp, Homo sapiens
aaatatagttgtcttt

SEQ ID NO: 1964891 - DNA, 23 bp, Homo sapiens
aaatatagttgtctttctttgct

SEQ ID NO: 1964892 - DNA, 13 bp, Homo sapiens
aaatcaatttttt

SEQ ID NO: 1964893 - DNA, 12 bp, Homo sapiens
aaatcttcagct

SEQ ID NO: 1964894 - DNA, 21 bp, Homo sapiens
catgtaaaatcttcagctggt

SEQ ID NO: 1964895 - DNA, 22 bp, Homo sapiens
catgtaaaatcttcagctggtg

SEQ ID NO: 1964896 - DNA, 15 bp, Homo sapiens
catgtatagctagct

SEQ ID NO: 1964897 - DNA, 21 bp, Homo sapiens
catgtatgtggatacagtcat

SEQ ID NO: 1964898 - DNA, 15 bp, Homo sapiens
catgtcatttctcat

SEQ ID NO: 1964899 - DNA, 19 bp, Homo sapiens
catgtgcaactcttgtatt

SEQ ID NO: 1964900 - DNA, 17 bp, Homo sapiens
catgtgggttgtgatat

SEQ ID NO: 1964901 - DNA, 22 bp, Homo sapiens
catgtgtatgagaagtactttg

SEQ ID NO: 1964902 - DNA, 21 bp, Homo sapiens
catgttttaaaagtttgtcct

SEQ ID NO: 1964903 - DNA, 15 bp, Homo sapiens
cattcacatttcaag

SEQ ID NO: 1964904 - DNA, 16 bp, Homo sapiens
cattcatgttttaaaa

SEQ ID NO: 1964905 - DNA, 13 bp, Homo sapiens
catttaggagaag

SEQ ID NO: 1964906 - DNA, 16 bp, Homo sapiens
catttaggagaagttg

SEQ ID NO: 1964907 - DNA, 22 bp, Homo sapiens
cattttcagcatcaaacatgaa

SEQ ID NO: 1964908 - DNA, 14 bp, Homo sapiens
cattttcttgtcaa

SEQ ID NO: 1964909 - DNA, 12 bp, Homo sapiens
cattttgaatgt

SEQ ID NO: 1964910 - DNA, 14 bp, Homo sapiens
cattttgaatgtga

SEQ ID NO: 1964911 - DNA, 23 bp, Homo sapiens
catttttaaaggacaaacagtga

SEQ ID NO: 1964912 - DNA, 18 bp, Homo sapiens
ccaaatgcattcatgttt

SEQ ID NO: 1964913 - DNA, 12 bp, Homo sapiens
ccaactttcatt

SEQ ID NO: 1964914 - DNA, 16 bp, Homo sapiens
ccagaaagaaaatgaa

SEQ ID NO: 1964915 - DNA, 18 bp, Homo sapiens
ccagccaagagctcttca

SEQ ID NO: 1964916 - DNA, 16 bp, Homo sapiens
ccaggccacaaatgtg

SEQ ID NO: 1964917 - DNA, 14 bp, Homo sapiens
ccagggaaaaagac

SEQ ID NO: 1964918 - DNA, 23 bp, Homo sapiens
ccaggttggaaaagaaatcaatt

SEQ ID NO: 1964919 - DNA, 23 bp, Homo sapiens
ccatgtatagctagctatttcta

SEQ ID NO: 1964920 - DNA, 22 bp, Homo sapiens
cccacggaaaatgccaatctct

SEQ ID NO: 1964921 - DNA, 23 bp, Homo sapiens
cccttaaatttctgccctgagcc

SEQ ID NO: 1964922 - DNA, 14 bp, Homo sapiens
cctcagatgtgttg

SEQ ID NO: 1964923 - DNA, 16 bp, Homo sapiens
cctcatgtcatttctc

SEQ ID NO: 1964924 - DNA, 10 bp, Homo sapiens
cctgagccct

SEQ ID NO: 1964925 - DNA, 17 bp, Homo sapiens
cctgctggttcactcta

SEQ ID NO: 1964926 - DNA, 16 bp, Homo sapiens
cctgtaaaccaaagtt

SEQ ID NO: 1964927 - DNA, 21 bp, Homo sapiens
ccttattgagcgtgattctgt

SEQ ID NO: 1964928 - DNA, 16 bp, Homo sapiens
aaatgaatttgactgg

SEQ ID NO: 1964929 - DNA, 18 bp, Homo sapiens
aaatgcattcatgtttta

SEQ ID NO: 1964930 - DNA, 14 bp, Homo sapiens
aaatgctgtgcaaa

SEQ ID NO: 1964931 - DNA, 19 bp, Homo sapiens
aaattgatcattcataatt

SEQ ID NO: 1964932 - DNA, 13 bp, Homo sapiens
aacaaaaggcttt

SEQ ID NO: 1964933 - DNA, 15 bp, Homo sapiens
aacaatcacaaaagc

SEQ ID NO: 1964934 - DNA, 14 bp, Homo sapiens
aacaatccaaatgc

SEQ ID NO: 1964935 - DNA, 23 bp, Homo sapiens
aacaatccaaatgcattcatgtt

SEQ ID NO: 1964936 - DNA, 21 bp, Homo sapiens
aacacacttgggagcagtcct

SEQ ID NO: 1964937 - DNA, 20 bp, Homo sapiens
aacagtgaatttaagcatga

SEQ ID NO: 1964938 - DNA, 24 bp, Homo sapiens
aacatagttgaaaaaagaagtttg

SEQ ID NO: 1964939 - DNA, 18 bp, Homo sapiens
aacatgcagctctgcagc

SEQ ID NO: 1964940 - DNA, 18 bp, Homo sapiens
aacatggattccaaagca

SEQ ID NO: 1964941 - DNA, 20 bp, Homo sapiens
aacatggattccaaagcatt

SEQ ID NO: 1964942 - DNA, 17 bp, Homo sapiens
aacatggtgtgtgtctc

SEQ ID NO: 1964943 - DNA, 21 bp, Homo sapiens
aacatggtgtgtgtctctgac

SEQ ID NO: 1964944 - DNA, 15 bp, Homo sapiens
aacattgatgaatga

SEQ ID NO: 1964945 - DNA, 19 bp, Homo sapiens
aacatttaggagaagttgg

SEQ ID NO: 1964946 - DNA, 22 bp, Homo sapiens
aaccactaatgcttgccaagaa

SEQ ID NO: 1964947 - DNA, 23 bp, Homo sapiens
aacctgcatttttaaaggacaaa

SEQ ID NO: 1964948 - DNA, 17 bp, Homo sapiens
aaccttgtttctttctg

SEQ ID NO: 1964949 - DNA, 22 bp, Homo sapiens
aactaccagtgggcatgtatta

SEQ ID NO: 1964950 - DNA, 15 bp, Homo sapiens
aactcctactgcttc

SEQ ID NO: 1964951 - DNA, 13 bp, Homo sapiens
aactcttgtattg

SEQ ID NO: 1964952 - DNA, 11 bp, Homo sapiens
aagaaaacact

SEQ ID NO: 1964953 - DNA, 12 bp, Homo sapiens
aagaaaatgaat

SEQ ID NO: 1964954 - DNA, 20 bp, Homo sapiens
aagaaatcgccttatgagaa

SEQ ID NO: 1964955 - DNA, 21 bp, Homo sapiens
aagaaatcgccttatgagaac

SEQ ID NO: 1964956 - DNA, 12 bp, Homo sapiens
aagaagtttggg

SEQ ID NO: 1964957 - DNA, 16 bp, Homo sapiens
aagcaggcttgtgctt

SEQ ID NO: 1964958 - DNA, 20 bp, Homo sapiens
aagcaggtttcttgcttctg

SEQ ID NO: 1964959 - DNA, 15 bp, Homo sapiens
aagcattttcagcat

SEQ ID NO: 1964960 - DNA, 17 bp, Homo sapiens
aagcattttcagcatca

SEQ ID NO: 1964961 - DNA, 21 bp, Homo sapiens
aagcattttcagcatcaaaca

SEQ ID NO: 1964962 - DNA, 13 bp, Homo sapiens
aagctatttcctt

SEQ ID NO: 1964963 - DNA, 21 bp, Homo sapiens
aaggacaaacagtgaatttaa

SEQ ID NO: 1964964 - DNA, 17 bp, Homo sapiens
aaggattctaaacagat

SEQ ID NO: 1964965 - DNA, 17 bp, Homo sapiens
aaggctttggcaacaga

SEQ ID NO: 1964966 - DNA, 15 bp, Homo sapiens
aagtaaatagcaaca

SEQ ID NO: 1964967 - DNA, 22 bp, Homo sapiens
aagtctgaggcacctgcatatc

SEQ ID NO: 1964968 - DNA, 17 bp, Homo sapiens
aagttccagttttgttt

SEQ ID NO: 1964969 - DNA, 20 bp, Homo sapiens
aatacgccagaactgcttta

SEQ ID NO: 1964970 - DNA, 18 bp, Homo sapiens
aatatagttgtctttctt

SEQ ID NO: 1964971 - DNA, 23 bp, Homo sapiens
aatatccctttttcacatattaa

SEQ ID NO: 1964972 - DNA, 15 bp, Homo sapiens
aatccagtagggaaa

SEQ ID NO: 1964973 - DNA, 16 bp, Homo sapiens
aatcctaccaacctct

SEQ ID NO: 1964974 - DNA, 18 bp, Homo sapiens
aatcctaccaacctctga

SEQ ID NO: 1964975 - DNA, 12 bp, Homo sapiens
aatcttcagctg

SEQ ID NO: 1964976 - DNA, 13 bp, Homo sapiens
aatcttcagctgg

SEQ ID NO: 1964977 - DNA, 22 bp, Homo sapiens
aatgaggaacaatcacaaaagc

SEQ ID NO: 1964978 - DNA, 17 bp, Homo sapiens
aatgatttttgtgtatc

SEQ ID NO: 1964979 - DNA, 20 bp, Homo sapiens
aatgcgtggcacatctaaat

SEQ ID NO: 1964980 - DNA, 22 bp, Homo sapiens
aatgctgtgcaaacagtgtaag

SEQ ID NO: 1964981 - DNA, 18 bp, Homo sapiens
aatgcttgccaagaaatc

SEQ ID NO: 1964982 - DNA, 19 bp, Homo sapiens
gaacatggtgtgtgtctct

SEQ ID NO: 1964983 - DNA, 12 bp, Homo sapiens
gaagaaacaaaa

SEQ ID NO: 1964984 - DNA, 16 bp, Homo sapiens
gaagaaccgcattttg

SEQ ID NO: 1964985 - DNA, 13 bp, Homo sapiens
gaagaagaaaaca

SEQ ID NO: 1964986 - DNA, 20 bp, Homo sapiens
gaagatgaaaccgtccctga

SEQ ID NO: 1964987 - DNA, 20 bp, Homo sapiens
gaagctatttcctttgcgca

SEQ ID NO: 1964988 - DNA, 19 bp, Homo sapiens
gaagctgggactcattcac

SEQ ID NO: 1964989 - DNA, 22 bp, Homo sapiens
gaagctgggactcattcacatt

SEQ ID NO: 1964990 - DNA, 16 bp, Homo sapiens
gaatagtctctgggtt

SEQ ID NO: 1964991 - DNA, 21 bp, Homo sapiens
gaatcgtttttgctgcagaga

SEQ ID NO: 1964992 - DNA, 23 bp, Homo sapiens
gaatgctgcccagggtcagtgta

SEQ ID NO: 1964993 - DNA, 22 bp, Homo sapiens
gaattaaactcctactgcttcc

SEQ ID NO: 1964994 - DNA, 22 bp, Homo sapiens
gaatttaagcatgagtggcctt

SEQ ID NO: 1964995 - DNA, 14 bp, Homo sapiens
gacaaacagtgaat

SEQ ID NO: 1964996 - DNA, 16 bp, Homo sapiens
gacagatcctccattt

SEQ ID NO: 1964997 - DNA, 17 bp, Homo sapiens
gacatcgatatgaaaaa

SEQ ID NO: 1964998 - DNA, 20 bp, Homo sapiens
gaccatgtgattatggacat

SEQ ID NO: 1964999 - DNA, 14 bp, Homo sapiens
gacctgaactctgc

SEQ ID NO: 1965000 - DNA, 19 bp, Homo sapiens
gagaacatggtgtgtgtct

SEQ ID NO: 1965001 - DNA, 19 bp, Homo sapiens
gagatatttaaaagacaaa

SEQ ID NO: 1965002 - DNA, 22 bp, Homo sapiens
gagatatttaaaagacaaacac

SEQ ID NO: 1965003 - DNA, 20 bp, Homo sapiens
gagctttccgcgtcagcaag

SEQ ID NO: 1965004 - DNA, 22 bp, Homo sapiens
gaggagaaaagtgacagatcct

SEQ ID NO: 1965005 - DNA, 16 bp, Homo sapiens
gagggatcattttctg

SEQ ID NO: 1965006 - DNA, 20 bp, Homo sapiens
gagtctggcaaacatgtgca

SEQ ID NO: 1965007 - DNA, 11 bp, Homo sapiens
gagtggcatgt

SEQ ID NO: 1965008 - DNA, 19 bp, Homo sapiens
gagttgcaccattctttct

SEQ ID NO: 1965009 - DNA, 16 bp, Homo sapiens
gataacggctctccag

SEQ ID NO: 1965010 - DNA, 17 bp, Homo sapiens
gataacggctctccaga

SEQ ID NO: 1965011 - DNA, 19 bp, Homo sapiens
gatccatccgtccagccaa

SEQ ID NO: 1965012 - DNA, 14 bp, Homo sapiens
gatcctacccctga

SEQ ID NO: 1965013 - DNA, 17 bp, Homo sapiens
gatgaaaccgtccctga

SEQ ID NO: 1965014 - DNA, 20 bp, Homo sapiens
gatggtgacttttgaagaac

SEQ ID NO: 1965015 - DNA, 18 bp, Homo sapiens
gattctgttctacttgat

SEQ ID NO: 1965016 - DNA, 14 bp, Homo sapiens
gattgaatgctgcc

SEQ ID NO: 1965017 - DNA, 12 bp, Homo sapiens
gcaaactttaac

SEQ ID NO: 1965018 - DNA, 13 bp, Homo sapiens
gcaattaactctg

SEQ ID NO: 1965019 - DNA, 14 bp, Homo sapiens
gcaattaactctgg

SEQ ID NO: 1965020 - DNA, 18 bp, Homo sapiens
gcatatctctagtccctg

SEQ ID NO: 1965021 - DNA, 20 bp, Homo sapiens
gcatcaaacatgaaaacatt

SEQ ID NO: 1965022 - DNA, 17 bp, Homo sapiens
gcatgtaaaatcttcag

SEQ ID NO: 1965023 - DNA, 21 bp, Homo sapiens
gcatgtaaaatcttcagctgg

SEQ ID NO: 1965024 - DNA, 16 bp, Homo sapiens
gcatgtgggttgtgat

SEQ ID NO: 1965025 - DNA, 12 bp, Homo sapiens
gcattcatgttt

SEQ ID NO: 1965026 - DNA, 15 bp, Homo sapiens
gcattcatgttttaa

SEQ ID NO: 1965027 - DNA, 23 bp, Homo sapiens
gcattcatgttttaaaagtttgt

SEQ ID NO: 1965028 - DNA, 15 bp, Homo sapiens
gcattttcagcatca

SEQ ID NO: 1965029 - DNA, 12 bp, Homo sapiens
gcattttgaatg

SEQ ID NO: 1965030 - DNA, 23 bp, Homo sapiens
gccaatctcttctaaaaaaaaac

SEQ ID NO: 1965031 - DNA, 22 bp, Homo sapiens
gccaattttgtcacagctcttg

SEQ ID NO: 1965032 - DNA, 17 bp, Homo sapiens
gcccctcctaacccagc

SEQ ID NO: 1965033 - DNA, 13 bp, Homo sapiens
gccttatgagaac

SEQ ID NO: 1965034 - DNA, 16 bp, Homo sapiens
gccttatgagaacatg

SEQ ID NO: 1965035 - DNA, 18 bp, Homo sapiens
gccttatgagaacatggt

SEQ ID NO: 1965036 - DNA, 20 bp, Homo sapiens
gctattagaagggctgaata

SEQ ID NO: 1965037 - DNA, 17 bp, Homo sapiens
gctctacacaacatgta

SEQ ID NO: 1965038 - DNA, 14 bp, Homo sapiens
gctctccagacctg

SEQ ID NO: 1965039 - DNA, 16 bp, Homo sapiens
gctctccagacctgag

SEQ ID NO: 1965040 - DNA, 17 bp, Homo sapiens
gctctccagacctgagc

SEQ ID NO: 1965041 - DNA, 15 bp, Homo sapiens
gctgaataaagggaa

SEQ ID NO: 1965042 - DNA, 22 bp, Homo sapiens
gctgtggaaaggattctaaaca

SEQ ID NO: 1965043 - DNA, 18 bp, Homo sapiens
gcttcatgaaaatcctac

SEQ ID NO: 1965044 - DNA, 15 bp, Homo sapiens
ggaaaatgccaatct

SEQ ID NO: 1965045 - DNA, 17 bp, Homo sapiens
ggaaaatgccaatctct

SEQ ID NO: 1965046 - DNA, 16 bp, Homo sapiens
ggaacaatcacaaaag

SEQ ID NO: 1965047 - DNA, 19 bp, Homo sapiens
ggaatcgtttttgctgcag

SEQ ID NO: 1965048 - DNA, 20 bp, Homo sapiens
ggaatcgtttttgctgcaga

SEQ ID NO: 1965049 - DNA, 18 bp, Homo sapiens
ggacctttaaagagcccc

SEQ ID NO: 1965050 - DNA, 17 bp, Homo sapiens
ggagaattaaactccta

SEQ ID NO: 1965051 - DNA, 16 bp, Homo sapiens
ggattccaaagcattt

SEQ ID NO: 1965052 - DNA, 23 bp, Homo sapiens
ggcaaaagtctgaggcacctgca

SEQ ID NO: 1965053 - DNA, 14 bp, Homo sapiens
ggcaaacatgtgca

SEQ ID NO: 1965054 - DNA, 20 bp, Homo sapiens
ggcattttgaatgtgatcat

SEQ ID NO: 1965055 - DNA, 14 bp, Homo sapiens
ggccttaataaata

SEQ ID NO: 1965056 - DNA, 17 bp, Homo sapiens
ggctttggcaacagaaa

SEQ ID NO: 1965057 - DNA, 24 bp, Homo sapiens
ggctttgttcttgtcatcagtaag

SEQ ID NO: 1965058 - DNA, 15 bp, Homo sapiens
ggtactaaggagaat

SEQ ID NO: 1965059 - DNA, 23 bp, Homo sapiens
ggtatctgcatgtaaaatcttca

SEQ ID NO: 1965060 - DNA, 11 bp, Homo sapiens
ggtatgtacag

SEQ ID NO: 1965061 - DNA, 20 bp, Homo sapiens
ggtcattcctaatgcattag

SEQ ID NO: 1965062 - DNA, 16 bp, Homo sapiens
ggtgcatgcaggtctc

SEQ ID NO: 1965063 - DNA, 15 bp, Homo sapiens
ggtgtgtgtctctga

SEQ ID NO: 1965064 - DNA, 14 bp, Homo sapiens
ggttatgatggaaa

SEQ ID NO: 1965065 - DNA, 12 bp, Homo sapiens
ggttgtgatatt

SEQ ID NO: 1965066 - DNA, 22 bp, Homo sapiens
ggtttgttattcttttccagaa

SEQ ID NO: 1965067 - DNA, 16 bp, Homo sapiens
gtaagtataacaaact

SEQ ID NO: 1965068 - DNA, 22 bp, Homo sapiens
gtacagtctcaattttgtattt

SEQ ID NO: 1965069 - DNA, 15 bp, Homo sapiens
gtacagttcataaat

SEQ ID NO: 1965070 - DNA, 17 bp, Homo sapiens
gtacagttcataaattt

SEQ ID NO: 1965071 - DNA, 17 bp, Homo sapiens
gtatctggtatctgcat

SEQ ID NO: 1965072 - DNA, 15 bp, Homo sapiens
gtattagccagtcat

SEQ ID NO: 1965073 - DNA, 23 bp, Homo sapiens
gtatttaatgatttttgtgtatc

SEQ ID NO: 1965074 - DNA, 15 bp, Homo sapiens
gtcacagctcttgtt

SEQ ID NO: 1965075 - DNA, 16 bp, Homo sapiens
gtcacagctcttgttt

SEQ ID NO: 1965076 - DNA, 19 bp, Homo sapiens
gtcattatttgataacatt

SEQ ID NO: 1965077 - DNA, 21 bp, Homo sapiens
gtcattatttgataacatttt

SEQ ID NO: 1965078 - DNA, 15 bp, Homo sapiens
gtcatttctcttttt

SEQ ID NO: 1965079 - DNA, 23 bp, Homo sapiens
gtccctgaagtcttgcattgaat

SEQ ID NO: 1965080 - DNA, 15 bp, Homo sapiens
gtctctgaacatcct

SEQ ID NO: 1965081 - DNA, 18 bp, Homo sapiens
gtcttgacctgaactctg

SEQ ID NO: 1965082 - DNA, 22 bp, Homo sapiens
gtgattatggacatcgatatga

SEQ ID NO: 1965083 - DNA, 14 bp, Homo sapiens
gtgcaactcttgta

SEQ ID NO: 1965084 - DNA, 15 bp, Homo sapiens
gtgcaactcttgtat

SEQ ID NO: 1965085 - DNA, 18 bp, Homo sapiens
gtgcaactcttgtattgc

SEQ ID NO: 1965086 - DNA, 15 bp, Homo sapiens
gtgcatgcaggtctc

SEQ ID NO: 1965087 - DNA, 16 bp, Homo sapiens
gtggatggtgactttt

SEQ ID NO: 1965088 - DNA, 22 bp, Homo sapiens
gtggatggtgacttttgaagaa

SEQ ID NO: 1965089 - DNA, 18 bp, Homo sapiens
gtgtcaactttcatttga

SEQ ID NO: 1965090 - DNA, 23 bp, Homo sapiens
gttaacagcgtgtcaactttcat

SEQ ID NO: 1965091 - DNA, 19 bp, Homo sapiens
gttaagatactcaagcagg

SEQ ID NO: 1965092 - DNA, 12 bp, Homo sapiens
gttcttgtcatc

SEQ ID NO: 1965093 - DNA, 21 bp, Homo sapiens
gttgcataaacaatccaaatg

SEQ ID NO: 1965094 - DNA, 18 bp, Homo sapiens
gttggtgcaattaactct

SEQ ID NO: 1965095 - DNA, 15 bp, Homo sapiens
gtttacaacaaacac

SEQ ID NO: 1965096 - DNA, 21 bp, Homo sapiens
gtttacaacaaacactgtgat

SEQ ID NO: 1965097 - DNA, 14 bp, Homo sapiens
gtttcaatttactt

SEQ ID NO: 1965098 - DNA, 22 bp, Homo sapiens
gtttcaatttactttttaaaca

SEQ ID NO: 1965099 - DNA, 11 bp, Homo sapiens
gtttcttgctt

SEQ ID NO: 1965100 - DNA, 21 bp, Homo sapiens
gtttgggggttaccaaaaata

SEQ ID NO: 1965101 - DNA, 17 bp, Homo sapiens
gtttttgctgcagagaa

SEQ ID NO: 1965102 - DNA, 15 bp, Homo sapiens
caatgtacaaggtat

SEQ ID NO: 1965103 - DNA, 19 bp, Homo sapiens
caattgttctgggtgattt

SEQ ID NO: 1965104 - DNA, 18 bp, Homo sapiens
caatttactttttaaaca

SEQ ID NO: 1965105 - DNA, 19 bp, Homo sapiens
caatttactttttaaacag

SEQ ID NO: 1965106 - DNA, 16 bp, Homo sapiens
caattttgtatttaat

SEQ ID NO: 1965107 - DNA, 18 bp, Homo sapiens
cacaaaagctgtgtctct

SEQ ID NO: 1965108 - DNA, 20 bp, Homo sapiens
cacaaaagctgtgtctctgt

SEQ ID NO: 1965109 - DNA, 21 bp, Homo sapiens
cacaatgttgcactgaaaacc

SEQ ID NO: 1965110 - DNA, 19 bp, Homo sapiens
cacacttgggagcagtcct

SEQ ID NO: 1965111 - DNA, 23 bp, Homo sapiens
cacatattaagaatagtctctgg

SEQ ID NO: 1965112 - DNA, 20 bp, Homo sapiens
cacattttgacacaatgttg

SEQ ID NO: 1965113 - DNA, 15 bp, Homo sapiens
cacgtcagtgccatc

SEQ ID NO: 1965114 - DNA, 14 bp, Homo sapiens
cactggatccatcc

SEQ ID NO: 1965115 - DNA, 18 bp, Homo sapiens
cagaaaacaattgttctg

SEQ ID NO: 1965116 - DNA, 16 bp, Homo sapiens
cagaaagaaaatgaat

SEQ ID NO: 1965117 - DNA, 16 bp, Homo sapiens
cagacctgagctttcc

SEQ ID NO: 1965118 - DNA, 14 bp, Homo sapiens
cagaggaggagaaa

SEQ ID NO: 1965119 - DNA, 13 bp, Homo sapiens
cagcatcaaacat

SEQ ID NO: 1965120 - DNA, 19 bp, Homo sapiens
cagcatcaaacatgaaaac

SEQ ID NO: 1965121 - DNA, 14 bp, Homo sapiens
cagccaagagctct

SEQ ID NO: 1965122 - DNA, 11 bp, Homo sapiens
cagctcttgtt

SEQ ID NO: 1965123 - DNA, 19 bp, Homo sapiens
cagctggtggatggtgact

SEQ ID NO: 1965124 - DNA, 22 bp, Homo sapiens
cagctggtggatggtgactttt

SEQ ID NO: 1965125 - DNA, 16 bp, Homo sapiens
caggccacaaatgtgt

SEQ ID NO: 1965126 - DNA, 20 bp, Homo sapiens
caggtctccatgaagaagct

SEQ ID NO: 1965127 - DNA, 23 bp, Homo sapiens
cagtaagtataacaaactatgta

SEQ ID NO: 1965128 - DNA, 21 bp, Homo sapiens
cagtcattatttaaagcacat

SEQ ID NO: 1965129 - DNA, 20 bp, Homo sapiens
cagtctcaattttgtattta

SEQ ID NO: 1965130 - DNA, 13 bp, Homo sapiens
cagttcataaatt

SEQ ID NO: 1965131 - DNA, 18 bp, Homo sapiens
cagttcataaatttgttg

SEQ ID NO: 1965132 - DNA, 22 bp, Homo sapiens
cataacatagttgaaaaaagaa

SEQ ID NO: 1965133 - DNA, 22 bp, Homo sapiens
catagagatatttaaaagacaa

SEQ ID NO: 1965134 - DNA, 20 bp, Homo sapiens
catatctctagtccctgtgt

SEQ ID NO: 1965135 - DNA, 21 bp, Homo sapiens
catcaaataaaccttgtttct

SEQ ID NO: 1965136 - DNA, 13 bp, Homo sapiens
catcagaactgaa

SEQ ID NO: 1965137 - DNA, 18 bp, Homo sapiens
catcattggataaatttg

SEQ ID NO: 1965138 - DNA, 16 bp, Homo sapiens
catcccggtgcatgca

SEQ ID NO: 1965139 - DNA, 14 bp, Homo sapiens
catccgtccagcca

SEQ ID NO: 1965140 - DNA, 20 bp, Homo sapiens
catctatagataacggctct

SEQ ID NO: 1965141 - DNA, 23 bp, Homo sapiens
catctatagataacggctctcca

SEQ ID NO: 1965142 - DNA, 20 bp, Homo sapiens
catctccagtatcctgctgg

SEQ ID NO: 1965143 - DNA, 12 bp, Homo sapiens
catctttgctga

SEQ ID NO: 1965144 - DNA, 14 bp, Homo sapiens
catgaaaacattga

SEQ ID NO: 1965145 - DNA, 22 bp, Homo sapiens
catgactgagtctggcaaacat

SEQ ID NO: 1965146 - DNA, 23 bp, Homo sapiens
catgactgagtctggcaaacatg

SEQ ID NO: 1965147 - DNA, 21 bp, Homo sapiens
catgagtggccttaataaata

SEQ ID NO: 1965148 - DNA, 19 bp, Homo sapiens
catggattccaaagcattt

SEQ ID NO: 1965149 - DNA, 18 bp, Homo sapiens
catgtaaaatcttcagct

SEQ ID NO: 1965150 - DNA, 19 bp, Homo sapiens
catgtattagccagtcatt

SEQ ID NO: 1965151 - DNA, 17 bp, Homo sapiens
catgtgattatggacat

SEQ ID NO: 1965152 - DNA, 16 bp, Homo sapiens
catgtgcaactcttgt

SEQ ID NO: 1965153 - DNA, 21 bp, Homo sapiens
catgtgggttgtgatattgac

SEQ ID NO: 1965154 - DNA, 21 bp, Homo sapiens
cattattattactttttaaaa

SEQ ID NO: 1965155 - DNA, 13 bp, Homo sapiens
cattatttgataa

SEQ ID NO: 1965156 - DNA, 13 bp, Homo sapiens
cattcacatttca

SEQ ID NO: 1965157 - DNA, 14 bp, Homo sapiens
cattcataatttta

SEQ ID NO: 1965158 - DNA, 17 bp, Homo sapiens
cattggttaaaatatta

SEQ ID NO: 1965159 - DNA, 17 bp, Homo sapiens
catttcaagatccaaat

SEQ ID NO: 1965160 - DNA, 23 bp, Homo sapiens
catttgaaagtgggtttcaattt

SEQ ID NO: 1965161 - DNA, 14 bp, Homo sapiens
catttgatttcgat

SEQ ID NO: 1965162 - DNA, 12 bp, Homo sapiens
cattttcttgtc

SEQ ID NO: 1965163 - DNA, 18 bp, Homo sapiens
cattttcttgtcaatgga

SEQ ID NO: 1965164 - DNA, 22 bp, Homo sapiens
cattttcttgtcaatggaagaa

SEQ ID NO: 1965165 - DNA, 18 bp, Homo sapiens
cattttgaatgtgatcat

SEQ ID NO: 1965166 - DNA, 15 bp, Homo sapiens
catttttaaaggaca

SEQ ID NO: 1965167 - DNA, 21 bp, Homo sapiens
catttttaaaggacaaacagt

SEQ ID NO: 1965168 - DNA, 21 bp, Homo sapiens
ccatagagatatttaaaagac

SEQ ID NO: 1965169 - DNA, 14 bp, Homo sapiens
ccctgagccctcca

SEQ ID NO: 1965170 - DNA, 21 bp, Homo sapiens
ccctgagttgcaccattcttt

SEQ ID NO: 1965171 - DNA, 22 bp, Homo sapiens
cccttaaaaattaaattctctc

SEQ ID NO: 1965172 - DNA, 10 bp, Homo sapiens
ccgtccctga

SEQ ID NO: 1965173 - DNA, 13 bp, Homo sapiens
cctaccaacctct

SEQ ID NO: 1965174 - DNA, 14 bp, Homo sapiens
cctaccaacctctg

SEQ ID NO: 1965175 - DNA, 15 bp, Homo sapiens
cctaccaacctctga

SEQ ID NO: 1965176 - DNA, 15 bp, Homo sapiens
cctccatttttgttg

SEQ ID NO: 1965177 - DNA, 20 bp, Homo sapiens
cctcgtttgatagtgcttct

SEQ ID NO: 1965178 - DNA, 16 bp, Homo sapiens
cctctgggccaggttg

SEQ ID NO: 1965179 - DNA, 23 bp, Homo sapiens
cctgagttgcaccattctttctt

SEQ ID NO: 1965180 - DNA, 22 bp, Homo sapiens
cctgcatatctctagtccctgt

SEQ ID NO: 1965181 - DNA, 19 bp, Homo sapiens
cctgcatttttaaaggaca

SEQ ID NO: 1965182 - DNA, 18 bp, Homo sapiens
ccttaaatttctgccctg

SEQ ID NO: 1965183 - DNA, 23 bp, Homo sapiens
ccttaaatttctgccctgagccc

SEQ ID NO: 1965184 - DNA, 23 bp, Homo sapiens
ccttaataaatatagttgtcttt

SEQ ID NO: 1965185 - DNA, 23 bp, Homo sapiens
ccttatttgtcggggaagatgaa

SEQ ID NO: 1965186 - DNA, 13 bp, Homo sapiens
ccttcagatccta

SEQ ID NO: 1965187 - DNA, 20 bp, Homo sapiens
ccttcagatcctacccctga

SEQ ID NO: 1965188 - DNA, 12 bp, Homo sapiens
cgggcattttga

SEQ ID NO: 1965189 - DNA, 21 bp, Homo sapiens
cgtttgatagtgcttcttgta

SEQ ID NO: 1965190 - DNA, 21 bp, Homo sapiens
ctaatcataacatagttgaaa

SEQ ID NO: 1965191 - DNA, 16 bp, Homo sapiens
ctaatgagaagtcaac

SEQ ID NO: 1965192 - DNA, 18 bp, Homo sapiens
ctacacaacatgtatgtg

SEQ ID NO: 1965193 - DNA, 18 bp, Homo sapiens
ctacccagtcatgtactg

SEQ ID NO: 1965194 - DNA, 19 bp, Homo sapiens
ctacttgatatttccttca

SEQ ID NO: 1965195 - DNA, 23 bp, Homo sapiens
ctacttgatatttccttcaccac

SEQ ID NO: 1965196 - DNA, 20 bp, Homo sapiens
ctagaatggtttttgttgag

SEQ ID NO: 1965197 - DNA, 13 bp, Homo sapiens
ctagctatttcta

SEQ ID NO: 1965198 - DNA, 16 bp, Homo sapiens
ctagtagaacaatgta

SEQ ID NO: 1965199 - DNA, 23 bp, Homo sapiens
ctatagataacggctctccagac

SEQ ID NO: 1965200 - DNA, 16 bp, Homo sapiens
ctatttcctttgcgca

SEQ ID NO: 1965201 - DNA, 21 bp, Homo sapiens
ctatttctatgtatgtgccaa

SEQ ID NO: 1965202 - DNA, 15 bp, Homo sapiens
ctcaagcaggtttct

SEQ ID NO: 1965203 - DNA, 19 bp, Homo sapiens
ctcaattttgtatttaatg

SEQ ID NO: 1965204 - DNA, 22 bp, Homo sapiens
ctcagtgccccttaaatttctg

SEQ ID NO: 1965205 - DNA, 20 bp, Homo sapiens
ctcatggatttggttatgat

SEQ ID NO: 1965206 - DNA, 15 bp, Homo sapiens
ctcatgtcatttctc

SEQ ID NO: 1965207 - DNA, 15 bp, Homo sapiens
ctccagacctgagct

SEQ ID NO: 1965208 - DNA, 16 bp, Homo sapiens
ctcctaacccagcagt

SEQ ID NO: 1965209 - DNA, 20 bp, Homo sapiens
ctcctactgcttcctctgaa

SEQ ID NO: 1965210 - DNA, 16 bp, Homo sapiens
ctctacacaacatgta

SEQ ID NO: 1965211 - DNA, 13 bp, Homo sapiens
ctctagtccctgt

SEQ ID NO: 1965212 - DNA, 17 bp, Homo sapiens
ctctccagacctgagct

SEQ ID NO: 1965213 - DNA, 14 bp, Homo sapiens
ctctgatgtttggg

SEQ ID NO: 1965214 - DNA, 13 bp, Homo sapiens
ctctgcaactgaa

SEQ ID NO: 1965215 - DNA, 18 bp, Homo sapiens
ctctggacctctcttgtg

SEQ ID NO: 1965216 - DNA, 21 bp, Homo sapiens
ctctttttttttttttttaaa

SEQ ID NO: 1965217 - DNA, 18 bp, Homo sapiens
ctgaacatcctaaatatt

SEQ ID NO: 1965218 - DNA, 16 bp, Homo sapiens
ctgaagtcttgcattg

SEQ ID NO: 1965219 - DNA, 20 bp, Homo sapiens
tgaaaacattgatgaatgag

SEQ ID NO: 1965220 - DNA, 18 bp, Homo sapiens
tgaagaaccgcattttga

SEQ ID NO: 1965221 - DNA, 18 bp, Homo sapiens
tgaagtcttgcattgaat

SEQ ID NO: 1965222 - DNA, 20 bp, Homo sapiens
tgaataaagggaacatgcag

SEQ ID NO: 1965223 - DNA, 21 bp, Homo sapiens
tgaataaagggaacatgcagc

SEQ ID NO: 1965224 - DNA, 14 bp, Homo sapiens
tgaatgtcattatt

SEQ ID NO: 1965225 - DNA, 18 bp, Homo sapiens
tgaatgtcattatttgat

SEQ ID NO: 1965226 - DNA, 23 bp, Homo sapiens
tgaatgtgatcatctttgctgaa

SEQ ID NO: 1965227 - DNA, 22 bp, Homo sapiens
tgacaatgcgtggcacatctaa

SEQ ID NO: 1965228 - DNA, 12 bp, Homo sapiens
tgaccatgtgat

SEQ ID NO: 1965229 - DNA, 14 bp, Homo sapiens
tgacctgaactctg

SEQ ID NO: 1965230 - DNA, 15 bp, Homo sapiens
tgacctgaactctgc

SEQ ID NO: 1965231 - DNA, 20 bp, Homo sapiens
tgactgagtctggcaaacat

SEQ ID NO: 1965232 - DNA, 13 bp, Homo sapiens
tgacttttgaaga

SEQ ID NO: 1965233 - DNA, 19 bp, Homo sapiens
tgagaagtactttgtgctg

SEQ ID NO: 1965234 - DNA, 21 bp, Homo sapiens
tgagaagtactttgtgctgat

SEQ ID NO: 1965235 - DNA, 13 bp, Homo sapiens
tgagcgtgattct

SEQ ID NO: 1965236 - DNA, 18 bp, Homo sapiens
tgaggtcttttacataca

SEQ ID NO: 1965237 - DNA, 14 bp, Homo sapiens
tgagtctggcaaac

SEQ ID NO: 1965238 - DNA, 18 bp, Homo sapiens
tgagtctggcaaacatgt

SEQ ID NO: 1965239 - DNA, 22 bp, Homo sapiens
tgagtggcatgtgggttgtgat

SEQ ID NO: 1965240 - DNA, 12 bp, Homo sapiens
tgatagtgcttc

SEQ ID NO: 1965241 - DNA, 17 bp, Homo sapiens
tgatcttacctttatga

SEQ ID NO: 1965242 - DNA, 20 bp, Homo sapiens
tgatgaatgaggaacaatca

SEQ ID NO: 1965243 - DNA, 13 bp, Homo sapiens
tgattctgttcta

SEQ ID NO: 1965244 - DNA, 14 bp, Homo sapiens
tgatttttgtgtat

SEQ ID NO: 1965245 - DNA, 21 bp, Homo sapiens
tgcaacatggattccaaagca

SEQ ID NO: 1965246 - DNA, 22 bp, Homo sapiens
tgcaacatggattccaaagcat

SEQ ID NO: 1965247 - DNA, 23 bp, Homo sapiens
tgcaacatggattccaaagcatt

SEQ ID NO: 1965248 - DNA, 13 bp, Homo sapiens
tgcaactcttgta

SEQ ID NO: 1965249 - DNA, 14 bp, Homo sapiens
tgcaagcttattta

SEQ ID NO: 1965250 - DNA, 19 bp, Homo sapiens
tgcaagtgggagatgaaaa

SEQ ID NO: 1965251 - DNA, 15 bp, Homo sapiens
tgcatgcaggtctcc

SEQ ID NO: 1965252 - DNA, 17 bp, Homo sapiens
tgcatggagtgtttgac

SEQ ID NO: 1965253 - DNA, 21 bp, Homo sapiens
tgcatgtaaaatcttcagctg

SEQ ID NO: 1965254 - DNA, 23 bp, Homo sapiens
tgcatgtaaaatcttcagctggt

SEQ ID NO: 1965255 - DNA, 23 bp, Homo sapiens
tgcattcgcggttaagatactca

SEQ ID NO: 1965256 - DNA, 22 bp, Homo sapiens
tgcattgaatttagtcattatt

SEQ ID NO: 1965257 - DNA, 17 bp, Homo sapiens
tgcatttttaaaggaca

SEQ ID NO: 1965258 - DNA, 19 bp, Homo sapiens
tgccaagaaatcgccttat

SEQ ID NO: 1965259 - DNA, 21 bp, Homo sapiens
tgccagggaaaaagaccaaat

SEQ ID NO: 1965260 - DNA, 22 bp, Homo sapiens
tgcgtggcacatctaaattgat

SEQ ID NO: 1965261 - DNA, 14 bp, Homo sapiens
tgctccattttctt

SEQ ID NO: 1965262 - DNA, 17 bp, Homo sapiens
tgctccattttcttgtc

SEQ ID NO: 1965263 - DNA, 14 bp, Homo sapiens
tgctgctgtggaaa

SEQ ID NO: 1965264 - DNA, 17 bp, Homo sapiens
tgctgtgcaaacagtgt

SEQ ID NO: 1965265 - DNA, 22 bp, Homo sapiens
tgctgtgcaaacagtgtaagct

SEQ ID NO: 1965266 - DNA, 21 bp, Homo sapiens
tgcttcatgaaaatcctacca

SEQ ID NO: 1965267 - DNA, 18 bp, Homo sapiens
tgcttcctctgaatatta

SEQ ID NO: 1965268 - DNA, 15 bp, Homo sapiens
tgcttcttgtaatat

SEQ ID NO: 1965269 - DNA, 19 bp, Homo sapiens
tggaaactaccagtgggca

SEQ ID NO: 1965270 - DNA, 20 bp, Homo sapiens
tggaaaggaagaatgcagag

SEQ ID NO: 1965271 - DNA, 22 bp, Homo sapiens
tggagcggctcatcagaactga

SEQ ID NO: 1965272 - DNA, 15 bp, Homo sapiens
tggataaatttgaac

SEQ ID NO: 1965273 - DNA, 21 bp, Homo sapiens
tggataaatttgaactccatg

SEQ ID NO: 1965274 - DNA, 14 bp, Homo sapiens
tggatggtgacttt

SEQ ID NO: 1965275 - DNA, 14 bp, Homo sapiens
tggcaaacatgtgc

SEQ ID NO: 1965276 - DNA, 14 bp, Homo sapiens
tggcagtgtttgta

SEQ ID NO: 1965277 - DNA, 15 bp, Homo sapiens
tgggagatgaaaacc

SEQ ID NO: 1965278 - DNA, 19 bp, Homo sapiens
tgggattttatctgtggat

SEQ ID NO: 1965279 - DNA, 12 bp, Homo sapiens
tgggctaacatt

SEQ ID NO: 1965280 - DNA, 21 bp, Homo sapiens
tgggctaacatttaggagaag

SEQ ID NO: 1965281 - DNA, 20 bp, Homo sapiens
tgggtgatttctagaatggt

SEQ ID NO: 1965282 - DNA, 17 bp, Homo sapiens
tggtgttggcagtgttt

SEQ ID NO: 1965283 - DNA, 18 bp, Homo sapiens
tggtgttggcagtgtttg

SEQ ID NO: 1965284 - DNA, 13 bp, Homo sapiens
tggtttgttattc

SEQ ID NO: 1965285 - DNA, 14 bp, Homo sapiens
tggtttttgttgag

SEQ ID NO: 1965286 - DNA, 21 bp, Homo sapiens
tgtaaatgaagggtcatttct

SEQ ID NO: 1965287 - DNA, 18 bp, Homo sapiens
tgtaacctcgtgtctagt

SEQ ID NO: 1965288 - DNA, 21 bp, Homo sapiens
tgtaagcttagattttctgta

SEQ ID NO: 1965289 - DNA, 20 bp, Homo sapiens
tgtaatattctctgatgttt

SEQ ID NO: 1965290 - DNA, 13 bp, Homo sapiens
tgtacaaggtatg

SEQ ID NO: 1965291 - DNA, 17 bp, Homo sapiens
tgtataccatgatgcat

SEQ ID NO: 1965292 - DNA, 14 bp, Homo sapiens
tgtattagccagtc

SEQ ID NO: 1965293 - DNA, 22 bp, Homo sapiens
tgtattgctccattttcttgtc

SEQ ID NO: 1965294 - DNA, 17 bp, Homo sapiens
tgtcaactttcatttga

SEQ ID NO: 1965295 - DNA, 13 bp, Homo sapiens
tgtcacagctctt

SEQ ID NO: 1965296 - DNA, 16 bp, Homo sapiens
tgtcatcagtaagtat

SEQ ID NO: 1965297 - DNA, 18 bp, Homo sapiens
tgtcatgtgtatgagaag

SEQ ID NO: 1965298 - DNA, 20 bp, Homo sapiens
tgtcatgtgtatgagaagta

SEQ ID NO: 1965299 - DNA, 21 bp, Homo sapiens
tgtcattatttgataacattt

SEQ ID NO: 1965300 - DNA, 13 bp, Homo sapiens
tgtcatttctcat

SEQ ID NO: 1965301 - DNA, 20 bp, Homo sapiens
tgtccctgaagtcttgcatt

SEQ ID NO: 1965302 - DNA, 14 bp, Homo sapiens
tgtctttctttgct

SEQ ID NO: 1965303 - DNA, 20 bp, Homo sapiens
tgtgatgttgggaagctatt

SEQ ID NO: 1965304 - DNA, 18 bp, Homo sapiens
tgtgcaaacagtgtaagc

SEQ ID NO: 1965305 - DNA, 15 bp, Homo sapiens
tgtgcaactcttgta

SEQ ID NO: 1965306 - DNA, 16 bp, Homo sapiens
tgtgcaactcttgtat

SEQ ID NO: 1965307 - DNA, 23 bp, Homo sapiens
tgtgcaactcttgtattgctcca

SEQ ID NO: 1965308 - DNA, 13 bp, Homo sapiens
tgtggaaaggatt

SEQ ID NO: 1965309 - DNA, 18 bp, Homo sapiens
tgtgggttgtgatattga

SEQ ID NO: 1965310 - DNA, 21 bp, Homo sapiens
tgttacttaaacatcattgga

SEQ ID NO: 1965311 - DNA, 17 bp, Homo sapiens
tgttgagtctctgaaca

SEQ ID NO: 1965312 - DNA, 14 bp, Homo sapiens
tgttgcataaacaa

SEQ ID NO: 1965313 - DNA, 19 bp, Homo sapiens
tgttgggaagctatttcct

SEQ ID NO: 1965314 - DNA, 22 bp, Homo sapiens
tgttgggatgcgggcattttga

SEQ ID NO: 1965315 - DNA, 15 bp, Homo sapiens
tgttgtcatgtgtat

SEQ ID NO: 1965316 - DNA, 16 bp, Homo sapiens
tgttgtcatgtgtatg

SEQ ID NO: 1965317 - DNA, 13 bp, Homo sapiens
tgtttctttctga

SEQ ID NO: 1965318 - DNA, 17 bp, Homo sapiens
tgtttctttctgaagtg

SEQ ID NO: 1965319 - DNA, 22 bp, Homo sapiens
tgtttgaagaaccgcattttga

SEQ ID NO: 1965320 - DNA, 14 bp, Homo sapiens
ttaaaagacaaaca

SEQ ID NO: 1965321 - DNA, 19 bp, Homo sapiens
ttaagaatagtctctgggt

SEQ ID NO: 1965322 - DNA, 12 bp, Homo sapiens
ttaagcatgagt

SEQ ID NO: 1965323 - DNA, 18 bp, Homo sapiens
ttaagcatgagtggcctt

SEQ ID NO: 1965324 - DNA, 15 bp, Homo sapiens
ttaatctgttgtttg

SEQ ID NO: 1965325 - DNA, 13 bp, Homo sapiens
ttacaacaaacac

SEQ ID NO: 1965326 - DNA, 16 bp, Homo sapiens
ttacaacaaacactgt

SEQ ID NO: 1965327 - DNA, 14 bp, Homo sapiens
ttacatacagtgat

SEQ ID NO: 1965328 - DNA, 15 bp, Homo sapiens
ttacatacagtgata

SEQ ID NO: 1965329 - DNA, 14 bp, Homo sapiens
ttactttgtgcaaa

SEQ ID NO: 1965330 - DNA, 15 bp, Homo sapiens
ttagattttctgtaa

SEQ ID NO: 1965331 - DNA, 16 bp, Homo sapiens
ttataccccatttgat

SEQ ID NO: 1965332 - DNA, 12 bp, Homo sapiens
ttatattcatca

SEQ ID NO: 1965333 - DNA, 22 bp, Homo sapiens
ttatcccacggaaaatgccaat

SEQ ID NO: 1965334 - DNA, 14 bp, Homo sapiens
ttatctacccagtc

SEQ ID NO: 1965335 - DNA, 19 bp, Homo sapiens
ttatggacatcgatatgaa

SEQ ID NO: 1965336 - DNA, 12 bp, Homo sapiens
ttattcttttcc

SEQ ID NO: 1965337 - DNA, 15 bp, Homo sapiens
aaaaaagaagtttgg

SEQ ID NO: 1965338 - DNA, 14 bp, Homo sapiens
aaaaagaagtttgg

SEQ ID NO: 1965339 - DNA, 13 bp, Homo sapiens
aaaagaaatcaat

SEQ ID NO: 1965340 - DNA, 16 bp, Homo sapiens
aaaatagggtccttga

SEQ ID NO: 1965341 - DNA, 18 bp, Homo sapiens
aaaatcctaccaacctct

SEQ ID NO: 1965342 - DNA, 22 bp, Homo sapiens
ctatttcctttgcgcaaacttt

SEQ ID NO: 1965343 - DNA, 15 bp, Homo sapiens
ctatttctttaatct

SEQ ID NO: 1965344 - DNA, 13 bp, Homo sapiens
ctcaattttgtat

SEQ ID NO: 1965345 - DNA, 15 bp, Homo sapiens
ctcaattttgtattt

SEQ ID NO: 1965346 - DNA, 19 bp, Homo sapiens
ctccatgaagaagctggga

SEQ ID NO: 1965347 - DNA, 19 bp, Homo sapiens
ctcctacaaccaggtcttg

SEQ ID NO: 1965348 - DNA, 14 bp, Homo sapiens
ctcctctatttctt

SEQ ID NO: 1965349 - DNA, 18 bp, Homo sapiens
ctcgcatctatagataac

SEQ ID NO: 1965350 - DNA, 17 bp, Homo sapiens
ctcgtttgatagtgctt

SEQ ID NO: 1965351 - DNA, 11 bp, Homo sapiens
ctctatttctt

SEQ ID NO: 1965352 - DNA, 21 bp, Homo sapiens
ctctcttgtgagccatagaga

SEQ ID NO: 1965353 - DNA, 14 bp, Homo sapiens
ctctgcaactgaat

SEQ ID NO: 1965354 - DNA, 23 bp, Homo sapiens
ctctgggtttacaacaaacactg

SEQ ID NO: 1965355 - DNA, 23 bp, Homo sapiens
ctctgtatatagctctacacaac

SEQ ID NO: 1965356 - DNA, 22 bp, Homo sapiens
ctcttgtttggagggatcattt

SEQ ID NO: 1965357 - DNA, 16 bp, Homo sapiens
ctgaatacttgaagta

SEQ ID NO: 1965358 - DNA, 20 bp, Homo sapiens
ctgaatgtcattatttgata

SEQ ID NO: 1965359 - DNA, 22 bp, Homo sapiens
ctgagttgcaccattctttctt

SEQ ID NO: 1965360 - DNA, 19 bp, Homo sapiens
ctgatcttacctttatgag

SEQ ID NO: 1965361 - DNA, 22 bp, Homo sapiens
ctgatgtttgggggttaccaaa

SEQ ID NO: 1965362 - DNA, 19 bp, Homo sapiens
ctgcatttttaaaggacaa

SEQ ID NO: 1965363 - DNA, 23 bp, Homo sapiens
ctgcatttttaaaggacaaacag

SEQ ID NO: 1965364 - DNA, 16 bp, Homo sapiens
ctgcccaactttcatt

SEQ ID NO: 1965365 - DNA, 19 bp, Homo sapiens
ctgcccaactttcattggt

SEQ ID NO: 1965366 - DNA, 13 bp, Homo sapiens
ctgccctgagccc

SEQ ID NO: 1965367 - DNA, 18 bp, Homo sapiens
ctggcaaacatgtgcaac

SEQ ID NO: 1965368 - DNA, 13 bp, Homo sapiens
ctgggtgatttct

SEQ ID NO: 1965369 - DNA, 18 bp, Homo sapiens
ctggtggatggtgacttt

SEQ ID NO: 1965370 - DNA, 20 bp, Homo sapiens
ctgtggattcagcttctgtt

SEQ ID NO: 1965371 - DNA, 23 bp, Homo sapiens
ctgtgtctctgtatatagctcta

SEQ ID NO: 1965372 - DNA, 14 bp, Homo sapiens
ctgttctacttgat

SEQ ID NO: 1965373 - DNA, 12 bp, Homo sapiens
cttactttgtgc

SEQ ID NO: 1965374 - DNA, 14 bp, Homo sapiens
cttactttgtgcaa

SEQ ID NO: 1965375 - DNA, 14 bp, Homo sapiens
cttagctgccaagt

SEQ ID NO: 1965376 - DNA, 17 bp, Homo sapiens
cttagctgccaagtaaa

SEQ ID NO: 1965377 - DNA, 18 bp, Homo sapiens
cttattgagcgtgattct

SEQ ID NO: 1965378 - DNA, 21 bp, Homo sapiens
cttatttatattcatcaaata

SEQ ID NO: 1965379 - DNA, 20 bp, Homo sapiens
cttcaagtgagtggcatgtg

SEQ ID NO: 1965380 - DNA, 14 bp, Homo sapiens
cttcagatcctacc

SEQ ID NO: 1965381 - DNA, 13 bp, Homo sapiens
cttcagctggtgg

SEQ ID NO: 1965382 - DNA, 16 bp, Homo sapiens
cttcatgaaaatccta

SEQ ID NO: 1965383 - DNA, 19 bp, Homo sapiens
cttcatgaaaatcctacca

SEQ ID NO: 1965384 - DNA, 20 bp, Homo sapiens
cttcttgtaatatttcttca

SEQ ID NO: 1965385 - DNA, 17 bp, Homo sapiens
cttgaagtaggaagtag

SEQ ID NO: 1965386 - DNA, 15 bp, Homo sapiens
cttgacctgaactct

SEQ ID NO: 1965387 - DNA, 19 bp, Homo sapiens
cttgacctgaactctgcaa

SEQ ID NO: 1965388 - DNA, 14 bp, Homo sapiens
cttgatatttcctt

SEQ ID NO: 1965389 - DNA, 22 bp, Homo sapiens
cttgggacctttaaagagcccc

SEQ ID NO: 1965390 - DNA, 14 bp, Homo sapiens
cttgtaatatttct

SEQ ID NO: 1965391 - DNA, 23 bp, Homo sapiens
cttgtcatcagtaagtataacaa

SEQ ID NO: 1965392 - DNA, 23 bp, Homo sapiens
cttgtttggagggatcattttct

SEQ ID NO: 1965393 - DNA, 13 bp, Homo sapiens
ctttcatttgaaa

SEQ ID NO: 1965394 - DNA, 21 bp, Homo sapiens
ctttcccatttcgtgtaatat

SEQ ID NO: 1965395 - DNA, 14 bp, Homo sapiens
ctttctttgctgct

SEQ ID NO: 1965396 - DNA, 15 bp, Homo sapiens
ctttctttgctgctg

SEQ ID NO: 1965397 - DNA, 13 bp, Homo sapiens
ctttgcaagctta

SEQ ID NO: 1965398 - DNA, 16 bp, Homo sapiens
ctttgctgaatgtcat

SEQ ID NO: 1965399 - DNA, 15 bp, Homo sapiens
cttttacatacagtg

SEQ ID NO: 1965400 - DNA, 16 bp, Homo sapiens
cttttccagaaagaaa

SEQ ID NO: 1965401 - DNA, 22 bp, Homo sapiens
cttttccagaaagaaaatgaat

SEQ ID NO: 1965402 - DNA, 15 bp, Homo sapiens
cttttgaagaacaaa

SEQ ID NO: 1965403 - DNA, 22 bp, Homo sapiens
cttttgaagaacaaaaggcttt

SEQ ID NO: 1965404 - DNA, 18 bp, Homo sapiens
gaaaagaaatcaattttt

SEQ ID NO: 1965405 - DNA, 18 bp, Homo sapiens
gaaaatagggtccttgaa

SEQ ID NO: 1965406 - DNA, 17 bp, Homo sapiens
gaaaatgaatttgactg

SEQ ID NO: 1965407 - DNA, 18 bp, Homo sapiens
gaaaggattctaaacaga

SEQ ID NO: 1965408 - DNA, 11 bp, Homo sapiens
gaaatccagta

SEQ ID NO: 1965409 - DNA, 19 bp, Homo sapiens
gaacaatcacaaaagctgt

SEQ ID NO: 1965410 - DNA, 23 bp, Homo sapiens
gaacaatcacaaaagctgtgtct

SEQ ID NO: 1965411 - DNA, 15 bp, Homo sapiens
gaacagtttggatgt

SEQ ID NO: 1965412 - DNA, 22 bp, Homo sapiens
gaacatggtgtgtgtctctgac

SEQ ID NO: 1965413 - DNA, 16 bp, Homo sapiens
gaactctgcaactgaa

SEQ ID NO: 1965414 - DNA, 21 bp, Homo sapiens
gaactgctttatcccacggaa

SEQ ID NO: 1965415 - DNA, 21 bp, Homo sapiens
gaagaaacccttccacgtgta

SEQ ID NO: 1965416 - DNA, 15 bp, Homo sapiens
gaagtcttgcattga

SEQ ID NO: 1965417 - DNA, 21 bp, Homo sapiens
gaagttggtcttactttgtgc

SEQ ID NO: 1965418 - DNA, 13 bp, Homo sapiens
gaatagtctctgg

SEQ ID NO: 1965419 - DNA, 17 bp, Homo sapiens
gaatagtctctgggttt

SEQ ID NO: 1965420 - DNA, 23 bp, Homo sapiens
gaatattaagaaacaatttaaat

SEQ ID NO: 1965421 - DNA, 16 bp, Homo sapiens
gaatgaggaacaatca

SEQ ID NO: 1965422 - DNA, 19 bp, Homo sapiens
gaatgtgatcatctttgct

SEQ ID NO: 1965423 - DNA, 18 bp, Homo sapiens
gacacaatgttgcactga

SEQ ID NO: 1965424 - DNA, 23 bp, Homo sapiens
gacacaatgttgcactgaaaacc

SEQ ID NO: 1965425 - DNA, 19 bp, Homo sapiens
gacagatcctccatttttg

SEQ ID NO: 1965426 - DNA, 17 bp, Homo sapiens
gaccctcgtttgatagt

SEQ ID NO: 1965427 - DNA, 13 bp, Homo sapiens
gacctctcttgtg

SEQ ID NO: 1965428 - DNA, 15 bp, Homo sapiens
gagaattaaactcct

SEQ ID NO: 1965429 - DNA, 12 bp, Homo sapiens
gagatgaaaacc

SEQ ID NO: 1965430 - DNA, 14 bp, Homo sapiens
gagcgtgattctgt

SEQ ID NO: 1965431 - DNA, 12 bp, Homo sapiens
gaggaggagaaa

SEQ ID NO: 1965432 - DNA, 16 bp, Homo sapiens
gagggatctaggtctt

SEQ ID NO: 1965433 - DNA, 22 bp, Homo sapiens
gaggtcgtataatttagtccct

SEQ ID NO: 1965434 - DNA, 18 bp, Homo sapiens
gataatcttagctgccaa

SEQ ID NO: 1965435 - DNA, 14 bp, Homo sapiens
gatacagtcattat

SEQ ID NO: 1965436 - DNA, 22 bp, Homo sapiens
gatacagtcattatttaaagca

SEQ ID NO: 1965437 - DNA, 17 bp, Homo sapiens
gatatgaaaaataaata

SEQ ID NO: 1965438 - DNA, 16 bp, Homo sapiens
gatattgaccatgtga

SEQ ID NO: 1965439 - DNA, 19 bp, Homo sapiens
gatcatctttgctgaatgt

SEQ ID NO: 1965440 - DNA, 18 bp, Homo sapiens
gatccatccgtccagcca

SEQ ID NO: 1965441 - DNA, 13 bp, Homo sapiens
gatctaggtcttg

SEQ ID NO: 1965442 - DNA, 22 bp, Homo sapiens
gattctaaacagatgtccctga

SEQ ID NO: 1965443 - DNA, 18 bp, Homo sapiens
gatttctagaatggtttt

SEQ ID NO: 1965444 - DNA, 15 bp, Homo sapiens
gattttatctgtgga

SEQ ID NO: 1965445 - DNA, 13 bp, Homo sapiens
gcaactcttgtat

SEQ ID NO: 1965446 - DNA, 16 bp, Homo sapiens
gcaagcttatttagca

SEQ ID NO: 1965447 - DNA, 21 bp, Homo sapiens
gcaagcttatttagcacattt

SEQ ID NO: 1965448 - DNA, 20 bp, Homo sapiens
gcaagtgggagatgaaaacc

SEQ ID NO: 1965449 - DNA, 16 bp, Homo sapiens
gcacatgccagggaaa

SEQ ID NO: 1965450 - DNA, 22 bp, Homo sapiens
gcaccattctttcttggtgcat

SEQ ID NO: 1965451 - DNA, 15 bp, Homo sapiens
gcagaggaggagaaa

SEQ ID NO: 1965452 - DNA, 18 bp, Homo sapiens
gcatcaaacatgaaaaca

SEQ ID NO: 1965453 - DNA, 15 bp, Homo sapiens
gcatggagtgtttga

SEQ ID NO: 1965454 - DNA, 11 bp, Homo sapiens
gcattcatgtt

SEQ ID NO: 1965455 - DNA, 23 bp, Homo sapiens
gcattttgaatgtgatcatcttt

SEQ ID NO: 1965456 - DNA, 12 bp, Homo sapiens
gccaagaaatcg

SEQ ID NO: 1965457 - DNA, 22 bp, Homo sapiens
gccccttaaatttctgccctga

SEQ ID NO: 1965458 - DNA, 12 bp, Homo sapiens
gccctgagccct

SEQ ID NO: 1965459 - DNA, 13 bp, Homo sapiens
gccttaataaata

SEQ ID NO: 1965460 - DNA, 21 bp, Homo sapiens
gccttatgagaacatggtgtg

SEQ ID NO: 1965461 - DNA, 20 bp, Homo sapiens
gcgtgtcaactttcatttga

SEQ ID NO: 1965462 - DNA, 20 bp, Homo sapiens
tagtaccttcagatcctacc

SEQ ID NO: 1965463 - DNA, 14 bp, Homo sapiens
tagtccctgtgttc

SEQ ID NO: 1965464 - DNA, 22 bp, Homo sapiens
tagtgcttcttgtaatatttct

SEQ ID NO: 1965465 - DNA, 16 bp, Homo sapiens
tagttgaaaaaagaag

SEQ ID NO: 1965466 - DNA, 19 bp, Homo sapiens
tagttgaaaaaagaagttt

SEQ ID NO: 1965467 - DNA, 13 bp, Homo sapiens
tagttgtctttct

SEQ ID NO: 1965468 - DNA, 15 bp, Homo sapiens
tataacaaactatgt

SEQ ID NO: 1965469 - DNA, 13 bp, Homo sapiens
tatagctagctat

SEQ ID NO: 1965470 - DNA, 21 bp, Homo sapiens
tatagctctacacaacatgta

SEQ ID NO: 1965471 - DNA, 16 bp, Homo sapiens
tatagttgtctttctt

SEQ ID NO: 1965472 - DNA, 21 bp, Homo sapiens
tatagttgtctttctttgctg

SEQ ID NO: 1965473 - DNA, 18 bp, Homo sapiens
tatcaaaaagtataaatt

SEQ ID NO: 1965474 - DNA, 19 bp, Homo sapiens
tatcccacggaaaatgcca

SEQ ID NO: 1965475 - DNA, 12 bp, Homo sapiens
tatctgcatgta

SEQ ID NO: 1965476 - DNA, 15 bp, Homo sapiens
tatgcaagtgggaga

SEQ ID NO: 1965477 - DNA, 23 bp, Homo sapiens
tatgcaagtgggagatgaaaacc

SEQ ID NO: 1965478 - DNA, 16 bp, Homo sapiens
tatgtaatgcttatgt

SEQ ID NO: 1965479 - DNA, 23 bp, Homo sapiens
tatgtacagttcataaatttgtt

SEQ ID NO: 1965480 - DNA, 19 bp, Homo sapiens
tatgttacttaaacatcat

SEQ ID NO: 1965481 - DNA, 18 bp, Homo sapiens
tattaagaatagtctctg

SEQ ID NO: 1965482 - DNA, 21 bp, Homo sapiens
tattaagaatagtctctgggt

SEQ ID NO: 1965483 - DNA, 21 bp, Homo sapiens
tattattactttttaaaatgt

SEQ ID NO: 1965484 - DNA, 23 bp, Homo sapiens
tattcatcaaataaaccttgttt

SEQ ID NO: 1965485 - DNA, 13 bp, Homo sapiens
tattctgataatg

SEQ ID NO: 1965486 - DNA, 18 bp, Homo sapiens
tattgagcgtgattctgt

SEQ ID NO: 1965487 - DNA, 18 bp, Homo sapiens
tattgctccattttcttg

SEQ ID NO: 1965488 - DNA, 18 bp, Homo sapiens
tatttatattcatcaaat

SEQ ID NO: 1965489 - DNA, 19 bp, Homo sapiens
tatttatattcatcaaata

SEQ ID NO: 1965490 - DNA, 18 bp, Homo sapiens
tatttgataacattttgt

SEQ ID NO: 1965491 - DNA, 19 bp, Homo sapiens
tatttgataacattttgtt

SEQ ID NO: 1965492 - DNA, 16 bp, Homo sapiens
tcaaacatgaaaacat

SEQ ID NO: 1965493 - DNA, 17 bp, Homo sapiens
tcaaacatgaaaacatt

SEQ ID NO: 1965494 - DNA, 17 bp, Homo sapiens
tcaactttcatttgaaa

SEQ ID NO: 1965495 - DNA, 22 bp, Homo sapiens
tcaagcaggtttcttgcttctg

SEQ ID NO: 1965496 - DNA, 17 bp, Homo sapiens
tcaatttactttttaaa

SEQ ID NO: 1965497 - DNA, 23 bp, Homo sapiens
tcaatttactttttaaacagtgt

SEQ ID NO: 1965498 - DNA, 13 bp, Homo sapiens
tcaattttgtatt

SEQ ID NO: 1965499 - DNA, 14 bp, Homo sapiens
tcaattttgtattt

SEQ ID NO: 1965500 - DNA, 21 bp, Homo sapiens
tcaattttttaaaccactaat

SEQ ID NO: 1965501 - DNA, 19 bp, Homo sapiens
tcacaaaagctgtgtctct

SEQ ID NO: 1965502 - DNA, 21 bp, Homo sapiens
tcacaaaagctgtgtctctgt

SEQ ID NO: 1965503 - DNA, 16 bp, Homo sapiens
tcacagctcttgtttg

SEQ ID NO: 1965504 - DNA, 18 bp, Homo sapiens
tcaccacctcatgtcatt

SEQ ID NO: 1965505 - DNA, 14 bp, Homo sapiens
tcacgctcgcatct

SEQ ID NO: 1965506 - DNA, 15 bp, Homo sapiens
tcagcatcaaacatg

SEQ ID NO: 1965507 - DNA, 21 bp, Homo sapiens
tcagcatcaaacatgaaaaca

SEQ ID NO: 1965508 - DNA, 12 bp, Homo sapiens
tcagtgtatcta

SEQ ID NO: 1965509 - DNA, 22 bp, Homo sapiens
tcatgaaaatcctaccaacctc

SEQ ID NO: 1965510 - DNA, 13 bp, Homo sapiens
tcatgtcatttct

SEQ ID NO: 1965511 - DNA, 12 bp, Homo sapiens
tcatgtgtatga

SEQ ID NO: 1965512 - DNA, 19 bp, Homo sapiens
tcatgtgtatgagaagtac

SEQ ID NO: 1965513 - DNA, 18 bp, Homo sapiens
tcattatttgataacatt

SEQ ID NO: 1965514 - DNA, 22 bp, Homo sapiens
tcattatttgataacattttgt

SEQ ID NO: 1965515 - DNA, 15 bp, Homo sapiens
tcatttctctttttt

SEQ ID NO: 1965516 - DNA, 13 bp, Homo sapiens
tcatttgaaagtg

SEQ ID NO: 1965517 - DNA, 13 bp, Homo sapiens
tccaaatgcattc

SEQ ID NO: 1965518 - DNA, 17 bp, Homo sapiens
tccaaatgctgtgcaaa

SEQ ID NO: 1965519 - DNA, 18 bp, Homo sapiens
tccaaatgctgtgcaaac

SEQ ID NO: 1965520 - DNA, 13 bp, Homo sapiens
tccacgtgtatgc

SEQ ID NO: 1965521 - DNA, 21 bp, Homo sapiens
tccagaaagaaaatgaatttg

SEQ ID NO: 1965522 - DNA, 14 bp, Homo sapiens
tccagacctgagct

SEQ ID NO: 1965523 - DNA, 22 bp, Homo sapiens
tccagccaagagctcttcatct

SEQ ID NO: 1965524 - DNA, 22 bp, Homo sapiens
tccagtggaagaagaaaacact

SEQ ID NO: 1965525 - DNA, 14 bp, Homo sapiens
tccattttcttgtc

SEQ ID NO: 1965526 - DNA, 15 bp, Homo sapiens
tccattttcttgtca

SEQ ID NO: 1965527 - DNA, 23 bp, Homo sapiens
tcccacggaaaatgccaatctct

SEQ ID NO: 1965528 - DNA, 21 bp, Homo sapiens
tccctgagttgcaccattctt

SEQ ID NO: 1965529 - DNA, 14 bp, Homo sapiens
tcctaccaacctct

SEQ ID NO: 1965530 - DNA, 13 bp, Homo sapiens
tcctctatttctt

SEQ ID NO: 1965531 - DNA, 16 bp, Homo sapiens
tccttgaaacagaaaa

SEQ ID NO: 1965532 - DNA, 17 bp, Homo sapiens
tcctttaactatcagag

SEQ ID NO: 1965533 - DNA, 21 bp, Homo sapiens
tcgtgtctagtagaacaatgt

SEQ ID NO: 1965534 - DNA, 20 bp, Homo sapiens
tcgtttttgctgcagagaat

SEQ ID NO: 1965535 - DNA, 17 bp, Homo sapiens
tctaaattgatcattca

SEQ ID NO: 1965536 - DNA, 20 bp, Homo sapiens
tctacttgatatttccttca

SEQ ID NO: 1965537 - DNA, 20 bp, Homo sapiens
tctagaaccactaaccccgc

SEQ ID NO: 1965538 - DNA, 12 bp, Homo sapiens
tctagaatggtt

SEQ ID NO: 1965539 - DNA, 19 bp, Homo sapiens
tctctgagctccagtggaa

SEQ ID NO: 1965540 - DNA, 21 bp, Homo sapiens
tctgaatattaagaaacaatt

SEQ ID NO: 1965541 - DNA, 17 bp, Homo sapiens
tctgataatgtattgca

SEQ ID NO: 1965542 - DNA, 12 bp, Homo sapiens
tctgcaacatgg

SEQ ID NO: 1965543 - DNA, 21 bp, Homo sapiens
tctgcatgtaaaatcttcagc

SEQ ID NO: 1965544 - DNA, 14 bp, Homo sapiens
tctgccctgagccc

SEQ ID NO: 1965545 - DNA, 17 bp, Homo sapiens
tctggacctctcttgtg

SEQ ID NO: 1965546 - DNA, 21 bp, Homo sapiens
tctggctttgttcttgtcatc

SEQ ID NO: 1965547 - DNA, 14 bp, Homo sapiens
tctggtatctgcat

SEQ ID NO: 1965548 - DNA, 16 bp, Homo sapiens
tctgtatatagctcta

SEQ ID NO: 1965549 - DNA, 21 bp, Homo sapiens
tctgtggattcagcttctgtt

SEQ ID NO: 1965550 - DNA, 14 bp, Homo sapiens
tctgttctacttga

SEQ ID NO: 1965551 - DNA, 13 bp, Homo sapiens
tctgttgtttgaa

SEQ ID NO: 1965552 - DNA, 15 bp, Homo sapiens
tctgttgtttgaaga

SEQ ID NO: 1965553 - DNA, 16 bp, Homo sapiens
tcttcaagtgagtggc

SEQ ID NO: 1965554 - DNA, 11 bp, Homo sapiens
tcttcagctgg

SEQ ID NO: 1965555 - DNA, 12 bp, Homo sapiens
tcttcagctggt

SEQ ID NO: 1965556 - DNA, 20 bp, Homo sapiens
tcttcagctggtggatggtg

SEQ ID NO: 1965557 - DNA, 15 bp, Homo sapiens
tcttctaatcataac

SEQ ID NO: 1965558 - DNA, 12 bp, Homo sapiens
tcttgcttctgg

SEQ ID NO: 1965559 - DNA, 21 bp, Homo sapiens
tcttgtttggagggatcattt

SEQ ID NO: 1965560 - DNA, 22 bp, Homo sapiens
tcttgtttggagggatcatttt

SEQ ID NO: 1965561 - DNA, 15 bp, Homo sapiens
tctttctttgctgct

SEQ ID NO: 1965562 - DNA, 16 bp, Homo sapiens
tctttctttgctgctg

SEQ ID NO: 1965563 - DNA, 19 bp, Homo sapiens
tctttctttgctgctgtgg

SEQ ID NO: 1965564 - DNA, 20 bp, Homo sapiens
tcttttacatacagtgatat

SEQ ID NO: 1965565 - DNA, 15 bp, Homo sapiens
tcttttccagaaaga

SEQ ID NO: 1965566 - DNA, 16 bp, Homo sapiens
tgaaaacattgatgaa

SEQ ID NO: 1965567 - DNA, 13 bp, Homo sapiens
tgaaaacctgcat

SEQ ID NO: 1965568 - DNA, 15 bp, Homo sapiens
tgaaaccgtccctga

SEQ ID NO: 1965569 - DNA, 14 bp, Homo sapiens
tgaatacttgaagt

SEQ ID NO: 1965570 - DNA, 21 bp, Homo sapiens
tgagaacatggtgtgtgtctc

SEQ ID NO: 1965571 - DNA, 20 bp, Homo sapiens
tgagaagtactttgtgctga

SEQ ID NO: 1965572 - DNA, 18 bp, Homo sapiens
tgaggcacctgcatatct

SEQ ID NO: 1965573 - DNA, 20 bp, Homo sapiens
tgaggcacctgcatatctct

SEQ ID NO: 1965574 - DNA, 15 bp, Homo sapiens
tgagtctggcaaaca

SEQ ID NO: 1965575 - DNA, 21 bp, Homo sapiens
tgagtggtgttggcagtgttt

SEQ ID NO: 1965576 - DNA, 20 bp, Homo sapiens
tgagttgcaccattctttct

SEQ ID NO: 1965577 - DNA, 16 bp, Homo sapiens
tgatagtgcttcttgt

SEQ ID NO: 1965578 - DNA, 21 bp, Homo sapiens
tgatattgaccatgtgattat

SEQ ID NO: 1965579 - DNA, 15 bp, Homo sapiens
tgatatttccttcac

SEQ ID NO: 1965580 - DNA, 13 bp, Homo sapiens
tgatcatctttgc

SEQ ID NO: 1965581 - DNA, 14 bp, Homo sapiens
tgatcatctttgct

SEQ ID NO: 1965582 - DNA, 22 bp, Homo sapiens
tgatcattcataattttatcta

SEQ ID NO: 1965583 - DNA, 11 bp, Homo sapiens
gctaacattta

SEQ ID NO: 1965584 - DNA, 15 bp, Homo sapiens
gctctccagacctga

SEQ ID NO: 1965585 - DNA, 18 bp, Homo sapiens
gctctccagacctgagct

SEQ ID NO: 1965586 - DNA, 16 bp, Homo sapiens
gctggtggatggtgac

SEQ ID NO: 1965587 - DNA, 17 bp, Homo sapiens
gctggtggatggtgact

SEQ ID NO: 1965588 - DNA, 18 bp, Homo sapiens
gctggtggatggtgactt

SEQ ID NO: 1965589 - DNA, 20 bp, Homo sapiens
gcttatttagcacattttga

SEQ ID NO: 1965590 - DNA, 20 bp, Homo sapiens
gcttcatgaaaatcctacca

SEQ ID NO: 1965591 - DNA, 21 bp, Homo sapiens
gcttcctctgaatattaagaa

SEQ ID NO: 1965592 - DNA, 17 bp, Homo sapiens
gctttataccccatttg

SEQ ID NO: 1965593 - DNA, 13 bp, Homo sapiens
ggaaaagaaatca

SEQ ID NO: 1965594 - DNA, 16 bp, Homo sapiens
ggaacatgcagctctg

SEQ ID NO: 1965595 - DNA, 21 bp, Homo sapiens
ggaatcgtttttgctgcagag

SEQ ID NO: 1965596 - DNA, 17 bp, Homo sapiens
ggacctttaaagagccc

SEQ ID NO: 1965597 - DNA, 19 bp, Homo sapiens
ggagaagttggtcttactt

SEQ ID NO: 1965598 - DNA, 21 bp, Homo sapiens
ggagtgtttgacgaagaaaca

SEQ ID NO: 1965599 - DNA, 18 bp, Homo sapiens
ggatccatccgtccagcc

SEQ ID NO: 1965600 - DNA, 15 bp, Homo sapiens
ggatggtgacttttg

SEQ ID NO: 1965601 - DNA, 20 bp, Homo sapiens
ggcatgtattagccagtcat

SEQ ID NO: 1965602 - DNA, 18 bp, Homo sapiens
ggcatgtgggttgtgata

SEQ ID NO: 1965603 - DNA, 17 bp, Homo sapiens
ggcattttgaatgtgat

SEQ ID NO: 1965604 - DNA, 21 bp, Homo sapiens
ggccaggttggaaaagaaatc

SEQ ID NO: 1965605 - DNA, 18 bp, Homo sapiens
ggctaacatttaggagaa

SEQ ID NO: 1965606 - DNA, 16 bp, Homo sapiens
ggctcatcagaactga

SEQ ID NO: 1965607 - DNA, 13 bp, Homo sapiens
ggtggatggtgac

SEQ ID NO: 1965608 - DNA, 14 bp, Homo sapiens
ggtggatggtgact

SEQ ID NO: 1965609 - DNA, 16 bp, Homo sapiens
ggtgtgtgtctctgac

SEQ ID NO: 1965610 - DNA, 22 bp, Homo sapiens
ggttaccaaaaatatccctttt

SEQ ID NO: 1965611 - DNA, 22 bp, Homo sapiens
ggttggaaaagaaatcaatttt

SEQ ID NO: 1965612 - DNA, 12 bp, Homo sapiens
ggtttcaattta

SEQ ID NO: 1965613 - DNA, 23 bp, Homo sapiens
gtaaatgaagggtcatttctctt

SEQ ID NO: 1965614 - DNA, 20 bp, Homo sapiens
gtaagcttagattttctgta

SEQ ID NO: 1965615 - DNA, 19 bp, Homo sapiens
gtaatattctctgatgttt

SEQ ID NO: 1965616 - DNA, 19 bp, Homo sapiens
gtaatatttcttcaagtga

SEQ ID NO: 1965617 - DNA, 18 bp, Homo sapiens
gtacaaggtatgtacagt

SEQ ID NO: 1965618 - DNA, 16 bp, Homo sapiens
gtacagtctcaatttt

SEQ ID NO: 1965619 - DNA, 17 bp, Homo sapiens
gtacagtctcaattttg

SEQ ID NO: 1965620 - DNA, 14 bp, Homo sapiens
gtactaaggagaat

SEQ ID NO: 1965621 - DNA, 22 bp, Homo sapiens
gtaggaatcgtttttgctgcag

SEQ ID NO: 1965622 - DNA, 15 bp, Homo sapiens
gtataacaaactatg

SEQ ID NO: 1965623 - DNA, 16 bp, Homo sapiens
gtataatttagtccct

SEQ ID NO: 1965624 - DNA, 13 bp, Homo sapiens
gtatcctgctggt

SEQ ID NO: 1965625 - DNA, 21 bp, Homo sapiens
gtatctgcatgtaaaatcttc

SEQ ID NO: 1965626 - DNA, 20 bp, Homo sapiens
gtatgcaagtgggagatgaa

SEQ ID NO: 1965627 - DNA, 22 bp, Homo sapiens
gtatgtacagttcataaatttg

SEQ ID NO: 1965628 - DNA, 20 bp, Homo sapiens
gtattagccagtcattgtaa

SEQ ID NO: 1965629 - DNA, 16 bp, Homo sapiens
gtcaactttcatttga

SEQ ID NO: 1965630 - DNA, 18 bp, Homo sapiens
gtcaactttcatttgaaa

SEQ ID NO: 1965631 - DNA, 15 bp, Homo sapiens
gtcatcagtaagtat

SEQ ID NO: 1965632 - DNA, 14 bp, Homo sapiens
gtcattatttaaag

SEQ ID NO: 1965633 - DNA, 20 bp, Homo sapiens
gtcctcaaagaagtggttct

SEQ ID NO: 1965634 - DNA, 12 bp, Homo sapiens
gtctagtagaac

SEQ ID NO: 1965635 - DNA, 17 bp, Homo sapiens
gtctcaattttgtattt

SEQ ID NO: 1965636 - DNA, 23 bp, Homo sapiens
gtctctgggtttacaacaaacac

SEQ ID NO: 1965637 - DNA, 13 bp, Homo sapiens
gtcttactttgtg

SEQ ID NO: 1965638 - DNA, 17 bp, Homo sapiens
gtctttctttgctgctg

SEQ ID NO: 1965639 - DNA, 19 bp, Homo sapiens
gtctttctttgctgctgtg

SEQ ID NO: 1965640 - DNA, 16 bp, Homo sapiens
gtgaatttaagcatga

SEQ ID NO: 1965641 - DNA, 17 bp, Homo sapiens
gtgaatttaagcatgag

SEQ ID NO: 1965642 - DNA, 14 bp, Homo sapiens
gtgacttttgaaga

SEQ ID NO: 1965643 - DNA, 22 bp, Homo sapiens
gtgatatggtactaaggagaat

SEQ ID NO: 1965644 - DNA, 20 bp, Homo sapiens
gtgcaaacagtgtaagctta

SEQ ID NO: 1965645 - DNA, 17 bp, Homo sapiens
gtgcaattaactctgga

SEQ ID NO: 1965646 - DNA, 23 bp, Homo sapiens
gtgccccttaaatttctgccctg

SEQ ID NO: 1965647 - DNA, 15 bp, Homo sapiens
gtgcttcttgtaata

SEQ ID NO: 1965648 - DNA, 19 bp, Homo sapiens
gtggaaaggattctaaaca

SEQ ID NO: 1965649 - DNA, 12 bp, Homo sapiens
gtgggagatgaa

SEQ ID NO: 1965650 - DNA, 17 bp, Homo sapiens
gtgggttgtgatattga

SEQ ID NO: 1965651 - DNA, 15 bp, Homo sapiens
gtgtatctaattccc

SEQ ID NO: 1965652 - DNA, 21 bp, Homo sapiens
gtgtatgagaagtactttgtg

SEQ ID NO: 1965653 - DNA, 22 bp, Homo sapiens
gtgtcaactttcatttgaaagt

SEQ ID NO: 1965654 - DNA, 19 bp, Homo sapiens
gtgtctagtagaacaatgt

SEQ ID NO: 1965655 - DNA, 17 bp, Homo sapiens
gttgaaaaaagaagttt

SEQ ID NO: 1965656 - DNA, 12 bp, Homo sapiens
gttggaaaagaa

SEQ ID NO: 1965657 - DNA, 15 bp, Homo sapiens
gttgtcatgtgtatg

SEQ ID NO: 1965658 - DNA, 20 bp, Homo sapiens
gtttgacgaagaaacaaaaa

SEQ ID NO: 1965659 - DNA, 21 bp, Homo sapiens
gtttgatagtgcttcttgtaa

SEQ ID NO: 1965660 - DNA, 22 bp, Homo sapiens
gtttgtataccatgatgcatgg

SEQ ID NO: 1965661 - DNA, 15 bp, Homo sapiens
gttttcttctaatca

SEQ ID NO: 1965662 - DNA, 13 bp, Homo sapiens
gtttttgctgcag

SEQ ID NO: 1965663 - DNA, 15 bp, Homo sapiens
taaacagtgtttatg

SEQ ID NO: 1965664 - DNA, 16 bp, Homo sapiens
taaacagtgtttatga

SEQ ID NO: 1965665 - DNA, 19 bp, Homo sapiens
taaaccttgtttctttctg

SEQ ID NO: 1965666 - DNA, 17 bp, Homo sapiens
taaaggacaaacagtga

SEQ ID NO: 1965667 - DNA, 22 bp, Homo sapiens
taaatatagttgtctttctttg

SEQ ID NO: 1965668 - DNA, 20 bp, Homo sapiens
taaatgaagggtcatttctc

SEQ ID NO: 1965669 - DNA, 21 bp, Homo sapiens
taaatgaagggtcatttctct

SEQ ID NO: 1965670 - DNA, 23 bp, Homo sapiens
taaattcgctgtgagtgagtggt

SEQ ID NO: 1965671 - DNA, 19 bp, Homo sapiens
taaattctctctaacataa

SEQ ID NO: 1965672 - DNA, 18 bp, Homo sapiens
taaattgttataacttca

SEQ ID NO: 1965673 - DNA, 21 bp, Homo sapiens
taaattgttataacttcataa

SEQ ID NO: 1965674 - DNA, 20 bp, Homo sapiens
taaatttctgccctgagccc

SEQ ID NO: 1965675 - DNA, 21 bp, Homo sapiens
taaatttctgccctgagccct

SEQ ID NO: 1965676 - DNA, 20 bp, Homo sapiens
taacagcgtgtcaactttca

SEQ ID NO: 1965677 - DNA, 19 bp, Homo sapiens
taacatttaggagaagttg

SEQ ID NO: 1965678 - DNA, 15 bp, Homo sapiens
taacctcgtgtctag

SEQ ID NO: 1965679 - DNA, 15 bp, Homo sapiens
taagcagagttcttt

SEQ ID NO: 1965680 - DNA, 16 bp, Homo sapiens
taaggaaccctggaaa

SEQ ID NO: 1965681 - DNA, 15 bp, Homo sapiens
taagtataacaaact

SEQ ID NO: 1965682 - DNA, 18 bp, Homo sapiens
taagtataacaaactatg

SEQ ID NO: 1965683 - DNA, 12 bp, Homo sapiens
taatattctctg

SEQ ID NO: 1965684 - DNA, 13 bp, Homo sapiens
taatatttcttca

SEQ ID NO: 1965685 - DNA, 18 bp, Homo sapiens
taatatttcttcaagtga

SEQ ID NO: 1965686 - DNA, 13 bp, Homo sapiens
taatcataacata

SEQ ID NO: 1965687 - DNA, 14 bp, Homo sapiens
taatctgttgtttg

SEQ ID NO: 1965688 - DNA, 15 bp, Homo sapiens
taatctgttgtttga

SEQ ID NO: 1965689 - DNA, 15 bp, Homo sapiens
taatgcttatgtgtt

SEQ ID NO: 1965690 - DNA, 14 bp, Homo sapiens
tacaacaaacactg

SEQ ID NO: 1965691 - DNA, 15 bp, Homo sapiens
tacaaccaggtcttg

SEQ ID NO: 1965692 - DNA, 13 bp, Homo sapiens
tacagtcattatt

SEQ ID NO: 1965693 - DNA, 14 bp, Homo sapiens
tacagtctcaattt

SEQ ID NO: 1965694 - DNA, 20 bp, Homo sapiens
tacagtctcaattttgtatt

SEQ ID NO: 1965695 - DNA, 14 bp, Homo sapiens
tactttgtgctgat

SEQ ID NO: 1965696 - DNA, 16 bp, Homo sapiens
tactttttaaaatgtt

SEQ ID NO: 1965697 - DNA, 23 bp, Homo sapiens
tagaacaatgtacaaggtatgta

SEQ ID NO: 1965698 - DNA, 16 bp, Homo sapiens
tagagatatttaaaag

SEQ ID NO: 1965699 - DNA, 22 bp, Homo sapiens
tagataacggctctccagacct

SEQ ID NO: 1965700 - DNA, 17 bp, Homo sapiens
tagccagtcattgtaac

SEQ ID NO: 1965701 - DNA, 14 bp, Homo sapiens
tagctctacacaac

SEQ ID NO: 1965702 - DNA, 12 bp, Homo sapiens
tagctgccaagt

SEQ ID NO: 1965703 - DNA, 21 bp, Homo sapiens
ttcagctggtggatggtgact

SEQ ID NO: 1965704 - DNA, 14 bp, Homo sapiens
ttcagcttctgttg

SEQ ID NO: 1965705 - DNA, 23 bp, Homo sapiens
ttcataaatttgttgtcatgtgt

SEQ ID NO: 1965706 - DNA, 20 bp, Homo sapiens
ttcatcaaataaaccttgtt

SEQ ID NO: 1965707 - DNA, 20 bp, Homo sapiens
ttccaaagcattttcagcat

SEQ ID NO: 1965708 - DNA, 14 bp, Homo sapiens
ttccacgtgtatgc

SEQ ID NO: 1965709 - DNA, 15 bp, Homo sapiens
ttcctaatgcattag

SEQ ID NO: 1965710 - DNA, 14 bp, Homo sapiens
ttctagaatggttt

SEQ ID NO: 1965711 - DNA, 14 bp, Homo sapiens
ttctggctttgttc

SEQ ID NO: 1965712 - DNA, 14 bp, Homo sapiens
ttcttgcttctggc

SEQ ID NO: 1965713 - DNA, 13 bp, Homo sapiens
ttctttcttggtg

SEQ ID NO: 1965714 - DNA, 12 bp, Homo sapiens
ttgaaaaaagaa

SEQ ID NO: 1965715 - DNA, 16 bp, Homo sapiens
ttgacctgaactctgc

SEQ ID NO: 1965716 - DNA, 16 bp, Homo sapiens
ttgcaccattctttct

SEQ ID NO: 1965717 - DNA, 23 bp, Homo sapiens
ttgcaccattctttcttggtgca

SEQ ID NO: 1965718 - DNA, 18 bp, Homo sapiens
ttgcataaacaatccaaa

SEQ ID NO: 1965719 - DNA, 14 bp, Homo sapiens
ttgccaagaaatcg

SEQ ID NO: 1965720 - DNA, 18 bp, Homo sapiens
ttgctgaatgtcattatt

SEQ ID NO: 1965721 - DNA, 21 bp, Homo sapiens
ttgctgaatgtcattatttga

SEQ ID NO: 1965722 - DNA, 12 bp, Homo sapiens
ttgctgcagaga

SEQ ID NO: 1965723 - DNA, 23 bp, Homo sapiens
ttgcttctggctttgttcttgtc

SEQ ID NO: 1965724 - DNA, 18 bp, Homo sapiens
ttgggggttaccaaaaat

SEQ ID NO: 1965725 - DNA, 18 bp, Homo sapiens
ttggtcttactttgtgca

SEQ ID NO: 1965726 - DNA, 12 bp, Homo sapiens
ttggtgcattcg

SEQ ID NO: 1965727 - DNA, 15 bp, Homo sapiens
ttgtaatatttcttc

SEQ ID NO: 1965728 - DNA, 23 bp, Homo sapiens
ttgtataccatgatgcatggagt

SEQ ID NO: 1965729 - DNA, 12 bp, Homo sapiens
ttgtcatgtgta

SEQ ID NO: 1965730 - DNA, 15 bp, Homo sapiens
ttgtcatgtgtatga

SEQ ID NO: 1965731 - DNA, 15 bp, Homo sapiens
ttgtctttctttgct

SEQ ID NO: 1965732 - DNA, 17 bp, Homo sapiens
ttgttattcttttccag

SEQ ID NO: 1965733 - DNA, 14 bp, Homo sapiens
tttaaaccactaat

SEQ ID NO: 1965734 - DNA, 22 bp, Homo sapiens
tttaatgatttttgtgtatcca

SEQ ID NO: 1965735 - DNA, 15 bp, Homo sapiens
tttaccctcctctat

SEQ ID NO: 1965736 - DNA, 21 bp, Homo sapiens
tttaccctcctctatttcttt

SEQ ID NO: 1965737 - DNA, 15 bp, Homo sapiens
tttactttttaaaca

SEQ ID NO: 1965738 - DNA, 20 bp, Homo sapiens
tttatctacccagtcatgta

SEQ ID NO: 1965739 - DNA, 12 bp, Homo sapiens
tttatctgtgga

SEQ ID NO: 1965740 - DNA, 18 bp, Homo sapiens
tttcaatttactttttaa

SEQ ID NO: 1965741 - DNA, 23 bp, Homo sapiens
tttcaatttactttttaaacagt

SEQ ID NO: 1965742 - DNA, 12 bp, Homo sapiens
tttcagcatcaa

SEQ ID NO: 1965743 - DNA, 17 bp, Homo sapiens
tttcagcatcaaacatg

SEQ ID NO: 1965744 - DNA, 19 bp, Homo sapiens
tttcagcatcaaacatgaa

SEQ ID NO: 1965745 - DNA, 21 bp, Homo sapiens
tttcagcatcaaacatgaaaa

SEQ ID NO: 1965746 - DNA, 19 bp, Homo sapiens
tttctgcccaactttcatt

SEQ ID NO: 1965747 - DNA, 14 bp, Homo sapiens
tttgacgaagaaac

SEQ ID NO: 1965748 - DNA, 12 bp, Homo sapiens
tttgaggtcttt

SEQ ID NO: 1965749 - DNA, 13 bp, Homo sapiens
tttgatagtgctt

SEQ ID NO: 1965750 - DNA, 23 bp, Homo sapiens
tttgcaagcttatttagcacatt

SEQ ID NO: 1965751 - DNA, 16 bp, Homo sapiens
tttggagggatcattt

SEQ ID NO: 1965752 - DNA, 14 bp, Homo sapiens
tttgggctaacatt

SEQ ID NO: 1965753 - DNA, 21 bp, Homo sapiens
tttgtttatgttacttaaaca

SEQ ID NO: 1965754 - DNA, 19 bp, Homo sapiens
ttttaaaatgttggtgcaa

SEQ ID NO: 1965755 - DNA, 12 bp, Homo sapiens
ttttaaacagtg

SEQ ID NO: 1965756 - DNA, 13 bp, Homo sapiens
ttttaaacagtgt

SEQ ID NO: 1965757 - DNA, 13 bp, Homo sapiens
ttttatctgtgga

SEQ ID NO: 1965758 - DNA, 18 bp, Homo sapiens
ttttgttgagtctctgaa

SEQ ID NO: 1965759 - DNA, 22 bp, Homo sapiens
tttttaaagaaaatgtgtctgc

SEQ ID NO: 1965760 - DNA, 15 bp, Homo sapiens
tttttgctgcagaga

SEQ ID NO: 1965761 - DNA, 14 bp, Homo sapiens
ttttttaaagaaaa

SEQ ID NO: 1965762 - DNA, 15 bp, Homo sapiens
tgatcgccttattta

SEQ ID NO: 1965763 - DNA, 22 bp, Homo sapiens
tgatcgccttatttatattcat

SEQ ID NO: 1965764 - DNA, 23 bp, Homo sapiens
tgatcgccttatttatattcatc

SEQ ID NO: 1965765 - DNA, 20 bp, Homo sapiens
tgatgcatggagtgtttgac

SEQ ID NO: 1965766 - DNA, 17 bp, Homo sapiens
tgatgttgggaagctat

SEQ ID NO: 1965767 - DNA, 22 bp, Homo sapiens
tgatgttgggaagctatttcct

SEQ ID NO: 1965768 - DNA, 19 bp, Homo sapiens
tgatttcgatgtacagtct

SEQ ID NO: 1965769 - DNA, 22 bp, Homo sapiens
tgatttcgatgtacagtctcaa

SEQ ID NO: 1965770 - DNA, 13 bp, Homo sapiens
tgatttctagaat

SEQ ID NO: 1965771 - DNA, 15 bp, Homo sapiens
tgatttttgtgtatc

SEQ ID NO: 1965772 - DNA, 14 bp, Homo sapiens
tgcaactcttgtat

SEQ ID NO: 1965773 - DNA, 18 bp, Homo sapiens
tgcaactcttgtattgct

SEQ ID NO: 1965774 - DNA, 20 bp, Homo sapiens
tgcaagtgggagatgaaaac

SEQ ID NO: 1965775 - DNA, 12 bp, Homo sapiens
tgcaatgttttt

SEQ ID NO: 1965776 - DNA, 16 bp, Homo sapiens
tgcaccattctttctt

SEQ ID NO: 1965777 - DNA, 16 bp, Homo sapiens
tgcacgttaacagcgt

SEQ ID NO: 1965778 - DNA, 21 bp, Homo sapiens
tgcagaggaggagaaaagtga

SEQ ID NO: 1965779 - DNA, 18 bp, Homo sapiens
tgcataaacaatccaaat

SEQ ID NO: 1965780 - DNA, 22 bp, Homo sapiens
tgcatatctctagtccctgtgt

SEQ ID NO: 1965781 - DNA, 19 bp, Homo sapiens
tgcatgtaaaatcttcagc

SEQ ID NO: 1965782 - DNA, 13 bp, Homo sapiens
tgccaagaaatcg

SEQ ID NO: 1965783 - DNA, 16 bp, Homo sapiens
tgccatcggtctagaa

SEQ ID NO: 1965784 - DNA, 23 bp, Homo sapiens
tgccccttaaatttctgccctga

SEQ ID NO: 1965785 - DNA, 12 bp, Homo sapiens
tgccctgagccc

SEQ ID NO: 1965786 - DNA, 21 bp, Homo sapiens
tgcgggcattttgaatgtgat

SEQ ID NO: 1965787 - DNA, 23 bp, Homo sapiens
tgcgggcattttgaatgtgatca

SEQ ID NO: 1965788 - DNA, 16 bp, Homo sapiens
tgctgaatgtcattat

SEQ ID NO: 1965789 - DNA, 21 bp, Homo sapiens
tgctgatcgccttatttatat

SEQ ID NO: 1965790 - DNA, 10 bp, Homo sapiens
tgctgcagag

SEQ ID NO: 1965791 - DNA, 16 bp, Homo sapiens
tgcttcatgaaaatcc

SEQ ID NO: 1965792 - DNA, 13 bp, Homo sapiens
tgcttcctctgaa

SEQ ID NO: 1965793 - DNA, 11 bp, Homo sapiens
tgcttcttgta

SEQ ID NO: 1965794 - DNA, 14 bp, Homo sapiens
tgcttcttgtaata

SEQ ID NO: 1965795 - DNA, 22 bp, Homo sapiens
tgctttataccccatttgattt

SEQ ID NO: 1965796 - DNA, 14 bp, Homo sapiens
tggaaaagaaatca

SEQ ID NO: 1965797 - DNA, 15 bp, Homo sapiens
tggacatcgatatga

SEQ ID NO: 1965798 - DNA, 16 bp, Homo sapiens
tggacatcgatatgaa

SEQ ID NO: 1965799 - DNA, 19 bp, Homo sapiens
tggacatcgatatgaaaaa

SEQ ID NO: 1965800 - DNA, 12 bp, Homo sapiens
tggatggtgact

SEQ ID NO: 1965801 - DNA, 17 bp, Homo sapiens
tggatggtgacttttga

SEQ ID NO: 1965802 - DNA, 18 bp, Homo sapiens
tggatggtgacttttgaa

SEQ ID NO: 1965803 - DNA, 23 bp, Homo sapiens
tggatgtcctcaaagaagtggtt

SEQ ID NO: 1965804 - DNA, 17 bp, Homo sapiens
tggcaaacatgtgcaac

SEQ ID NO: 1965805 - DNA, 22 bp, Homo sapiens
tggcaaacatgtgcaactcttg

SEQ ID NO: 1965806 - DNA, 20 bp, Homo sapiens
tggcaacagaaaacaattgt

SEQ ID NO: 1965807 - DNA, 17 bp, Homo sapiens
tggctttgttcttgtca

SEQ ID NO: 1965808 - DNA, 23 bp, Homo sapiens
tgggagcagtcctatgtctcagt

SEQ ID NO: 1965809 - DNA, 20 bp, Homo sapiens
tgggccaggttggaaaagaa

SEQ ID NO: 1965810 - DNA, 21 bp, Homo sapiens
tggggaaggaggaggctccca

SEQ ID NO: 1965811 - DNA, 16 bp, Homo sapiens
tgggtttacaacaaac

SEQ ID NO: 1965812 - DNA, 22 bp, Homo sapiens
tgggtttacaacaaacactgtg

SEQ ID NO: 1965813 - DNA, 16 bp, Homo sapiens
tggtactaaggagaat

SEQ ID NO: 1965814 - DNA, 14 bp, Homo sapiens
tggtggatggtgac

SEQ ID NO: 1965815 - DNA, 14 bp, Homo sapiens
tggtgtgtgtctct

SEQ ID NO: 1965816 - DNA, 15 bp, Homo sapiens
tggtgtgtgtctctg

SEQ ID NO: 1965817 - DNA, 18 bp, Homo sapiens
tggtgtgtgtctctgaca

SEQ ID NO: 1965818 - DNA, 21 bp, Homo sapiens
tggttagagaagtaagcagag

SEQ ID NO: 1965819 - DNA, 14 bp, Homo sapiens
tgtaaaatcttcag

SEQ ID NO: 1965820 - DNA, 16 bp, Homo sapiens
tgtaaaatcttcagct

SEQ ID NO: 1965821 - DNA, 19 bp, Homo sapiens
tgtaagcttagattttctg

SEQ ID NO: 1965822 - DNA, 19 bp, Homo sapiens
tgtaatatttcttcaagtg

SEQ ID NO: 1965823 - DNA, 18 bp, Homo sapiens
tgtacagtctcaattttg

SEQ ID NO: 1965824 - DNA, 20 bp, Homo sapiens
tgtagagtggcgattgaatg

SEQ ID NO: 1965825 - DNA, 21 bp, Homo sapiens
tgtataccatgatgcatggag

SEQ ID NO: 1965826 - DNA, 22 bp, Homo sapiens
tgtataccatgatgcatggagt

SEQ ID NO: 1965827 - DNA, 17 bp, Homo sapiens
tgtatgagaagtacttt

SEQ ID NO: 1965828 - DNA, 21 bp, Homo sapiens
tgtatgagaagtactttgtgc

SEQ ID NO: 1965829 - DNA, 19 bp, Homo sapiens
tgtatgtggatacagtcat

SEQ ID NO: 1965830 - DNA, 22 bp, Homo sapiens
tgtatgtggatacagtcattat

SEQ ID NO: 1965831 - DNA, 15 bp, Homo sapiens
tgtcaactttcattt

SEQ ID NO: 1965832 - DNA, 17 bp, Homo sapiens
tgtcaatggaagaaacc

SEQ ID NO: 1965833 - DNA, 12 bp, Homo sapiens
tgtcacagctct

SEQ ID NO: 1965834 - DNA, 16 bp, Homo sapiens
tgtcacagctcttgtt

SEQ ID NO: 1965835 - DNA, 12 bp, Homo sapiens
tgtcatgtgtat

SEQ ID NO: 1965836 - DNA, 18 bp, Homo sapiens
tgtcattatttgataaca

SEQ ID NO: 1965837 - DNA, 16 bp, Homo sapiens
tgtcatttctcatgga

SEQ ID NO: 1965838 - DNA, 13 bp, Homo sapiens
tgtcccagtgaac

SEQ ID NO: 1965839 - DNA, 19 bp, Homo sapiens
tgtctagtagaacaatgta

SEQ ID NO: 1965840 - DNA, 19 bp, Homo sapiens
tgtctctgtatatagctct

SEQ ID NO: 1965841 - DNA, 13 bp, Homo sapiens
tgtctgcaacatg

SEQ ID NO: 1965842 - DNA, 19 bp, Homo sapiens
tgtctttctttgctgctgt

SEQ ID NO: 1965843 - DNA, 22 bp, Homo sapiens
tgtgatattgaccatgtgatta

SEQ ID NO: 1965844 - DNA, 14 bp, Homo sapiens
tgtgattatggaca

SEQ ID NO: 1965845 - DNA, 21 bp, Homo sapiens
tgtgtatgagaagtactttgt

SEQ ID NO: 1965846 - DNA, 15 bp, Homo sapiens
tgtgtcccagtgaac

SEQ ID NO: 1965847 - DNA, 16 bp, Homo sapiens
tgtgttgcataaacaa

SEQ ID NO: 1965848 - DNA, 14 bp, Homo sapiens
tgttacttaaacat

SEQ ID NO: 1965849 - DNA, 11 bp, Homo sapiens
tgttggtgcaa

SEQ ID NO: 1965850 - DNA, 12 bp, Homo sapiens
tgtttctttctg

SEQ ID NO: 1965851 - DNA, 21 bp, Homo sapiens
tgtttgtataccatgatgcat

SEQ ID NO: 1965852 - DNA, 19 bp, Homo sapiens
tgttttaaaagtttgtcct

SEQ ID NO: 1965853 - DNA, 16 bp, Homo sapiens
ttaaaagacaaacacc

SEQ ID NO: 1965854 - DNA, 18 bp, Homo sapiens
ttaaaatgttggtgcaat

SEQ ID NO: 1965855 - DNA, 21 bp, Homo sapiens
ttaaacatcattggataaatt

SEQ ID NO: 1965856 - DNA, 13 bp, Homo sapiens
ttaaagaaaatgt

SEQ ID NO: 1965857 - DNA, 15 bp, Homo sapiens
ttaaaggacaaacag

SEQ ID NO: 1965858 - DNA, 16 bp, Homo sapiens
ttaaaggacaaacagt

SEQ ID NO: 1965859 - DNA, 19 bp, Homo sapiens
ttaaaggacaaacagtgaa

SEQ ID NO: 1965860 - DNA, 17 bp, Homo sapiens
ttaaattctctctaaca

SEQ ID NO: 1965861 - DNA, 19 bp, Homo sapiens
ttaacagcgtgtcaacttt

SEQ ID NO: 1965862 - DNA, 20 bp, Homo sapiens
ttaacaggttttcttctaat

SEQ ID NO: 1965863 - DNA, 22 bp, Homo sapiens
ttaacaggttttcttctaatca

SEQ ID NO: 1965864 - DNA, 22 bp, Homo sapiens
ttacatacagtgatatggtact

SEQ ID NO: 1965865 - DNA, 23 bp, Homo sapiens
ttaccttattgagcgtgattctg

SEQ ID NO: 1965866 - DNA, 21 bp, Homo sapiens
ttactgatcttacctttatga

SEQ ID NO: 1965867 - DNA, 14 bp, Homo sapiens
ttactttttaaaca

SEQ ID NO: 1965868 - DNA, 17 bp, Homo sapiens
ttactttttaaacagtg

SEQ ID NO: 1965869 - DNA, 15 bp, Homo sapiens
ttagccagtcattgt

SEQ ID NO: 1965870 - DNA, 14 bp, Homo sapiens
ttatgagaacatgg

SEQ ID NO: 1965871 - DNA, 11 bp, Homo sapiens
ttatggacatc

SEQ ID NO: 1965872 - DNA, 14 bp, Homo sapiens
ttattactttttaa

SEQ ID NO: 1965873 - DNA, 15 bp, Homo sapiens
ttattcttttccaga

SEQ ID NO: 1965874 - DNA, 13 bp, Homo sapiens
ttatttaaagcac

SEQ ID NO: 1965875 - DNA, 19 bp, Homo sapiens
ttatttaaagcacatgcca

SEQ ID NO: 1965876 - DNA, 14 bp, Homo sapiens
ttcaagatccaaat

SEQ ID NO: 1965877 - DNA, 20 bp, Homo sapiens
ttcaatttactttttaaaca

SEQ ID NO: 1965878 - DNA, 20 bp, Homo sapiens
ttcacatttcaagatccaaa

SEQ ID NO: 1965879 - DNA, 14 bp, Homo sapiens
ttcagatcctaccc

SEQ ID NO: 1965880 - DNA, 20 bp, Homo sapiens
ttcagcatcaaacatgaaaa

SEQ ID NO: 1965881 - DNA, 11 bp, Homo sapiens
ttcagctggtg

SEQ ID NO: 1965882 - DNA, 20 bp, Homo sapiens
ttcagctggtggatggtgac

SEQ ID NO: 1965883 - DNA, 19 bp, Homo sapiens
aaaaattaaattctctcta

SEQ ID NO: 1965884 - DNA, 15 bp, Homo sapiens
aaaagaaatcaattt

SEQ ID NO: 1965885 - DNA, 17 bp, Homo sapiens
aaaagaccaaattttga

SEQ ID NO: 1965886 - DNA, 23 bp, Homo sapiens
aaaagcaggcttgtgctttatac

SEQ ID NO: 1965887 - DNA, 18 bp, Homo sapiens
aaaatatccctttttcac

SEQ ID NO: 1965888 - DNA, 13 bp, Homo sapiens
aaaatcttcagct

SEQ ID NO: 1965889 - DNA, 12 bp, Homo sapiens
aaaatgtgtctg

SEQ ID NO: 1965890 - DNA, 16 bp, Homo sapiens
aaaatgttggtgcaat

SEQ ID NO: 1965891 - DNA, 18 bp, Homo sapiens
aaaatgttggtgcaatta

SEQ ID NO: 1965892 - DNA, 23 bp, Homo sapiens
aaacactagtaccttcagatcct

SEQ ID NO: 1965893 - DNA, 13 bp, Homo sapiens
aaacatgtgcaac

SEQ ID NO: 1965894 - DNA, 16 bp, Homo sapiens
aaacattgatgaatga

SEQ ID NO: 1965895 - DNA, 11 bp, Homo sapiens
cagatcctacc

SEQ ID NO: 1965896 - DNA, 20 bp, Homo sapiens
cagcatcaaacatgaaaaca

SEQ ID NO: 1965897 - DNA, 13 bp, Homo sapiens
cagccaagagctc

SEQ ID NO: 1965898 - DNA, 17 bp, Homo sapiens
cagccaagagctcttca

SEQ ID NO: 1965899 - DNA, 15 bp, Homo sapiens
cagctcttgtttgga

SEQ ID NO: 1965900 - DNA, 11 bp, Homo sapiens
cagctggtgga

SEQ ID NO: 1965901 - DNA, 17 bp, Homo sapiens
cagggtcagtgtatcta

SEQ ID NO: 1965902 - DNA, 14 bp, Homo sapiens
caggttggaaaaga

SEQ ID NO: 1965903 - DNA, 16 bp, Homo sapiens
caggttggaaaagaaa

SEQ ID NO: 1965904 - DNA, 22 bp, Homo sapiens
caggttggaaaagaaatcaatt

SEQ ID NO: 1965905 - DNA, 20 bp, Homo sapiens
caggttttcttctaatcata

SEQ ID NO: 1965906 - DNA, 19 bp, Homo sapiens
cagtaagtataacaaacta

SEQ ID NO: 1965907 - DNA, 17 bp, Homo sapiens
cagtagtcacctctggg

SEQ ID NO: 1965908 - DNA, 16 bp, Homo sapiens
cagtatcctgctggtt

SEQ ID NO: 1965909 - DNA, 18 bp, Homo sapiens
cagtcattatttaaagca

SEQ ID NO: 1965910 - DNA, 19 bp, Homo sapiens
cagtcctatgtctcagtgc

SEQ ID NO: 1965911 - DNA, 23 bp, Homo sapiens
cagtgatatggtactaaggagaa

SEQ ID NO: 1965912 - DNA, 16 bp, Homo sapiens
cagtgggcatgtatta

SEQ ID NO: 1965913 - DNA, 15 bp, Homo sapiens
cagtgtttatgacga

SEQ ID NO: 1965914 - DNA, 15 bp, Homo sapiens
cagttcataaatttg

SEQ ID NO: 1965915 - DNA, 13 bp, Homo sapiens
catagttgaaaaa

SEQ ID NO: 1965916 - DNA, 21 bp, Homo sapiens
catagttgaaaaaagaagttt

SEQ ID NO: 1965917 - DNA, 24 bp, Homo sapiens
catatctctagtccctgtgttctg

SEQ ID NO: 1965918 - DNA, 22 bp, Homo sapiens
catcaaacatgaaaacattgat

SEQ ID NO: 1965919 - DNA, 12 bp, Homo sapiens
catcattggata

SEQ ID NO: 1965920 - DNA, 20 bp, Homo sapiens
catcattggataaatttgaa

SEQ ID NO: 1965921 - DNA, 14 bp, Homo sapiens
catcctaaatattg

SEQ ID NO: 1965922 - DNA, 19 bp, Homo sapiens
catctaaattgatcattca

SEQ ID NO: 1965923 - DNA, 22 bp, Homo sapiens
catgaaaatcctaccaacctct

SEQ ID NO: 1965924 - DNA, 17 bp, Homo sapiens
catgcaggtctccatga

SEQ ID NO: 1965925 - DNA, 13 bp, Homo sapiens
catggagtgtttg

SEQ ID NO: 1965926 - DNA, 17 bp, Homo sapiens
catggattccaaagcat

SEQ ID NO: 1965927 - DNA, 18 bp, Homo sapiens
catggattccaaagcatt

SEQ ID NO: 1965928 - DNA, 22 bp, Homo sapiens
catggattccaaagcattttca

SEQ ID NO: 1965929 - DNA, 13 bp, Homo sapiens
catggatttggtt

SEQ ID NO: 1965930 - DNA, 14 bp, Homo sapiens
catgtaaaatcttc

SEQ ID NO: 1965931 - DNA, 23 bp, Homo sapiens
catgtaaaatcttcagctggtgg

SEQ ID NO: 1965932 - DNA, 16 bp, Homo sapiens
catgtatgtggataca

SEQ ID NO: 1965933 - DNA, 22 bp, Homo sapiens
catgtatgtggatacagtcatt

SEQ ID NO: 1965934 - DNA, 15 bp, Homo sapiens
catgtgcaactcttg

SEQ ID NO: 1965935 - DNA, 20 bp, Homo sapiens
catgtgcaactcttgtattg

SEQ ID NO: 1965936 - DNA, 17 bp, Homo sapiens
cattatttgataacatt

SEQ ID NO: 1965937 - DNA, 22 bp, Homo sapiens
cattcatgttttaaaagtttgt

SEQ ID NO: 1965938 - DNA, 17 bp, Homo sapiens
cattctttcttggtgca

SEQ ID NO: 1965939 - DNA, 20 bp, Homo sapiens
cattctttcttggtgcattc

SEQ ID NO: 1965940 - DNA, 20 bp, Homo sapiens
cattgaatttagtcattatt

SEQ ID NO: 1965941 - DNA, 22 bp, Homo sapiens
cattgatgaatgaggaacaatc

SEQ ID NO: 1965942 - DNA, 20 bp, Homo sapiens
cattgtaacctcgtgtctag

SEQ ID NO: 1965943 - DNA, 18 bp, Homo sapiens
catttcaagatccaaatg

SEQ ID NO: 1965944 - DNA, 20 bp, Homo sapiens
catttgatttcgatgtacag

SEQ ID NO: 1965945 - DNA, 23 bp, Homo sapiens
cattttcagcatcaaacatgaaa

SEQ ID NO: 1965946 - DNA, 12 bp, Homo sapiens
catttttaaagg

SEQ ID NO: 1965947 - DNA, 22 bp, Homo sapiens
catttttaaaggacaaacagtg

SEQ ID NO: 1965948 - DNA, 13 bp, Homo sapiens
ccaaatgcattca

SEQ ID NO: 1965949 - DNA, 17 bp, Homo sapiens
ccaagtaaatagcaaca

SEQ ID NO: 1965950 - DNA, 20 bp, Homo sapiens
ccacggaaaatgccaatctc

SEQ ID NO: 1965951 - DNA, 15 bp, Homo sapiens
ccagaaagaaaatga

SEQ ID NO: 1965952 - DNA, 13 bp, Homo sapiens
ccagacctgagct

SEQ ID NO: 1965953 - DNA, 21 bp, Homo sapiens
ccaggtcttgacctgaactct

SEQ ID NO: 1965954 - DNA, 23 bp, Homo sapiens
ccagtatcctgctggttcactct

SEQ ID NO: 1965955 - DNA, 17 bp, Homo sapiens
ccatgatgcatggagtg

SEQ ID NO: 1965956 - DNA, 12 bp, Homo sapiens
ccattctttctt

SEQ ID NO: 1965957 - DNA, 21 bp, Homo sapiens
ccatttgatttcgatgtacag

SEQ ID NO: 1965958 - DNA, 13 bp, Homo sapiens
ccccatttgattt

SEQ ID NO: 1965959 - DNA, 23 bp, Homo sapiens
ccccttaaatttctgccctgagc

SEQ ID NO: 1965960 - DNA, 17 bp, Homo sapiens
ccctgtgttctgcacat

SEQ ID NO: 1965961 - DNA, 17 bp, Homo sapiens
cctcatgtcatttctca

SEQ ID NO: 1965962 - DNA, 14 bp, Homo sapiens
cctctatttcttta

SEQ ID NO: 1965963 - DNA, 22 bp, Homo sapiens
cctctcttgtgagccatagaga

SEQ ID NO: 1965964 - DNA, 14 bp, Homo sapiens
cctgaactctgcaa

SEQ ID NO: 1965965 - DNA, 10 bp, Homo sapiens
cctgcatttt

SEQ ID NO: 1965966 - DNA, 12 bp, Homo sapiens
ccttaataaata

SEQ ID NO: 1965967 - DNA, 19 bp, Homo sapiens
ccttattgagcgtgattct

SEQ ID NO: 1965968 - DNA, 19 bp, Homo sapiens
ccttccacgtgtatgcaag

SEQ ID NO: 1965969 - DNA, 14 bp, Homo sapiens
ccttgtttctttct

SEQ ID NO: 1965970 - DNA, 15 bp, Homo sapiens
ccttgtttctttctg

SEQ ID NO: 1965971 - DNA, 18 bp, Homo sapiens
cgatatgaaaaataaata

SEQ ID NO: 1965972 - DNA, 15 bp, Homo sapiens
cgccttatttatatt

SEQ ID NO: 1965973 - DNA, 15 bp, Homo sapiens
cgctgtgagtgagtg

SEQ ID NO: 1965974 - DNA, 18 bp, Homo sapiens
cggaaaatgccaatctct

SEQ ID NO: 1965975 - DNA, 10 bp, Homo sapiens
cggctctcca

SEQ ID NO: 1965976 - DNA, 20 bp, Homo sapiens
cggctctccagacctgagct

SEQ ID NO: 1965977 - DNA, 23 bp, Homo sapiens
cggctctccagacctgagctttc

SEQ ID NO: 1965978 - DNA, 15 bp, Homo sapiens
cgtaagctctatctg

SEQ ID NO: 1965979 - DNA, 13 bp, Homo sapiens
cgtgattctgttc

SEQ ID NO: 1965980 - DNA, 15 bp, Homo sapiens
cgtgattctgttcta

SEQ ID NO: 1965981 - DNA, 18 bp, Homo sapiens
ctaaacagatgtccctga

SEQ ID NO: 1965982 - DNA, 23 bp, Homo sapiens
ctaaatattggtttgttattctt

SEQ ID NO: 1965983 - DNA, 13 bp, Homo sapiens
ctaacccagcagt

SEQ ID NO: 1965984 - DNA, 17 bp, Homo sapiens
ctaattggtcattccta

SEQ ID NO: 1965985 - DNA, 15 bp, Homo sapiens
ctacaaccaggtctt

SEQ ID NO: 1965986 - DNA, 15 bp, Homo sapiens
ctacacaacatgtat

SEQ ID NO: 1965987 - DNA, 22 bp, Homo sapiens
ctactgcttcctctgaatatta

SEQ ID NO: 1965988 - DNA, 21 bp, Homo sapiens
ctatgtatgtgccaattttgt

SEQ ID NO: 1965989 - DNA, 14 bp, Homo sapiens
ctatttcctttgcg

SEQ ID NO: 1965990 - DNA, 17 bp, Homo sapiens
ctatttctatgtatgtg

SEQ ID NO: 1965991 - DNA, 15 bp, Homo sapiens
ctcatcagaactgaa

SEQ ID NO: 1965992 - DNA, 14 bp, Homo sapiens
ctccacgtcagtgc

SEQ ID NO: 1965993 - DNA, 19 bp, Homo sapiens
ctccagtggaagaagaaaa

SEQ ID NO: 1965994 - DNA, 15 bp, Homo sapiens
ctccattttcttgtc

SEQ ID NO: 1965995 - DNA, 16 bp, Homo sapiens
ctccattttcttgtca

SEQ ID NO: 1965996 - DNA, 13 bp, Homo sapiens
ctccatttttgtt

SEQ ID NO: 1965997 - DNA, 14 bp, Homo sapiens
ctcccactggatcc

SEQ ID NO: 1965998 - DNA, 17 bp, Homo sapiens
ctctacacaacatgtat

SEQ ID NO: 1965999 - DNA, 13 bp, Homo sapiens
ctctccagacctg

SEQ ID NO: 1966000 - DNA, 15 bp, Homo sapiens
ctctccagacctgag

SEQ ID NO: 1966001 - DNA, 21 bp, Homo sapiens
ctctgcaactgaatacttgaa

SEQ ID NO: 1966002 - DNA, 19 bp, Homo sapiens
ctctgggccaggttggaaa

SEQ ID NO: 1966003 - DNA, 18 bp, Homo sapiens
ctgaactctgcaactgaa

SEQ ID NO: 1966004 - DNA, 13 bp, Homo sapiens
ctgaagtcttgca

SEQ ID NO: 1966005 - DNA, 18 bp, Homo sapiens
ctgaagtcttgcattgaa

SEQ ID NO: 1966006 - DNA, 19 bp, Homo sapiens
ctgaagtcttgcattgaat

SEQ ID NO: 1966007 - DNA, 14 bp, Homo sapiens
ctgaatacttgaag

SEQ ID NO: 1966008 - DNA, 23 bp, Homo sapiens
ctgaatgtcattatttgataaca

SEQ ID NO: 1966009 - DNA, 23 bp, Homo sapiens
ctgagctttccgcgtcagcaagt

SEQ ID NO: 1966010 - DNA, 24 bp, Homo sapiens
ctgagctttccgcgtcagcaagta

SEQ ID NO: 1966011 - DNA, 15 bp, Homo sapiens
ctgagtctggcaaac

SEQ ID NO: 1966012 - DNA, 17 bp, Homo sapiens
ctgagtctggcaaacat

SEQ ID NO: 1966013 - DNA, 20 bp, Homo sapiens
ctgagtctggcaaacatgtg

SEQ ID NO: 1966014 - DNA, 14 bp, Homo sapiens
ctgataatgtattg

SEQ ID NO: 1966015 - DNA, 17 bp, Homo sapiens
ctgcaatgtttttgtgt

SEQ ID NO: 1966016 - DNA, 20 bp, Homo sapiens
ctgcagagaataaaaggacc

SEQ ID NO: 1966017 - DNA, 21 bp, Homo sapiens
ctgcagagaataaaaggacca

SEQ ID NO: 1966018 - DNA, 21 bp, Homo sapiens
ctgcatatctctagtccctgt

SEQ ID NO: 1966019 - DNA, 18 bp, Homo sapiens
ctgcatgtaaaatcttca

SEQ ID NO: 1966020 - DNA, 22 bp, Homo sapiens
ctgcatgtaaaatcttcagctg

SEQ ID NO: 1966021 - DNA, 17 bp, Homo sapiens
ctgccctgagccctcca

SEQ ID NO: 1966022 - DNA, 15 bp, Homo sapiens
ctgctgtggaaagga

SEQ ID NO: 1966023 - DNA, 16 bp, Homo sapiens
ctggacctctcttgtg

SEQ ID NO: 1966024 - DNA, 16 bp, Homo sapiens
ctggagagtggcaaaa

SEQ ID NO: 1966025 - DNA, 22 bp, Homo sapiens
ctggatccatccgtccagccaa

SEQ ID NO: 1966026 - DNA, 15 bp, Homo sapiens
ctgggactcattcac

SEQ ID NO: 1966027 - DNA, 13 bp, Homo sapiens
ctgtgagtgagtg

SEQ ID NO: 1966028 - DNA, 16 bp, Homo sapiens
ctgtgcaaacagtgta

SEQ ID NO: 1966029 - DNA, 22 bp, Homo sapiens
ctgtgcaaacagtgtaagctta

SEQ ID NO: 1966030 - DNA, 12 bp, Homo sapiens
ctgtgtctctgt

SEQ ID NO: 1966031 - DNA, 18 bp, Homo sapiens
ctgtgtctctgtatatag

SEQ ID NO: 1966032 - DNA, 21 bp, Homo sapiens
ctgttgatcgtcacgctcgca

SEQ ID NO: 1966033 - DNA, 22 bp, Homo sapiens
cttaaaaattaaattctctcta

SEQ ID NO: 1966034 - DNA, 22 bp, Homo sapiens
cttaaatttctgccctgagccc

SEQ ID NO: 1966035 - DNA, 15 bp, Homo sapiens
cttactttgtgcaaa

SEQ ID NO: 1966036 - DNA, 13 bp, Homo sapiens
cttagattttctg

SEQ ID NO: 1966037 - DNA, 18 bp, Homo sapiens
cttcaagtgagtggcatg

SEQ ID NO: 1966038 - DNA, 16 bp, Homo sapiens
cttcagatcctacccc

SEQ ID NO: 1966039 - DNA, 11 bp, Homo sapiens
cttcagctggt

SEQ ID NO: 1966040 - DNA, 12 bp, Homo sapiens
cttcagctggtg

SEQ ID NO: 1966041 - DNA, 16 bp, Homo sapiens
cttcataaaactcatg

SEQ ID NO: 1966042 - DNA, 19 bp, Homo sapiens
cttctaaaaaaaaacaaaa

SEQ ID NO: 1966043 - DNA, 18 bp, Homo sapiens
cttcttgtaatatttctt

SEQ ID NO: 1966044 - DNA, 17 bp, Homo sapiens
cttgacctgaactctgc

SEQ ID NO: 1966045 - DNA, 22 bp, Homo sapiens
cttgcttctggctttgttcttg

SEQ ID NO: 1966046 - DNA, 14 bp, Homo sapiens
cttgtattgctcca

SEQ ID NO: 1966047 - DNA, 18 bp, Homo sapiens
cttgtattgctccatttt

SEQ ID NO: 1966048 - DNA, 16 bp, Homo sapiens
cttgtttctttctgaa

SEQ ID NO: 1966049 - DNA, 20 bp, Homo sapiens
ctttatgaggtcgtataatt

SEQ ID NO: 1966050 - DNA, 11 bp, Homo sapiens
ctttctttgct

SEQ ID NO: 1966051 - DNA, 21 bp, Homo sapiens
ctttctttgctgctgtggaaa

SEQ ID NO: 1966052 - DNA, 20 bp, Homo sapiens
ctttgcgcaaactttaacag

SEQ ID NO: 1966053 - DNA, 19 bp, Homo sapiens
ctttgctgaatgtcattat

SEQ ID NO: 1966054 - DNA, 12 bp, Homo sapiens
ctttgtgcaaaa

SEQ ID NO: 1966055 - DNA, 17 bp, Homo sapiens
ctttgtgcaaaagcagg

SEQ ID NO: 1966056 - DNA, 11 bp, Homo sapiens
cttttccagaa

SEQ ID NO: 1966057 - DNA, 21 bp, Homo sapiens
cttttgaagaacaaaaggctt

SEQ ID NO: 1966058 - DNA, 14 bp, Homo sapiens
ctttttaaacagtg

SEQ ID NO: 1966059 - DNA, 21 bp, Homo sapiens
ctttttttttttttttaaaga

SEQ ID NO: 1966060 - DNA, 12 bp, Homo sapiens
gaaaaataaata

SEQ ID NO: 1966061 - DNA, 16 bp, Homo sapiens
gaaaacaattgttctg

SEQ ID NO: 1966062 - DNA, 21 bp, Homo sapiens
gaaaatagggtccttgaaaca

SEQ ID NO: 1966063 - DNA, 13 bp, Homo sapiens
gaaaatcctacca

SEQ ID NO: 1966064 - DNA, 10 bp, Homo sapiens
gaaaatgtgt

SEQ ID NO: 1966065 - DNA, 12 bp, Homo sapiens
gaaaatgtgtct

SEQ ID NO: 1966066 - DNA, 21 bp, Homo sapiens
gaaaatgtgtctgcaacatgg

SEQ ID NO: 1966067 - DNA, 18 bp, Homo sapiens
gaaactaccagtgggcat

SEQ ID NO: 1966068 - DNA, 20 bp, Homo sapiens
gaaatacgccagaactgctt

SEQ ID NO: 1966069 - DNA, 17 bp, Homo sapiens
gaaatcgccttatgaga

SEQ ID NO: 1966070 - DNA, 20 bp, Homo sapiens
gaaatcgccttatgagaaca

SEQ ID NO: 1966071 - DNA, 14 bp, Homo sapiens
gaacaatcacaaaa

SEQ ID NO: 1966072 - DNA, 15 bp, Homo sapiens
gaagaacaaaaggct

SEQ ID NO: 1966073 - DNA, 22 bp, Homo sapiens
gaagtaagcagagttctttgca

SEQ ID NO: 1966074 - DNA, 15 bp, Homo sapiens
gaagtactttgtgct

SEQ ID NO: 1966075 - DNA, 22 bp, Homo sapiens
gaagttggtcttactttgtgca

SEQ ID NO: 1966076 - DNA, 19 bp, Homo sapiens
gaagtttgggctaacattt

SEQ ID NO: 1966077 - DNA, 13 bp, Homo sapiens
gaatacttgaagt

SEQ ID NO: 1966078 - DNA, 15 bp, Homo sapiens
gaatattaagaaaca

SEQ ID NO: 1966079 - DNA, 16 bp, Homo sapiens
gaatgtcattatttga

SEQ ID NO: 1966080 - DNA, 13 bp, Homo sapiens
gaatttaagcatg

SEQ ID NO: 1966081 - DNA, 13 bp, Homo sapiens
gacatcgatatga

SEQ ID NO: 1966082 - DNA, 16 bp, Homo sapiens
gacatcgatatgaaaa

SEQ ID NO: 1966083 - DNA, 13 bp, Homo sapiens
gacctcagatgtg

SEQ ID NO: 1966084 - DNA, 22 bp, Homo sapiens
gacctgaactctgcaactgaat

SEQ ID NO: 1966085 - DNA, 14 bp, Homo sapiens
gacctgagctttcc

SEQ ID NO: 1966086 - DNA, 11 bp, Homo sapiens
gactcattcac

SEQ ID NO: 1966087 - DNA, 13 bp, Homo sapiens
gacttttgaagaa

SEQ ID NO: 1966088 - DNA, 16 bp, Homo sapiens
gacttttgaagaacaa

SEQ ID NO: 1966089 - DNA, 16 bp, Homo sapiens
gagtctctgaacatcc

SEQ ID NO: 1966090 - DNA, 12 bp, Homo sapiens
gagttctttgca

SEQ ID NO: 1966091 - DNA, 22 bp, Homo sapiens
gagttctttgcaagcttattta

SEQ ID NO: 1966092 - DNA, 20 bp, Homo sapiens
gagttgcaccattctttctt

SEQ ID NO: 1966093 - DNA, 15 bp, Homo sapiens
gataacggctctcca

SEQ ID NO: 1966094 - DNA, 13 bp, Homo sapiens
gataatgtattgc

SEQ ID NO: 1966095 - DNA, 15 bp, Homo sapiens
gatatgaaaaataaa

SEQ ID NO: 1966096 - DNA, 15 bp, Homo sapiens
gatcctccatttttg

SEQ ID NO: 1966097 - DNA, 17 bp, Homo sapiens
gatggtgacttttgaag

SEQ ID NO: 1966098 - DNA, 13 bp, Homo sapiens
gattccaaagcat

SEQ ID NO: 1966099 - DNA, 17 bp, Homo sapiens
gattctaaacagatgtc

SEQ ID NO: 1966100 - DNA, 12 bp, Homo sapiens
gatttctagaat

SEQ ID NO: 1966101 - DNA, 22 bp, Homo sapiens
gcaaactttaacaggttttctt

SEQ ID NO: 1966102 - DNA, 23 bp, Homo sapiens
gcaacatgcttcatgaaaatcct

SEQ ID NO: 1966103 - DNA, 17 bp, Homo sapiens
gcaactgaatacttgaa

SEQ ID NO: 1966104 - DNA, 23 bp, Homo sapiens
gcacatctaaattgatcattcat

SEQ ID NO: 1966105 - DNA, 12 bp, Homo sapiens
gcactgaaaacc

SEQ ID NO: 1966106 - DNA, 15 bp, Homo sapiens
gcagagttctttgca

SEQ ID NO: 1966107 - DNA, 19 bp, Homo sapiens
gcagagttctttgcaagct

SEQ ID NO: 1966108 - DNA, 15 bp, Homo sapiens
gcatcaaacatgaaa

SEQ ID NO: 1966109 - DNA, 20 bp, Homo sapiens
gcatgtaaaatcttcagctg

SEQ ID NO: 1966110 - DNA, 22 bp, Homo sapiens
gcatgtaaaatcttcagctggt

SEQ ID NO: 1966111 - DNA, 23 bp, Homo sapiens
gcatgtaaaatcttcagctggtg

SEQ ID NO: 1966112 - DNA, 14 bp, Homo sapiens
gcatttttaaagga

SEQ ID NO: 1966113 - DNA, 23 bp, Homo sapiens
gccaagaaatcgccttatgagaa

SEQ ID NO: 1966114 - DNA, 23 bp, Homo sapiens
gccccttaaatttctgccctgag

SEQ ID NO: 1966115 - DNA, 11 bp, Homo sapiens
gccctgagccc

SEQ ID NO: 1966116 - DNA, 23 bp, Homo sapiens
gcctttaccctcctctatttctt

SEQ ID NO: 1966117 - DNA, 13 bp, Homo sapiens
gcgattgaatgct

SEQ ID NO: 1966118 - DNA, 12 bp, Homo sapiens
gcgcaaacttta

SEQ ID NO: 1966119 - DNA, 13 bp, Homo sapiens
gcgtgattctgtt

SEQ ID NO: 1966120 - DNA, 18 bp, Homo sapiens
gctaacatttaggagaag

SEQ ID NO: 1966121 - DNA, 18 bp, Homo sapiens
gctagctatttctatgta

SEQ ID NO: 1966122 - DNA, 22 bp, Homo sapiens
gctagctatttctatgtatgtg

SEQ ID NO: 1966123 - DNA, 18 bp, Homo sapiens
gctatttctatgtatgtg

SEQ ID NO: 1966124 - DNA, 22 bp, Homo sapiens
gctatttctatgtatgtgccaa

SEQ ID NO: 1966125 - DNA, 16 bp, Homo sapiens
gctcatcagaactgaa

SEQ ID NO: 1966126 - DNA, 15 bp, Homo sapiens
gctcgcatctataga

SEQ ID NO: 1966127 - DNA, 15 bp, Homo sapiens
gctctacacaacatg

SEQ ID NO: 1966128 - DNA, 20 bp, Homo sapiens
gctctacacaacatgtatgt

SEQ ID NO: 1966129 - DNA, 12 bp, Homo sapiens
gctctatctgca

SEQ ID NO: 1966130 - DNA, 17 bp, Homo sapiens
gctcttcatctgctaca

SEQ ID NO: 1966131 - DNA, 13 bp, Homo sapiens
gctggttcactct

SEQ ID NO: 1966132 - DNA, 17 bp, Homo sapiens
gcttagattttctgtaa

SEQ ID NO: 1966133 - DNA, 18 bp, Homo sapiens
gcttctggctttgttctt

SEQ ID NO: 1966134 - DNA, 23 bp, Homo sapiens
gctttataccccatttgatttcg

SEQ ID NO: 1966135 - DNA, 14 bp, Homo sapiens
gctttgttcttgtc

SEQ ID NO: 1966136 - DNA, 22 bp, Homo sapiens
gctttgttcttgtcatcagtaa

SEQ ID NO: 1966137 - DNA, 21 bp, Homo sapiens
ggacaaacagtgaatttaagc

SEQ ID NO: 1966138 - DNA, 12 bp, Homo sapiens
ggagtgtttgac

SEQ ID NO: 1966139 - DNA, 20 bp, Homo sapiens
ggatggtgacttttgaagaa

SEQ ID NO: 1966140 - DNA, 21 bp, Homo sapiens
ggatggtgacttttgaagaac

SEQ ID NO: 1966141 - DNA, 23 bp, Homo sapiens
ggatggtgacttttgaagaacaa

SEQ ID NO: 1966142 - DNA, 15 bp, Homo sapiens
ggcagtgtttgtata

SEQ ID NO: 1966143 - DNA, 22 bp, Homo sapiens
ggccaggttggaaaagaaatca

SEQ ID NO: 1966144 - DNA, 19 bp, Homo sapiens
ggctaacatttaggagaag

SEQ ID NO: 1966145 - DNA, 15 bp, Homo sapiens
ggctctccagacctg

SEQ ID NO: 1966146 - DNA, 16 bp, Homo sapiens
ggctctccagacctga

SEQ ID NO: 1966147 - DNA, 15 bp, Homo sapiens
ggctttgttcttgtc

SEQ ID NO: 1966148 - DNA, 20 bp, Homo sapiens
gggctaacatttaggagaag

SEQ ID NO: 1966149 - DNA, 12 bp, Homo sapiens
ggggaagatgaa

SEQ ID NO: 1966150 - DNA, 23 bp, Homo sapiens
ggggaagatgaaaccgtccctga

SEQ ID NO: 1966151 - DNA, 17 bp, Homo sapiens
gggtttacaacaaacac

SEQ ID NO: 1966152 - DNA, 21 bp, Homo sapiens
ggtatctgcatgtaaaatctt

SEQ ID NO: 1966153 - DNA, 20 bp, Homo sapiens
ggtctccatgaagaagctgg

SEQ ID NO: 1966154 - DNA, 23 bp, Homo sapiens
ggtcttactttgtgcaaaagcag

SEQ ID NO: 1966155 - DNA, 19 bp, Homo sapiens
ggtgcaattaactctggac

SEQ ID NO: 1966156 - DNA, 15 bp, Homo sapiens
ggtggatggtgactt

SEQ ID NO: 1966157 - DNA, 22 bp, Homo sapiens
ggtggatggtgacttttgaaga

SEQ ID NO: 1966158 - DNA, 15 bp, Homo sapiens
ggtttacaacaaaca

SEQ ID NO: 1966159 - DNA, 17 bp, Homo sapiens
ggtttacaacaaacact

SEQ ID NO: 1966160 - DNA, 18 bp, Homo sapiens
ggtttacaacaaacactg

SEQ ID NO: 1966161 - DNA, 19 bp, Homo sapiens
ggtttacaacaaacactgt

SEQ ID NO: 1966162 - DNA, 19 bp, Homo sapiens
gtaaaatcttcagctggtg

SEQ ID NO: 1966163 - DNA, 18 bp, Homo sapiens
gtaaatagcaacatgctt

SEQ ID NO: 1966164 - DNA, 12 bp, Homo sapiens
gtaactggaaca

SEQ ID NO: 1966165 - DNA, 18 bp, Homo sapiens
gtaagcagagttctttgc

SEQ ID NO: 1966166 - DNA, 16 bp, Homo sapiens
gtaagctctatctgca

SEQ ID NO: 1966167 - DNA, 20 bp, Homo sapiens
gtaagtataacaaactatgt

SEQ ID NO: 1966168 - DNA, 19 bp, Homo sapiens
gtaccttcagatcctaccc

SEQ ID NO: 1966169 - DNA, 18 bp, Homo sapiens
gtataacaaactatgtaa

SEQ ID NO: 1966170 - DNA, 15 bp, Homo sapiens
gtatctgcatgtaaa

SEQ ID NO: 1966171 - DNA, 19 bp, Homo sapiens
gtatctgcatgtaaaatct

SEQ ID NO: 1966172 - DNA, 20 bp, Homo sapiens
gtatctgcatgtaaaatctt

SEQ ID NO: 1966173 - DNA, 15 bp, Homo sapiens
gtatgtgccaatttt

SEQ ID NO: 1966174 - DNA, 20 bp, Homo sapiens
gtatttaatgatttttgtgt

SEQ ID NO: 1966175 - DNA, 21 bp, Homo sapiens
gtatttaatgatttttgtgta

SEQ ID NO: 1966176 - DNA, 22 bp, Homo sapiens
gtatttaatgatttttgtgtat

SEQ ID NO: 1966177 - DNA, 12 bp, Homo sapiens
gtcaacagtgaa

SEQ ID NO: 1966178 - DNA, 16 bp, Homo sapiens
gtcattatttaaagca

SEQ ID NO: 1966179 - DNA, 17 bp, Homo sapiens
gtcattcctaatgcatt

SEQ ID NO: 1966180 - DNA, 18 bp, Homo sapiens
gtcattgtaacctcgtgt

SEQ ID NO: 1966181 - DNA, 21 bp, Homo sapiens
gtcattgtaacctcgtgtcta

SEQ ID NO: 1966182 - DNA, 13 bp, Homo sapiens
gtccctgaagtct

SEQ ID NO: 1966183 - DNA, 14 bp, Homo sapiens
gtcctcaaagaagt

SEQ ID NO: 1966184 - DNA, 12 bp, Homo sapiens
gtccttgaaaca

SEQ ID NO: 1966185 - DNA, 16 bp, Homo sapiens
gtctcaattttgtatt

SEQ ID NO: 1966186 - DNA, 17 bp, Homo sapiens
gtcttactttgtgcaaa

SEQ ID NO: 1966187 - DNA, 21 bp, Homo sapiens
gtcttgacctgaactctgcaa

SEQ ID NO: 1966188 - DNA, 22 bp, Homo sapiens
gtctttctttgctgctgtggaa

SEQ ID NO: 1966189 - DNA, 16 bp, Homo sapiens
gtcttttacatacagt

SEQ ID NO: 1966190 - DNA, 23 bp, Homo sapiens
gtgagccatagagatatttaaaa

SEQ ID NO: 1966191 - DNA, 14 bp, Homo sapiens
gtgagtggcatgtg

SEQ ID NO: 1966192 - DNA, 16 bp, Homo sapiens
gtgagtggcatgtggg

SEQ ID NO: 1966193 - DNA, 19 bp, Homo sapiens
gtgatattgaccatgtgat

SEQ ID NO: 1966194 - DNA, 15 bp, Homo sapiens
gtgatcatctttgct

SEQ ID NO: 1966195 - DNA, 13 bp, Homo sapiens
gtgcttcttgtaa

SEQ ID NO: 1966196 - DNA, 21 bp, Homo sapiens
gtgcttcttgtaatatttctt

SEQ ID NO: 1966197 - DNA, 16 bp, Homo sapiens
gtggaaaggattctaa

SEQ ID NO: 1966198 - DNA, 18 bp, Homo sapiens
gtggatggtgacttttga

SEQ ID NO: 1966199 - DNA, 21 bp, Homo sapiens
gtggattcagcttctgttgga

SEQ ID NO: 1966200 - DNA, 16 bp, Homo sapiens
gtgtcaactttcattt

SEQ ID NO: 1966201 - DNA, 13 bp, Homo sapiens
gtgtcccagtgaa

SEQ ID NO: 1966202 - DNA, 14 bp, Homo sapiens
gtgtctgcaacatg

SEQ ID NO: 1966203 - DNA, 17 bp, Homo sapiens
gtgttgacgtaagctct

SEQ ID NO: 1966204 - DNA, 22 bp, Homo sapiens
gtgtttgtataccatgatgcat

SEQ ID NO: 1966205 - DNA, 15 bp, Homo sapiens
gttacttaaacatca

SEQ ID NO: 1966206 - DNA, 18 bp, Homo sapiens
gttctacttgatatttcc

SEQ ID NO: 1966207 - DNA, 16 bp, Homo sapiens
gttgcataaacaatcc

SEQ ID NO: 1966208 - DNA, 18 bp, Homo sapiens
gttggcagtgtttgtata

SEQ ID NO: 1966209 - DNA, 22 bp, Homo sapiens
gttgtctttctttgctgctgtg

SEQ ID NO: 1966210 - DNA, 14 bp, Homo sapiens
gtttacaacaaaca

SEQ ID NO: 1966211 - DNA, 18 bp, Homo sapiens
gtttacaacaaacactgt

SEQ ID NO: 1966212 - DNA, 18 bp, Homo sapiens
gtttccattttttgttcc

SEQ ID NO: 1966213 - DNA, 19 bp, Homo sapiens
gtttgaagaaccgcatttt

SEQ ID NO: 1966214 - DNA, 12 bp, Homo sapiens
gtttgatagtgc

SEQ ID NO: 1966215 - DNA, 13 bp, Homo sapiens
gtttttgttgagt

SEQ ID NO: 1966216 - DNA, 20 bp, Homo sapiens
gtttttgttgagtctctgaa

SEQ ID NO: 1966217 - DNA, 15 bp, Homo sapiens
taaaagtttgtcctt

SEQ ID NO: 1966218 - DNA, 20 bp, Homo sapiens
taaaagtttgtcctttaact

SEQ ID NO: 1966219 - DNA, 13 bp, Homo sapiens
taaaatattactg

SEQ ID NO: 1966220 - DNA, 14 bp, Homo sapiens
taaaatcttcagct

SEQ ID NO: 1966221 - DNA, 15 bp, Homo sapiens
taaaatcttcagctg

SEQ ID NO: 1966222 - DNA, 20 bp, Homo sapiens
taaaatcttcagctggtgga

SEQ ID NO: 1966223 - DNA, 20 bp, Homo sapiens
taaaccactaatgcttgcca

SEQ ID NO: 1966224 - DNA, 24 bp, Homo sapiens
taaactcctactgcttcctctgaa

SEQ ID NO: 1966225 - DNA, 13 bp, Homo sapiens
taaagaaaatgtg

SEQ ID NO: 1966226 - DNA, 17 bp, Homo sapiens
taaagaaaatgtgtctg

SEQ ID NO: 1966227 - DNA, 20 bp, Homo sapiens
taaagagcccctcctaaccc

SEQ ID NO: 1966228 - DNA, 19 bp, Homo sapiens
taaaggacaaacagtgaat

SEQ ID NO: 1966229 - DNA, 16 bp, Homo sapiens
taaatatagttgtctt

SEQ ID NO: 1966230 - DNA, 20 bp, Homo sapiens
taaatatagttgtctttctt

SEQ ID NO: 1966231 - DNA, 14 bp, Homo sapiens
taaattctctctaa

SEQ ID NO: 1966232 - DNA, 17 bp, Homo sapiens
taaattctctctaacat

SEQ ID NO: 1966233 - DNA, 19 bp, Homo sapiens
taaattgttataacttcat

SEQ ID NO: 1966234 - DNA, 13 bp, Homo sapiens
taaatttgttgtc

SEQ ID NO: 1966235 - DNA, 15 bp, Homo sapiens
taaatttgttgtcat

SEQ ID NO: 1966236 - DNA, 18 bp, Homo sapiens
taaatttgttgtcatgtg

SEQ ID NO: 1966237 - DNA, 19 bp, Homo sapiens
taaatttgttgtcatgtgt

SEQ ID NO: 1966238 - DNA, 23 bp, Homo sapiens
taaatttgttgtcatgtgtatga

SEQ ID NO: 1966239 - DNA, 23 bp, Homo sapiens
taacagcgtgtcaactttcattt

SEQ ID NO: 1966240 - DNA, 15 bp, Homo sapiens
taacaggttttcttc

SEQ ID NO: 1966241 - DNA, 15 bp, Homo sapiens
taacatttaggagaa

SEQ ID NO: 1966242 - DNA, 16 bp, Homo sapiens
taagaaacaatttaaa

SEQ ID NO: 1966243 - DNA, 20 bp, Homo sapiens
taagatactcaagcaggttt

SEQ ID NO: 1966244 - DNA, 21 bp, Homo sapiens
taagcagagttctttgcaagc

SEQ ID NO: 1966245 - DNA, 19 bp, Homo sapiens
taagctctatctgcaatgt

SEQ ID NO: 1966246 - DNA, 18 bp, Homo sapiens
taaggaaccctggaaact

SEQ ID NO: 1966247 - DNA, 19 bp, Homo sapiens
taagtataacaaactatgt

SEQ ID NO: 1966248 - DNA, 14 bp, Homo sapiens
taatattctctgat

SEQ ID NO: 1966249 - DNA, 22 bp, Homo sapiens
taatatttcttcaagtgagtgg

SEQ ID NO: 1966250 - DNA, 19 bp, Homo sapiens
taatttagtcccttaaaaa

SEQ ID NO: 1966251 - DNA, 15 bp, Homo sapiens
tacaacaaacactgt

SEQ ID NO: 1966252 - DNA, 19 bp, Homo sapiens
tacaacaaacactgtgatg

SEQ ID NO: 1966253 - DNA, 13 bp, Homo sapiens
tacaaggtatgta

SEQ ID NO: 1966254 - DNA, 19 bp, Homo sapiens
tacaagttaaggtatctgg

SEQ ID NO: 1966255 - DNA, 16 bp, Homo sapiens
tacacaacatgtatgt

SEQ ID NO: 1966256 - DNA, 15 bp, Homo sapiens
tacagtctcaatttt

SEQ ID NO: 1966257 - DNA, 18 bp, Homo sapiens
tacagtctcaattttgta

SEQ ID NO: 1966258 - DNA, 21 bp, Homo sapiens
tacagtctcaattttgtattt

SEQ ID NO: 1966259 - DNA, 22 bp, Homo sapiens
tacagtctcaattttgtattta

SEQ ID NO: 1966260 - DNA, 13 bp, Homo sapiens
tacagtgatatgg

SEQ ID NO: 1966261 - DNA, 17 bp, Homo sapiens
tacagttcataaatttg

SEQ ID NO: 1966262 - DNA, 15 bp, Homo sapiens
tacatacagtgatat

SEQ ID NO: 1966263 - DNA, 14 bp, Homo sapiens
taccagtgggcatg

SEQ ID NO: 1966264 - DNA, 19 bp, Homo sapiens
taccagtgggcatgtatta

SEQ ID NO: 1966265 - DNA, 15 bp, Homo sapiens
taccatgatgcatgg

SEQ ID NO: 1966266 - DNA, 14 bp, Homo sapiens
taccccatttgatt

SEQ ID NO: 1966267 - DNA, 18 bp, Homo sapiens
taccctcctctatttctt

SEQ ID NO: 1966268 - DNA, 19 bp, Homo sapiens
tactaaggagaattaaact

SEQ ID NO: 1966269 - DNA, 19 bp, Homo sapiens
tactcaagcaggtttcttg

SEQ ID NO: 1966270 - DNA, 15 bp, Homo sapiens
tacttaaacatcatt

SEQ ID NO: 1966271 - DNA, 21 bp, Homo sapiens
tactttttaaacagtgtttat

SEQ ID NO: 1966272 - DNA, 23 bp, Homo sapiens
tagagaagtaagcagagttcttt

SEQ ID NO: 1966273 - DNA, 20 bp, Homo sapiens
tagagatatttaaaagacaa

SEQ ID NO: 1966274 - DNA, 17 bp, Homo sapiens
tagctctacacaacatg

SEQ ID NO: 1966275 - DNA, 18 bp, Homo sapiens
tagctctacacaacatgt

SEQ ID NO: 1966276 - DNA, 13 bp, Homo sapiens
tagggtccttgaa

SEQ ID NO: 1966277 - DNA, 16 bp, Homo sapiens
tataccccatttgatt

SEQ ID NO: 1966278 - DNA, 19 bp, Homo sapiens
tatagctagctatttctat

SEQ ID NO: 1966279 - DNA, 20 bp, Homo sapiens
tatagttgtctttctttgct

SEQ ID NO: 1966280 - DNA, 22 bp, Homo sapiens
tatagttgtctttctttgctgc

SEQ ID NO: 1966281 - DNA, 14 bp, Homo sapiens
tatattcatcaaat

SEQ ID NO: 1966282 - DNA, 16 bp, Homo sapiens
tatcccacggaaaatg

SEQ ID NO: 1966283 - DNA, 16 bp, Homo sapiens
tatctctagtccctgt

SEQ ID NO: 1966284 - DNA, 21 bp, Homo sapiens
tatctgcaatgtttttgtgta

SEQ ID NO: 1966285 - DNA, 23 bp, Homo sapiens
tatctgtggattcagcttctgtt

SEQ ID NO: 1966286 - DNA, 20 bp, Homo sapiens
tatgagaacatggtgtgtgt

SEQ ID NO: 1966287 - DNA, 17 bp, Homo sapiens
tatgagaagtactttgt

SEQ ID NO: 1966288 - DNA, 23 bp, Homo sapiens
tatgcacgttaacagcgtgtcaa

SEQ ID NO: 1966289 - DNA, 19 bp, Homo sapiens
tatgtacagttcataaatt

SEQ ID NO: 1966290 - DNA, 20 bp, Homo sapiens
tatgtatgtgccaattttgt

SEQ ID NO: 1966291 - DNA, 19 bp, Homo sapiens
tatgtgccaattttgtcac

SEQ ID NO: 1966292 - DNA, 15 bp, Homo sapiens
tatgtggatacagtc

SEQ ID NO: 1966293 - DNA, 17 bp, Homo sapiens
tatgtggatacagtcat

SEQ ID NO: 1966294 - DNA, 15 bp, Homo sapiens
tatgttacttaaaca

SEQ ID NO: 1966295 - DNA, 16 bp, Homo sapiens
tatgttacttaaacat

SEQ ID NO: 1966296 - DNA, 20 bp, Homo sapiens
tatgttacttaaacatcatt

SEQ ID NO: 1966297 - DNA, 15 bp, Homo sapiens
tattactttttaaaa

SEQ ID NO: 1966298 - DNA, 18 bp, Homo sapiens
tattctgataatgtattg

SEQ ID NO: 1966299 - DNA, 20 bp, Homo sapiens
tattcttttccagaaagaaa

SEQ ID NO: 1966300 - DNA, 13 bp, Homo sapiens
tatttaaaagaca

SEQ ID NO: 1966301 - DNA, 14 bp, Homo sapiens
tatttaaaagacaa

SEQ ID NO: 1966302 - DNA, 17 bp, Homo sapiens
tatttaaaagacaaaca

SEQ ID NO: 1966303 - DNA, 14 bp, Homo sapiens
tatttaaagcacat

SEQ ID NO: 1966304 - DNA, 22 bp, Homo sapiens
tatttatattcatcaaataaac

SEQ ID NO: 1966305 - DNA, 12 bp, Homo sapiens
tatttcctttgc

SEQ ID NO: 1966306 - DNA, 17 bp, Homo sapiens
tatttcttcaagtgagt

SEQ ID NO: 1966307 - DNA, 13 bp, Homo sapiens
tatttgataacat

SEQ ID NO: 1966308 - DNA, 16 bp, Homo sapiens
tcaaaaagtataaatt

SEQ ID NO: 1966309 - DNA, 15 bp, Homo sapiens
tcaaacatgaaaaca

SEQ ID NO: 1966310 - DNA, 23 bp, Homo sapiens
tcaagatccaaatgctgtgcaaa

SEQ ID NO: 1966311 - DNA, 18 bp, Homo sapiens
tcaagcaggtttcttgct

SEQ ID NO: 1966312 - DNA, 16 bp, Homo sapiens
tcaagtgagtggcatg

SEQ ID NO: 1966313 - DNA, 19 bp, Homo sapiens
tcaatttactttttaaaca

SEQ ID NO: 1966314 - DNA, 18 bp, Homo sapiens
tcacaaaagctgtgtctc

SEQ ID NO: 1966315 - DNA, 21 bp, Homo sapiens
tcacatttcaagatccaaatg

SEQ ID NO: 1966316 - DNA, 12 bp, Homo sapiens
tcagatcctacc

SEQ ID NO: 1966317 - DNA, 16 bp, Homo sapiens
tcagcatcaaacatga

SEQ ID NO: 1966318 - DNA, 19 bp, Homo sapiens
tcagcatcaaacatgaaaa

SEQ ID NO: 1966319 - DNA, 23 bp, Homo sapiens
tcagcatcaaacatgaaaacatt

SEQ ID NO: 1966320 - DNA, 19 bp, Homo sapiens
tcagctggtggatggtgac

SEQ ID NO: 1966321 - DNA, 22 bp, Homo sapiens
tcagctggtggatggtgacttt

SEQ ID NO: 1966322 - DNA, 19 bp, Homo sapiens
tcataaatttgttgtcatg

SEQ ID NO: 1966323 - DNA, 17 bp, Homo sapiens
tcatcaaataaaccttg

SEQ ID NO: 1966324 - DNA, 14 bp, Homo sapiens
tcatcagtaagtat

SEQ ID NO: 1966325 - DNA, 20 bp, Homo sapiens
tcatcagtaagtataacaaa

SEQ ID NO: 1966326 - DNA, 14 bp, Homo sapiens
tcatggatttggtt

SEQ ID NO: 1966327 - DNA, 16 bp, Homo sapiens
tcatgtcatttctcat

SEQ ID NO: 1966328 - DNA, 13 bp, Homo sapiens
tcatgtgtatgag

SEQ ID NO: 1966329 - DNA, 16 bp, Homo sapiens
tcattatttgataaca

SEQ ID NO: 1966330 - DNA, 17 bp, Homo sapiens
tcattcctaatgcatta

SEQ ID NO: 1966331 - DNA, 14 bp, Homo sapiens
tccaaatgcattca

SEQ ID NO: 1966332 - DNA, 18 bp, Homo sapiens
tccaaatgcattcatgtt

SEQ ID NO: 1966333 - DNA, 23 bp, Homo sapiens
tccaaatgctgtgcaaacagtgt

SEQ ID NO: 1966334 - DNA, 19 bp, Homo sapiens
tccagccaagagctcttca

SEQ ID NO: 1966335 - DNA, 18 bp, Homo sapiens
tccatgggattttatctg

SEQ ID NO: 1966336 - DNA, 20 bp, Homo sapiens
tcccacggaaaatgccaatc

SEQ ID NO: 1966337 - DNA, 22 bp, Homo sapiens
tccctgagttgcaccattcttt

SEQ ID NO: 1966338 - DNA, 14 bp, Homo sapiens
tcctacaaccaggt

SEQ ID NO: 1966339 - DNA, 17 bp, Homo sapiens
tcctttgcgcaaacttt

SEQ ID NO: 1966340 - DNA, 15 bp, Homo sapiens
tcggtctagaaccac

SEQ ID NO: 1966341 - DNA, 15 bp, Homo sapiens
tctaatcataacata

SEQ ID NO: 1966342 - DNA, 14 bp, Homo sapiens
tctaattggtcatt

SEQ ID NO: 1966343 - DNA, 24 bp, Homo sapiens
tctaattggtcattcctaatgcat

SEQ ID NO: 1966344 - DNA, 14 bp, Homo sapiens
tctacacaacatgt

SEQ ID NO: 1966345 - DNA, 15 bp, Homo sapiens
tctaggtcttggtta

SEQ ID NO: 1966346 - DNA, 12 bp, Homo sapiens
tctatttcttta

SEQ ID NO: 1966347 - DNA, 16 bp, Homo sapiens
tctcaattttgtattt

SEQ ID NO: 1966348 - DNA, 16 bp, Homo sapiens
tctccagacctgagct

SEQ ID NO: 1966349 - DNA, 20 bp, Homo sapiens
tctctagtccctgtgttctg

SEQ ID NO: 1966350 - DNA, 16 bp, Homo sapiens
tctctctaacataaca

SEQ ID NO: 1966351 - DNA, 23 bp, Homo sapiens
tctctgagctccagtggaagaag

SEQ ID NO: 1966352 - DNA, 22 bp, Homo sapiens
tctctgggtttacaacaaacac

SEQ ID NO: 1966353 - DNA, 17 bp, Homo sapiens
tctgaatattaagaaac

SEQ ID NO: 1966354 - DNA, 19 bp, Homo sapiens
tctgaatattaagaaacaa

SEQ ID NO: 1966355 - DNA, 19 bp, Homo sapiens
tctgacaatgcgtggcaca

SEQ ID NO: 1966356 - DNA, 14 bp, Homo sapiens
tctgataatgtatt

SEQ ID NO: 1966357 - DNA, 20 bp, Homo sapiens
tctgataatgtattgcagtg

SEQ ID NO: 1966358 - DNA, 13 bp, Homo sapiens
tctgcaactgaat

SEQ ID NO: 1966359 - DNA, 18 bp, Homo sapiens
tctgcaatgtttttgtgt

SEQ ID NO: 1966360 - DNA, 21 bp, Homo sapiens
tctgcaatgtttttgtgtaga

SEQ ID NO: 1966361 - DNA, 22 bp, Homo sapiens
tctgcatgtaaaatcttcagct

SEQ ID NO: 1966362 - DNA, 23 bp, Homo sapiens
tctgcatgtaaaatcttcagctg

SEQ ID NO: 1966363 - DNA, 15 bp, Homo sapiens
tctgcccaactttca

SEQ ID NO: 1966364 - DNA, 20 bp, Homo sapiens
tctgcccaactttcattggt

SEQ ID NO: 1966365 - DNA, 13 bp, Homo sapiens
tctgccctgagcc

SEQ ID NO: 1966366 - DNA, 18 bp, Homo sapiens
tctgccctgagccctcca

SEQ ID NO: 1966367 - DNA, 16 bp, Homo sapiens
tctggacctctcttgt

SEQ ID NO: 1966368 - DNA, 15 bp, Homo sapiens
tctggctttgttctt

SEQ ID NO: 1966369 - DNA, 19 bp, Homo sapiens
tctgggtgatttctagaat

SEQ ID NO: 1966370 - DNA, 20 bp, Homo sapiens
tctgggtttacaacaaacac

SEQ ID NO: 1966371 - DNA, 12 bp, Homo sapiens
tcttactttgtg

SEQ ID NO: 1966372 - DNA, 13 bp, Homo sapiens
tcttactttgtgc

SEQ ID NO: 1966373 - DNA, 23 bp, Homo sapiens
tcttactttgtgcaaaagcaggc

SEQ ID NO: 1966374 - DNA, 16 bp, Homo sapiens
tcttcatctgctacaa

SEQ ID NO: 1966375 - DNA, 16 bp, Homo sapiens
tcttctaaaaaaaaac

SEQ ID NO: 1966376 - DNA, 20 bp, Homo sapiens
tcttctaatcataacatagt

SEQ ID NO: 1966377 - DNA, 22 bp, Homo sapiens
tcttgcattgaatttagtcatt

SEQ ID NO: 1966378 - DNA, 16 bp, Homo sapiens
tcttgtattgctccat

SEQ ID NO: 1966379 - DNA, 13 bp, Homo sapiens
tctttaatctgtt

SEQ ID NO: 1966380 - DNA, 15 bp, Homo sapiens
tctttaatctgttgt

SEQ ID NO: 1966381 - DNA, 17 bp, Homo sapiens
tctttcttggtgcattc

SEQ ID NO: 1966382 - DNA, 18 bp, Homo sapiens
tctttcttggtgcattcg

SEQ ID NO: 1966383 - DNA, 13 bp, Homo sapiens
tctttctttgctg

SEQ ID NO: 1966384 - DNA, 20 bp, Homo sapiens
tctttctttgctgctgtgga

SEQ ID NO: 1966385 - DNA, 23 bp, Homo sapiens
tctttgctgctgtggaaaggatt

SEQ ID NO: 1966386 - DNA, 23 bp, Homo sapiens
tctttttttttttttttaaagaa

SEQ ID NO: 1966387 - DNA, 21 bp, Homo sapiens
tgaaaaaagaagtttgggcta

SEQ ID NO: 1966388 - DNA, 17 bp, Homo sapiens
tgaaaacattgatgaat

SEQ ID NO: 1966389 - DNA, 13 bp, Homo sapiens
tgaaaatcctacc

SEQ ID NO: 1966390 - DNA, 15 bp, Homo sapiens
tgaaaatcctaccaa

SEQ ID NO: 1966391 - DNA, 20 bp, Homo sapiens
tgaaagtgggtttcaattta

SEQ ID NO: 1966392 - DNA, 13 bp, Homo sapiens
tgaagaagctggg

SEQ ID NO: 1966393 - DNA, 16 bp, Homo sapiens
tgaagggtcatttctc

SEQ ID NO: 1966394 - DNA, 22 bp, Homo sapiens
tgaataaagggaacatgcagct

SEQ ID NO: 1966395 - DNA, 16 bp, Homo sapiens
tgaatattaagaaaca

SEQ ID NO: 1966396 - DNA, 17 bp, Homo sapiens
tgaatgaggaacaatca

SEQ ID NO: 1966397 - DNA, 13 bp, Homo sapiens
tgaatttaagcat

SEQ ID NO: 1966398 - DNA, 14 bp, Homo sapiens
tgaatttaagcatg

SEQ ID NO: 1966399 - DNA, 21 bp, Homo sapiens
tgacagatcctccatttttgt

SEQ ID NO: 1966400 - DNA, 22 bp, Homo sapiens
tgacagatcctccatttttgtt

SEQ ID NO: 1966401 - DNA, 13 bp, Homo sapiens
tgacgtaagctct

SEQ ID NO: 1966402 - DNA, 18 bp, Homo sapiens
tgacgtaagctctatctg

SEQ ID NO: 1966403 - DNA, 17 bp, Homo sapiens
tgacttttgaagaacaa

SEQ ID NO: 1966404 - DNA, 23 bp, Homo sapiens
tgagaacatggtgtgtgtctctg

SEQ ID NO: 1966405 - DNA, 24 bp, Homo sapiens
tgagaacatggtgtgtgtctctga

SEQ ID NO: 1966406 - DNA, 21 bp, Homo sapiens
tgagctttccgcgtcagcaag

SEQ ID NO: 1966407 - DNA, 21 bp, Homo sapiens
tgagtctggcaaacatgtgca

SEQ ID NO: 1966408 - DNA, 15 bp, Homo sapiens
tgataacattttgtt

SEQ ID NO: 1966409 - DNA, 18 bp, Homo sapiens
tgataatgtattgcagtg

SEQ ID NO: 1966410 - DNA, 14 bp, Homo sapiens
tgatagtgcttctt

SEQ ID NO: 1966411 - DNA, 17 bp, Homo sapiens
tgatagtgcttcttgta

SEQ ID NO: 1966412 - DNA, 19 bp, Homo sapiens
tgatagtgcttcttgtaat

SEQ ID NO: 1966413 - DNA, 16 bp, Homo sapiens
tgatattgaccatgtg

SEQ ID NO: 1966414 - DNA, 18 bp, Homo sapiens
tgatattgaccatgtgat

SEQ ID NO: 1966415 - DNA, 19 bp, Homo sapiens
tgatattgaccatgtgatt

SEQ ID NO: 1966416 - DNA, 14 bp, Homo sapiens
tgatatttccttca

SEQ ID NO: 1966417 - DNA, 16 bp, Homo sapiens
tgatcatctttgctga

SEQ ID NO: 1966418 - DNA, 17 bp, Homo sapiens
tgattatggacatcgat

SEQ ID NO: 1966419 - DNA, 19 bp, Homo sapiens
tgattctgttctacttgat

SEQ ID NO: 1966420 - DNA, 12 bp, Homo sapiens
tgatttttgtgt

SEQ ID NO: 1966421 - DNA, 20 bp, Homo sapiens
tgatttttgtgtatccagta

SEQ ID NO: 1966422 - DNA, 21 bp, Homo sapiens
tgatttttgtgtatccagtat

SEQ ID NO: 1966423 - DNA, 12 bp, Homo sapiens
tgcaaacagtgt

SEQ ID NO: 1966424 - DNA, 16 bp, Homo sapiens
tgcaactgaatacttg

SEQ ID NO: 1966425 - DNA, 17 bp, Homo sapiens
tgcaagtgggagatgaa

SEQ ID NO: 1966426 - DNA, 19 bp, Homo sapiens
tgcaatgtttttgtgtaga

SEQ ID NO: 1966427 - DNA, 15 bp, Homo sapiens
tgcaattaactctgg

SEQ ID NO: 1966428 - DNA, 17 bp, Homo sapiens
tgcaattaactctggac

SEQ ID NO: 1966429 - DNA, 23 bp, Homo sapiens
tgcaccattctttcttggtgcat

SEQ ID NO: 1966430 - DNA, 20 bp, Homo sapiens
tgcagagaataaaaggacca

SEQ ID NO: 1966431 - DNA, 13 bp, Homo sapiens
tgcagctctgcag

SEQ ID NO: 1966432 - DNA, 20 bp, Homo sapiens
tgcagctctgcagcaatatt

SEQ ID NO: 1966433 - DNA, 20 bp, Homo sapiens
tgcaggtctccatgaagaag

SEQ ID NO: 1966434 - DNA, 19 bp, Homo sapiens
tgcataaacaatccaaatg

SEQ ID NO: 1966435 - DNA, 18 bp, Homo sapiens
tgcatatctctagtccct

SEQ ID NO: 1966436 - DNA, 20 bp, Homo sapiens
tgcatatctctagtccctgt

SEQ ID NO: 1966437 - DNA, 21 bp, Homo sapiens
tgcatgcaggtctccatgaag

SEQ ID NO: 1966438 - DNA, 15 bp, Homo sapiens
tgcatggagtgtttg

SEQ ID NO: 1966439 - DNA, 18 bp, Homo sapiens
tgcatgtaaaatcttcag

SEQ ID NO: 1966440 - DNA, 21 bp, Homo sapiens
tgccaattttgtcacagctct

SEQ ID NO: 1966441 - DNA, 17 bp, Homo sapiens
tgccagggaaaaagacc

SEQ ID NO: 1966442 - DNA, 18 bp, Homo sapiens
tgcccaactttcattggt

SEQ ID NO: 1966443 - DNA, 20 bp, Homo sapiens
tgcccagggtcagtgtatct

SEQ ID NO: 1966444 - DNA, 21 bp, Homo sapiens
tgcccagggtcagtgtatcta

SEQ ID NO: 1966445 - DNA, 13 bp, Homo sapiens
tgccctgagccct

SEQ ID NO: 1966446 - DNA, 21 bp, Homo sapiens
tgcctcctacaaccaggtctt

SEQ ID NO: 1966447 - DNA, 13 bp, Homo sapiens
tgctgaatgtcat

SEQ ID NO: 1966448 - DNA, 23 bp, Homo sapiens
tgctgaatgtcattatttgataa

SEQ ID NO: 1966449 - DNA, 15 bp, Homo sapiens
tgctgatcgccttat

SEQ ID NO: 1966450 - DNA, 18 bp, Homo sapiens
tgctgtgcaaacagtgta

SEQ ID NO: 1966451 - DNA, 16 bp, Homo sapiens
tgcttatgtgttgcat

SEQ ID NO: 1966452 - DNA, 17 bp, Homo sapiens
tgcttcatgaaaatcct

SEQ ID NO: 1966453 - DNA, 18 bp, Homo sapiens
tgcttcatgaaaatccta

SEQ ID NO: 1966454 - DNA, 16 bp, Homo sapiens
tgcttctggctttgtt

SEQ ID NO: 1966455 - DNA, 22 bp, Homo sapiens
tgcttctggctttgttcttgtc

SEQ ID NO: 1966456 - DNA, 23 bp, Homo sapiens
tgcttctggctttgttcttgtca

SEQ ID NO: 1966457 - DNA, 16 bp, Homo sapiens
tgcttcttgtaatatt

SEQ ID NO: 1966458 - DNA, 19 bp, Homo sapiens
tgcttcttgtaatatttct

SEQ ID NO: 1966459 - DNA, 21 bp, Homo sapiens
tgcttcttgtaatatttcttc

SEQ ID NO: 1966460 - DNA, 20 bp, Homo sapiens
tgctttataccccatttgat

SEQ ID NO: 1966461 - DNA, 18 bp, Homo sapiens
tggaaaggattctaaaca

SEQ ID NO: 1966462 - DNA, 20 bp, Homo sapiens
tggaaaggattctaaacaga

SEQ ID NO: 1966463 - DNA, 21 bp, Homo sapiens
tggaaaggattctaaacagat

SEQ ID NO: 1966464 - DNA, 18 bp, Homo sapiens
tggacatcgatatgaaaa

SEQ ID NO: 1966465 - DNA, 15 bp, Homo sapiens
tggacctctcttgtg

SEQ ID NO: 1966466 - DNA, 18 bp, Homo sapiens
tggacctctcttgtgagc

SEQ ID NO: 1966467 - DNA, 12 bp, Homo sapiens
tggagcggctca

SEQ ID NO: 1966468 - DNA, 22 bp, Homo sapiens
tggagtgtttgacgaagaaaca

SEQ ID NO: 1966469 - DNA, 20 bp, Homo sapiens
tggatccatccgtccagcca

SEQ ID NO: 1966470 - DNA, 20 bp, Homo sapiens
tggatggtgacttttgaaga

SEQ ID NO: 1966471 - DNA, 13 bp, Homo sapiens
tggcagtgtttgt

SEQ ID NO: 1966472 - DNA, 18 bp, Homo sapiens
tgggtttacaacaaacac

SEQ ID NO: 1966473 - DNA, 20 bp, Homo sapiens
tgggtttacaacaaacactg

SEQ ID NO: 1966474 - DNA, 15 bp, Homo sapiens
tggtactaaggagaa

SEQ ID NO: 1966475 - DNA, 19 bp, Homo sapiens
tggtcattcctaatgcatt

SEQ ID NO: 1966476 - DNA, 20 bp, Homo sapiens
tggtcttactttgtgcaaaa

SEQ ID NO: 1966477 - DNA, 14 bp, Homo sapiens
tggtgacttttgaa

SEQ ID NO: 1966478 - DNA, 17 bp, Homo sapiens
tggtgacttttgaagaa

SEQ ID NO: 1966479 - DNA, 18 bp, Homo sapiens
tggtgcaattaactctgg

SEQ ID NO: 1966480 - DNA, 11 bp, Homo sapiens
tggtgcattcg

SEQ ID NO: 1966481 - DNA, 16 bp, Homo sapiens
tggtgtgtgtctctga

SEQ ID NO: 1966482 - DNA, 15 bp, Homo sapiens
tggtttttgttgagt

SEQ ID NO: 1966483 - DNA, 19 bp, Homo sapiens
tgtaaaatcttcagctggt

SEQ ID NO: 1966484 - DNA, 22 bp, Homo sapiens
tgtaagcttagattttctgtaa

SEQ ID NO: 1966485 - DNA, 18 bp, Homo sapiens
tgtaatattctctgatgt

SEQ ID NO: 1966486 - DNA, 15 bp, Homo sapiens
tgtaatatttcttca

SEQ ID NO: 1966487 - DNA, 20 bp, Homo sapiens
tgtaatatttcttcaagtga

SEQ ID NO: 1966488 - DNA, 15 bp, Homo sapiens
tgtaatgcttatgtg

SEQ ID NO: 1966489 - DNA, 22 bp, Homo sapiens
tgtacagtctcaattttgtatt

SEQ ID NO: 1966490 - DNA, 18 bp, Homo sapiens
tgtactggagagtggcaa

SEQ ID NO: 1966491 - DNA, 22 bp, Homo sapiens
tgtatatagctctacacaacat

SEQ ID NO: 1966492 - DNA, 16 bp, Homo sapiens
tgtatgagaagtactt

SEQ ID NO: 1966493 - DNA, 17 bp, Homo sapiens
tgtatgtggatacagtc

SEQ ID NO: 1966494 - DNA, 20 bp, Homo sapiens
tgtatgtggatacagtcatt

SEQ ID NO: 1966495 - DNA, 20 bp, Homo sapiens
tgtattagccagtcattgta

SEQ ID NO: 1966496 - DNA, 21 bp, Homo sapiens
tgtattagccagtcattgtaa

SEQ ID NO: 1966497 - DNA, 18 bp, Homo sapiens
tgtcaactttcatttgaa

SEQ ID NO: 1966498 - DNA, 22 bp, Homo sapiens
tgtcaactttcatttgaaagtg

SEQ ID NO: 1966499 - DNA, 14 bp, Homo sapiens
tgtcacagctcttg

SEQ ID NO: 1966500 - DNA, 18 bp, Homo sapiens
tgtcacagctcttgtttg

SEQ ID NO: 1966501 - DNA, 13 bp, Homo sapiens
tgtcctcaaagaa

SEQ ID NO: 1966502 - DNA, 19 bp, Homo sapiens
tgtcggggaagatgaaacc

SEQ ID NO: 1966503 - DNA, 21 bp, Homo sapiens
tgtctagtagaacaatgtaca

SEQ ID NO: 1966504 - DNA, 14 bp, Homo sapiens
tgtctgcaacatgg

SEQ ID NO: 1966505 - DNA, 22 bp, Homo sapiens
tgtctgcaacatggattccaaa

SEQ ID NO: 1966506 - DNA, 13 bp, Homo sapiens
tgtctttctttgc

SEQ ID NO: 1966507 - DNA, 15 bp, Homo sapiens
tgtgatattgaccat

SEQ ID NO: 1966508 - DNA, 19 bp, Homo sapiens
tgtgatattgaccatgtga

SEQ ID NO: 1966509 - DNA, 17 bp, Homo sapiens
tgtgatcatctttgctg

SEQ ID NO: 1966510 - DNA, 14 bp, Homo sapiens
tgtgcaaaagcagg

SEQ ID NO: 1966511 - DNA, 24 bp, Homo sapiens
tgtgcaactcttgtattgctccat

SEQ ID NO: 1966512 - DNA, 15 bp, Homo sapiens
tgtggattcagcttc

SEQ ID NO: 1966513 - DNA, 22 bp, Homo sapiens
tgtgtagagtggcgattgaatg

SEQ ID NO: 1966514 - DNA, 22 bp, Homo sapiens
tgtgtatgagaagtactttgtg

SEQ ID NO: 1966515 - DNA, 23 bp, Homo sapiens
tgtgtatgagaagtactttgtgc

SEQ ID NO: 1966516 - DNA, 23 bp, Homo sapiens
tgtgttgcataaacaatccaaat

SEQ ID NO: 1966517 - DNA, 18 bp, Homo sapiens
tgttacttaaacatcatt

SEQ ID NO: 1966518 - DNA, 13 bp, Homo sapiens
tgttctacttgat

SEQ ID NO: 1966519 - DNA, 16 bp, Homo sapiens
tgttctacttgatatt

SEQ ID NO: 1966520 - DNA, 20 bp, Homo sapiens
tgttctacttgatatttcct

SEQ ID NO: 1966521 - DNA, 21 bp, Homo sapiens
tgttctgggtgatttctagaa

SEQ ID NO: 1966522 - DNA, 14 bp, Homo sapiens
tgttggtgcaatta

SEQ ID NO: 1966523 - DNA, 15 bp, Homo sapiens
tgttgtttgaagaac

SEQ ID NO: 1966524 - DNA, 14 bp, Homo sapiens
tgtttttgtgtaga

SEQ ID NO: 1966525 - DNA, 15 bp, Homo sapiens
ttaaaagacaaacac

SEQ ID NO: 1966526 - DNA, 16 bp, Homo sapiens
ttaaaagtttgtcctt

SEQ ID NO: 1966527 - DNA, 17 bp, Homo sapiens
ttaaagaaaatgtgtct

SEQ ID NO: 1966528 - DNA, 18 bp, Homo sapiens
ttaaagaaaatgtgtctg

SEQ ID NO: 1966529 - DNA, 16 bp, Homo sapiens
ttaaagcacatgccag

SEQ ID NO: 1966530 - DNA, 21 bp, Homo sapiens
ttaaagcacatgccagggaaa

SEQ ID NO: 1966531 - DNA, 14 bp, Homo sapiens
ttaaaggacaaaca

SEQ ID NO: 1966532 - DNA, 20 bp, Homo sapiens
ttaaaggacaaacagtgaat

SEQ ID NO: 1966533 - DNA, 14 bp, Homo sapiens
ttaaattctctcta

SEQ ID NO: 1966534 - DNA, 17 bp, Homo sapiens
ttaagaatagtctctgg

SEQ ID NO: 1966535 - DNA, 15 bp, Homo sapiens
ttacaacaaacactg

SEQ ID NO: 1966536 - DNA, 21 bp, Homo sapiens
ttagattttctgtaaatgaag

SEQ ID NO: 1966537 - DNA, 18 bp, Homo sapiens
ttaggagaagttggtctt

SEQ ID NO: 1966538 - DNA, 13 bp, Homo sapiens
ttagtcattatta

SEQ ID NO: 1966539 - DNA, 20 bp, Homo sapiens
ttatctacccagtcatgtac

SEQ ID NO: 1966540 - DNA, 15 bp, Homo sapiens
ttatgagaacatggt

SEQ ID NO: 1966541 - DNA, 22 bp, Homo sapiens
ttatggacatcgatatgaaaaa

SEQ ID NO: 1966542 - DNA, 16 bp, Homo sapiens
ttattcttttccagaa

SEQ ID NO: 1966543 - DNA, 16 bp, Homo sapiens
ttatttgataacattt

SEQ ID NO: 1966544 - DNA, 21 bp, Homo sapiens
ttatttgtcggggaagatgaa

SEQ ID NO: 1966545 - DNA, 21 bp, Homo sapiens
ttcaatttactttttaaacag

SEQ ID NO: 1966546 - DNA, 13 bp, Homo sapiens
ttcactctaattg

SEQ ID NO: 1966547 - DNA, 13 bp, Homo sapiens
ttcagatcctacc

SEQ ID NO: 1966548 - DNA, 15 bp, Homo sapiens
ttcagatcctacccc

SEQ ID NO: 1966549 - DNA, 16 bp, Homo sapiens
ttcagcatcaaacatg

SEQ ID NO: 1966550 - DNA, 19 bp, Homo sapiens
ttcagctggtggatggtga

SEQ ID NO: 1966551 - DNA, 22 bp, Homo sapiens
ttcagctggtggatggtgactt

SEQ ID NO: 1966552 - DNA, 19 bp, Homo sapiens
ttcataaatttgttgtcat

SEQ ID NO: 1966553 - DNA, 14 bp, Homo sapiens
ttcatcaaataaac

SEQ ID NO: 1966554 - DNA, 12 bp, Homo sapiens
ttcatctgctac

SEQ ID NO: 1966555 - DNA, 18 bp, Homo sapiens
ttcatgaaaatcctacca

SEQ ID NO: 1966556 - DNA, 14 bp, Homo sapiens
ttcattggttaaaa

SEQ ID NO: 1966557 - DNA, 22 bp, Homo sapiens
ttcccatttcgtgtaatattct

SEQ ID NO: 1966558 - DNA, 21 bp, Homo sapiens
ttcctctgaatattaagaaac

SEQ ID NO: 1966559 - DNA, 23 bp, Homo sapiens
ttcgatgtacagtctcaattttg

SEQ ID NO: 1966560 - DNA, 18 bp, Homo sapiens
ttcgtgtaatattctctg

SEQ ID NO: 1966561 - DNA, 15 bp, Homo sapiens
ttctaatcataacat

SEQ ID NO: 1966562 - DNA, 16 bp, Homo sapiens
ttctacttgatatttc

SEQ ID NO: 1966563 - DNA, 14 bp, Homo sapiens
ttctcatggatttg

SEQ ID NO: 1966564 - DNA, 16 bp, Homo sapiens
ttctggctttgttctt

SEQ ID NO: 1966565 - DNA, 13 bp, Homo sapiens
ttctgggtgattt

SEQ ID NO: 1966566 - DNA, 16 bp, Homo sapiens
ttctgggtgatttcta

SEQ ID NO: 1966567 - DNA, 13 bp, Homo sapiens
ttctgtaaatgaa

SEQ ID NO: 1966568 - DNA, 13 bp, Homo sapiens
ttctgttctactt

SEQ ID NO: 1966569 - DNA, 18 bp, Homo sapiens
ttcttgtcaatggaagaa

SEQ ID NO: 1966570 - DNA, 17 bp, Homo sapiens
ttcttttccagaaagaa

SEQ ID NO: 1966571 - DNA, 16 bp, Homo sapiens
ttgaaaaaagaagttt

SEQ ID NO: 1966572 - DNA, 23 bp, Homo sapiens
ttgaatgtgatcatctttgctga

SEQ ID NO: 1966573 - DNA, 21 bp, Homo sapiens
ttgatcgtcacgctcgcatct

SEQ ID NO: 1966574 - DNA, 17 bp, Homo sapiens
ttgatttcgatgtacag

SEQ ID NO: 1966575 - DNA, 17 bp, Homo sapiens
ttgcataaacaatccaa

SEQ ID NO: 1966576 - DNA, 19 bp, Homo sapiens
ttgcataaacaatccaaat

SEQ ID NO: 1966577 - DNA, 14 bp, Homo sapiens
ttgctgctgtggaa

SEQ ID NO: 1966578 - DNA, 13 bp, Homo sapiens
ttggaaaagaaat

SEQ ID NO: 1966579 - DNA, 16 bp, Homo sapiens
ttggaaaagaaatcaa

SEQ ID NO: 1966580 - DNA, 20 bp, Homo sapiens
ttggaaaagaaatcaatttt

SEQ ID NO: 1966581 - DNA, 17 bp, Homo sapiens
ttggtcttactttgtgc

SEQ ID NO: 1966582 - DNA, 18 bp, Homo sapiens
ttgtcaatggaagaaacc

SEQ ID NO: 1966583 - DNA, 21 bp, Homo sapiens
ttgtgatattgaccatgtgat

SEQ ID NO: 1966584 - DNA, 13 bp, Homo sapiens
ttgttctgggtga

SEQ ID NO: 1966585 - DNA, 22 bp, Homo sapiens
ttgttctgggtgatttctagaa

SEQ ID NO: 1966586 - DNA, 13 bp, Homo sapiens
ttgtttctttctg

SEQ ID NO: 1966587 - DNA, 18 bp, Homo sapiens
tttaaaagtttgtccttt

SEQ ID NO: 1966588 - DNA, 11 bp, Homo sapiens
tttaaagaaaa

SEQ ID NO: 1966589 - DNA, 13 bp, Homo sapiens
tttaaaggacaaa

SEQ ID NO: 1966590 - DNA, 19 bp, Homo sapiens
tttaaaggacaaacagtga

SEQ ID NO: 1966591 - DNA, 21 bp, Homo sapiens
tttaaaggacaaacagtgaat

SEQ ID NO: 1966592 - DNA, 21 bp, Homo sapiens
tttaacaggttttcttctaat

SEQ ID NO: 1966593 - DNA, 13 bp, Homo sapiens
tttagtcattatt

SEQ ID NO: 1966594 - DNA, 17 bp, Homo sapiens
tttatcccacggaaaat

SEQ ID NO: 1966595 - DNA, 22 bp, Homo sapiens
tttatgacgagacctcagatgt

SEQ ID NO: 1966596 - DNA, 22 bp, Homo sapiens
tttatgttacttaaacatcatt

SEQ ID NO: 1966597 - DNA, 13 bp, Homo sapiens
tttcaatttactt

SEQ ID NO: 1966598 - DNA, 22 bp, Homo sapiens
tttcagcatcaaacatgaaaac

SEQ ID NO: 1966599 - DNA, 23 bp, Homo sapiens
tttccagaaagaaaatgaatttg

SEQ ID NO: 1966600 - DNA, 14 bp, Homo sapiens
tttctgtaaatgaa

SEQ ID NO: 1966601 - DNA, 13 bp, Homo sapiens
tttctttgctgct

SEQ ID NO: 1966602 - DNA, 14 bp, Homo sapiens
tttctttgctgctg

SEQ ID NO: 1966603 - DNA, 22 bp, Homo sapiens
tttgaaagtgggtttcaattta

SEQ ID NO: 1966604 - DNA, 19 bp, Homo sapiens
tttgaatgtgatcatcttt

SEQ ID NO: 1966605 - DNA, 16 bp, Homo sapiens
tttgacgaagaaacaa

SEQ ID NO: 1966606 - DNA, 12 bp, Homo sapiens
tttgataacatt

SEQ ID NO: 1966607 - DNA, 16 bp, Homo sapiens
tttgatagtgcttctt

SEQ ID NO: 1966608 - DNA, 13 bp, Homo sapiens
tttgctgcagaga

SEQ ID NO: 1966609 - DNA, 14 bp, Homo sapiens
tttgtatttaatga

SEQ ID NO: 1966610 - DNA, 23 bp, Homo sapiens
tttgtatttaatgatttttgtgt

SEQ ID NO: 1966611 - DNA, 19 bp, Homo sapiens
tttgtcacagctcttgttt

SEQ ID NO: 1966612 - DNA, 16 bp, Homo sapiens
tttgttgtcatgtgta

SEQ ID NO: 1966613 - DNA, 20 bp, Homo sapiens
ttttaaagaaaatgtgtctg

SEQ ID NO: 1966614 - DNA, 16 bp, Homo sapiens
ttttaaaggacaaaca

SEQ ID NO: 1966615 - DNA, 22 bp, Homo sapiens
ttttaaaggacaaacagtgaat

SEQ ID NO: 1966616 - DNA, 22 bp, Homo sapiens
ttttatctacccagtcatgtac

SEQ ID NO: 1966617 - DNA, 22 bp, Homo sapiens
ttttcagcatcaaacatgaaaa

SEQ ID NO: 1966618 - DNA, 14 bp, Homo sapiens
ttttgaagaacaaa

SEQ ID NO: 1966619 - DNA, 15 bp, Homo sapiens
ttttgtatttaatga

SEQ ID NO: 1966620 - DNA, 19 bp, Homo sapiens
ttttgtcacagctcttgtt

SEQ ID NO: 1966621 - DNA, 19 bp, Homo sapiens
tttttgttgagtctctgaa

SEQ ID NO: 1966622 - DNA, 13 bp, Homo sapiens
aaaccgtccctga

SEQ ID NO: 1966623 - DNA, 20 bp, Homo sapiens
aaacctgcatttttaaagga

SEQ ID NO: 1966624 - DNA, 21 bp, Homo sapiens
aaactaaggaaccctggaaac

SEQ ID NO: 1966625 - DNA, 15 bp, Homo sapiens
aaactcctactgctt

SEQ ID NO: 1966626 - DNA, 16 bp, Homo sapiens
aaagaaaatgtgtctg

SEQ ID NO: 1966627 - DNA, 14 bp, Homo sapiens
aaagaaatcaattt

SEQ ID NO: 1966628 - DNA, 19 bp, Homo sapiens
aaagctgtgtctctgtata

SEQ ID NO: 1966629 - DNA, 21 bp, Homo sapiens
aaagctgtgtctctgtatata

SEQ ID NO: 1966630 - DNA, 17 bp, Homo sapiens
aaaggacaaacagtgaa

SEQ ID NO: 1966631 - DNA, 13 bp, Homo sapiens
aaagttccagttt

SEQ ID NO: 1966632 - DNA, 19 bp, Homo sapiens
aaataaaactaaggaaccc

SEQ ID NO: 1966633 - DNA, 21 bp, Homo sapiens
aaatacgccagaactgcttta

SEQ ID NO: 1966634 - DNA, 19 bp, Homo sapiens
aaatatccctttttcacat

SEQ ID NO: 1966635 - DNA, 13 bp, Homo sapiens
aaatattactgat

SEQ ID NO: 1966636 - DNA, 17 bp, Homo sapiens
aaatattggtttgttat

SEQ ID NO: 1966637 - DNA, 11 bp, Homo sapiens
aaatcaatttt

SEQ ID NO: 1966638 - DNA, 19 bp, Homo sapiens
aaatcaattttttaaacca

SEQ ID NO: 1966639 - DNA, 16 bp, Homo sapiens
aaatcgccttatgaga

SEQ ID NO: 1966640 - DNA, 17 bp, Homo sapiens
aaatcgccttatgagaa

SEQ ID NO: 1966641 - DNA, 16 bp, Homo sapiens
aaatcttcagctggtg

SEQ ID NO: 1966642 - DNA, 14 bp, Homo sapiens
aaatgccaatctct

SEQ ID NO: 1966643 - DNA, 19 bp, Homo sapiens
aaatgctgtgcaaacagtg

SEQ ID NO: 1966644 - DNA, 13 bp, Homo sapiens
aaatgttggtgca

SEQ ID NO: 1966645 - DNA, 17 bp, Homo sapiens
aaattaaattctctcta

SEQ ID NO: 1966646 - DNA, 21 bp, Homo sapiens
aaattaaattctctctaacat

SEQ ID NO: 1966647 - DNA, 16 bp, Homo sapiens
aaatttctgccctgag

SEQ ID NO: 1966648 - DNA, 17 bp, Homo sapiens
aaattttgaggtctttt

SEQ ID NO: 1966649 - DNA, 23 bp, Homo sapiens
aacaatcacaaaagctgtgtctc

SEQ ID NO: 1966650 - DNA, 18 bp, Homo sapiens
aacaatccaaatgcattc

SEQ ID NO: 1966651 - DNA, 22 bp, Homo sapiens
aacagatgtccctgaagtcttg

SEQ ID NO: 1966652 - DNA, 21 bp, Homo sapiens
aacaggttttcttctaatcat

SEQ ID NO: 1966653 - DNA, 12 bp, Homo sapiens
aacagtgaattt

SEQ ID NO: 1966654 - DNA, 15 bp, Homo sapiens
aacatgaaaacattg

SEQ ID NO: 1966655 - DNA, 21 bp, Homo sapiens
aacatgaaaacattgatgaat

SEQ ID NO: 1966656 - DNA, 17 bp, Homo sapiens
aacatggattccaaagc

SEQ ID NO: 1966657 - DNA, 22 bp, Homo sapiens
aacatgtgcaactcttgtattg

SEQ ID NO: 1966658 - DNA, 18 bp, Homo sapiens
aacattgatgaatgagga

SEQ ID NO: 1966659 - DNA, 15 bp, Homo sapiens
aacatttaggagaag

SEQ ID NO: 1966660 - DNA, 18 bp, Homo sapiens
aacatttaggagaagttg

SEQ ID NO: 1966661 - DNA, 11 bp, Homo sapiens
aacattttgtt

SEQ ID NO: 1966662 - DNA, 15 bp, Homo sapiens
aaccaacccatgtat

SEQ ID NO: 1966663 - DNA, 21 bp, Homo sapiens
aacccaggccacaaatgtgtc

SEQ ID NO: 1966664 - DNA, 12 bp, Homo sapiens
aaccgtccctga

SEQ ID NO: 1966665 - DNA, 11 bp, Homo sapiens
aacctgcattt

SEQ ID NO: 1966666 - DNA, 21 bp, Homo sapiens
aactaaggaaccctggaaact

SEQ ID NO: 1966667 - DNA, 16 bp, Homo sapiens
aactaccagtgggcat

SEQ ID NO: 1966668 - DNA, 18 bp, Homo sapiens
aactaccagtgggcatgt

SEQ ID NO: 1966669 - DNA, 17 bp, Homo sapiens
aactcctactgcttcct

SEQ ID NO: 1966670 - DNA, 22 bp, Homo sapiens
aagaaaatgaatttgactggtt

SEQ ID NO: 1966671 - DNA, 12 bp, Homo sapiens
aagaaacaaaaa

SEQ ID NO: 1966672 - DNA, 14 bp, Homo sapiens
aagaaacaatttaa

SEQ ID NO: 1966673 - DNA, 21 bp, Homo sapiens
aagaaacccttccacgtgtat

SEQ ID NO: 1966674 - DNA, 14 bp, Homo sapiens
aagaaatcaatttt

SEQ ID NO: 1966675 - DNA, 15 bp, Homo sapiens
aagaaatcaattttt

SEQ ID NO: 1966676 - DNA, 13 bp, Homo sapiens
aagaagaaaacac

SEQ ID NO: 1966677 - DNA, 19 bp, Homo sapiens
aagaagtttgggctaacat

SEQ ID NO: 1966678 - DNA, 17 bp, Homo sapiens
aagcaggtttcttgctt

SEQ ID NO: 1966679 - DNA, 16 bp, Homo sapiens
aagcattttcagcatc

SEQ ID NO: 1966680 - DNA, 22 bp, Homo sapiens
aagctgggactcattcacattt

SEQ ID NO: 1966681 - DNA, 20 bp, Homo sapiens
aagctgtgtctctgtatata

SEQ ID NO: 1966682 - DNA, 17 bp, Homo sapiens
aagtgagtggcatgtgg

SEQ ID NO: 1966683 - DNA, 17 bp, Homo sapiens
aagtgggtttcaattta

SEQ ID NO: 1966684 - DNA, 18 bp, Homo sapiens
aagttaaggtatctggta

SEQ ID NO: 1966685 - DNA, 17 bp, Homo sapiens
aagtttgggctaacatt

SEQ ID NO: 1966686 - DNA, 18 bp, Homo sapiens
aagtttgggctaacattt

SEQ ID NO: 1966687 - DNA, 19 bp, Homo sapiens
aagtttgggctaacattta

SEQ ID NO: 1966688 - DNA, 14 bp, Homo sapiens
aataaaccttgttt

SEQ ID NO: 1966689 - DNA, 17 bp, Homo sapiens
aataaaccttgtttctt

SEQ ID NO: 1966690 - DNA, 22 bp, Homo sapiens
aataaaccttgtttctttctga

SEQ ID NO: 1966691 - DNA, 21 bp, Homo sapiens
aatatagttgtctttctttgc

SEQ ID NO: 1966692 - DNA, 22 bp, Homo sapiens
aatatagttgtctttctttgct

SEQ ID NO: 1966693 - DNA, 14 bp, Homo sapiens
aatattaagaaaca

SEQ ID NO: 1966694 - DNA, 19 bp, Homo sapiens
aatattaagaaacaattta

SEQ ID NO: 1966695 - DNA, 19 bp, Homo sapiens
aatattctgataatgtatt

SEQ ID NO: 1966696 - DNA, 13 bp, Homo sapiens
aatattggtttgt

SEQ ID NO: 1966697 - DNA, 22 bp, Homo sapiens
aatcacaaaagctgtgtctctg

SEQ ID NO: 1966698 - DNA, 19 bp, Homo sapiens
aatcataacatagttgaaa

SEQ ID NO: 1966699 - DNA, 17 bp, Homo sapiens
aatcgtttttgctgcag

SEQ ID NO: 1966700 - DNA, 19 bp, Homo sapiens
aatcgtttttgctgcagag

SEQ ID NO: 1966701 - DNA, 19 bp, Homo sapiens
aatctgttgtttgaagaac

SEQ ID NO: 1966702 - DNA, 16 bp, Homo sapiens
aatcttagctgccaag

SEQ ID NO: 1966703 - DNA, 15 bp, Homo sapiens
aatcttcagctggtg

SEQ ID NO: 1966704 - DNA, 23 bp, Homo sapiens
aatcttcagctggtggatggtga

SEQ ID NO: 1966705 - DNA, 15 bp, Homo sapiens
aatgatttttgtgta

SEQ ID NO: 1966706 - DNA, 18 bp, Homo sapiens
aatgcagaggaggagaaa

SEQ ID NO: 1966707 - DNA, 19 bp, Homo sapiens
aatgcttgccaagaaatcg

SEQ ID NO: 1966708 - DNA, 13 bp, Homo sapiens
aatggaagaaacc

SEQ ID NO: 1966709 - DNA, 15 bp, Homo sapiens
aatgtcattatttga

SEQ ID NO: 1966710 - DNA, 20 bp, Homo sapiens
aatgtcattatttgataaca

SEQ ID NO: 1966711 - DNA, 15 bp, Homo sapiens
aatgtgatcatcttt

SEQ ID NO: 1966712 - DNA, 19 bp, Homo sapiens
aatgtgtctgcaacatgga

SEQ ID NO: 1966713 - DNA, 21 bp, Homo sapiens
aatgtgtctgcaacatggatt

SEQ ID NO: 1966714 - DNA, 23 bp, Homo sapiens
aatgtgtctgcaacatggattcc

SEQ ID NO: 1966715 - DNA, 15 bp, Homo sapiens
aatgttggtgcaatt

SEQ ID NO: 1966716 - DNA, 17 bp, Homo sapiens
aatgttggtgcaattaa

SEQ ID NO: 1966717 - DNA, 14 bp, Homo sapiens
aattaactctggac

SEQ ID NO: 1966718 - DNA, 13 bp, Homo sapiens
aattggtcattcc

SEQ ID NO: 1966719 - DNA, 23 bp, Homo sapiens
aatttactttttaaacagtgttt

SEQ ID NO: 1966720 - DNA, 15 bp, Homo sapiens
aatttagtcattatt

SEQ ID NO: 1966721 - DNA, 13 bp, Homo sapiens
aatttctgccctg

SEQ ID NO: 1966722 - DNA, 14 bp, Homo sapiens
acaaccaggtcttg

SEQ ID NO: 1966723 - DNA, 16 bp, Homo sapiens
acaacctttcccattt

SEQ ID NO: 1966724 - DNA, 20 bp, Homo sapiens
acaagttaaggtatctggta

SEQ ID NO: 1966725 - DNA, 18 bp, Homo sapiens
acaatccaaatgcattca

SEQ ID NO: 1966726 - DNA, 22 bp, Homo sapiens
acaatccaaatgcattcatgtt

SEQ ID NO: 1966727 - DNA, 14 bp, Homo sapiens
acaatttaaattgt

SEQ ID NO: 1966728 - DNA, 18 bp, Homo sapiens
acagtcattatttaaagc

SEQ ID NO: 1966729 - DNA, 22 bp, Homo sapiens
acagtcattatttaaagcacat

SEQ ID NO: 1966730 - DNA, 20 bp, Homo sapiens
acagtctcaattttgtattt

SEQ ID NO: 1966731 - DNA, 16 bp, Homo sapiens
acagtgaatttaagca

SEQ ID NO: 1966732 - DNA, 16 bp, Homo sapiens
acagttcataaatttg

SEQ ID NO: 1966733 - DNA, 20 bp, Homo sapiens
acataacaacctttcccatt

SEQ ID NO: 1966734 - DNA, 21 bp, Homo sapiens
acataacaacctttcccattt

SEQ ID NO: 1966735 - DNA, 22 bp, Homo sapiens
acatattaagaatagtctctgg

SEQ ID NO: 1966736 - DNA, 19 bp, Homo sapiens
acatcattggataaatttg

SEQ ID NO: 1966737 - DNA, 12 bp, Homo sapiens
acatctaaattg

SEQ ID NO: 1966738 - DNA, 18 bp, Homo sapiens
acatctaaattgatcatt

SEQ ID NO: 1966739 - DNA, 21 bp, Homo sapiens
acatctaaattgatcattcat

SEQ ID NO: 1966740 - DNA, 14 bp, Homo sapiens
acatgaaaacattg

SEQ ID NO: 1966741 - DNA, 21 bp, Homo sapiens
acatgcttcatgaaaatccta

SEQ ID NO: 1966742 - DNA, 18 bp, Homo sapiens
acatggattccaaagcat

SEQ ID NO: 1966743 - DNA, 20 bp, Homo sapiens
acatggattccaaagcattt

SEQ ID NO: 1966744 - DNA, 18 bp, Homo sapiens
acatgtatgtggatacag

SEQ ID NO: 1966745 - DNA, 15 bp, Homo sapiens
acatgtgcaactctt

SEQ ID NO: 1966746 - DNA, 19 bp, Homo sapiens
acatgtgcaactcttgtat

SEQ ID NO: 1966747 - DNA, 19 bp, Homo sapiens
acatttcaagatccaaatg

SEQ ID NO: 1966748 - DNA, 20 bp, Homo sapiens
accaaaaattgcgagccttt

SEQ ID NO: 1966749 - DNA, 19 bp, Homo sapiens
accaaattttgaggtcttt

SEQ ID NO: 1966750 - DNA, 21 bp, Homo sapiens
accaaattttgaggtctttta

SEQ ID NO: 1966751 - DNA, 14 bp, Homo sapiens
accaacccatgtat

SEQ ID NO: 1966752 - DNA, 12 bp, Homo sapiens
accacctcatgt

SEQ ID NO: 1966753 - DNA, 16 bp, Homo sapiens
accacctcatgtcatt

SEQ ID NO: 1966754 - DNA, 22 bp, Homo sapiens
accactaatgcttgccaagaaa

SEQ ID NO: 1966755 - DNA, 24 bp, Homo sapiens
accctggaaactaccagtgggcat

SEQ ID NO: 1966756 - DNA, 11 bp, Homo sapiens
accgtccctga

SEQ ID NO: 1966757 - DNA, 23 bp, Homo sapiens
acctcgtgtctagtagaacaatg

SEQ ID NO: 1966758 - DNA, 15 bp, Homo sapiens
acctgaactctgcaa

SEQ ID NO: 1966759 - DNA, 23 bp, Homo sapiens
acctgcatatctctagtccctgt

SEQ ID NO: 1966760 - DNA, 10 bp, Homo sapiens
acctgcattt

SEQ ID NO: 1966761 - DNA, 16 bp, Homo sapiens
accttgtttctttctg

SEQ ID NO: 1966762 - DNA, 15 bp, Homo sapiens
acctttaaagagccc

SEQ ID NO: 1966763 - DNA, 13 bp, Homo sapiens
acctttatgaggt

SEQ ID NO: 1966764 - DNA, 16 bp, Homo sapiens
acctttcccatttcgt

SEQ ID NO: 1966765 - DNA, 16 bp, Homo sapiens
acggctctccagacct

SEQ ID NO: 1966766 - DNA, 18 bp, Homo sapiens
actaccagtgggcatgta

SEQ ID NO: 1966767 - DNA, 19 bp, Homo sapiens
actcaagcaggtttcttgc

SEQ ID NO: 1966768 - DNA, 17 bp, Homo sapiens
actcattcacatttcaa

SEQ ID NO: 1966769 - DNA, 19 bp, Homo sapiens
actctaattggtcattcct

SEQ ID NO: 1966770 - DNA, 21 bp, Homo sapiens
actctgcaactgaatacttga

SEQ ID NO: 1966771 - DNA, 23 bp, Homo sapiens
actcttaccatcccggtgcatgc

SEQ ID NO: 1966772 - DNA, 14 bp, Homo sapiens
actgaatacttgaa

SEQ ID NO: 1966773 - DNA, 23 bp, Homo sapiens
actggagagtggcaaaagtctga

SEQ ID NO: 1966774 - DNA, 22 bp, Homo sapiens
actggatccatccgtccagcca

SEQ ID NO: 1966775 - DNA, 23 bp, Homo sapiens
acttttgaagaacaaaaggcttt

SEQ ID NO: 1966776 - DNA, 22 bp, Homo sapiens
actttttaaacagtgtttatga

SEQ ID NO: 1966777 - DNA, 21 bp, Homo sapiens
agaaaatgaatttgactggtt

SEQ ID NO: 1966778 - DNA, 24 bp, Homo sapiens
agaaaatgtgtctgcaacatggat

SEQ ID NO: 1966779 - DNA, 13 bp, Homo sapiens
agaaatcaatttt

SEQ ID NO: 1966780 - DNA, 15 bp, Homo sapiens
agaaccgcattttga

SEQ ID NO: 1966781 - DNA, 22 bp, Homo sapiens
agaactgaaggggagttttcac

SEQ ID NO: 1966782 - DNA, 22 bp, Homo sapiens
agaagctgggactcattcacat

SEQ ID NO: 1966783 - DNA, 14 bp, Homo sapiens
agaagtaagcagag

SEQ ID NO: 1966784 - DNA, 22 bp, Homo sapiens
agaagtttgggctaacatttag

SEQ ID NO: 1966785 - DNA, 10 bp, Homo sapiens
agacaaacac

SEQ ID NO: 1966786 - DNA, 14 bp, Homo sapiens
agaccaaattttga

SEQ ID NO: 1966787 - DNA, 15 bp, Homo sapiens
agagaagtaagcaga

SEQ ID NO: 1966788 - DNA, 23 bp, Homo sapiens
agagatatttaaaagacaaacac

SEQ ID NO: 1966789 - DNA, 21 bp, Homo sapiens
agataacggctctccagacct

SEQ ID NO: 1966790 - DNA, 20 bp, Homo sapiens
agatccaaatgctgtgcaaa

SEQ ID NO: 1966791 - DNA, 23 bp, Homo sapiens
agatgaaaacctgcatttttaaa

SEQ ID NO: 1966792 - DNA, 15 bp, Homo sapiens
agatgtccctgaagt

SEQ ID NO: 1966793 - DNA, 21 bp, Homo sapiens
agatgtccctgaagtcttgca

SEQ ID NO: 1966794 - DNA, 23 bp, Homo sapiens
agcaagtaggaatcgtttttgct

SEQ ID NO: 1966795 - DNA, 20 bp, Homo sapiens
agcacatgccagggaaaaag

SEQ ID NO: 1966796 - DNA, 22 bp, Homo sapiens
agcacattttgacacaatgttg

SEQ ID NO: 1966797 - DNA, 16 bp, Homo sapiens
agcagagttctttgca

SEQ ID NO: 1966798 - DNA, 23 bp, Homo sapiens
agcagagttctttgcaagcttat

SEQ ID NO: 1966799 - DNA, 14 bp, Homo sapiens
agcatcaaacatga

SEQ ID NO: 1966800 - DNA, 16 bp, Homo sapiens
agcatcaaacatgaaa

SEQ ID NO: 1966801 - DNA, 23 bp, Homo sapiens
agccagtcattgtaacctcgtgt

SEQ ID NO: 1966802 - DNA, 19 bp, Homo sapiens
agctagctatttctatgta

SEQ ID NO: 1966803 - DNA, 22 bp, Homo sapiens
agctagctatttctatgtatgt

SEQ ID NO: 1966804 - DNA, 19 bp, Homo sapiens
agctccagtggaagaagaa

SEQ ID NO: 1966805 - DNA, 17 bp, Homo sapiens
agctctacacaacatgt

SEQ ID NO: 1966806 - DNA, 12 bp, Homo sapiens
agctggtggatg

SEQ ID NO: 1966807 - DNA, 17 bp, Homo sapiens
agctggtggatggtgac

SEQ ID NO: 1966808 - DNA, 13 bp, Homo sapiens
agctgtgtctctg

SEQ ID NO: 1966809 - DNA, 14 bp, Homo sapiens
agctgtgtctctgt

SEQ ID NO: 1966810 - DNA, 18 bp, Homo sapiens
agcttagattttctgtaa

SEQ ID NO: 1966811 - DNA, 22 bp, Homo sapiens
agcttagattttctgtaaatga

SEQ ID NO: 1966812 - DNA, 18 bp, Homo sapiens
agcttatttagcacattt

SEQ ID NO: 1966813 - DNA, 11 bp, Homo sapiens
aggagaagttg

SEQ ID NO: 1966814 - DNA, 12 bp, Homo sapiens
aggaggctccca

SEQ ID NO: 1966815 - DNA, 22 bp, Homo sapiens
aggctttggcaacagaaaacaa

SEQ ID NO: 1966816 - DNA, 13 bp, Homo sapiens
agggaacatgcag

SEQ ID NO: 1966817 - DNA, 16 bp, Homo sapiens
agggaacatgcagctc

SEQ ID NO: 1966818 - DNA, 18 bp, Homo sapiens
agggctgaataaagggaa

SEQ ID NO: 1966819 - DNA, 16 bp, Homo sapiens
aggtcttgacctgaac

SEQ ID NO: 1966820 - DNA, 23 bp, Homo sapiens
aggtcttgacctgaactctgcaa

SEQ ID NO: 1966821 - DNA, 20 bp, Homo sapiens
aggtcttggttagagaagta

SEQ ID NO: 1966822 - DNA, 15 bp, Homo sapiens
aggttggaaaagaaa

SEQ ID NO: 1966823 - DNA, 18 bp, Homo sapiens
aggttggaaaagaaatca

SEQ ID NO: 1966824 - DNA, 13 bp, Homo sapiens
agtactttgtgct

SEQ ID NO: 1966825 - DNA, 13 bp, Homo sapiens
agtataacaaact

SEQ ID NO: 1966826 - DNA, 19 bp, Homo sapiens
agtctcaattttgtattta

SEQ ID NO: 1966827 - DNA, 12 bp, Homo sapiens
agtgagtggcat

SEQ ID NO: 1966828 - DNA, 16 bp, Homo sapiens
agtgagtggcatgtgg

SEQ ID NO: 1966829 - DNA, 23 bp, Homo sapiens
agtgatatggtactaaggagaat

SEQ ID NO: 1966830 - DNA, 16 bp, Homo sapiens
agtgcttcttgtaata

SEQ ID NO: 1966831 - DNA, 15 bp, Homo sapiens
agtgggagatgaaaa

SEQ ID NO: 1966832 - DNA, 15 bp, Homo sapiens
agtgggcatgtatta

SEQ ID NO: 1966833 - DNA, 18 bp, Homo sapiens
agttccagttttgttttg

SEQ ID NO: 1966834 - DNA, 15 bp, Homo sapiens
agttctttgcaagct

SEQ ID NO: 1966835 - DNA, 21 bp, Homo sapiens
agttggtcttactttgtgcaa

SEQ ID NO: 1966836 - DNA, 15 bp, Homo sapiens
agttgtctttctttg

SEQ ID NO: 1966837 - DNA, 17 bp, Homo sapiens
agttgtctttctttgct

SEQ ID NO: 1966838 - DNA, 16 bp, Homo sapiens
ataaagggaacatgca

SEQ ID NO: 1966839 - DNA, 20 bp, Homo sapiens
ataaagggaacatgcagctc

SEQ ID NO: 1966840 - DNA, 17 bp, Homo sapiens
ataaatttgttgtcatg

SEQ ID NO: 1966841 - DNA, 22 bp, Homo sapiens
ataaatttgttgtcatgtgtat

SEQ ID NO: 1966842 - DNA, 12 bp, Homo sapiens
ataacatagttg

SEQ ID NO: 1966843 - DNA, 23 bp, Homo sapiens
ataacatagttgaaaaaagaagt

SEQ ID NO: 1966844 - DNA, 17 bp, Homo sapiens
ataacattttgtttatg

SEQ ID NO: 1966845 - DNA, 22 bp, Homo sapiens
ataacattttgtttatgttact

SEQ ID NO: 1966846 - DNA, 12 bp, Homo sapiens
ataacttcataa

SEQ ID NO: 1966847 - DNA, 21 bp, Homo sapiens
atacagtcattatttaaagca

SEQ ID NO: 1966848 - DNA, 20 bp, Homo sapiens
atacgccagaactgctttat

SEQ ID NO: 1966849 - DNA, 16 bp, Homo sapiens
atagagatatttaaaa

SEQ ID NO: 1966850 - DNA, 18 bp, Homo sapiens
atagagatatttaaaaga

SEQ ID NO: 1966851 - DNA, 15 bp, Homo sapiens
atagcaacatgcttc

SEQ ID NO: 1966852 - DNA, 22 bp, Homo sapiens
atagctagctatttctatgtat

SEQ ID NO: 1966853 - DNA, 17 bp, Homo sapiens
atagctctacacaacat

SEQ ID NO: 1966854 - DNA, 19 bp, Homo sapiens
atagctctacacaacatgt

SEQ ID NO: 1966855 - DNA, 20 bp, Homo sapiens
atagctctacacaacatgta

SEQ ID NO: 1966856 - DNA, 18 bp, Homo sapiens
atagtgcttcttgtaata

SEQ ID NO: 1966857 - DNA, 23 bp, Homo sapiens
atagttgtctttctttgctgctg

SEQ ID NO: 1966858 - DNA, 23 bp, Homo sapiens
atatagctctacacaacatgtat

SEQ ID NO: 1966859 - DNA, 19 bp, Homo sapiens
atatggtactaaggagaat

SEQ ID NO: 1966860 - DNA, 18 bp, Homo sapiens
atattaagaaacaattta

SEQ ID NO: 1966861 - DNA, 14 bp, Homo sapiens
atattctctgatgt

SEQ ID NO: 1966862 - DNA, 24 bp, Homo sapiens
atattctgataatgtattgcagtg

SEQ ID NO: 1966863 - DNA, 14 bp, Homo sapiens
atattgaccatgtg

SEQ ID NO: 1966864 - DNA, 15 bp, Homo sapiens
atattgaccatgtga

SEQ ID NO: 1966865 - DNA, 20 bp, Homo sapiens
atattggtttgttattcttt

SEQ ID NO: 1966866 - DNA, 23 bp, Homo sapiens
atatttcttcaagtgagtggcat

SEQ ID NO: 1966867 - DNA, 15 bp, Homo sapiens
atcaaacatgaaaac

SEQ ID NO: 1966868 - DNA, 19 bp, Homo sapiens
atcacaaaagctgtgtctc

SEQ ID NO: 1966869 - DNA, 17 bp, Homo sapiens
atcataacatagttgaa

SEQ ID NO: 1966870 - DNA, 14 bp, Homo sapiens
atcctaccaacctc

SEQ ID NO: 1966871 - DNA, 15 bp, Homo sapiens
atcctccatttttgt

SEQ ID NO: 1966872 - DNA, 17 bp, Homo sapiens
atcgatatgaaaaataa

SEQ ID NO: 1966873 - DNA, 15 bp, Homo sapiens
atcgccttatgagaa

SEQ ID NO: 1966874 - DNA, 22 bp, Homo sapiens
atcgccttatgagaacatggtg

SEQ ID NO: 1966875 - DNA, 18 bp, Homo sapiens
atcgccttatttatattc

SEQ ID NO: 1966876 - DNA, 18 bp, Homo sapiens
atcgtttttgctgcagag

SEQ ID NO: 1966877 - DNA, 18 bp, Homo sapiens
atctacccagtcatgtac

SEQ ID NO: 1966878 - DNA, 22 bp, Homo sapiens
atctatagataacggctctcca

SEQ ID NO: 1966879 - DNA, 22 bp, Homo sapiens
atctgcaatgtttttgtgtaga

SEQ ID NO: 1966880 - DNA, 23 bp, Homo sapiens
atctgcatgtaaaatcttcagct

SEQ ID NO: 1966881 - DNA, 13 bp, Homo sapiens
atctgttgtttga

SEQ ID NO: 1966882 - DNA, 14 bp, Homo sapiens
atctgttgtttgaa

SEQ ID NO: 1966883 - DNA, 16 bp, Homo sapiens
atcttagctgccaagt

SEQ ID NO: 1966884 - DNA, 20 bp, Homo sapiens
atcttcagctggtggatggt

SEQ ID NO: 1966885 - DNA, 11 bp, Homo sapiens
atgaaaacatt

SEQ ID NO: 1966886 - DNA, 15 bp, Homo sapiens
atgaaaacattgatg

SEQ ID NO: 1966887 - DNA, 21 bp, Homo sapiens
atgaaaatcctaccaacctct

SEQ ID NO: 1966888 - DNA, 21 bp, Homo sapiens
atgaggaacaatcacaaaagc

SEQ ID NO: 1966889 - DNA, 21 bp, Homo sapiens
atgatttttgtgtatccagta

SEQ ID NO: 1966890 - DNA, 18 bp, Homo sapiens
atgcacgttaacagcgtg

SEQ ID NO: 1966891 - DNA, 17 bp, Homo sapiens
atgcgggcattttgaat

SEQ ID NO: 1966892 - DNA, 21 bp, Homo sapiens
atgctgcccagggtcagtgta

SEQ ID NO: 1966893 - DNA, 18 bp, Homo sapiens
atgcttcatgaaaatcct

SEQ ID NO: 1966894 - DNA, 22 bp, Homo sapiens
atgcttcatgaaaatcctacca

SEQ ID NO: 1966895 - DNA, 14 bp, Homo sapiens
atggaaaggaagaa

SEQ ID NO: 1966896 - DNA, 19 bp, Homo sapiens
atggacatcgatatgaaaa

SEQ ID NO: 1966897 - DNA, 13 bp, Homo sapiens
atggagtgtttga

SEQ ID NO: 1966898 - DNA, 17 bp, Homo sapiens
atggatttggttatgat

SEQ ID NO: 1966899 - DNA, 17 bp, Homo sapiens
atggtactaaggagaat

SEQ ID NO: 1966900 - DNA, 16 bp, Homo sapiens
atggtgtgtgtctctg

SEQ ID NO: 1966901 - DNA, 24 bp, Homo sapiens
atgtaaaatcttcagctggtggat

SEQ ID NO: 1966902 - DNA, 21 bp, Homo sapiens
atgtacagtctcaattttgta

SEQ ID NO: 1966903 - DNA, 21 bp, Homo sapiens
atgtattgcagtgcggctcac

SEQ ID NO: 1966904 - DNA, 22 bp, Homo sapiens
atgtcattatttgataacattt

SEQ ID NO: 1966905 - DNA, 18 bp, Homo sapiens
atgtgatcatctttgctg

SEQ ID NO: 1966906 - DNA, 14 bp, Homo sapiens
atgtgccaattttg

SEQ ID NO: 1966907 - DNA, 14 bp, Homo sapiens
atgtgggttgtgat

SEQ ID NO: 1966908 - DNA, 18 bp, Homo sapiens
atgtgggttgtgatattg

SEQ ID NO: 1966909 - DNA, 13 bp, Homo sapiens
atgtgtctgcaac

SEQ ID NO: 1966910 - DNA, 16 bp, Homo sapiens
atgttttaaaagtttg

SEQ ID NO: 1966911 - DNA, 21 bp, Homo sapiens
attaaattctctctaacataa

SEQ ID NO: 1966912 - DNA, 24 bp, Homo sapiens
attaaattctctctaacataacaa

SEQ ID NO: 1966913 - DNA, 14 bp, Homo sapiens
attagccagtcatt

SEQ ID NO: 1966914 - DNA, 21 bp, Homo sapiens
attcacatttcaagatccaaa

SEQ ID NO: 1966915 - DNA, 14 bp, Homo sapiens
attcatcaaataaa

SEQ ID NO: 1966916 - DNA, 19 bp, Homo sapiens
attcatcaaataaaccttg

SEQ ID NO: 1966917 - DNA, 21 bp, Homo sapiens
attcatgttttaaaagtttgt

SEQ ID NO: 1966918 - DNA, 15 bp, Homo sapiens
attctaaacagatgt

SEQ ID NO: 1966919 - DNA, 17 bp, Homo sapiens
attctctctaacataac

SEQ ID NO: 1966920 - DNA, 17 bp, Homo sapiens
attctgataatgtattg

SEQ ID NO: 1966921 - DNA, 20 bp, Homo sapiens
attctttcttggtgcattcg

SEQ ID NO: 1966922 - DNA, 14 bp, Homo sapiens
attcttttccagaa

SEQ ID NO: 1966923 - DNA, 13 bp, Homo sapiens
attgaatgctgcc

SEQ ID NO: 1966924 - DNA, 15 bp, Homo sapiens
attgatcattcataa

SEQ ID NO: 1966925 - DNA, 20 bp, Homo sapiens
attgctccattttcttgtca

SEQ ID NO: 1966926 - DNA, 23 bp, Homo sapiens
attggtttgttattcttttccag

SEQ ID NO: 1966927 - DNA, 19 bp, Homo sapiens
atttaagcatgagtggcct

SEQ ID NO: 1966928 - DNA, 17 bp, Homo sapiens
atttactttttaaacag

SEQ ID NO: 1966929 - DNA, 14 bp, Homo sapiens
atttaggagaagtt

SEQ ID NO: 1966930 - DNA, 17 bp, Homo sapiens
atttagtcccttaaaaa

SEQ ID NO: 1966931 - DNA, 16 bp, Homo sapiens
atttatattcatcaaa

SEQ ID NO: 1966932 - DNA, 14 bp, Homo sapiens
atttcaagatccaa

SEQ ID NO: 1966933 - DNA, 18 bp, Homo sapiens
atttcctttgcgcaaact

SEQ ID NO: 1966934 - DNA, 20 bp, Homo sapiens
atttcgtgtaatattctctg

SEQ ID NO: 1966935 - DNA, 20 bp, Homo sapiens
atttctatgtatgtgccaat

SEQ ID NO: 1966936 - DNA, 17 bp, Homo sapiens
atttctgccctgagccc

SEQ ID NO: 1966937 - DNA, 15 bp, Homo sapiens
atttgataacatttt

SEQ ID NO: 1966938 - DNA, 16 bp, Homo sapiens
atttgatttcgatgta

SEQ ID NO: 1966939 - DNA, 16 bp, Homo sapiens
atttgttgtcatgtgt

SEQ ID NO: 1966940 - DNA, 22 bp, Homo sapiens
attttatctacccagtcatgta

SEQ ID NO: 1966941 - DNA, 22 bp, Homo sapiens
attttcagcatcaaacatgaaa

SEQ ID NO: 1966942 - DNA, 20 bp, Homo sapiens
attttctgcccaactttcat

SEQ ID NO: 1966943 - DNA, 17 bp, Homo sapiens
attttctgtaaatgaag

SEQ ID NO: 1966944 - DNA, 14 bp, Homo sapiens
attttcttgtcaat

SEQ ID NO: 1966945 - DNA, 12 bp, Homo sapiens
attttgaatgtg

SEQ ID NO: 1966946 - DNA, 20 bp, Homo sapiens
attttgagggtgtaaccagt

SEQ ID NO: 1966947 - DNA, 19 bp, Homo sapiens
atttttaaaggacaaacag

SEQ ID NO: 1966948 - DNA, 20 bp, Homo sapiens
atttttaaaggacaaacagt

SEQ ID NO: 1966949 - DNA, 23 bp, Homo sapiens
atttttaaaggacaaacagtgaa

SEQ ID NO: 1966950 - DNA, 12 bp, Homo sapiens
atttttgtgtat

SEQ ID NO: 1966951 - DNA, 20 bp, Homo sapiens
caaacagtgaatttaagcat

SEQ ID NO: 1966952 - DNA, 18 bp, Homo sapiens
caaacatgaaaacattga

SEQ ID NO: 1966953 - DNA, 15 bp, Homo sapiens
caaactttaacaggt

SEQ ID NO: 1966954 - DNA, 14 bp, Homo sapiens
caaagttccagttt

SEQ ID NO: 1966955 - DNA, 14 bp, Homo sapiens
caacagaaaacaat

SEQ ID NO: 1966956 - DNA, 17 bp, Homo sapiens
caacatgtatgtggata

SEQ ID NO: 1966957 - DNA, 14 bp, Homo sapiens
caactcttgtattg

SEQ ID NO: 1966958 - DNA, 23 bp, Homo sapiens
caactttcatttgaaagtgggtt

SEQ ID NO: 1966959 - DNA, 21 bp, Homo sapiens
caagaaatcgccttatgagaa

SEQ ID NO: 1966960 - DNA, 23 bp, Homo sapiens
caagtaaatagcaacatgcttca

SEQ ID NO: 1966961 - DNA, 18 bp, Homo sapiens
caagtgggagatgaaaac

SEQ ID NO: 1966962 - DNA, 22 bp, Homo sapiens
caagttaaggtatctggtatct

SEQ ID NO: 1966963 - DNA, 15 bp, Homo sapiens
caatccaaatgcatt

SEQ ID NO: 1966964 - DNA, 16 bp, Homo sapiens
caatccaaatgcattc

SEQ ID NO: 1966965 - DNA, 19 bp, Homo sapiens
caatgttgcactgaaaacc

SEQ ID NO: 1966966 - DNA, 15 bp, Homo sapiens
caatgtttttgtgta

SEQ ID NO: 1966967 - DNA, 20 bp, Homo sapiens
caatgtttttgtgtagagtg

SEQ ID NO: 1966968 - DNA, 21 bp, Homo sapiens
caatttactttttaaacagtg

SEQ ID NO: 1966969 - DNA, 14 bp, Homo sapiens
caattttgtcacag

SEQ ID NO: 1966970 - DNA, 14 bp, Homo sapiens
caattttttaaacc

SEQ ID NO: 1966971 - DNA, 14 bp, Homo sapiens
cacaaatgtgtccc

SEQ ID NO: 1966972 - DNA, 20 bp, Homo sapiens
cacaaatgtgtcccagtgaa

SEQ ID NO: 1966973 - DNA, 21 bp, Homo sapiens
cacatattaagaatagtctct

SEQ ID NO: 1966974 - DNA, 14 bp, Homo sapiens
cacattttgacaca

SEQ ID NO: 1966975 - DNA, 19 bp, Homo sapiens
cactgcctcctacaaccag

SEQ ID NO: 1966976 - DNA, 16 bp, Homo sapiens
cactgtgatgttggga

SEQ ID NO: 1966977 - DNA, 19 bp, Homo sapiens
cagaaagaaaatgaatttg

SEQ ID NO: 1966978 - DNA, 13 bp, Homo sapiens
cagaactgcttta

SEQ ID NO: 1966979 - DNA, 12 bp, Homo sapiens
cagacctgagct

SEQ ID NO: 1966980 - DNA, 16 bp, Homo sapiens
cagagttctttgcaag

SEQ ID NO: 1966981 - DNA, 14 bp, Homo sapiens
ccttcagatcctac

SEQ ID NO: 1966982 - DNA, 20 bp, Homo sapiens
ccttgtttctttctgaagtg

SEQ ID NO: 1966983 - DNA, 15 bp, Homo sapiens
cggctctccagacct

SEQ ID NO: 1966984 - DNA, 22 bp, Homo sapiens
cgtataatttagtcccttaaaa

SEQ ID NO: 1966985 - DNA, 15 bp, Homo sapiens
cgtccagccaagagc

SEQ ID NO: 1966986 - DNA, 16 bp, Homo sapiens
ctaacccagcagtaac

SEQ ID NO: 1966987 - DNA, 22 bp, Homo sapiens
ctacacaacatgtatgtggata

SEQ ID NO: 1966988 - DNA, 15 bp, Homo sapiens
ctaccagtgggcatg

SEQ ID NO: 1966989 - DNA, 15 bp, Homo sapiens
ctagtagaacaatgt

SEQ ID NO: 1966990 - DNA, 19 bp, Homo sapiens
ctatgtaatgcttatgtgt

SEQ ID NO: 1966991 - DNA, 13 bp, Homo sapiens
ctcaagcaggttt

SEQ ID NO: 1966992 - DNA, 21 bp, Homo sapiens
ctcaattttgtatttaatgat

SEQ ID NO: 1966993 - DNA, 17 bp, Homo sapiens
ctcatgtcatttctcat

SEQ ID NO: 1966994 - DNA, 21 bp, Homo sapiens
ctcatgtcatttctcatggat

SEQ ID NO: 1966995 - DNA, 14 bp, Homo sapiens
ctccattttcttgt

SEQ ID NO: 1966996 - DNA, 17 bp, Homo sapiens
ctcctaacccagcagta

SEQ ID NO: 1966997 - DNA, 12 bp, Homo sapiens
ctcgtttgatag

SEQ ID NO: 1966998 - DNA, 15 bp, Homo sapiens
ctctacacaacatgt

SEQ ID NO: 1966999 - DNA, 23 bp, Homo sapiens
ctctacacaacatgtatgtggat

SEQ ID NO: 1967000 - DNA, 21 bp, Homo sapiens
ctctagtccctgtgttctgca

SEQ ID NO: 1967001 - DNA, 14 bp, Homo sapiens
ctctccagacctga

SEQ ID NO: 1967002 - DNA, 12 bp, Homo sapiens
ctctctaacata

SEQ ID NO: 1967003 - DNA, 13 bp, Homo sapiens
ctctctaacataa

SEQ ID NO: 1967004 - DNA, 19 bp, Homo sapiens
ctctgaatattaagaaaca

SEQ ID NO: 1967005 - DNA, 17 bp, Homo sapiens
ctctgcagcaatattct

SEQ ID NO: 1967006 - DNA, 21 bp, Homo sapiens
ctctgggtttacaacaaacac

SEQ ID NO: 1967007 - DNA, 22 bp, Homo sapiens
ctcttgtattgctccattttct

SEQ ID NO: 1967008 - DNA, 23 bp, Homo sapiens
ctcttgtattgctccattttctt

SEQ ID NO: 1967009 - DNA, 23 bp, Homo sapiens
ctgaaaacccaggccacaaatgt

SEQ ID NO: 1967010 - DNA, 14 bp, Homo sapiens
ctgaataaagggaa

SEQ ID NO: 1967011 - DNA, 19 bp, Homo sapiens
ctgaatacttgaagtagga

SEQ ID NO: 1967012 - DNA, 14 bp, Homo sapiens
ctgaatattaagaa

SEQ ID NO: 1967013 - DNA, 15 bp, Homo sapiens
ctgaatgtcattatt

SEQ ID NO: 1967014 - DNA, 19 bp, Homo sapiens
ctgacaatgcgtggcacat

SEQ ID NO: 1967015 - DNA, 21 bp, Homo sapiens
ctgagctttccgcgtcagcaa

SEQ ID NO: 1967016 - DNA, 19 bp, Homo sapiens
ctgagtctggcaaacatgt

SEQ ID NO: 1967017 - DNA, 21 bp, Homo sapiens
ctgagtctggcaaacatgtgc

SEQ ID NO: 1967018 - DNA, 22 bp, Homo sapiens
ctgagtctggcaaacatgtgca

SEQ ID NO: 1967019 - DNA, 12 bp, Homo sapiens
ctgcaacatgga

SEQ ID NO: 1967020 - DNA, 18 bp, Homo sapiens
ctgcaatgtttttgtgta

SEQ ID NO: 1967021 - DNA, 21 bp, Homo sapiens
ctgcatgtaaaatcttcagct

SEQ ID NO: 1967022 - DNA, 18 bp, Homo sapiens
ctgcatttttaaaggaca

SEQ ID NO: 1967023 - DNA, 12 bp, Homo sapiens
ctgccctgagcc

SEQ ID NO: 1967024 - DNA, 14 bp, Homo sapiens
ctgccctgagccct

SEQ ID NO: 1967025 - DNA, 21 bp, Homo sapiens
ctggatccatccgtccagcca

SEQ ID NO: 1967026 - DNA, 16 bp, Homo sapiens
ctgggtttacaacaaa

SEQ ID NO: 1967027 - DNA, 12 bp, Homo sapiens
ctggtatctgca

SEQ ID NO: 1967028 - DNA, 17 bp, Homo sapiens
ctggtggatggtgactt

SEQ ID NO: 1967029 - DNA, 22 bp, Homo sapiens
ctggtggatggtgacttttgaa

SEQ ID NO: 1967030 - DNA, 14 bp, Homo sapiens
ctgtgcaaacagtg

SEQ ID NO: 1967031 - DNA, 17 bp, Homo sapiens
ctgttctacttgatatt

SEQ ID NO: 1967032 - DNA, 12 bp, Homo sapiens
ctgttgtttgaa

SEQ ID NO: 1967033 - DNA, 14 bp, Homo sapiens
ctgttgtttgaaga

SEQ ID NO: 1967034 - DNA, 13 bp, Homo sapiens
cttactttgtgca

SEQ ID NO: 1967035 - DNA, 19 bp, Homo sapiens
cttactttgtgcaaaagca

SEQ ID NO: 1967036 - DNA, 23 bp, Homo sapiens
cttatgagaacatggtgtgtgtc

SEQ ID NO: 1967037 - DNA, 14 bp, Homo sapiens
cttatgtgttgcat

SEQ ID NO: 1967038 - DNA, 18 bp, Homo sapiens
cttatttatattcatcaa

SEQ ID NO: 1967039 - DNA, 23 bp, Homo sapiens
cttatttgtcggggaagatgaaa

SEQ ID NO: 1967040 - DNA, 23 bp, Homo sapiens
cttcaccacctcatgtcatttct

SEQ ID NO: 1967041 - DNA, 15 bp, Homo sapiens
cttcagatcctaccc

SEQ ID NO: 1967042 - DNA, 14 bp, Homo sapiens
cttcagctggtgga

SEQ ID NO: 1967043 - DNA, 15 bp, Homo sapiens
cttctggctttgttc

SEQ ID NO: 1967044 - DNA, 12 bp, Homo sapiens
cttcttgtaata

SEQ ID NO: 1967045 - DNA, 15 bp, Homo sapiens
cttgtaatatttctt

SEQ ID NO: 1967046 - DNA, 20 bp, Homo sapiens
cttgtcaatggaagaaaccc

SEQ ID NO: 1967047 - DNA, 13 bp, Homo sapiens
cttgtttctttct

SEQ ID NO: 1967048 - DNA, 17 bp, Homo sapiens
ctttcatttgaaagtgg

SEQ ID NO: 1967049 - DNA, 17 bp, Homo sapiens
ctttcttggtgcattcg

SEQ ID NO: 1967050 - DNA, 18 bp, Homo sapiens
ctttgctgaatgtcatta

SEQ ID NO: 1967051 - DNA, 14 bp, Homo sapiens
ctttgctgctgtgg

SEQ ID NO: 1967052 - DNA, 16 bp, Homo sapiens
ctttgtgcaaaagcag

SEQ ID NO: 1967053 - DNA, 11 bp, Homo sapiens
ctttgtgctga

SEQ ID NO: 1967054 - DNA, 15 bp, Homo sapiens
ctttgttcttgtcat

SEQ ID NO: 1967055 - DNA, 17 bp, Homo sapiens
gaaaacattgatgaatg

SEQ ID NO: 1967056 - DNA, 18 bp, Homo sapiens
gaaaacattgatgaatga

SEQ ID NO: 1967057 - DNA, 14 bp, Homo sapiens
gaaaatcctaccaa

SEQ ID NO: 1967058 - DNA, 18 bp, Homo sapiens
gaaaatgtgtctgcaaca

SEQ ID NO: 1967059 - DNA, 22 bp, Homo sapiens
gaaaatgtgtctgcaacatgga

SEQ ID NO: 1967060 - DNA, 21 bp, Homo sapiens
gaaacaaaaaacaccaaaaat

SEQ ID NO: 1967061 - DNA, 14 bp, Homo sapiens
gaaacaatttaaat

SEQ ID NO: 1967062 - DNA, 13 bp, Homo sapiens
gaaagaaaatgaa

SEQ ID NO: 1967063 - DNA, 19 bp, Homo sapiens
gaaatacgccagaactgct

SEQ ID NO: 1967064 - DNA, 19 bp, Homo sapiens
gaaatcgccttatgagaac

SEQ ID NO: 1967065 - DNA, 21 bp, Homo sapiens
gaacacacttgggagcagtcc

SEQ ID NO: 1967066 - DNA, 19 bp, Homo sapiens
gaacatgcagctctgcagc

SEQ ID NO: 1967067 - DNA, 18 bp, Homo sapiens
gaacatggtgtgtgtctc

SEQ ID NO: 1967068 - DNA, 14 bp, Homo sapiens
taagtataacaaac

SEQ ID NO: 1967069 - DNA, 16 bp, Homo sapiens
taatctgttgtttgaa

SEQ ID NO: 1967070 - DNA, 13 bp, Homo sapiens
taatgatttttgt

SEQ ID NO: 1967071 - DNA, 16 bp, Homo sapiens
taatgatttttgtgta

SEQ ID NO: 1967072 - DNA, 17 bp, Homo sapiens
taatgatttttgtgtat

SEQ ID NO: 1967073 - DNA, 18 bp, Homo sapiens
taatgatttttgtgtatc

SEQ ID NO: 1967074 - DNA, 20 bp, Homo sapiens
taatgcttatgtgttgcata

SEQ ID NO: 1967075 - DNA, 20 bp, Homo sapiens
tacaacaaacactgtgatgt

SEQ ID NO: 1967076 - DNA, 17 bp, Homo sapiens
tacacaacatgtatgtg

SEQ ID NO: 1967077 - DNA, 21 bp, Homo sapiens
tacacaacatgtatgtggata

SEQ ID NO: 1967078 - DNA, 19 bp, Homo sapiens
tacagtctcaattttgtat

SEQ ID NO: 1967079 - DNA, 15 bp, Homo sapiens
tacagttcataaatt

SEQ ID NO: 1967080 - DNA, 15 bp, Homo sapiens
taccttcagatccta

SEQ ID NO: 1967081 - DNA, 17 bp, Homo sapiens
taccttcagatcctacc

SEQ ID NO: 1967082 - DNA, 18 bp, Homo sapiens
taccttcagatcctaccc

SEQ ID NO: 1967083 - DNA, 13 bp, Homo sapiens
tactaaggagaat

SEQ ID NO: 1967084 - DNA, 16 bp, Homo sapiens
tactgatcttaccttt

SEQ ID NO: 1967085 - DNA, 18 bp, Homo sapiens
tacttgatatttccttca

SEQ ID NO: 1967086 - DNA, 11 bp, Homo sapiens
tactttgtgct

SEQ ID NO: 1967087 - DNA, 15 bp, Homo sapiens
tagaaccactaaccc

SEQ ID NO: 1967088 - DNA, 14 bp, Homo sapiens
tagagatatttaaa

SEQ ID NO: 1967089 - DNA, 17 bp, Homo sapiens
tagataacggctctcca

SEQ ID NO: 1967090 - DNA, 15 bp, Homo sapiens
tagattttctgtaaa

SEQ ID NO: 1967091 - DNA, 15 bp, Homo sapiens
tagccagtcattgta

SEQ ID NO: 1967092 - DNA, 15 bp, Homo sapiens
tagctagctatttct

SEQ ID NO: 1967093 - DNA, 17 bp, Homo sapiens
tagctagctatttctat

SEQ ID NO: 1967094 - DNA, 18 bp, Homo sapiens
tagctagctatttctatg

SEQ ID NO: 1967095 - DNA, 19 bp, Homo sapiens
tagggaaaatagggtcctt

SEQ ID NO: 1967096 - DNA, 16 bp, Homo sapiens
tagggtccttgaaaca

SEQ ID NO: 1967097 - DNA, 20 bp, Homo sapiens
tagggtccttgaaacagaaa

SEQ ID NO: 1967098 - DNA, 14 bp, Homo sapiens
tagtagaacaatgt

SEQ ID NO: 1967099 - DNA, 15 bp, Homo sapiens
tagtcacctctgggc

SEQ ID NO: 1967100 - DNA, 18 bp, Homo sapiens
tagtctctgggtttacaa

SEQ ID NO: 1967101 - DNA, 14 bp, Homo sapiens
tagttgtctttctt

SEQ ID NO: 1967102 - DNA, 22 bp, Homo sapiens
tatagctagctatttctatgta

SEQ ID NO: 1967103 - DNA, 19 bp, Homo sapiens
tatagctctacacaacatg

SEQ ID NO: 1967104 - DNA, 19 bp, Homo sapiens
tatagttgtctttctttgc

SEQ ID NO: 1967105 - DNA, 23 bp, Homo sapiens
tatattcatcaaataaaccttgt

SEQ ID NO: 1967106 - DNA, 19 bp, Homo sapiens
tatctctagtccctgtgtt

SEQ ID NO: 1967107 - DNA, 23 bp, Homo sapiens
tatctgcaatgtttttgtgtaga

SEQ ID NO: 1967108 - DNA, 15 bp, Homo sapiens
tatctggtatctgca

SEQ ID NO: 1967109 - DNA, 16 bp, Homo sapiens
tatctggtatctgcat

SEQ ID NO: 1967110 - DNA, 18 bp, Homo sapiens
tatgagaagtactttgtg

SEQ ID NO: 1967111 - DNA, 21 bp, Homo sapiens
tatgagaagtactttgtgctg

SEQ ID NO: 1967112 - DNA, 18 bp, Homo sapiens
tatgtacagttcataaat

SEQ ID NO: 1967113 - DNA, 18 bp, Homo sapiens
tatgtggatacagtcatt

SEQ ID NO: 1967114 - DNA, 18 bp, Homo sapiens
tatgtgttgcataaacaa

SEQ ID NO: 1967115 - DNA, 20 bp, Homo sapiens
tattaagaaacaatttaaat

SEQ ID NO: 1967116 - DNA, 18 bp, Homo sapiens
tattagccagtcattgta

SEQ ID NO: 1967117 - DNA, 19 bp, Homo sapiens
tattagccagtcattgtaa

SEQ ID NO: 1967118 - DNA, 15 bp, Homo sapiens
tattgaccatgtgat

SEQ ID NO: 1967119 - DNA, 18 bp, Homo sapiens
tatttaaaagacaaacac

SEQ ID NO: 1967120 - DNA, 13 bp, Homo sapiens
tatttaaagcaca

SEQ ID NO: 1967121 - DNA, 16 bp, Homo sapiens
tatttaatgatttttg

SEQ ID NO: 1967122 - DNA, 13 bp, Homo sapiens
tcaaataaacctt

SEQ ID NO: 1967123 - DNA, 20 bp, Homo sapiens
tcaaataaaccttgtttctt

SEQ ID NO: 1967124 - DNA, 23 bp, Homo sapiens
tcaaataaaccttgtttctttct

SEQ ID NO: 1967125 - DNA, 15 bp, Homo sapiens
tcaactttcatttga

SEQ ID NO: 1967126 - DNA, 16 bp, Homo sapiens
tcaactttcatttgaa

SEQ ID NO: 1967127 - DNA, 18 bp, Homo sapiens
tcaagtgagtggcatgtg

SEQ ID NO: 1967128 - DNA, 18 bp, Homo sapiens
tcaatggaagaaaccctt

SEQ ID NO: 1967129 - DNA, 15 bp, Homo sapiens
tcaattttgtattta

SEQ ID NO: 1967130 - DNA, 17 bp, Homo sapiens
tcaattttgtatttaat

SEQ ID NO: 1967131 - DNA, 14 bp, Homo sapiens
tcacaaaagctgtg

SEQ ID NO: 1967132 - DNA, 20 bp, Homo sapiens
tcacaaaagctgtgtctctg

SEQ ID NO: 1967133 - DNA, 24 bp, Homo sapiens
tcagatgtgttgacgtaagctcta

SEQ ID NO: 1967134 - DNA, 18 bp, Homo sapiens
tcagcatcaaacatgaaa

SEQ ID NO: 1967135 - DNA, 20 bp, Homo sapiens
tcagcatcaaacatgaaaac

SEQ ID NO: 1967136 - DNA, 21 bp, Homo sapiens
tcagctggtggatggtgactt

SEQ ID NO: 1967137 - DNA, 23 bp, Homo sapiens
tcagctggtggatggtgactttt

SEQ ID NO: 1967138 - DNA, 17 bp, Homo sapiens
tcagtaagtataacaaa

SEQ ID NO: 1967139 - DNA, 23 bp, Homo sapiens
tcataaatttgttgtcatgtgta

SEQ ID NO: 1967140 - DNA, 24 bp, Homo sapiens
tcataaatttgttgtcatgtgtat

SEQ ID NO: 1967141 - DNA, 20 bp, Homo sapiens
tcatctccagtatcctgctg

SEQ ID NO: 1967142 - DNA, 19 bp, Homo sapiens
tcatgactgagtctggcaa

SEQ ID NO: 1967143 - DNA, 14 bp, Homo sapiens
tcatgtcatttctc

SEQ ID NO: 1967144 - DNA, 18 bp, Homo sapiens
tcatgttttaaaagtttg

SEQ ID NO: 1967145 - DNA, 14 bp, Homo sapiens
tcattcacatttca

SEQ ID NO: 1967146 - DNA, 22 bp, Homo sapiens
tccaaatgctgtgcaaacagtg

SEQ ID NO: 1967147 - DNA, 14 bp, Homo sapiens
tccacgtgtatgca

SEQ ID NO: 1967148 - DNA, 23 bp, Homo sapiens
tccagtagggaaaatagggtcct

SEQ ID NO: 1967149 - DNA, 15 bp, Homo sapiens
tccagtatcctgctg

SEQ ID NO: 1967150 - DNA, 19 bp, Homo sapiens
tccagtggaagaagaaaac

SEQ ID NO: 1967151 - DNA, 13 bp, Homo sapiens
tccatttttgttg

SEQ ID NO: 1967152 - DNA, 17 bp, Homo sapiens
tcccatttcgtgtaata

SEQ ID NO: 1967153 - DNA, 16 bp, Homo sapiens
tccctgaagtcttgca

SEQ ID NO: 1967154 - DNA, 13 bp, Homo sapiens
tccctgtgttctg

SEQ ID NO: 1967155 - DNA, 15 bp, Homo sapiens
tccgcgtcagcaagt

SEQ ID NO: 1967156 - DNA, 17 bp, Homo sapiens
tcctacaaccaggtctt

SEQ ID NO: 1967157 - DNA, 15 bp, Homo sapiens
tcctctgaatattaa

SEQ ID NO: 1967158 - DNA, 12 bp, Homo sapiens
tccttgaaacag

SEQ ID NO: 1967159 - DNA, 23 bp, Homo sapiens
tcgtttgatagtgcttcttgtaa

SEQ ID NO: 1967160 - DNA, 19 bp, Homo sapiens
tctaaacagatgtccctga

SEQ ID NO: 1967161 - DNA, 15 bp, Homo sapiens
tctaaattgatcatt

SEQ ID NO: 1967162 - DNA, 18 bp, Homo sapiens
tctacttgatatttcctt

SEQ ID NO: 1967163 - DNA, 11 bp, Homo sapiens
tctaggtcttg

SEQ ID NO: 1967164 - DNA, 21 bp, Homo sapiens
tctaggtcttggttagagaag

SEQ ID NO: 1967165 - DNA, 13 bp, Homo sapiens
tctagtagaacaa

SEQ ID NO: 1967166 - DNA, 17 bp, Homo sapiens
tctagtagaacaatgta

SEQ ID NO: 1967167 - DNA, 19 bp, Homo sapiens
tctagtccctgtgttctgc

SEQ ID NO: 1967168 - DNA, 21 bp, Homo sapiens
tctatctgcaatgtttttgtg

SEQ ID NO: 1967169 - DNA, 12 bp, Homo sapiens
aatgtcattatt

SEQ ID NO: 1967170 - DNA, 19 bp, Homo sapiens
aatgtgatcatctttgctg

SEQ ID NO: 1967171 - DNA, 10 bp, Homo sapiens
aatgtgtctg

SEQ ID NO: 1967172 - DNA, 23 bp, Homo sapiens
aatgttggtgcaattaactctgg

SEQ ID NO: 1967173 - DNA, 13 bp, Homo sapiens
aattaaactccta

SEQ ID NO: 1967174 - DNA, 14 bp, Homo sapiens
aattgatcattcat

SEQ ID NO: 1967175 - DNA, 14 bp, Homo sapiens
aattgttctgggtg

SEQ ID NO: 1967176 - DNA, 18 bp, Homo sapiens
aattgttctgggtgattt

SEQ ID NO: 1967177 - DNA, 20 bp, Homo sapiens
aatttaagcatgagtggcct

SEQ ID NO: 1967178 - DNA, 17 bp, Homo sapiens
aatttactttttaaaca

SEQ ID NO: 1967179 - DNA, 22 bp, Homo sapiens
aatttagtcccttaaaaattaa

SEQ ID NO: 1967180 - DNA, 12 bp, Homo sapiens
aatttctgccct

SEQ ID NO: 1967181 - DNA, 19 bp, Homo sapiens
aatttgttgtcatgtgtat

SEQ ID NO: 1967182 - DNA, 21 bp, Homo sapiens
aatttgttgtcatgtgtatga

SEQ ID NO: 1967183 - DNA, 15 bp, Homo sapiens
aattttgaggtcttt

SEQ ID NO: 1967184 - DNA, 21 bp, Homo sapiens
aattttgaggtcttttacata

SEQ ID NO: 1967185 - DNA, 17 bp, Homo sapiens
aattttgtatttaatga

SEQ ID NO: 1967186 - DNA, 15 bp, Homo sapiens
acaaaagctgtgtct

SEQ ID NO: 1967187 - DNA, 21 bp, Homo sapiens
acaaacagtgaatttaagcat

SEQ ID NO: 1967188 - DNA, 18 bp, Homo sapiens
acaaatgtgtcccagtga

SEQ ID NO: 1967189 - DNA, 11 bp, Homo sapiens
acaacaaacac

SEQ ID NO: 1967190 - DNA, 14 bp, Homo sapiens
acaacatgtatgtg

SEQ ID NO: 1967191 - DNA, 18 bp, Homo sapiens
acaagttaaggtatctgg

SEQ ID NO: 1967192 - DNA, 12 bp, Homo sapiens
acaatccaaatg

SEQ ID NO: 1967193 - DNA, 21 bp, Homo sapiens
acacaatgttgcactgaaaac

SEQ ID NO: 1967194 - DNA, 22 bp, Homo sapiens
acacaatgttgcactgaaaacc

SEQ ID NO: 1967195 - DNA, 22 bp, Homo sapiens
acactagtaccttcagatccta

SEQ ID NO: 1967196 - DNA, 21 bp, Homo sapiens
acagtcattatttaaagcaca

SEQ ID NO: 1967197 - DNA, 14 bp, Homo sapiens
acagtctcaatttt

SEQ ID NO: 1967198 - DNA, 15 bp, Homo sapiens
acagtctcaattttg

SEQ ID NO: 1967199 - DNA, 16 bp, Homo sapiens
acagtctcaattttgt

SEQ ID NO: 1967200 - DNA, 17 bp, Homo sapiens
acagtctcaattttgta

SEQ ID NO: 1967201 - DNA, 17 bp, Homo sapiens
acagtgaatttaagcat

SEQ ID NO: 1967202 - DNA, 23 bp, Homo sapiens
acagtgtaagcttagattttctg

SEQ ID NO: 1967203 - DNA, 23 bp, Homo sapiens
acagttcataaatttgttgtcat

SEQ ID NO: 1967204 - DNA, 20 bp, Homo sapiens
acatctaaattgatcattca

SEQ ID NO: 1967205 - DNA, 17 bp, Homo sapiens
acatgaaaacattgatg

SEQ ID NO: 1967206 - DNA, 15 bp, Homo sapiens
acatggtgtgtgtct

SEQ ID NO: 1967207 - DNA, 17 bp, Homo sapiens
acatttaggagaagttg

SEQ ID NO: 1967208 - DNA, 11 bp, Homo sapiens
accaaaaatat

SEQ ID NO: 1967209 - DNA, 12 bp, Homo sapiens
accaaattttga

SEQ ID NO: 1967210 - DNA, 22 bp, Homo sapiens
accaaattttgaggtcttttac

SEQ ID NO: 1967211 - DNA, 19 bp, Homo sapiens
accacctggagcggctcat

SEQ ID NO: 1967212 - DNA, 19 bp, Homo sapiens
accctcctctatttcttta

SEQ ID NO: 1967213 - DNA, 20 bp, Homo sapiens
accctcctctatttctttaa

SEQ ID NO: 1967214 - DNA, 12 bp, Homo sapiens
acctctcttgtg

SEQ ID NO: 1967215 - DNA, 15 bp, Homo sapiens
acctgcatatctcta

SEQ ID NO: 1967216 - DNA, 17 bp, Homo sapiens
acctgcatatctctagt

SEQ ID NO: 1967217 - DNA, 22 bp, Homo sapiens
accttattgagcgtgattctgt

SEQ ID NO: 1967218 - DNA, 17 bp, Homo sapiens
accttcagatcctaccc

SEQ ID NO: 1967219 - DNA, 18 bp, Homo sapiens
accttcagatcctacccc

SEQ ID NO: 1967220 - DNA, 14 bp, Homo sapiens
acctttcccatttc

SEQ ID NO: 1967221 - DNA, 15 bp, Homo sapiens
acggaaaatgccaat

SEQ ID NO: 1967222 - DNA, 21 bp, Homo sapiens
acggctctccagacctgagct

SEQ ID NO: 1967223 - DNA, 12 bp, Homo sapiens
actaaggagaat

SEQ ID NO: 1967224 - DNA, 23 bp, Homo sapiens
actcatgactgagtctggcaaac

SEQ ID NO: 1967225 - DNA, 16 bp, Homo sapiens
actctgcaactgaata

SEQ ID NO: 1967226 - DNA, 15 bp, Homo sapiens
actctggacctctct

SEQ ID NO: 1967227 - DNA, 20 bp, Homo sapiens
actcttgtattgctccattt

SEQ ID NO: 1967228 - DNA, 23 bp, Homo sapiens
actgtgatgttgggaagctattt

SEQ ID NO: 1967229 - DNA, 15 bp, Homo sapiens
acttgatatttcctt

SEQ ID NO: 1967230 - DNA, 22 bp, Homo sapiens
acttttgaagaacaaaaggctt

SEQ ID NO: 1967231 - DNA, 23 bp, Homo sapiens
agaaaacaattgttctgggtgat

SEQ ID NO: 1967232 - DNA, 14 bp, Homo sapiens
agaaatcaattttt

SEQ ID NO: 1967233 - DNA, 21 bp, Homo sapiens
agaaatcaattttttaaacca

SEQ ID NO: 1967234 - DNA, 20 bp, Homo sapiens
agaaatcgccttatgagaac

SEQ ID NO: 1967235 - DNA, 22 bp, Homo sapiens
agaacatggtgtgtgtctctga

SEQ ID NO: 1967236 - DNA, 16 bp, Homo sapiens
agaagggctgaataaa

SEQ ID NO: 1967237 - DNA, 18 bp, Homo sapiens
agaagtactttgtgctga

SEQ ID NO: 1967238 - DNA, 20 bp, Homo sapiens
agaagtttgggctaacattt

SEQ ID NO: 1967239 - DNA, 21 bp, Homo sapiens
agaagtttgggctaacattta

SEQ ID NO: 1967240 - DNA, 20 bp, Homo sapiens
agaataaaaggaccacgtgc

SEQ ID NO: 1967241 - DNA, 14 bp, Homo sapiens
agaatagtctctgg

SEQ ID NO: 1967242 - DNA, 13 bp, Homo sapiens
agagatatttaaa

SEQ ID NO: 1967243 - DNA, 13 bp, Homo sapiens
agaggaggagaaa

SEQ ID NO: 1967244 - DNA, 12 bp, Homo sapiens
agatgtccctga

SEQ ID NO: 1967245 - DNA, 19 bp, Homo sapiens
agattttctgtaaatgaag

SEQ ID NO: 1967246 - DNA, 15 bp, Homo sapiens
agcacatgccaggga

SEQ ID NO: 1967247 - DNA, 15 bp, Homo sapiens
agccagtcattgtaa

SEQ ID NO: 1967248 - DNA, 13 bp, Homo sapiens
agcccctcctaac

SEQ ID NO: 1967249 - DNA, 22 bp, Homo sapiens
agccctccacgtcagtgccatc

SEQ ID NO: 1967250 - DNA, 23 bp, Homo sapiens
agcctttaccctcctctatttct

SEQ ID NO: 1967251 - DNA, 18 bp, Homo sapiens
agctatttcctttgcgca

SEQ ID NO: 1967252 - DNA, 16 bp, Homo sapiens
agctatttctatgtat

SEQ ID NO: 1967253 - DNA, 23 bp, Homo sapiens
agctccagtggaagaagaaaaca

SEQ ID NO: 1967254 - DNA, 18 bp, Homo sapiens
agctctacacaacatgta

SEQ ID NO: 1967255 - DNA, 21 bp, Homo sapiens
agctctacacaacatgtatgt

SEQ ID NO: 1967256 - DNA, 21 bp, Homo sapiens
agctctgcagcaatattctga

SEQ ID NO: 1967257 - DNA, 14 bp, Homo sapiens
agctcttcatctgc

SEQ ID NO: 1967258 - DNA, 16 bp, Homo sapiens
agctgtgtctctgtat

SEQ ID NO: 1967259 - DNA, 17 bp, Homo sapiens
agcttagattttctgta

SEQ ID NO: 1967260 - DNA, 13 bp, Homo sapiens
aggacaaacagtg

SEQ ID NO: 1967261 - DNA, 15 bp, Homo sapiens
aggacaaacagtgaa

SEQ ID NO: 1967262 - DNA, 15 bp, Homo sapiens
aggagaattaaactc

SEQ ID NO: 1967263 - DNA, 15 bp, Homo sapiens
aggaggaggctccca

SEQ ID NO: 1967264 - DNA, 17 bp, Homo sapiens
aggattctaaacagatg

SEQ ID NO: 1967265 - DNA, 17 bp, Homo sapiens
aggtcgtataatttagt

SEQ ID NO: 1967266 - DNA, 18 bp, Homo sapiens
agtaagcagagttctttg

SEQ ID NO: 1967267 - DNA, 22 bp, Homo sapiens
agtaagcagagttctttgcaag

SEQ ID NO: 1967268 - DNA, 14 bp, Homo sapiens
agtatcctgctggt

SEQ ID NO: 1967269 - DNA, 14 bp, Homo sapiens
agtcaacagtgaaa

SEQ ID NO: 1967270 - DNA, 15 bp, Homo sapiens
agtcccttaaaaatt

SEQ ID NO: 1967271 - DNA, 13 bp, Homo sapiens
agtctcaattttg

SEQ ID NO: 1967272 - DNA, 14 bp, Homo sapiens
agtctcaattttgt

SEQ ID NO: 1967273 - DNA, 17 bp, Homo sapiens
agtctcaattttgtatt

SEQ ID NO: 1967274 - DNA, 21 bp, Homo sapiens
agtctcaattttgtatttaat

SEQ ID NO: 1967275 - DNA, 12 bp, Homo sapiens
agtctctgaaca

SEQ ID NO: 1967276 - DNA, 19 bp, Homo sapiens
agtctgaggcacctgcata

SEQ ID NO: 1967277 - DNA, 20 bp, Homo sapiens
agtctggcaaacatgtgcaa

SEQ ID NO: 1967278 - DNA, 12 bp, Homo sapiens
agtcttgcattg

SEQ ID NO: 1967279 - DNA, 15 bp, Homo sapiens
agtcttgcattgaat

SEQ ID NO: 1967280 - DNA, 15 bp, Homo sapiens
agtgaacagtttgga

SEQ ID NO: 1967281 - DNA, 17 bp, Homo sapiens
atttaaaagacaaacac

SEQ ID NO: 1967282 - DNA, 14 bp, Homo sapiens
atttaaattgttat

SEQ ID NO: 1967283 - DNA, 18 bp, Homo sapiens
atttactttttaaacagt

SEQ ID NO: 1967284 - DNA, 12 bp, Homo sapiens
atttaggagaag

SEQ ID NO: 1967285 - DNA, 21 bp, Homo sapiens
atttccttcaccacctcatgt

SEQ ID NO: 1967286 - DNA, 11 bp, Homo sapiens
atttctttaat

SEQ ID NO: 1967287 - DNA, 22 bp, Homo sapiens
atttgatttcgatgtacagtct

SEQ ID NO: 1967288 - DNA, 14 bp, Homo sapiens
atttgttgtcatgt

SEQ ID NO: 1967289 - DNA, 16 bp, Homo sapiens
attttcagcatcaaac

SEQ ID NO: 1967290 - DNA, 19 bp, Homo sapiens
attttcagcatcaaacatg

SEQ ID NO: 1967291 - DNA, 21 bp, Homo sapiens
attttcagcatcaaacatgaa

SEQ ID NO: 1967292 - DNA, 19 bp, Homo sapiens
attttcttgtcaatggaag

SEQ ID NO: 1967293 - DNA, 19 bp, Homo sapiens
attttgagggtgtaaccag

SEQ ID NO: 1967294 - DNA, 20 bp, Homo sapiens
attttgtcacagctcttgtt

SEQ ID NO: 1967295 - DNA, 14 bp, Homo sapiens
caaaagctgtgtct

SEQ ID NO: 1967296 - DNA, 22 bp, Homo sapiens
caaacagtgaatttaagcatga

SEQ ID NO: 1967297 - DNA, 14 bp, Homo sapiens
caaacatgaaaaca

SEQ ID NO: 1967298 - DNA, 15 bp, Homo sapiens
caaacatgaaaacat

SEQ ID NO: 1967299 - DNA, 22 bp, Homo sapiens
caaatgctgtgcaaacagtgta

SEQ ID NO: 1967300 - DNA, 16 bp, Homo sapiens
caaattttgaggtctt

SEQ ID NO: 1967301 - DNA, 15 bp, Homo sapiens
caacaaacactgtga

SEQ ID NO: 1967302 - DNA, 20 bp, Homo sapiens
caacatggattccaaagcat

SEQ ID NO: 1967303 - DNA, 15 bp, Homo sapiens
caacatgtatgtgga

SEQ ID NO: 1967304 - DNA, 19 bp, Homo sapiens
caacatgtatgtggataca

SEQ ID NO: 1967305 - DNA, 19 bp, Homo sapiens
caagatccaaatgctgtgc

SEQ ID NO: 1967306 - DNA, 20 bp, Homo sapiens
caagatccaaatgctgtgca

SEQ ID NO: 1967307 - DNA, 12 bp, Homo sapiens
caagtaggaatc

SEQ ID NO: 1967308 - DNA, 17 bp, Homo sapiens
caatccaaatgcattca

SEQ ID NO: 1967309 - DNA, 13 bp, Homo sapiens
caattaactctgg

SEQ ID NO: 1967310 - DNA, 17 bp, Homo sapiens
caatttaaattgttata

SEQ ID NO: 1967311 - DNA, 16 bp, Homo sapiens
cacagctcttgtttgg

SEQ ID NO: 1967312 - DNA, 22 bp, Homo sapiens
cacatctaaattgatcattcat

SEQ ID NO: 1967313 - DNA, 22 bp, Homo sapiens
cacattttgacacaatgttgca

SEQ ID NO: 1967314 - DNA, 14 bp, Homo sapiens
caccattctttctt

SEQ ID NO: 1967315 - DNA, 20 bp, Homo sapiens
cacctctgggccaggttgga

SEQ ID NO: 1967316 - DNA, 20 bp, Homo sapiens
cacggaaaatgccaatctct

SEQ ID NO: 1967317 - DNA, 23 bp, Homo sapiens
cactggatccatccgtccagcca

SEQ ID NO: 1967318 - DNA, 13 bp, Homo sapiens
cactgtccaccac

SEQ ID NO: 1967319 - DNA, 18 bp, Homo sapiens
cagagaataaaaggacca

SEQ ID NO: 1967320 - DNA, 18 bp, Homo sapiens
cagagggatctaggtctt

SEQ ID NO: 1967321 - DNA, 13 bp, Homo sapiens
cagagttctttgc

SEQ ID NO: 1967322 - DNA, 12 bp, Homo sapiens
cagatcctaccc

SEQ ID NO: 1967323 - DNA, 23 bp, Homo sapiens
cagatcctccatttttgttggga

SEQ ID NO: 1967324 - DNA, 14 bp, Homo sapiens
cagatgtccctgaa

SEQ ID NO: 1967325 - DNA, 15 bp, Homo sapiens
cagcaatattctgat

SEQ ID NO: 1967326 - DNA, 17 bp, Homo sapiens
cagcatcaaacatgaaa

SEQ ID NO: 1967327 - DNA, 21 bp, Homo sapiens
cagcatcaaacatgaaaacat

SEQ ID NO: 1967328 - DNA, 22 bp, Homo sapiens
cagccaagagctcttcatctgc

SEQ ID NO: 1967329 - DNA, 15 bp, Homo sapiens
cagcgtgtcaacttt

SEQ ID NO: 1967330 - DNA, 19 bp, Homo sapiens
cagctctgcagcaatattc

SEQ ID NO: 1967331 - DNA, 15 bp, Homo sapiens
cagctggtggatggt

SEQ ID NO: 1967332 - DNA, 14 bp, Homo sapiens
cagcttctgttgga

SEQ ID NO: 1967333 - DNA, 19 bp, Homo sapiens
cagggaaaaagaccaaatt

SEQ ID NO: 1967334 - DNA, 18 bp, Homo sapiens
caggttggaaaagaaatc

SEQ ID NO: 1967335 - DNA, 13 bp, Homo sapiens
cagtctcaatttt

SEQ ID NO: 1967336 - DNA, 14 bp, Homo sapiens
cagtctcaattttg

SEQ ID NO: 1967337 - DNA, 15 bp, Homo sapiens
cagtctcaattttgt

SEQ ID NO: 1967338 - DNA, 16 bp, Homo sapiens
cagtctcaattttgta

SEQ ID NO: 1967339 - DNA, 18 bp, Homo sapiens
cagtgaatttaagcatga

SEQ ID NO: 1967340 - DNA, 15 bp, Homo sapiens
cagtgtttgtatacc

SEQ ID NO: 1967341 - DNA, 23 bp, Homo sapiens
cagttcataaatttgttgtcatg

SEQ ID NO: 1967342 - DNA, 13 bp, Homo sapiens
cagttttgttttg

SEQ ID NO: 1967343 - DNA, 16 bp, Homo sapiens
cataaatttgttgtca

SEQ ID NO: 1967344 - DNA, 14 bp, Homo sapiens
cataattttatcta

SEQ ID NO: 1967345 - DNA, 12 bp, Homo sapiens
catcaaacatga

SEQ ID NO: 1967346 - DNA, 14 bp, Homo sapiens
catcaaacatgaaa

SEQ ID NO: 1967347 - DNA, 15 bp, Homo sapiens
catcaaacatgaaaa

SEQ ID NO: 1967348 - DNA, 18 bp, Homo sapiens
catcaaacatgaaaacat

SEQ ID NO: 1967349 - DNA, 17 bp, Homo sapiens
catcaaataaaccttgt

SEQ ID NO: 1967350 - DNA, 13 bp, Homo sapiens
catcgatatgaaa

SEQ ID NO: 1967351 - DNA, 21 bp, Homo sapiens
catctccagtatcctgctggt

SEQ ID NO: 1967352 - DNA, 23 bp, Homo sapiens
catctttgctgaatgtcattatt

SEQ ID NO: 1967353 - DNA, 16 bp, Homo sapiens
catgaaaatcctacca

SEQ ID NO: 1967354 - DNA, 21 bp, Homo sapiens
catgaaaatcctaccaacctc

SEQ ID NO: 1967355 - DNA, 14 bp, Homo sapiens
catgaagaagctgg

SEQ ID NO: 1967356 - DNA, 20 bp, Homo sapiens
catgagtggccttaataaat

SEQ ID NO: 1967357 - DNA, 19 bp, Homo sapiens
catgcttcatgaaaatcct

SEQ ID NO: 1967358 - DNA, 23 bp, Homo sapiens
catgcttcatgaaaatcctacca

SEQ ID NO: 1967359 - DNA, 14 bp, Homo sapiens
catggagtgtttga

SEQ ID NO: 1967360 - DNA, 15 bp, Homo sapiens
catggtgtgtgtctc

SEQ ID NO: 1967361 - DNA, 17 bp, Homo sapiens
catggtgtgtgtctctg

SEQ ID NO: 1967362 - DNA, 17 bp, Homo sapiens
catgtaaaatcttcagc

SEQ ID NO: 1967363 - DNA, 13 bp, Homo sapiens
tgtcattatttga

SEQ ID NO: 1967364 - DNA, 16 bp, Homo sapiens
tgtctgcaacatggat

SEQ ID NO: 1967365 - DNA, 15 bp, Homo sapiens
tgtctttctttgctg

SEQ ID NO: 1967366 - DNA, 13 bp, Homo sapiens
tgtgcaaacagtg

SEQ ID NO: 1967367 - DNA, 21 bp, Homo sapiens
tgtggaaaggattctaaacag

SEQ ID NO: 1967368 - DNA, 15 bp, Homo sapiens
tgtgggttgtgatat

SEQ ID NO: 1967369 - DNA, 20 bp, Homo sapiens
tgtgtatccagtatgcacgt

SEQ ID NO: 1967370 - DNA, 12 bp, Homo sapiens
tgtgtatgagaa

SEQ ID NO: 1967371 - DNA, 12 bp, Homo sapiens
tgtgtctctgta

SEQ ID NO: 1967372 - DNA, 15 bp, Homo sapiens
tgtgtctctgtatat

SEQ ID NO: 1967373 - DNA, 12 bp, Homo sapiens
tgtgtgtctctg

SEQ ID NO: 1967374 - DNA, 13 bp, Homo sapiens
tgtgtgtctctga

SEQ ID NO: 1967375 - DNA, 16 bp, Homo sapiens
tgttattcttttccag

SEQ ID NO: 1967376 - DNA, 18 bp, Homo sapiens
tgttattcttttccagaa

SEQ ID NO: 1967377 - DNA, 16 bp, Homo sapiens
tgttcttgtcatcagt

SEQ ID NO: 1967378 - DNA, 18 bp, Homo sapiens
tgttgagtctctgaacat

SEQ ID NO: 1967379 - DNA, 16 bp, Homo sapiens
tgttgcactgaaaacc

SEQ ID NO: 1967380 - DNA, 18 bp, Homo sapiens
tgttggcagtgtttgtat

SEQ ID NO: 1967381 - DNA, 21 bp, Homo sapiens
tgttggtgcaattaactctgg

SEQ ID NO: 1967382 - DNA, 23 bp, Homo sapiens
tgttggtgcaattaactctggac

SEQ ID NO: 1967383 - DNA, 14 bp, Homo sapiens
tgttgtcatgtgta

SEQ ID NO: 1967384 - DNA, 20 bp, Homo sapiens
tgtttgtataccatgatgca

SEQ ID NO: 1967385 - DNA, 20 bp, Homo sapiens
tgttttaaaagtttgtcctt

SEQ ID NO: 1967386 - DNA, 21 bp, Homo sapiens
tgttttgagggctattagaag

SEQ ID NO: 1967387 - DNA, 17 bp, Homo sapiens
ttaaaggacaaacagtg

SEQ ID NO: 1967388 - DNA, 18 bp, Homo sapiens
ttaaattctctctaacat

SEQ ID NO: 1967389 - DNA, 23 bp, Homo sapiens
ttaaattctctctaacataacaa

SEQ ID NO: 1967390 - DNA, 17 bp, Homo sapiens
ttaaattgttataactt

SEQ ID NO: 1967391 - DNA, 21 bp, Homo sapiens
ttaaatttctgccctgagccc

SEQ ID NO: 1967392 - DNA, 18 bp, Homo sapiens
ttaacaggttttcttcta

SEQ ID NO: 1967393 - DNA, 20 bp, Homo sapiens
ttaagaaacaatttaaattg

SEQ ID NO: 1967394 - DNA, 17 bp, Homo sapiens
ttaatgatttttgtgta

SEQ ID NO: 1967395 - DNA, 18 bp, Homo sapiens
ttaatgatttttgtgtat

SEQ ID NO: 1967396 - DNA, 14 bp, Homo sapiens
ttacaacaaacact

SEQ ID NO: 1967397 - DNA, 16 bp, Homo sapiens
ttacttaaacatcatt

SEQ ID NO: 1967398 - DNA, 18 bp, Homo sapiens
ttactttttaaacagtgt

SEQ ID NO: 1967399 - DNA, 13 bp, Homo sapiens
ttaggagaagttg

SEQ ID NO: 1967400 - DNA, 20 bp, Homo sapiens
ttagtcattattattacttt

SEQ ID NO: 1967401 - DNA, 18 bp, Homo sapiens
ttatcaaaaagtataaat

SEQ ID NO: 1967402 - DNA, 13 bp, Homo sapiens
ttatgagaacatg

SEQ ID NO: 1967403 - DNA, 22 bp, Homo sapiens
ttatgagaacatggtgtgtgtc

SEQ ID NO: 1967404 - DNA, 23 bp, Homo sapiens
ttcaatttactttttaaacagtg

SEQ ID NO: 1967405 - DNA, 12 bp, Homo sapiens
ttcagatcctac

SEQ ID NO: 1967406 - DNA, 23 bp, Homo sapiens
ttcagctggtggatggtgacttt

SEQ ID NO: 1967407 - DNA, 22 bp, Homo sapiens
ttcataaatttgttgtcatgtg

SEQ ID NO: 1967408 - DNA, 16 bp, Homo sapiens
ttcatgaaaatcctac

SEQ ID NO: 1967409 - DNA, 17 bp, Homo sapiens
ttccagttttgttttga

SEQ ID NO: 1967410 - DNA, 16 bp, Homo sapiens
ttccgcgtcagcaagt

SEQ ID NO: 1967411 - DNA, 16 bp, Homo sapiens
ttcgatgtacagtctc

SEQ ID NO: 1967412 - DNA, 20 bp, Homo sapiens
ttctaaacagatgtccctga

SEQ ID NO: 1967413 - DNA, 13 bp, Homo sapiens
ttctatgtatgtg

SEQ ID NO: 1967414 - DNA, 15 bp, Homo sapiens
ttctgataatgtatt

SEQ ID NO: 1967415 - DNA, 13 bp, Homo sapiens
ttctgccctgagc

SEQ ID NO: 1967416 - DNA, 15 bp, Homo sapiens
ttctgccctgagccc

SEQ ID NO: 1967417 - DNA, 19 bp, Homo sapiens
ttctgccctgagccctcca

SEQ ID NO: 1967418 - DNA, 21 bp, Homo sapiens
ttctggctttgttcttgtcat

SEQ ID NO: 1967419 - DNA, 18 bp, Homo sapiens
ttcttccttaaactcctg

SEQ ID NO: 1967420 - DNA, 22 bp, Homo sapiens
ttcttgtcatcagtaagtataa

SEQ ID NO: 1967421 - DNA, 12 bp, Homo sapiens
ttctttcttggt

SEQ ID NO: 1967422 - DNA, 14 bp, Homo sapiens
ttctttcttggtgc

SEQ ID NO: 1967423 - DNA, 22 bp, Homo sapiens
ttgaactccatgggattttatc

SEQ ID NO: 1967424 - DNA, 19 bp, Homo sapiens
ttgaagaacaaaaggcttt

SEQ ID NO: 1967425 - DNA, 13 bp, Homo sapiens
ttgaatcttggga

SEQ ID NO: 1967426 - DNA, 18 bp, Homo sapiens
ttgaatgtgatcatcttt

SEQ ID NO: 1967427 - DNA, 21 bp, Homo sapiens
ttgaatgtgatcatctttgct

SEQ ID NO: 1967428 - DNA, 15 bp, Homo sapiens
ttgaccatgtgatta

SEQ ID NO: 1967429 - DNA, 18 bp, Homo sapiens
ttgagggtgtaaccagta

SEQ ID NO: 1967430 - DNA, 18 bp, Homo sapiens
ttgaggtcttttacatac

SEQ ID NO: 1967431 - DNA, 14 bp, Homo sapiens
ttgatatttccttc

SEQ ID NO: 1967432 - DNA, 13 bp, Homo sapiens
ttgatcattcata

SEQ ID NO: 1967433 - DNA, 21 bp, Homo sapiens
ttgatcattcataattttatc

SEQ ID NO: 1967434 - DNA, 17 bp, Homo sapiens
ttgcaccattctttctt

SEQ ID NO: 1967435 - DNA, 18 bp, Homo sapiens
ttgcaccattctttcttg

SEQ ID NO: 1967436 - DNA, 14 bp, Homo sapiens
ttgcactgaaaacc

SEQ ID NO: 1967437 - DNA, 21 bp, Homo sapiens
ttggaaaagaaatcaattttt

SEQ ID NO: 1967438 - DNA, 19 bp, Homo sapiens
ttgggggttaccaaaaata

SEQ ID NO: 1967439 - DNA, 19 bp, Homo sapiens
ttggtgcaattaactctgg

SEQ ID NO: 1967440 - DNA, 17 bp, Homo sapiens
ttggttagagaagtaag

SEQ ID NO: 1967441 - DNA, 12 bp, Homo sapiens
ttgtaatatttc

SEQ ID NO: 1967442 - DNA, 21 bp, Homo sapiens
ttgtaatatttcttcaagtga

SEQ ID NO: 1967443 - DNA, 14 bp, Homo sapiens
ttgtcacagctctt

SEQ ID NO: 1967444 - DNA, 17 bp, Homo sapiens
ttgtcctttaactatca

SEQ ID NO: 1967445 - DNA, 16 bp, Homo sapiens
ttgtctttctttgctg

SEQ ID NO: 1967446 - DNA, 17 bp, Homo sapiens
ttgtctttctttgctgc

SEQ ID NO: 1967447 - DNA, 20 bp, Homo sapiens
ttgtgatattgaccatgtga

SEQ ID NO: 1967448 - DNA, 22 bp, Homo sapiens
ttgtgctttataccccatttga

SEQ ID NO: 1967449 - DNA, 19 bp, Homo sapiens
ttgttataacttcataaaa

SEQ ID NO: 1967450 - DNA, 18 bp, Homo sapiens
ttgttctgggtgatttct

SEQ ID NO: 1967451 - DNA, 12 bp, Homo sapiens
tttaaaagacaa

SEQ ID NO: 1967452 - DNA, 13 bp, Homo sapiens
tttaaaagacaaa

SEQ ID NO: 1967453 - DNA, 17 bp, Homo sapiens
tttaaaatgttggtgca

SEQ ID NO: 1967454 - DNA, 19 bp, Homo sapiens
tttaaattgttataacttc

SEQ ID NO: 1967455 - DNA, 20 bp, Homo sapiens
tttaacaggttttcttctaa

SEQ ID NO: 1967456 - DNA, 24 bp, Homo sapiens
tttaacaggttttcttctaatcat

SEQ ID NO: 1967457 - DNA, 22 bp, Homo sapiens
tttaagcatgagtggccttaat

SEQ ID NO: 1967458 - DNA, 17 bp, Homo sapiens
tttacaacaaacactgt

SEQ ID NO: 1967459 - DNA, 16 bp, Homo sapiens
tttataccccatttga

SEQ ID NO: 1967460 - DNA, 21 bp, Homo sapiens
tttccagaaagaaaatgaatt

SEQ ID NO: 1967461 - DNA, 20 bp, Homo sapiens
tttctgcccaactttcattg

SEQ ID NO: 1967462 - DNA, 16 bp, Homo sapiens
tttctgccctgagccc

SEQ ID NO: 1967463 - DNA, 15 bp, Homo sapiens
tttctgtaaatgaag

SEQ ID NO: 1967464 - DNA, 19 bp, Homo sapiens
tttcttcaagtgagtggca

SEQ ID NO: 1967465 - DNA, 20 bp, Homo sapiens
tttcttcaagtgagtggcat

SEQ ID NO: 1967466 - DNA, 23 bp, Homo sapiens
tttcttcaagtgagtggcatgtg

SEQ ID NO: 1967467 - DNA, 19 bp, Homo sapiens
tttgaagaacaaaaggctt

SEQ ID NO: 1967468 - DNA, 19 bp, Homo sapiens
tttgacgaagaaacaaaaa

SEQ ID NO: 1967469 - DNA, 23 bp, Homo sapiens
tttgataacattttgtttatgtt

SEQ ID NO: 1967470 - DNA, 15 bp, Homo sapiens
tttgcgcaaacttta

SEQ ID NO: 1967471 - DNA, 21 bp, Homo sapiens
tttgctgaatgtcattatttg

SEQ ID NO: 1967472 - DNA, 22 bp, Homo sapiens
tttggatgtcctcaaagaagtg

SEQ ID NO: 1967473 - DNA, 16 bp, Homo sapiens
tttggcaacagaaaac

SEQ ID NO: 1967474 - DNA, 17 bp, Homo sapiens
tttgtataccatgatgc

SEQ ID NO: 1967475 - DNA, 14 bp, Homo sapiens
tttgttgtcatgtg

SEQ ID NO: 1967476 - DNA, 13 bp, Homo sapiens
tttgtttatgtta

SEQ ID NO: 1967477 - DNA, 13 bp, Homo sapiens
ataaagggaacat

SEQ ID NO: 1967478 - DNA, 16 bp, Homo sapiens
ataaatttgttgtcat

SEQ ID NO: 1967479 - DNA, 17 bp, Homo sapiens
ataacatagttgaaaaa

SEQ ID NO: 1967480 - DNA, 15 bp, Homo sapiens
ataacggctctccag

SEQ ID NO: 1967481 - DNA, 24 bp, Homo sapiens
atacagtcattatttaaagcacat

SEQ ID NO: 1967482 - DNA, 14 bp, Homo sapiens
atactcaagcaggt

SEQ ID NO: 1967483 - DNA, 23 bp, Homo sapiens
atagctctacacaacatgtatgt

SEQ ID NO: 1967484 - DNA, 17 bp, Homo sapiens
atagtgcttcttgtaat

SEQ ID NO: 1967485 - DNA, 20 bp, Homo sapiens
atatagctctacacaacatg

SEQ ID NO: 1967486 - DNA, 21 bp, Homo sapiens
atatagctctacacaacatgt

SEQ ID NO: 1967487 - DNA, 22 bp, Homo sapiens
atatctctagtccctgtgttct

SEQ ID NO: 1967488 - DNA, 20 bp, Homo sapiens
atattcatcaaataaacctt

SEQ ID NO: 1967489 - DNA, 18 bp, Homo sapiens
atattgaccatgtgatta

SEQ ID NO: 1967490 - DNA, 23 bp, Homo sapiens
atatttccttcaccacctcatgt

SEQ ID NO: 1967491 - DNA, 13 bp, Homo sapiens
atcaaacatgaaa

SEQ ID NO: 1967492 - DNA, 17 bp, Homo sapiens
atcaaacatgaaaacat

SEQ ID NO: 1967493 - DNA, 14 bp, Homo sapiens
atcaattttttaaa

SEQ ID NO: 1967494 - DNA, 14 bp, Homo sapiens
atcacaaaagctgt

SEQ ID NO: 1967495 - DNA, 15 bp, Homo sapiens
atcacaaaagctgtg

SEQ ID NO: 1967496 - DNA, 20 bp, Homo sapiens
atccaaatgcattcatgttt

SEQ ID NO: 1967497 - DNA, 18 bp, Homo sapiens
atccaaatgctgtgcaaa

SEQ ID NO: 1967498 - DNA, 19 bp, Homo sapiens
atccaaatgctgtgcaaac

SEQ ID NO: 1967499 - DNA, 17 bp, Homo sapiens
atccatccgtccagcca

SEQ ID NO: 1967500 - DNA, 23 bp, Homo sapiens
atcccacggaaaatgccaatctc

SEQ ID NO: 1967501 - DNA, 19 bp, Homo sapiens
atcgtttttgctgcagaga

SEQ ID NO: 1967502 - DNA, 15 bp, Homo sapiens
atctctagtccctgt

SEQ ID NO: 1967503 - DNA, 13 bp, Homo sapiens
atcttcagctggt

SEQ ID NO: 1967504 - DNA, 19 bp, Homo sapiens
atgaaaatcctaccaacct

SEQ ID NO: 1967505 - DNA, 20 bp, Homo sapiens
atgaaaatcctaccaacctc

SEQ ID NO: 1967506 - DNA, 18 bp, Homo sapiens
atgaggaacaatcacaaa

SEQ ID NO: 1967507 - DNA, 18 bp, Homo sapiens
atgatttttgtgtatcca

SEQ ID NO: 1967508 - DNA, 19 bp, Homo sapiens
atgcaagtgggagatgaaa

SEQ ID NO: 1967509 - DNA, 14 bp, Homo sapiens
atgcacgttaacag

SEQ ID NO: 1967510 - DNA, 17 bp, Homo sapiens
atgcagaggaggagaaa

SEQ ID NO: 1967511 - DNA, 21 bp, Homo sapiens
atgcaggtctccatgaagaag

SEQ ID NO: 1967512 - DNA, 17 bp, Homo sapiens
atgctgtgcaaacagtg

SEQ ID NO: 1967513 - DNA, 23 bp, Homo sapiens
atggagtgtttgacgaagaaaca

SEQ ID NO: 1967514 - DNA, 16 bp, Homo sapiens
atggtactaaggagaa

SEQ ID NO: 1967515 - DNA, 17 bp, Homo sapiens
atggtgtgtgtctctga

SEQ ID NO: 1967516 - DNA, 18 bp, Homo sapiens
atggtgtgtgtctctgac

SEQ ID NO: 1967517 - DNA, 16 bp, Homo sapiens
atgtaaaatcttcagc

SEQ ID NO: 1967518 - DNA, 20 bp, Homo sapiens
atgtaaaatcttcagctggt

SEQ ID NO: 1967519 - DNA, 23 bp, Homo sapiens
atgtaaaatcttcagctggtgga

SEQ ID NO: 1967520 - DNA, 19 bp, Homo sapiens
atgtaatgcttatgtgttg

SEQ ID NO: 1967521 - DNA, 16 bp, Homo sapiens
atgtacaaggtatgta

SEQ ID NO: 1967522 - DNA, 22 bp, Homo sapiens
atgtacagtctcaattttgtat

SEQ ID NO: 1967523 - DNA, 15 bp, Homo sapiens
atgtactggagagtg

SEQ ID NO: 1967524 - DNA, 19 bp, Homo sapiens
atgtccctgaagtcttgca

SEQ ID NO: 1967525 - DNA, 17 bp, Homo sapiens
atgtcctcaaagaagtg

SEQ ID NO: 1967526 - DNA, 15 bp, Homo sapiens
atgtgatcatctttg

SEQ ID NO: 1967527 - DNA, 15 bp, Homo sapiens
atgtgcaactcttgt

SEQ ID NO: 1967528 - DNA, 17 bp, Homo sapiens
atgtgcaactcttgtat

SEQ ID NO: 1967529 - DNA, 16 bp, Homo sapiens
atgtgccaattttgtc

SEQ ID NO: 1967530 - DNA, 15 bp, Homo sapiens
atgtgggttgtgata

SEQ ID NO: 1967531 - DNA, 19 bp, Homo sapiens
atgtgtatgagaagtactt

SEQ ID NO: 1967532 - DNA, 18 bp, Homo sapiens
atgtgtcccagtgaacag

SEQ ID NO: 1967533 - DNA, 21 bp, Homo sapiens
atgtgtcccagtgaacagttt

SEQ ID NO: 1967534 - DNA, 18 bp, Homo sapiens
atgtgttgcataaacaat

SEQ ID NO: 1967535 - DNA, 14 bp, Homo sapiens
atgttgcactgaaa

SEQ ID NO: 1967536 - DNA, 13 bp, Homo sapiens
atgtttttgtgta

SEQ ID NO: 1967537 - DNA, 23 bp, Homo sapiens
attaactctggacctctcttgtg

SEQ ID NO: 1967538 - DNA, 19 bp, Homo sapiens
attactttttaaaatgttg

SEQ ID NO: 1967539 - DNA, 14 bp, Homo sapiens
attattacttttta

SEQ ID NO: 1967540 - DNA, 13 bp, Homo sapiens
attatttaaagca

SEQ ID NO: 1967541 - DNA, 18 bp, Homo sapiens
attcatcaaataaacctt

SEQ ID NO: 1967542 - DNA, 12 bp, Homo sapiens
attctaaacaga

SEQ ID NO: 1967543 - DNA, 15 bp, Homo sapiens
attgagcgtgattct

SEQ ID NO: 1967544 - DNA, 15 bp, Homo sapiens
attgcagtgcggctc

SEQ ID NO: 1967545 - DNA, 19 bp, Homo sapiens
attgctccattttcttgtc

SEQ ID NO: 1967546 - DNA, 12 bp, Homo sapiens
atttaaagcaca

SEQ ID NO: 1967547 - DNA, 12 bp, Homo sapiens
atttaagcatga

SEQ ID NO: 1967548 - DNA, 14 bp, Homo sapiens
atttagcacatttt

SEQ ID NO: 1967549 - DNA, 17 bp, Homo sapiens
atttaggagaagttggt

SEQ ID NO: 1967550 - DNA, 19 bp, Homo sapiens
atttcaagatccaaatgct

SEQ ID NO: 1967551 - DNA, 13 bp, Homo sapiens
atttcgtgtaata

SEQ ID NO: 1967552 - DNA, 17 bp, Homo sapiens
atttcgtgtaatattct

SEQ ID NO: 1967553 - DNA, 14 bp, Homo sapiens
atttctatgtatgt

SEQ ID NO: 1967554 - DNA, 22 bp, Homo sapiens
atttctatgtatgtgccaattt

SEQ ID NO: 1967555 - DNA, 18 bp, Homo sapiens
atttctgccctgagccct

SEQ ID NO: 1967556 - DNA, 21 bp, Homo sapiens
atttctttaatctgttgtttg

SEQ ID NO: 1967557 - DNA, 22 bp, Homo sapiens
atttctttaatctgttgtttga

SEQ ID NO: 1967558 - DNA, 23 bp, Homo sapiens
atttgaaagtgggtttcaattta

SEQ ID NO: 1967559 - DNA, 19 bp, Homo sapiens
atttgtcggggaagatgaa

SEQ ID NO: 1967560 - DNA, 17 bp, Homo sapiens
atttgttgtcatgtgta

SEQ ID NO: 1967561 - DNA, 21 bp, Homo sapiens
attttgtcacagctcttgttt

SEQ ID NO: 1967562 - DNA, 11 bp, Homo sapiens
atttttcttcc

SEQ ID NO: 1967563 - DNA, 16 bp, Homo sapiens
atttttgtgtatccag

SEQ ID NO: 1967564 - DNA, 13 bp, Homo sapiens
attttttaaacca

SEQ ID NO: 1967565 - DNA, 11 bp, Homo sapiens
caaaagcaggc

SEQ ID NO: 1967566 - DNA, 19 bp, Homo sapiens
caaaagcaggcttgtgctt

SEQ ID NO: 1967567 - DNA, 11 bp, Homo sapiens
caaaagtctga

SEQ ID NO: 1967568 - DNA, 12 bp, Homo sapiens
caaacagtgaat

SEQ ID NO: 1967569 - DNA, 13 bp, Homo sapiens
caaacatgaaaac

SEQ ID NO: 1967570 - DNA, 16 bp, Homo sapiens
caaacatgaaaacatt

SEQ ID NO: 1967571 - DNA, 19 bp, Homo sapiens
caaacatgaaaacattgat

SEQ ID NO: 1967572 - DNA, 19 bp, Homo sapiens
caaacatgtgcaactcttg

SEQ ID NO: 1967573 - DNA, 13 bp, Homo sapiens
caaagttccagtt

SEQ ID NO: 1967574 - DNA, 21 bp, Homo sapiens
caaagttccagttttgttttg

SEQ ID NO: 1967575 - DNA, 16 bp, Homo sapiens
caaatgcattcatgtt

SEQ ID NO: 1967576 - DNA, 17 bp, Homo sapiens
caaatgcattcatgttt

SEQ ID NO: 1967577 - DNA, 19 bp, Homo sapiens
caaatgcattcatgtttta

SEQ ID NO: 1967578 - DNA, 20 bp, Homo sapiens
caaatgctgtgcaaacagtg

SEQ ID NO: 1967579 - DNA, 14 bp, Homo sapiens
caaatgtgtcccag

SEQ ID NO: 1967580 - DNA, 19 bp, Homo sapiens
caaatgtgtcccagtgaac

SEQ ID NO: 1967581 - DNA, 12 bp, Homo sapiens
caacaaacactg

SEQ ID NO: 1967582 - DNA, 22 bp, Homo sapiens
caacctttcccatttcgtgtaa

SEQ ID NO: 1967583 - DNA, 22 bp, Homo sapiens
caactcttgtattgctccattt

SEQ ID NO: 1967584 - DNA, 15 bp, Homo sapiens
caactttcatttgaa

SEQ ID NO: 1967585 - DNA, 22 bp, Homo sapiens
caagatccaaatgctgtgcaaa

SEQ ID NO: 1967586 - DNA, 23 bp, Homo sapiens
caagcttatttagcacattttga

SEQ ID NO: 1967587 - DNA, 10 bp, Homo sapiens
caagtgagtg

SEQ ID NO: 1967588 - DNA, 12 bp, Homo sapiens
caagtgagtggc

SEQ ID NO: 1967589 - DNA, 19 bp, Homo sapiens
caagtgggagatgaaaacc

SEQ ID NO: 1967590 - DNA, 22 bp, Homo sapiens
caagtgggagatgaaaacctgc

SEQ ID NO: 1967591 - DNA, 16 bp, Homo sapiens
caatcacaaaagctgt

SEQ ID NO: 1967592 - DNA, 23 bp, Homo sapiens
caatcacaaaagctgtgtctctg

SEQ ID NO: 1967593 - DNA, 12 bp, Homo sapiens
caatgcgtggca

SEQ ID NO: 1967594 - DNA, 22 bp, Homo sapiens
caatgcgtggcacatctaaatt

SEQ ID NO: 1967595 - DNA, 21 bp, Homo sapiens
taccatcccggtgcatgcagg

SEQ ID NO: 1967596 - DNA, 14 bp, Homo sapiens
tacccagtcatgta

SEQ ID NO: 1967597 - DNA, 21 bp, Homo sapiens
taccttattgagcgtgattct

SEQ ID NO: 1967598 - DNA, 22 bp, Homo sapiens
taccttattgagcgtgattctg

SEQ ID NO: 1967599 - DNA, 16 bp, Homo sapiens
tacttgatatttcctt

SEQ ID NO: 1967600 - DNA, 13 bp, Homo sapiens
tactttgtgcaaa

SEQ ID NO: 1967601 - DNA, 13 bp, Homo sapiens
tactttttaaaca

SEQ ID NO: 1967602 - DNA, 16 bp, Homo sapiens
tagagaagtaagcaga

SEQ ID NO: 1967603 - DNA, 19 bp, Homo sapiens
tagagatatttaaaagaca

SEQ ID NO: 1967604 - DNA, 22 bp, Homo sapiens
tagagatatttaaaagacaaac

SEQ ID NO: 1967605 - DNA, 19 bp, Homo sapiens
tagagtggcgattgaatgc

SEQ ID NO: 1967606 - DNA, 16 bp, Homo sapiens
tagctatttctatgta

SEQ ID NO: 1967607 - DNA, 14 bp, Homo sapiens
tagtgcttcttgta

SEQ ID NO: 1967608 - DNA, 21 bp, Homo sapiens
tagttgtctttctttgctgct

SEQ ID NO: 1967609 - DNA, 17 bp, Homo sapiens
tataacaaactatgtaa

SEQ ID NO: 1967610 - DNA, 21 bp, Homo sapiens
tataatttagtcccttaaaaa

SEQ ID NO: 1967611 - DNA, 16 bp, Homo sapiens
tatagataacggctct

SEQ ID NO: 1967612 - DNA, 21 bp, Homo sapiens
tatagctagctatttctatgt

SEQ ID NO: 1967613 - DNA, 21 bp, Homo sapiens
tatcccacggaaaatgccaat

SEQ ID NO: 1967614 - DNA, 21 bp, Homo sapiens
tatctacccagtcatgtactg

SEQ ID NO: 1967615 - DNA, 22 bp, Homo sapiens
tatctctagtccctgtgttctg

SEQ ID NO: 1967616 - DNA, 21 bp, Homo sapiens
tatctgcatgtaaaatcttca

SEQ ID NO: 1967617 - DNA, 22 bp, Homo sapiens
tatctgcatgtaaaatcttcag

SEQ ID NO: 1967618 - DNA, 11 bp, Homo sapiens
tatctggtatc

SEQ ID NO: 1967619 - DNA, 19 bp, Homo sapiens
tatctggtatctgcatgta

SEQ ID NO: 1967620 - DNA, 14 bp, Homo sapiens
tatgagaacatggt

SEQ ID NO: 1967621 - DNA, 13 bp, Homo sapiens
tatgcaagtggga

SEQ ID NO: 1967622 - DNA, 15 bp, Homo sapiens
tatgcacgttaacag

SEQ ID NO: 1967623 - DNA, 19 bp, Homo sapiens
tatggacatcgatatgaaa

SEQ ID NO: 1967624 - DNA, 21 bp, Homo sapiens
tatggacatcgatatgaaaaa

SEQ ID NO: 1967625 - DNA, 20 bp, Homo sapiens
tatgtaatgcttatgtgttg

SEQ ID NO: 1967626 - DNA, 19 bp, Homo sapiens
tatgtatgtgccaattttg

SEQ ID NO: 1967627 - DNA, 17 bp, Homo sapiens
tatgtgccaattttgtc

SEQ ID NO: 1967628 - DNA, 12 bp, Homo sapiens
tatgttacttaa

SEQ ID NO: 1967629 - DNA, 19 bp, Homo sapiens
tattaagaatagtctctgg

SEQ ID NO: 1967630 - DNA, 18 bp, Homo sapiens
tattcatcaaataaacct

SEQ ID NO: 1967631 - DNA, 14 bp, Homo sapiens
tattctctgatgtt

SEQ ID NO: 1967632 - DNA, 17 bp, Homo sapiens
tatttaatgatttttgt

SEQ ID NO: 1967633 - DNA, 18 bp, Homo sapiens
tatttaatgatttttgtg

SEQ ID NO: 1967634 - DNA, 20 bp, Homo sapiens
tatttaatgatttttgtgta

SEQ ID NO: 1967635 - DNA, 22 bp, Homo sapiens
tatttcctttgcgcaaacttta

SEQ ID NO: 1967636 - DNA, 21 bp, Homo sapiens
tatttctttaatctgttgttt

SEQ ID NO: 1967637 - DNA, 15 bp, Homo sapiens
tatttgataacattt

SEQ ID NO: 1967638 - DNA, 23 bp, Homo sapiens
tatttgtcggggaagatgaaacc

SEQ ID NO: 1967639 - DNA, 14 bp, Homo sapiens
tcaactttcatttg

SEQ ID NO: 1967640 - DNA, 13 bp, Homo sapiens
tcaagatccaaat

SEQ ID NO: 1967641 - DNA, 22 bp, Homo sapiens
tcaagatccaaatgctgtgcaa

SEQ ID NO: 1967642 - DNA, 19 bp, Homo sapiens
tcaagcaggtttcttgctt

SEQ ID NO: 1967643 - DNA, 13 bp, Homo sapiens
tcaagtgagtggc

SEQ ID NO: 1967644 - DNA, 22 bp, Homo sapiens
tcaatttactttttaaacagtg

SEQ ID NO: 1967645 - DNA, 20 bp, Homo sapiens
tcaattttgtatttaatgat

SEQ ID NO: 1967646 - DNA, 15 bp, Homo sapiens
tcaattttttaaacc

SEQ ID NO: 1967647 - DNA, 14 bp, Homo sapiens
tcacagctcttgtt

SEQ ID NO: 1967648 - DNA, 21 bp, Homo sapiens
tcaccacctcatgtcatttct

SEQ ID NO: 1967649 - DNA, 21 bp, Homo sapiens
tcactctaattggtcattcct

SEQ ID NO: 1967650 - DNA, 14 bp, Homo sapiens
tcagatcctacccc

SEQ ID NO: 1967651 - DNA, 11 bp, Homo sapiens
tcagctggtgg

SEQ ID NO: 1967652 - DNA, 12 bp, Homo sapiens
tcagcttctgtt

SEQ ID NO: 1967653 - DNA, 16 bp, Homo sapiens
tcagtaagtataacaa

SEQ ID NO: 1967654 - DNA, 22 bp, Homo sapiens
tcatcaaataaaccttgtttct

SEQ ID NO: 1967655 - DNA, 14 bp, Homo sapiens
tcatcagaactgaa

SEQ ID NO: 1967656 - DNA, 22 bp, Homo sapiens
tcatctccagtatcctgctggt

SEQ ID NO: 1967657 - DNA, 11 bp, Homo sapiens
tcatctttgct

SEQ ID NO: 1967658 - DNA, 16 bp, Homo sapiens
tcatgaaaatcctacc

SEQ ID NO: 1967659 - DNA, 22 bp, Homo sapiens
tcatgttttaaaagtttgtcct

SEQ ID NO: 1967660 - DNA, 23 bp, Homo sapiens
tcatgttttaaaagtttgtcctt

SEQ ID NO: 1967661 - DNA, 16 bp, Homo sapiens
tcattcctaatgcatt

SEQ ID NO: 1967662 - DNA, 18 bp, Homo sapiens
tcattggataaatttgaa

SEQ ID NO: 1967663 - DNA, 23 bp, Homo sapiens
tcattggttaaaatattactgat

SEQ ID NO: 1967664 - DNA, 18 bp, Homo sapiens
tcatttctcatggatttg

SEQ ID NO: 1967665 - DNA, 16 bp, Homo sapiens
tccaaatgcattcatg

SEQ ID NO: 1967666 - DNA, 19 bp, Homo sapiens
tccaaatgcattcatgttt

SEQ ID NO: 1967667 - DNA, 18 bp, Homo sapiens
tccacgtgtatgcaagtg

SEQ ID NO: 1967668 - DNA, 16 bp, Homo sapiens
tccagccaagagctct

SEQ ID NO: 1967669 - DNA, 12 bp, Homo sapiens
tccagttttgtt

SEQ ID NO: 1967670 - DNA, 15 bp, Homo sapiens
tccatccgtccagcc

SEQ ID NO: 1967671 - DNA, 16 bp, Homo sapiens
tccatccgtccagcca

SEQ ID NO: 1967672 - DNA, 17 bp, Homo sapiens
tccctgaagtcttgcat

SEQ ID NO: 1967673 - DNA, 20 bp, Homo sapiens
tccctgaagtcttgcattga

SEQ ID NO: 1967674 - DNA, 18 bp, Homo sapiens
tcctaaatattggtttgt

SEQ ID NO: 1967675 - DNA, 15 bp, Homo sapiens
tcctaacccagcagt

SEQ ID NO: 1967676 - DNA, 13 bp, Homo sapiens
tcctaatgcatta

SEQ ID NO: 1967677 - DNA, 15 bp, Homo sapiens
tcctccatttttgtt

SEQ ID NO: 1967678 - DNA, 14 bp, Homo sapiens
tcctctatttcttt

SEQ ID NO: 1967679 - DNA, 15 bp, Homo sapiens
tcctctatttcttta

SEQ ID NO: 1967680 - DNA, 23 bp, Homo sapiens
tcctttaactatcagagggatct

SEQ ID NO: 1967681 - DNA, 13 bp, Homo sapiens
tcgatatgaaaaa

SEQ ID NO: 1967682 - DNA, 22 bp, Homo sapiens
tctaaacagatgtccctgaagt

SEQ ID NO: 1967683 - DNA, 19 bp, Homo sapiens
tctaaattgatcattcata

SEQ ID NO: 1967684 - DNA, 16 bp, Homo sapiens
tctagtagaacaatgt

SEQ ID NO: 1967685 - DNA, 21 bp, Homo sapiens
tctatagataacggctctcca

SEQ ID NO: 1967686 - DNA, 23 bp, Homo sapiens
tctatctgcaatgtttttgtgta

SEQ ID NO: 1967687 - DNA, 22 bp, Homo sapiens
tctatgtatgtgccaattttgt

SEQ ID NO: 1967688 - DNA, 13 bp, Homo sapiens
tctcaattttgta

SEQ ID NO: 1967689 - DNA, 21 bp, Homo sapiens
tctctgggtttacaacaaaca

SEQ ID NO: 1967690 - DNA, 23 bp, Homo sapiens
tctgaggcacctgcatatctcta

SEQ ID NO: 1967691 - DNA, 15 bp, Homo sapiens
tctgataatgtattg

SEQ ID NO: 1967692 - DNA, 13 bp, Homo sapiens
tctgcaacatgga

SEQ ID NO: 1967693 - DNA, 15 bp, Homo sapiens
tctgcaacatggatt

SEQ ID NO: 1967694 - DNA, 17 bp, Homo sapiens
tctgcatgtaaaatctt

SEQ ID NO: 1967695 - DNA, 20 bp, Homo sapiens
tctgcatgtaaaatcttcag

SEQ ID NO: 1967696 - DNA, 17 bp, Homo sapiens
tctgcccaactttcatt

SEQ ID NO: 1967697 - DNA, 15 bp, Homo sapiens
tctgccctgagccct

SEQ ID NO: 1967698 - DNA, 19 bp, Homo sapiens
tctggcaaacatgtgcaac

SEQ ID NO: 1967699 - DNA, 15 bp, Homo sapiens
tctgggtgatttcta

SEQ ID NO: 1967700 - DNA, 16 bp, Homo sapiens
tctgggtttacaacaa

SEQ ID NO: 1967701 - DNA, 14 bp, Homo sapiens
tcttacctttatga

SEQ ID NO: 1967702 - DNA, 19 bp, Homo sapiens
tcttactttgtgcaaaagc

SEQ ID NO: 1967703 - DNA, 15 bp, Homo sapiens
tcttccttaaactcc

SEQ ID NO: 1967704 - DNA, 24 bp, Homo sapiens
tcttctaatcataacatagttgaa

SEQ ID NO: 1967705 - DNA, 20 bp, Homo sapiens
tcttgacctgaactctgcaa

SEQ ID NO: 1967706 - DNA, 18 bp, Homo sapiens
tcttggttagagaagtaa

SEQ ID NO: 1967707 - DNA, 16 bp, Homo sapiens
tcttgtcatcagtaag

SEQ ID NO: 1967708 - DNA, 15 bp, Homo sapiens
tctttcttggtgcat

SEQ ID NO: 1967709 - DNA, 17 bp, Homo sapiens
tctttgctgctgtggaa

SEQ ID NO: 1967710 - DNA, 18 bp, Homo sapiens
tcttttacatacagtgat

SEQ ID NO: 1967711 - DNA, 14 bp, Homo sapiens
tcttttccagaaag

SEQ ID NO: 1967712 - DNA, 15 bp, Homo sapiens
tgaaaacattgatga

SEQ ID NO: 1967713 - DNA, 14 bp, Homo sapiens
aaaaaaaaattgca

SEQ ID NO: 1967714 - DNA, 10 bp, Homo sapiens
aaaaaaactg

SEQ ID NO: 1967715 - DNA, 16 bp, Homo sapiens
aaaaaaataatgtaag

SEQ ID NO: 1967716 - DNA, 14 bp, Homo sapiens
aaaaaagcaacagt

SEQ ID NO: 1967717 - DNA, 20 bp, Homo sapiens
aaaaaagtttacaagtgtat

SEQ ID NO: 1967718 - DNA, 13 bp, Homo sapiens
aaaaaataaatat

SEQ ID NO: 1967719 - DNA, 21 bp, Homo sapiens
aaaaaataaatataattggga

SEQ ID NO: 1967720 - DNA, 13 bp, Homo sapiens
aaaaaatatatat

SEQ ID NO: 1967721 - DNA, 11 bp, Homo sapiens
aaaaaatgtcc

SEQ ID NO: 1967722 - DNA, 22 bp, Homo sapiens
aaaaaatttgagaaagccttca

SEQ ID NO: 1967723 - DNA, 12 bp, Homo sapiens
aaaaacacagca

SEQ ID NO: 1967724 - DNA, 13 bp, Homo sapiens
aaaaacacagcaa

SEQ ID NO: 1967725 - DNA, 14 bp, Homo sapiens
aaaaacatttgtac

SEQ ID NO: 1967726 - DNA, 15 bp, Homo sapiens
aaaaacatttgtaca

SEQ ID NO: 1967727 - DNA, 14 bp, Homo sapiens
aaaaactaaaaact

SEQ ID NO: 1967728 - DNA, 20 bp, Homo sapiens
aaaaactaaatctctaatat

SEQ ID NO: 1967729 - DNA, 15 bp, Homo sapiens
aaaaacttgtactat

SEQ ID NO: 1967730 - DNA, 18 bp, Homo sapiens
aaaaagaagcaacctcag

SEQ ID NO: 1967731 - DNA, 20 bp, Homo sapiens
aaaaagagaaaaaccaatga

SEQ ID NO: 1967732 - DNA, 13 bp, Homo sapiens
aaaaagattatat

SEQ ID NO: 1967733 - DNA, 18 bp, Homo sapiens
aaaaagctgaagcctatt

SEQ ID NO: 1967734 - DNA, 17 bp, Homo sapiens
aaaaagcttaaaacttt

SEQ ID NO: 1967735 - DNA, 20 bp, Homo sapiens
aaaaaggaaagaaaactaac

SEQ ID NO: 1967736 - DNA, 21 bp, Homo sapiens
aaaaaggccagtggaaattca

SEQ ID NO: 1967737 - DNA, 20 bp, Homo sapiens
aaaaaggctagtttattttg

SEQ ID NO: 1967738 - DNA, 18 bp, Homo sapiens
aaaaagtatacttttgtt

SEQ ID NO: 1967739 - DNA, 11 bp, Homo sapiens
aaaaagtatat

SEQ ID NO: 1967740 - DNA, 14 bp, Homo sapiens
aaaaagtatatatt

SEQ ID NO: 1967741 - DNA, 20 bp, Homo sapiens
aaaaagtatttttttaagtt

SEQ ID NO: 1967742 - DNA, 12 bp, Homo sapiens
aaaaagtgttta

SEQ ID NO: 1967743 - DNA, 18 bp, Homo sapiens
aaaaagtttgccagaagt

SEQ ID NO: 1967744 - DNA, 13 bp, Homo sapiens
aaaaagtttgttt

SEQ ID NO: 1967745 - DNA, 13 bp, Homo sapiens
aaaaataaactag

SEQ ID NO: 1967746 - DNA, 11 bp, Homo sapiens
aaaaataaagc

SEQ ID NO: 1967747 - DNA, 21 bp, Homo sapiens
aaaaataaatttggttctaat

SEQ ID NO: 1967748 - DNA, 18 bp, Homo sapiens
aaaaatacaccacgaatt

SEQ ID NO: 1967749 - DNA, 12 bp, Homo sapiens
aaaaatacagta

SEQ ID NO: 1967750 - DNA, 14 bp, Homo sapiens
aaaaatacagtaaa

SEQ ID NO: 1967751 - DNA, 18 bp, Homo sapiens
aaaaatacagtaaagttt

SEQ ID NO: 1967752 - DNA, 20 bp, Homo sapiens
aaaaatactatgaaatgaaa

SEQ ID NO: 1967753 - DNA, 21 bp, Homo sapiens
aaaaatagctaaatacctcaa

SEQ ID NO: 1967754 - DNA, 14 bp, Homo sapiens
aaaaatagtttgga

SEQ ID NO: 1967755 - DNA, 21 bp, Homo sapiens
aaaaatatatatatatattta

SEQ ID NO: 1967756 - DNA, 16 bp, Homo sapiens
aaaaatattataactt

SEQ ID NO: 1967757 - DNA, 13 bp, Homo sapiens
aaaaatattccat

SEQ ID NO: 1967758 - DNA, 15 bp, Homo sapiens
aaaaatattctccat

SEQ ID NO: 1967759 - DNA, 14 bp, Homo sapiens
aaaaatcttgggca

SEQ ID NO: 1967760 - DNA, 17 bp, Homo sapiens
aaaaatgacagatgttg

SEQ ID NO: 1967761 - DNA, 16 bp, Homo sapiens
aaaaatgatttcagta

SEQ ID NO: 1967762 - DNA, 19 bp, Homo sapiens
aaaaatggtggtttgtcat

SEQ ID NO: 1967763 - DNA, 12 bp, Homo sapiens
aaaaatgttcta

SEQ ID NO: 1967764 - DNA, 18 bp, Homo sapiens
aaaaattaagagatacat

SEQ ID NO: 1967765 - DNA, 13 bp, Homo sapiens
aaaaattagctga

SEQ ID NO: 1967766 - DNA, 15 bp, Homo sapiens
aaaaattgcacaatt

SEQ ID NO: 1967767 - DNA, 18 bp, Homo sapiens
aaaaattgcacaatttga

SEQ ID NO: 1967768 - DNA, 22 bp, Homo sapiens
aaaaattgtgtttagattttat

SEQ ID NO: 1967769 - DNA, 15 bp, Homo sapiens
aaaacaaaaaacttt

SEQ ID NO: 1967770 - DNA, 14 bp, Homo sapiens
aaaacaaaaagaca

SEQ ID NO: 1967771 - DNA, 18 bp, Homo sapiens
aaaacaaaaccagctgct

SEQ ID NO: 1967772 - DNA, 16 bp, Homo sapiens
aaaacaaaagagagaa

SEQ ID NO: 1967773 - DNA, 18 bp, Homo sapiens
aaaacaacttctttgtaa

SEQ ID NO: 1967774 - DNA, 14 bp, Homo sapiens
aaaacaagaaagaa

SEQ ID NO: 1967775 - DNA, 21 bp, Homo sapiens
aaaacactaaaaataaaaatg

SEQ ID NO: 1967776 - DNA, 15 bp, Homo sapiens
aaaacatacttcaaa

SEQ ID NO: 1967777 - DNA, 13 bp, Homo sapiens
aaaacatttattt

SEQ ID NO: 1967778 - DNA, 16 bp, Homo sapiens
aaaacatttattttga

SEQ ID NO: 1967779 - DNA, 12 bp, Homo sapiens
aaaacatttgta

SEQ ID NO: 1967780 - DNA, 15 bp, Homo sapiens
aaaacatttgtacat

SEQ ID NO: 1967781 - DNA, 19 bp, Homo sapiens
aaaaccaagccgtggcttc

SEQ ID NO: 1967782 - DNA, 14 bp, Homo sapiens
aaaaccaatgattc

SEQ ID NO: 1967783 - DNA, 14 bp, Homo sapiens
aaaaccacagcagt

SEQ ID NO: 1967784 - DNA, 17 bp, Homo sapiens
aaaaccactagaactct

SEQ ID NO: 1967785 - DNA, 17 bp, Homo sapiens
aaaaccagaatcataat

SEQ ID NO: 1967786 - DNA, 20 bp, Homo sapiens
aaaaccatcaaaaatattcc

SEQ ID NO: 1967787 - DNA, 14 bp, Homo sapiens
aaaaccatgcagct

SEQ ID NO: 1967788 - DNA, 15 bp, Homo sapiens
aaaaccatgcagctt

SEQ ID NO: 1967789 - DNA, 18 bp, Homo sapiens
aaaaccatgcagcttcat

SEQ ID NO: 1967790 - DNA, 23 bp, Homo sapiens
aaaaccatgcagcttcatcaatt

SEQ ID NO: 1967791 - DNA, 17 bp, Homo sapiens
aaaaccatgtagtttta

SEQ ID NO: 1967792 - DNA, 12 bp, Homo sapiens
aaaacccagaga

SEQ ID NO: 1967793 - DNA, 21 bp, Homo sapiens
aaaacccagcaacagaaaaat

SEQ ID NO: 1967794 - DNA, 19 bp, Homo sapiens
aaaacctagaacttcaaaa

SEQ ID NO: 1967795 - DNA, 22 bp, Homo sapiens
aaaacctagaacttcaaaatgt

SEQ ID NO: 1967796 - DNA, 21 bp, Homo sapiens
aaaacctcatgacagccagag

SEQ ID NO: 1967797 - DNA, 20 bp, Homo sapiens
aaaacctccagtagtggaca

SEQ ID NO: 1967798 - DNA, 21 bp, Homo sapiens
aaaacctttccccagacacat

SEQ ID NO: 1967799 - DNA, 16 bp, Homo sapiens
aaaactaaaaactaga

SEQ ID NO: 1967800 - DNA, 23 bp, Homo sapiens
aaaactatacttgtactccttaa

SEQ ID NO: 1967801 - DNA, 13 bp, Homo sapiens
aaaactcattttt

SEQ ID NO: 1967802 - DNA, 16 bp, Homo sapiens
aaaactgactccttag

SEQ ID NO: 1967803 - DNA, 15 bp, Homo sapiens
aaaactgatcaaaaa

SEQ ID NO: 1967804 - DNA, 20 bp, Homo sapiens
aaaactgatcaaaaataaac

SEQ ID NO: 1967805 - DNA, 21 bp, Homo sapiens
aaaactgatcaaaaataaact

SEQ ID NO: 1967806 - DNA, 11 bp, Homo sapiens
aaaacttattt

SEQ ID NO: 1967807 - DNA, 15 bp, Homo sapiens
aaaacttatttgagt

SEQ ID NO: 1967808 - DNA, 20 bp, Homo sapiens
aaaacttgaatctgttactg

SEQ ID NO: 1967809 - DNA, 22 bp, Homo sapiens
aaaacttgtactatgttaataa

SEQ ID NO: 1967810 - DNA, 12 bp, Homo sapiens
aaaagaaacttt

SEQ ID NO: 1967811 - DNA, 10 bp, Homo sapiens
aaaagaaagc

SEQ ID NO: 1967812 - DNA, 15 bp, Homo sapiens
aaaagaagactggaa

SEQ ID NO: 1967813 - DNA, 16 bp, Homo sapiens
aaaagaatacagaaag

SEQ ID NO: 1967814 - DNA, 21 bp, Homo sapiens
aaaagaatattcagagaatat

SEQ ID NO: 1967815 - DNA, 12 bp, Homo sapiens
aaaagaatattt

SEQ ID NO: 1967816 - DNA, 23 bp, Homo sapiens
aaaagaatttgtgacattttaaa

SEQ ID NO: 1967817 - DNA, 12 bp, Homo sapiens
aaaagacatgtt

SEQ ID NO: 1967818 - DNA, 13 bp, Homo sapiens
aaaagacattttt

SEQ ID NO: 1967819 - DNA, 14 bp, Homo sapiens
aaaagaccagggct

SEQ ID NO: 1967820 - DNA, 13 bp, Homo sapiens
aaaagactccaaa

SEQ ID NO: 1967821 - DNA, 17 bp, Homo sapiens
aaaagactgcagctgct

SEQ ID NO: 1967822 - DNA, 20 bp, Homo sapiens
aaaagataggtttgagttca

SEQ ID NO: 1967823 - DNA, 13 bp, Homo sapiens
aaaagattatata

SEQ ID NO: 1967824 - DNA, 23 bp, Homo sapiens
aaaagattatatatcataaagta

SEQ ID NO: 1967825 - DNA, 17 bp, Homo sapiens
aaaagattctgtaagaa

SEQ ID NO: 1967826 - DNA, 16 bp, Homo sapiens
aaaagcaaaaaagaaa

SEQ ID NO: 1967827 - DNA, 14 bp, Homo sapiens
aaaagcacttttta

SEQ ID NO: 1967828 - DNA, 22 bp, Homo sapiens
aaaagcagtcctcttattccta

SEQ ID NO: 1967829 - DNA, 15 bp, Homo sapiens
aaaagcataaatgca

SEQ ID NO: 1967830 - DNA, 20 bp, Homo sapiens
aaaagcccagtgacctgacc

SEQ ID NO: 1967831 - DNA, 21 bp, Homo sapiens
aaaagcccagtgacctgaccg

SEQ ID NO: 1967832 - DNA, 11 bp, Homo sapiens
aaaagctaatt

SEQ ID NO: 1967833 - DNA, 14 bp, Homo sapiens
aaaagctagaattg

SEQ ID NO: 1967834 - DNA, 13 bp, Homo sapiens
aaaagctcctgtc

SEQ ID NO: 1967835 - DNA, 23 bp, Homo sapiens
aaaagctctctttggaatgaaca

SEQ ID NO: 1967836 - DNA, 20 bp, Homo sapiens
aaaagctcttacactacatt

SEQ ID NO: 1967837 - DNA, 22 bp, Homo sapiens
aaaagctgcttgactatcacat

SEQ ID NO: 1967838 - DNA, 23 bp, Homo sapiens
aaaagctgcttgactatcacata

SEQ ID NO: 1967839 - DNA, 21 bp, Homo sapiens
aaaaggagaaaggagctctga

SEQ ID NO: 1967840 - DNA, 13 bp, Homo sapiens
aaaaggagagaag

SEQ ID NO: 1967841 - DNA, 22 bp, Homo sapiens
aaaaggagccaatttaaagaaa

SEQ ID NO: 1967842 - DNA, 12 bp, Homo sapiens
aaaaggcctggg

SEQ ID NO: 1967843 - DNA, 13 bp, Homo sapiens
aaaaggcctgggg

SEQ ID NO: 1967844 - DNA, 18 bp, Homo sapiens
aaaagggcaataaatgcc

SEQ ID NO: 1967845 - DNA, 11 bp, Homo sapiens
aaaaggggcat

SEQ ID NO: 1967846 - DNA, 22 bp, Homo sapiens
aaaaggtagcttacctgacaca

SEQ ID NO: 1967847 - DNA, 20 bp, Homo sapiens
aaaaggtgcctgtgaggcag

SEQ ID NO: 1967848 - DNA, 22 bp, Homo sapiens
aaaaggtgcctgtgaggcaggg

SEQ ID NO: 1967849 - DNA, 19 bp, Homo sapiens
aaaaggtttatgaaaaaga

SEQ ID NO: 1967850 - DNA, 15 bp, Homo sapiens
aaaagtaaatgtaca

SEQ ID NO: 1967851 - DNA, 22 bp, Homo sapiens
aaaagtaagtaccactcaggcc

SEQ ID NO: 1967852 - DNA, 13 bp, Homo sapiens
aaaagtacattta

SEQ ID NO: 1967853 - DNA, 16 bp, Homo sapiens
aaaagtactgaagacc

SEQ ID NO: 1967854 - DNA, 23 bp, Homo sapiens
aaaagtagaattatatctaattt

SEQ ID NO: 1967855 - DNA, 20 bp, Homo sapiens
aaaagtagcaaccttcattt

SEQ ID NO: 1967856 - DNA, 19 bp, Homo sapiens
aaaagtatgtgaatatgaa

SEQ ID NO: 1967857 - DNA, 12 bp, Homo sapiens
aaaagtcacaca

SEQ ID NO: 1967858 - DNA, 18 bp, Homo sapiens
aaaagtcacacagacaca

SEQ ID NO: 1967859 - DNA, 19 bp, Homo sapiens
aaaagtcacacagacacac

SEQ ID NO: 1967860 - DNA, 19 bp, Homo sapiens
aaaagtgaacttgatttta

SEQ ID NO: 1967861 - DNA, 21 bp, Homo sapiens
aaaagtgatctgtcccctctc

SEQ ID NO: 1967862 - DNA, 21 bp, Homo sapiens
aaaagtgcaatgcgtgttgta

SEQ ID NO: 1967863 - DNA, 21 bp, Homo sapiens
aaaagtggctaattcaattta

SEQ ID NO: 1967864 - DNA, 19 bp, Homo sapiens
aaaagttacatgtttgcac

SEQ ID NO: 1967865 - DNA, 14 bp, Homo sapiens
aaaagttagctgag

SEQ ID NO: 1967866 - DNA, 16 bp, Homo sapiens
aaaagtttacaagtgt

SEQ ID NO: 1967867 - DNA, 13 bp, Homo sapiens
aaaagtttcaatg

SEQ ID NO: 1967868 - DNA, 16 bp, Homo sapiens
aaaataaaaaaataca

SEQ ID NO: 1967869 - DNA, 18 bp, Homo sapiens
aaaataaaaaaatacagt

SEQ ID NO: 1967870 - DNA, 13 bp, Homo sapiens
aaaataaaaatgg

SEQ ID NO: 1967871 - DNA, 11 bp, Homo sapiens
aaaataaaatg

SEQ ID NO: 1967872 - DNA, 12 bp, Homo sapiens
aaaataaacaaa

SEQ ID NO: 1967873 - DNA, 12 bp, Homo sapiens
aaaataaactag

SEQ ID NO: 1967874 - DNA, 14 bp, Homo sapiens
aaaataaactagtt

SEQ ID NO: 1967875 - DNA, 19 bp, Homo sapiens
aaaataaactagtttccag

SEQ ID NO: 1967876 - DNA, 21 bp, Homo sapiens
aaaataaactagtttccagtg

SEQ ID NO: 1967877 - DNA, 15 bp, Homo sapiens
aaaataaactgggga

SEQ ID NO: 1967878 - DNA, 14 bp, Homo sapiens
aaaataaagctact

SEQ ID NO: 1967879 - DNA, 15 bp, Homo sapiens
aaaataaagctactg

SEQ ID NO: 1967880 - DNA, 14 bp, Homo sapiens
aaaataaatgtttt

SEQ ID NO: 1967881 - DNA, 15 bp, Homo sapiens
aaaataacttatatc

SEQ ID NO: 1967882 - DNA, 13 bp, Homo sapiens
aaaataagtgaat

SEQ ID NO: 1967883 - DNA, 21 bp, Homo sapiens
aaaataagtgaataataatta

SEQ ID NO: 1967884 - DNA, 14 bp, Homo sapiens
aaaataatgattta

SEQ ID NO: 1967885 - DNA, 19 bp, Homo sapiens
aaaataatttaactaattt

SEQ ID NO: 1967886 - DNA, 23 bp, Homo sapiens
aaaataatttaactaatttaaac

SEQ ID NO: 1967887 - DNA, 14 bp, Homo sapiens
aaaatacacactca

SEQ ID NO: 1967888 - DNA, 19 bp, Homo sapiens
aaaatacaccacgaatttg

SEQ ID NO: 1967889 - DNA, 17 bp, Homo sapiens
aaaatacataagaccat

SEQ ID NO: 1967890 - DNA, 19 bp, Homo sapiens
aaaatacttgagctgtata

SEQ ID NO: 1967891 - DNA, 14 bp, Homo sapiens
aaaatagaagaata

SEQ ID NO: 1967892 - DNA, 17 bp, Homo sapiens
aaaatagcaaaagaaga

SEQ ID NO: 1967893 - DNA, 22 bp, Homo sapiens
aaaatagcaacactctatattt

SEQ ID NO: 1967894 - DNA, 18 bp, Homo sapiens
aaaatagtaagcctccct

SEQ ID NO: 1967895 - DNA, 21 bp, Homo sapiens
aaaatagtagaacaagcaaca

SEQ ID NO: 1967896 - DNA, 13 bp, Homo sapiens
aaaatataaaata

SEQ ID NO: 1967897 - DNA, 11 bp, Homo sapiens
aaaatataaat

SEQ ID NO: 1967898 - DNA, 12 bp, Homo sapiens
aaaatataaatg

SEQ ID NO: 1967899 - DNA, 22 bp, Homo sapiens
aaaatataaatgcatgatttta

SEQ ID NO: 1967900 - DNA, 17 bp, Homo sapiens
aaaatatacaaacatgt

SEQ ID NO: 1967901 - DNA, 13 bp, Homo sapiens
aaaatatatataa

SEQ ID NO: 1967902 - DNA, 19 bp, Homo sapiens
aaaatatatatagtgctat

SEQ ID NO: 1967903 - DNA, 20 bp, Homo sapiens
aaaatatatatagtgctata

SEQ ID NO: 1967904 - DNA, 22 bp, Homo sapiens
aaaatatatatgtgcagtattt

SEQ ID NO: 1967905 - DNA, 14 bp, Homo sapiens
aaaatatatattgt

SEQ ID NO: 1967906 - DNA, 15 bp, Homo sapiens
aaaatatttgtacat

SEQ ID NO: 1967907 - DNA, 15 bp, Homo sapiens
aaaatcaacttgtgt

SEQ ID NO: 1967908 - DNA, 16 bp, Homo sapiens
aaaatcaacttgtgta

SEQ ID NO: 1967909 - DNA, 17 bp, Homo sapiens
aaaatcacaagcaataa

SEQ ID NO: 1967910 - DNA, 15 bp, Homo sapiens
aaaatcactatcttt

SEQ ID NO: 1967911 - DNA, 21 bp, Homo sapiens
aaaatcaggtggcttttgcgg

SEQ ID NO: 1967912 - DNA, 20 bp, Homo sapiens
aaaatcagttatattcttta

SEQ ID NO: 1967913 - DNA, 22 bp, Homo sapiens
aaaatcataaactgtgtgcaga

SEQ ID NO: 1967914 - DNA, 17 bp, Homo sapiens
aaaatcatgtacatttc

SEQ ID NO: 1967915 - DNA, 10 bp, Homo sapiens
aaaatcattt

SEQ ID NO: 1967916 - DNA, 14 bp, Homo sapiens
aaaatccatggata

SEQ ID NO: 1967917 - DNA, 17 bp, Homo sapiens
aaaatccctatttaatt

SEQ ID NO: 1967918 - DNA, 23 bp, Homo sapiens
aaaatctagatcaattaattctt

SEQ ID NO: 1967919 - DNA, 12 bp, Homo sapiens
aaaatctagttt

SEQ ID NO: 1967920 - DNA, 15 bp, Homo sapiens
aaaatctgatttaat

SEQ ID NO: 1967921 - DNA, 23 bp, Homo sapiens
aaaatctgatttaatgttttctg

SEQ ID NO: 1967922 - DNA, 15 bp, Homo sapiens
aaaatcttgggcaag

SEQ ID NO: 1967923 - DNA, 18 bp, Homo sapiens
aaaatgaaagccaaattt

SEQ ID NO: 1967924 - DNA, 15 bp, Homo sapiens
aaaatgaaatgtttt

SEQ ID NO: 1967925 - DNA, 20 bp, Homo sapiens
aaaatgaaggttaggattta

SEQ ID NO: 1967926 - DNA, 17 bp, Homo sapiens
aaaatgacagatgttga

SEQ ID NO: 1967927 - DNA, 21 bp, Homo sapiens
aaaatgactaaaaatattata

SEQ ID NO: 1967928 - DNA, 19 bp, Homo sapiens
aaaatgagcctgtaatcct

SEQ ID NO: 1967929 - DNA, 16 bp, Homo sapiens
aaaatgaggacatgtt

SEQ ID NO: 1967930 - DNA, 15 bp, Homo sapiens
aaaatgaggaggatt

SEQ ID NO: 1967931 - DNA, 20 bp, Homo sapiens
aaaatgattgtaaaatagct

SEQ ID NO: 1967932 - DNA, 18 bp, Homo sapiens
aaaatgcaacaacatgta

SEQ ID NO: 1967933 - DNA, 19 bp, Homo sapiens
aaaatgcagtccagaataa

SEQ ID NO: 1967934 - DNA, 15 bp, Homo sapiens
aaaatgcattatgtg

SEQ ID NO: 1967935 - DNA, 14 bp, Homo sapiens
aaaatgcttttaat

SEQ ID NO: 1967936 - DNA, 18 bp, Homo sapiens
aaaatggaaaagagagat

SEQ ID NO: 1967937 - DNA, 14 bp, Homo sapiens
aaaatggaaagaat

SEQ ID NO: 1967938 - DNA, 19 bp, Homo sapiens
aaaatggccatttgctttt

SEQ ID NO: 1967939 - DNA, 22 bp, Homo sapiens
aaaatggtggtttgtcatatat

SEQ ID NO: 1967940 - DNA, 12 bp, Homo sapiens
aaaatgtaactt

SEQ ID NO: 1967941 - DNA, 18 bp, Homo sapiens
aaaatgtactgagatttt

SEQ ID NO: 1967942 - DNA, 16 bp, Homo sapiens
aaaatgttcagaaggt

SEQ ID NO: 1967943 - DNA, 22 bp, Homo sapiens
aaaatgttcatcaattcccatt

SEQ ID NO: 1967944 - DNA, 17 bp, Homo sapiens
aaaatgttctatatgca

SEQ ID NO: 1967945 - DNA, 13 bp, Homo sapiens
aaaattaaagccc

SEQ ID NO: 1967946 - DNA, 18 bp, Homo sapiens
aaaattaagagatacatt

SEQ ID NO: 1967947 - DNA, 23 bp, Homo sapiens
aaaattagtgagatttgtattta

SEQ ID NO: 1967948 - DNA, 17 bp, Homo sapiens
aaaattatttttattaa

SEQ ID NO: 1967949 - DNA, 16 bp, Homo sapiens
aaaattcaaaaagtgt

SEQ ID NO: 1967950 - DNA, 20 bp, Homo sapiens
aaaattctcagtcagtaatt

SEQ ID NO: 1967951 - DNA, 20 bp, Homo sapiens
aaaattctgtaggttctgtg

SEQ ID NO: 1967952 - DNA, 12 bp, Homo sapiens
aaaattgaatgc

SEQ ID NO: 1967953 - DNA, 13 bp, Homo sapiens
aaaattgcacaat

SEQ ID NO: 1967954 - DNA, 16 bp, Homo sapiens
aaaattggccagagag

SEQ ID NO: 1967955 - DNA, 13 bp, Homo sapiens
aaaattgtataga

SEQ ID NO: 1967956 - DNA, 21 bp, Homo sapiens
aaaattgtatagagatatgca

SEQ ID NO: 1967957 - DNA, 21 bp, Homo sapiens
aaaattgtatgttaagttact

SEQ ID NO: 1967958 - DNA, 17 bp, Homo sapiens
aaaattgtcaaatgtca

SEQ ID NO: 1967959 - DNA, 21 bp, Homo sapiens
aaaattgtgtttagattttat

SEQ ID NO: 1967960 - DNA, 20 bp, Homo sapiens
aaaatttatattgtaaatat

SEQ ID NO: 1967961 - DNA, 23 bp, Homo sapiens
aaaatttccagtacctttgtcac

SEQ ID NO: 1967962 - DNA, 18 bp, Homo sapiens
aaaatttgaaatttagct

SEQ ID NO: 1967963 - DNA, 23 bp, Homo sapiens
aaaattttacttttgttctgtat

SEQ ID NO: 1967964 - DNA, 13 bp, Homo sapiens
aaaattttataag

SEQ ID NO: 1967965 - DNA, 23 bp, Homo sapiens
aaaattttataagcaaatttcaa

SEQ ID NO: 1967966 - DNA, 15 bp, Homo sapiens
aaaattttgtgagtg

SEQ ID NO: 1967967 - DNA, 13 bp, Homo sapiens
aaacaaaaataaa

SEQ ID NO: 1967968 - DNA, 16 bp, Homo sapiens
aaacaaaacaaaacaa

SEQ ID NO: 1967969 - DNA, 21 bp, Homo sapiens
aaacaaaatatctgacatctt

SEQ ID NO: 1967970 - DNA, 20 bp, Homo sapiens
aaacaaactcgttttttaca

SEQ ID NO: 1967971 - DNA, 17 bp, Homo sapiens
aaacaaaggttgagatg

SEQ ID NO: 1967972 - DNA, 16 bp, Homo sapiens
aaacaaataatcacat

SEQ ID NO: 1967973 - DNA, 15 bp, Homo sapiens
aaacaacaacaatac

SEQ ID NO: 1967974 - DNA, 12 bp, Homo sapiens
aaacaagaaaga

SEQ ID NO: 1967975 - DNA, 12 bp, Homo sapiens
aaacaagaatgt

SEQ ID NO: 1967976 - DNA, 19 bp, Homo sapiens
aaacaaggggctgttacat

SEQ ID NO: 1967977 - DNA, 12 bp, Homo sapiens
aaacaagtattt

SEQ ID NO: 1967978 - DNA, 15 bp, Homo sapiens
aaacaatcacactca

SEQ ID NO: 1967979 - DNA, 13 bp, Homo sapiens
aaacacagagcgg

SEQ ID NO: 1967980 - DNA, 15 bp, Homo sapiens
aaacacagagcggga

SEQ ID NO: 1967981 - DNA, 13 bp, Homo sapiens
aaacacagtgctg

SEQ ID NO: 1967982 - DNA, 12 bp, Homo sapiens
aaacaccattca

SEQ ID NO: 1967983 - DNA, 13 bp, Homo sapiens
aaacacctcccag

SEQ ID NO: 1967984 - DNA, 12 bp, Homo sapiens
aaacacctgaca

SEQ ID NO: 1967985 - DNA, 13 bp, Homo sapiens
aaacacctgacac

SEQ ID NO: 1967986 - DNA, 21 bp, Homo sapiens
aaacacgtgtctataatggaa

SEQ ID NO: 1967987 - DNA, 13 bp, Homo sapiens
aaacactgaatca

SEQ ID NO: 1967988 - DNA, 17 bp, Homo sapiens
aaacactgaatcatgtt

SEQ ID NO: 1967989 - DNA, 14 bp, Homo sapiens
aaacactgtaatct

SEQ ID NO: 1967990 - DNA, 12 bp, Homo sapiens
aaacactgtgta

SEQ ID NO: 1967991 - DNA, 13 bp, Homo sapiens
aaacagaaacaaa

SEQ ID NO: 1967992 - DNA, 19 bp, Homo sapiens
aaacagaaacaaaaacact

SEQ ID NO: 1967993 - DNA, 15 bp, Homo sapiens
aaacagagacaggcc

SEQ ID NO: 1967994 - DNA, 13 bp, Homo sapiens
aaacagataccat

SEQ ID NO: 1967995 - DNA, 19 bp, Homo sapiens
aaacagataccatactcat

SEQ ID NO: 1967996 - DNA, 12 bp, Homo sapiens
aaacagatataa

SEQ ID NO: 1967997 - DNA, 16 bp, Homo sapiens
aaacagattgtttgca

SEQ ID NO: 1967998 - DNA, 14 bp, Homo sapiens
aaacagcagtgttc

SEQ ID NO: 1967999 - DNA, 14 bp, Homo sapiens
aaacagctgtaact

SEQ ID NO: 1968000 - DNA, 14 bp, Homo sapiens
aaacaggaaaaaaa

SEQ ID NO: 1968001 - DNA, 18 bp, Homo sapiens
aaacaggagacaggaagg

SEQ ID NO: 1968002 - DNA, 11 bp, Homo sapiens
aaacagggagc

SEQ ID NO: 1968003 - DNA, 16 bp, Homo sapiens
aaacaggggatcaaag

SEQ ID NO: 1968004 - DNA, 21 bp, Homo sapiens
aaacaggggatcaaagttcct

SEQ ID NO: 1968005 - DNA, 15 bp, Homo sapiens
aaacagtctcaggaa

SEQ ID NO: 1968006 - DNA, 16 bp, Homo sapiens
aaacagttcttggacc

SEQ ID NO: 1968007 - DNA, 18 bp, Homo sapiens
aaacataaaatatacaaa

SEQ ID NO: 1968008 - DNA, 14 bp, Homo sapiens
aaacataagtgcaa

SEQ ID NO: 1968009 - DNA, 17 bp, Homo sapiens
aaacataatataagaat

SEQ ID NO: 1968010 - DNA, 16 bp, Homo sapiens
aaacatagcttgtaac

SEQ ID NO: 1968011 - DNA, 18 bp, Homo sapiens
aaacatatcaattcaaca

SEQ ID NO: 1968012 - DNA, 12 bp, Homo sapiens
aaacatgaagtg

SEQ ID NO: 1968013 - DNA, 13 bp, Homo sapiens
aaacatgacactg

SEQ ID NO: 1968014 - DNA, 15 bp, Homo sapiens
aaacatgacactgac

SEQ ID NO: 1968015 - DNA, 14 bp, Homo sapiens
aaacatgagaaatg

SEQ ID NO: 1968016 - DNA, 17 bp, Homo sapiens
aaacatgagaaatgtga

SEQ ID NO: 1968017 - DNA, 19 bp, Homo sapiens
aaacatgagtgaatagctt

SEQ ID NO: 1968018 - DNA, 18 bp, Homo sapiens
aaacatgtacaaaatcga

SEQ ID NO: 1968019 - DNA, 14 bp, Homo sapiens
aaacatgtgtttta

SEQ ID NO: 1968020 - DNA, 20 bp, Homo sapiens
aaacattaagattgaggcct

SEQ ID NO: 1968021 - DNA, 13 bp, Homo sapiens
aaacattcatcca

SEQ ID NO: 1968022 - DNA, 13 bp, Homo sapiens
aaacatttacaat

SEQ ID NO: 1968023 - DNA, 18 bp, Homo sapiens
aaacatttacaataaata

SEQ ID NO: 1968024 - DNA, 19 bp, Homo sapiens
aaacatttacaataaatat

SEQ ID NO: 1968025 - DNA, 18 bp, Homo sapiens
aaacatttattttgacat

SEQ ID NO: 1968026 - DNA, 21 bp, Homo sapiens
aaacatttattttgacataaa

SEQ ID NO: 1968027 - DNA, 11 bp, Homo sapiens
aaacatttctt

SEQ ID NO: 1968028 - DNA, 16 bp, Homo sapiens
aaacattttctttctt

SEQ ID NO: 1968029 - DNA, 18 bp, Homo sapiens
aaacattttctttctttt

SEQ ID NO: 1968030 - DNA, 23 bp, Homo sapiens
aaaccaaaggacattatgtgtgc

SEQ ID NO: 1968031 - DNA, 15 bp, Homo sapiens
aaaccaatgattcat

SEQ ID NO: 1968032 - DNA, 21 bp, Homo sapiens
aaaccacaactgacacaggaa

SEQ ID NO: 1968033 - DNA, 16 bp, Homo sapiens
aaaccactgaacattt

SEQ ID NO: 1968034 - DNA, 16 bp, Homo sapiens
aaaccactgtacatat

SEQ ID NO: 1968035 - DNA, 16 bp, Homo sapiens
aaaccagcagaaaagt

SEQ ID NO: 1968036 - DNA, 18 bp, Homo sapiens
aaaccagcagaaaagtgc

SEQ ID NO: 1968037 - DNA, 20 bp, Homo sapiens
aaaccatgcagcttcatcaa

SEQ ID NO: 1968038 - DNA, 21 bp, Homo sapiens
aaaccatttaattcataatta

SEQ ID NO: 1968039 - DNA, 16 bp, Homo sapiens
aaacccagcatgtaca

SEQ ID NO: 1968040 - DNA, 17 bp, Homo sapiens
aaacccagcatgtacaa

SEQ ID NO: 1968041 - DNA, 18 bp, Homo sapiens
aaacccccgctccagatc

SEQ ID NO: 1968042 - DNA, 13 bp, Homo sapiens
aaaccccgtctct

SEQ ID NO: 1968043 - DNA, 13 bp, Homo sapiens
aaacccctgggta

SEQ ID NO: 1968044 - DNA, 11 bp, Homo sapiens
aaaccctggtt

SEQ ID NO: 1968045 - DNA, 21 bp, Homo sapiens
aaaccctgtggggcctgatgg

SEQ ID NO: 1968046 - DNA, 13 bp, Homo sapiens
aaacccttctctt

SEQ ID NO: 1968047 - DNA, 15 bp, Homo sapiens
aaaccgctaaaagaa

SEQ ID NO: 1968048 - DNA, 21 bp, Homo sapiens
aaaccgctaaaagaaactttc

SEQ ID NO: 1968049 - DNA, 23 bp, Homo sapiens
aaaccgctaaaagaaactttctt

SEQ ID NO: 1968050 - DNA, 14 bp, Homo sapiens
aaaccgtaatttta

SEQ ID NO: 1968051 - DNA, 15 bp, Homo sapiens
aaaccgtaattttat

SEQ ID NO: 1968052 - DNA, 16 bp, Homo sapiens
aaaccgtaattttatt

SEQ ID NO: 1968053 - DNA, 19 bp, Homo sapiens
aaacctagaacttcaaaat

SEQ ID NO: 1968054 - DNA, 22 bp, Homo sapiens
aaacctcacccgaggctgccca

SEQ ID NO: 1968055 - DNA, 14 bp, Homo sapiens
aaacctcacttgaa

SEQ ID NO: 1968056 - DNA, 18 bp, Homo sapiens
aaacctcatgacagccag

SEQ ID NO: 1968057 - DNA, 21 bp, Homo sapiens
aaacctcatgacagccagagc

SEQ ID NO: 1968058 - DNA, 23 bp, Homo sapiens
aaacctcatgacagccagagcct

SEQ ID NO: 1968059 - DNA, 23 bp, Homo sapiens
aaacctgaggatgcaacaaatat

SEQ ID NO: 1968060 - DNA, 14 bp, Homo sapiens
aaacctgatgttaa

SEQ ID NO: 1968061 - DNA, 16 bp, Homo sapiens
aaacctggagatgatg

SEQ ID NO: 1968062 - DNA, 17 bp, Homo sapiens
aaacctggagatgatga

SEQ ID NO: 1968063 - DNA, 18 bp, Homo sapiens
aaacctggagatgatgat

SEQ ID NO: 1968064 - DNA, 18 bp, Homo sapiens
aaacctgtcaatgataca

SEQ ID NO: 1968065 - DNA, 18 bp, Homo sapiens
aaaccttattgtacctct

SEQ ID NO: 1968066 - DNA, 13 bp, Homo sapiens
aaaccttgcagca

SEQ ID NO: 1968067 - DNA, 11 bp, Homo sapiens
aaacctttcaa

SEQ ID NO: 1968068 - DNA, 19 bp, Homo sapiens
aaacctttccccagacaca

SEQ ID NO: 1968069 - DNA, 19 bp, Homo sapiens
aaacgaagccatctttctt

SEQ ID NO: 1968070 - DNA, 12 bp, Homo sapiens
aaacgccatgtc

SEQ ID NO: 1968071 - DNA, 13 bp, Homo sapiens
aaacgggaaagaa

SEQ ID NO: 1968072 - DNA, 13 bp, Homo sapiens
aaactaaatctct

SEQ ID NO: 1968073 - DNA, 18 bp, Homo sapiens
aaactaaatctctaatat

SEQ ID NO: 1968074 - DNA, 17 bp, Homo sapiens
aaactacagaataatgt

SEQ ID NO: 1968075 - DNA, 13 bp, Homo sapiens
aaactactgtaat

SEQ ID NO: 1968076 - DNA, 23 bp, Homo sapiens
aaactacttttgtaccagtgtga

SEQ ID NO: 1968077 - DNA, 14 bp, Homo sapiens
aaactagtttccag

SEQ ID NO: 1968078 - DNA, 16 bp, Homo sapiens
aaactagtttccagtg

SEQ ID NO: 1968079 - DNA, 19 bp, Homo sapiens
aaactataaactactgtaa

SEQ ID NO: 1968080 - DNA, 21 bp, Homo sapiens
aaactataaactactgtaatt

SEQ ID NO: 1968081 - DNA, 22 bp, Homo sapiens
aaactataagcaagaaggcaaa

SEQ ID NO: 1968082 - DNA, 18 bp, Homo sapiens
aaactcaaaacttaacat

SEQ ID NO: 1968083 - DNA, 13 bp, Homo sapiens
aaactcaaaatat

SEQ ID NO: 1968084 - DNA, 16 bp, Homo sapiens
aaactcaccatgtaaa

SEQ ID NO: 1968085 - DNA, 15 bp, Homo sapiens
aaactcactgctcaa

SEQ ID NO: 1968086 - DNA, 14 bp, Homo sapiens
aaactcagttaaaa

SEQ ID NO: 1968087 - DNA, 17 bp, Homo sapiens
aaactcagttaaaatgt

SEQ ID NO: 1968088 - DNA, 19 bp, Homo sapiens
aaactccgtcttagaagtg

SEQ ID NO: 1968089 - DNA, 19 bp, Homo sapiens
aaactcctgattttgtagt

SEQ ID NO: 1968090 - DNA, 12 bp, Homo sapiens
aaactcctgcct

SEQ ID NO: 1968091 - DNA, 21 bp, Homo sapiens
aaactctaaacattaatcaat

SEQ ID NO: 1968092 - DNA, 14 bp, Homo sapiens
aaactctgggaaat

SEQ ID NO: 1968093 - DNA, 13 bp, Homo sapiens
aaactcttctact

SEQ ID NO: 1968094 - DNA, 16 bp, Homo sapiens
aaactgaaaaatgtca

SEQ ID NO: 1968095 - DNA, 13 bp, Homo sapiens
aaactgaaaatct

SEQ ID NO: 1968096 - DNA, 14 bp, Homo sapiens
aaactgaagaagga

SEQ ID NO: 1968097 - DNA, 15 bp, Homo sapiens
aaactgaagaaggat

SEQ ID NO: 1968098 - DNA, 22 bp, Homo sapiens
aaactgacaacctgtgcagtcc

SEQ ID NO: 1968099 - DNA, 14 bp, Homo sapiens
aaactgaggaattt

SEQ ID NO: 1968100 - DNA, 23 bp, Homo sapiens
aaactgaggagtagctgagagga

SEQ ID NO: 1968101 - DNA, 20 bp, Homo sapiens
aaactgagtaaattggaaac

SEQ ID NO: 1968102 - DNA, 19 bp, Homo sapiens
aaactgatcaaaaataaac

SEQ ID NO: 1968103 - DNA, 21 bp, Homo sapiens
aaactgatcaaaaataaacta

SEQ ID NO: 1968104 - DNA, 22 bp, Homo sapiens
aaactgatcaaaaataaactag

SEQ ID NO: 1968105 - DNA, 20 bp, Homo sapiens
aaactgatgcgaaaacttga

SEQ ID NO: 1968106 - DNA, 22 bp, Homo sapiens
aaactgatgcgaaaacttgaat

SEQ ID NO: 1968107 - DNA, 14 bp, Homo sapiens
aaactgcattagaa

SEQ ID NO: 1968108 - DNA, 14 bp, Homo sapiens
aaactgccagcaac

SEQ ID NO: 1968109 - DNA, 9 bp, Homo sapiens
aaactggct

SEQ ID NO: 1968110 - DNA, 16 bp, Homo sapiens
aaactggggcctccct

SEQ ID NO: 1968111 - DNA, 23 bp, Homo sapiens
aaactggtttagcacaatttata

SEQ ID NO: 1968112 - DNA, 18 bp, Homo sapiens
aaactgtatcaaatctgt

SEQ ID NO: 1968113 - DNA, 14 bp, Homo sapiens
aaactgttcacgtt

SEQ ID NO: 1968114 - DNA, 21 bp, Homo sapiens
aaacttaattacatccagaaa

SEQ ID NO: 1968115 - DNA, 22 bp, Homo sapiens
aaacttagaataaaattgtaaa

SEQ ID NO: 1968116 - DNA, 10 bp, Homo sapiens
aaacttattt

SEQ ID NO: 1968117 - DNA, 23 bp, Homo sapiens
aaacttccatgaggccaaacgtt

SEQ ID NO: 1968118 - DNA, 17 bp, Homo sapiens
aaacttcggaaacaagt

SEQ ID NO: 1968119 - DNA, 16 bp, Homo sapiens
aaacttctaaatgttg

SEQ ID NO: 1968120 - DNA, 19 bp, Homo sapiens
aaacttgtgtatgatccaa

SEQ ID NO: 1968121 - DNA, 20 bp, Homo sapiens
aaactttacccaaaaactaa

SEQ ID NO: 1968122 - DNA, 21 bp, Homo sapiens
aaactttagagtagcatgaga

SEQ ID NO: 1968123 - DNA, 13 bp, Homo sapiens
aaagaaaaaaaat

SEQ ID NO: 1968124 - DNA, 16 bp, Homo sapiens
aaagaaaaaaatatat

SEQ ID NO: 1968125 - DNA, 13 bp, Homo sapiens
aaagaaaaccatt

SEQ ID NO: 1968126 - DNA, 19 bp, Homo sapiens
aaagaaaccgtaattttat

SEQ ID NO: 1968127 - DNA, 12 bp, Homo sapiens
aaagaaactttc

SEQ ID NO: 1968128 - DNA, 13 bp, Homo sapiens
aaagaaagaaaca

SEQ ID NO: 1968129 - DNA, 14 bp, Homo sapiens
aaagaaagaaggaa

SEQ ID NO: 1968130 - DNA, 15 bp, Homo sapiens
aaagaacagtaaaca

SEQ ID NO: 1968131 - DNA, 12 bp, Homo sapiens
aaagaagagcct

SEQ ID NO: 1968132 - DNA, 20 bp, Homo sapiens
aaagaagcccaatattataa

SEQ ID NO: 1968133 - DNA, 13 bp, Homo sapiens
aaagaagcttcat

SEQ ID NO: 1968134 - DNA, 12 bp, Homo sapiens
aaagaaggaagt

SEQ ID NO: 1968135 - DNA, 18 bp, Homo sapiens
aaagaagtaaatttgtcc

SEQ ID NO: 1968136 - DNA, 15 bp, Homo sapiens
aaagaagtttgatat

SEQ ID NO: 1968137 - DNA, 17 bp, Homo sapiens
aaagaataaatgaatct

SEQ ID NO: 1968138 - DNA, 17 bp, Homo sapiens
aaagaatacagaaagat

SEQ ID NO: 1968139 - DNA, 15 bp, Homo sapiens
aaagaatccctgcag

SEQ ID NO: 1968140 - DNA, 20 bp, Homo sapiens
aaagaattatttttgtgttt

SEQ ID NO: 1968141 - DNA, 22 bp, Homo sapiens
aaagaattatttttgtgtttct

SEQ ID NO: 1968142 - DNA, 13 bp, Homo sapiens
aaagacacctact

SEQ ID NO: 1968143 - DNA, 20 bp, Homo sapiens
aaagaccctgagactccaga

SEQ ID NO: 1968144 - DNA, 23 bp, Homo sapiens
aaagactaatttaaaaaataact

SEQ ID NO: 1968145 - DNA, 19 bp, Homo sapiens
aaagactattcaaacagtc

SEQ ID NO: 1968146 - DNA, 13 bp, Homo sapiens
aaagactccaaag

SEQ ID NO: 1968147 - DNA, 14 bp, Homo sapiens
aaagactccaaaga

SEQ ID NO: 1968148 - DNA, 16 bp, Homo sapiens
aaagactgcagctgct

SEQ ID NO: 1968149 - DNA, 11 bp, Homo sapiens
aaagacttaag

SEQ ID NO: 1968150 - DNA, 19 bp, Homo sapiens
aaagacttaagattaaatt

SEQ ID NO: 1968151 - DNA, 12 bp, Homo sapiens
aaagagaaaaac

SEQ ID NO: 1968152 - DNA, 15 bp, Homo sapiens
aaagagactggagca

SEQ ID NO: 1968153 - DNA, 13 bp, Homo sapiens
aaagagagaaaac

SEQ ID NO: 1968154 - DNA, 18 bp, Homo sapiens
aaagagagaaaacttatt

SEQ ID NO: 1968155 - DNA, 24 bp, Homo sapiens
aaagagatccaggaagcatgagtg

SEQ ID NO: 1968156 - DNA, 23 bp, Homo sapiens
aaagagcaagtctggatctggga

SEQ ID NO: 1968157 - DNA, 19 bp, Homo sapiens
aaagaggatgatttcagaa

SEQ ID NO: 1968158 - DNA, 20 bp, Homo sapiens
aaagaggcagcttgaaactg

SEQ ID NO: 1968159 - DNA, 19 bp, Homo sapiens
aaagaggcgtcttgtattt

SEQ ID NO: 1968160 - DNA, 21 bp, Homo sapiens
aaagaggtggattcctgggca

SEQ ID NO: 1968161 - DNA, 12 bp, Homo sapiens
aaagagttagaa

SEQ ID NO: 1968162 - DNA, 20 bp, Homo sapiens
aaagagttattcaaatgaag

SEQ ID NO: 1968163 - DNA, 15 bp, Homo sapiens
aaagataaagatgat

SEQ ID NO: 1968164 - DNA, 16 bp, Homo sapiens
aaagatggatgtgctt

SEQ ID NO: 1968165 - DNA, 20 bp, Homo sapiens
aaagatgtgttgttggtttc

SEQ ID NO: 1968166 - DNA, 20 bp, Homo sapiens
aaagatgtttgtcagatatg

SEQ ID NO: 1968167 - DNA, 12 bp, Homo sapiens
aaagattatata

SEQ ID NO: 1968168 - DNA, 17 bp, Homo sapiens
aaagattatatatcata

SEQ ID NO: 1968169 - DNA, 13 bp, Homo sapiens
aaagattcactaa

SEQ ID NO: 1968170 - DNA, 14 bp, Homo sapiens
aaagattttttaat

SEQ ID NO: 1968171 - DNA, 21 bp, Homo sapiens
aaagattttttaataatttag

SEQ ID NO: 1968172 - DNA, 14 bp, Homo sapiens
aaagcaaaaaagaa

SEQ ID NO: 1968173 - DNA, 21 bp, Homo sapiens
aaagcaaaaaagaaaaccttt

SEQ ID NO: 1968174 - DNA, 19 bp, Homo sapiens
aaagcaaaagaagtaaaag

SEQ ID NO: 1968175 - DNA, 21 bp, Homo sapiens
aaagcaacagtagcagggaat

SEQ ID NO: 1968176 - DNA, 14 bp, Homo sapiens
aaagcaattgccct

SEQ ID NO: 1968177 - DNA, 19 bp, Homo sapiens
aaagcaattgccctgtaac

SEQ ID NO: 1968178 - DNA, 14 bp, Homo sapiens
aaagcacagtgtta

SEQ ID NO: 1968179 - DNA, 16 bp, Homo sapiens
aaagcacattgaaaga

SEQ ID NO: 1968180 - DNA, 22 bp, Homo sapiens
aaagcaccagcttctccaggct

SEQ ID NO: 1968181 - DNA, 19 bp, Homo sapiens
aaagcaccgcagcatgtgg

SEQ ID NO: 1968182 - DNA, 14 bp, Homo sapiens
aaagcactttttaa

SEQ ID NO: 1968183 - DNA, 13 bp, Homo sapiens
aaagcagcatctg

SEQ ID NO: 1968184 - DNA, 11 bp, Homo sapiens
aaagcagtgtt

SEQ ID NO: 1968185 - DNA, 18 bp, Homo sapiens
aaagcagtgttttcacct

SEQ ID NO: 1968186 - DNA, 17 bp, Homo sapiens
aaagcagttaaactgat

SEQ ID NO: 1968187 - DNA, 15 bp, Homo sapiens
aaagcataaatgcaa

SEQ ID NO: 1968188 - DNA, 17 bp, Homo sapiens
aaagcatcacctcaggc

SEQ ID NO: 1968189 - DNA, 12 bp, Homo sapiens
aaagcatggact

SEQ ID NO: 1968190 - DNA, 13 bp, Homo sapiens
aaagcatgtctca

SEQ ID NO: 1968191 - DNA, 17 bp, Homo sapiens
aaagcattgtaaatgtg

SEQ ID NO: 1968192 - DNA, 16 bp, Homo sapiens
aaagcatttactttga

SEQ ID NO: 1968193 - DNA, 13 bp, Homo sapiens
aaagccacatttt

SEQ ID NO: 1968194 - DNA, 16 bp, Homo sapiens
aaagcccaacctcctg

SEQ ID NO: 1968195 - DNA, 22 bp, Homo sapiens
aaagcccataaggccagaaact

SEQ ID NO: 1968196 - DNA, 23 bp, Homo sapiens
aaagcccttccatgtcgcctctg

SEQ ID NO: 1968197 - DNA, 15 bp, Homo sapiens
aaagccgtgcctttc

SEQ ID NO: 1968198 - DNA, 18 bp, Homo sapiens
aaagcctattagatgttt

SEQ ID NO: 1968199 - DNA, 12 bp, Homo sapiens
aaagcgaaaaaa

SEQ ID NO: 1968200 - DNA, 17 bp, Homo sapiens
aaagctactgaatttat

SEQ ID NO: 1968201 - DNA, 14 bp, Homo sapiens
aaagctagaattga

SEQ ID NO: 1968202 - DNA, 20 bp, Homo sapiens
aaagctagaattgagtgttt

SEQ ID NO: 1968203 - DNA, 14 bp, Homo sapiens
aaagctaggcctgg

SEQ ID NO: 1968204 - DNA, 16 bp, Homo sapiens
aaagctaggcctggcc

SEQ ID NO: 1968205 - DNA, 20 bp, Homo sapiens
aaagctcaagatgacagctc

SEQ ID NO: 1968206 - DNA, 18 bp, Homo sapiens
aaagctctctttggaatg

SEQ ID NO: 1968207 - DNA, 19 bp, Homo sapiens
aaagctctctttggaatga

SEQ ID NO: 1968208 - DNA, 16 bp, Homo sapiens
aaagctgcctgtagtt

SEQ ID NO: 1968209 - DNA, 23 bp, Homo sapiens
aaagctgctgagaatctagcctc

SEQ ID NO: 1968210 - DNA, 21 bp, Homo sapiens
aaagctgcttgactatcacat

SEQ ID NO: 1968211 - DNA, 24 bp, Homo sapiens
aaagctgcttgactatcacataca

SEQ ID NO: 1968212 - DNA, 20 bp, Homo sapiens
aaagctggacaagaagctgc

SEQ ID NO: 1968213 - DNA, 15 bp, Homo sapiens
aaagcttaaaacttt

SEQ ID NO: 1968214 - DNA, 19 bp, Homo sapiens
aaagcttctatcccaggag

SEQ ID NO: 1968215 - DNA, 21 bp, Homo sapiens
aaagctttgcttatggtaata

SEQ ID NO: 1968216 - DNA, 21 bp, Homo sapiens
aaaggaccaactggcttctgt

SEQ ID NO: 1968217 - DNA, 15 bp, Homo sapiens
aaaggacccacccat

SEQ ID NO: 1968218 - DNA, 11 bp, Homo sapiens
aaaggagcctg

SEQ ID NO: 1968219 - DNA, 12 bp, Homo sapiens
aaaggatatttt

SEQ ID NO: 1968220 - DNA, 15 bp, Homo sapiens
aaaggatattttctt

SEQ ID NO: 1968221 - DNA, 19 bp, Homo sapiens
aaaggatgtaaacagtgcc

SEQ ID NO: 1968222 - DNA, 18 bp, Homo sapiens
aaaggattcatgtggaat

SEQ ID NO: 1968223 - DNA, 12 bp, Homo sapiens
aaaggcaaaggc

SEQ ID NO: 1968224 - DNA, 12 bp, Homo sapiens
aaaggcctggaa

SEQ ID NO: 1968225 - DNA, 20 bp, Homo sapiens
aaaggcctggaaccagggag

SEQ ID NO: 1968226 - DNA, 19 bp, Homo sapiens
aaaggctggctgaaaatca

SEQ ID NO: 1968227 - DNA, 23 bp, Homo sapiens
aaaggctggctgaaaatcactat

SEQ ID NO: 1968228 - DNA, 12 bp, Homo sapiens
aaaggcttttgg

SEQ ID NO: 1968229 - DNA, 19 bp, Homo sapiens
aaagggaaggctgctgtgt

SEQ ID NO: 1968230 - DNA, 23 bp, Homo sapiens
aaagggacccgaagcccaggctg

SEQ ID NO: 1968231 - DNA, 23 bp, Homo sapiens
aaagggagcactgggttgacttt

SEQ ID NO: 1968232 - DNA, 20 bp, Homo sapiens
aaagggatggcaagatgtgg

SEQ ID NO: 1968233 - DNA, 20 bp, Homo sapiens
aaagggcccagagagggtgg

SEQ ID NO: 1968234 - DNA, 23 bp, Homo sapiens
aaaggggagaagggccagcccta

SEQ ID NO: 1968235 - DNA, 18 bp, Homo sapiens
aaaggggcagaaaaactc

SEQ ID NO: 1968236 - DNA, 15 bp, Homo sapiens
aaaggggctgctggg

SEQ ID NO: 1968237 - DNA, 23 bp, Homo sapiens
aaagggtctgataaacacagagg

SEQ ID NO: 1968238 - DNA, 16 bp, Homo sapiens
aaaggtagagatgtgt

SEQ ID NO: 1968239 - DNA, 20 bp, Homo sapiens
aaaggtagagatgtgtgtgt

SEQ ID NO: 1968240 - DNA, 16 bp, Homo sapiens
aaaggtataattttat

SEQ ID NO: 1968241 - DNA, 23 bp, Homo sapiens
aaaggtattgagccattttttaa

SEQ ID NO: 1968242 - DNA, 18 bp, Homo sapiens
aaaggtcattgtggctat

SEQ ID NO: 1968243 - DNA, 22 bp, Homo sapiens
aaaggtggtatgtgtgtgtatg

SEQ ID NO: 1968244 - DNA, 21 bp, Homo sapiens
aaaggttcttcatccctttcc

SEQ ID NO: 1968245 - DNA, 17 bp, Homo sapiens
aaaggttgactcaagtt

SEQ ID NO: 1968246 - DNA, 19 bp, Homo sapiens
aaaggttgttttgaaactg

SEQ ID NO: 1968247 - DNA, 22 bp, Homo sapiens
aaagtaaaggcctcatctcctt

SEQ ID NO: 1968248 - DNA, 19 bp, Homo sapiens
aaagtaccatagaacagaa

SEQ ID NO: 1968249 - DNA, 21 bp, Homo sapiens
aaagtacttctccaccctgct

SEQ ID NO: 1968250 - DNA, 22 bp, Homo sapiens
aaagtagaattatatctaattt

SEQ ID NO: 1968251 - DNA, 15 bp, Homo sapiens
aaagtagagaacagt

SEQ ID NO: 1968252 - DNA, 20 bp, Homo sapiens
aaagtagagaagtatccaat

SEQ ID NO: 1968253 - DNA, 13 bp, Homo sapiens
aaagtagcaggac

SEQ ID NO: 1968254 - DNA, 14 bp, Homo sapiens
aaagtatatattct

SEQ ID NO: 1968255 - DNA, 14 bp, Homo sapiens
aaagtatcatgcat

SEQ ID NO: 1968256 - DNA, 21 bp, Homo sapiens
aaagtatgccttcctgtttaa

SEQ ID NO: 1968257 - DNA, 19 bp, Homo sapiens
aaagtatgtaaagtatgta

SEQ ID NO: 1968258 - DNA, 17 bp, Homo sapiens
aaagtcacacagacaca

SEQ ID NO: 1968259 - DNA, 18 bp, Homo sapiens
aaagtcacacagacacac

SEQ ID NO: 1968260 - DNA, 20 bp, Homo sapiens
aaagtcacatataaaagtta

SEQ ID NO: 1968261 - DNA, 20 bp, Homo sapiens
aaagtcagctttcagagcca

SEQ ID NO: 1968262 - DNA, 15 bp, Homo sapiens
aaagtcgaattaata

SEQ ID NO: 1968263 - DNA, 17 bp, Homo sapiens
aaagtctattgtttgtt

SEQ ID NO: 1968264 - DNA, 23 bp, Homo sapiens
aaagtcttgttaattactatatt

SEQ ID NO: 1968265 - DNA, 19 bp, Homo sapiens
aaagtgaataaacttcagc

SEQ ID NO: 1968266 - DNA, 20 bp, Homo sapiens
aaagtgaataaacttcagca

SEQ ID NO: 1968267 - DNA, 21 bp, Homo sapiens
aaagtgaataaacttcagcac

SEQ ID NO: 1968268 - DNA, 15 bp, Homo sapiens
aaagtgacagagacc

SEQ ID NO: 1968269 - DNA, 23 bp, Homo sapiens
aaagtgaccaggctcacaactgt

SEQ ID NO: 1968270 - DNA, 22 bp, Homo sapiens
aaagtgatctgtcccctctccc

SEQ ID NO: 1968271 - DNA, 16 bp, Homo sapiens
aaagtgcttagaaagt

SEQ ID NO: 1968272 - DNA, 20 bp, Homo sapiens
aaagtgcttagaaagttatt

SEQ ID NO: 1968273 - DNA, 17 bp, Homo sapiens
aaagtggattttcctga

SEQ ID NO: 1968274 - DNA, 20 bp, Homo sapiens
aaagtggggctaaatgaagt

SEQ ID NO: 1968275 - DNA, 21 bp, Homo sapiens
aaagtgggttcactagagctg

SEQ ID NO: 1968276 - DNA, 16 bp, Homo sapiens
aaagtgtaaaatagaa

SEQ ID NO: 1968277 - DNA, 15 bp, Homo sapiens
aaagtgtaataatat

SEQ ID NO: 1968278 - DNA, 20 bp, Homo sapiens
aaagttaaactacttgtaaa

SEQ ID NO: 1968279 - DNA, 16 bp, Homo sapiens
aaagttaatcttcatg

SEQ ID NO: 1968280 - DNA, 23 bp, Homo sapiens
aaagttaggttataagaaacaga

SEQ ID NO: 1968281 - DNA, 20 bp, Homo sapiens
aaagttattgtgttgcctta

SEQ ID NO: 1968282 - DNA, 14 bp, Homo sapiens
aaagttcagccaga

SEQ ID NO: 1968283 - DNA, 14 bp, Homo sapiens
aaagttcctgttca

SEQ ID NO: 1968284 - DNA, 17 bp, Homo sapiens
aaagttgataaagattt

SEQ ID NO: 1968285 - DNA, 18 bp, Homo sapiens
aaagttgtgattccagat

SEQ ID NO: 1968286 - DNA, 18 bp, Homo sapiens
aaagtttaaaaaatacac

SEQ ID NO: 1968287 - DNA, 22 bp, Homo sapiens
aaagtttcccctctattttggt

SEQ ID NO: 1968288 - DNA, 23 bp, Homo sapiens
aaagtttctcttttcaaaacatt

SEQ ID NO: 1968289 - DNA, 10 bp, Homo sapiens
aaagtttctt

SEQ ID NO: 1968290 - DNA, 12 bp, Homo sapiens
aaataaaaagta

SEQ ID NO: 1968291 - DNA, 11 bp, Homo sapiens
aaataaaacct

SEQ ID NO: 1968292 - DNA, 14 bp, Homo sapiens
aaataaaacctcag

SEQ ID NO: 1968293 - DNA, 19 bp, Homo sapiens
aaataaaagcagcatctgc

SEQ ID NO: 1968294 - DNA, 14 bp, Homo sapiens
aaataaaagcctct

SEQ ID NO: 1968295 - DNA, 12 bp, Homo sapiens
aaataaaatgat

SEQ ID NO: 1968296 - DNA, 11 bp, Homo sapiens
aaataaactag

SEQ ID NO: 1968297 - DNA, 13 bp, Homo sapiens
aaataaagctact

SEQ ID NO: 1968298 - DNA, 14 bp, Homo sapiens
aaataaagctactg

SEQ ID NO: 1968299 - DNA, 13 bp, Homo sapiens
aaataaagtatat

SEQ ID NO: 1968300 - DNA, 18 bp, Homo sapiens
aaataaatataattggga

SEQ ID NO: 1968301 - DNA, 12 bp, Homo sapiens
aaataaatatca

SEQ ID NO: 1968302 - DNA, 13 bp, Homo sapiens
aaataaatatttt

SEQ ID NO: 1968303 - DNA, 21 bp, Homo sapiens
aaataaatgtatcatagaaat

SEQ ID NO: 1968304 - DNA, 15 bp, Homo sapiens
aaataaatgtgtaaa

SEQ ID NO: 1968305 - DNA, 17 bp, Homo sapiens
aaataaatgtttttatt

SEQ ID NO: 1968306 - DNA, 13 bp, Homo sapiens
aaataaattcaaa

SEQ ID NO: 1968307 - DNA, 15 bp, Homo sapiens
aaataaattgtttga

SEQ ID NO: 1968308 - DNA, 17 bp, Homo sapiens
aaataacaatgtgctct

SEQ ID NO: 1968309 - DNA, 14 bp, Homo sapiens
aaataagaagaatg

SEQ ID NO: 1968310 - DNA, 18 bp, Homo sapiens
aaataatgtaagggtctg

SEQ ID NO: 1968311 - DNA, 17 bp, Homo sapiens
aaataatttaactaatt

SEQ ID NO: 1968312 - DNA, 18 bp, Homo sapiens
aaatacaaaataaaatta

SEQ ID NO: 1968313 - DNA, 19 bp, Homo sapiens
aaatacacactcaaatcaa

SEQ ID NO: 1968314 - DNA, 21 bp, Homo sapiens
aaatacaccacctcactcctg

SEQ ID NO: 1968315 - DNA, 15 bp, Homo sapiens
aaatacagtaaagtt

SEQ ID NO: 1968316 - DNA, 16 bp, Homo sapiens
aaatacagtaaagttt

SEQ ID NO: 1968317 - DNA, 14 bp, Homo sapiens
aaatacatgtgtgg

SEQ ID NO: 1968318 - DNA, 21 bp, Homo sapiens
aaatacatgtgtggatgtgta

SEQ ID NO: 1968319 - DNA, 22 bp, Homo sapiens
aaatacatgtgtggatgtgtaa

SEQ ID NO: 1968320 - DNA, 18 bp, Homo sapiens
aaataccagtgaaccaaa

SEQ ID NO: 1968321 - DNA, 17 bp, Homo sapiens
aaataccatgtctctaa

SEQ ID NO: 1968322 - DNA, 19 bp, Homo sapiens
aaatactccaagcttcaag

SEQ ID NO: 1968323 - DNA, 22 bp, Homo sapiens
aaatactgcctagaaaatgcaa

SEQ ID NO: 1968324 - DNA, 14 bp, Homo sapiens
aaatactgctctga

SEQ ID NO: 1968325 - DNA, 17 bp, Homo sapiens
aaatactgtacatagat

SEQ ID NO: 1968326 - DNA, 15 bp, Homo sapiens
aaatacttgagctgt

SEQ ID NO: 1968327 - DNA, 18 bp, Homo sapiens
aaatagagttccaaataa

SEQ ID NO: 1968328 - DNA, 21 bp, Homo sapiens
aaatagatttgattatttcct

SEQ ID NO: 1968329 - DNA, 17 bp, Homo sapiens
aaatagtgttcttttta

SEQ ID NO: 1968330 - DNA, 13 bp, Homo sapiens
aaatagttcagta

SEQ ID NO: 1968331 - DNA, 23 bp, Homo sapiens
aaatagttgtccatattttcaca

SEQ ID NO: 1968332 - DNA, 21 bp, Homo sapiens
aaatagtttggatatgtaaaa

SEQ ID NO: 1968333 - DNA, 12 bp, Homo sapiens
aaatataaaata

SEQ ID NO: 1968334 - DNA, 13 bp, Homo sapiens
aaatataaacttg

SEQ ID NO: 1968335 - DNA, 20 bp, Homo sapiens
aaatataaacttgtgtatga

SEQ ID NO: 1968336 - DNA, 14 bp, Homo sapiens
aaatataaatgcat

SEQ ID NO: 1968337 - DNA, 22 bp, Homo sapiens
aaatataaatgcatgattttat

SEQ ID NO: 1968338 - DNA, 15 bp, Homo sapiens
aaatataaattaaga

SEQ ID NO: 1968339 - DNA, 20 bp, Homo sapiens
aaatataaccattacatgtt

SEQ ID NO: 1968340 - DNA, 22 bp, Homo sapiens
aaatataaccattacatgttta

SEQ ID NO: 1968341 - DNA, 23 bp, Homo sapiens
aaatataaccattacatgtttaa

SEQ ID NO: 1968342 - DNA, 21 bp, Homo sapiens
aaatatataaaaagaaaagat

SEQ ID NO: 1968343 - DNA, 18 bp, Homo sapiens
aaatatataatggtttac

SEQ ID NO: 1968344 - DNA, 15 bp, Homo sapiens
aaatatatataaata

SEQ ID NO: 1968345 - DNA, 19 bp, Homo sapiens
aaatatatataaatatata

SEQ ID NO: 1968346 - DNA, 20 bp, Homo sapiens
aaatatatataaatatatat

SEQ ID NO: 1968347 - DNA, 21 bp, Homo sapiens
aaatatatataaatatatatt

SEQ ID NO: 1968348 - DNA, 14 bp, Homo sapiens
aaatatatatacat

SEQ ID NO: 1968349 - DNA, 14 bp, Homo sapiens
aaatatatatatat

SEQ ID NO: 1968350 - DNA, 17 bp, Homo sapiens
aaatatatatttttcaa

SEQ ID NO: 1968351 - DNA, 23 bp, Homo sapiens
aaatatatatttttcaaccagca

SEQ ID NO: 1968352 - DNA, 20 bp, Homo sapiens
aaatatatttaagataatta

SEQ ID NO: 1968353 - DNA, 21 bp, Homo sapiens
aaatatatttaatacctttgg

SEQ ID NO: 1968354 - DNA, 14 bp, Homo sapiens
aaatatatttaatt

SEQ ID NO: 1968355 - DNA, 15 bp, Homo sapiens
aaatatattttatga

SEQ ID NO: 1968356 - DNA, 20 bp, Homo sapiens
aaatatattttatgatttaa

SEQ ID NO: 1968357 - DNA, 18 bp, Homo sapiens
aaatatctacctgccctc

SEQ ID NO: 1968358 - DNA, 19 bp, Homo sapiens
aaatatctacctgccctct

SEQ ID NO: 1968359 - DNA, 13 bp, Homo sapiens
aaatatctcagag

SEQ ID NO: 1968360 - DNA, 15 bp, Homo sapiens
aaatatctgacatct

SEQ ID NO: 1968361 - DNA, 23 bp, Homo sapiens
aaatatgagtggttattgaaaat

SEQ ID NO: 1968362 - DNA, 15 bp, Homo sapiens
aaatatgatgttaaa

SEQ ID NO: 1968363 - DNA, 13 bp, Homo sapiens
aaatatgtatgtc

SEQ ID NO: 1968364 - DNA, 20 bp, Homo sapiens
aaatatgttagcaaagagtt

SEQ ID NO: 1968365 - DNA, 22 bp, Homo sapiens
aaatattaccaaaaaagtattt

SEQ ID NO: 1968366 - DNA, 16 bp, Homo sapiens
aaatattcatgcttct

SEQ ID NO: 1968367 - DNA, 15 bp, Homo sapiens
aaatattcctgcatt

SEQ ID NO: 1968368 - DNA, 20 bp, Homo sapiens
aaatattcctgcatttgtga

SEQ ID NO: 1968369 - DNA, 12 bp, Homo sapiens
aaatatttaaga

SEQ ID NO: 1968370 - DNA, 13 bp, Homo sapiens
aaatatttatttt

SEQ ID NO: 1968371 - DNA, 20 bp, Homo sapiens
aaatatttcatgattcacaa

SEQ ID NO: 1968372 - DNA, 17 bp, Homo sapiens
aaatatttggtctctat

SEQ ID NO: 1968373 - DNA, 16 bp, Homo sapiens
aaatattttaaagaat

SEQ ID NO: 1968374 - DNA, 19 bp, Homo sapiens
aaatattttaaagaattgt

SEQ ID NO: 1968375 - DNA, 17 bp, Homo sapiens
aaatattttttaaagtc

SEQ ID NO: 1968376 - DNA, 13 bp, Homo sapiens
aaatcaaaagctg

SEQ ID NO: 1968377 - DNA, 15 bp, Homo sapiens
aaatcaaaagctgct

SEQ ID NO: 1968378 - DNA, 19 bp, Homo sapiens
aaatcaaatatgcaaagca

SEQ ID NO: 1968379 - DNA, 14 bp, Homo sapiens
aaatcacaagcaat

SEQ ID NO: 1968380 - DNA, 17 bp, Homo sapiens
aaatcacgctttttgaa

SEQ ID NO: 1968381 - DNA, 15 bp, Homo sapiens
aaatcactgtattta

SEQ ID NO: 1968382 - DNA, 18 bp, Homo sapiens
aaatcacttgtaaataaa

SEQ ID NO: 1968383 - DNA, 15 bp, Homo sapiens
aaatcagaagtgcaa

SEQ ID NO: 1968384 - DNA, 20 bp, Homo sapiens
aaatcagaagtgcaaaggtg

SEQ ID NO: 1968385 - DNA, 21 bp, Homo sapiens
aaatcagttatattctttaaa

SEQ ID NO: 1968386 - DNA, 15 bp, Homo sapiens
aaatcatgaatattt

SEQ ID NO: 1968387 - DNA, 17 bp, Homo sapiens
aaatcatgtacatttct

SEQ ID NO: 1968388 - DNA, 12 bp, Homo sapiens
aaatcatttctg

SEQ ID NO: 1968389 - DNA, 19 bp, Homo sapiens
aaatcatttctgcatcagc

SEQ ID NO: 1968390 - DNA, 21 bp, Homo sapiens
aaatcatttctgcatcagctg

SEQ ID NO: 1968391 - DNA, 22 bp, Homo sapiens
aaatcatttctgcatcagctgc

SEQ ID NO: 1968392 - DNA, 12 bp, Homo sapiens
aaatccaaagaa

SEQ ID NO: 1968393 - DNA, 14 bp, Homo sapiens
aaatccacagccaa

SEQ ID NO: 1968394 - DNA, 15 bp, Homo sapiens
aaatcctactgaatg

SEQ ID NO: 1968395 - DNA, 12 bp, Homo sapiens
aaatcctctggc

SEQ ID NO: 1968396 - DNA, 18 bp, Homo sapiens
aaatcctgttacttaaat

SEQ ID NO: 1968397 - DNA, 16 bp, Homo sapiens
aaatccttccatgaaa

SEQ ID NO: 1968398 - DNA, 19 bp, Homo sapiens
aaatcctttttctttataa

SEQ ID NO: 1968399 - DNA, 13 bp, Homo sapiens
aaatcgaatgaaa

SEQ ID NO: 1968400 - DNA, 15 bp, Homo sapiens
aaatcgattggcttt

SEQ ID NO: 1968401 - DNA, 22 bp, Homo sapiens
aaatcggatctggggctctggg

SEQ ID NO: 1968402 - DNA, 23 bp, Homo sapiens
aaatcggatctggggctctggga

SEQ ID NO: 1968403 - DNA, 19 bp, Homo sapiens
aaatctaatgtaagaaaat

SEQ ID NO: 1968404 - DNA, 11 bp, Homo sapiens
aaatctatatt

SEQ ID NO: 1968405 - DNA, 12 bp, Homo sapiens
aaatctctaata

SEQ ID NO: 1968406 - DNA, 13 bp, Homo sapiens
aaatctctaatat

SEQ ID NO: 1968407 - DNA, 15 bp, Homo sapiens
aaatctctaatatgg

SEQ ID NO: 1968408 - DNA, 15 bp, Homo sapiens
aaatctgatttaatg

SEQ ID NO: 1968409 - DNA, 22 bp, Homo sapiens
aaatctgatttaatgttttctg

SEQ ID NO: 1968410 - DNA, 21 bp, Homo sapiens
aaatctgcctttgtttctaaa

SEQ ID NO: 1968411 - DNA, 15 bp, Homo sapiens
aaatctgtgaattaa

SEQ ID NO: 1968412 - DNA, 15 bp, Homo sapiens
aaatcttccttgtga

SEQ ID NO: 1968413 - DNA, 18 bp, Homo sapiens
aaatcttccttgtgagga

SEQ ID NO: 1968414 - DNA, 17 bp, Homo sapiens
aaatcttggcacagaaa

SEQ ID NO: 1968415 - DNA, 20 bp, Homo sapiens
aaatcttggttgatgccaaa

SEQ ID NO: 1968416 - DNA, 16 bp, Homo sapiens
aaatgaaaatgtaact

SEQ ID NO: 1968417 - DNA, 22 bp, Homo sapiens
aaatgaaagccaaatttatatg

SEQ ID NO: 1968418 - DNA, 22 bp, Homo sapiens
aaatgaaattactacaaaattt

SEQ ID NO: 1968419 - DNA, 11 bp, Homo sapiens
aaatgaagaaa

SEQ ID NO: 1968420 - DNA, 20 bp, Homo sapiens
aaatgaagtgcaaatttgat

SEQ ID NO: 1968421 - DNA, 16 bp, Homo sapiens
aaatgaatttatctga

SEQ ID NO: 1968422 - DNA, 20 bp, Homo sapiens
aaatgaatttatctgaatat

SEQ ID NO: 1968423 - DNA, 14 bp, Homo sapiens
aaatgacagatgtt

SEQ ID NO: 1968424 - DNA, 13 bp, Homo sapiens
aaatgacagtgaa

SEQ ID NO: 1968425 - DNA, 13 bp, Homo sapiens
aaatgaccaagaa

SEQ ID NO: 1968426 - DNA, 20 bp, Homo sapiens
aaatgaccaagaaaaagaaa

SEQ ID NO: 1968427 - DNA, 12 bp, Homo sapiens
aaatgacctcag

SEQ ID NO: 1968428 - DNA, 21 bp, Homo sapiens
aaatgacctcagcaaatcctc

SEQ ID NO: 1968429 - DNA, 22 bp, Homo sapiens
aaatgacctcagcaaatcctct

SEQ ID NO: 1968430 - DNA, 19 bp, Homo sapiens
aaatgagatttttgttttc

SEQ ID NO: 1968431 - DNA, 22 bp, Homo sapiens
aaatgagcattagctacttttc

SEQ ID NO: 1968432 - DNA, 14 bp, Homo sapiens
aaatgaggacatgt

SEQ ID NO: 1968433 - DNA, 17 bp, Homo sapiens
aaatgataaagatgtca

SEQ ID NO: 1968434 - DNA, 19 bp, Homo sapiens
aaatgataaagatgtcaaa

SEQ ID NO: 1968435 - DNA, 20 bp, Homo sapiens
aaatgataaagatgtcaaat

SEQ ID NO: 1968436 - DNA, 16 bp, Homo sapiens
aaatgatcttttcaag

SEQ ID NO: 1968437 - DNA, 19 bp, Homo sapiens
aaatgattttcatcaattt

SEQ ID NO: 1968438 - DNA, 21 bp, Homo sapiens
aaatgattttcatcaatttaa

SEQ ID NO: 1968439 - DNA, 21 bp, Homo sapiens
aaatgcaaacacacaaaggta

SEQ ID NO: 1968440 - DNA, 16 bp, Homo sapiens
aaatgcaacaacatgt

SEQ ID NO: 1968441 - DNA, 14 bp, Homo sapiens
aaatgcaagatttt

SEQ ID NO: 1968442 - DNA, 23 bp, Homo sapiens
aaatgcagcgaaccaatatttgt

SEQ ID NO: 1968443 - DNA, 22 bp, Homo sapiens
aaatgcatgattttatacatag

SEQ ID NO: 1968444 - DNA, 13 bp, Homo sapiens
aaatgcatggagg

SEQ ID NO: 1968445 - DNA, 20 bp, Homo sapiens
aaatgcattataggatcatt

SEQ ID NO: 1968446 - DNA, 15 bp, Homo sapiens
aaatgctaaatgcaa

SEQ ID NO: 1968447 - DNA, 18 bp, Homo sapiens
aaatgctaaatgcaaaca

SEQ ID NO: 1968448 - DNA, 20 bp, Homo sapiens
aaatggagcttgtacatatt

SEQ ID NO: 1968449 - DNA, 17 bp, Homo sapiens
aaatggcaagttttgat

SEQ ID NO: 1968450 - DNA, 22 bp, Homo sapiens
aaatggccatttgctttttcac

SEQ ID NO: 1968451 - DNA, 23 bp, Homo sapiens
aaatggccatttgctttttcacc

SEQ ID NO: 1968452 - DNA, 20 bp, Homo sapiens
aaatggctctgtgaaatcag

SEQ ID NO: 1968453 - DNA, 20 bp, Homo sapiens
aaatgggttggtgcttctaa

SEQ ID NO: 1968454 - DNA, 22 bp, Homo sapiens
aaatgggttggtgcttctaacc

SEQ ID NO: 1968455 - DNA, 13 bp, Homo sapiens
aaatggtgggaac

SEQ ID NO: 1968456 - DNA, 16 bp, Homo sapiens
aaatggtggtttgtca

SEQ ID NO: 1968457 - DNA, 21 bp, Homo sapiens
aaatggtggtttgtcatatat

SEQ ID NO: 1968458 - DNA, 23 bp, Homo sapiens
aaatggtggtttgtcatatattc

SEQ ID NO: 1968459 - DNA, 17 bp, Homo sapiens
aaatgtaacttttgtaa

SEQ ID NO: 1968460 - DNA, 13 bp, Homo sapiens
aaatgtatataca

SEQ ID NO: 1968461 - DNA, 15 bp, Homo sapiens
aaatgtatatacaca

SEQ ID NO: 1968462 - DNA, 17 bp, Homo sapiens
aaatgtatatacacata

SEQ ID NO: 1968463 - DNA, 21 bp, Homo sapiens
aaatgtcacaatcctgtccct

SEQ ID NO: 1968464 - DNA, 16 bp, Homo sapiens
aaatgtcatcaaatat

SEQ ID NO: 1968465 - DNA, 18 bp, Homo sapiens
aaatgtcattatgtagaa

SEQ ID NO: 1968466 - DNA, 15 bp, Homo sapiens
aaatgtccaaaatgt

SEQ ID NO: 1968467 - DNA, 21 bp, Homo sapiens
aaatgtctatagagaaaaact

SEQ ID NO: 1968468 - DNA, 21 bp, Homo sapiens
aaatgtctctttaatgtcaca

SEQ ID NO: 1968469 - DNA, 16 bp, Homo sapiens
aaatgtcttatatagc

SEQ ID NO: 1968470 - DNA, 16 bp, Homo sapiens
aaatgtgaagggtggg

SEQ ID NO: 1968471 - DNA, 15 bp, Homo sapiens
aaatgtggctcctgg

SEQ ID NO: 1968472 - DNA, 12 bp, Homo sapiens
aaatgtgtaaat

SEQ ID NO: 1968473 - DNA, 15 bp, Homo sapiens
aaatgtgtattctgg

SEQ ID NO: 1968474 - DNA, 18 bp, Homo sapiens
aaatgttcatcaattccc

SEQ ID NO: 1968475 - DNA, 17 bp, Homo sapiens
aaatgttcccttgacca

SEQ ID NO: 1968476 - DNA, 17 bp, Homo sapiens
aaatgttctatatgcat

SEQ ID NO: 1968477 - DNA, 15 bp, Homo sapiens
aaatgttctttgggg

SEQ ID NO: 1968478 - DNA, 23 bp, Homo sapiens
aaatgttgatcttccactgcaaa

SEQ ID NO: 1968479 - DNA, 19 bp, Homo sapiens
aaatgttggaattttcaaa

SEQ ID NO: 1968480 - DNA, 23 bp, Homo sapiens
aaatgtttctgcagtagtctctg

SEQ ID NO: 1968481 - DNA, 13 bp, Homo sapiens
aaatgttttacaa

SEQ ID NO: 1968482 - DNA, 12 bp, Homo sapiens
aaattaacactg

SEQ ID NO: 1968483 - DNA, 21 bp, Homo sapiens
aaattaacactgcttgtgttt

SEQ ID NO: 1968484 - DNA, 21 bp, Homo sapiens
aaattaactgggtaatgaaac

SEQ ID NO: 1968485 - DNA, 20 bp, Homo sapiens
aaattaagagatacattccc

SEQ ID NO: 1968486 - DNA, 16 bp, Homo sapiens
aaattaatacttcatt

SEQ ID NO: 1968487 - DNA, 16 bp, Homo sapiens
aaattacacccaaaga

SEQ ID NO: 1968488 - DNA, 15 bp, Homo sapiens
aaattactctttctc

SEQ ID NO: 1968489 - DNA, 14 bp, Homo sapiens
aaattagatgaact

SEQ ID NO: 1968490 - DNA, 22 bp, Homo sapiens
aaattaggaggctcaacaataa

SEQ ID NO: 1968491 - DNA, 23 bp, Homo sapiens
aaattaggttttgtacaattgaa

SEQ ID NO: 1968492 - DNA, 20 bp, Homo sapiens
aaattagtgaagttctttta

SEQ ID NO: 1968493 - DNA, 17 bp, Homo sapiens
aaattataacttaaaat

SEQ ID NO: 1968494 - DNA, 20 bp, Homo sapiens
aaattatgttacatctgttt

SEQ ID NO: 1968495 - DNA, 12 bp, Homo sapiens
aaattatttaaa

SEQ ID NO: 1968496 - DNA, 15 bp, Homo sapiens
aaattatttaataaa

SEQ ID NO: 1968497 - DNA, 13 bp, Homo sapiens
aaattatttcata

SEQ ID NO: 1968498 - DNA, 20 bp, Homo sapiens
aaattatttcatacaaaact

SEQ ID NO: 1968499 - DNA, 16 bp, Homo sapiens
aaattatttgtgtaat

SEQ ID NO: 1968500 - DNA, 20 bp, Homo sapiens
aaattcaacctgtgtcttat

SEQ ID NO: 1968501 - DNA, 20 bp, Homo sapiens
aaattcaaggagatataaaa

SEQ ID NO: 1968502 - DNA, 14 bp, Homo sapiens
aaattcacactgtg

SEQ ID NO: 1968503 - DNA, 16 bp, Homo sapiens
aaattcatttcacatt

SEQ ID NO: 1968504 - DNA, 19 bp, Homo sapiens
aaattccatgtccctgtat

SEQ ID NO: 1968505 - DNA, 15 bp, Homo sapiens
aaattctgctcagat

SEQ ID NO: 1968506 - DNA, 17 bp, Homo sapiens
aaattcttgaagttcat

SEQ ID NO: 1968507 - DNA, 17 bp, Homo sapiens
aaattgaagagagatat

SEQ ID NO: 1968508 - DNA, 13 bp, Homo sapiens
aaattgaatgcaa

SEQ ID NO: 1968509 - DNA, 18 bp, Homo sapiens
aaattgacaacattttat

SEQ ID NO: 1968510 - DNA, 9 bp, Homo sapiens
aaattgcac

SEQ ID NO: 1968511 - DNA, 22 bp, Homo sapiens
aaattgcacaatttgagcaatt

SEQ ID NO: 1968512 - DNA, 19 bp, Homo sapiens
aaattgctagtgatttcat

SEQ ID NO: 1968513 - DNA, 20 bp, Homo sapiens
aaattgctagtgatttcatt

SEQ ID NO: 1968514 - DNA, 19 bp, Homo sapiens
aaattgctattttatttgt

SEQ ID NO: 1968515 - DNA, 14 bp, Homo sapiens
aaattgctccttga

SEQ ID NO: 1968516 - DNA, 15 bp, Homo sapiens
aaattggaattttct

SEQ ID NO: 1968517 - DNA, 22 bp, Homo sapiens
aaattggtaattgaatggaagc

SEQ ID NO: 1968518 - DNA, 16 bp, Homo sapiens
aaattggtgataagtg

SEQ ID NO: 1968519 - DNA, 18 bp, Homo sapiens
aaattggtgataagtgga

SEQ ID NO: 1968520 - DNA, 19 bp, Homo sapiens
aaattgtatacattttgtt

SEQ ID NO: 1968521 - DNA, 13 bp, Homo sapiens
aaattgtgatgtt

SEQ ID NO: 1968522 - DNA, 15 bp, Homo sapiens
aaattgtgatgtttt

SEQ ID NO: 1968523 - DNA, 21 bp, Homo sapiens
aaattgtttggcttcctcctg

SEQ ID NO: 1968524 - DNA, 14 bp, Homo sapiens
aaatttaaactata

SEQ ID NO: 1968525 - DNA, 14 bp, Homo sapiens
aaatttaataaaaa

SEQ ID NO: 1968526 - DNA, 15 bp, Homo sapiens
aaatttaattttgca

SEQ ID NO: 1968527 - DNA, 13 bp, Homo sapiens
aaatttcaaaaga

SEQ ID NO: 1968528 - DNA, 21 bp, Homo sapiens
aaatttcaaaagacatgttgt

SEQ ID NO: 1968529 - DNA, 12 bp, Homo sapiens
aaatttcagatt

SEQ ID NO: 1968530 - DNA, 22 bp, Homo sapiens
aaatttccagtacctttgtcac

SEQ ID NO: 1968531 - DNA, 16 bp, Homo sapiens
aaatttggttctaata

SEQ ID NO: 1968532 - DNA, 18 bp, Homo sapiens
aaatttgttgaaattatg

SEQ ID NO: 1968533 - DNA, 10 bp, Homo sapiens
aaattttaac

SEQ ID NO: 1968534 - DNA, 11 bp, Homo sapiens
aaattttagag

SEQ ID NO: 1968535 - DNA, 16 bp, Homo sapiens
aaattttagagcatac

SEQ ID NO: 1968536 - DNA, 12 bp, Homo sapiens
aaattttattcc

SEQ ID NO: 1968537 - DNA, 14 bp, Homo sapiens
aaattttcaaactt

SEQ ID NO: 1968538 - DNA, 14 bp, Homo sapiens
aaattttctagact

SEQ ID NO: 1968539 - DNA, 18 bp, Homo sapiens
aaattttctagactttct

SEQ ID NO: 1968540 - DNA, 18 bp, Homo sapiens
aaattttctatgcttatt

SEQ ID NO: 1968541 - DNA, 12 bp, Homo sapiens
aaattttgaatg

SEQ ID NO: 1968542 - DNA, 11 bp, Homo sapiens
aaattttgtcc

SEQ ID NO: 1968543 - DNA, 17 bp, Homo sapiens
aaattttgtttcagaat

SEQ ID NO: 1968544 - DNA, 15 bp, Homo sapiens
aaatttttatttttc

SEQ ID NO: 1968545 - DNA, 14 bp, Homo sapiens
aaatttttcctgca

SEQ ID NO: 1968546 - DNA, 21 bp, Homo sapiens
aaatttttctcagtttgtata

SEQ ID NO: 1968547 - DNA, 19 bp, Homo sapiens
aaattttttgatgtcagcc

SEQ ID NO: 1968548 - DNA, 13 bp, Homo sapiens
aacaaaacaagaa

SEQ ID NO: 1968549 - DNA, 17 bp, Homo sapiens
aacaaaacaagaaagaa

SEQ ID NO: 1968550 - DNA, 15 bp, Homo sapiens
aacaaaagcaagact

SEQ ID NO: 1968551 - DNA, 21 bp, Homo sapiens
aacaaacactgaatcatgtta

SEQ ID NO: 1968552 - DNA, 20 bp, Homo sapiens
aacaaactcgttttttacaa

SEQ ID NO: 1968553 - DNA, 20 bp, Homo sapiens
aacaaagaaataaaatcctg

SEQ ID NO: 1968554 - DNA, 13 bp, Homo sapiens
aacaaagaaatat

SEQ ID NO: 1968555 - DNA, 19 bp, Homo sapiens
aacaaagagaaaaaataca

SEQ ID NO: 1968556 - DNA, 19 bp, Homo sapiens
aacaaagagttcaagaaat

SEQ ID NO: 1968557 - DNA, 23 bp, Homo sapiens
aacaaagagttcaagaaataagt

SEQ ID NO: 1968558 - DNA, 16 bp, Homo sapiens
aacaaatagtctatca

SEQ ID NO: 1968559 - DNA, 20 bp, Homo sapiens
aacaaattaggttttgtaca

SEQ ID NO: 1968560 - DNA, 13 bp, Homo sapiens
aacaacaacaata

SEQ ID NO: 1968561 - DNA, 15 bp, Homo sapiens
aacaacaacaataac

SEQ ID NO: 1968562 - DNA, 13 bp, Homo sapiens
aacaacatgtata

SEQ ID NO: 1968563 - DNA, 23 bp, Homo sapiens
aacaactccctgaacctcagttt

SEQ ID NO: 1968564 - DNA, 16 bp, Homo sapiens
aacaacttctttgtaa

SEQ ID NO: 1968565 - DNA, 17 bp, Homo sapiens
aacaacttctttgtaat

SEQ ID NO: 1968566 - DNA, 12 bp, Homo sapiens
aacaagaaagaa

SEQ ID NO: 1968567 - DNA, 19 bp, Homo sapiens
aacaagatctttcaggaaa

SEQ ID NO: 1968568 - DNA, 22 bp, Homo sapiens
aacaagcaaggatatcagagct

SEQ ID NO: 1968569 - DNA, 19 bp, Homo sapiens
aacaaggggctgttacata

SEQ ID NO: 1968570 - DNA, 15 bp, Homo sapiens
aacaagtagaaaagt

SEQ ID NO: 1968571 - DNA, 20 bp, Homo sapiens
aacaagtatttgttaattta

SEQ ID NO: 1968572 - DNA, 19 bp, Homo sapiens
aacaagtcacagctgcagc

SEQ ID NO: 1968573 - DNA, 20 bp, Homo sapiens
aacaagtcacagctgcagct

SEQ ID NO: 1968574 - DNA, 15 bp, Homo sapiens
aacaataacaacaat

SEQ ID NO: 1968575 - DNA, 22 bp, Homo sapiens
aacaatacaacaagaacaacaa

SEQ ID NO: 1968576 - DNA, 23 bp, Homo sapiens
aacaatacaacaagaacaacaac

SEQ ID NO: 1968577 - DNA, 16 bp, Homo sapiens
aacaatagctattgca

SEQ ID NO: 1968578 - DNA, 23 bp, Homo sapiens
aacaatagctattgcatgtaaaa

SEQ ID NO: 1968579 - DNA, 23 bp, Homo sapiens
aacaatgtatgtgaaagtgtaaa

SEQ ID NO: 1968580 - DNA, 14 bp, Homo sapiens
aacaattctaaaat

SEQ ID NO: 1968581 - DNA, 20 bp, Homo sapiens
aacaatttcctttatattta

SEQ ID NO: 1968582 - DNA, 21 bp, Homo sapiens
aacaatttcctttatatttag

SEQ ID NO: 1968583 - DNA, 13 bp, Homo sapiens
aacaattttaatg

SEQ ID NO: 1968584 - DNA, 15 bp, Homo sapiens
aacacaaaccacaac

SEQ ID NO: 1968585 - DNA, 14 bp, Homo sapiens
aacacaaatgtaaa

SEQ ID NO: 1968586 - DNA, 23 bp, Homo sapiens
aacacaagacaccttttgtattt

SEQ ID NO: 1968587 - DNA, 12 bp, Homo sapiens
aacacacaacag

SEQ ID NO: 1968588 - DNA, 18 bp, Homo sapiens
aacacagcaagggtgatg

SEQ ID NO: 1968589 - DNA, 23 bp, Homo sapiens
aacacagcagttctgcagaggac

SEQ ID NO: 1968590 - DNA, 22 bp, Homo sapiens
aacacagcctgggaccagggca

SEQ ID NO: 1968591 - DNA, 19 bp, Homo sapiens
aacacagctgagagacttt

SEQ ID NO: 1968592 - DNA, 15 bp, Homo sapiens
aacacagctttacaa

SEQ ID NO: 1968593 - DNA, 15 bp, Homo sapiens
aacacagggttttgt

SEQ ID NO: 1968594 - DNA, 17 bp, Homo sapiens
aacacagggttttgtat

SEQ ID NO: 1968595 - DNA, 13 bp, Homo sapiens
aacacagtttagt

SEQ ID NO: 1968596 - DNA, 20 bp, Homo sapiens
aacacagttttgaaagaaaa

SEQ ID NO: 1968597 - DNA, 17 bp, Homo sapiens
aacacatactagaaagc

SEQ ID NO: 1968598 - DNA, 16 bp, Homo sapiens
aacacattacttgcac

SEQ ID NO: 1968599 - DNA, 15 bp, Homo sapiens
aacaccactttgtct

SEQ ID NO: 1968600 - DNA, 20 bp, Homo sapiens
aacaccataggtagaatgta

SEQ ID NO: 1968601 - DNA, 14 bp, Homo sapiens
aacacccactggcc

SEQ ID NO: 1968602 - DNA, 15 bp, Homo sapiens
aacacccactggcca

SEQ ID NO: 1968603 - DNA, 23 bp, Homo sapiens
aacacctcccaggagacagttca

SEQ ID NO: 1968604 - DNA, 14 bp, Homo sapiens
aacacctgacacat

SEQ ID NO: 1968605 - DNA, 15 bp, Homo sapiens
aacacctgacacatc

SEQ ID NO: 1968606 - DNA, 20 bp, Homo sapiens
aacaccttcttggcttctgg

SEQ ID NO: 1968607 - DNA, 14 bp, Homo sapiens
aacacgcattgtac

SEQ ID NO: 1968608 - DNA, 14 bp, Homo sapiens
aacacggcagctgt

SEQ ID NO: 1968609 - DNA, 18 bp, Homo sapiens
aacacggcagctgtagct

SEQ ID NO: 1968610 - DNA, 21 bp, Homo sapiens
aacacgtccagaatttttcat

SEQ ID NO: 1968611 - DNA, 16 bp, Homo sapiens
aacacgtgtctataat

SEQ ID NO: 1968612 - DNA, 20 bp, Homo sapiens
aacactatatggcagtgtct

SEQ ID NO: 1968613 - DNA, 19 bp, Homo sapiens
aacactcagaagcctgggg

SEQ ID NO: 1968614 - DNA, 20 bp, Homo sapiens
aacactccaccccctccagc

SEQ ID NO: 1968615 - DNA, 14 bp, Homo sapiens
aacactgcaagaag

SEQ ID NO: 1968616 - DNA, 11 bp, Homo sapiens
aacagaaggag

SEQ ID NO: 1968617 - DNA, 13 bp, Homo sapiens
aacagaattttaa

SEQ ID NO: 1968618 - DNA, 18 bp, Homo sapiens
aacagacaaaaacagcct

SEQ ID NO: 1968619 - DNA, 21 bp, Homo sapiens
aacagacaaaaacagcctcac

SEQ ID NO: 1968620 - DNA, 14 bp, Homo sapiens
aacagacaggagaa

SEQ ID NO: 1968621 - DNA, 20 bp, Homo sapiens
aacagactatttaacttgag

SEQ ID NO: 1968622 - DNA, 23 bp, Homo sapiens
aacagactgaattttaaatgttc

SEQ ID NO: 1968623 - DNA, 19 bp, Homo sapiens
aacagactggaagcacagc

SEQ ID NO: 1968624 - DNA, 13 bp, Homo sapiens
aacagagaaggca

SEQ ID NO: 1968625 - DNA, 11 bp, Homo sapiens
aacagagactc

SEQ ID NO: 1968626 - DNA, 19 bp, Homo sapiens
aacagagccttcacaacca

SEQ ID NO: 1968627 - DNA, 14 bp, Homo sapiens
aacagagcgggcct

SEQ ID NO: 1968628 - DNA, 21 bp, Homo sapiens
aacagaggccatggcagaata

SEQ ID NO: 1968629 - DNA, 14 bp, Homo sapiens
aacagagtatatat

SEQ ID NO: 1968630 - DNA, 19 bp, Homo sapiens
aacagagtgagaccctgtc

SEQ ID NO: 1968631 - DNA, 16 bp, Homo sapiens
aacagcagaggttctt

SEQ ID NO: 1968632 - DNA, 21 bp, Homo sapiens
aacagcagaggttcttttaaa

SEQ ID NO: 1968633 - DNA, 11 bp, Homo sapiens
aacagcagtgt

SEQ ID NO: 1968634 - DNA, 23 bp, Homo sapiens
aacagcatctgcctctattcaat

SEQ ID NO: 1968635 - DNA, 22 bp, Homo sapiens
aacagccgtcagccaaatgtaa

SEQ ID NO: 1968636 - DNA, 13 bp, Homo sapiens
aacagcctcacag

SEQ ID NO: 1968637 - DNA, 16 bp, Homo sapiens
aacagctaatgggaca

SEQ ID NO: 1968638 - DNA, 20 bp, Homo sapiens
aacagctcttcactcagcca

SEQ ID NO: 1968639 - DNA, 18 bp, Homo sapiens
aacagcttgaccagacct

SEQ ID NO: 1968640 - DNA, 18 bp, Homo sapiens
aacagcttttcccaggag

SEQ ID NO: 1968641 - DNA, 19 bp, Homo sapiens
aacaggaaaaaaaataatg

SEQ ID NO: 1968642 - DNA, 10 bp, Homo sapiens
aacaggaagc

SEQ ID NO: 1968643 - DNA, 15 bp, Homo sapiens
aacaggaatctcaga

SEQ ID NO: 1968644 - DNA, 21 bp, Homo sapiens
acatatatatatacacataca

SEQ ID NO: 1968645 - DNA, 13 bp, Homo sapiens
acatatatatctg

SEQ ID NO: 1968646 - DNA, 17 bp, Homo sapiens
acatatatatctgataa

SEQ ID NO: 1968647 - DNA, 20 bp, Homo sapiens
acatatatatctgataaaat

SEQ ID NO: 1968648 - DNA, 22 bp, Homo sapiens
acatatatatgccttatgtaat

SEQ ID NO: 1968649 - DNA, 23 bp, Homo sapiens
acatatatgtatatgtatatcta

SEQ ID NO: 1968650 - DNA, 15 bp, Homo sapiens
acatatcaattcaac

SEQ ID NO: 1968651 - DNA, 16 bp, Homo sapiens
acatatcaattcaaca

SEQ ID NO: 1968652 - DNA, 12 bp, Homo sapiens
acatatcagaaa

SEQ ID NO: 1968653 - DNA, 16 bp, Homo sapiens
acatatcagaaaagta

SEQ ID NO: 1968654 - DNA, 21 bp, Homo sapiens
acatatcagaaaagtagaatt

SEQ ID NO: 1968655 - DNA, 13 bp, Homo sapiens
acatatcattttt

SEQ ID NO: 1968656 - DNA, 15 bp, Homo sapiens
acatatgaaatttaa

SEQ ID NO: 1968657 - DNA, 16 bp, Homo sapiens
acatatgatactgatg

SEQ ID NO: 1968658 - DNA, 17 bp, Homo sapiens
acatatgcaccttgtgt

SEQ ID NO: 1968659 - DNA, 19 bp, Homo sapiens
acatatgcaccttgtgtct

SEQ ID NO: 1968660 - DNA, 20 bp, Homo sapiens
acatatgcaccttgtgtctg

SEQ ID NO: 1968661 - DNA, 16 bp, Homo sapiens
acatatgggtgctggc

SEQ ID NO: 1968662 - DNA, 13 bp, Homo sapiens
acatatgtaaaat

SEQ ID NO: 1968663 - DNA, 16 bp, Homo sapiens
acatatgtagactata

SEQ ID NO: 1968664 - DNA, 16 bp, Homo sapiens
acatattataaataaa

SEQ ID NO: 1968665 - DNA, 17 bp, Homo sapiens
acatattggaaaggtca

SEQ ID NO: 1968666 - DNA, 13 bp, Homo sapiens
acatcaacattcc

SEQ ID NO: 1968667 - DNA, 16 bp, Homo sapiens
acatcacttgtacaaa

SEQ ID NO: 1968668 - DNA, 14 bp, Homo sapiens
acatcaggagttca

SEQ ID NO: 1968669 - DNA, 15 bp, Homo sapiens
acatcattcttgaga

SEQ ID NO: 1968670 - DNA, 15 bp, Homo sapiens
acatccaatgcatag

SEQ ID NO: 1968671 - DNA, 11 bp, Homo sapiens
acatccatgtc

SEQ ID NO: 1968672 - DNA, 13 bp, Homo sapiens
acatccattccca

SEQ ID NO: 1968673 - DNA, 18 bp, Homo sapiens
acatccattcccaagaaa

SEQ ID NO: 1968674 - DNA, 21 bp, Homo sapiens
acatccattcccaagaaatgc

SEQ ID NO: 1968675 - DNA, 20 bp, Homo sapiens
acatccatttcatctatttc

SEQ ID NO: 1968676 - DNA, 14 bp, Homo sapiens
acatcccacagtgg

SEQ ID NO: 1968677 - DNA, 18 bp, Homo sapiens
acatcccaggaggggcct

SEQ ID NO: 1968678 - DNA, 17 bp, Homo sapiens
acatcccattgccctgg

SEQ ID NO: 1968679 - DNA, 15 bp, Homo sapiens
acatccccaggtctc

SEQ ID NO: 1968680 - DNA, 15 bp, Homo sapiens
acatcccggcctctt

SEQ ID NO: 1968681 - DNA, 17 bp, Homo sapiens
acatccctaacatcatg

SEQ ID NO: 1968682 - DNA, 15 bp, Homo sapiens
acatccctgggcctg

SEQ ID NO: 1968683 - DNA, 16 bp, Homo sapiens
acatccctgggcctgc

SEQ ID NO: 1968684 - DNA, 18 bp, Homo sapiens
acatccctgggcctgctg

SEQ ID NO: 1968685 - DNA, 19 bp, Homo sapiens
acatccctgggcctgctgc

SEQ ID NO: 1968686 - DNA, 20 bp, Homo sapiens
acatccctgggcctgctgct

SEQ ID NO: 1968687 - DNA, 21 bp, Homo sapiens
acatccctgggcctgctgctg

SEQ ID NO: 1968688 - DNA, 23 bp, Homo sapiens
acatctaatgtctcttcctctgt

SEQ ID NO: 1968689 - DNA, 14 bp, Homo sapiens
acatctcactttgc

SEQ ID NO: 1968690 - DNA, 20 bp, Homo sapiens
acatctcgagccccctggat

SEQ ID NO: 1968691 - DNA, 15 bp, Homo sapiens
acatctctgaaagca

SEQ ID NO: 1968692 - DNA, 13 bp, Homo sapiens
acatctgaaagcc

SEQ ID NO: 1968693 - DNA, 12 bp, Homo sapiens
acatctgataac

SEQ ID NO: 1968694 - DNA, 15 bp, Homo sapiens
acatctgtcctgtga

SEQ ID NO: 1968695 - DNA, 15 bp, Homo sapiens
acatctgtgtctctg

SEQ ID NO: 1968696 - DNA, 16 bp, Homo sapiens
acatcttcagctccca

SEQ ID NO: 1968697 - DNA, 16 bp, Homo sapiens
acatcttctcagtgtt

SEQ ID NO: 1968698 - DNA, 22 bp, Homo sapiens
acatcttgctctgctgacagac

SEQ ID NO: 1968699 - DNA, 16 bp, Homo sapiens
acatctttttcctccc

SEQ ID NO: 1968700 - DNA, 20 bp, Homo sapiens
acatgaaaaacacggcagct

SEQ ID NO: 1968701 - DNA, 22 bp, Homo sapiens
acatgaaaaacacggcagctgt

SEQ ID NO: 1968702 - DNA, 14 bp, Homo sapiens
acatgaaaactatt

SEQ ID NO: 1968703 - DNA, 15 bp, Homo sapiens
acatgaaacagaaac

SEQ ID NO: 1968704 - DNA, 19 bp, Homo sapiens
acatgaagtgtgtttcctt

SEQ ID NO: 1968705 - DNA, 15 bp, Homo sapiens
acatgaatgcacact

SEQ ID NO: 1968706 - DNA, 14 bp, Homo sapiens
acatgacactgacc

SEQ ID NO: 1968707 - DNA, 15 bp, Homo sapiens
acatgacactgacct

SEQ ID NO: 1968708 - DNA, 11 bp, Homo sapiens
acatgacattt

SEQ ID NO: 1968709 - DNA, 14 bp, Homo sapiens
acatgacgtaaaat

SEQ ID NO: 1968710 - DNA, 22 bp, Homo sapiens
acatgagaaaatcagtaattgg

SEQ ID NO: 1968711 - DNA, 11 bp, Homo sapiens
acatgagaaat

SEQ ID NO: 1968712 - DNA, 12 bp, Homo sapiens
acatgaggaggg

SEQ ID NO: 1968713 - DNA, 13 bp, Homo sapiens
acatgaggagggt

SEQ ID NO: 1968714 - DNA, 19 bp, Homo sapiens
acatgatttagggaagcag

SEQ ID NO: 1968715 - DNA, 15 bp, Homo sapiens
acatgcaacccgaag

SEQ ID NO: 1968716 - DNA, 21 bp, Homo sapiens
acatgcaatttattaaaatga

SEQ ID NO: 1968717 - DNA, 18 bp, Homo sapiens
acatgcacatttatatat

SEQ ID NO: 1968718 - DNA, 19 bp, Homo sapiens
acatgcacatttatatata

SEQ ID NO: 1968719 - DNA, 17 bp, Homo sapiens
acatgcactatgaggaa

SEQ ID NO: 1968720 - DNA, 18 bp, Homo sapiens
acatgcactgacccttcc

SEQ ID NO: 1968721 - DNA, 22 bp, Homo sapiens
acatgcacttggctgcataaat

SEQ ID NO: 1968722 - DNA, 16 bp, Homo sapiens
acatgcattactgcat

SEQ ID NO: 1968723 - DNA, 21 bp, Homo sapiens
acatgccaccctctccatgcc

SEQ ID NO: 1968724 - DNA, 15 bp, Homo sapiens
acatgccagcttcct

SEQ ID NO: 1968725 - DNA, 18 bp, Homo sapiens
acatgccatttgtactga

SEQ ID NO: 1968726 - DNA, 18 bp, Homo sapiens
acatgcctgattttaaaa

SEQ ID NO: 1968727 - DNA, 17 bp, Homo sapiens
acatgctaagagaagta

SEQ ID NO: 1968728 - DNA, 19 bp, Homo sapiens
acatgctaagagaagtaga

SEQ ID NO: 1968729 - DNA, 18 bp, Homo sapiens
acatgctgtgctctttga

SEQ ID NO: 1968730 - DNA, 13 bp, Homo sapiens
acatgctttgttt

SEQ ID NO: 1968731 - DNA, 22 bp, Homo sapiens
acatggagactcctgccctgtt

SEQ ID NO: 1968732 - DNA, 15 bp, Homo sapiens
acatggccagtgtga

SEQ ID NO: 1968733 - DNA, 18 bp, Homo sapiens
acatggctatcctagaga

SEQ ID NO: 1968734 - DNA, 19 bp, Homo sapiens
acatggctatcctagagag

SEQ ID NO: 1968735 - DNA, 17 bp, Homo sapiens
acatggctttgctttgt

SEQ ID NO: 1968736 - DNA, 18 bp, Homo sapiens
acatggggttttcaattt

SEQ ID NO: 1968737 - DNA, 21 bp, Homo sapiens
acatggtgaaacctcatctct

SEQ ID NO: 1968738 - DNA, 14 bp, Homo sapiens
acatggtgttgtat

SEQ ID NO: 1968739 - DNA, 15 bp, Homo sapiens
acatggtgttgtata

SEQ ID NO: 1968740 - DNA, 18 bp, Homo sapiens
acatgtactccagaggga

SEQ ID NO: 1968741 - DNA, 20 bp, Homo sapiens
acatgtataatatttttaat

SEQ ID NO: 1968742 - DNA, 13 bp, Homo sapiens
acatgtatagtga

SEQ ID NO: 1968743 - DNA, 15 bp, Homo sapiens
acatgtatagtgagt

SEQ ID NO: 1968744 - DNA, 21 bp, Homo sapiens
acatgtccagtgggaggtgag

SEQ ID NO: 1968745 - DNA, 17 bp, Homo sapiens
acatgtcggagtagaaa

SEQ ID NO: 1968746 - DNA, 19 bp, Homo sapiens
acatgtcttgtacatgtgt

SEQ ID NO: 1968747 - DNA, 12 bp, Homo sapiens
acatgtgacaca

SEQ ID NO: 1968748 - DNA, 15 bp, Homo sapiens
acatgtgacacatat

SEQ ID NO: 1968749 - DNA, 11 bp, Homo sapiens
acatgtgctat

SEQ ID NO: 1968750 - DNA, 16 bp, Homo sapiens
acatgtgctattgaac

SEQ ID NO: 1968751 - DNA, 23 bp, Homo sapiens
acatgtgctattgaactgagcca

SEQ ID NO: 1968752 - DNA, 16 bp, Homo sapiens
acatgtggtttataga

SEQ ID NO: 1968753 - DNA, 17 bp, Homo sapiens
acatgtgtagcctgtgc

SEQ ID NO: 1968754 - DNA, 21 bp, Homo sapiens
acatgtgtctgtgtggtatat

SEQ ID NO: 1968755 - DNA, 12 bp, Homo sapiens
acatgtgtgtat

SEQ ID NO: 1968756 - DNA, 18 bp, Homo sapiens
acatgtgtgtatatatgt

SEQ ID NO: 1968757 - DNA, 20 bp, Homo sapiens
acatgttgtaagcactgact

SEQ ID NO: 1968758 - DNA, 21 bp, Homo sapiens
acatgtttatttattctgcat

SEQ ID NO: 1968759 - DNA, 15 bp, Homo sapiens
acatgtttcacaaca

SEQ ID NO: 1968760 - DNA, 16 bp, Homo sapiens
acatgtttcacaacag

SEQ ID NO: 1968761 - DNA, 22 bp, Homo sapiens
acatgtttcacaacaggcattc

SEQ ID NO: 1968762 - DNA, 15 bp, Homo sapiens
acagccccacagcac

SEQ ID NO: 1968763 - DNA, 20 bp, Homo sapiens
acagccccacagcacccagg

SEQ ID NO: 1968764 - DNA, 15 bp, Homo sapiens
acagccccagggccc

SEQ ID NO: 1968765 - DNA, 23 bp, Homo sapiens
acagcccgggtgtgcctgccctg

SEQ ID NO: 1968766 - DNA, 12 bp, Homo sapiens
acagccctggga

SEQ ID NO: 1968767 - DNA, 13 bp, Homo sapiens
acagccgcagcct

SEQ ID NO: 1968768 - DNA, 22 bp, Homo sapiens
acagccgcagcctccctctgac

SEQ ID NO: 1968769 - DNA, 23 bp, Homo sapiens
acagccgcagcctccctctgacc

SEQ ID NO: 1968770 - DNA, 18 bp, Homo sapiens
acagccgctcctgtctgc

SEQ ID NO: 1968771 - DNA, 14 bp, Homo sapiens
acagcctcacagaa

SEQ ID NO: 1968772 - DNA, 17 bp, Homo sapiens
acagcctcacagaagaa

SEQ ID NO: 1968773 - DNA, 20 bp, Homo sapiens
acagcctgacaacatttcta

SEQ ID NO: 1968774 - DNA, 12 bp, Homo sapiens
acagcctggact

SEQ ID NO: 1968775 - DNA, 11 bp, Homo sapiens
acagcctggca

SEQ ID NO: 1968776 - DNA, 12 bp, Homo sapiens
acagcctggcac

SEQ ID NO: 1968777 - DNA, 18 bp, Homo sapiens
acagcctgggaccagggc

SEQ ID NO: 1968778 - DNA, 17 bp, Homo sapiens
acagcgaactagaagaa

SEQ ID NO: 1968779 - DNA, 14 bp, Homo sapiens
acagcgagaggcag

SEQ ID NO: 1968780 - DNA, 21 bp, Homo sapiens
acagcggaggagaccagctca

SEQ ID NO: 1968781 - DNA, 23 bp, Homo sapiens
acagcggaggagaccagctcaga

SEQ ID NO: 1968782 - DNA, 16 bp, Homo sapiens
acagcggggccccagg

SEQ ID NO: 1968783 - DNA, 22 bp, Homo sapiens
acagctaatcagcattctcact

SEQ ID NO: 1968784 - DNA, 20 bp, Homo sapiens
acagctcaagtcttccctga

SEQ ID NO: 1968785 - DNA, 21 bp, Homo sapiens
acagctcagctttttgtcttt

SEQ ID NO: 1968786 - DNA, 22 bp, Homo sapiens
acagctcccaccccaccccctt

SEQ ID NO: 1968787 - DNA, 23 bp, Homo sapiens
acagctcctcttaccgtagcctc

SEQ ID NO: 1968788 - DNA, 13 bp, Homo sapiens
acagctccttctg

SEQ ID NO: 1968789 - DNA, 14 bp, Homo sapiens
acagctccttctgt

SEQ ID NO: 1968790 - DNA, 18 bp, Homo sapiens
acagctcggagttgtgag

SEQ ID NO: 1968791 - DNA, 13 bp, Homo sapiens
acagctctgtcct

SEQ ID NO: 1968792 - DNA, 14 bp, Homo sapiens
acagctctgtcctg

SEQ ID NO: 1968793 - DNA, 16 bp, Homo sapiens
acagctctgtcctggg

SEQ ID NO: 1968794 - DNA, 17 bp, Homo sapiens
acagctcttctaaggaa

SEQ ID NO: 1968795 - DNA, 17 bp, Homo sapiens
acagctcttctccaggc

SEQ ID NO: 1968796 - DNA, 20 bp, Homo sapiens
acagctcttctccaggctgt

SEQ ID NO: 1968797 - DNA, 16 bp, Homo sapiens
acagctcttggcattt

SEQ ID NO: 1968798 - DNA, 16 bp, Homo sapiens
acagctgaacagtgtt

SEQ ID NO: 1968799 - DNA, 19 bp, Homo sapiens
acagctgagagacttttaa

SEQ ID NO: 1968800 - DNA, 22 bp, Homo sapiens
acagctgagagacttttaatca

SEQ ID NO: 1968801 - DNA, 15 bp, Homo sapiens
acagctgcagctggg

SEQ ID NO: 1968802 - DNA, 12 bp, Homo sapiens
acagctgcctgc

SEQ ID NO: 1968803 - DNA, 15 bp, Homo sapiens
acagctgctgaagag

SEQ ID NO: 1968804 - DNA, 18 bp, Homo sapiens
acagctgtccctgtcacc

SEQ ID NO: 1968805 - DNA, 17 bp, Homo sapiens
acagctgtgcctcgctc

SEQ ID NO: 1968806 - DNA, 17 bp, Homo sapiens
acagctgtttaagatgg

SEQ ID NO: 1968807 - DNA, 19 bp, Homo sapiens
acagcttcatttcctgtgt

SEQ ID NO: 1968808 - DNA, 17 bp, Homo sapiens
acagcttgaccagacct

SEQ ID NO: 1968809 - DNA, 18 bp, Homo sapiens
acagcttgaccagaccta

SEQ ID NO: 1968810 - DNA, 15 bp, Homo sapiens
acagctttacacaca

SEQ ID NO: 1968811 - DNA, 20 bp, Homo sapiens
acagctttcccctcattttt

SEQ ID NO: 1968812 - DNA, 18 bp, Homo sapiens
acagcttttcccaggaga

SEQ ID NO: 1968813 - DNA, 11 bp, Homo sapiens
acaggaaaaaa

SEQ ID NO: 1968814 - DNA, 15 bp, Homo sapiens
acaggaaaagctgct

SEQ ID NO: 1968815 - DNA, 16 bp, Homo sapiens
acaggaaaagctgctg

SEQ ID NO: 1968816 - DNA, 18 bp, Homo sapiens
acaggaaaagctgctgac

SEQ ID NO: 1968817 - DNA, 19 bp, Homo sapiens
acaggaaaagctgctgaca

SEQ ID NO: 1968818 - DNA, 20 bp, Homo sapiens
acaggaaaagctgctgacag

SEQ ID NO: 1968819 - DNA, 17 bp, Homo sapiens
acaggaaaatcctctgg

SEQ ID NO: 1968820 - DNA, 18 bp, Homo sapiens
acaggaaaatcctctggc

SEQ ID NO: 1968821 - DNA, 23 bp, Homo sapiens
acaggaaaatcctctggctggct

SEQ ID NO: 1968822 - DNA, 16 bp, Homo sapiens
acaggaaagccctccc

SEQ ID NO: 1968823 - DNA, 20 bp, Homo sapiens
acaggaaggtggtgcttaca

SEQ ID NO: 1968824 - DNA, 17 bp, Homo sapiens
acaggaatctcagagac

SEQ ID NO: 1968825 - DNA, 19 bp, Homo sapiens
acaggaatctcagagacag

SEQ ID NO: 1968826 - DNA, 15 bp, Homo sapiens
acaggacacctggcc

SEQ ID NO: 1968827 - DNA, 16 bp, Homo sapiens
acaggactaacactca

SEQ ID NO: 1968828 - DNA, 19 bp, Homo sapiens
acaggactaacactcagaa

SEQ ID NO: 1968829 - DNA, 20 bp, Homo sapiens
acaggactaacactcagaag

SEQ ID NO: 1968830 - DNA, 24 bp, Homo sapiens
acaggactaacactcagaagcctg

SEQ ID NO: 1968831 - DNA, 15 bp, Homo sapiens
acaggactctgcctc

SEQ ID NO: 1968832 - DNA, 16 bp, Homo sapiens
acaggactgattctgg

SEQ ID NO: 1968833 - DNA, 16 bp, Homo sapiens
acaggagcagacagag

SEQ ID NO: 1968834 - DNA, 22 bp, Homo sapiens
acaggagccccacccccatgca

SEQ ID NO: 1968835 - DNA, 23 bp, Homo sapiens
acaggagctacctgtgtggacag

SEQ ID NO: 1968836 - DNA, 19 bp, Homo sapiens
acaggagggagagaactta

SEQ ID NO: 1968837 - DNA, 17 bp, Homo sapiens
acaggaggggcccacaa

SEQ ID NO: 1968838 - DNA, 19 bp, Homo sapiens
acaggaggggcccacaatg

SEQ ID NO: 1968839 - DNA, 21 bp, Homo sapiens
acaggaggggcccacaatgga

SEQ ID NO: 1968840 - DNA, 23 bp, Homo sapiens
acaggaggttgtggatgctccag

SEQ ID NO: 1968841 - DNA, 16 bp, Homo sapiens
acaggagtgagcacta

SEQ ID NO: 1968842 - DNA, 19 bp, Homo sapiens
acaggataaagatatcaat

SEQ ID NO: 1968843 - DNA, 16 bp, Homo sapiens
acaggcaactgaggca

SEQ ID NO: 1968844 - DNA, 19 bp, Homo sapiens
acaggcaagcacctcctgc

SEQ ID NO: 1968845 - DNA, 14 bp, Homo sapiens
acaggcaatgctgg

SEQ ID NO: 1968846 - DNA, 17 bp, Homo sapiens
acaggcaatgctggctg

SEQ ID NO: 1968847 - DNA, 14 bp, Homo sapiens
acaggcacccacca

SEQ ID NO: 1968848 - DNA, 21 bp, Homo sapiens
acaggcagctggatgagactt

SEQ ID NO: 1968849 - DNA, 13 bp, Homo sapiens
acaggcaggtcca

SEQ ID NO: 1968850 - DNA, 17 bp, Homo sapiens
acaggcatctacacagc

SEQ ID NO: 1968851 - DNA, 19 bp, Homo sapiens
acaggcatctacacagcct

SEQ ID NO: 1968852 - DNA, 20 bp, Homo sapiens
acaggcatctacacagcctg

SEQ ID NO: 1968853 - DNA, 18 bp, Homo sapiens
acaggcatgttctctgag

SEQ ID NO: 1968854 - DNA, 16 bp, Homo sapiens
acaggccagccccatc

SEQ ID NO: 1968855 - DNA, 18 bp, Homo sapiens
acaggccagccccatctt

SEQ ID NO: 1968856 - DNA, 15 bp, Homo sapiens
acaggccatttcatt

SEQ ID NO: 1968857 - DNA, 24 bp, Homo sapiens
acaggccccccgcagcaccctgca

SEQ ID NO: 1968858 - DNA, 13 bp, Homo sapiens
acaggcccttcct

SEQ ID NO: 1968859 - DNA, 13 bp, Homo sapiens
acaggcccttggg

SEQ ID NO: 1968860 - DNA, 19 bp, Homo sapiens
acaggcctgtgtagctgtg

SEQ ID NO: 1968861 - DNA, 23 bp, Homo sapiens
acaggcctgtgtagctgtgacct

SEQ ID NO: 1968862 - DNA, 21 bp, Homo sapiens
acaggctgttctgcactgaaa

SEQ ID NO: 1968863 - DNA, 22 bp, Homo sapiens
acaggctgttctgcactgaaaa

SEQ ID NO: 1968864 - DNA, 22 bp, Homo sapiens
acagggaaccctgcttgcactt

SEQ ID NO: 1968865 - DNA, 13 bp, Homo sapiens
acagggaaggcag

SEQ ID NO: 1968866 - DNA, 19 bp, Homo sapiens
acagggaaggcaggcaggg

SEQ ID NO: 1968867 - DNA, 22 bp, Homo sapiens
acagggaaggcaggcagggctc

SEQ ID NO: 1968868 - DNA, 23 bp, Homo sapiens
acagggaaggcaggcagggctct

SEQ ID NO: 1968869 - DNA, 15 bp, Homo sapiens
acagggacaaagaaa

SEQ ID NO: 1968870 - DNA, 16 bp, Homo sapiens
acagggcagagccggg

SEQ ID NO: 1968871 - DNA, 23 bp, Homo sapiens
acagggcagtgacaagtggaggg

SEQ ID NO: 1968872 - DNA, 22 bp, Homo sapiens
acagggctaagagctagcgctg

SEQ ID NO: 1968873 - DNA, 12 bp, Homo sapiens
acagggctcttt

SEQ ID NO: 1968874 - DNA, 16 bp, Homo sapiens
acagggcttggggagc

SEQ ID NO: 1968875 - DNA, 19 bp, Homo sapiens
acagggcttggggagcagg

SEQ ID NO: 1968876 - DNA, 22 bp, Homo sapiens
acaggggccccagatctgcctg

SEQ ID NO: 1968877 - DNA, 23 bp, Homo sapiens
acaggggccccagatctgcctgg

SEQ ID NO: 1968878 - DNA, 18 bp, Homo sapiens
acagggtctcactatgtt

SEQ ID NO: 1968879 - DNA, 13 bp, Homo sapiens
acagggtcttgca

SEQ ID NO: 1968880 - DNA, 22 bp, Homo sapiens
acagggtggaccccctgagtca

SEQ ID NO: 1968881 - DNA, 14 bp, Homo sapiens
acagggttttgtat

SEQ ID NO: 1968882 - DNA, 15 bp, Homo sapiens
acaggtacagcaaca

SEQ ID NO: 1968883 - DNA, 16 bp, Homo sapiens
acaggtatcaggcaca

SEQ ID NO: 1968884 - DNA, 19 bp, Homo sapiens
acaggtatcaggcacaggc

SEQ ID NO: 1968885 - DNA, 21 bp, Homo sapiens
acaggtatcaggcacaggcag

SEQ ID NO: 1968886 - DNA, 16 bp, Homo sapiens
acaggtggacacacaa

SEQ ID NO: 1968887 - DNA, 21 bp, Homo sapiens
acaggtggcaggaccaggact

SEQ ID NO: 1968888 - DNA, 22 bp, Homo sapiens
acaggtgtgagtcaccaagccc

SEQ ID NO: 1968889 - DNA, 14 bp, Homo sapiens
acaggttcccagca

SEQ ID NO: 1968890 - DNA, 18 bp, Homo sapiens
acaggttcccagcagctg

SEQ ID NO: 1968891 - DNA, 22 bp, Homo sapiens
acaggttcccagcagctgggcc

SEQ ID NO: 1968892 - DNA, 12 bp, Homo sapiens
acagtaaacatt

SEQ ID NO: 1968893 - DNA, 14 bp, Homo sapiens
acagtaaataaatt

SEQ ID NO: 1968894 - DNA, 21 bp, Homo sapiens
acagtactatgtaaatttaaa

SEQ ID NO: 1968895 - DNA, 17 bp, Homo sapiens
acagtagaggcatgaac

SEQ ID NO: 1968896 - DNA, 15 bp, Homo sapiens
acagtatatttgaaa

SEQ ID NO: 1968897 - DNA, 17 bp, Homo sapiens
acagtattctcagtgct

SEQ ID NO: 1968898 - DNA, 18 bp, Homo sapiens
acagtcaaaacagagatg

SEQ ID NO: 1968899 - DNA, 16 bp, Homo sapiens
acagtcacccttctgg

SEQ ID NO: 1968900 - DNA, 21 bp, Homo sapiens
acagtccgtcaaaacagattg

SEQ ID NO: 1968901 - DNA, 19 bp, Homo sapiens
acagtcctaactggtatag

SEQ ID NO: 1968902 - DNA, 19 bp, Homo sapiens
acagtcctcacagcctctc

SEQ ID NO: 1968903 - DNA, 21 bp, Homo sapiens
acagtcctcacagcctctccc

SEQ ID NO: 1968904 - DNA, 18 bp, Homo sapiens
acagtctcaagcactaaa

SEQ ID NO: 1968905 - DNA, 13 bp, Homo sapiens
acagtctcaggaa

SEQ ID NO: 1968906 - DNA, 16 bp, Homo sapiens
acagtctcaggaaatc

SEQ ID NO: 1968907 - DNA, 17 bp, Homo sapiens
acagtctcaggaaatca

SEQ ID NO: 1968908 - DNA, 16 bp, Homo sapiens
acagtctcccattctc

SEQ ID NO: 1968909 - DNA, 14 bp, Homo sapiens
acagtgacccttcc

SEQ ID NO: 1968910 - DNA, 22 bp, Homo sapiens
acagtgactgtcgtgtttacaa

SEQ ID NO: 1968911 - DNA, 12 bp, Homo sapiens
acagtgagcctg

SEQ ID NO: 1968912 - DNA, 13 bp, Homo sapiens
acagtgagctgat

SEQ ID NO: 1968913 - DNA, 19 bp, Homo sapiens
acagtgatctccatatgtt

SEQ ID NO: 1968914 - DNA, 17 bp, Homo sapiens
acagtgcccagctaatt

SEQ ID NO: 1968915 - DNA, 18 bp, Homo sapiens
acagtgcccagctaattt

SEQ ID NO: 1968916 - DNA, 13 bp, Homo sapiens
acagtgcctgctg

SEQ ID NO: 1968917 - DNA, 14 bp, Homo sapiens
acagtgcctgctga

SEQ ID NO: 1968918 - DNA, 14 bp, Homo sapiens
acagtgctgccctg

SEQ ID NO: 1968919 - DNA, 16 bp, Homo sapiens
acagtgctgccctgcg

SEQ ID NO: 1968920 - DNA, 24 bp, Homo sapiens
acagtgctgccctgcgaagtggct

SEQ ID NO: 1968921 - DNA, 15 bp, Homo sapiens
acagtgctgttctgg

SEQ ID NO: 1968922 - DNA, 14 bp, Homo sapiens
acagtgcttcagcc

SEQ ID NO: 1968923 - DNA, 21 bp, Homo sapiens
acagtgcttcagcctgaggct

SEQ ID NO: 1968924 - DNA, 22 bp, Homo sapiens
acagtgcttcagcctgaggctg

SEQ ID NO: 1968925 - DNA, 18 bp, Homo sapiens
acagtggaactacattag

SEQ ID NO: 1968926 - DNA, 15 bp, Homo sapiens
acagtggagaaatat

SEQ ID NO: 1968927 - DNA, 16 bp, Homo sapiens
acagtggagtgagatc

SEQ ID NO: 1968928 - DNA, 22 bp, Homo sapiens
acagtggcacggagagaaggcc

SEQ ID NO: 1968929 - DNA, 16 bp, Homo sapiens
acagtggcgagaggag

SEQ ID NO: 1968930 - DNA, 21 bp, Homo sapiens
acagtgggtgccccccttgcc

SEQ ID NO: 1968931 - DNA, 23 bp, Homo sapiens
acagtgtctgtatcggagacagt

SEQ ID NO: 1968932 - DNA, 24 bp, Homo sapiens
acagtgtctgtatcggagacagtg

SEQ ID NO: 1968933 - DNA, 14 bp, Homo sapiens
acagtgttaaatga

SEQ ID NO: 1968934 - DNA, 20 bp, Homo sapiens
acagtgttattttctttgaa

SEQ ID NO: 1968935 - DNA, 22 bp, Homo sapiens
acagtgttattttctttgaaat

SEQ ID NO: 1968936 - DNA, 19 bp, Homo sapiens
acagtgttgaaaatgttca

SEQ ID NO: 1968937 - DNA, 15 bp, Homo sapiens
acagtgtttcccata

SEQ ID NO: 1968938 - DNA, 18 bp, Homo sapiens
acagtgtttcccataatt

SEQ ID NO: 1968939 - DNA, 17 bp, Homo sapiens
acagtgtttgcaatggt

SEQ ID NO: 1968940 - DNA, 18 bp, Homo sapiens
acagttactcttcagttt

SEQ ID NO: 1968941 - DNA, 15 bp, Homo sapiens
acagttatctaagtt

SEQ ID NO: 1968942 - DNA, 16 bp, Homo sapiens
acagttatctaagtta

SEQ ID NO: 1968943 - DNA, 17 bp, Homo sapiens
acagttatctaagttaa

SEQ ID NO: 1968944 - DNA, 14 bp, Homo sapiens
acagttatttatag

SEQ ID NO: 1968945 - DNA, 20 bp, Homo sapiens
acagttcaattctcatttgt

SEQ ID NO: 1968946 - DNA, 16 bp, Homo sapiens
acagttcagttcctct

SEQ ID NO: 1968947 - DNA, 15 bp, Homo sapiens
acagttcatatgtac

SEQ ID NO: 1968948 - DNA, 22 bp, Homo sapiens
acagttgctgtcataagaatga

SEQ ID NO: 1968949 - DNA, 13 bp, Homo sapiens
acagttggcagag

SEQ ID NO: 1968950 - DNA, 20 bp, Homo sapiens
acagttgtctattctgagcc

SEQ ID NO: 1968951 - DNA, 21 bp, Homo sapiens
acagttgtctattctgagcct

SEQ ID NO: 1968952 - DNA, 22 bp, Homo sapiens
acagttgtctattctgagcctt

SEQ ID NO: 1968953 - DNA, 16 bp, Homo sapiens
acagtttgatgtcatt

SEQ ID NO: 1968954 - DNA, 21 bp, Homo sapiens
acagtttggaagtgttaacta

SEQ ID NO: 1968955 - DNA, 19 bp, Homo sapiens
acagttttctgagaaagac

SEQ ID NO: 1968956 - DNA, 12 bp, Homo sapiens
acagtttttaaa

SEQ ID NO: 1968957 - DNA, 14 bp, Homo sapiens
acagtttttaaact

SEQ ID NO: 1968958 - DNA, 12 bp, Homo sapiens
acataaagttga

SEQ ID NO: 1968959 - DNA, 13 bp, Homo sapiens
acataaattagag

SEQ ID NO: 1968960 - DNA, 14 bp, Homo sapiens
acataacaagaaaa

SEQ ID NO: 1968961 - DNA, 19 bp, Homo sapiens
acataatatcttgaagaat

SEQ ID NO: 1968962 - DNA, 21 bp, Homo sapiens
acataatatcttgaagaatat

SEQ ID NO: 1968963 - DNA, 21 bp, Homo sapiens
acataatttagtttcatataa

SEQ ID NO: 1968964 - DNA, 18 bp, Homo sapiens
acataattttttattcaa

SEQ ID NO: 1968965 - DNA, 14 bp, Homo sapiens
acatacaatttgca

SEQ ID NO: 1968966 - DNA, 20 bp, Homo sapiens
acatacaatttgcactgtta

SEQ ID NO: 1968967 - DNA, 21 bp, Homo sapiens
acatacacttgtataaatgta

SEQ ID NO: 1968968 - DNA, 14 bp, Homo sapiens
acataccctccccc

SEQ ID NO: 1968969 - DNA, 18 bp, Homo sapiens
acatacccttctttaaat

SEQ ID NO: 1968970 - DNA, 20 bp, Homo sapiens
acatacccttctttaaatca

SEQ ID NO: 1968971 - DNA, 22 bp, Homo sapiens
acatacctctctctatatatac

SEQ ID NO: 1968972 - DNA, 14 bp, Homo sapiens
acatacgaaacaca

SEQ ID NO: 1968973 - DNA, 17 bp, Homo sapiens
acatacgaaacacaaac

SEQ ID NO: 1968974 - DNA, 18 bp, Homo sapiens
acatacgtgttaggaggc

SEQ ID NO: 1968975 - DNA, 14 bp, Homo sapiens
acatactcattttt

SEQ ID NO: 1968976 - DNA, 12 bp, Homo sapiens
acatagaaagtt

SEQ ID NO: 1968977 - DNA, 17 bp, Homo sapiens
acatagacagaagaaac

SEQ ID NO: 1968978 - DNA, 18 bp, Homo sapiens
acatagagatatgcacac

SEQ ID NO: 1968979 - DNA, 22 bp, Homo sapiens
acatagagtgactccaagaaca

SEQ ID NO: 1968980 - DNA, 14 bp, Homo sapiens
acatagatggacca

SEQ ID NO: 1968981 - DNA, 19 bp, Homo sapiens
acatagattaatggcactg

SEQ ID NO: 1968982 - DNA, 20 bp, Homo sapiens
acatagattaatggcactga

SEQ ID NO: 1968983 - DNA, 21 bp, Homo sapiens
acatagctacccaaaagagaa

SEQ ID NO: 1968984 - DNA, 17 bp, Homo sapiens
acataggcaaattggaa

SEQ ID NO: 1968985 - DNA, 21 bp, Homo sapiens
acatagtaagaccccatctct

SEQ ID NO: 1968986 - DNA, 23 bp, Homo sapiens
acatagttctccagttgtatgga

SEQ ID NO: 1968987 - DNA, 23 bp, Homo sapiens
acatataatgttgttatttaaag

SEQ ID NO: 1968988 - DNA, 17 bp, Homo sapiens
acatatacatatatata

SEQ ID NO: 1968989 - DNA, 16 bp, Homo sapiens
acatatacctataatg

SEQ ID NO: 1968990 - DNA, 20 bp, Homo sapiens
acatatacctataatgtgtg

SEQ ID NO: 1968991 - DNA, 16 bp, Homo sapiens
acatataggagcaata

SEQ ID NO: 1968992 - DNA, 11 bp, Homo sapiens
acatatatata

SEQ ID NO: 1968993 - DNA, 20 bp, Homo sapiens
acatatatatatacacatac

SEQ ID NO: 1968994 - DNA, 23 bp, Homo sapiens
aatttgaaaacataatctgcaaa

SEQ ID NO: 1968995 - DNA, 14 bp, Homo sapiens
aatttgaaatttag

SEQ ID NO: 1968996 - DNA, 15 bp, Homo sapiens
aatttgagaattatt

SEQ ID NO: 1968997 - DNA, 15 bp, Homo sapiens
aatttgagcaattca

SEQ ID NO: 1968998 - DNA, 14 bp, Homo sapiens
aatttgaggacaac

SEQ ID NO: 1968999 - DNA, 20 bp, Homo sapiens
aatttgatacatatgtgaat

SEQ ID NO: 1969000 - DNA, 12 bp, Homo sapiens
aatttgggcctc

SEQ ID NO: 1969001 - DNA, 15 bp, Homo sapiens
aatttgggcctcttg

SEQ ID NO: 1969002 - DNA, 19 bp, Homo sapiens
aatttgggcctcttgtaca

SEQ ID NO: 1969003 - DNA, 21 bp, Homo sapiens
aatttggtgtggctgtattca

SEQ ID NO: 1969004 - DNA, 19 bp, Homo sapiens
aatttgtaattgcttacat

SEQ ID NO: 1969005 - DNA, 20 bp, Homo sapiens
aatttgtatctgaaggagat

SEQ ID NO: 1969006 - DNA, 12 bp, Homo sapiens
aatttgtatttt

SEQ ID NO: 1969007 - DNA, 20 bp, Homo sapiens
aattttaaaagttgggaaaa

SEQ ID NO: 1969008 - DNA, 17 bp, Homo sapiens
aattttaacttaaattt

SEQ ID NO: 1969009 - DNA, 19 bp, Homo sapiens
aattttaagtgctttgtaa

SEQ ID NO: 1969010 - DNA, 17 bp, Homo sapiens
aattttaagttatttta

SEQ ID NO: 1969011 - DNA, 13 bp, Homo sapiens
aattttaatgcta

SEQ ID NO: 1969012 - DNA, 18 bp, Homo sapiens
aattttactgacagaaat

SEQ ID NO: 1969013 - DNA, 19 bp, Homo sapiens
aattttactgacagaaatg

SEQ ID NO: 1969014 - DNA, 15 bp, Homo sapiens
aattttagagcatac

SEQ ID NO: 1969015 - DNA, 19 bp, Homo sapiens
aattttatagctcagttta

SEQ ID NO: 1969016 - DNA, 20 bp, Homo sapiens
aattttatagctcagtttat

SEQ ID NO: 1969017 - DNA, 17 bp, Homo sapiens
aattttatttagttctt

SEQ ID NO: 1969018 - DNA, 15 bp, Homo sapiens
aattttcaagagaag

SEQ ID NO: 1969019 - DNA, 14 bp, Homo sapiens
aattttcttcatgc

SEQ ID NO: 1969020 - DNA, 17 bp, Homo sapiens
aattttggccaaagtgt

SEQ ID NO: 1969021 - DNA, 12 bp, Homo sapiens
aattttgtaaaa

SEQ ID NO: 1969022 - DNA, 11 bp, Homo sapiens
aatttttaatg

SEQ ID NO: 1969023 - DNA, 15 bp, Homo sapiens
aatttttacatgacc

SEQ ID NO: 1969024 - DNA, 15 bp, Homo sapiens
aatttttatacatat

SEQ ID NO: 1969025 - DNA, 21 bp, Homo sapiens
aatttttatacatatcagaaa

SEQ ID NO: 1969026 - DNA, 23 bp, Homo sapiens
aatttttatacatatcagaaaag

SEQ ID NO: 1969027 - DNA, 17 bp, Homo sapiens
aatttttatttttgaac

SEQ ID NO: 1969028 - DNA, 21 bp, Homo sapiens
aatttttcagctctctgtata

SEQ ID NO: 1969029 - DNA, 23 bp, Homo sapiens
aatttttcattgatatgaaaaat

SEQ ID NO: 1969030 - DNA, 13 bp, Homo sapiens
aatttttgatact

SEQ ID NO: 1969031 - DNA, 19 bp, Homo sapiens
aatttttgcaattattcta

SEQ ID NO: 1969032 - DNA, 15 bp, Homo sapiens
aattttttaaatgaa

SEQ ID NO: 1969033 - DNA, 19 bp, Homo sapiens
aatttttttatactaccaa

SEQ ID NO: 1969034 - DNA, 15 bp, Homo sapiens
aatttttttattact

SEQ ID NO: 1969035 - DNA, 15 bp, Homo sapiens
acaaaaacaaaacaa

SEQ ID NO: 1969036 - DNA, 15 bp, Homo sapiens
acaaaaacagcctca

SEQ ID NO: 1969037 - DNA, 21 bp, Homo sapiens
acaaaaacagcctcacagaag

SEQ ID NO: 1969038 - DNA, 15 bp, Homo sapiens
acaaaacaagaaaga

SEQ ID NO: 1969039 - DNA, 13 bp, Homo sapiens
acaaaaccagctg

SEQ ID NO: 1969040 - DNA, 15 bp, Homo sapiens
acaaaaccagctgct

SEQ ID NO: 1969041 - DNA, 21 bp, Homo sapiens
acaaaataatttaactaattt

SEQ ID NO: 1969042 - DNA, 22 bp, Homo sapiens
acaaaataatttaactaattta

SEQ ID NO: 1969043 - DNA, 15 bp, Homo sapiens
acaaaatagaagctg

SEQ ID NO: 1969044 - DNA, 22 bp, Homo sapiens
acaaaatcacaagcaataatta

SEQ ID NO: 1969045 - DNA, 19 bp, Homo sapiens
acaaaatcgattggcttta

SEQ ID NO: 1969046 - DNA, 13 bp, Homo sapiens
acaaaatggaagg

SEQ ID NO: 1969047 - DNA, 15 bp, Homo sapiens
acaaaatgtcacact

SEQ ID NO: 1969048 - DNA, 16 bp, Homo sapiens
acaaaccacaactgac

SEQ ID NO: 1969049 - DNA, 22 bp, Homo sapiens
acaaaccaccctaaaatgacag

SEQ ID NO: 1969050 - DNA, 23 bp, Homo sapiens
acaaaccaccctaaaatgacagc

SEQ ID NO: 1969051 - DNA, 15 bp, Homo sapiens
acaaaccactgtaca

SEQ ID NO: 1969052 - DNA, 17 bp, Homo sapiens
acaaacctctatatgtt

SEQ ID NO: 1969053 - DNA, 20 bp, Homo sapiens
acaaactgatgcgaaaactt

SEQ ID NO: 1969054 - DNA, 22 bp, Homo sapiens
acaaactgatgcgaaaacttga

SEQ ID NO: 1969055 - DNA, 13 bp, Homo sapiens
acaaactttaaat

SEQ ID NO: 1969056 - DNA, 12 bp, Homo sapiens
acaaagaaatat

SEQ ID NO: 1969057 - DNA, 14 bp, Homo sapiens
acaaagagaaaaag

SEQ ID NO: 1969058 - DNA, 21 bp, Homo sapiens
acaaagagaaaaagaaatgca

SEQ ID NO: 1969059 - DNA, 16 bp, Homo sapiens
acaaagagaataaaga

SEQ ID NO: 1969060 - DNA, 16 bp, Homo sapiens
acaaagagttcaagaa

SEQ ID NO: 1969061 - DNA, 18 bp, Homo sapiens
acaaagagttcaagaaat

SEQ ID NO: 1969062 - DNA, 21 bp, Homo sapiens
acaaagagttcaagaaataag

SEQ ID NO: 1969063 - DNA, 23 bp, Homo sapiens
acaaagatgtttgtcagatatga

SEQ ID NO: 1969064 - DNA, 16 bp, Homo sapiens
acaaagcacagtgtta

SEQ ID NO: 1969065 - DNA, 22 bp, Homo sapiens
acaaagcatcattgtaaattat

SEQ ID NO: 1969066 - DNA, 17 bp, Homo sapiens
acaaagccaacagtcaa

SEQ ID NO: 1969067 - DNA, 13 bp, Homo sapiens
acaaagctcaaga

SEQ ID NO: 1969068 - DNA, 18 bp, Homo sapiens
acaaagctcaagatgaca

SEQ ID NO: 1969069 - DNA, 13 bp, Homo sapiens
acaaaggagcctg

SEQ ID NO: 1969070 - DNA, 15 bp, Homo sapiens
acaaaggagcctgtg

SEQ ID NO: 1969071 - DNA, 20 bp, Homo sapiens
acaaaggggagaagggccag

SEQ ID NO: 1969072 - DNA, 21 bp, Homo sapiens
acaaaggttttcctcttctat

SEQ ID NO: 1969073 - DNA, 13 bp, Homo sapiens
acaaagtagagaa

SEQ ID NO: 1969074 - DNA, 13 bp, Homo sapiens
acaaagtttgttc

SEQ ID NO: 1969075 - DNA, 14 bp, Homo sapiens
acaaataaagatgg

SEQ ID NO: 1969076 - DNA, 17 bp, Homo sapiens
acaaataaagatggcta

SEQ ID NO: 1969077 - DNA, 13 bp, Homo sapiens
acaaataatcaca

SEQ ID NO: 1969078 - DNA, 19 bp, Homo sapiens
acaaatatatttaattgtg

SEQ ID NO: 1969079 - DNA, 20 bp, Homo sapiens
acaaatatccaccactttaa

SEQ ID NO: 1969080 - DNA, 20 bp, Homo sapiens
acaaatatttatatatttga

SEQ ID NO: 1969081 - DNA, 22 bp, Homo sapiens
acaaatatttattttctttctg

SEQ ID NO: 1969082 - DNA, 17 bp, Homo sapiens
acaaatcacacctctgg

SEQ ID NO: 1969083 - DNA, 15 bp, Homo sapiens
acaaatctatattaa

SEQ ID NO: 1969084 - DNA, 23 bp, Homo sapiens
acaaatctatattaaagtgttat

SEQ ID NO: 1969085 - DNA, 21 bp, Homo sapiens
acaaatcttcaaggtgtaaaa

SEQ ID NO: 1969086 - DNA, 20 bp, Homo sapiens
acaaattaggttttgtacaa

SEQ ID NO: 1969087 - DNA, 18 bp, Homo sapiens
acaaatttttatttctaa

SEQ ID NO: 1969088 - DNA, 14 bp, Homo sapiens
acaacaaaccaaaa

SEQ ID NO: 1969089 - DNA, 14 bp, Homo sapiens
acaacaacaataca

SEQ ID NO: 1969090 - DNA, 12 bp, Homo sapiens
acaacaagaaca

SEQ ID NO: 1969091 - DNA, 9 bp, Homo sapiens
acaacaata

SEQ ID NO: 1969092 - DNA, 12 bp, Homo sapiens
acaacaataaca

SEQ ID NO: 1969093 - DNA, 23 bp, Homo sapiens
acaacaatggtttacatgaacac

SEQ ID NO: 1969094 - DNA, 13 bp, Homo sapiens
acaacagaagctt

SEQ ID NO: 1969095 - DNA, 19 bp, Homo sapiens
acaacagaagcttcagaag

SEQ ID NO: 1969096 - DNA, 11 bp, Homo sapiens
acaacagaagt

SEQ ID NO: 1969097 - DNA, 13 bp, Homo sapiens
acaacagaagtca

SEQ ID NO: 1969098 - DNA, 17 bp, Homo sapiens
acaacaggttttcacca

SEQ ID NO: 1969099 - DNA, 19 bp, Homo sapiens
acaacaggttttcaccata

SEQ ID NO: 1969100 - DNA, 18 bp, Homo sapiens
acaacataaggagaatgt

SEQ ID NO: 1969101 - DNA, 19 bp, Homo sapiens
acaacatcccacagtggca

SEQ ID NO: 1969102 - DNA, 14 bp, Homo sapiens
acaacatgtataat

SEQ ID NO: 1969103 - DNA, 22 bp, Homo sapiens
acaacatgtataatatttttaa

SEQ ID NO: 1969104 - DNA, 14 bp, Homo sapiens
acaacatttctata

SEQ ID NO: 1969105 - DNA, 22 bp, Homo sapiens
acaacatttctatagccaaaaa

SEQ ID NO: 1969106 - DNA, 13 bp, Homo sapiens
acaaccagagccc

SEQ ID NO: 1969107 - DNA, 15 bp, Homo sapiens
acaaccagccacaca

SEQ ID NO: 1969108 - DNA, 19 bp, Homo sapiens
acaaccagccacacagagc

SEQ ID NO: 1969109 - DNA, 17 bp, Homo sapiens
acaactaatcaagagtg

SEQ ID NO: 1969110 - DNA, 23 bp, Homo sapiens
acaactaatcaagagtgagtgaa

SEQ ID NO: 1969111 - DNA, 17 bp, Homo sapiens
acaactgtttttgaaga

SEQ ID NO: 1969112 - DNA, 18 bp, Homo sapiens
acaactgtttttgaagaa

SEQ ID NO: 1969113 - DNA, 22 bp, Homo sapiens
acaacttgtctattacctgtta

SEQ ID NO: 1969114 - DNA, 17 bp, Homo sapiens
acaacttgtgttctatt

SEQ ID NO: 1969115 - DNA, 16 bp, Homo sapiens
acaagaaatccctgtt

SEQ ID NO: 1969116 - DNA, 21 bp, Homo sapiens
acaagaaatccctgtttaata

SEQ ID NO: 1969117 - DNA, 22 bp, Homo sapiens
acaagaagctcccagatgctgg

SEQ ID NO: 1969118 - DNA, 13 bp, Homo sapiens
acaagaagctgct

SEQ ID NO: 1969119 - DNA, 23 bp, Homo sapiens
acaagaagggttttccaccctgg

SEQ ID NO: 1969120 - DNA, 13 bp, Homo sapiens
acaagagcccagc

SEQ ID NO: 1969121 - DNA, 17 bp, Homo sapiens
acaagagcgaaactccg

SEQ ID NO: 1969122 - DNA, 22 bp, Homo sapiens
acaagagtttatttccaaataa

SEQ ID NO: 1969123 - DNA, 14 bp, Homo sapiens
acaagatctttcag

SEQ ID NO: 1969124 - DNA, 14 bp, Homo sapiens
acaagattcccaga

SEQ ID NO: 1969125 - DNA, 22 bp, Homo sapiens
acaagcaaggatatcagagctg

SEQ ID NO: 1969126 - DNA, 22 bp, Homo sapiens
acaagcacagacattaaacctg

SEQ ID NO: 1969127 - DNA, 11 bp, Homo sapiens
acaagcagagg

SEQ ID NO: 1969128 - DNA, 14 bp, Homo sapiens
acaagcatatttga

SEQ ID NO: 1969129 - DNA, 15 bp, Homo sapiens
acaagcatatttgag

SEQ ID NO: 1969130 - DNA, 23 bp, Homo sapiens
acaagcatggtcccacatccctg

SEQ ID NO: 1969131 - DNA, 14 bp, Homo sapiens
acaagccaacttgt

SEQ ID NO: 1969132 - DNA, 12 bp, Homo sapiens
acaagccacccc

SEQ ID NO: 1969133 - DNA, 14 bp, Homo sapiens
acaagccctggcaa

SEQ ID NO: 1969134 - DNA, 18 bp, Homo sapiens
acaagcctggcaacacac

SEQ ID NO: 1969135 - DNA, 14 bp, Homo sapiens
acaagctaaaatta

SEQ ID NO: 1969136 - DNA, 18 bp, Homo sapiens
acaagctggaagcacatg

SEQ ID NO: 1969137 - DNA, 19 bp, Homo sapiens
acaagcttgtatatacata

SEQ ID NO: 1969138 - DNA, 12 bp, Homo sapiens
acaaggaaccac

SEQ ID NO: 1969139 - DNA, 21 bp, Homo sapiens
acaaggaatagtcgcgcaagc

SEQ ID NO: 1969140 - DNA, 14 bp, Homo sapiens
acaaggaccctgtt

SEQ ID NO: 1969141 - DNA, 17 bp, Homo sapiens
acaaggcacttgtcact

SEQ ID NO: 1969142 - DNA, 18 bp, Homo sapiens
acaaggcagcaaggcccg

SEQ ID NO: 1969143 - DNA, 21 bp, Homo sapiens
acaaggcagcaaggcccgagc

SEQ ID NO: 1969144 - DNA, 18 bp, Homo sapiens
acaaggctgaccaagaga

SEQ ID NO: 1969145 - DNA, 17 bp, Homo sapiens
acaaggcttaaaagagt

SEQ ID NO: 1969146 - DNA, 18 bp, Homo sapiens
acaaggggctgttacata

SEQ ID NO: 1969147 - DNA, 17 bp, Homo sapiens
acaagggtctagggaga

SEQ ID NO: 1969148 - DNA, 15 bp, Homo sapiens
acaaggtagacatgg

SEQ ID NO: 1969149 - DNA, 16 bp, Homo sapiens
acaaggtagtttttac

SEQ ID NO: 1969150 - DNA, 18 bp, Homo sapiens
acaagtaatcactaaccc

SEQ ID NO: 1969151 - DNA, 23 bp, Homo sapiens
acaagtatgaataaagacaccta

SEQ ID NO: 1969152 - DNA, 17 bp, Homo sapiens
acaagtatttgttaatt

SEQ ID NO: 1969153 - DNA, 22 bp, Homo sapiens
acaagtatttgttaatttagaa

SEQ ID NO: 1969154 - DNA, 19 bp, Homo sapiens
acaagtcacagctgcagct

SEQ ID NO: 1969155 - DNA, 21 bp, Homo sapiens
acaagtcattttaactttatc

SEQ ID NO: 1969156 - DNA, 15 bp, Homo sapiens
acaagtcctgtgaat

SEQ ID NO: 1969157 - DNA, 16 bp, Homo sapiens
acaagtcctgtgaatt

SEQ ID NO: 1969158 - DNA, 19 bp, Homo sapiens
acaagtcctgtgaatttct

SEQ ID NO: 1969159 - DNA, 16 bp, Homo sapiens
acaagttccagctggt

SEQ ID NO: 1969160 - DNA, 15 bp, Homo sapiens
acaataaaacattat

SEQ ID NO: 1969161 - DNA, 14 bp, Homo sapiens
acaataaagactga

SEQ ID NO: 1969162 - DNA, 14 bp, Homo sapiens
acaataaagagctc

SEQ ID NO: 1969163 - DNA, 14 bp, Homo sapiens
acaataaataatct

SEQ ID NO: 1969164 - DNA, 18 bp, Homo sapiens
acaataaatattctgcat

SEQ ID NO: 1969165 - DNA, 15 bp, Homo sapiens
acaataacaacaatg

SEQ ID NO: 1969166 - DNA, 11 bp, Homo sapiens
acaataattaa

SEQ ID NO: 1969167 - DNA, 12 bp, Homo sapiens
acaataatttca

SEQ ID NO: 1969168 - DNA, 18 bp, Homo sapiens
acaatacaacaagaacaa

SEQ ID NO: 1969169 - DNA, 16 bp, Homo sapiens
acaatacatgctgcta

SEQ ID NO: 1969170 - DNA, 18 bp, Homo sapiens
acaataccagatcactca

SEQ ID NO: 1969171 - DNA, 15 bp, Homo sapiens
acaatatataaaaat

SEQ ID NO: 1969172 - DNA, 17 bp, Homo sapiens
acaatatataaaaatat

SEQ ID NO: 1969173 - DNA, 13 bp, Homo sapiens
acaatatttaaaa

SEQ ID NO: 1969174 - DNA, 16 bp, Homo sapiens
acaatatttaaaattt

SEQ ID NO: 1969175 - DNA, 17 bp, Homo sapiens
acaatccactctcagga

SEQ ID NO: 1969176 - DNA, 20 bp, Homo sapiens
acaatcctgaagaaaccaca

SEQ ID NO: 1969177 - DNA, 14 bp, Homo sapiens
acaatcctgtccct

SEQ ID NO: 1969178 - DNA, 16 bp, Homo sapiens
acaatctttccttgtc

SEQ ID NO: 1969179 - DNA, 21 bp, Homo sapiens
acaatctttccttgtctctca

SEQ ID NO: 1969180 - DNA, 19 bp, Homo sapiens
acaatgatgattaaacacc

SEQ ID NO: 1969181 - DNA, 22 bp, Homo sapiens
acaatgatgattaaacacctga

SEQ ID NO: 1969182 - DNA, 18 bp, Homo sapiens
acaatgcctctcccacga

SEQ ID NO: 1969183 - DNA, 15 bp, Homo sapiens
acaatggccatggaa

SEQ ID NO: 1969184 - DNA, 20 bp, Homo sapiens
acaatgtttcagaagcccca

SEQ ID NO: 1969185 - DNA, 16 bp, Homo sapiens
acaattaaagctgtta

SEQ ID NO: 1969186 - DNA, 14 bp, Homo sapiens
acaattactaaatt

SEQ ID NO: 1969187 - DNA, 17 bp, Homo sapiens
acaattactaaattgta

SEQ ID NO: 1969188 - DNA, 17 bp, Homo sapiens
acaattatggaaatata

SEQ ID NO: 1969189 - DNA, 18 bp, Homo sapiens
acaattattgtacactaa

SEQ ID NO: 1969190 - DNA, 17 bp, Homo sapiens
acaattccatttccagt

SEQ ID NO: 1969191 - DNA, 12 bp, Homo sapiens
acaattctaaaa

SEQ ID NO: 1969192 - DNA, 14 bp, Homo sapiens
acaattctaaaatg

SEQ ID NO: 1969193 - DNA, 17 bp, Homo sapiens
acaattgaacttaaata

SEQ ID NO: 1969194 - DNA, 19 bp, Homo sapiens
acaattgtccatggtctca

SEQ ID NO: 1969195 - DNA, 20 bp, Homo sapiens
acaatttaaagcaaaggagt

SEQ ID NO: 1969196 - DNA, 20 bp, Homo sapiens
acaatttagaaaacattcat

SEQ ID NO: 1969197 - DNA, 22 bp, Homo sapiens
acaatttgcactgttacttttt

SEQ ID NO: 1969198 - DNA, 23 bp, Homo sapiens
acaatttgcactgttacttttta

SEQ ID NO: 1969199 - DNA, 13 bp, Homo sapiens
acacaaaatgtca

SEQ ID NO: 1969200 - DNA, 16 bp, Homo sapiens
acacaaacacctccta

SEQ ID NO: 1969201 - DNA, 19 bp, Homo sapiens
acacaaaccacaactgaca

SEQ ID NO: 1969202 - DNA, 14 bp, Homo sapiens
acacaagctggaag

SEQ ID NO: 1969203 - DNA, 13 bp, Homo sapiens
acacaagtaaaca

SEQ ID NO: 1969204 - DNA, 15 bp, Homo sapiens
acacaagtcctgtga

SEQ ID NO: 1969205 - DNA, 14 bp, Homo sapiens
acacaatatgaata

SEQ ID NO: 1969206 - DNA, 16 bp, Homo sapiens
acacaatctttccttg

SEQ ID NO: 1969207 - DNA, 19 bp, Homo sapiens
acacaatctttccttgtct

SEQ ID NO: 1969208 - DNA, 22 bp, Homo sapiens
acacaatgctattgaaattact

SEQ ID NO: 1969209 - DNA, 14 bp, Homo sapiens
acacacacacacac

SEQ ID NO: 1969210 - DNA, 13 bp, Homo sapiens
acacacacagaga

SEQ ID NO: 1969211 - DNA, 16 bp, Homo sapiens
acacacagagatatgc

SEQ ID NO: 1969212 - DNA, 14 bp, Homo sapiens
acacacagatatgc

SEQ ID NO: 1969213 - DNA, 12 bp, Homo sapiens
acacacagctct

SEQ ID NO: 1969214 - DNA, 13 bp, Homo sapiens
acacacagctctg

SEQ ID NO: 1969215 - DNA, 16 bp, Homo sapiens
acacacccctcaaaaa

SEQ ID NO: 1969216 - DNA, 19 bp, Homo sapiens
acacacccctcaaaaaaag

SEQ ID NO: 1969217 - DNA, 16 bp, Homo sapiens
acacaccggtcaccga

SEQ ID NO: 1969218 - DNA, 21 bp, Homo sapiens
acacacgcaggaactcccagc

SEQ ID NO: 1969219 - DNA, 21 bp, Homo sapiens
acacacgcgtgcacacaccag

SEQ ID NO: 1969220 - DNA, 14 bp, Homo sapiens
acacacggatgcac

SEQ ID NO: 1969221 - DNA, 17 bp, Homo sapiens
acacacgtatttatatt

SEQ ID NO: 1969222 - DNA, 21 bp, Homo sapiens
acacacgtatttatatttgga

SEQ ID NO: 1969223 - DNA, 15 bp, Homo sapiens
acacactcagcagcc

SEQ ID NO: 1969224 - DNA, 19 bp, Homo sapiens
acacactcagcagccccct

SEQ ID NO: 1969225 - DNA, 13 bp, Homo sapiens
acacactgtaaat

SEQ ID NO: 1969226 - DNA, 21 bp, Homo sapiens
acacactgtaaatatccacag

SEQ ID NO: 1969227 - DNA, 16 bp, Homo sapiens
acacagaaatatatat

SEQ ID NO: 1969228 - DNA, 19 bp, Homo sapiens
acacagagcctgcctcagc

SEQ ID NO: 1969229 - DNA, 19 bp, Homo sapiens
acacagatttttgggctcc

SEQ ID NO: 1969230 - DNA, 18 bp, Homo sapiens
acacagcagcactgcaga

SEQ ID NO: 1969231 - DNA, 21 bp, Homo sapiens
acacagcctgggaccagggca

SEQ ID NO: 1969232 - DNA, 17 bp, Homo sapiens
acacagcgtccctagca

SEQ ID NO: 1969233 - DNA, 11 bp, Homo sapiens
acacagctctg

SEQ ID NO: 1969234 - DNA, 20 bp, Homo sapiens
acacagctctgtcctgggag

SEQ ID NO: 1969235 - DNA, 11 bp, Homo sapiens
acacagctctt

SEQ ID NO: 1969236 - DNA, 13 bp, Homo sapiens
acacagctcttct

SEQ ID NO: 1969237 - DNA, 18 bp, Homo sapiens
acacagctcttctccagg

SEQ ID NO: 1969238 - DNA, 19 bp, Homo sapiens
acacagctcttctccaggc

SEQ ID NO: 1969239 - DNA, 22 bp, Homo sapiens
acacagctcttctccaggctgt

SEQ ID NO: 1969240 - DNA, 24 bp, Homo sapiens
acacaggatcctattctcaccagg

SEQ ID NO: 1969241 - DNA, 15 bp, Homo sapiens
acacaggcaactgag

SEQ ID NO: 1969242 - DNA, 23 bp, Homo sapiens
acacaggcatttcctgggtggct

SEQ ID NO: 1969243 - DNA, 15 bp, Homo sapiens
acacaggccagcccc

SEQ ID NO: 1969244 - DNA, 16 bp, Homo sapiens
acacaggccagcccca

SEQ ID NO: 1969245 - DNA, 17 bp, Homo sapiens
acacaggccagccccat

SEQ ID NO: 1969246 - DNA, 21 bp, Homo sapiens
acacaggccagccccatcttg

SEQ ID NO: 1969247 - DNA, 16 bp, Homo sapiens
acacaggcccggctcc

SEQ ID NO: 1969248 - DNA, 20 bp, Homo sapiens
acacaggcccggctccaggc

SEQ ID NO: 1969249 - DNA, 22 bp, Homo sapiens
acacaggcccggctccaggctc

SEQ ID NO: 1969250 - DNA, 17 bp, Homo sapiens
acacaggtcctgaaagt

SEQ ID NO: 1969251 - DNA, 22 bp, Homo sapiens
acacagtaaaaacttgtactat

SEQ ID NO: 1969252 - DNA, 16 bp, Homo sapiens
acacagtattacttct

SEQ ID NO: 1969253 - DNA, 16 bp, Homo sapiens
acacagtctcagtcca

SEQ ID NO: 1969254 - DNA, 16 bp, Homo sapiens
acacataactagaaac

SEQ ID NO: 1969255 - DNA, 15 bp, Homo sapiens
acacatactagaaag

SEQ ID NO: 1969256 - DNA, 20 bp, Homo sapiens
acacatagattaatggcact

SEQ ID NO: 1969257 - DNA, 22 bp, Homo sapiens
acacatagattaatggcactga

SEQ ID NO: 1969258 - DNA, 23 bp, Homo sapiens
acacatagattaatggcactgat

SEQ ID NO: 1969259 - DNA, 16 bp, Homo sapiens
acacatatacatatat

SEQ ID NO: 1969260 - DNA, 23 bp, Homo sapiens
acacatatacctataatgtgtgt

SEQ ID NO: 1969261 - DNA, 13 bp, Homo sapiens
acacatctttcct

SEQ ID NO: 1969262 - DNA, 15 bp, Homo sapiens
acacatggacacaga

SEQ ID NO: 1969263 - DNA, 22 bp, Homo sapiens
acacatggctatcctagagagg

SEQ ID NO: 1969264 - DNA, 18 bp, Homo sapiens
acacatgtcctatccaaa

SEQ ID NO: 1969265 - DNA, 23 bp, Homo sapiens
acacatgtcctatccaaaggaat

SEQ ID NO: 1969266 - DNA, 23 bp, Homo sapiens
acacattatcgggagcagtgtct

SEQ ID NO: 1969267 - DNA, 19 bp, Homo sapiens
acacattctcacaattgta

SEQ ID NO: 1969268 - DNA, 17 bp, Homo sapiens
acacattctcctgtgcc

SEQ ID NO: 1969269 - DNA, 17 bp, Homo sapiens
acacattgtgcttggcc

SEQ ID NO: 1969270 - DNA, 17 bp, Homo sapiens
acacattttctcctagg

SEQ ID NO: 1969271 - DNA, 21 bp, Homo sapiens
acacattttctcctaggagaa

SEQ ID NO: 1969272 - DNA, 13 bp, Homo sapiens
acaccaaaaaaat

SEQ ID NO: 1969273 - DNA, 19 bp, Homo sapiens
acaccaaattccaaacttc

SEQ ID NO: 1969274 - DNA, 18 bp, Homo sapiens
acaccacctcactcctgt

SEQ ID NO: 1969275 - DNA, 11 bp, Homo sapiens
acaccactgcc

SEQ ID NO: 1969276 - DNA, 15 bp, Homo sapiens
acaccactgccctgc

SEQ ID NO: 1969277 - DNA, 18 bp, Homo sapiens
acaccactttgtctctga

SEQ ID NO: 1969278 - DNA, 19 bp, Homo sapiens
acaccactttgtctctgag

SEQ ID NO: 1969279 - DNA, 15 bp, Homo sapiens
acaccagaataatga

SEQ ID NO: 1969280 - DNA, 17 bp, Homo sapiens
acaccagaataatgagt

SEQ ID NO: 1969281 - DNA, 18 bp, Homo sapiens
acaccagagcccaccttg

SEQ ID NO: 1969282 - DNA, 21 bp, Homo sapiens
acaccagagtgtagaataata

SEQ ID NO: 1969283 - DNA, 19 bp, Homo sapiens
acaccattgttccttacct

SEQ ID NO: 1969284 - DNA, 12 bp, Homo sapiens
acacccagccca

SEQ ID NO: 1969285 - DNA, 21 bp, Homo sapiens
acacccagcccacttctgcca

SEQ ID NO: 1969286 - DNA, 20 bp, Homo sapiens
acaccccccgccccccacct

SEQ ID NO: 1969287 - DNA, 19 bp, Homo sapiens
acaccccttatccaggact

SEQ ID NO: 1969288 - DNA, 14 bp, Homo sapiens
acacccggctcccc

SEQ ID NO: 1969289 - DNA, 13 bp, Homo sapiens
acaccctccccat

SEQ ID NO: 1969290 - DNA, 17 bp, Homo sapiens
acaccctccccattcag

SEQ ID NO: 1969291 - DNA, 20 bp, Homo sapiens
acacccttcacataccctcc

SEQ ID NO: 1969292 - DNA, 24 bp, Homo sapiens
acaccgagtctctgtataatctat

SEQ ID NO: 1969293 - DNA, 16 bp, Homo sapiens
acaccgggcactcaga

SEQ ID NO: 1969294 - DNA, 16 bp, Homo sapiens
acaccgggcctggaga

SEQ ID NO: 1969295 - DNA, 17 bp, Homo sapiens
acacctatgtcatttca

SEQ ID NO: 1969296 - DNA, 13 bp, Homo sapiens
acacctcccagga

SEQ ID NO: 1969297 - DNA, 19 bp, Homo sapiens
acacctcccaggagacagt

SEQ ID NO: 1969298 - DNA, 14 bp, Homo sapiens
acacctccctactc

SEQ ID NO: 1969299 - DNA, 22 bp, Homo sapiens
acacctccctgaaccatccctg

SEQ ID NO: 1969300 - DNA, 12 bp, Homo sapiens
acacctctgggc

SEQ ID NO: 1969301 - DNA, 20 bp, Homo sapiens
acacctgaggctgaggcagg

SEQ ID NO: 1969302 - DNA, 12 bp, Homo sapiens
acacctgcacct

SEQ ID NO: 1969303 - DNA, 15 bp, Homo sapiens
acacctgcacctccc

SEQ ID NO: 1969304 - DNA, 24 bp, Homo sapiens
acacctgcacctccccccactgca

SEQ ID NO: 1969305 - DNA, 14 bp, Homo sapiens
acacctgccccagc

SEQ ID NO: 1969306 - DNA, 23 bp, Homo sapiens
acacctgccctgccctgccacct

SEQ ID NO: 1969307 - DNA, 17 bp, Homo sapiens
acacctgttgcacctca

SEQ ID NO: 1969308 - DNA, 14 bp, Homo sapiens
acaccttagcagct

SEQ ID NO: 1969309 - DNA, 15 bp, Homo sapiens
acaccttagcagctc

SEQ ID NO: 1969310 - DNA, 15 bp, Homo sapiens
acaccttatatttac

SEQ ID NO: 1969311 - DNA, 15 bp, Homo sapiens
acaccttgacagggc

SEQ ID NO: 1969312 - DNA, 21 bp, Homo sapiens
acaccttgtgaccttctctat

SEQ ID NO: 1969313 - DNA, 23 bp, Homo sapiens
acaccttgtgaccttctctatat

SEQ ID NO: 1969314 - DNA, 21 bp, Homo sapiens
acacctttgttttgcactgac

SEQ ID NO: 1969315 - DNA, 14 bp, Homo sapiens
acacgagcaggcta

SEQ ID NO: 1969316 - DNA, 16 bp, Homo sapiens
acacgatcttgtaaga

SEQ ID NO: 1969317 - DNA, 22 bp, Homo sapiens
acacgcaagggcatcaggcact

SEQ ID NO: 1969318 - DNA, 15 bp, Homo sapiens
acacgcgtgcacaca

SEQ ID NO: 1969319 - DNA, 15 bp, Homo sapiens
acacgctgtctcttg

SEQ ID NO: 1969320 - DNA, 18 bp, Homo sapiens
acacggaggcatctgcac

SEQ ID NO: 1969321 - DNA, 23 bp, Homo sapiens
acacggatgcacagagatatgca

SEQ ID NO: 1969322 - DNA, 13 bp, Homo sapiens
acacggcagctgt

SEQ ID NO: 1969323 - DNA, 14 bp, Homo sapiens
acacggccctgccc

SEQ ID NO: 1969324 - DNA, 23 bp, Homo sapiens
acacggccctgccccatcctggg

SEQ ID NO: 1969325 - DNA, 17 bp, Homo sapiens
acacggtgaaatccagg

SEQ ID NO: 1969326 - DNA, 13 bp, Homo sapiens
acacgtatttata

SEQ ID NO: 1969327 - DNA, 21 bp, Homo sapiens
acacgtatttatatttggaaa

SEQ ID NO: 1969328 - DNA, 23 bp, Homo sapiens
acacgtatttatatttggaaaga

SEQ ID NO: 1969329 - DNA, 23 bp, Homo sapiens
acacgtggaggtgaagtccctgt

SEQ ID NO: 1969330 - DNA, 20 bp, Homo sapiens
acactaaacagactatttaa

SEQ ID NO: 1969331 - DNA, 14 bp, Homo sapiens
acactaaccacgct

SEQ ID NO: 1969332 - DNA, 19 bp, Homo sapiens
acactaagttatagtatat

SEQ ID NO: 1969333 - DNA, 17 bp, Homo sapiens
acactaattcctttcta

SEQ ID NO: 1969334 - DNA, 14 bp, Homo sapiens
acactacattagaa

SEQ ID NO: 1969335 - DNA, 13 bp, Homo sapiens
acactagcctctc

SEQ ID NO: 1969336 - DNA, 17 bp, Homo sapiens
acactatggtatttgag

SEQ ID NO: 1969337 - DNA, 22 bp, Homo sapiens
acactatggtatttgagtgttt

SEQ ID NO: 1969338 - DNA, 13 bp, Homo sapiens
acactcaaatcaa

SEQ ID NO: 1969339 - DNA, 19 bp, Homo sapiens
acactcaaatcaagaaact

SEQ ID NO: 1969340 - DNA, 22 bp, Homo sapiens
acactcacatttattctgctca

SEQ ID NO: 1969341 - DNA, 14 bp, Homo sapiens
acactcagaagcct

SEQ ID NO: 1969342 - DNA, 18 bp, Homo sapiens
acactccaccccctccag

SEQ ID NO: 1969343 - DNA, 15 bp, Homo sapiens
acactccagcctgag

SEQ ID NO: 1969344 - DNA, 21 bp, Homo sapiens
aagcatgatcttgttaatgca

SEQ ID NO: 1969345 - DNA, 23 bp, Homo sapiens
aagcatggtcccacatccctggg

SEQ ID NO: 1969346 - DNA, 18 bp, Homo sapiens
aagcattacatttccaaa

SEQ ID NO: 1969347 - DNA, 21 bp, Homo sapiens
aagcattcagaagaaaaagaa

SEQ ID NO: 1969348 - DNA, 22 bp, Homo sapiens
aagcattgggtgggtaaattca

SEQ ID NO: 1969349 - DNA, 23 bp, Homo sapiens
aagcatttgtttctactttgata

SEQ ID NO: 1969350 - DNA, 21 bp, Homo sapiens
aagcattttactgtctgtaag

SEQ ID NO: 1969351 - DNA, 14 bp, Homo sapiens
aagccaaactctgc

SEQ ID NO: 1969352 - DNA, 21 bp, Homo sapiens
aagccaaatttatatgccacc

SEQ ID NO: 1969353 - DNA, 17 bp, Homo sapiens
aagccaacttgtaaata

SEQ ID NO: 1969354 - DNA, 19 bp, Homo sapiens
aagccaacttgtaaataca

SEQ ID NO: 1969355 - DNA, 21 bp, Homo sapiens
aagccaatatttactcatcag

SEQ ID NO: 1969356 - DNA, 16 bp, Homo sapiens
aagccacaagaaattt

SEQ ID NO: 1969357 - DNA, 18 bp, Homo sapiens
aagccacaagaaatttga

SEQ ID NO: 1969358 - DNA, 14 bp, Homo sapiens
aagccacagcttct

SEQ ID NO: 1969359 - DNA, 19 bp, Homo sapiens
aagccactatgtccagcta

SEQ ID NO: 1969360 - DNA, 20 bp, Homo sapiens
aagccagaagctaagctgca

SEQ ID NO: 1969361 - DNA, 21 bp, Homo sapiens
aagccagggtcctgagtggct

SEQ ID NO: 1969362 - DNA, 20 bp, Homo sapiens
aagccagtatttctttccct

SEQ ID NO: 1969363 - DNA, 18 bp, Homo sapiens
aagccatggtgacacaca

SEQ ID NO: 1969364 - DNA, 22 bp, Homo sapiens
aagccatggtgacacacagcag

SEQ ID NO: 1969365 - DNA, 17 bp, Homo sapiens
aagcccaacctcctgac

SEQ ID NO: 1969366 - DNA, 16 bp, Homo sapiens
aagcccagctctttgt

SEQ ID NO: 1969367 - DNA, 19 bp, Homo sapiens
aagcccagctctttgttca

SEQ ID NO: 1969368 - DNA, 14 bp, Homo sapiens
aagcccaggctgga

SEQ ID NO: 1969369 - DNA, 18 bp, Homo sapiens
aagccccagggcctgggg

SEQ ID NO: 1969370 - DNA, 13 bp, Homo sapiens
aagcccctcagcc

SEQ ID NO: 1969371 - DNA, 15 bp, Homo sapiens
aagcccctcagccct

SEQ ID NO: 1969372 - DNA, 12 bp, Homo sapiens
aagcccctggaa

SEQ ID NO: 1969373 - DNA, 20 bp, Homo sapiens
aagccccttgtcctctcccg

SEQ ID NO: 1969374 - DNA, 9 bp, Homo sapiens
aagccctcc

SEQ ID NO: 1969375 - DNA, 14 bp, Homo sapiens
aagccctggcaaca

SEQ ID NO: 1969376 - DNA, 16 bp, Homo sapiens
aagccgtactgtctat

SEQ ID NO: 1969377 - DNA, 19 bp, Homo sapiens
aagccgtctgactccagag

SEQ ID NO: 1969378 - DNA, 20 bp, Homo sapiens
aagccgtctgactccagagt

SEQ ID NO: 1969379 - DNA, 13 bp, Homo sapiens
aagccgtggcttc

SEQ ID NO: 1969380 - DNA, 14 bp, Homo sapiens
aagccgtggcttcc

SEQ ID NO: 1969381 - DNA, 14 bp, Homo sapiens
aagcctcatattta

SEQ ID NO: 1969382 - DNA, 15 bp, Homo sapiens
aagcctccggtttcc

SEQ ID NO: 1969383 - DNA, 18 bp, Homo sapiens
aagcctctgccccaaggg

SEQ ID NO: 1969384 - DNA, 19 bp, Homo sapiens
aagcctctgccctgcctcc

SEQ ID NO: 1969385 - DNA, 20 bp, Homo sapiens
aagcctctgccctgcctccc

SEQ ID NO: 1969386 - DNA, 22 bp, Homo sapiens
aagcctctgccctgcctccctt

SEQ ID NO: 1969387 - DNA, 19 bp, Homo sapiens
aagcctctgcctccctagc

SEQ ID NO: 1969388 - DNA, 13 bp, Homo sapiens
aagcctctggaaa

SEQ ID NO: 1969389 - DNA, 17 bp, Homo sapiens
aagcctgggattgacag

SEQ ID NO: 1969390 - DNA, 20 bp, Homo sapiens
aagcctgggggcctggctgg

SEQ ID NO: 1969391 - DNA, 23 bp, Homo sapiens
aagcctgggggcctggctggctg

SEQ ID NO: 1969392 - DNA, 17 bp, Homo sapiens
aagcctgtaatcccagc

SEQ ID NO: 1969393 - DNA, 18 bp, Homo sapiens
aagcctgtgccacctgca

SEQ ID NO: 1969394 - DNA, 17 bp, Homo sapiens
aagcctgttcatggcag

SEQ ID NO: 1969395 - DNA, 16 bp, Homo sapiens
aagccttactcacctc

SEQ ID NO: 1969396 - DNA, 18 bp, Homo sapiens
aagcgaggtcaacagaga

SEQ ID NO: 1969397 - DNA, 15 bp, Homo sapiens
aagcgattcttctgc

SEQ ID NO: 1969398 - DNA, 20 bp, Homo sapiens
aagcgattcttgtgcctcag

SEQ ID NO: 1969399 - DNA, 19 bp, Homo sapiens
aagcgcagggaggatgcca

SEQ ID NO: 1969400 - DNA, 23 bp, Homo sapiens
aagcgcagggaggatgccacagc

SEQ ID NO: 1969401 - DNA, 20 bp, Homo sapiens
aagcggttgcttctggctcc

SEQ ID NO: 1969402 - DNA, 20 bp, Homo sapiens
aagcggtttccaggccaccg

SEQ ID NO: 1969403 - DNA, 16 bp, Homo sapiens
aagcgtgagccactgc

SEQ ID NO: 1969404 - DNA, 21 bp, Homo sapiens
aagcgtgagccactgcaccgg

SEQ ID NO: 1969405 - DNA, 16 bp, Homo sapiens
aagctaaaacctgagc

SEQ ID NO: 1969406 - DNA, 12 bp, Homo sapiens
aagctactgaat

SEQ ID NO: 1969407 - DNA, 21 bp, Homo sapiens
aagctactgaatttattgccg

SEQ ID NO: 1969408 - DNA, 18 bp, Homo sapiens
aagctagccagagggtgg

SEQ ID NO: 1969409 - DNA, 18 bp, Homo sapiens
aagctagtggcttcaaaa

SEQ ID NO: 1969410 - DNA, 16 bp, Homo sapiens
aagctattgagaaaga

SEQ ID NO: 1969411 - DNA, 15 bp, Homo sapiens
aagctattgatgttt

SEQ ID NO: 1969412 - DNA, 20 bp, Homo sapiens
aagctcaagatgacagctct

SEQ ID NO: 1969413 - DNA, 22 bp, Homo sapiens
aagctcacagttcctcgccctg

SEQ ID NO: 1969414 - DNA, 23 bp, Homo sapiens
aagctcaggaggcgaataaatgt

SEQ ID NO: 1969415 - DNA, 23 bp, Homo sapiens
aagctcatattttgtatatatct

SEQ ID NO: 1969416 - DNA, 19 bp, Homo sapiens
aagctccacggtgcgtggc

SEQ ID NO: 1969417 - DNA, 16 bp, Homo sapiens
aagctccactgtcacc

SEQ ID NO: 1969418 - DNA, 19 bp, Homo sapiens
aagctccactgtcaccctc

SEQ ID NO: 1969419 - DNA, 15 bp, Homo sapiens
aagctcctgtcctcc

SEQ ID NO: 1969420 - DNA, 16 bp, Homo sapiens
aagctctagtgggaag

SEQ ID NO: 1969421 - DNA, 18 bp, Homo sapiens
aagctctgaacaaaagct

SEQ ID NO: 1969422 - DNA, 17 bp, Homo sapiens
aagctctgctcctctcc

SEQ ID NO: 1969423 - DNA, 23 bp, Homo sapiens
aagctctggccccaggcttgtca

SEQ ID NO: 1969424 - DNA, 11 bp, Homo sapiens
aagctctggct

SEQ ID NO: 1969425 - DNA, 22 bp, Homo sapiens
aagctctgtttataaaaacaaa

SEQ ID NO: 1969426 - DNA, 22 bp, Homo sapiens
aagctcttacactacattagaa

SEQ ID NO: 1969427 - DNA, 15 bp, Homo sapiens
aagctgactttgttg

SEQ ID NO: 1969428 - DNA, 16 bp, Homo sapiens
aagctgagaagaagct

SEQ ID NO: 1969429 - DNA, 23 bp, Homo sapiens
aagctgagcaggcccgacagaga

SEQ ID NO: 1969430 - DNA, 13 bp, Homo sapiens
aagctgaggtgcc

SEQ ID NO: 1969431 - DNA, 21 bp, Homo sapiens
aagctgagttacttgtctgag

SEQ ID NO: 1969432 - DNA, 23 bp, Homo sapiens
aagctgagttacttgtctgaggc

SEQ ID NO: 1969433 - DNA, 21 bp, Homo sapiens
aagctgctgagaatctagcct

SEQ ID NO: 1969434 - DNA, 19 bp, Homo sapiens
aagctgcttgactatcaca

SEQ ID NO: 1969435 - DNA, 20 bp, Homo sapiens
aagctgcttgactatcacat

SEQ ID NO: 1969436 - DNA, 14 bp, Homo sapiens
aagctgctttattc

SEQ ID NO: 1969437 - DNA, 11 bp, Homo sapiens
aagctggaagc

SEQ ID NO: 1969438 - DNA, 18 bp, Homo sapiens
aagctggacaagaagctg

SEQ ID NO: 1969439 - DNA, 19 bp, Homo sapiens
aagctggacaagaagctgc

SEQ ID NO: 1969440 - DNA, 23 bp, Homo sapiens
aagctggaggactagaacctgga

SEQ ID NO: 1969441 - DNA, 15 bp, Homo sapiens
aagctggcagcactc

SEQ ID NO: 1969442 - DNA, 22 bp, Homo sapiens
aagctgggaaaaaagttttgat

SEQ ID NO: 1969443 - DNA, 20 bp, Homo sapiens
aagctgggcatgaacgcact

SEQ ID NO: 1969444 - DNA, 15 bp, Homo sapiens
aagctgggggaaggg

SEQ ID NO: 1969445 - DNA, 18 bp, Homo sapiens
aagctggtcccactcagt

SEQ ID NO: 1969446 - DNA, 21 bp, Homo sapiens
aagctggtcccactcagtcca

SEQ ID NO: 1969447 - DNA, 20 bp, Homo sapiens
aagctgtactcagagcagag

SEQ ID NO: 1969448 - DNA, 23 bp, Homo sapiens
aagctgtagtagccctttctgtg

SEQ ID NO: 1969449 - DNA, 20 bp, Homo sapiens
aagctgtgtccttgcacctg

SEQ ID NO: 1969450 - DNA, 19 bp, Homo sapiens
aagctgtttatttattcac

SEQ ID NO: 1969451 - DNA, 15 bp, Homo sapiens
aagctgtttccatag

SEQ ID NO: 1969452 - DNA, 21 bp, Homo sapiens
aagcttaatggctgataattt

SEQ ID NO: 1969453 - DNA, 18 bp, Homo sapiens
aagcttattaaaactcat

SEQ ID NO: 1969454 - DNA, 12 bp, Homo sapiens
aagcttcaaccc

SEQ ID NO: 1969455 - DNA, 19 bp, Homo sapiens
aagcttcaaccctcagcct

SEQ ID NO: 1969456 - DNA, 18 bp, Homo sapiens
aagcttcaagtgatatat

SEQ ID NO: 1969457 - DNA, 20 bp, Homo sapiens
aagcttcaagtgatatatgt

SEQ ID NO: 1969458 - DNA, 12 bp, Homo sapiens
aagcttcagagc

SEQ ID NO: 1969459 - DNA, 17 bp, Homo sapiens
acactccagcctgagca

SEQ ID NO: 1969460 - DNA, 23 bp, Homo sapiens
acactctagtgacttcctggtga

SEQ ID NO: 1969461 - DNA, 21 bp, Homo sapiens
acactgaatctcccctcctca

SEQ ID NO: 1969462 - DNA, 15 bp, Homo sapiens
acactgagcaagatc

SEQ ID NO: 1969463 - DNA, 21 bp, Homo sapiens
acactgagcaagatcttgtct

SEQ ID NO: 1969464 - DNA, 13 bp, Homo sapiens
acactgcaagaag

SEQ ID NO: 1969465 - DNA, 15 bp, Homo sapiens
acactgcaagaagtc

SEQ ID NO: 1969466 - DNA, 13 bp, Homo sapiens
acactgctgcacc

SEQ ID NO: 1969467 - DNA, 14 bp, Homo sapiens
acactggatatgtt

SEQ ID NO: 1969468 - DNA, 14 bp, Homo sapiens
acactggtggagga

SEQ ID NO: 1969469 - DNA, 17 bp, Homo sapiens
acactggtggaggagct

SEQ ID NO: 1969470 - DNA, 19 bp, Homo sapiens
acactgtaaatatccacag

SEQ ID NO: 1969471 - DNA, 23 bp, Homo sapiens
acactgtcagagctgttggcctc

SEQ ID NO: 1969472 - DNA, 14 bp, Homo sapiens
acactgtcatccgt

SEQ ID NO: 1969473 - DNA, 13 bp, Homo sapiens
acactgtcttgaa

SEQ ID NO: 1969474 - DNA, 19 bp, Homo sapiens
acactgtgcgttttagagt

SEQ ID NO: 1969475 - DNA, 22 bp, Homo sapiens
acactgttactccacagcggag

SEQ ID NO: 1969476 - DNA, 20 bp, Homo sapiens
acacttatggggacagcata

SEQ ID NO: 1969477 - DNA, 19 bp, Homo sapiens
acacttcatggaccaagaa

SEQ ID NO: 1969478 - DNA, 22 bp, Homo sapiens
acacttctcaggacacaggcct

SEQ ID NO: 1969479 - DNA, 20 bp, Homo sapiens
acacttctcatcatattgta

SEQ ID NO: 1969480 - DNA, 16 bp, Homo sapiens
acacttcttgaaacag

SEQ ID NO: 1969481 - DNA, 20 bp, Homo sapiens
acacttgccttcttcaccca

SEQ ID NO: 1969482 - DNA, 13 bp, Homo sapiens
acacttggagccc

SEQ ID NO: 1969483 - DNA, 17 bp, Homo sapiens
acacttggagcccgtgc

SEQ ID NO: 1969484 - DNA, 21 bp, Homo sapiens
acacttgggcgctctgccctc

SEQ ID NO: 1969485 - DNA, 22 bp, Homo sapiens
acactttggccaagcaagaggt

SEQ ID NO: 1969486 - DNA, 17 bp, Homo sapiens
acagaaacaaaaacact

SEQ ID NO: 1969487 - DNA, 14 bp, Homo sapiens
acagaaacattttc

SEQ ID NO: 1969488 - DNA, 15 bp, Homo sapiens
acagaaatactgctc

SEQ ID NO: 1969489 - DNA, 19 bp, Homo sapiens
acagaaatatatatacata

SEQ ID NO: 1969490 - DNA, 20 bp, Homo sapiens
acagaaatatatatacatat

SEQ ID NO: 1969491 - DNA, 13 bp, Homo sapiens
acagaaatgttaa

SEQ ID NO: 1969492 - DNA, 17 bp, Homo sapiens
acagaaattagccgggc

SEQ ID NO: 1969493 - DNA, 16 bp, Homo sapiens
acagaacatagacaga

SEQ ID NO: 1969494 - DNA, 15 bp, Homo sapiens
acagaaccagagggt

SEQ ID NO: 1969495 - DNA, 17 bp, Homo sapiens
acagaacccctacatga

SEQ ID NO: 1969496 - DNA, 21 bp, Homo sapiens
acagaactgaacgtcctgcag

SEQ ID NO: 1969497 - DNA, 14 bp, Homo sapiens
acagaagaaacaag

SEQ ID NO: 1969498 - DNA, 20 bp, Homo sapiens
acagaagaaggcagcaggtg

SEQ ID NO: 1969499 - DNA, 22 bp, Homo sapiens
acagaagcagttgagtcgtcat

SEQ ID NO: 1969500 - DNA, 18 bp, Homo sapiens
acagaagccaggagcaaa

SEQ ID NO: 1969501 - DNA, 21 bp, Homo sapiens
acagaagccaggagcaaatgt

SEQ ID NO: 1969502 - DNA, 20 bp, Homo sapiens
acagaaggaatctgtgcaga

SEQ ID NO: 1969503 - DNA, 16 bp, Homo sapiens
acagaagtcatgaagc

SEQ ID NO: 1969504 - DNA, 17 bp, Homo sapiens
acagaagtcatgaagcc

SEQ ID NO: 1969505 - DNA, 14 bp, Homo sapiens
acagaatcttgtat

SEQ ID NO: 1969506 - DNA, 15 bp, Homo sapiens
acagaatttttaatg

SEQ ID NO: 1969507 - DNA, 20 bp, Homo sapiens
acagaatttttaatgacttt

SEQ ID NO: 1969508 - DNA, 18 bp, Homo sapiens
acagacaaaaacagcctc

SEQ ID NO: 1969509 - DNA, 20 bp, Homo sapiens
acagacaaaaacagcctcac

SEQ ID NO: 1969510 - DNA, 22 bp, Homo sapiens
acagacacaggcccggctccag

SEQ ID NO: 1969511 - DNA, 21 bp, Homo sapiens
acagacagatcccatccatca

SEQ ID NO: 1969512 - DNA, 13 bp, Homo sapiens
acagacaggagaa

SEQ ID NO: 1969513 - DNA, 17 bp, Homo sapiens
acagacattaaacctgg

SEQ ID NO: 1969514 - DNA, 17 bp, Homo sapiens
acagacattttcaataa

SEQ ID NO: 1969515 - DNA, 15 bp, Homo sapiens
acagaccacctgctt

SEQ ID NO: 1969516 - DNA, 20 bp, Homo sapiens
acagaccacctgcttctgaa

SEQ ID NO: 1969517 - DNA, 13 bp, Homo sapiens
acagacctggaca

SEQ ID NO: 1969518 - DNA, 16 bp, Homo sapiens
acagacttctggaagg

SEQ ID NO: 1969519 - DNA, 11 bp, Homo sapiens
acagagaaagt

SEQ ID NO: 1969520 - DNA, 18 bp, Homo sapiens
acagagaaagtacttctc

SEQ ID NO: 1969521 - DNA, 14 bp, Homo sapiens
acagagaaggcagg

SEQ ID NO: 1969522 - DNA, 14 bp, Homo sapiens
acagagacacctgc

SEQ ID NO: 1969523 - DNA, 15 bp, Homo sapiens
acagagacacctgca

SEQ ID NO: 1969524 - DNA, 16 bp, Homo sapiens
acagagacacctgcac

SEQ ID NO: 1969525 - DNA, 17 bp, Homo sapiens
acagagacagagagaga

SEQ ID NO: 1969526 - DNA, 19 bp, Homo sapiens
acagagactctggaagccc

SEQ ID NO: 1969527 - DNA, 20 bp, Homo sapiens
acagagaggagttgccaggg

SEQ ID NO: 1969528 - DNA, 16 bp, Homo sapiens
acagagcccccaagcc

SEQ ID NO: 1969529 - DNA, 15 bp, Homo sapiens
acagagcgggcctct

SEQ ID NO: 1969530 - DNA, 23 bp, Homo sapiens
acagagcgggcctcttccctcag

SEQ ID NO: 1969531 - DNA, 16 bp, Homo sapiens
acagagctggctgtct

SEQ ID NO: 1969532 - DNA, 14 bp, Homo sapiens
acagagcttgaaaa

SEQ ID NO: 1969533 - DNA, 17 bp, Homo sapiens
acagaggaagagcaggc

SEQ ID NO: 1969534 - DNA, 18 bp, Homo sapiens
acagaggaagagcaggca

SEQ ID NO: 1969535 - DNA, 21 bp, Homo sapiens
acagaggaatctacctgtggt

SEQ ID NO: 1969536 - DNA, 15 bp, Homo sapiens
acagaggcagcccca

SEQ ID NO: 1969537 - DNA, 19 bp, Homo sapiens
acagaggcagccccattct

SEQ ID NO: 1969538 - DNA, 23 bp, Homo sapiens
acagaggcagctgtgtgggctgc

SEQ ID NO: 1969539 - DNA, 23 bp, Homo sapiens
acagagggaccaaattgcttcta

SEQ ID NO: 1969540 - DNA, 14 bp, Homo sapiens
acagagtatatatg

SEQ ID NO: 1969541 - DNA, 15 bp, Homo sapiens
acagagtatatatgt

SEQ ID NO: 1969542 - DNA, 19 bp, Homo sapiens
acagagtctcactgttgcc

SEQ ID NO: 1969543 - DNA, 17 bp, Homo sapiens
acagagtggagccctca

SEQ ID NO: 1969544 - DNA, 22 bp, Homo sapiens
acagataatttattttgtattt

SEQ ID NO: 1969545 - DNA, 21 bp, Homo sapiens
acagatactggaagttttgca

SEQ ID NO: 1969546 - DNA, 23 bp, Homo sapiens
acagatagtcaaaccataaactt

SEQ ID NO: 1969547 - DNA, 14 bp, Homo sapiens
acagatataaatgg

SEQ ID NO: 1969548 - DNA, 17 bp, Homo sapiens
acagatataaatggctg

SEQ ID NO: 1969549 - DNA, 17 bp, Homo sapiens
acagatatacacatgga

SEQ ID NO: 1969550 - DNA, 19 bp, Homo sapiens
acagatatgcacacacatg

SEQ ID NO: 1969551 - DNA, 18 bp, Homo sapiens
acagatatttccatttct

SEQ ID NO: 1969552 - DNA, 23 bp, Homo sapiens
acagatcccatccatcagctccc

SEQ ID NO: 1969553 - DNA, 18 bp, Homo sapiens
acagatgataaatattta

SEQ ID NO: 1969554 - DNA, 21 bp, Homo sapiens
acagatgcacacacagatgca

SEQ ID NO: 1969555 - DNA, 16 bp, Homo sapiens
acagatggcttagtta

SEQ ID NO: 1969556 - DNA, 18 bp, Homo sapiens
acagatgggtattaaact

SEQ ID NO: 1969557 - DNA, 19 bp, Homo sapiens
acagatgggtattaaactt

SEQ ID NO: 1969558 - DNA, 23 bp, Homo sapiens
acagatgggtattaaacttgtca

SEQ ID NO: 1969559 - DNA, 18 bp, Homo sapiens
acagattacttcagggct

SEQ ID NO: 1969560 - DNA, 14 bp, Homo sapiens
acagattgtttgca

SEQ ID NO: 1969561 - DNA, 16 bp, Homo sapiens
acagcacccaggctcc

SEQ ID NO: 1969562 - DNA, 19 bp, Homo sapiens
acagcacccaggctccatg

SEQ ID NO: 1969563 - DNA, 13 bp, Homo sapiens
acagcagaaagac

SEQ ID NO: 1969564 - DNA, 13 bp, Homo sapiens
acagcagaatgaa

SEQ ID NO: 1969565 - DNA, 15 bp, Homo sapiens
acagcagaatgaaga

SEQ ID NO: 1969566 - DNA, 20 bp, Homo sapiens
acagcagccccccagcacta

SEQ ID NO: 1969567 - DNA, 14 bp, Homo sapiens
acagcagctgaaca

SEQ ID NO: 1969568 - DNA, 14 bp, Homo sapiens
acagcagtcttctt

SEQ ID NO: 1969569 - DNA, 19 bp, Homo sapiens
acagcagtggagagtgttc

SEQ ID NO: 1969570 - DNA, 17 bp, Homo sapiens
acagcagtgtcatcaga

SEQ ID NO: 1969571 - DNA, 23 bp, Homo sapiens
acagcagttgaaaagactccaaa

SEQ ID NO: 1969572 - DNA, 13 bp, Homo sapiens
acagccaacaggt

SEQ ID NO: 1969573 - DNA, 18 bp, Homo sapiens
acagccacggccaggcca

SEQ ID NO: 1969574 - DNA, 17 bp, Homo sapiens
acagcccaaagaaggaa

SEQ ID NO: 1969575 - DNA, 20 bp, Homo sapiens
aaggctttgccatgggcctg

SEQ ID NO: 1969576 - DNA, 15 bp, Homo sapiens
aagggaaggctgctg

SEQ ID NO: 1969577 - DNA, 19 bp, Homo sapiens
aagggaaggctgctgtgta

SEQ ID NO: 1969578 - DNA, 13 bp, Homo sapiens
aagggacacacac

SEQ ID NO: 1969579 - DNA, 19 bp, Homo sapiens
aagggacagtattctcagt

SEQ ID NO: 1969580 - DNA, 18 bp, Homo sapiens
aagggacccgaagcccag

SEQ ID NO: 1969581 - DNA, 20 bp, Homo sapiens
aagggacttggaagctccgc

SEQ ID NO: 1969582 - DNA, 14 bp, Homo sapiens
aagggagaagaaat

SEQ ID NO: 1969583 - DNA, 18 bp, Homo sapiens
aagggagagggagggagc

SEQ ID NO: 1969584 - DNA, 20 bp, Homo sapiens
aagggaggcccagccgcagg

SEQ ID NO: 1969585 - DNA, 16 bp, Homo sapiens
aagggagggctctgag

SEQ ID NO: 1969586 - DNA, 18 bp, Homo sapiens
aagggagggctctgaggc

SEQ ID NO: 1969587 - DNA, 21 bp, Homo sapiens
aagggagggctctgaggcgcc

SEQ ID NO: 1969588 - DNA, 17 bp, Homo sapiens
aagggagttgctcactc

SEQ ID NO: 1969589 - DNA, 14 bp, Homo sapiens
aagggatggcaaga

SEQ ID NO: 1969590 - DNA, 20 bp, Homo sapiens
aagggcaaaccatttcaaat

SEQ ID NO: 1969591 - DNA, 13 bp, Homo sapiens
aagggcaataaat

SEQ ID NO: 1969592 - DNA, 16 bp, Homo sapiens
aagggcagccaggggc

SEQ ID NO: 1969593 - DNA, 22 bp, Homo sapiens
aagggcagccaggggctgctca

SEQ ID NO: 1969594 - DNA, 16 bp, Homo sapiens
aagggcagtaaagttt

SEQ ID NO: 1969595 - DNA, 14 bp, Homo sapiens
aagggccagcccta

SEQ ID NO: 1969596 - DNA, 19 bp, Homo sapiens
aagggccagccctacatct

SEQ ID NO: 1969597 - DNA, 22 bp, Homo sapiens
aagggccagccctacatcttca

SEQ ID NO: 1969598 - DNA, 23 bp, Homo sapiens
aagggccagccctacatcttcag

SEQ ID NO: 1969599 - DNA, 14 bp, Homo sapiens
aagggccagtctgg

SEQ ID NO: 1969600 - DNA, 19 bp, Homo sapiens
aagggctagaacctggagg

SEQ ID NO: 1969601 - DNA, 17 bp, Homo sapiens
aagggctgacctgcctc

SEQ ID NO: 1969602 - DNA, 18 bp, Homo sapiens
aagggctgacctgcctct

SEQ ID NO: 1969603 - DNA, 23 bp, Homo sapiens
aaggggaatgtttgcctctgcct

SEQ ID NO: 1969604 - DNA, 23 bp, Homo sapiens
aaggggacgcgggctgtgcctta

SEQ ID NO: 1969605 - DNA, 18 bp, Homo sapiens
aaggggagaagggccagc

SEQ ID NO: 1969606 - DNA, 14 bp, Homo sapiens
aaggggcacaccac

SEQ ID NO: 1969607 - DNA, 23 bp, Homo sapiens
aaggggcacctgggaaaacagag

SEQ ID NO: 1969608 - DNA, 19 bp, Homo sapiens
aaggggcacgcctgcccag

SEQ ID NO: 1969609 - DNA, 18 bp, Homo sapiens
aaggggccccggggctgg

SEQ ID NO: 1969610 - DNA, 21 bp, Homo sapiens
aaggggccctggtccttccag

SEQ ID NO: 1969611 - DNA, 16 bp, Homo sapiens
aaggggcgagcaccca

SEQ ID NO: 1969612 - DNA, 21 bp, Homo sapiens
aaggggctgctggggcatgtg

SEQ ID NO: 1969613 - DNA, 19 bp, Homo sapiens
aagggggagtttttagttt

SEQ ID NO: 1969614 - DNA, 17 bp, Homo sapiens
aagggggtcaaaggaag

SEQ ID NO: 1969615 - DNA, 20 bp, Homo sapiens
aaggggttggttgaggtgga

SEQ ID NO: 1969616 - DNA, 16 bp, Homo sapiens
aagggtatcaggtgct

SEQ ID NO: 1969617 - DNA, 17 bp, Homo sapiens
aagggtatcaggtgctg

SEQ ID NO: 1969618 - DNA, 19 bp, Homo sapiens
aagggtatcaggtgctgcc

SEQ ID NO: 1969619 - DNA, 13 bp, Homo sapiens
aagggtccagaag

SEQ ID NO: 1969620 - DNA, 20 bp, Homo sapiens
aagggtctagggagagaccc

SEQ ID NO: 1969621 - DNA, 22 bp, Homo sapiens
aagggtctagggagagaccctt

SEQ ID NO: 1969622 - DNA, 15 bp, Homo sapiens
aagggtctgataaac

SEQ ID NO: 1969623 - DNA, 14 bp, Homo sapiens
aagggtcttcttgg

SEQ ID NO: 1969624 - DNA, 16 bp, Homo sapiens
aagggtgacatcccag

SEQ ID NO: 1969625 - DNA, 16 bp, Homo sapiens
aagggtggtttggcaa

SEQ ID NO: 1969626 - DNA, 23 bp, Homo sapiens
aagggtttctgacccaagaggtg

SEQ ID NO: 1969627 - DNA, 16 bp, Homo sapiens
aaggtagagatgtgtg

SEQ ID NO: 1969628 - DNA, 20 bp, Homo sapiens
aaggtagcccagcactgtga

SEQ ID NO: 1969629 - DNA, 22 bp, Homo sapiens
aaggtagtttttacctaccaca

SEQ ID NO: 1969630 - DNA, 11 bp, Homo sapiens
aaggtataatt

SEQ ID NO: 1969631 - DNA, 18 bp, Homo sapiens
aaggtattccttttgtgt

SEQ ID NO: 1969632 - DNA, 22 bp, Homo sapiens
aaggtattccttttgtgtacag

SEQ ID NO: 1969633 - DNA, 19 bp, Homo sapiens
aaggtattgagccattttt

SEQ ID NO: 1969634 - DNA, 20 bp, Homo sapiens
aaggtcattgtggctatctg

SEQ ID NO: 1969635 - DNA, 23 bp, Homo sapiens
aaggtctccttactctgagccca

SEQ ID NO: 1969636 - DNA, 12 bp, Homo sapiens
aaggtctgcttt

SEQ ID NO: 1969637 - DNA, 19 bp, Homo sapiens
aaggtcttcttgtgtcctg

SEQ ID NO: 1969638 - DNA, 14 bp, Homo sapiens
aaggtcttgcctga

SEQ ID NO: 1969639 - DNA, 12 bp, Homo sapiens
aaggtctttgca

SEQ ID NO: 1969640 - DNA, 19 bp, Homo sapiens
aaggtctttggttcagcta

SEQ ID NO: 1969641 - DNA, 18 bp, Homo sapiens
aaggtgcagtaggagcaa

SEQ ID NO: 1969642 - DNA, 13 bp, Homo sapiens
aaggtgctgagct

SEQ ID NO: 1969643 - DNA, 14 bp, Homo sapiens
aaggtgctgagctt

SEQ ID NO: 1969644 - DNA, 16 bp, Homo sapiens
aaggtgggctgagccc

SEQ ID NO: 1969645 - DNA, 20 bp, Homo sapiens
aaggtgggctgagccctggc

SEQ ID NO: 1969646 - DNA, 23 bp, Homo sapiens
aaggtggggtatttaccacagca

SEQ ID NO: 1969647 - DNA, 21 bp, Homo sapiens
aaggtgggtccaggaaggcag

SEQ ID NO: 1969648 - DNA, 24 bp, Homo sapiens
aaggtgggtccaggaaggcagctg

SEQ ID NO: 1969649 - DNA, 16 bp, Homo sapiens
aaggtggtatgtgtgt

SEQ ID NO: 1969650 - DNA, 18 bp, Homo sapiens
aaggttactcagcagcag

SEQ ID NO: 1969651 - DNA, 18 bp, Homo sapiens
aaggtttggtccagcctg

SEQ ID NO: 1969652 - DNA, 17 bp, Homo sapiens
aaggtttgtatattgtc

SEQ ID NO: 1969653 - DNA, 13 bp, Homo sapiens
aaggttttctcca

SEQ ID NO: 1969654 - DNA, 16 bp, Homo sapiens
aagtaaaaccacagca

SEQ ID NO: 1969655 - DNA, 18 bp, Homo sapiens
aagtaaaagcaaaaaaga

SEQ ID NO: 1969656 - DNA, 22 bp, Homo sapiens
aagtaaaagctaattaggattt

SEQ ID NO: 1969657 - DNA, 15 bp, Homo sapiens
aagtaacttttacaa

SEQ ID NO: 1969658 - DNA, 21 bp, Homo sapiens
aagtaagagctaagttctaag

SEQ ID NO: 1969659 - DNA, 22 bp, Homo sapiens
aagtaagagctaagttctaagt

SEQ ID NO: 1969660 - DNA, 18 bp, Homo sapiens
aagtaagtaccactcagg

SEQ ID NO: 1969661 - DNA, 22 bp, Homo sapiens
aagtaattatcgggaacagtgt

SEQ ID NO: 1969662 - DNA, 23 bp, Homo sapiens
aagtaattatcgggaacagtgtt

SEQ ID NO: 1969663 - DNA, 20 bp, Homo sapiens
aagtaattgcatttctgctc

SEQ ID NO: 1969664 - DNA, 13 bp, Homo sapiens
aagtacatttaat

SEQ ID NO: 1969665 - DNA, 16 bp, Homo sapiens
aagtactgtgtacaga

SEQ ID NO: 1969666 - DNA, 20 bp, Homo sapiens
aagtacttctccaccctgct

SEQ ID NO: 1969667 - DNA, 21 bp, Homo sapiens
aagtacttctccaccctgctc

SEQ ID NO: 1969668 - DNA, 23 bp, Homo sapiens
aagtacttctccaccctgctctc

SEQ ID NO: 1969669 - DNA, 17 bp, Homo sapiens
aagtagaattatatcta

SEQ ID NO: 1969670 - DNA, 19 bp, Homo sapiens
aagtagaattatatctaat

SEQ ID NO: 1969671 - DNA, 21 bp, Homo sapiens
aagtagaattatatctaattt

SEQ ID NO: 1969672 - DNA, 23 bp, Homo sapiens
aagtagaattatatctaatttat

SEQ ID NO: 1969673 - DNA, 12 bp, Homo sapiens
aagtagagaagt

SEQ ID NO: 1969674 - DNA, 18 bp, Homo sapiens
aagtagcaaccttcattt

SEQ ID NO: 1969675 - DNA, 20 bp, Homo sapiens
aagtagcaaccttcatttta

SEQ ID NO: 1969676 - DNA, 22 bp, Homo sapiens
aagtagcaaccttcattttaca

SEQ ID NO: 1969677 - DNA, 23 bp, Homo sapiens
aagtaggactttcctaaatgttt

SEQ ID NO: 1969678 - DNA, 15 bp, Homo sapiens
aagtaggcatgaggg

SEQ ID NO: 1969679 - DNA, 12 bp, Homo sapiens
aagtagtttgta

SEQ ID NO: 1969680 - DNA, 20 bp, Homo sapiens
aagtagtttgtataacttct

SEQ ID NO: 1969681 - DNA, 16 bp, Homo sapiens
aagtatatagtatatt

SEQ ID NO: 1969682 - DNA, 18 bp, Homo sapiens
aagtatatagtatattta

SEQ ID NO: 1969683 - DNA, 23 bp, Homo sapiens
aagtatatagtatatttatactc

SEQ ID NO: 1969684 - DNA, 14 bp, Homo sapiens
aagtatattttcct

SEQ ID NO: 1969685 - DNA, 12 bp, Homo sapiens
aagtatcatgca

SEQ ID NO: 1969686 - DNA, 16 bp, Homo sapiens
aagtatccaattatgt

SEQ ID NO: 1969687 - DNA, 18 bp, Homo sapiens
aagtatccaattatgtga

SEQ ID NO: 1969688 - DNA, 20 bp, Homo sapiens
aagtatccaattatgtgaca

SEQ ID NO: 1969689 - DNA, 17 bp, Homo sapiens
aagtatgagggaaaatg

SEQ ID NO: 1969690 - DNA, 22 bp, Homo sapiens
aagtattaggggtaatatattg

SEQ ID NO: 1969691 - DNA, 13 bp, Homo sapiens
aagtatttatata

SEQ ID NO: 1969692 - DNA, 21 bp, Homo sapiens
aagtatttatatatttataac

SEQ ID NO: 1969693 - DNA, 22 bp, Homo sapiens
aagtatttatatatttataact

SEQ ID NO: 1969694 - DNA, 23 bp, Homo sapiens
aagtatttatatatttataactc

SEQ ID NO: 1969695 - DNA, 21 bp, Homo sapiens
aagtatttgttaatttagaaa

SEQ ID NO: 1969696 - DNA, 18 bp, Homo sapiens
aagtcaacatcttctctc

SEQ ID NO: 1969697 - DNA, 22 bp, Homo sapiens
aagtcaaccaatgtagaaagct

SEQ ID NO: 1969698 - DNA, 15 bp, Homo sapiens
aagtcacacagacac

SEQ ID NO: 1969699 - DNA, 13 bp, Homo sapiens
aagtcacagctgc

SEQ ID NO: 1969700 - DNA, 17 bp, Homo sapiens
aagtcacatataaaagt

SEQ ID NO: 1969701 - DNA, 19 bp, Homo sapiens
aagtcacatcacaggacac

SEQ ID NO: 1969702 - DNA, 19 bp, Homo sapiens
aagtcaccactccattccc

SEQ ID NO: 1969703 - DNA, 15 bp, Homo sapiens
aagtcacttccagtg

SEQ ID NO: 1969704 - DNA, 18 bp, Homo sapiens
aagtcagaacagcagact

SEQ ID NO: 1969705 - DNA, 18 bp, Homo sapiens
aagtcaggacctggcttg

SEQ ID NO: 1969706 - DNA, 17 bp, Homo sapiens
aagtcagttggagaaaa

SEQ ID NO: 1969707 - DNA, 20 bp, Homo sapiens
aagtcataaacagcatttat

SEQ ID NO: 1969708 - DNA, 20 bp, Homo sapiens
aagtccaggcagagacaata

SEQ ID NO: 1969709 - DNA, 19 bp, Homo sapiens
aagtccaggtcctggtggg

SEQ ID NO: 1969710 - DNA, 21 bp, Homo sapiens
aagtccaggtcctggtggggc

SEQ ID NO: 1969711 - DNA, 16 bp, Homo sapiens
aagtccccaggtcatg

SEQ ID NO: 1969712 - DNA, 16 bp, Homo sapiens
aagtccccgtccccca

SEQ ID NO: 1969713 - DNA, 23 bp, Homo sapiens
aagtccccgtcccccagaacctc

SEQ ID NO: 1969714 - DNA, 19 bp, Homo sapiens
aagtccctgttctcagctc

SEQ ID NO: 1969715 - DNA, 20 bp, Homo sapiens
aagtcgtccttactcctgtg

SEQ ID NO: 1969716 - DNA, 24 bp, Homo sapiens
aagtcgtccttactcctgtgggag

SEQ ID NO: 1969717 - DNA, 15 bp, Homo sapiens
aagtcgttgtgaggg

SEQ ID NO: 1969718 - DNA, 15 bp, Homo sapiens
aagtctaaagtttac

SEQ ID NO: 1969719 - DNA, 19 bp, Homo sapiens
aagtctaaagtttacagta

SEQ ID NO: 1969720 - DNA, 20 bp, Homo sapiens
aagtctaaagtttacagtaa

SEQ ID NO: 1969721 - DNA, 16 bp, Homo sapiens
aagtctattgtttgtt

SEQ ID NO: 1969722 - DNA, 23 bp, Homo sapiens
aagtctattgtttgttgtgcttg

SEQ ID NO: 1969723 - DNA, 21 bp, Homo sapiens
aagtctccaagaatacagaaa

SEQ ID NO: 1969724 - DNA, 20 bp, Homo sapiens
aagtctctgactcttgcctt

SEQ ID NO: 1969725 - DNA, 18 bp, Homo sapiens
aagtctggatctgggacc

SEQ ID NO: 1969726 - DNA, 17 bp, Homo sapiens
aagtctgggatgtagaa

SEQ ID NO: 1969727 - DNA, 15 bp, Homo sapiens
aagtctgtgtccaat

SEQ ID NO: 1969728 - DNA, 17 bp, Homo sapiens
aagtctgtgtccaatta

SEQ ID NO: 1969729 - DNA, 23 bp, Homo sapiens
aagtctgtgtgatgaactttctc

SEQ ID NO: 1969730 - DNA, 18 bp, Homo sapiens
aagtcttaaaataactta

SEQ ID NO: 1969731 - DNA, 18 bp, Homo sapiens
aagtgaacttgattttaa

SEQ ID NO: 1969732 - DNA, 16 bp, Homo sapiens
aagtgaagaaaagtga

SEQ ID NO: 1969733 - DNA, 12 bp, Homo sapiens
aagtgaagcccc

SEQ ID NO: 1969734 - DNA, 17 bp, Homo sapiens
aagtgaagccccttgtc

SEQ ID NO: 1969735 - DNA, 22 bp, Homo sapiens
aagtgaagccccttgtcctctc

SEQ ID NO: 1969736 - DNA, 13 bp, Homo sapiens
aagtgacatgcca

SEQ ID NO: 1969737 - DNA, 22 bp, Homo sapiens
aagtgactaccagaaagtgagg

SEQ ID NO: 1969738 - DNA, 18 bp, Homo sapiens
aagtgagcgattagttga

SEQ ID NO: 1969739 - DNA, 13 bp, Homo sapiens
aagtgatatatgt

SEQ ID NO: 1969740 - DNA, 16 bp, Homo sapiens
aagtgattctcctgcc

SEQ ID NO: 1969741 - DNA, 18 bp, Homo sapiens
aagtgattctcctgcctc

SEQ ID NO: 1969742 - DNA, 17 bp, Homo sapiens
aagtgatttttttgtcc

SEQ ID NO: 1969743 - DNA, 18 bp, Homo sapiens
aagtgcaaagtgccctca

SEQ ID NO: 1969744 - DNA, 20 bp, Homo sapiens
aagtgcacacagaaatatat

SEQ ID NO: 1969745 - DNA, 21 bp, Homo sapiens
aagtgcacacagaaatatata

SEQ ID NO: 1969746 - DNA, 16 bp, Homo sapiens
aagtgcatgctctctg

SEQ ID NO: 1969747 - DNA, 20 bp, Homo sapiens
aagtgccactcattcctgta

SEQ ID NO: 1969748 - DNA, 12 bp, Homo sapiens
aagtgccagaaa

SEQ ID NO: 1969749 - DNA, 14 bp, Homo sapiens
aagtgccatcccac

SEQ ID NO: 1969750 - DNA, 17 bp, Homo sapiens
aagtgcccgccctgccc

SEQ ID NO: 1969751 - DNA, 14 bp, Homo sapiens
aagtgcctcttgtt

SEQ ID NO: 1969752 - DNA, 12 bp, Homo sapiens
aagtgctgggat

SEQ ID NO: 1969753 - DNA, 13 bp, Homo sapiens
aagtgctgtaccc

SEQ ID NO: 1969754 - DNA, 13 bp, Homo sapiens
aagtgctgtttga

SEQ ID NO: 1969755 - DNA, 15 bp, Homo sapiens
aagtgctgtttgaga

SEQ ID NO: 1969756 - DNA, 18 bp, Homo sapiens
aagtgctgtttgagatgt

SEQ ID NO: 1969757 - DNA, 23 bp, Homo sapiens
aagtgctgtttgagatgtgatgc

SEQ ID NO: 1969758 - DNA, 13 bp, Homo sapiens
aagtgcttagaaa

SEQ ID NO: 1969759 - DNA, 11 bp, Homo sapiens
aagtggaaaaa

SEQ ID NO: 1969760 - DNA, 13 bp, Homo sapiens
aagtggaaaaaag

SEQ ID NO: 1969761 - DNA, 19 bp, Homo sapiens
aagtggaaaaaagagaaaa

SEQ ID NO: 1969762 - DNA, 16 bp, Homo sapiens
aagtggaccaggacag

SEQ ID NO: 1969763 - DNA, 15 bp, Homo sapiens
aagtggggctctggg

SEQ ID NO: 1969764 - DNA, 20 bp, Homo sapiens
aagtgggggccgctggccca

SEQ ID NO: 1969765 - DNA, 20 bp, Homo sapiens
aagtggggttgcaaccactg

SEQ ID NO: 1969766 - DNA, 14 bp, Homo sapiens
aagtgtaaaataga

SEQ ID NO: 1969767 - DNA, 15 bp, Homo sapiens
aagtgtaataatatg

SEQ ID NO: 1969768 - DNA, 20 bp, Homo sapiens
aagtgtagatagttaaaaga

SEQ ID NO: 1969769 - DNA, 15 bp, Homo sapiens
aagtgtgagcagtga

SEQ ID NO: 1969770 - DNA, 23 bp, Homo sapiens
aagtgtgtggaaggcagggacag

SEQ ID NO: 1969771 - DNA, 24 bp, Homo sapiens
aagtgtgtggaaggcagggacaga

SEQ ID NO: 1969772 - DNA, 23 bp, Homo sapiens
aagtgtgtggtcccaagttggaa

SEQ ID NO: 1969773 - DNA, 15 bp, Homo sapiens
aagtgttagatagaa

SEQ ID NO: 1969774 - DNA, 21 bp, Homo sapiens
aagtgttcaagaaataaaaat

SEQ ID NO: 1969775 - DNA, 17 bp, Homo sapiens
aagtgttgtaaatattt

SEQ ID NO: 1969776 - DNA, 20 bp, Homo sapiens
aagtgttgtaaatatttatg

SEQ ID NO: 1969777 - DNA, 17 bp, Homo sapiens
aagttaaagtgaataac

SEQ ID NO: 1969778 - DNA, 19 bp, Homo sapiens
aagttacatgtttgcacct

SEQ ID NO: 1969779 - DNA, 21 bp, Homo sapiens
aagttagctgagcgtggtggc

SEQ ID NO: 1969780 - DNA, 20 bp, Homo sapiens
aagttataaatcaatgtcac

SEQ ID NO: 1969781 - DNA, 12 bp, Homo sapiens
aagttatattta

SEQ ID NO: 1969782 - DNA, 12 bp, Homo sapiens
aagttattgtac

SEQ ID NO: 1969783 - DNA, 16 bp, Homo sapiens
aagttcaacatgttat

SEQ ID NO: 1969784 - DNA, 16 bp, Homo sapiens
aagttcagggaagcag

SEQ ID NO: 1969785 - DNA, 17 bp, Homo sapiens
aagttcctgcactccag

SEQ ID NO: 1969786 - DNA, 15 bp, Homo sapiens
aagttcgaaagaaaa

SEQ ID NO: 1969787 - DNA, 15 bp, Homo sapiens
aagttctaagttcat

SEQ ID NO: 1969788 - DNA, 18 bp, Homo sapiens
aagttctagagaagaggc

SEQ ID NO: 1969789 - DNA, 19 bp, Homo sapiens
aagttctgaaaactgttta

SEQ ID NO: 1969790 - DNA, 15 bp, Homo sapiens
aagttcttctccaat

SEQ ID NO: 1969791 - DNA, 18 bp, Homo sapiens
aagttgaagctaagattt

SEQ ID NO: 1969792 - DNA, 16 bp, Homo sapiens
aagttgcagtctcaga

SEQ ID NO: 1969793 - DNA, 18 bp, Homo sapiens
aagttgggaaaagtgtta

SEQ ID NO: 1969794 - DNA, 18 bp, Homo sapiens
aagttgtgccttttatag

SEQ ID NO: 1969795 - DNA, 18 bp, Homo sapiens
aagtttacagtaaataaa

SEQ ID NO: 1969796 - DNA, 16 bp, Homo sapiens
aagtttatgtctaaag

SEQ ID NO: 1969797 - DNA, 17 bp, Homo sapiens
aagtttatgtctaaaga

SEQ ID NO: 1969798 - DNA, 19 bp, Homo sapiens
aagtttattttttctacac

SEQ ID NO: 1969799 - DNA, 17 bp, Homo sapiens
aagtttcgaggggtcct

SEQ ID NO: 1969800 - DNA, 17 bp, Homo sapiens
aagtttgtgctatctat

SEQ ID NO: 1969801 - DNA, 11 bp, Homo sapiens
aagttttcagg

SEQ ID NO: 1969802 - DNA, 13 bp, Homo sapiens
aagttttgtacag

SEQ ID NO: 1969803 - DNA, 13 bp, Homo sapiens
aagtttttacaaa

SEQ ID NO: 1969804 - DNA, 18 bp, Homo sapiens
aataaaaaaaagaaatga

SEQ ID NO: 1969805 - DNA, 14 bp, Homo sapiens
aataaaaaaataca

SEQ ID NO: 1969806 - DNA, 18 bp, Homo sapiens
aataaaaaaatacagtaa

SEQ ID NO: 1969807 - DNA, 21 bp, Homo sapiens
aataaaaaccagaatcataat

SEQ ID NO: 1969808 - DNA, 19 bp, Homo sapiens
aataaaaacttcagaaaaa

SEQ ID NO: 1969809 - DNA, 22 bp, Homo sapiens
aataaaaagactattaagagca

SEQ ID NO: 1969810 - DNA, 13 bp, Homo sapiens
aataaaaagtata

SEQ ID NO: 1969811 - DNA, 21 bp, Homo sapiens
aataaaaatcaacttgtgtac

SEQ ID NO: 1969812 - DNA, 16 bp, Homo sapiens
aataaaaatttgttta

SEQ ID NO: 1969813 - DNA, 23 bp, Homo sapiens
aataaaacctttcaaatttcaca

SEQ ID NO: 1969814 - DNA, 11 bp, Homo sapiens
aataaaatcat

SEQ ID NO: 1969815 - DNA, 18 bp, Homo sapiens
aataaaatgaaagggtca

SEQ ID NO: 1969816 - DNA, 12 bp, Homo sapiens
aataaaatgatg

SEQ ID NO: 1969817 - DNA, 12 bp, Homo sapiens
aataaaattgta

SEQ ID NO: 1969818 - DNA, 12 bp, Homo sapiens
aataaaattttc

SEQ ID NO: 1969819 - DNA, 14 bp, Homo sapiens
aataaaattttcaa

SEQ ID NO: 1969820 - DNA, 19 bp, Homo sapiens
aataaacatagcttgtaac

SEQ ID NO: 1969821 - DNA, 23 bp, Homo sapiens
aataaacatccttcaagaactct

SEQ ID NO: 1969822 - DNA, 17 bp, Homo sapiens
aataaaccaaaggacat

SEQ ID NO: 1969823 - DNA, 14 bp, Homo sapiens
aataaacctggaga

SEQ ID NO: 1969824 - DNA, 18 bp, Homo sapiens
aataaacctggagatgat

SEQ ID NO: 1969825 - DNA, 17 bp, Homo sapiens
aataaactagtttccag

SEQ ID NO: 1969826 - DNA, 15 bp, Homo sapiens
aataaactctaaaca

SEQ ID NO: 1969827 - DNA, 17 bp, Homo sapiens
aataaacttattcctcc

SEQ ID NO: 1969828 - DNA, 12 bp, Homo sapiens
aataaagagctc

SEQ ID NO: 1969829 - DNA, 18 bp, Homo sapiens
aataaagagttagaatga

SEQ ID NO: 1969830 - DNA, 11 bp, Homo sapiens
aataaagctgg

SEQ ID NO: 1969831 - DNA, 12 bp, Homo sapiens
aataaagctgga

SEQ ID NO: 1969832 - DNA, 11 bp, Homo sapiens
aataaagtatc

SEQ ID NO: 1969833 - DNA, 16 bp, Homo sapiens
aataaagtatctacat

SEQ ID NO: 1969834 - DNA, 12 bp, Homo sapiens
aataaagtgtat

SEQ ID NO: 1969835 - DNA, 12 bp, Homo sapiens
aataaatataat

SEQ ID NO: 1969836 - DNA, 13 bp, Homo sapiens
aataaatataatt

SEQ ID NO: 1969837 - DNA, 15 bp, Homo sapiens
aataaatattttaca

SEQ ID NO: 1969838 - DNA, 13 bp, Homo sapiens
aataaatgccaac

SEQ ID NO: 1969839 - DNA, 13 bp, Homo sapiens
aataaatgctgaa

SEQ ID NO: 1969840 - DNA, 20 bp, Homo sapiens
aataaatgtatcttattcac

SEQ ID NO: 1969841 - DNA, 21 bp, Homo sapiens
aataaatgtatcttattcaca

SEQ ID NO: 1969842 - DNA, 17 bp, Homo sapiens
aataaatgtcattaaaa

SEQ ID NO: 1969843 - DNA, 13 bp, Homo sapiens
aataaatgtgtaa

SEQ ID NO: 1969844 - DNA, 15 bp, Homo sapiens
aataaatgtgtaaat

SEQ ID NO: 1969845 - DNA, 17 bp, Homo sapiens
aataaatgtgtaaatgt

SEQ ID NO: 1969846 - DNA, 18 bp, Homo sapiens
aataaatgtgtaaatgtg

SEQ ID NO: 1969847 - DNA, 17 bp, Homo sapiens
aataaatgttcaaactg

SEQ ID NO: 1969848 - DNA, 12 bp, Homo sapiens
aataaattcaaa

SEQ ID NO: 1969849 - DNA, 19 bp, Homo sapiens
aataaattcaaaccattta

SEQ ID NO: 1969850 - DNA, 14 bp, Homo sapiens
aataaattcagata

SEQ ID NO: 1969851 - DNA, 20 bp, Homo sapiens
aataaattgctccttgacat

SEQ ID NO: 1969852 - DNA, 13 bp, Homo sapiens
aataaattgtttg

SEQ ID NO: 1969853 - DNA, 16 bp, Homo sapiens
aataacatgatactat

SEQ ID NO: 1969854 - DNA, 21 bp, Homo sapiens
aataacatgatactattcaga

SEQ ID NO: 1969855 - DNA, 22 bp, Homo sapiens
aataaccacttaaaaaatgtcc

SEQ ID NO: 1969856 - DNA, 22 bp, Homo sapiens
aataacgtttaagccaaaacaa

SEQ ID NO: 1969857 - DNA, 19 bp, Homo sapiens
aataactagatctcctgta

SEQ ID NO: 1969858 - DNA, 18 bp, Homo sapiens
aataacttcagagaagtc

SEQ ID NO: 1969859 - DNA, 19 bp, Homo sapiens
aataacttcagagaagtca

SEQ ID NO: 1969860 - DNA, 13 bp, Homo sapiens
aataagaaacttt

SEQ ID NO: 1969861 - DNA, 15 bp, Homo sapiens
aataagaaagtataa

SEQ ID NO: 1969862 - DNA, 20 bp, Homo sapiens
aataaggctccttcatgtgg

SEQ ID NO: 1969863 - DNA, 13 bp, Homo sapiens
aataagtgctgtt

SEQ ID NO: 1969864 - DNA, 21 bp, Homo sapiens
aataataattatccagagttt

SEQ ID NO: 1969865 - DNA, 15 bp, Homo sapiens
aataatagtgtgtca

SEQ ID NO: 1969866 - DNA, 15 bp, Homo sapiens
aataatcacattgac

SEQ ID NO: 1969867 - DNA, 13 bp, Homo sapiens
aataatcggccca

SEQ ID NO: 1969868 - DNA, 16 bp, Homo sapiens
aataatgaacagcaga

SEQ ID NO: 1969869 - DNA, 18 bp, Homo sapiens
aataatgaagttattctt

SEQ ID NO: 1969870 - DNA, 12 bp, Homo sapiens
aataatgattta

SEQ ID NO: 1969871 - DNA, 18 bp, Homo sapiens
aataatgtgcaaattttg

SEQ ID NO: 1969872 - DNA, 19 bp, Homo sapiens
aataatgtgcaaattttgc

SEQ ID NO: 1969873 - DNA, 21 bp, Homo sapiens
aataatgtgcaaattttgcat

SEQ ID NO: 1969874 - DNA, 16 bp, Homo sapiens
aataattaggatctat

SEQ ID NO: 1969875 - DNA, 20 bp, Homo sapiens
aataattgatttcaagacct

SEQ ID NO: 1969876 - DNA, 14 bp, Homo sapiens
aataatttaactaa

SEQ ID NO: 1969877 - DNA, 17 bp, Homo sapiens
aataatttaactaattt

SEQ ID NO: 1969878 - DNA, 23 bp, Homo sapiens
aataatttaactaatttaaacca

SEQ ID NO: 1969879 - DNA, 16 bp, Homo sapiens
aataatttgttgtact

SEQ ID NO: 1969880 - DNA, 16 bp, Homo sapiens
aataattttaaacaaa

SEQ ID NO: 1969881 - DNA, 15 bp, Homo sapiens
aataattttcctcct

SEQ ID NO: 1969882 - DNA, 21 bp, Homo sapiens
aatacaaacatatttgttaaa

SEQ ID NO: 1969883 - DNA, 17 bp, Homo sapiens
aatacaacaagaacaac

SEQ ID NO: 1969884 - DNA, 22 bp, Homo sapiens
aatacaagccactaccttctga

SEQ ID NO: 1969885 - DNA, 22 bp, Homo sapiens
aatacaccacctcactcctgtt

SEQ ID NO: 1969886 - DNA, 21 bp, Homo sapiens
aatacaccaggtagaacacaa

SEQ ID NO: 1969887 - DNA, 20 bp, Homo sapiens
aatacagacactaagttata

SEQ ID NO: 1969888 - DNA, 21 bp, Homo sapiens
aatacagtaaagtttaaaaaa

SEQ ID NO: 1969889 - DNA, 21 bp, Homo sapiens
aatacagtaagctgctctatt

SEQ ID NO: 1969890 - DNA, 16 bp, Homo sapiens
aatacagtggatctca

SEQ ID NO: 1969891 - DNA, 22 bp, Homo sapiens
aatacatgctaagagaagtaga

SEQ ID NO: 1969892 - DNA, 19 bp, Homo sapiens
aatacatgtgtggatgtgt

SEQ ID NO: 1969893 - DNA, 14 bp, Homo sapiens
aataccaaatattt

SEQ ID NO: 1969894 - DNA, 17 bp, Homo sapiens
aataccaaatattttag

SEQ ID NO: 1969895 - DNA, 23 bp, Homo sapiens
aataccactggttaaaataaagc

SEQ ID NO: 1969896 - DNA, 20 bp, Homo sapiens
aataccagtgaaccaaagag

SEQ ID NO: 1969897 - DNA, 16 bp, Homo sapiens
aatacccccagagacc

SEQ ID NO: 1969898 - DNA, 16 bp, Homo sapiens
aatacctcatgggaca

SEQ ID NO: 1969899 - DNA, 15 bp, Homo sapiens
aatacctttggaaaa

SEQ ID NO: 1969900 - DNA, 17 bp, Homo sapiens
aatacctttggaaaaat

SEQ ID NO: 1969901 - DNA, 21 bp, Homo sapiens
aatacctttggaaaaatcttg

SEQ ID NO: 1969902 - DNA, 15 bp, Homo sapiens
aatactactgtaaat

SEQ ID NO: 1969903 - DNA, 14 bp, Homo sapiens
aatactcacctcct

SEQ ID NO: 1969904 - DNA, 17 bp, Homo sapiens
aatactccaagcttcaa

SEQ ID NO: 1969905 - DNA, 19 bp, Homo sapiens
aatactccaagcttcaagt

SEQ ID NO: 1969906 - DNA, 20 bp, Homo sapiens
aatactctagcctgggccag

SEQ ID NO: 1969907 - DNA, 23 bp, Homo sapiens
aatactcttaggaagagaaacca

SEQ ID NO: 1969908 - DNA, 12 bp, Homo sapiens
aatactgtacat

SEQ ID NO: 1969909 - DNA, 14 bp, Homo sapiens
aatactgtacatag

SEQ ID NO: 1969910 - DNA, 15 bp, Homo sapiens
aatactgtacataga

SEQ ID NO: 1969911 - DNA, 19 bp, Homo sapiens
aatactgtacatagatgta

SEQ ID NO: 1969912 - DNA, 22 bp, Homo sapiens
aatacttaacattgatttattt

SEQ ID NO: 1969913 - DNA, 13 bp, Homo sapiens
aatacttcatgat

SEQ ID NO: 1969914 - DNA, 17 bp, Homo sapiens
aatagaaaactgaaaat

SEQ ID NO: 1969915 - DNA, 20 bp, Homo sapiens
aatagaaaactgaaaatcta

SEQ ID NO: 1969916 - DNA, 17 bp, Homo sapiens
aatagaatataattatc

SEQ ID NO: 1969917 - DNA, 20 bp, Homo sapiens
aatagacagtatatttatag

SEQ ID NO: 1969918 - DNA, 21 bp, Homo sapiens
aatagagagtatgtaatcttt

SEQ ID NO: 1969919 - DNA, 16 bp, Homo sapiens
aatagatgctgactgt

SEQ ID NO: 1969920 - DNA, 19 bp, Homo sapiens
aatagatgtttgatagatt

SEQ ID NO: 1969921 - DNA, 22 bp, Homo sapiens
aatagatgtttgatagattttc

SEQ ID NO: 1969922 - DNA, 17 bp, Homo sapiens
aatagatttgattattt

SEQ ID NO: 1969923 - DNA, 13 bp, Homo sapiens
aatagcaaaagaa

SEQ ID NO: 1969924 - DNA, 17 bp, Homo sapiens
aatagcgaatcatctca

SEQ ID NO: 1969925 - DNA, 14 bp, Homo sapiens
aatagctgggacta

SEQ ID NO: 1969926 - DNA, 21 bp, Homo sapiens
aataggatgataggaaataaa

SEQ ID NO: 1969927 - DNA, 22 bp, Homo sapiens
aataggccatgttaattaaact

SEQ ID NO: 1969928 - DNA, 22 bp, Homo sapiens
aatagtaaaagataacaagatc

SEQ ID NO: 1969929 - DNA, 16 bp, Homo sapiens
aatagtcaagaaaaat

SEQ ID NO: 1969930 - DNA, 16 bp, Homo sapiens
aatagtccaatatttg

SEQ ID NO: 1969931 - DNA, 22 bp, Homo sapiens
aatagtccccatcagcaccatg

SEQ ID NO: 1969932 - DNA, 20 bp, Homo sapiens
aatagtctgtgtgcacaatg

SEQ ID NO: 1969933 - DNA, 16 bp, Homo sapiens
aatagtgttcttttta

SEQ ID NO: 1969934 - DNA, 21 bp, Homo sapiens
aatagttcaggtaacaggcag

SEQ ID NO: 1969935 - DNA, 14 bp, Homo sapiens
aatagtttggatat

SEQ ID NO: 1969936 - DNA, 16 bp, Homo sapiens
aatagttttaaatatg

SEQ ID NO: 1969937 - DNA, 13 bp, Homo sapiens
aatataaacacta

SEQ ID NO: 1969938 - DNA, 23 bp, Homo sapiens
aatataaactgaaaaatgtcagt

SEQ ID NO: 1969939 - DNA, 12 bp, Homo sapiens
aatataaacttg

SEQ ID NO: 1969940 - DNA, 18 bp, Homo sapiens
aatataaagttaaaaaaa

SEQ ID NO: 1969941 - DNA, 12 bp, Homo sapiens
aatataaatgca

SEQ ID NO: 1969942 - DNA, 15 bp, Homo sapiens
aatataaatgtttaa

SEQ ID NO: 1969943 - DNA, 19 bp, Homo sapiens
aatataaccattacatgtt

SEQ ID NO: 1969944 - DNA, 20 bp, Homo sapiens
aatataaccattacatgttt

SEQ ID NO: 1969945 - DNA, 23 bp, Homo sapiens
aatataatggaagagaaatctca

SEQ ID NO: 1969946 - DNA, 15 bp, Homo sapiens
aatatagctattttt

SEQ ID NO: 1969947 - DNA, 16 bp, Homo sapiens
aatatatatacatatg

SEQ ID NO: 1969948 - DNA, 17 bp, Homo sapiens
aatatatatacatatgt

SEQ ID NO: 1969949 - DNA, 17 bp, Homo sapiens
aatatatatatatattt

SEQ ID NO: 1969950 - DNA, 22 bp, Homo sapiens
aatatatatctatctatttgag

SEQ ID NO: 1969951 - DNA, 14 bp, Homo sapiens
aatatatatgtgca

SEQ ID NO: 1969952 - DNA, 15 bp, Homo sapiens
aatatatatttttca

SEQ ID NO: 1969953 - DNA, 16 bp, Homo sapiens
aatatatatttttcaa

SEQ ID NO: 1969954 - DNA, 16 bp, Homo sapiens
aatatatcccagaaat

SEQ ID NO: 1969955 - DNA, 19 bp, Homo sapiens
aatatatttaagataatta

SEQ ID NO: 1969956 - DNA, 14 bp, Homo sapiens
aatatatttaattg

SEQ ID NO: 1969957 - DNA, 16 bp, Homo sapiens
aatatatttaattgtg

SEQ ID NO: 1969958 - DNA, 20 bp, Homo sapiens
aatatatttttatatttagt

SEQ ID NO: 1969959 - DNA, 15 bp, Homo sapiens
aatatcagactagtg

SEQ ID NO: 1969960 - DNA, 13 bp, Homo sapiens
aatatcctcaggg

SEQ ID NO: 1969961 - DNA, 14 bp, Homo sapiens
aatatctacctgcc

SEQ ID NO: 1969962 - DNA, 22 bp, Homo sapiens
aatatctacctgccctctctca

SEQ ID NO: 1969963 - DNA, 20 bp, Homo sapiens
aatatctgacagttactctt

SEQ ID NO: 1969964 - DNA, 20 bp, Homo sapiens
aatatctgagaagtgtatat

SEQ ID NO: 1969965 - DNA, 23 bp, Homo sapiens
aatatctgagaagtgtatatagt

SEQ ID NO: 1969966 - DNA, 22 bp, Homo sapiens
aatatctgtgaggtgctgatga

SEQ ID NO: 1969967 - DNA, 23 bp, Homo sapiens
aatatctgtgaggtgctgatgag

SEQ ID NO: 1969968 - DNA, 13 bp, Homo sapiens
aatatcttgaaga

SEQ ID NO: 1969969 - DNA, 18 bp, Homo sapiens
aatatcttgaagaatatt

SEQ ID NO: 1969970 - DNA, 10 bp, Homo sapiens
aatatgaaca

SEQ ID NO: 1969971 - DNA, 20 bp, Homo sapiens
aatatgattttttaaaagaa

SEQ ID NO: 1969972 - DNA, 22 bp, Homo sapiens
aatatgctgccaaattttggcc

SEQ ID NO: 1969973 - DNA, 17 bp, Homo sapiens
aatatggaacttctaat

SEQ ID NO: 1969974 - DNA, 18 bp, Homo sapiens
aatatggctataaatata

SEQ ID NO: 1969975 - DNA, 13 bp, Homo sapiens
aatatgtatgtct

SEQ ID NO: 1969976 - DNA, 22 bp, Homo sapiens
aatatgtctcgctagtgatgtt

SEQ ID NO: 1969977 - DNA, 17 bp, Homo sapiens
aatatgtctgccacaga

SEQ ID NO: 1969978 - DNA, 22 bp, Homo sapiens
aatatgttaacctcagtgtcat

SEQ ID NO: 1969979 - DNA, 22 bp, Homo sapiens
aatatgttcattaaattttcta

SEQ ID NO: 1969980 - DNA, 16 bp, Homo sapiens
aatatgtttgtgcctt

SEQ ID NO: 1969981 - DNA, 20 bp, Homo sapiens
aatattaatcccagccctac

SEQ ID NO: 1969982 - DNA, 13 bp, Homo sapiens
aatattaccaaaa

SEQ ID NO: 1969983 - DNA, 15 bp, Homo sapiens
aatattataaatcca

SEQ ID NO: 1969984 - DNA, 15 bp, Homo sapiens
aatattcaataaagc

SEQ ID NO: 1969985 - DNA, 15 bp, Homo sapiens
aatattctgtaagaa

SEQ ID NO: 1969986 - DNA, 12 bp, Homo sapiens
aatattgtgctt

SEQ ID NO: 1969987 - DNA, 18 bp, Homo sapiens
aatatttaagtatatagt

SEQ ID NO: 1969988 - DNA, 16 bp, Homo sapiens
aatatttattacctct

SEQ ID NO: 1969989 - DNA, 12 bp, Homo sapiens
aatatttattat

SEQ ID NO: 1969990 - DNA, 19 bp, Homo sapiens
aatatttattattttcacc

SEQ ID NO: 1969991 - DNA, 14 bp, Homo sapiens
aatatttcaaatga

SEQ ID NO: 1969992 - DNA, 14 bp, Homo sapiens
aatatttcatgatt

SEQ ID NO: 1969993 - DNA, 16 bp, Homo sapiens
aatatttgcttattta

SEQ ID NO: 1969994 - DNA, 23 bp, Homo sapiens
aatatttgttctggtttagtgtt

SEQ ID NO: 1969995 - DNA, 13 bp, Homo sapiens
aatattttaaaga

SEQ ID NO: 1969996 - DNA, 16 bp, Homo sapiens
aatattttaaagaatt

SEQ ID NO: 1969997 - DNA, 16 bp, Homo sapiens
aatattttatatgaaa

SEQ ID NO: 1969998 - DNA, 14 bp, Homo sapiens
aatattttgtattt

SEQ ID NO: 1969999 - DNA, 19 bp, Homo sapiens
aatattttgtattttcaac

SEQ ID NO: 1970000 - DNA, 20 bp, Homo sapiens
aatatttttagctctgttct

SEQ ID NO: 1970001 - DNA, 15 bp, Homo sapiens
aatcaaaagctgctt

SEQ ID NO: 1970002 - DNA, 16 bp, Homo sapiens
aatcaacttgtgtact

SEQ ID NO: 1970003 - DNA, 15 bp, Homo sapiens
aatcaaggaatcctg

SEQ ID NO: 1970004 - DNA, 17 bp, Homo sapiens
aatcaatgtcacttaaa

SEQ ID NO: 1970005 - DNA, 18 bp, Homo sapiens
aatcaattattacattta

SEQ ID NO: 1970006 - DNA, 15 bp, Homo sapiens
aatcacacctctggg

SEQ ID NO: 1970007 - DNA, 17 bp, Homo sapiens
aatcacactctaagttc

SEQ ID NO: 1970008 - DNA, 23 bp, Homo sapiens
aatcacagatgggtattaaactt

SEQ ID NO: 1970009 - DNA, 12 bp, Homo sapiens
aatcaccaaagt

SEQ ID NO: 1970010 - DNA, 20 bp, Homo sapiens
aatcaccacaccaaacctct

SEQ ID NO: 1970011 - DNA, 13 bp, Homo sapiens
aatcacctggagg

SEQ ID NO: 1970012 - DNA, 20 bp, Homo sapiens
aatcacgctttttgaaaaag

SEQ ID NO: 1970013 - DNA, 13 bp, Homo sapiens
aatcactgaggca

SEQ ID NO: 1970014 - DNA, 19 bp, Homo sapiens
aatcactgaggcattttta

SEQ ID NO: 1970015 - DNA, 13 bp, Homo sapiens
aatcacttgtaaa

SEQ ID NO: 1970016 - DNA, 14 bp, Homo sapiens
aatcacttgtaaat

SEQ ID NO: 1970017 - DNA, 17 bp, Homo sapiens
aatcacttgtaaataaa

SEQ ID NO: 1970018 - DNA, 15 bp, Homo sapiens
aatcagaagtgcaaa

SEQ ID NO: 1970019 - DNA, 20 bp, Homo sapiens
aatcagaccctaccccacca

SEQ ID NO: 1970020 - DNA, 17 bp, Homo sapiens
aatcagactcatctaca

SEQ ID NO: 1970021 - DNA, 16 bp, Homo sapiens
aatcagatagatattc

SEQ ID NO: 1970022 - DNA, 13 bp, Homo sapiens
aatcagcactgaa

SEQ ID NO: 1970023 - DNA, 15 bp, Homo sapiens
aatcagcactgaaaa

SEQ ID NO: 1970024 - DNA, 18 bp, Homo sapiens
aatcagcttttaataaaa

SEQ ID NO: 1970025 - DNA, 19 bp, Homo sapiens
aatcaggttgacagtccct

SEQ ID NO: 1970026 - DNA, 18 bp, Homo sapiens
aatcaggttgttaatgtt

SEQ ID NO: 1970027 - DNA, 18 bp, Homo sapiens
aatcagtcctttgattcc

SEQ ID NO: 1970028 - DNA, 12 bp, Homo sapiens
aatcagtgcagt

SEQ ID NO: 1970029 - DNA, 20 bp, Homo sapiens
aatcagttatattctttaaa

SEQ ID NO: 1970030 - DNA, 17 bp, Homo sapiens
aatcataaactgtgtgc

SEQ ID NO: 1970031 - DNA, 17 bp, Homo sapiens
aatcatagtgccataga

SEQ ID NO: 1970032 - DNA, 21 bp, Homo sapiens
aatcatataataaatgtacat

SEQ ID NO: 1970033 - DNA, 14 bp, Homo sapiens
aatcatcgaaaatt

SEQ ID NO: 1970034 - DNA, 19 bp, Homo sapiens
aatcatcgaaaattcattt

SEQ ID NO: 1970035 - DNA, 16 bp, Homo sapiens
aatcatgatctgactt

SEQ ID NO: 1970036 - DNA, 14 bp, Homo sapiens
aatcatgtacattt

SEQ ID NO: 1970037 - DNA, 19 bp, Homo sapiens
aatcatgtacatttctgaa

SEQ ID NO: 1970038 - DNA, 16 bp, Homo sapiens
aatcattctttcccct

SEQ ID NO: 1970039 - DNA, 22 bp, Homo sapiens
aatcattgctttgaagcagttg

SEQ ID NO: 1970040 - DNA, 14 bp, Homo sapiens
aatcattgtagaaa

SEQ ID NO: 1970041 - DNA, 22 bp, Homo sapiens
aatcatttctgcatcagctgct

SEQ ID NO: 1970042 - DNA, 14 bp, Homo sapiens
aatcatttgctttt

SEQ ID NO: 1970043 - DNA, 13 bp, Homo sapiens
aatcattttaaga

SEQ ID NO: 1970044 - DNA, 22 bp, Homo sapiens
aatcattttaattattattctt

SEQ ID NO: 1970045 - DNA, 19 bp, Homo sapiens
aatcattttgcctcttttc

SEQ ID NO: 1970046 - DNA, 15 bp, Homo sapiens
aatccaaagaaaaag

SEQ ID NO: 1970047 - DNA, 11 bp, Homo sapiens
aatccaaagat

SEQ ID NO: 1970048 - DNA, 23 bp, Homo sapiens
aatccaagcgaggtcaacagaga

SEQ ID NO: 1970049 - DNA, 13 bp, Homo sapiens
aatccacagccaa

SEQ ID NO: 1970050 - DNA, 23 bp, Homo sapiens
aatccacccatcctaccaatgca

SEQ ID NO: 1970051 - DNA, 22 bp, Homo sapiens
aatccagaattgaccttttgac

SEQ ID NO: 1970052 - DNA, 17 bp, Homo sapiens
aatccaggtgggagaga

SEQ ID NO: 1970053 - DNA, 22 bp, Homo sapiens
aatccaggtgggagagacactc

SEQ ID NO: 1970054 - DNA, 20 bp, Homo sapiens
aatccagtgtgcacccctcc

SEQ ID NO: 1970055 - DNA, 15 bp, Homo sapiens
aatccatgcttgggt

SEQ ID NO: 1970056 - DNA, 19 bp, Homo sapiens
aatccatgttagtttttac

SEQ ID NO: 1970057 - DNA, 17 bp, Homo sapiens
aatcccacccacatgtg

SEQ ID NO: 1970058 - DNA, 17 bp, Homo sapiens
aatccccaagctggcag

SEQ ID NO: 1970059 - DNA, 14 bp, Homo sapiens
aatcccctcattca

SEQ ID NO: 1970060 - DNA, 23 bp, Homo sapiens
aatccctggttttaagtatcaat

SEQ ID NO: 1970061 - DNA, 21 bp, Homo sapiens
aatccgcctgcagaggacaga

SEQ ID NO: 1970062 - DNA, 16 bp, Homo sapiens
aatcctaacacattat

SEQ ID NO: 1970063 - DNA, 20 bp, Homo sapiens
aatcctctggggttcatcta

SEQ ID NO: 1970064 - DNA, 16 bp, Homo sapiens
aatcctgttacttaaa

SEQ ID NO: 1970065 - DNA, 18 bp, Homo sapiens
aatccttgcttatgacat

SEQ ID NO: 1970066 - DNA, 21 bp, Homo sapiens
aatcctttgagaatgtgattc

SEQ ID NO: 1970067 - DNA, 17 bp, Homo sapiens
aatcgatctgtactgta

SEQ ID NO: 1970068 - DNA, 18 bp, Homo sapiens
aatcgatctgtactgtaa

SEQ ID NO: 1970069 - DNA, 13 bp, Homo sapiens
aatcgattggctt

SEQ ID NO: 1970070 - DNA, 14 bp, Homo sapiens
aatcgccccagact

SEQ ID NO: 1970071 - DNA, 18 bp, Homo sapiens
aatcggagcgaagcagag

SEQ ID NO: 1970072 - DNA, 23 bp, Homo sapiens
aatcggatctggggctctgggat

SEQ ID NO: 1970073 - DNA, 15 bp, Homo sapiens
aatcgttatgtgtgt

SEQ ID NO: 1970074 - DNA, 14 bp, Homo sapiens
aatctaactacaag

SEQ ID NO: 1970075 - DNA, 21 bp, Homo sapiens
aatctagataggtgcttttaa

SEQ ID NO: 1970076 - DNA, 19 bp, Homo sapiens
aatctagttttttttgtaa

SEQ ID NO: 1970077 - DNA, 12 bp, Homo sapiens
aatctattcaga

SEQ ID NO: 1970078 - DNA, 19 bp, Homo sapiens
aatctcatacctctgacca

SEQ ID NO: 1970079 - DNA, 22 bp, Homo sapiens
aatctcatacctctgaccaaca

SEQ ID NO: 1970080 - DNA, 18 bp, Homo sapiens
aatctccagggctgcccc

SEQ ID NO: 1970081 - DNA, 20 bp, Homo sapiens
aatctccagggctgcccctg

SEQ ID NO: 1970082 - DNA, 21 bp, Homo sapiens
aatctccagggctgcccctgt

SEQ ID NO: 1970083 - DNA, 23 bp, Homo sapiens
aatctccagggctgcccctgtag

SEQ ID NO: 1970084 - DNA, 15 bp, Homo sapiens
aatctccagtattct

SEQ ID NO: 1970085 - DNA, 15 bp, Homo sapiens
aatctcctcttttat

SEQ ID NO: 1970086 - DNA, 18 bp, Homo sapiens
aatctctaaatcaagtat

SEQ ID NO: 1970087 - DNA, 20 bp, Homo sapiens
aatctctcggttccacgtcc

SEQ ID NO: 1970088 - DNA, 20 bp, Homo sapiens
aatctcttttttcaactggc

SEQ ID NO: 1970089 - DNA, 22 bp, Homo sapiens
aatctcttttttcaactggctg

SEQ ID NO: 1970090 - DNA, 18 bp, Homo sapiens
aatctgaagcttcactca

SEQ ID NO: 1970091 - DNA, 22 bp, Homo sapiens
aatctgagatctccctccaggg

SEQ ID NO: 1970092 - DNA, 18 bp, Homo sapiens
aatctgagcctaaatcta

SEQ ID NO: 1970093 - DNA, 20 bp, Homo sapiens
aatctgagcctaaatctaat

SEQ ID NO: 1970094 - DNA, 17 bp, Homo sapiens
aatctgataggaaaaga

SEQ ID NO: 1970095 - DNA, 15 bp, Homo sapiens
aatctgatttaatgt

SEQ ID NO: 1970096 - DNA, 11 bp, Homo sapiens
aatctgcaggg

SEQ ID NO: 1970097 - DNA, 18 bp, Homo sapiens
aatctgcattattggaat

SEQ ID NO: 1970098 - DNA, 15 bp, Homo sapiens
aatctgcctttgttt

SEQ ID NO: 1970099 - DNA, 21 bp, Homo sapiens
aatctgcctttgtttctaaag

SEQ ID NO: 1970100 - DNA, 16 bp, Homo sapiens
aatctgctcagcaggc

SEQ ID NO: 1970101 - DNA, 20 bp, Homo sapiens
aatctgctcagcaggcccta

SEQ ID NO: 1970102 - DNA, 21 bp, Homo sapiens
aatctgctggttttaacaact

SEQ ID NO: 1970103 - DNA, 11 bp, Homo sapiens
aatctgctgtt

SEQ ID NO: 1970104 - DNA, 15 bp, Homo sapiens
aatctggaaatctgt

SEQ ID NO: 1970105 - DNA, 16 bp, Homo sapiens
aatctggaaatctgtt

SEQ ID NO: 1970106 - DNA, 21 bp, Homo sapiens
aatctggaaggcccctcccag

SEQ ID NO: 1970107 - DNA, 16 bp, Homo sapiens
aatctggactcctctg

SEQ ID NO: 1970108 - DNA, 19 bp, Homo sapiens
aatctggagagctagaacc

SEQ ID NO: 1970109 - DNA, 16 bp, Homo sapiens
aatctggcaaagttat

SEQ ID NO: 1970110 - DNA, 19 bp, Homo sapiens
aatctggctcctgtttcca

SEQ ID NO: 1970111 - DNA, 19 bp, Homo sapiens
aatctgtagggctggacct

SEQ ID NO: 1970112 - DNA, 23 bp, Homo sapiens
aatctgtatatgttgtaataaaa

SEQ ID NO: 1970113 - DNA, 16 bp, Homo sapiens
aatctgtgaattaaaa

SEQ ID NO: 1970114 - DNA, 17 bp, Homo sapiens
aatctgtttgatccctg

SEQ ID NO: 1970115 - DNA, 13 bp, Homo sapiens
aatctgttttgta

SEQ ID NO: 1970116 - DNA, 19 bp, Homo sapiens
aatctgttttgtatatgat

SEQ ID NO: 1970117 - DNA, 18 bp, Homo sapiens
aatcttaattttgtattt

SEQ ID NO: 1970118 - DNA, 19 bp, Homo sapiens
aatcttaggggagagcttt

SEQ ID NO: 1970119 - DNA, 22 bp, Homo sapiens
aatcttcagttttatctttaat

SEQ ID NO: 1970120 - DNA, 23 bp, Homo sapiens
aatcttgacacggtgaaatccag

SEQ ID NO: 1970121 - DNA, 19 bp, Homo sapiens
aatcttggggggtttttac

SEQ ID NO: 1970122 - DNA, 13 bp, Homo sapiens
aatcttgtccaca

SEQ ID NO: 1970123 - DNA, 14 bp, Homo sapiens
aatcttgtccacag

SEQ ID NO: 1970124 - DNA, 21 bp, Homo sapiens
aatcttgttaaattgcttatt

SEQ ID NO: 1970125 - DNA, 21 bp, Homo sapiens
aatctttcagcactcagaaaa

SEQ ID NO: 1970126 - DNA, 14 bp, Homo sapiens
aatctttcttacta

SEQ ID NO: 1970127 - DNA, 15 bp, Homo sapiens
aatctttctttacct

SEQ ID NO: 1970128 - DNA, 19 bp, Homo sapiens
aatctttctttacctgaga

SEQ ID NO: 1970129 - DNA, 22 bp, Homo sapiens
aatctttctttacctgagacca

SEQ ID NO: 1970130 - DNA, 15 bp, Homo sapiens
aatctttgattcaga

SEQ ID NO: 1970131 - DNA, 16 bp, Homo sapiens
aatctttgtgacagga

SEQ ID NO: 1970132 - DNA, 14 bp, Homo sapiens
aatgaaaaattctc

SEQ ID NO: 1970133 - DNA, 14 bp, Homo sapiens
aatgaaaatgtaac

SEQ ID NO: 1970134 - DNA, 14 bp, Homo sapiens
aatgaaaatgtcag

SEQ ID NO: 1970135 - DNA, 20 bp, Homo sapiens
aatgaaaatgtcagaaacca

SEQ ID NO: 1970136 - DNA, 19 bp, Homo sapiens
aatgaaacaaataatcaca

SEQ ID NO: 1970137 - DNA, 15 bp, Homo sapiens
aatgaaaccaaagcc

SEQ ID NO: 1970138 - DNA, 15 bp, Homo sapiens
aatgaaatgtttttg

SEQ ID NO: 1970139 - DNA, 14 bp, Homo sapiens
aatgaaattaactg

SEQ ID NO: 1970140 - DNA, 14 bp, Homo sapiens
aatgaacagaacat

SEQ ID NO: 1970141 - DNA, 16 bp, Homo sapiens
aatgaaccacatcttg

SEQ ID NO: 1970142 - DNA, 23 bp, Homo sapiens
aatgaaccacatcttgctctgct

SEQ ID NO: 1970143 - DNA, 16 bp, Homo sapiens
aatgaactgtgacagg

SEQ ID NO: 1970144 - DNA, 23 bp, Homo sapiens
aatgaagacctaaatgacctcag

SEQ ID NO: 1970145 - DNA, 12 bp, Homo sapiens
aatgaagcatgt

SEQ ID NO: 1970146 - DNA, 22 bp, Homo sapiens
aatgaaggttaggatttaacag

SEQ ID NO: 1970147 - DNA, 16 bp, Homo sapiens
aatgaagtatttctca

SEQ ID NO: 1970148 - DNA, 15 bp, Homo sapiens
aatgaataataatta

SEQ ID NO: 1970149 - DNA, 21 bp, Homo sapiens
aatgaataataattatccaga

SEQ ID NO: 1970150 - DNA, 17 bp, Homo sapiens
aatgaattaaataaacc

SEQ ID NO: 1970151 - DNA, 22 bp, Homo sapiens
aatgaattctctctaaaaataa

SEQ ID NO: 1970152 - DNA, 19 bp, Homo sapiens
aatgaatttatctgaatat

SEQ ID NO: 1970153 - DNA, 20 bp, Homo sapiens
aatgaatttatctgaatata

SEQ ID NO: 1970154 - DNA, 23 bp, Homo sapiens
aatgacacggtaggccaagctga

SEQ ID NO: 1970155 - DNA, 16 bp, Homo sapiens
aatgacagaatgctgt

SEQ ID NO: 1970156 - DNA, 13 bp, Homo sapiens
aatgacagggatg

SEQ ID NO: 1970157 - DNA, 13 bp, Homo sapiens
aatgacatcttca

SEQ ID NO: 1970158 - DNA, 15 bp, Homo sapiens
aatgacatgcactga

SEQ ID NO: 1970159 - DNA, 22 bp, Homo sapiens
aatgacatgcactgacccttcc

SEQ ID NO: 1970160 - DNA, 13 bp, Homo sapiens
aatgacatttttg

SEQ ID NO: 1970161 - DNA, 17 bp, Homo sapiens
aatgacatttttgataa

SEQ ID NO: 1970162 - DNA, 18 bp, Homo sapiens
aatgaccaagaaaaagaa

SEQ ID NO: 1970163 - DNA, 18 bp, Homo sapiens
aatgaccacgggcctcag

SEQ ID NO: 1970164 - DNA, 21 bp, Homo sapiens
aatgaccacgggcctcagttt

SEQ ID NO: 1970165 - DNA, 16 bp, Homo sapiens
aatgacctcaagatgt

SEQ ID NO: 1970166 - DNA, 13 bp, Homo sapiens
aatgacctcagca

SEQ ID NO: 1970167 - DNA, 16 bp, Homo sapiens
aatgactataaacatt

SEQ ID NO: 1970168 - DNA, 15 bp, Homo sapiens
aatgagacttgctct

SEQ ID NO: 1970169 - DNA, 14 bp, Homo sapiens
aatgagcattagct

SEQ ID NO: 1970170 - DNA, 14 bp, Homo sapiens
aatgagcctgtaat

SEQ ID NO: 1970171 - DNA, 20 bp, Homo sapiens
aatgagggactggaaccagg

SEQ ID NO: 1970172 - DNA, 16 bp, Homo sapiens
aatgaggtcagagcct

SEQ ID NO: 1970173 - DNA, 15 bp, Homo sapiens
aatgaggtcccaggc

SEQ ID NO: 1970174 - DNA, 22 bp, Homo sapiens
aatgagtctgcataaacttcat

SEQ ID NO: 1970175 - DNA, 23 bp, Homo sapiens
aatgagtctgcataaacttcatc

SEQ ID NO: 1970176 - DNA, 17 bp, Homo sapiens
aatgatgagtaacttaa

SEQ ID NO: 1970177 - DNA, 18 bp, Homo sapiens
aatgatgagtaacttaac

SEQ ID NO: 1970178 - DNA, 17 bp, Homo sapiens
aatgatgattaaacacc

SEQ ID NO: 1970179 - DNA, 20 bp, Homo sapiens
aatgatgccaaaatattgct

SEQ ID NO: 1970180 - DNA, 22 bp, Homo sapiens
aatgatgccaaaatattgctta

SEQ ID NO: 1970181 - DNA, 17 bp, Homo sapiens
aatgatggcaattttgt

SEQ ID NO: 1970182 - DNA, 18 bp, Homo sapiens
aatgatggcaattttgta

SEQ ID NO: 1970183 - DNA, 19 bp, Homo sapiens
aatgatggcaattttgtaa

SEQ ID NO: 1970184 - DNA, 19 bp, Homo sapiens
aatgatgtatgatttgttg

SEQ ID NO: 1970185 - DNA, 18 bp, Homo sapiens
aatgatgtccagaagaat

SEQ ID NO: 1970186 - DNA, 16 bp, Homo sapiens
aatgattatatgacaa

SEQ ID NO: 1970187 - DNA, 23 bp, Homo sapiens
aatgattatgtgtcctttcttga

SEQ ID NO: 1970188 - DNA, 14 bp, Homo sapiens
aatgattattttca

SEQ ID NO: 1970189 - DNA, 19 bp, Homo sapiens
aatgattattttcattaca

SEQ ID NO: 1970190 - DNA, 21 bp, Homo sapiens
aatgattattttcattacaat

SEQ ID NO: 1970191 - DNA, 23 bp, Homo sapiens
aatgattattttcattacaatgg

SEQ ID NO: 1970192 - DNA, 18 bp, Homo sapiens
aatgattccctcttgcta

SEQ ID NO: 1970193 - DNA, 14 bp, Homo sapiens
aatgattgtaaaat

SEQ ID NO: 1970194 - DNA, 18 bp, Homo sapiens
aatgattgtttaattgta

SEQ ID NO: 1970195 - DNA, 16 bp, Homo sapiens
aatgattttcatcaat

SEQ ID NO: 1970196 - DNA, 21 bp, Homo sapiens
aatgcaagattttccacaaga

SEQ ID NO: 1970197 - DNA, 17 bp, Homo sapiens
aatgcacaagctcagaa

SEQ ID NO: 1970198 - DNA, 10 bp, Homo sapiens
aatgcacaat

SEQ ID NO: 1970199 - DNA, 13 bp, Homo sapiens
aatgcacaattta

SEQ ID NO: 1970200 - DNA, 17 bp, Homo sapiens
aatgcacaatttagaaa

SEQ ID NO: 1970201 - DNA, 21 bp, Homo sapiens
aatgcacaatttagaaaacat

SEQ ID NO: 1970202 - DNA, 24 bp, Homo sapiens
aatgcacacacacagagatatgca

SEQ ID NO: 1970203 - DNA, 17 bp, Homo sapiens
aatgcacactagcctct

SEQ ID NO: 1970204 - DNA, 17 bp, Homo sapiens
aatgcacatccattccc

SEQ ID NO: 1970205 - DNA, 18 bp, Homo sapiens
aatgcacatccattccca

SEQ ID NO: 1970206 - DNA, 15 bp, Homo sapiens
aatgcacctaaagaa

SEQ ID NO: 1970207 - DNA, 16 bp, Homo sapiens
aatgcagattcctggg

SEQ ID NO: 1970208 - DNA, 17 bp, Homo sapiens
aatgcagattcctgggc

SEQ ID NO: 1970209 - DNA, 18 bp, Homo sapiens
aatgcagattcctgggcc

SEQ ID NO: 1970210 - DNA, 19 bp, Homo sapiens
aatgcagattcctgggcct

SEQ ID NO: 1970211 - DNA, 20 bp, Homo sapiens
aatgcagattcctgggcctg

SEQ ID NO: 1970212 - DNA, 17 bp, Homo sapiens
aatgcagtgaattgtga

SEQ ID NO: 1970213 - DNA, 14 bp, Homo sapiens
aatgcatagtttgt

SEQ ID NO: 1970214 - DNA, 23 bp, Homo sapiens
aatgcatccattcctcagggaca

SEQ ID NO: 1970215 - DNA, 13 bp, Homo sapiens
aatgcatgatttt

SEQ ID NO: 1970216 - DNA, 14 bp, Homo sapiens
aatgcatgatttta

SEQ ID NO: 1970217 - DNA, 16 bp, Homo sapiens
aatgcatgattttata

SEQ ID NO: 1970218 - DNA, 20 bp, Homo sapiens
aatgcatgattttatacata

SEQ ID NO: 1970219 - DNA, 19 bp, Homo sapiens
aatgcatgcagccactgtg

SEQ ID NO: 1970220 - DNA, 20 bp, Homo sapiens
aatgcatgtaaggtcttctt

SEQ ID NO: 1970221 - DNA, 21 bp, Homo sapiens
aatgcatgtaaggtcttcttg

SEQ ID NO: 1970222 - DNA, 17 bp, Homo sapiens
aatgcattattttgaat

SEQ ID NO: 1970223 - DNA, 19 bp, Homo sapiens
aatgccaactggtcactgt

SEQ ID NO: 1970224 - DNA, 17 bp, Homo sapiens
aatgccaagataattca

SEQ ID NO: 1970225 - DNA, 19 bp, Homo sapiens
aatgcccgtaatgcttaga

SEQ ID NO: 1970226 - DNA, 13 bp, Homo sapiens
aatgccctctctg

SEQ ID NO: 1970227 - DNA, 20 bp, Homo sapiens
aatgcggccgcattccctga

SEQ ID NO: 1970228 - DNA, 16 bp, Homo sapiens
aatgctaagaaatgct

SEQ ID NO: 1970229 - DNA, 12 bp, Homo sapiens
aatgctattgaa

SEQ ID NO: 1970230 - DNA, 22 bp, Homo sapiens
aatgctcccatctcctgatttc

SEQ ID NO: 1970231 - DNA, 23 bp, Homo sapiens
aatgctcccatctcctgatttct

SEQ ID NO: 1970232 - DNA, 23 bp, Homo sapiens
aatgctcgtgtgatttcctacag

SEQ ID NO: 1970233 - DNA, 18 bp, Homo sapiens
aatgctgaaaatcaaagt

SEQ ID NO: 1970234 - DNA, 22 bp, Homo sapiens
aatgctggctgttggctggggg

SEQ ID NO: 1970235 - DNA, 21 bp, Homo sapiens
aatgctggttttcctaaatgc

SEQ ID NO: 1970236 - DNA, 23 bp, Homo sapiens
aatgctggttttcctaaatgcag

SEQ ID NO: 1970237 - DNA, 17 bp, Homo sapiens
aatgctgtcaactatga

SEQ ID NO: 1970238 - DNA, 16 bp, Homo sapiens
aatgctgttgcctcat

SEQ ID NO: 1970239 - DNA, 16 bp, Homo sapiens
aatgctttcctccctg

SEQ ID NO: 1970240 - DNA, 14 bp, Homo sapiens
aatgcttttctagc

SEQ ID NO: 1970241 - DNA, 14 bp, Homo sapiens
aatgctttttgaat

SEQ ID NO: 1970242 - DNA, 16 bp, Homo sapiens
aatggaaacagggcag

SEQ ID NO: 1970243 - DNA, 12 bp, Homo sapiens
aatggaagaaaa

SEQ ID NO: 1970244 - DNA, 16 bp, Homo sapiens
aatggaagagaaatct

SEQ ID NO: 1970245 - DNA, 21 bp, Homo sapiens
aatggaatcagcttttaataa

SEQ ID NO: 1970246 - DNA, 14 bp, Homo sapiens
aatggagaagctct

SEQ ID NO: 1970247 - DNA, 15 bp, Homo sapiens
aatggagaagctctg

SEQ ID NO: 1970248 - DNA, 13 bp, Homo sapiens
aatggagcttgta

SEQ ID NO: 1970249 - DNA, 19 bp, Homo sapiens
aatggcacagcccaaagaa

SEQ ID NO: 1970250 - DNA, 18 bp, Homo sapiens
aatggcagctagactgga

SEQ ID NO: 1970251 - DNA, 19 bp, Homo sapiens
aatggcagctagactggag

SEQ ID NO: 1970252 - DNA, 20 bp, Homo sapiens
aatggcctgccttgaagcca

SEQ ID NO: 1970253 - DNA, 18 bp, Homo sapiens
aatggctgtaaactataa

SEQ ID NO: 1970254 - DNA, 22 bp, Homo sapiens
aatgggaactgcctctttcctg

SEQ ID NO: 1970255 - DNA, 14 bp, Homo sapiens
aatgggagggggct

SEQ ID NO: 1970256 - DNA, 21 bp, Homo sapiens
aatgggagggggctccatgga

SEQ ID NO: 1970257 - DNA, 17 bp, Homo sapiens
aatgggcagtgcctcct

SEQ ID NO: 1970258 - DNA, 18 bp, Homo sapiens
aatgggccaattaaaata

SEQ ID NO: 1970259 - DNA, 22 bp, Homo sapiens
aatggtctttctaatgtgtgaa

SEQ ID NO: 1970260 - DNA, 19 bp, Homo sapiens
aatggtgttactaaagtca

SEQ ID NO: 1970261 - DNA, 21 bp, Homo sapiens
aatggttccatgcctgagggt

SEQ ID NO: 1970262 - DNA, 15 bp, Homo sapiens
aatggttgccttaaa

SEQ ID NO: 1970263 - DNA, 18 bp, Homo sapiens
aatggttgccttaaagaa

SEQ ID NO: 1970264 - DNA, 18 bp, Homo sapiens
aatggtttactgctgtca

SEQ ID NO: 1970265 - DNA, 17 bp, Homo sapiens
aatggtttgcaaggaag

SEQ ID NO: 1970266 - DNA, 18 bp, Homo sapiens
aatggtttgcaaggaagc

SEQ ID NO: 1970267 - DNA, 16 bp, Homo sapiens
aatgtaaatattttaa

SEQ ID NO: 1970268 - DNA, 19 bp, Homo sapiens
aatgtaaatattttaaaga

SEQ ID NO: 1970269 - DNA, 22 bp, Homo sapiens
aatgtaacttttgtaagacaaa

SEQ ID NO: 1970270 - DNA, 23 bp, Homo sapiens
aatgtaattatgaggtgaaacaa

SEQ ID NO: 1970271 - DNA, 14 bp, Homo sapiens
aatgtaattgaata

SEQ ID NO: 1970272 - DNA, 16 bp, Homo sapiens
aatgtacactggatat

SEQ ID NO: 1970273 - DNA, 20 bp, Homo sapiens
aatgtaggtatgaataagtt

SEQ ID NO: 1970274 - DNA, 16 bp, Homo sapiens
aatgtatataaagtac

SEQ ID NO: 1970275 - DNA, 13 bp, Homo sapiens
aatgtatatacac

SEQ ID NO: 1970276 - DNA, 18 bp, Homo sapiens
aatgtatcatagaaatgt

SEQ ID NO: 1970277 - DNA, 19 bp, Homo sapiens
aatgtatcatagaaatgta

SEQ ID NO: 1970278 - DNA, 22 bp, Homo sapiens
aatgtatcatagaaatgtaact

SEQ ID NO: 1970279 - DNA, 11 bp, Homo sapiens
aatgtatctta

SEQ ID NO: 1970280 - DNA, 12 bp, Homo sapiens
aatgtatcttat

SEQ ID NO: 1970281 - DNA, 20 bp, Homo sapiens
aatgtatcttatttatatat

SEQ ID NO: 1970282 - DNA, 15 bp, Homo sapiens
aatgtatgtgaaagt

SEQ ID NO: 1970283 - DNA, 20 bp, Homo sapiens
aatgtatgtgaaagtgtaaa

SEQ ID NO: 1970284 - DNA, 13 bp, Homo sapiens
aatgtatttatat

SEQ ID NO: 1970285 - DNA, 21 bp, Homo sapiens
aatgtcacaatcctgtccctc

SEQ ID NO: 1970286 - DNA, 21 bp, Homo sapiens
aatgtcacacttgtttcttgt

SEQ ID NO: 1970287 - DNA, 22 bp, Homo sapiens
aatgtcacacttgtttcttgtt

SEQ ID NO: 1970288 - DNA, 13 bp, Homo sapiens
aatgtcacaggca

SEQ ID NO: 1970289 - DNA, 16 bp, Homo sapiens
aatgtcacaggcaggt

SEQ ID NO: 1970290 - DNA, 19 bp, Homo sapiens
aatgtcacaggcaggtcca

SEQ ID NO: 1970291 - DNA, 16 bp, Homo sapiens
aatgtcaccaccttcc

SEQ ID NO: 1970292 - DNA, 19 bp, Homo sapiens
aatgtcaccaccttcccag

SEQ ID NO: 1970293 - DNA, 22 bp, Homo sapiens
aatgtcagagctatgttccctc

SEQ ID NO: 1970294 - DNA, 14 bp, Homo sapiens
aatgtcattttggt

SEQ ID NO: 1970295 - DNA, 19 bp, Homo sapiens
aatgtcattttggtacttt

SEQ ID NO: 1970296 - DNA, 16 bp, Homo sapiens
aatgtctcttcctctg

SEQ ID NO: 1970297 - DNA, 20 bp, Homo sapiens
aatgtctctttaatgtcaca

SEQ ID NO: 1970298 - DNA, 17 bp, Homo sapiens
aatgtctttctattcat

SEQ ID NO: 1970299 - DNA, 23 bp, Homo sapiens
aatgtgaactaagttttttactt

SEQ ID NO: 1970300 - DNA, 17 bp, Homo sapiens
aatgtgagtgtgtttgt

SEQ ID NO: 1970301 - DNA, 14 bp, Homo sapiens
aatgtgatcaactg

SEQ ID NO: 1970302 - DNA, 17 bp, Homo sapiens
aatgtgattccttttga

SEQ ID NO: 1970303 - DNA, 19 bp, Homo sapiens
aatgtgattctaatgtctt

SEQ ID NO: 1970304 - DNA, 15 bp, Homo sapiens
aatgtgcatttcttg

SEQ ID NO: 1970305 - DNA, 22 bp, Homo sapiens
aatgtggatttcctattttaaa

SEQ ID NO: 1970306 - DNA, 16 bp, Homo sapiens
aatgtggtagcctcac

SEQ ID NO: 1970307 - DNA, 17 bp, Homo sapiens
aatgtgtaagcattgta

SEQ ID NO: 1970308 - DNA, 21 bp, Homo sapiens
aatgtgtaagcattgtataca

SEQ ID NO: 1970309 - DNA, 16 bp, Homo sapiens
aatgtgtattctggct

SEQ ID NO: 1970310 - DNA, 12 bp, Homo sapiens
aatgtgtgtatg

SEQ ID NO: 1970311 - DNA, 13 bp, Homo sapiens
aatgtgtgtatgt

SEQ ID NO: 1970312 - DNA, 22 bp, Homo sapiens
aatgtgttgatttgagaaattt

SEQ ID NO: 1970313 - DNA, 19 bp, Homo sapiens
aatgttaaaatattgattt

SEQ ID NO: 1970314 - DNA, 23 bp, Homo sapiens
aatgttaattcagcactgatttc

SEQ ID NO: 1970315 - DNA, 15 bp, Homo sapiens
aatgttacattatta

SEQ ID NO: 1970316 - DNA, 19 bp, Homo sapiens
aatgttcacgcaacttgaa

SEQ ID NO: 1970317 - DNA, 18 bp, Homo sapiens
aatgttccctgcaccctg

SEQ ID NO: 1970318 - DNA, 20 bp, Homo sapiens
aatgttcgtattctattcaa

SEQ ID NO: 1970319 - DNA, 15 bp, Homo sapiens
aatgttctgttgtaa

SEQ ID NO: 1970320 - DNA, 18 bp, Homo sapiens
aatgttcttggttcccat

SEQ ID NO: 1970321 - DNA, 15 bp, Homo sapiens
aatgttgaaatatga

SEQ ID NO: 1970322 - DNA, 16 bp, Homo sapiens
aatgttggaattttca

SEQ ID NO: 1970323 - DNA, 18 bp, Homo sapiens
aatgttggaattttcaaa

SEQ ID NO: 1970324 - DNA, 24 bp, Homo sapiens
aatgttgggatttatatctatagt

SEQ ID NO: 1970325 - DNA, 16 bp, Homo sapiens
aatgtttaaatataaa

SEQ ID NO: 1970326 - DNA, 21 bp, Homo sapiens
aatgtttatgcaaggaaggaa

SEQ ID NO: 1970327 - DNA, 23 bp, Homo sapiens
aatgtttatgcaaggaaggaaag

SEQ ID NO: 1970328 - DNA, 20 bp, Homo sapiens
aatgtttattcctgataata

SEQ ID NO: 1970329 - DNA, 21 bp, Homo sapiens
aatgtttcattttcattaaaa

SEQ ID NO: 1970330 - DNA, 14 bp, Homo sapiens
aatgtttgatttag

SEQ ID NO: 1970331 - DNA, 13 bp, Homo sapiens
aatgttttgtaca

SEQ ID NO: 1970332 - DNA, 16 bp, Homo sapiens
aatgtttttattaaca

SEQ ID NO: 1970333 - DNA, 18 bp, Homo sapiens
aattaaaaaaaagaagag

SEQ ID NO: 1970334 - DNA, 14 bp, Homo sapiens
aattaaaaaccact

SEQ ID NO: 1970335 - DNA, 15 bp, Homo sapiens
aattaaaatatatat

SEQ ID NO: 1970336 - DNA, 19 bp, Homo sapiens
aattaaaatatatataaat

SEQ ID NO: 1970337 - DNA, 13 bp, Homo sapiens
aattaaaatctgg

SEQ ID NO: 1970338 - DNA, 12 bp, Homo sapiens
aattaaactgaa

SEQ ID NO: 1970339 - DNA, 12 bp, Homo sapiens
aattaacactgc

SEQ ID NO: 1970340 - DNA, 21 bp, Homo sapiens
aattaactgggtaatgaaaca

SEQ ID NO: 1970341 - DNA, 22 bp, Homo sapiens
aattaactgggtaatgaaacaa

SEQ ID NO: 1970342 - DNA, 12 bp, Homo sapiens
aattaagacaag

SEQ ID NO: 1970343 - DNA, 17 bp, Homo sapiens
aattaagagatacattc

SEQ ID NO: 1970344 - DNA, 14 bp, Homo sapiens
aattaagtgcaatt

SEQ ID NO: 1970345 - DNA, 20 bp, Homo sapiens
aattaataaacgaagataaa

SEQ ID NO: 1970346 - DNA, 19 bp, Homo sapiens
aattacaaaatgaagtttt

SEQ ID NO: 1970347 - DNA, 14 bp, Homo sapiens
aattacacccaaag

SEQ ID NO: 1970348 - DNA, 21 bp, Homo sapiens
aattaccttagattagctctg

SEQ ID NO: 1970349 - DNA, 17 bp, Homo sapiens
aattactacaaaatttg

SEQ ID NO: 1970350 - DNA, 11 bp, Homo sapiens
aattacttctc

SEQ ID NO: 1970351 - DNA, 14 bp, Homo sapiens
aattagaacaatag

SEQ ID NO: 1970352 - DNA, 14 bp, Homo sapiens
aattagccgggcgt

SEQ ID NO: 1970353 - DNA, 16 bp, Homo sapiens
aattaggatctatgca

SEQ ID NO: 1970354 - DNA, 19 bp, Homo sapiens
aattaggatctatgcaatt

SEQ ID NO: 1970355 - DNA, 13 bp, Homo sapiens
aattagtacagta

SEQ ID NO: 1970356 - DNA, 14 bp, Homo sapiens
aattagtacagtag

SEQ ID NO: 1970357 - DNA, 22 bp, Homo sapiens
aattagtacagtagcttaaata

SEQ ID NO: 1970358 - DNA, 14 bp, Homo sapiens
aattagtgagattt

SEQ ID NO: 1970359 - DNA, 13 bp, Homo sapiens
aattatatctaat

SEQ ID NO: 1970360 - DNA, 14 bp, Homo sapiens
aattatatctaatt

SEQ ID NO: 1970361 - DNA, 18 bp, Homo sapiens
aattatatctaatttata

SEQ ID NO: 1970362 - DNA, 20 bp, Homo sapiens
aattatatctaatttataca

SEQ ID NO: 1970363 - DNA, 21 bp, Homo sapiens
aattatatctaatttatacaa

SEQ ID NO: 1970364 - DNA, 17 bp, Homo sapiens
aattatcggaagcagtg

SEQ ID NO: 1970365 - DNA, 21 bp, Homo sapiens
aattatcggaagcagtgcctt

SEQ ID NO: 1970366 - DNA, 17 bp, Homo sapiens
aattatcgggaacagtg

SEQ ID NO: 1970367 - DNA, 20 bp, Homo sapiens
aattatcgggaacagtgttt

SEQ ID NO: 1970368 - DNA, 22 bp, Homo sapiens
aattatctgatcgggataacaa

SEQ ID NO: 1970369 - DNA, 14 bp, Homo sapiens
aattatcttattta

SEQ ID NO: 1970370 - DNA, 16 bp, Homo sapiens
aattatcttatttaat

SEQ ID NO: 1970371 - DNA, 16 bp, Homo sapiens
aattatgtgacaacct

SEQ ID NO: 1970372 - DNA, 22 bp, Homo sapiens
aattatgtgacaacctttgtgt

SEQ ID NO: 1970373 - DNA, 18 bp, Homo sapiens
aattattacatttataca

SEQ ID NO: 1970374 - DNA, 23 bp, Homo sapiens
aattattatgactcaataaaaga

SEQ ID NO: 1970375 - DNA, 13 bp, Homo sapiens
aattattatttat

SEQ ID NO: 1970376 - DNA, 16 bp, Homo sapiens
aattattatttatata

SEQ ID NO: 1970377 - DNA, 14 bp, Homo sapiens
aattattgtacact

SEQ ID NO: 1970378 - DNA, 15 bp, Homo sapiens
aattattgtacacta

SEQ ID NO: 1970379 - DNA, 18 bp, Homo sapiens
aattattgtacactaaca

SEQ ID NO: 1970380 - DNA, 22 bp, Homo sapiens
aattatttaaaccgctaaaaga

SEQ ID NO: 1970381 - DNA, 21 bp, Homo sapiens
aattatttgtgtaatagaaaa

SEQ ID NO: 1970382 - DNA, 15 bp, Homo sapiens
aattatttttataca

SEQ ID NO: 1970383 - DNA, 22 bp, Homo sapiens
aattcaaaagctctctttggaa

SEQ ID NO: 1970384 - DNA, 13 bp, Homo sapiens
aattcaaaccatt

SEQ ID NO: 1970385 - DNA, 13 bp, Homo sapiens
aattcaacacatt

SEQ ID NO: 1970386 - DNA, 21 bp, Homo sapiens
aattcaaccactgtaaaatga

SEQ ID NO: 1970387 - DNA, 17 bp, Homo sapiens
aattcaacctgtgtctt

SEQ ID NO: 1970388 - DNA, 12 bp, Homo sapiens
aattcacacctt

SEQ ID NO: 1970389 - DNA, 23 bp, Homo sapiens
aattcactcccacacccaagaag

SEQ ID NO: 1970390 - DNA, 15 bp, Homo sapiens
aattcacttagggtc

SEQ ID NO: 1970391 - DNA, 23 bp, Homo sapiens
aattcacttagggtcgagcatcc

SEQ ID NO: 1970392 - DNA, 20 bp, Homo sapiens
aattcagaaaacataatata

SEQ ID NO: 1970393 - DNA, 23 bp, Homo sapiens
aattcagaaaacataatataaga

SEQ ID NO: 1970394 - DNA, 16 bp, Homo sapiens
aattcagaagcatcac

SEQ ID NO: 1970395 - DNA, 20 bp, Homo sapiens
aattcagatatatttttcac

SEQ ID NO: 1970396 - DNA, 20 bp, Homo sapiens
aattcagcactgatttcaca

SEQ ID NO: 1970397 - DNA, 23 bp, Homo sapiens
aattcataattagaacaatagct

SEQ ID NO: 1970398 - DNA, 15 bp, Homo sapiens
aattcatttcacttt

SEQ ID NO: 1970399 - DNA, 16 bp, Homo sapiens
aattcatttcacttta

SEQ ID NO: 1970400 - DNA, 23 bp, Homo sapiens
aattccaaggagttccatgaaga

SEQ ID NO: 1970401 - DNA, 13 bp, Homo sapiens
aattccactggac

SEQ ID NO: 1970402 - DNA, 21 bp, Homo sapiens
aattccactggacttgagctt

SEQ ID NO: 1970403 - DNA, 16 bp, Homo sapiens
aattccataaccccag

SEQ ID NO: 1970404 - DNA, 21 bp, Homo sapiens
aattcccattttgcaaaattt

SEQ ID NO: 1970405 - DNA, 14 bp, Homo sapiens
aattcccccacttg

SEQ ID NO: 1970406 - DNA, 21 bp, Homo sapiens
aattcctggcatgacactcta

SEQ ID NO: 1970407 - DNA, 23 bp, Homo sapiens
aattccttagcttagacctcagc

SEQ ID NO: 1970408 - DNA, 16 bp, Homo sapiens
aattctaaatgctggt

SEQ ID NO: 1970409 - DNA, 22 bp, Homo sapiens
aattctcaacctaccacccctt

SEQ ID NO: 1970410 - DNA, 19 bp, Homo sapiens
aattctcatgtgatccttt

SEQ ID NO: 1970411 - DNA, 20 bp, Homo sapiens
aattctcatgtgatcctttt

SEQ ID NO: 1970412 - DNA, 14 bp, Homo sapiens
aattctctctaaaa

SEQ ID NO: 1970413 - DNA, 17 bp, Homo sapiens
aattctgacttctccca

SEQ ID NO: 1970414 - DNA, 19 bp, Homo sapiens
aattctgacttctcccatc

SEQ ID NO: 1970415 - DNA, 17 bp, Homo sapiens
aattctgagctggccct

SEQ ID NO: 1970416 - DNA, 22 bp, Homo sapiens
aattctgagctggccctttcca

SEQ ID NO: 1970417 - DNA, 17 bp, Homo sapiens
aattctggaggaagaag

SEQ ID NO: 1970418 - DNA, 14 bp, Homo sapiens
aattctgtgaagaa

SEQ ID NO: 1970419 - DNA, 18 bp, Homo sapiens
aattctgtgaagaatgaa

SEQ ID NO: 1970420 - DNA, 18 bp, Homo sapiens
aattcttatttctgtgtt

SEQ ID NO: 1970421 - DNA, 15 bp, Homo sapiens
aattcttggaatact

SEQ ID NO: 1970422 - DNA, 14 bp, Homo sapiens
aattcttgtatatt

SEQ ID NO: 1970423 - DNA, 16 bp, Homo sapiens
aattcttgtatattat

SEQ ID NO: 1970424 - DNA, 16 bp, Homo sapiens
aattctttatttctgt

SEQ ID NO: 1970425 - DNA, 13 bp, Homo sapiens
aattctttttcaa

SEQ ID NO: 1970426 - DNA, 18 bp, Homo sapiens
aattgaaatttaaaaata

SEQ ID NO: 1970427 - DNA, 21 bp, Homo sapiens
aattgaaatttaaaaataaag

SEQ ID NO: 1970428 - DNA, 16 bp, Homo sapiens
aattgaagataggaga

SEQ ID NO: 1970429 - DNA, 14 bp, Homo sapiens
aattgaagatgtaa

SEQ ID NO: 1970430 - DNA, 17 bp, Homo sapiens
aattgaaggagaaaatg

SEQ ID NO: 1970431 - DNA, 18 bp, Homo sapiens
aattgaatgcaaaccata

SEQ ID NO: 1970432 - DNA, 17 bp, Homo sapiens
aattgacccatgttccc

SEQ ID NO: 1970433 - DNA, 14 bp, Homo sapiens
aattgactgtcact

SEQ ID NO: 1970434 - DNA, 15 bp, Homo sapiens
aattgagaaggaaaa

SEQ ID NO: 1970435 - DNA, 23 bp, Homo sapiens
aattgagataatatctgtgaggt

SEQ ID NO: 1970436 - DNA, 21 bp, Homo sapiens
aattgatcataggtatttcaa

SEQ ID NO: 1970437 - DNA, 10 bp, Homo sapiens
aattgcacaa

SEQ ID NO: 1970438 - DNA, 11 bp, Homo sapiens
aattgcacaat

SEQ ID NO: 1970439 - DNA, 14 bp, Homo sapiens
aattgcacaatttg

SEQ ID NO: 1970440 - DNA, 22 bp, Homo sapiens
aattgcacgcggagtgagtttt

SEQ ID NO: 1970441 - DNA, 18 bp, Homo sapiens
aattgcacttttaaacct

SEQ ID NO: 1970442 - DNA, 22 bp, Homo sapiens
aattgcatgccatctccaccct

SEQ ID NO: 1970443 - DNA, 15 bp, Homo sapiens
aattgcctgacgaac

SEQ ID NO: 1970444 - DNA, 20 bp, Homo sapiens
aattgctagtgatttcatta

SEQ ID NO: 1970445 - DNA, 16 bp, Homo sapiens
aattgctgctctctga

SEQ ID NO: 1970446 - DNA, 17 bp, Homo sapiens
aattgcttaaaagacat

SEQ ID NO: 1970447 - DNA, 21 bp, Homo sapiens
aattgcttacatttttacaat

SEQ ID NO: 1970448 - DNA, 20 bp, Homo sapiens
aattggaagctgccctgccc

SEQ ID NO: 1970449 - DNA, 18 bp, Homo sapiens
aattggaccatcctattt

SEQ ID NO: 1970450 - DNA, 13 bp, Homo sapiens
aattggctcctcc

SEQ ID NO: 1970451 - DNA, 14 bp, Homo sapiens
aattggctcctcca

SEQ ID NO: 1970452 - DNA, 22 bp, Homo sapiens
aattggcttattttttaaaata

SEQ ID NO: 1970453 - DNA, 16 bp, Homo sapiens
aattgggaagctgggg

SEQ ID NO: 1970454 - DNA, 16 bp, Homo sapiens
aattggtaattgaatg

SEQ ID NO: 1970455 - DNA, 18 bp, Homo sapiens
aattggtgataagtggaa

SEQ ID NO: 1970456 - DNA, 20 bp, Homo sapiens
aattggtgataagtggaaaa

SEQ ID NO: 1970457 - DNA, 22 bp, Homo sapiens
aattggttagaacctcctattt

SEQ ID NO: 1970458 - DNA, 13 bp, Homo sapiens
aattgtaaatttt

SEQ ID NO: 1970459 - DNA, 18 bp, Homo sapiens
aattgtacattccctgca

SEQ ID NO: 1970460 - DNA, 19 bp, Homo sapiens
aattgtagatggaaatcag

SEQ ID NO: 1970461 - DNA, 14 bp, Homo sapiens
aattgtatacattt

SEQ ID NO: 1970462 - DNA, 21 bp, Homo sapiens
aattgtatacattttgttata

SEQ ID NO: 1970463 - DNA, 22 bp, Homo sapiens
aattgtatacattttgttatag

SEQ ID NO: 1970464 - DNA, 22 bp, Homo sapiens
aattgtatgttaagttacttca

SEQ ID NO: 1970465 - DNA, 18 bp, Homo sapiens
aattgtattttatatgag

SEQ ID NO: 1970466 - DNA, 19 bp, Homo sapiens
aattgtcaaatgtcattat

SEQ ID NO: 1970467 - DNA, 18 bp, Homo sapiens
aattgtccctgtttcaaa

SEQ ID NO: 1970468 - DNA, 12 bp, Homo sapiens
aattgtgtacaa

SEQ ID NO: 1970469 - DNA, 15 bp, Homo sapiens
aattgtgtacaaagt

SEQ ID NO: 1970470 - DNA, 22 bp, Homo sapiens
aattgtgtacaaagtagagaag

SEQ ID NO: 1970471 - DNA, 20 bp, Homo sapiens
aattgtttaagtgttgtaaa

SEQ ID NO: 1970472 - DNA, 17 bp, Homo sapiens
aattgtttggcttcctc

SEQ ID NO: 1970473 - DNA, 19 bp, Homo sapiens
aattgttttatctgaattt

SEQ ID NO: 1970474 - DNA, 14 bp, Homo sapiens
aatttaaaaaataa

SEQ ID NO: 1970475 - DNA, 15 bp, Homo sapiens
aatttaaaaataaag

SEQ ID NO: 1970476 - DNA, 18 bp, Homo sapiens
aatttaaaccagcagaaa

SEQ ID NO: 1970477 - DNA, 21 bp, Homo sapiens
aatttaaaccagcagaaaagt

SEQ ID NO: 1970478 - DNA, 11 bp, Homo sapiens
aatttaattaa

SEQ ID NO: 1970479 - DNA, 15 bp, Homo sapiens
aatttaattcaaagt

SEQ ID NO: 1970480 - DNA, 15 bp, Homo sapiens
aatttagaaaacttt

SEQ ID NO: 1970481 - DNA, 22 bp, Homo sapiens
aatttagtttcatataaagtat

SEQ ID NO: 1970482 - DNA, 18 bp, Homo sapiens
aatttataaaattagaaa

SEQ ID NO: 1970483 - DNA, 16 bp, Homo sapiens
aatttatacaaaataa

SEQ ID NO: 1970484 - DNA, 22 bp, Homo sapiens
aatttatacaaaataatttaac

SEQ ID NO: 1970485 - DNA, 18 bp, Homo sapiens
aatttatcttgtctctgg

SEQ ID NO: 1970486 - DNA, 20 bp, Homo sapiens
aatttatgagtttttgatag

SEQ ID NO: 1970487 - DNA, 16 bp, Homo sapiens
aatttattattgttct

SEQ ID NO: 1970488 - DNA, 16 bp, Homo sapiens
aatttattgcttgata

SEQ ID NO: 1970489 - DNA, 16 bp, Homo sapiens
aatttatttcatccag

SEQ ID NO: 1970490 - DNA, 15 bp, Homo sapiens
aatttcaaaagacat

SEQ ID NO: 1970491 - DNA, 20 bp, Homo sapiens
aatttcaaaagacatgttgt

SEQ ID NO: 1970492 - DNA, 20 bp, Homo sapiens
aatttcaggttttgtaaaga

SEQ ID NO: 1970493 - DNA, 23 bp, Homo sapiens
aatttcagtaggctttatgctgt

SEQ ID NO: 1970494 - DNA, 21 bp, Homo sapiens
aatttcccacaccccagcgcc

SEQ ID NO: 1970495 - DNA, 21 bp, Homo sapiens
aatttcctttatatttagtga

SEQ ID NO: 1970496 - DNA, 18 bp, Homo sapiens
aatttcgccgttgaagag

SEQ ID NO: 1970497 - DNA, 21 bp, Homo sapiens
aatttcgccgttgaagaggaa

SEQ ID NO: 1970498 - DNA, 16 bp, Homo sapiens
aatttctaccatttca

SEQ ID NO: 1970499 - DNA, 19 bp, Homo sapiens
aatttctcccagtcattta

SEQ ID NO: 1970500 - DNA, 20 bp, Homo sapiens
aatttctcccagtcatttaa

SEQ ID NO: 1970501 - DNA, 20 bp, Homo sapiens
aatttcttactaaacatttt

SEQ ID NO: 1970502 - DNA, 20 bp, Homo sapiens
aatttcttcactgttgaaaa

SEQ ID NO: 1970503 - DNA, 19 bp, Homo sapiens
aatttctttgtcattcaag

SEQ ID NO: 1970504 - DNA, 14 bp, Homo sapiens
aagcttcagagcct

SEQ ID NO: 1970505 - DNA, 22 bp, Homo sapiens
aagcttcagagcctagccacct

SEQ ID NO: 1970506 - DNA, 13 bp, Homo sapiens
aagcttgtatata

SEQ ID NO: 1970507 - DNA, 16 bp, Homo sapiens
aagcttgtatatacat

SEQ ID NO: 1970508 - DNA, 18 bp, Homo sapiens
aagcttgtatatacatat

SEQ ID NO: 1970509 - DNA, 21 bp, Homo sapiens
aagctttatttatttctttgt

SEQ ID NO: 1970510 - DNA, 16 bp, Homo sapiens
aagctttctcctttga

SEQ ID NO: 1970511 - DNA, 21 bp, Homo sapiens
aagctttgaatacccccagag

SEQ ID NO: 1970512 - DNA, 23 bp, Homo sapiens
aaggaaaagtcaacatcttctct

SEQ ID NO: 1970513 - DNA, 18 bp, Homo sapiens
aaggaaaccttttcatgc

SEQ ID NO: 1970514 - DNA, 22 bp, Homo sapiens
aaggaaagaaaactaacaacca

SEQ ID NO: 1970515 - DNA, 15 bp, Homo sapiens
aaggaacacccggaa

SEQ ID NO: 1970516 - DNA, 17 bp, Homo sapiens
aaggaacctaattgaaa

SEQ ID NO: 1970517 - DNA, 20 bp, Homo sapiens
aaggaactctggcttccagg

SEQ ID NO: 1970518 - DNA, 18 bp, Homo sapiens
aaggaagctccactgtca

SEQ ID NO: 1970519 - DNA, 11 bp, Homo sapiens
aaggaaggaaa

SEQ ID NO: 1970520 - DNA, 20 bp, Homo sapiens
aaggaaggagactcacctct

SEQ ID NO: 1970521 - DNA, 16 bp, Homo sapiens
aaggaagggacacaca

SEQ ID NO: 1970522 - DNA, 18 bp, Homo sapiens
aaggaagggacacacaca

SEQ ID NO: 1970523 - DNA, 22 bp, Homo sapiens
aaggaagggcatccttctgcct

SEQ ID NO: 1970524 - DNA, 16 bp, Homo sapiens
aaggaaggttttctcc

SEQ ID NO: 1970525 - DNA, 16 bp, Homo sapiens
aaggaagtcaccaaaa

SEQ ID NO: 1970526 - DNA, 16 bp, Homo sapiens
aaggaatagccagaga

SEQ ID NO: 1970527 - DNA, 21 bp, Homo sapiens
aaggaatagtcgcgcaagcat

SEQ ID NO: 1970528 - DNA, 18 bp, Homo sapiens
aaggaatcgtttcaaatg

SEQ ID NO: 1970529 - DNA, 17 bp, Homo sapiens
aaggaatctccagtttt

SEQ ID NO: 1970530 - DNA, 21 bp, Homo sapiens
aaggaatctccagttttcagt

SEQ ID NO: 1970531 - DNA, 21 bp, Homo sapiens
aaggaatgtagctggtttcct

SEQ ID NO: 1970532 - DNA, 15 bp, Homo sapiens
aaggaattctaggca

SEQ ID NO: 1970533 - DNA, 17 bp, Homo sapiens
aaggacaacctgcccct

SEQ ID NO: 1970534 - DNA, 21 bp, Homo sapiens
aaggacaacctgcccctcccc

SEQ ID NO: 1970535 - DNA, 13 bp, Homo sapiens
aaggacaatgcct

SEQ ID NO: 1970536 - DNA, 14 bp, Homo sapiens
aaggacacactaat

SEQ ID NO: 1970537 - DNA, 15 bp, Homo sapiens
aaggacatgtgctat

SEQ ID NO: 1970538 - DNA, 17 bp, Homo sapiens
aaggacatgtgctattg

SEQ ID NO: 1970539 - DNA, 17 bp, Homo sapiens
aaggacattatgtgtgc

SEQ ID NO: 1970540 - DNA, 22 bp, Homo sapiens
aaggacattttctctttaaaag

SEQ ID NO: 1970541 - DNA, 19 bp, Homo sapiens
aaggaccaactggcttctg

SEQ ID NO: 1970542 - DNA, 21 bp, Homo sapiens
aaggaccaactggcttctgtg

SEQ ID NO: 1970543 - DNA, 18 bp, Homo sapiens
aaggacccacccatcttc

SEQ ID NO: 1970544 - DNA, 18 bp, Homo sapiens
aaggacccggaggggcct

SEQ ID NO: 1970545 - DNA, 22 bp, Homo sapiens
aaggacccggaggggcctggca

SEQ ID NO: 1970546 - DNA, 20 bp, Homo sapiens
aaggaccctgttttccacac

SEQ ID NO: 1970547 - DNA, 22 bp, Homo sapiens
aaggaccctgttttccacacca

SEQ ID NO: 1970548 - DNA, 17 bp, Homo sapiens
aaggaccgtttttacta

SEQ ID NO: 1970549 - DNA, 21 bp, Homo sapiens
aaggacggccttcaactgaaa

SEQ ID NO: 1970550 - DNA, 17 bp, Homo sapiens
aaggactattaattcca

SEQ ID NO: 1970551 - DNA, 14 bp, Homo sapiens
aaggactttccagt

SEQ ID NO: 1970552 - DNA, 20 bp, Homo sapiens
aaggagaaaatgcattatgt

SEQ ID NO: 1970553 - DNA, 18 bp, Homo sapiens
aaggagaaaggagccgga

SEQ ID NO: 1970554 - DNA, 16 bp, Homo sapiens
aaggagactcacctct

SEQ ID NO: 1970555 - DNA, 14 bp, Homo sapiens
aaggagatcagggc

SEQ ID NO: 1970556 - DNA, 21 bp, Homo sapiens
aaggagatgggtgattccttc

SEQ ID NO: 1970557 - DNA, 18 bp, Homo sapiens
aaggagattttccttcct

SEQ ID NO: 1970558 - DNA, 19 bp, Homo sapiens
aaggagcccagaaaacctc

SEQ ID NO: 1970559 - DNA, 22 bp, Homo sapiens
aaggagcctgtgaacccaggac

SEQ ID NO: 1970560 - DNA, 20 bp, Homo sapiens
aaggaggcatgcctctgata

SEQ ID NO: 1970561 - DNA, 15 bp, Homo sapiens
aaggagggcagagcc

SEQ ID NO: 1970562 - DNA, 16 bp, Homo sapiens
aaggagggcagagcca

SEQ ID NO: 1970563 - DNA, 18 bp, Homo sapiens
aaggagggttagggaggg

SEQ ID NO: 1970564 - DNA, 19 bp, Homo sapiens
aaggagggttagggagggg

SEQ ID NO: 1970565 - DNA, 19 bp, Homo sapiens
aaggagtgagatcattttc

SEQ ID NO: 1970566 - DNA, 19 bp, Homo sapiens
aaggagtgtagcaactaca

SEQ ID NO: 1970567 - DNA, 13 bp, Homo sapiens
aaggagttaagag

SEQ ID NO: 1970568 - DNA, 16 bp, Homo sapiens
aaggataagaaccaca

SEQ ID NO: 1970569 - DNA, 23 bp, Homo sapiens
aaggataagaaccacagaacact

SEQ ID NO: 1970570 - DNA, 22 bp, Homo sapiens
aaggatatttactacttttgca

SEQ ID NO: 1970571 - DNA, 22 bp, Homo sapiens
aaggatctctcaggagcacagg

SEQ ID NO: 1970572 - DNA, 21 bp, Homo sapiens
aaggatctgtttttaaaaatc

SEQ ID NO: 1970573 - DNA, 20 bp, Homo sapiens
aaggatgtaaacagtgcctg

SEQ ID NO: 1970574 - DNA, 23 bp, Homo sapiens
aaggatgtaaacagtgcctgctg

SEQ ID NO: 1970575 - DNA, 19 bp, Homo sapiens
aaggatgttttgtcccatt

SEQ ID NO: 1970576 - DNA, 22 bp, Homo sapiens
aaggatgttttgtcccatttcc

SEQ ID NO: 1970577 - DNA, 16 bp, Homo sapiens
aaggattcatgtggaa

SEQ ID NO: 1970578 - DNA, 17 bp, Homo sapiens
aaggattgtgatatttt

SEQ ID NO: 1970579 - DNA, 13 bp, Homo sapiens
aaggcaaaaatag

SEQ ID NO: 1970580 - DNA, 18 bp, Homo sapiens
aaggcaaagcccctggaa

SEQ ID NO: 1970581 - DNA, 20 bp, Homo sapiens
aaggcaagtttctagctaga

SEQ ID NO: 1970582 - DNA, 17 bp, Homo sapiens
aaggcacaggtgtaaat

SEQ ID NO: 1970583 - DNA, 18 bp, Homo sapiens
aaggcacgtttggcattt

SEQ ID NO: 1970584 - DNA, 16 bp, Homo sapiens
aaggcagccacagaca

SEQ ID NO: 1970585 - DNA, 16 bp, Homo sapiens
aaggcagcctccagag

SEQ ID NO: 1970586 - DNA, 17 bp, Homo sapiens
aaggcagcctccagagc

SEQ ID NO: 1970587 - DNA, 19 bp, Homo sapiens
aaggcagcctccagagcca

SEQ ID NO: 1970588 - DNA, 20 bp, Homo sapiens
aaggcagcctccagagccag

SEQ ID NO: 1970589 - DNA, 12 bp, Homo sapiens
aaggcagctgct

SEQ ID NO: 1970590 - DNA, 13 bp, Homo sapiens
aaggcagctgctc

SEQ ID NO: 1970591 - DNA, 16 bp, Homo sapiens
aaggcaggaatgtgtg

SEQ ID NO: 1970592 - DNA, 19 bp, Homo sapiens
aaggcaggaatgtgtggca

SEQ ID NO: 1970593 - DNA, 14 bp, Homo sapiens
aaggcaggcagggc

SEQ ID NO: 1970594 - DNA, 17 bp, Homo sapiens
aaggcaggcagggctct

SEQ ID NO: 1970595 - DNA, 22 bp, Homo sapiens
aaggcaggcagggctctcctgg

SEQ ID NO: 1970596 - DNA, 18 bp, Homo sapiens
aaggcagggaaaggctct

SEQ ID NO: 1970597 - DNA, 23 bp, Homo sapiens
aaggcaggtagatcgcttgagcc

SEQ ID NO: 1970598 - DNA, 21 bp, Homo sapiens
aaggccaataaagagttagaa

SEQ ID NO: 1970599 - DNA, 20 bp, Homo sapiens
aaggcccaggtcaacatcta

SEQ ID NO: 1970600 - DNA, 18 bp, Homo sapiens
aaggcccgagcagctgag

SEQ ID NO: 1970601 - DNA, 19 bp, Homo sapiens
aaggcccgagcagctgagc

SEQ ID NO: 1970602 - DNA, 20 bp, Homo sapiens
aaggcccgagcagctgagca

SEQ ID NO: 1970603 - DNA, 17 bp, Homo sapiens
aaggccgtgtctctgag

SEQ ID NO: 1970604 - DNA, 18 bp, Homo sapiens
aaggcctcatctccttta

SEQ ID NO: 1970605 - DNA, 13 bp, Homo sapiens
aaggcctctgtcc

SEQ ID NO: 1970606 - DNA, 15 bp, Homo sapiens
aaggcctcttgtgct

SEQ ID NO: 1970607 - DNA, 14 bp, Homo sapiens
aaggcctgccctcc

SEQ ID NO: 1970608 - DNA, 19 bp, Homo sapiens
aaggcctggaaccagggag

SEQ ID NO: 1970609 - DNA, 22 bp, Homo sapiens
aaggcctggggtgacccggcac

SEQ ID NO: 1970610 - DNA, 20 bp, Homo sapiens
aaggcgtgcaaggggctcag

SEQ ID NO: 1970611 - DNA, 18 bp, Homo sapiens
aaggctactggcattaat

SEQ ID NO: 1970612 - DNA, 20 bp, Homo sapiens
aaggctacttcggggctggg

SEQ ID NO: 1970613 - DNA, 23 bp, Homo sapiens
aaggctacttcggggctgggaag

SEQ ID NO: 1970614 - DNA, 18 bp, Homo sapiens
aaggctctgaaagccagc

SEQ ID NO: 1970615 - DNA, 19 bp, Homo sapiens
aaggctgaccaagagagaa

SEQ ID NO: 1970616 - DNA, 12 bp, Homo sapiens
aaggctggctga

SEQ ID NO: 1970617 - DNA, 20 bp, Homo sapiens
aaggctggctgaaaatcact

SEQ ID NO: 1970618 - DNA, 16 bp, Homo sapiens
aaggctttgccatggg

SEQ ID NO: 1970619 - DNA, 21 bp, Homo sapiens
aagaaacaggggatcaaagtt

SEQ ID NO: 1970620 - DNA, 22 bp, Homo sapiens
aagaaacaggggatcaaagttc

SEQ ID NO: 1970621 - DNA, 22 bp, Homo sapiens
aagaaacgtacttaactgtgtg

SEQ ID NO: 1970622 - DNA, 19 bp, Homo sapiens
aagaaactgaggaattttc

SEQ ID NO: 1970623 - DNA, 23 bp, Homo sapiens
aagaaactttctttctcactaaa

SEQ ID NO: 1970624 - DNA, 15 bp, Homo sapiens
aagaaagaaggaagt

SEQ ID NO: 1970625 - DNA, 20 bp, Homo sapiens
aagaaagcacctgtttttac

SEQ ID NO: 1970626 - DNA, 20 bp, Homo sapiens
aagaaagccgtactgtctat

SEQ ID NO: 1970627 - DNA, 17 bp, Homo sapiens
aagaaagctggtaaact

SEQ ID NO: 1970628 - DNA, 17 bp, Homo sapiens
aagaaagtgcagaatca

SEQ ID NO: 1970629 - DNA, 18 bp, Homo sapiens
aagaaagtgcagaatcaa

SEQ ID NO: 1970630 - DNA, 13 bp, Homo sapiens
aagaaataaaaat

SEQ ID NO: 1970631 - DNA, 16 bp, Homo sapiens
aagaaatgcaaaaatc

SEQ ID NO: 1970632 - DNA, 14 bp, Homo sapiens
aagaaatgtaaggg

SEQ ID NO: 1970633 - DNA, 14 bp, Homo sapiens
aagaaattcctgta

SEQ ID NO: 1970634 - DNA, 17 bp, Homo sapiens
aagaaattcctgtagca

SEQ ID NO: 1970635 - DNA, 16 bp, Homo sapiens
aagaaattgtttcttt

SEQ ID NO: 1970636 - DNA, 14 bp, Homo sapiens
aagaacaacaacaa

SEQ ID NO: 1970637 - DNA, 21 bp, Homo sapiens
aagaacaattgtccatggtct

SEQ ID NO: 1970638 - DNA, 19 bp, Homo sapiens
aagaacaccctatattttg

SEQ ID NO: 1970639 - DNA, 21 bp, Homo sapiens
aagaacaccctatattttgca

SEQ ID NO: 1970640 - DNA, 22 bp, Homo sapiens
aagaaccaaaagttttcctgag

SEQ ID NO: 1970641 - DNA, 13 bp, Homo sapiens
aagaactccttat

SEQ ID NO: 1970642 - DNA, 23 bp, Homo sapiens
aagaacttgatatatttcattct

SEQ ID NO: 1970643 - DNA, 17 bp, Homo sapiens
aagaagacatggagact

SEQ ID NO: 1970644 - DNA, 19 bp, Homo sapiens
aagaagaccagactgtgga

SEQ ID NO: 1970645 - DNA, 21 bp, Homo sapiens
aagaagaccagactgtggaga

SEQ ID NO: 1970646 - DNA, 15 bp, Homo sapiens
aagaagagtttgcaa

SEQ ID NO: 1970647 - DNA, 16 bp, Homo sapiens
aagaagcaaataaata

SEQ ID NO: 1970648 - DNA, 22 bp, Homo sapiens
aagaagctcccagatgctgggg

SEQ ID NO: 1970649 - DNA, 15 bp, Homo sapiens
aagaaggcaaaaata

SEQ ID NO: 1970650 - DNA, 19 bp, Homo sapiens
aagaaggcaaaaatagttt

SEQ ID NO: 1970651 - DNA, 23 bp, Homo sapiens
aagaaggcacaggtgtaaatata

SEQ ID NO: 1970652 - DNA, 19 bp, Homo sapiens
aagaaggcagcaggtggca

SEQ ID NO: 1970653 - DNA, 17 bp, Homo sapiens
aagaagggaaattcaca

SEQ ID NO: 1970654 - DNA, 13 bp, Homo sapiens
aagaagtaaattt

SEQ ID NO: 1970655 - DNA, 21 bp, Homo sapiens
aagaagtcataaacagcattt

SEQ ID NO: 1970656 - DNA, 22 bp, Homo sapiens
aagaatacaaacatatttgtta

SEQ ID NO: 1970657 - DNA, 18 bp, Homo sapiens
aagaatacagaaaatgct

SEQ ID NO: 1970658 - DNA, 17 bp, Homo sapiens
aagaatactagaatggt

SEQ ID NO: 1970659 - DNA, 12 bp, Homo sapiens
aagaatacttct

SEQ ID NO: 1970660 - DNA, 12 bp, Homo sapiens
aagaataggtca

SEQ ID NO: 1970661 - DNA, 19 bp, Homo sapiens
aagaatataaagttaaaaa

SEQ ID NO: 1970662 - DNA, 16 bp, Homo sapiens
aagaatattcaaatgt

SEQ ID NO: 1970663 - DNA, 13 bp, Homo sapiens
aagaatattgtat

SEQ ID NO: 1970664 - DNA, 12 bp, Homo sapiens
aagaatattgtt

SEQ ID NO: 1970665 - DNA, 13 bp, Homo sapiens
aagaatattttaa

SEQ ID NO: 1970666 - DNA, 19 bp, Homo sapiens
aagaatcacctcaaattgt

SEQ ID NO: 1970667 - DNA, 20 bp, Homo sapiens
aagaatctcatctcagtgaa

SEQ ID NO: 1970668 - DNA, 21 bp, Homo sapiens
aagaatgcagattcctgggcc

SEQ ID NO: 1970669 - DNA, 19 bp, Homo sapiens
aagaatgctggttttccta

SEQ ID NO: 1970670 - DNA, 19 bp, Homo sapiens
aagaatgttaagacttgac

SEQ ID NO: 1970671 - DNA, 19 bp, Homo sapiens
aagaattcctgaagccaga

SEQ ID NO: 1970672 - DNA, 16 bp, Homo sapiens
aagaattgaacccagg

SEQ ID NO: 1970673 - DNA, 18 bp, Homo sapiens
aagaattgaacccaggag

SEQ ID NO: 1970674 - DNA, 19 bp, Homo sapiens
aagaattgaacccaggagg

SEQ ID NO: 1970675 - DNA, 23 bp, Homo sapiens
aagaatttcttggtaagaagccg

SEQ ID NO: 1970676 - DNA, 20 bp, Homo sapiens
aagacaaaccactgtacata

SEQ ID NO: 1970677 - DNA, 13 bp, Homo sapiens
aagacaagaatat

SEQ ID NO: 1970678 - DNA, 20 bp, Homo sapiens
aagacaagaatatgttcaca

SEQ ID NO: 1970679 - DNA, 14 bp, Homo sapiens
aagacacacctctg

SEQ ID NO: 1970680 - DNA, 15 bp, Homo sapiens
aagacagagctggga

SEQ ID NO: 1970681 - DNA, 14 bp, Homo sapiens
aagacagtgtgtgt

SEQ ID NO: 1970682 - DNA, 15 bp, Homo sapiens
aagacagtgtgtgtg

SEQ ID NO: 1970683 - DNA, 21 bp, Homo sapiens
aagaccagggcttttcccagg

SEQ ID NO: 1970684 - DNA, 14 bp, Homo sapiens
aagaccccagcttc

SEQ ID NO: 1970685 - DNA, 20 bp, Homo sapiens
aagacctaaatgacctcagc

SEQ ID NO: 1970686 - DNA, 21 bp, Homo sapiens
aagacctaaatgacctcagca

SEQ ID NO: 1970687 - DNA, 19 bp, Homo sapiens
aagaccttctgaagatctc

SEQ ID NO: 1970688 - DNA, 22 bp, Homo sapiens
aagacgtcctggaatgaagcat

SEQ ID NO: 1970689 - DNA, 20 bp, Homo sapiens
aagacgtgatgccaggacca

SEQ ID NO: 1970690 - DNA, 16 bp, Homo sapiens
aagactaatttaaaaa

SEQ ID NO: 1970691 - DNA, 21 bp, Homo sapiens
aagactattaagagcaataaa

SEQ ID NO: 1970692 - DNA, 21 bp, Homo sapiens
aagactcaagtgggaacgact

SEQ ID NO: 1970693 - DNA, 23 bp, Homo sapiens
aagactcaagtgggaacgactgg

SEQ ID NO: 1970694 - DNA, 16 bp, Homo sapiens
aagactccaaagaaat

SEQ ID NO: 1970695 - DNA, 19 bp, Homo sapiens
aagactgagcacctgcttc

SEQ ID NO: 1970696 - DNA, 12 bp, Homo sapiens
aagactgtggct

SEQ ID NO: 1970697 - DNA, 16 bp, Homo sapiens
aagactgttgctcaaa

SEQ ID NO: 1970698 - DNA, 17 bp, Homo sapiens
aagactgttgctcaaat

SEQ ID NO: 1970699 - DNA, 24 bp, Homo sapiens
aagactgttgctcaaatctattca

SEQ ID NO: 1970700 - DNA, 17 bp, Homo sapiens
aagacttaaatagttca

SEQ ID NO: 1970701 - DNA, 13 bp, Homo sapiens
aagacttcatgtt

SEQ ID NO: 1970702 - DNA, 20 bp, Homo sapiens
aagacttggcaacagaagca

SEQ ID NO: 1970703 - DNA, 22 bp, Homo sapiens
aagagaaaaaaagtttgccaga

SEQ ID NO: 1970704 - DNA, 17 bp, Homo sapiens
aagagaaaaagaaatgc

SEQ ID NO: 1970705 - DNA, 15 bp, Homo sapiens
aagagaagaaaaaat

SEQ ID NO: 1970706 - DNA, 12 bp, Homo sapiens
aagagaagctga

SEQ ID NO: 1970707 - DNA, 13 bp, Homo sapiens
aagagaaggagca

SEQ ID NO: 1970708 - DNA, 13 bp, Homo sapiens
aagagacagagcc

SEQ ID NO: 1970709 - DNA, 17 bp, Homo sapiens
aagagacagagccccca

SEQ ID NO: 1970710 - DNA, 17 bp, Homo sapiens
aagagacagttatttat

SEQ ID NO: 1970711 - DNA, 13 bp, Homo sapiens
aagagaccagcac

SEQ ID NO: 1970712 - DNA, 19 bp, Homo sapiens
aagagactaatagagacac

SEQ ID NO: 1970713 - DNA, 16 bp, Homo sapiens
aagagactctggcctc

SEQ ID NO: 1970714 - DNA, 16 bp, Homo sapiens
aagagagattggattt

SEQ ID NO: 1970715 - DNA, 15 bp, Homo sapiens
aagagagccctggtc

SEQ ID NO: 1970716 - DNA, 15 bp, Homo sapiens
aagagaggacacaaa

SEQ ID NO: 1970717 - DNA, 13 bp, Homo sapiens
aagagaggcacct

SEQ ID NO: 1970718 - DNA, 16 bp, Homo sapiens
aagagaggcacctgct

SEQ ID NO: 1970719 - DNA, 21 bp, Homo sapiens
aagagagggccatgcaattca

SEQ ID NO: 1970720 - DNA, 15 bp, Homo sapiens
aagagatcaggaaga

SEQ ID NO: 1970721 - DNA, 16 bp, Homo sapiens
aagagatcaggaagag

SEQ ID NO: 1970722 - DNA, 13 bp, Homo sapiens
aagagatgaagag

SEQ ID NO: 1970723 - DNA, 20 bp, Homo sapiens
aagagatgggcttgttttct

SEQ ID NO: 1970724 - DNA, 20 bp, Homo sapiens
aagagatgtagcagaataat

SEQ ID NO: 1970725 - DNA, 14 bp, Homo sapiens
aagagatgtggcaa

SEQ ID NO: 1970726 - DNA, 13 bp, Homo sapiens
aagagcaaaatga

SEQ ID NO: 1970727 - DNA, 14 bp, Homo sapiens
aagagcagcctgat

SEQ ID NO: 1970728 - DNA, 19 bp, Homo sapiens
aagagcagcctgatggcca

SEQ ID NO: 1970729 - DNA, 20 bp, Homo sapiens
aagagcagcctgatggccaa

SEQ ID NO: 1970730 - DNA, 15 bp, Homo sapiens
aagagcatcatgcct

SEQ ID NO: 1970731 - DNA, 18 bp, Homo sapiens
aagagcatcatgcctctg

SEQ ID NO: 1970732 - DNA, 24 bp, Homo sapiens
aagagcatcatgcctctgaggcca

SEQ ID NO: 1970733 - DNA, 14 bp, Homo sapiens
aagagccctgagct

SEQ ID NO: 1970734 - DNA, 11 bp, Homo sapiens
aagagcctgga

SEQ ID NO: 1970735 - DNA, 21 bp, Homo sapiens
aagagcctggagaagctgatg

SEQ ID NO: 1970736 - DNA, 14 bp, Homo sapiens
aagagctacataat

SEQ ID NO: 1970737 - DNA, 20 bp, Homo sapiens
aagagctacgtatttaatag

SEQ ID NO: 1970738 - DNA, 19 bp, Homo sapiens
aagagctagcgctgccgca

SEQ ID NO: 1970739 - DNA, 11 bp, Homo sapiens
aagagctgctg

SEQ ID NO: 1970740 - DNA, 18 bp, Homo sapiens
aagagctgttcacagcca

SEQ ID NO: 1970741 - DNA, 14 bp, Homo sapiens
aagaggaagagaga

SEQ ID NO: 1970742 - DNA, 15 bp, Homo sapiens
aagaggaagcaagaa

SEQ ID NO: 1970743 - DNA, 15 bp, Homo sapiens
aagaggaggagggat

SEQ ID NO: 1970744 - DNA, 21 bp, Homo sapiens
aagaggagtttcgaggtagag

SEQ ID NO: 1970745 - DNA, 18 bp, Homo sapiens
aagaggcacctgtcccag

SEQ ID NO: 1970746 - DNA, 15 bp, Homo sapiens
aagaggcgacttcct

SEQ ID NO: 1970747 - DNA, 13 bp, Homo sapiens
aagaggctgaggc

SEQ ID NO: 1970748 - DNA, 17 bp, Homo sapiens
aagaggctggtgctgtg

SEQ ID NO: 1970749 - DNA, 15 bp, Homo sapiens
aagagggaggcttcc

SEQ ID NO: 1970750 - DNA, 19 bp, Homo sapiens
aagagggcctgtgggagcc

SEQ ID NO: 1970751 - DNA, 19 bp, Homo sapiens
aagaggggaccagaagcca

SEQ ID NO: 1970752 - DNA, 15 bp, Homo sapiens
aagaggtctgagccc

SEQ ID NO: 1970753 - DNA, 18 bp, Homo sapiens
aagaggtctgagccctgg

SEQ ID NO: 1970754 - DNA, 22 bp, Homo sapiens
aagaggtctgagccctggtgtg

SEQ ID NO: 1970755 - DNA, 18 bp, Homo sapiens
aagaggtgaccccagggc

SEQ ID NO: 1970756 - DNA, 19 bp, Homo sapiens
aagaggtgaccccagggca

SEQ ID NO: 1970757 - DNA, 20 bp, Homo sapiens
aagaggtgaccccagggcac

SEQ ID NO: 1970758 - DNA, 21 bp, Homo sapiens
aagaggtgaccccagggcaca

SEQ ID NO: 1970759 - DNA, 22 bp, Homo sapiens
aagaggtgaccccagggcacag

SEQ ID NO: 1970760 - DNA, 13 bp, Homo sapiens
aagaggtggggac

SEQ ID NO: 1970761 - DNA, 15 bp, Homo sapiens
aagaggtggggacca

SEQ ID NO: 1970762 - DNA, 21 bp, Homo sapiens
aagagtttaactttgggccca

SEQ ID NO: 1970763 - DNA, 18 bp, Homo sapiens
aagataaaatatcctcag

SEQ ID NO: 1970764 - DNA, 17 bp, Homo sapiens
aagataaagatgatcta

SEQ ID NO: 1970765 - DNA, 15 bp, Homo sapiens
aagataacttgagca

SEQ ID NO: 1970766 - DNA, 12 bp, Homo sapiens
aagataatgttc

SEQ ID NO: 1970767 - DNA, 18 bp, Homo sapiens
aagatacactcctgctgt

SEQ ID NO: 1970768 - DNA, 15 bp, Homo sapiens
aagatagcagggcat

SEQ ID NO: 1970769 - DNA, 17 bp, Homo sapiens
aagatatcagagctctt

SEQ ID NO: 1970770 - DNA, 18 bp, Homo sapiens
aagatatcagagctctta

SEQ ID NO: 1970771 - DNA, 20 bp, Homo sapiens
aagatatcagagctcttaat

SEQ ID NO: 1970772 - DNA, 22 bp, Homo sapiens
aagatcaaaagcttattcatct

SEQ ID NO: 1970773 - DNA, 20 bp, Homo sapiens
aagatcgcgccactgcactc

SEQ ID NO: 1970774 - DNA, 18 bp, Homo sapiens
aagatctcagataaagtg

SEQ ID NO: 1970775 - DNA, 23 bp, Homo sapiens
aagatctgcagggggtgtgtctg

SEQ ID NO: 1970776 - DNA, 15 bp, Homo sapiens
aagatcttgtctcca

SEQ ID NO: 1970777 - DNA, 21 bp, Homo sapiens
aagatcttttaaaaaggcagt

SEQ ID NO: 1970778 - DNA, 20 bp, Homo sapiens
aagatgaaaaatggtccctt

SEQ ID NO: 1970779 - DNA, 13 bp, Homo sapiens
aagatgaaaatat

SEQ ID NO: 1970780 - DNA, 21 bp, Homo sapiens
aagatgaattttatcagccat

SEQ ID NO: 1970781 - DNA, 13 bp, Homo sapiens
aagatgacacaag

SEQ ID NO: 1970782 - DNA, 16 bp, Homo sapiens
aagatggactctgaaa

SEQ ID NO: 1970783 - DNA, 18 bp, Homo sapiens
aagatggctgtgcctctg

SEQ ID NO: 1970784 - DNA, 15 bp, Homo sapiens
aagatgggcacatga

SEQ ID NO: 1970785 - DNA, 13 bp, Homo sapiens
aagatgtaaggaa

SEQ ID NO: 1970786 - DNA, 18 bp, Homo sapiens
aagatgtcaaatatctca

SEQ ID NO: 1970787 - DNA, 16 bp, Homo sapiens
aagatgtcagactggc

SEQ ID NO: 1970788 - DNA, 20 bp, Homo sapiens
aagatgtcctccttgttcta

SEQ ID NO: 1970789 - DNA, 12 bp, Homo sapiens
aagatgtgttgt

SEQ ID NO: 1970790 - DNA, 16 bp, Homo sapiens
aagattaaaattagtg

SEQ ID NO: 1970791 - DNA, 17 bp, Homo sapiens
aagattaaaattagtga

SEQ ID NO: 1970792 - DNA, 18 bp, Homo sapiens
aagattaaaggaaggaaa

SEQ ID NO: 1970793 - DNA, 13 bp, Homo sapiens
aagattagaatga

SEQ ID NO: 1970794 - DNA, 20 bp, Homo sapiens
aagattatatatcataaagt

SEQ ID NO: 1970795 - DNA, 24 bp, Homo sapiens
aagattatattataataatgttct

SEQ ID NO: 1970796 - DNA, 14 bp, Homo sapiens
aagattcccagaga

SEQ ID NO: 1970797 - DNA, 15 bp, Homo sapiens
aagattcccagagac

SEQ ID NO: 1970798 - DNA, 18 bp, Homo sapiens
aagattcccagagacagg

SEQ ID NO: 1970799 - DNA, 20 bp, Homo sapiens
aagattggacatggtctcct

SEQ ID NO: 1970800 - DNA, 14 bp, Homo sapiens
aagattgtaattca

SEQ ID NO: 1970801 - DNA, 13 bp, Homo sapiens
aagattgttttat

SEQ ID NO: 1970802 - DNA, 13 bp, Homo sapiens
aagattttaaatt

SEQ ID NO: 1970803 - DNA, 14 bp, Homo sapiens
aagattttttaata

SEQ ID NO: 1970804 - DNA, 14 bp, Homo sapiens
aagattttttttgt

SEQ ID NO: 1970805 - DNA, 15 bp, Homo sapiens
aagattttttttgta

SEQ ID NO: 1970806 - DNA, 22 bp, Homo sapiens
aagcaaaattataagaagagga

SEQ ID NO: 1970807 - DNA, 13 bp, Homo sapiens
aagcaaataaata

SEQ ID NO: 1970808 - DNA, 14 bp, Homo sapiens
aagcaaataaatat

SEQ ID NO: 1970809 - DNA, 15 bp, Homo sapiens
aagcaacctcagtaa

SEQ ID NO: 1970810 - DNA, 22 bp, Homo sapiens
aagcaacctcagtaatttagaa

SEQ ID NO: 1970811 - DNA, 19 bp, Homo sapiens
aagcaacctcccaacccag

SEQ ID NO: 1970812 - DNA, 14 bp, Homo sapiens
aagcaactcacacg

SEQ ID NO: 1970813 - DNA, 18 bp, Homo sapiens
aagcaacttgcttctaaa

SEQ ID NO: 1970814 - DNA, 17 bp, Homo sapiens
aagcaagaaagccgtac

SEQ ID NO: 1970815 - DNA, 15 bp, Homo sapiens
aagcaagcattcaga

SEQ ID NO: 1970816 - DNA, 13 bp, Homo sapiens
aagcaatatttcc

SEQ ID NO: 1970817 - DNA, 13 bp, Homo sapiens
aagcaattatatt

SEQ ID NO: 1970818 - DNA, 16 bp, Homo sapiens
aagcacaaagctcaag

SEQ ID NO: 1970819 - DNA, 21 bp, Homo sapiens
aagcacaatgtctcacatggg

SEQ ID NO: 1970820 - DNA, 18 bp, Homo sapiens
aagcacaggagacactgt

SEQ ID NO: 1970821 - DNA, 20 bp, Homo sapiens
aagcaccagcttctccaggc

SEQ ID NO: 1970822 - DNA, 13 bp, Homo sapiens
aagcaccctgttc

SEQ ID NO: 1970823 - DNA, 16 bp, Homo sapiens
aagcaccgcagcatgt

SEQ ID NO: 1970824 - DNA, 17 bp, Homo sapiens
aagcacctcctgcctcg

SEQ ID NO: 1970825 - DNA, 19 bp, Homo sapiens
aagcaccttagctggcatt

SEQ ID NO: 1970826 - DNA, 22 bp, Homo sapiens
aagcactgactgggaccaggca

SEQ ID NO: 1970827 - DNA, 16 bp, Homo sapiens
aagcactgacttctaa

SEQ ID NO: 1970828 - DNA, 17 bp, Homo sapiens
aagcactgacttctaag

SEQ ID NO: 1970829 - DNA, 20 bp, Homo sapiens
aagcactgacttctaagtaa

SEQ ID NO: 1970830 - DNA, 20 bp, Homo sapiens
aagcactgctgtgtccgctt

SEQ ID NO: 1970831 - DNA, 19 bp, Homo sapiens
aagcacttgttccttctgc

SEQ ID NO: 1970832 - DNA, 20 bp, Homo sapiens
aagcacttgttccttctgct

SEQ ID NO: 1970833 - DNA, 22 bp, Homo sapiens
aagcacttgttccttctgcttc

SEQ ID NO: 1970834 - DNA, 16 bp, Homo sapiens
aagcactttttaaaaa

SEQ ID NO: 1970835 - DNA, 16 bp, Homo sapiens
aagcagagaggtggag

SEQ ID NO: 1970836 - DNA, 12 bp, Homo sapiens
aagcagccagcc

SEQ ID NO: 1970837 - DNA, 13 bp, Homo sapiens
aagcagcctcctg

SEQ ID NO: 1970838 - DNA, 14 bp, Homo sapiens
aagcagcctttctg

SEQ ID NO: 1970839 - DNA, 18 bp, Homo sapiens
aagcagcctttctgtgga

SEQ ID NO: 1970840 - DNA, 18 bp, Homo sapiens
aagcagggaaagctccac

SEQ ID NO: 1970841 - DNA, 16 bp, Homo sapiens
aagcaggttcttgatg

SEQ ID NO: 1970842 - DNA, 12 bp, Homo sapiens
aagcagtgcctc

SEQ ID NO: 1970843 - DNA, 15 bp, Homo sapiens
aagcagtgccttcca

SEQ ID NO: 1970844 - DNA, 18 bp, Homo sapiens
aagcagtgcttgtaaacc

SEQ ID NO: 1970845 - DNA, 18 bp, Homo sapiens
aagcagtgtgtccttggg

SEQ ID NO: 1970846 - DNA, 13 bp, Homo sapiens
aagcatatttgag

SEQ ID NO: 1970847 - DNA, 15 bp, Homo sapiens
aagcatatttgagaa

SEQ ID NO: 1970848 - DNA, 15 bp, Homo sapiens
aagcatcacctcagg

SEQ ID NO: 1970849 - DNA, 16 bp, Homo sapiens
aagcatcacctcaggc

SEQ ID NO: 1970850 - DNA, 19 bp, Homo sapiens
aagcatcacctcaggccag

SEQ ID NO: 1970851 - DNA, 22 bp, Homo sapiens
aagcatcagagatggtaatcta

SEQ ID NO: 1970852 - DNA, 13 bp, Homo sapiens
aactcctgcctgt

SEQ ID NO: 1970853 - DNA, 16 bp, Homo sapiens
aactcctgcctgtgtt

SEQ ID NO: 1970854 - DNA, 12 bp, Homo sapiens
aactcctggcct

SEQ ID NO: 1970855 - DNA, 18 bp, Homo sapiens
aactcctttagcaggtgg

SEQ ID NO: 1970856 - DNA, 19 bp, Homo sapiens
aactcgaagcccttccagt

SEQ ID NO: 1970857 - DNA, 23 bp, Homo sapiens
aactctaccctggtaggaaagca

SEQ ID NO: 1970858 - DNA, 12 bp, Homo sapiens
aactctccactc

SEQ ID NO: 1970859 - DNA, 22 bp, Homo sapiens
aactctcgggacctcgtttggg

SEQ ID NO: 1970860 - DNA, 12 bp, Homo sapiens
aactctctccac

SEQ ID NO: 1970861 - DNA, 22 bp, Homo sapiens
aactctgacaagggctgacctg

SEQ ID NO: 1970862 - DNA, 22 bp, Homo sapiens
aactctgcactccatggccacc

SEQ ID NO: 1970863 - DNA, 23 bp, Homo sapiens
aactctgcactccatggccaccc

SEQ ID NO: 1970864 - DNA, 16 bp, Homo sapiens
aactctgcattctagt

SEQ ID NO: 1970865 - DNA, 18 bp, Homo sapiens
aactctggcttccaggta

SEQ ID NO: 1970866 - DNA, 14 bp, Homo sapiens
aactcttcattttg

SEQ ID NO: 1970867 - DNA, 22 bp, Homo sapiens
aactcttcattttgagtctcag

SEQ ID NO: 1970868 - DNA, 20 bp, Homo sapiens
aactgaaaagactcagtgtt

SEQ ID NO: 1970869 - DNA, 13 bp, Homo sapiens
aactgaagaagga

SEQ ID NO: 1970870 - DNA, 17 bp, Homo sapiens
aactgaagacctccaca

SEQ ID NO: 1970871 - DNA, 13 bp, Homo sapiens
aactgaaggagaa

SEQ ID NO: 1970872 - DNA, 19 bp, Homo sapiens
aactgaagggggcggccta

SEQ ID NO: 1970873 - DNA, 22 bp, Homo sapiens
aactgaatggaaggtttgtata

SEQ ID NO: 1970874 - DNA, 13 bp, Homo sapiens
aactgacacagga

SEQ ID NO: 1970875 - DNA, 17 bp, Homo sapiens
aactgagaaatgaatgc

SEQ ID NO: 1970876 - DNA, 16 bp, Homo sapiens
aactgagcctagctac

SEQ ID NO: 1970877 - DNA, 18 bp, Homo sapiens
aactgagcctcttttcaa

SEQ ID NO: 1970878 - DNA, 18 bp, Homo sapiens
aactgaggaattttcttt

SEQ ID NO: 1970879 - DNA, 20 bp, Homo sapiens
aactgaggcagacagcagct

SEQ ID NO: 1970880 - DNA, 18 bp, Homo sapiens
aactgagtaaattggaaa

SEQ ID NO: 1970881 - DNA, 16 bp, Homo sapiens
aactgatcaaaaataa

SEQ ID NO: 1970882 - DNA, 23 bp, Homo sapiens
aactgatggaccgggtgggcctg

SEQ ID NO: 1970883 - DNA, 16 bp, Homo sapiens
aactgcattagaaatt

SEQ ID NO: 1970884 - DNA, 14 bp, Homo sapiens
aactgccccgggtg

SEQ ID NO: 1970885 - DNA, 15 bp, Homo sapiens
aactgctaaatactg

SEQ ID NO: 1970886 - DNA, 14 bp, Homo sapiens
aactgctctgccca

SEQ ID NO: 1970887 - DNA, 12 bp, Homo sapiens
aactgctgagcc

SEQ ID NO: 1970888 - DNA, 13 bp, Homo sapiens
aactgctgagcca

SEQ ID NO: 1970889 - DNA, 20 bp, Homo sapiens
aactgctgttaattgattaa

SEQ ID NO: 1970890 - DNA, 14 bp, Homo sapiens
aactggaaatctgg

SEQ ID NO: 1970891 - DNA, 14 bp, Homo sapiens
aactggaataagaa

SEQ ID NO: 1970892 - DNA, 15 bp, Homo sapiens
aactggaataagaag

SEQ ID NO: 1970893 - DNA, 18 bp, Homo sapiens
aactggacatcacagcag

SEQ ID NO: 1970894 - DNA, 21 bp, Homo sapiens
aactggacatcacagcagaat

SEQ ID NO: 1970895 - DNA, 23 bp, Homo sapiens
aactggacatcacagcagaatga

SEQ ID NO: 1970896 - DNA, 16 bp, Homo sapiens
aactggccaagctgag

SEQ ID NO: 1970897 - DNA, 19 bp, Homo sapiens
aactggccaagctgaggtg

SEQ ID NO: 1970898 - DNA, 21 bp, Homo sapiens
aactggccaagctgaggtgcc

SEQ ID NO: 1970899 - DNA, 17 bp, Homo sapiens
aactggctggccagtct

SEQ ID NO: 1970900 - DNA, 13 bp, Homo sapiens
aactggctgggac

SEQ ID NO: 1970901 - DNA, 19 bp, Homo sapiens
aactggctgtttgatagca

SEQ ID NO: 1970902 - DNA, 23 bp, Homo sapiens
aactggggagttataaaaataca

SEQ ID NO: 1970903 - DNA, 16 bp, Homo sapiens
aactgggggaaaagat

SEQ ID NO: 1970904 - DNA, 13 bp, Homo sapiens
aactggtttagca

SEQ ID NO: 1970905 - DNA, 23 bp, Homo sapiens
aactggtttagcacaatttatat

SEQ ID NO: 1970906 - DNA, 13 bp, Homo sapiens
aactgtaaataca

SEQ ID NO: 1970907 - DNA, 14 bp, Homo sapiens
aactgtaaatacaa

SEQ ID NO: 1970908 - DNA, 23 bp, Homo sapiens
aactgtaaatacaaaataaaatt

SEQ ID NO: 1970909 - DNA, 11 bp, Homo sapiens
aactgtaaatc

SEQ ID NO: 1970910 - DNA, 12 bp, Homo sapiens
aactgtaaatca

SEQ ID NO: 1970911 - DNA, 14 bp, Homo sapiens
aactgtaaatcact

SEQ ID NO: 1970912 - DNA, 18 bp, Homo sapiens
aactgtaaatcacttgta

SEQ ID NO: 1970913 - DNA, 20 bp, Homo sapiens
aactgtaaatcacttgtaaa

SEQ ID NO: 1970914 - DNA, 21 bp, Homo sapiens
aactgtaaatcacttgtaaat

SEQ ID NO: 1970915 - DNA, 20 bp, Homo sapiens
aactgtagataaagtggttt

SEQ ID NO: 1970916 - DNA, 17 bp, Homo sapiens
aactgtcaagtcatgat

SEQ ID NO: 1970917 - DNA, 18 bp, Homo sapiens
aactgtcatctagcccct

SEQ ID NO: 1970918 - DNA, 16 bp, Homo sapiens
aactgtgaacctggag

SEQ ID NO: 1970919 - DNA, 15 bp, Homo sapiens
aactgtgacaggaag

SEQ ID NO: 1970920 - DNA, 16 bp, Homo sapiens
aactgtgccctgcctt

SEQ ID NO: 1970921 - DNA, 16 bp, Homo sapiens
aactgtgtgaagaaat

SEQ ID NO: 1970922 - DNA, 14 bp, Homo sapiens
aactgttgattgca

SEQ ID NO: 1970923 - DNA, 17 bp, Homo sapiens
aactgttggataataac

SEQ ID NO: 1970924 - DNA, 10 bp, Homo sapiens
aactgtttat

SEQ ID NO: 1970925 - DNA, 16 bp, Homo sapiens
aacttaaaatatttta

SEQ ID NO: 1970926 - DNA, 13 bp, Homo sapiens
aacttaaatcact

SEQ ID NO: 1970927 - DNA, 16 bp, Homo sapiens
aacttaacattctgta

SEQ ID NO: 1970928 - DNA, 21 bp, Homo sapiens
aacttaacattctgtaaaatg

SEQ ID NO: 1970929 - DNA, 18 bp, Homo sapiens
aacttaatagtatttatg

SEQ ID NO: 1970930 - DNA, 19 bp, Homo sapiens
aacttacctgggcattctt

SEQ ID NO: 1970931 - DNA, 19 bp, Homo sapiens
aacttagcatgtgttgaaa

SEQ ID NO: 1970932 - DNA, 23 bp, Homo sapiens
aacttatatcatcagcatacctt

SEQ ID NO: 1970933 - DNA, 21 bp, Homo sapiens
aacttatctagaaagaaaaga

SEQ ID NO: 1970934 - DNA, 16 bp, Homo sapiens
aacttcaaatatagag

SEQ ID NO: 1970935 - DNA, 16 bp, Homo sapiens
aacttcagagaagtca

SEQ ID NO: 1970936 - DNA, 12 bp, Homo sapiens
aacttcagcacc

SEQ ID NO: 1970937 - DNA, 15 bp, Homo sapiens
aacttcataaatgtt

SEQ ID NO: 1970938 - DNA, 22 bp, Homo sapiens
aacttccttggactcattttaa

SEQ ID NO: 1970939 - DNA, 14 bp, Homo sapiens
aacttctaatatat

SEQ ID NO: 1970940 - DNA, 19 bp, Homo sapiens
aacttgaaattatatctgt

SEQ ID NO: 1970941 - DNA, 14 bp, Homo sapiens
aacttgaactgatt

SEQ ID NO: 1970942 - DNA, 13 bp, Homo sapiens
aacttgaatctgt

SEQ ID NO: 1970943 - DNA, 13 bp, Homo sapiens
aacttgaggacac

SEQ ID NO: 1970944 - DNA, 14 bp, Homo sapiens
aacttgaggacaca

SEQ ID NO: 1970945 - DNA, 18 bp, Homo sapiens
aacttgaggacacatgtc

SEQ ID NO: 1970946 - DNA, 19 bp, Homo sapiens
aacttgagggtaataaact

SEQ ID NO: 1970947 - DNA, 20 bp, Homo sapiens
aacttgctgaatttcaggca

SEQ ID NO: 1970948 - DNA, 13 bp, Homo sapiens
aacttgcttctaa

SEQ ID NO: 1970949 - DNA, 21 bp, Homo sapiens
aacttggttttgctacataat

SEQ ID NO: 1970950 - DNA, 17 bp, Homo sapiens
aacttgtatctgaagac

SEQ ID NO: 1970951 - DNA, 20 bp, Homo sapiens
aacttgtcaaaaaacaaaaa

SEQ ID NO: 1970952 - DNA, 21 bp, Homo sapiens
aacttgtcctatgtcaatttg

SEQ ID NO: 1970953 - DNA, 21 bp, Homo sapiens
aactttatcacattatttgca

SEQ ID NO: 1970954 - DNA, 13 bp, Homo sapiens
aactttcattttt

SEQ ID NO: 1970955 - DNA, 18 bp, Homo sapiens
aactttctcttcatactt

SEQ ID NO: 1970956 - DNA, 12 bp, Homo sapiens
aactttgatctc

SEQ ID NO: 1970957 - DNA, 17 bp, Homo sapiens
aactttgatctctgctt

SEQ ID NO: 1970958 - DNA, 17 bp, Homo sapiens
aacttttaatgccttcc

SEQ ID NO: 1970959 - DNA, 21 bp, Homo sapiens
aacttttaatgccttccacat

SEQ ID NO: 1970960 - DNA, 11 bp, Homo sapiens
aacttttgtaa

SEQ ID NO: 1970961 - DNA, 13 bp, Homo sapiens
aagaaaaaaatat

SEQ ID NO: 1970962 - DNA, 16 bp, Homo sapiens
aagaaaaaatacattt

SEQ ID NO: 1970963 - DNA, 15 bp, Homo sapiens
aagaaaaagaagcaa

SEQ ID NO: 1970964 - DNA, 15 bp, Homo sapiens
aagaaaaagttgcag

SEQ ID NO: 1970965 - DNA, 19 bp, Homo sapiens
aagaaaagcactttttaaa

SEQ ID NO: 1970966 - DNA, 22 bp, Homo sapiens
aagaaacactcaacaataaaga

SEQ ID NO: 1970967 - DNA, 16 bp, Homo sapiens
aagaaacagataccat

SEQ ID NO: 1970968 - DNA, 20 bp, Homo sapiens
aagaaacaggggatcaaagt

SEQ ID NO: 1970969 - DNA, 16 bp, Homo sapiens
aacaggaatctcagag

SEQ ID NO: 1970970 - DNA, 19 bp, Homo sapiens
aacaggacttaaaatgaca

SEQ ID NO: 1970971 - DNA, 13 bp, Homo sapiens
aacaggcattcca

SEQ ID NO: 1970972 - DNA, 20 bp, Homo sapiens
aacaggctcaatattcctga

SEQ ID NO: 1970973 - DNA, 23 bp, Homo sapiens
aacagggaaggcaggcagggctc

SEQ ID NO: 1970974 - DNA, 14 bp, Homo sapiens
aacagggagactgc

SEQ ID NO: 1970975 - DNA, 15 bp, Homo sapiens
aacagggcagtgaca

SEQ ID NO: 1970976 - DNA, 13 bp, Homo sapiens
aacaggtctcctc

SEQ ID NO: 1970977 - DNA, 20 bp, Homo sapiens
aacaggtctcctcttaaaaa

SEQ ID NO: 1970978 - DNA, 14 bp, Homo sapiens
aacaggtggagaaa

SEQ ID NO: 1970979 - DNA, 16 bp, Homo sapiens
aacaggtggcaggacc

SEQ ID NO: 1970980 - DNA, 23 bp, Homo sapiens
aacaggtggcaggaccaggacta

SEQ ID NO: 1970981 - DNA, 17 bp, Homo sapiens
aacagtcaaaacagaga

SEQ ID NO: 1970982 - DNA, 20 bp, Homo sapiens
aacagtcatgaggcagcttt

SEQ ID NO: 1970983 - DNA, 21 bp, Homo sapiens
aacagtgagcctgaattttgt

SEQ ID NO: 1970984 - DNA, 18 bp, Homo sapiens
aacagtgtttcccataat

SEQ ID NO: 1970985 - DNA, 20 bp, Homo sapiens
aacagttaactttcagaaga

SEQ ID NO: 1970986 - DNA, 16 bp, Homo sapiens
aacagttagctggagc

SEQ ID NO: 1970987 - DNA, 14 bp, Homo sapiens
aacagttccttcag

SEQ ID NO: 1970988 - DNA, 13 bp, Homo sapiens
aacagtttgtaca

SEQ ID NO: 1970989 - DNA, 14 bp, Homo sapiens
aacagtttgtacag

SEQ ID NO: 1970990 - DNA, 21 bp, Homo sapiens
aacagttttttatgctaatca

SEQ ID NO: 1970991 - DNA, 16 bp, Homo sapiens
aacataaaacaatgaa

SEQ ID NO: 1970992 - DNA, 16 bp, Homo sapiens
aacataaaatctgtga

SEQ ID NO: 1970993 - DNA, 19 bp, Homo sapiens
aacatacccttctttaaat

SEQ ID NO: 1970994 - DNA, 21 bp, Homo sapiens
aacatacccttctttaaatca

SEQ ID NO: 1970995 - DNA, 22 bp, Homo sapiens
aacatacccttctttaaatcaa

SEQ ID NO: 1970996 - DNA, 18 bp, Homo sapiens
aacatataatgttgttat

SEQ ID NO: 1970997 - DNA, 13 bp, Homo sapiens
aacatatcaattc

SEQ ID NO: 1970998 - DNA, 22 bp, Homo sapiens
aacatcctaagtgggaagtgaa

SEQ ID NO: 1970999 - DNA, 13 bp, Homo sapiens
aacatctcacttt

SEQ ID NO: 1971000 - DNA, 16 bp, Homo sapiens
aacatctttgaaaaga

SEQ ID NO: 1971001 - DNA, 21 bp, Homo sapiens
aacatctttttcctccctttc

SEQ ID NO: 1971002 - DNA, 16 bp, Homo sapiens
aacatgagaaatgtga

SEQ ID NO: 1971003 - DNA, 14 bp, Homo sapiens
aacatgatgtgaga

SEQ ID NO: 1971004 - DNA, 20 bp, Homo sapiens
aacatgcacatttatatata

SEQ ID NO: 1971005 - DNA, 15 bp, Homo sapiens
aacatgcctgatttt

SEQ ID NO: 1971006 - DNA, 15 bp, Homo sapiens
aacatgggcattggg

SEQ ID NO: 1971007 - DNA, 20 bp, Homo sapiens
aacatggttttgaaatgctt

SEQ ID NO: 1971008 - DNA, 20 bp, Homo sapiens
aacatgtttacttttcaggg

SEQ ID NO: 1971009 - DNA, 15 bp, Homo sapiens
aacattaaacactgt

SEQ ID NO: 1971010 - DNA, 15 bp, Homo sapiens
aacattaaatgtctt

SEQ ID NO: 1971011 - DNA, 21 bp, Homo sapiens
aacattatagattttcatgtt

SEQ ID NO: 1971012 - DNA, 17 bp, Homo sapiens
aacattcaaagcagcag

SEQ ID NO: 1971013 - DNA, 19 bp, Homo sapiens
aacattgacttcttggttt

SEQ ID NO: 1971014 - DNA, 19 bp, Homo sapiens
aacattgttgctccctgtg

SEQ ID NO: 1971015 - DNA, 18 bp, Homo sapiens
aacatttatctaaaagaa

SEQ ID NO: 1971016 - DNA, 20 bp, Homo sapiens
aacatttatctaaaagaatt

SEQ ID NO: 1971017 - DNA, 19 bp, Homo sapiens
aacatttcttaaaatgttt

SEQ ID NO: 1971018 - DNA, 20 bp, Homo sapiens
aacatttcttatgattttta

SEQ ID NO: 1971019 - DNA, 23 bp, Homo sapiens
aaccaaagagactggagcatctg

SEQ ID NO: 1971020 - DNA, 17 bp, Homo sapiens
aaccaaccacaaaccac

SEQ ID NO: 1971021 - DNA, 17 bp, Homo sapiens
aaccaactatttttgag

SEQ ID NO: 1971022 - DNA, 14 bp, Homo sapiens
aaccaagcttcaga

SEQ ID NO: 1971023 - DNA, 16 bp, Homo sapiens
aaccaagcttcagagc

SEQ ID NO: 1971024 - DNA, 18 bp, Homo sapiens
aaccaagcttcagagcct

SEQ ID NO: 1971025 - DNA, 13 bp, Homo sapiens
aaccaaggcagcc

SEQ ID NO: 1971026 - DNA, 15 bp, Homo sapiens
aaccaaggcagcctc

SEQ ID NO: 1971027 - DNA, 23 bp, Homo sapiens
aaccaatcccgtgaaagaattat

SEQ ID NO: 1971028 - DNA, 18 bp, Homo sapiens
aaccaatgattcataaca

SEQ ID NO: 1971029 - DNA, 23 bp, Homo sapiens
aaccaatgattcataacaatgta

SEQ ID NO: 1971030 - DNA, 17 bp, Homo sapiens
aaccacactgttgagtt

SEQ ID NO: 1971031 - DNA, 15 bp, Homo sapiens
aaccacacttcttga

SEQ ID NO: 1971032 - DNA, 18 bp, Homo sapiens
aaccacaggcccttgggg

SEQ ID NO: 1971033 - DNA, 22 bp, Homo sapiens
aaccacatacaacacaaagaga

SEQ ID NO: 1971034 - DNA, 18 bp, Homo sapiens
aaccacatcttgctctgc

SEQ ID NO: 1971035 - DNA, 13 bp, Homo sapiens
aaccacgctggac

SEQ ID NO: 1971036 - DNA, 21 bp, Homo sapiens
aaccacgtgttttgacatcat

SEQ ID NO: 1971037 - DNA, 15 bp, Homo sapiens
aaccactgtaaaatg

SEQ ID NO: 1971038 - DNA, 12 bp, Homo sapiens
aaccactgtaca

SEQ ID NO: 1971039 - DNA, 13 bp, Homo sapiens
aaccactgtacat

SEQ ID NO: 1971040 - DNA, 14 bp, Homo sapiens
aaccactgtacata

SEQ ID NO: 1971041 - DNA, 19 bp, Homo sapiens
aaccacttaaaaaatgtcc

SEQ ID NO: 1971042 - DNA, 17 bp, Homo sapiens
aaccagaatcataattt

SEQ ID NO: 1971043 - DNA, 11 bp, Homo sapiens
aaccagagccc

SEQ ID NO: 1971044 - DNA, 13 bp, Homo sapiens
aaccagagccccc

SEQ ID NO: 1971045 - DNA, 14 bp, Homo sapiens
aaccagcagaaaag

SEQ ID NO: 1971046 - DNA, 14 bp, Homo sapiens
aaccagcattttac

SEQ ID NO: 1971047 - DNA, 15 bp, Homo sapiens
aaccagccacacaga

SEQ ID NO: 1971048 - DNA, 22 bp, Homo sapiens
aaccagctgtaacacagctgag

SEQ ID NO: 1971049 - DNA, 16 bp, Homo sapiens
aaccaggactctgccc

SEQ ID NO: 1971050 - DNA, 21 bp, Homo sapiens
aaccagggagcccctttgatg

SEQ ID NO: 1971051 - DNA, 17 bp, Homo sapiens
aaccagtacttctaaga

SEQ ID NO: 1971052 - DNA, 20 bp, Homo sapiens
aaccagtatggaagggaggg

SEQ ID NO: 1971053 - DNA, 14 bp, Homo sapiens
aaccagttatgtga

SEQ ID NO: 1971054 - DNA, 22 bp, Homo sapiens
aaccagtttagatttcaagaaa

SEQ ID NO: 1971055 - DNA, 18 bp, Homo sapiens
aaccagtttcaggtgttt

SEQ ID NO: 1971056 - DNA, 21 bp, Homo sapiens
aaccatgcagcttcatcaatt

SEQ ID NO: 1971057 - DNA, 20 bp, Homo sapiens
aaccatgtagttttaacaga

SEQ ID NO: 1971058 - DNA, 21 bp, Homo sapiens
aaccatgtagttttaacagaa

SEQ ID NO: 1971059 - DNA, 20 bp, Homo sapiens
aaccattacatgtttaaatt

SEQ ID NO: 1971060 - DNA, 13 bp, Homo sapiens
aaccattactgta

SEQ ID NO: 1971061 - DNA, 18 bp, Homo sapiens
aaccatttaattcataat

SEQ ID NO: 1971062 - DNA, 14 bp, Homo sapiens
aaccatttcaaatg

SEQ ID NO: 1971063 - DNA, 14 bp, Homo sapiens
aacccaaaacctca

SEQ ID NO: 1971064 - DNA, 19 bp, Homo sapiens
aacccaccagcctaagaag

SEQ ID NO: 1971065 - DNA, 23 bp, Homo sapiens
aacccaccagcctaagaagctct

SEQ ID NO: 1971066 - DNA, 14 bp, Homo sapiens
aacccacctgctga

SEQ ID NO: 1971067 - DNA, 14 bp, Homo sapiens
aacccagcatgtac

SEQ ID NO: 1971068 - DNA, 15 bp, Homo sapiens
aacccagccctgggg

SEQ ID NO: 1971069 - DNA, 18 bp, Homo sapiens
aacccaggacctctggac

SEQ ID NO: 1971070 - DNA, 15 bp, Homo sapiens
aacccatcagacagg

SEQ ID NO: 1971071 - DNA, 17 bp, Homo sapiens
aacccatcttccccgga

SEQ ID NO: 1971072 - DNA, 15 bp, Homo sapiens
aaccccaacgcacag

SEQ ID NO: 1971073 - DNA, 14 bp, Homo sapiens
aaccccagactcaa

SEQ ID NO: 1971074 - DNA, 11 bp, Homo sapiens
aaccccagctg

SEQ ID NO: 1971075 - DNA, 17 bp, Homo sapiens
aaccccagctggcctct

SEQ ID NO: 1971076 - DNA, 17 bp, Homo sapiens
aaccccagggcccccac

SEQ ID NO: 1971077 - DNA, 23 bp, Homo sapiens
aaccccatcatatgacatgccac

SEQ ID NO: 1971078 - DNA, 13 bp, Homo sapiens
aaccccatgggct

SEQ ID NO: 1971079 - DNA, 19 bp, Homo sapiens
aacccccagcccacagagc

SEQ ID NO: 1971080 - DNA, 14 bp, Homo sapiens
aacccccagcctgc

SEQ ID NO: 1971081 - DNA, 17 bp, Homo sapiens
aacccccagtgccacag

SEQ ID NO: 1971082 - DNA, 15 bp, Homo sapiens
aaccccgcagcccgt

SEQ ID NO: 1971083 - DNA, 17 bp, Homo sapiens
aacccctgtacccagct

SEQ ID NO: 1971084 - DNA, 11 bp, Homo sapiens
aacccctgtgt

SEQ ID NO: 1971085 - DNA, 12 bp, Homo sapiens
aacccctgtgtc

SEQ ID NO: 1971086 - DNA, 14 bp, Homo sapiens
aacccgtgccaagt

SEQ ID NO: 1971087 - DNA, 14 bp, Homo sapiens
aacccgtggaggct

SEQ ID NO: 1971088 - DNA, 15 bp, Homo sapiens
aacccgtggaggctg

SEQ ID NO: 1971089 - DNA, 20 bp, Homo sapiens
aaccctcacatcagagtgac

SEQ ID NO: 1971090 - DNA, 12 bp, Homo sapiens
aaccctcagagc

SEQ ID NO: 1971091 - DNA, 15 bp, Homo sapiens
aaccctcagccttga

SEQ ID NO: 1971092 - DNA, 23 bp, Homo sapiens
aaccctctcttccctattatttc

SEQ ID NO: 1971093 - DNA, 22 bp, Homo sapiens
aaccctgcccacttcagcccag

SEQ ID NO: 1971094 - DNA, 13 bp, Homo sapiens
aaccctgtttcct

SEQ ID NO: 1971095 - DNA, 22 bp, Homo sapiens
aaccctgttttatactgtactt

SEQ ID NO: 1971096 - DNA, 16 bp, Homo sapiens
aacccttgctgctgcc

SEQ ID NO: 1971097 - DNA, 16 bp, Homo sapiens
aaccgctaaaagaaac

SEQ ID NO: 1971098 - DNA, 14 bp, Homo sapiens
aaccgcttgccata

SEQ ID NO: 1971099 - DNA, 17 bp, Homo sapiens
aaccgtggcccttcctg

SEQ ID NO: 1971100 - DNA, 16 bp, Homo sapiens
aaccgtgtccagcaca

SEQ ID NO: 1971101 - DNA, 17 bp, Homo sapiens
aaccgtgtccagcacag

SEQ ID NO: 1971102 - DNA, 15 bp, Homo sapiens
aacctaacccctttc

SEQ ID NO: 1971103 - DNA, 18 bp, Homo sapiens
aacctaaggcaacatttc

SEQ ID NO: 1971104 - DNA, 15 bp, Homo sapiens
aacctagaacttcaa

SEQ ID NO: 1971105 - DNA, 16 bp, Homo sapiens
aacctagaacttcaaa

SEQ ID NO: 1971106 - DNA, 14 bp, Homo sapiens
aacctatccttcca

SEQ ID NO: 1971107 - DNA, 23 bp, Homo sapiens
aacctcactatggtatgctggcc

SEQ ID NO: 1971108 - DNA, 11 bp, Homo sapiens
aacctcacttg

SEQ ID NO: 1971109 - DNA, 17 bp, Homo sapiens
aacctcagccaaacaca

SEQ ID NO: 1971110 - DNA, 18 bp, Homo sapiens
aacctcagccaaacacag

SEQ ID NO: 1971111 - DNA, 17 bp, Homo sapiens
aacctcatggtcatgga

SEQ ID NO: 1971112 - DNA, 21 bp, Homo sapiens
aacctccacagtagcatttct

SEQ ID NO: 1971113 - DNA, 19 bp, Homo sapiens
aacctccccgcagagctcc

SEQ ID NO: 1971114 - DNA, 17 bp, Homo sapiens
aacctctctaagccaca

SEQ ID NO: 1971115 - DNA, 16 bp, Homo sapiens
aacctcttcctcctgg

SEQ ID NO: 1971116 - DNA, 20 bp, Homo sapiens
aacctgacagatgtcagccg

SEQ ID NO: 1971117 - DNA, 19 bp, Homo sapiens
aacctgagccttttcttat

SEQ ID NO: 1971118 - DNA, 18 bp, Homo sapiens
aacctgatgccccttccc

SEQ ID NO: 1971119 - DNA, 17 bp, Homo sapiens
aacctgcagttcctgag

SEQ ID NO: 1971120 - DNA, 22 bp, Homo sapiens
aacctgcagttcctgagtacct

SEQ ID NO: 1971121 - DNA, 22 bp, Homo sapiens
aacctgcccctccccagccctt

SEQ ID NO: 1971122 - DNA, 14 bp, Homo sapiens
aacctggagatgat

SEQ ID NO: 1971123 - DNA, 11 bp, Homo sapiens
aacctggcctt

SEQ ID NO: 1971124 - DNA, 17 bp, Homo sapiens
aacctggtggcaccaga

SEQ ID NO: 1971125 - DNA, 13 bp, Homo sapiens
aacctggttcctg

SEQ ID NO: 1971126 - DNA, 17 bp, Homo sapiens
aacctgtactgggttat

SEQ ID NO: 1971127 - DNA, 20 bp, Homo sapiens
aacctgtactgggttatttt

SEQ ID NO: 1971128 - DNA, 23 bp, Homo sapiens
aacctgtacttcaagttaaagtg

SEQ ID NO: 1971129 - DNA, 13 bp, Homo sapiens
aacctgtgtctta

SEQ ID NO: 1971130 - DNA, 20 bp, Homo sapiens
aacctgttcttcctaccaaa

SEQ ID NO: 1971131 - DNA, 15 bp, Homo sapiens
aaccttactatggaa

SEQ ID NO: 1971132 - DNA, 13 bp, Homo sapiens
aaccttcatttta

SEQ ID NO: 1971133 - DNA, 19 bp, Homo sapiens
aaccttgtctctatgccag

SEQ ID NO: 1971134 - DNA, 15 bp, Homo sapiens
aacctttccccagac

SEQ ID NO: 1971135 - DNA, 19 bp, Homo sapiens
aacctttccccagacacat

SEQ ID NO: 1971136 - DNA, 17 bp, Homo sapiens
aacctttccctcacccc

SEQ ID NO: 1971137 - DNA, 16 bp, Homo sapiens
aacgaacccactgtgc

SEQ ID NO: 1971138 - DNA, 17 bp, Homo sapiens
aacgaatgtttcaaatc

SEQ ID NO: 1971139 - DNA, 15 bp, Homo sapiens
aacgagcactggcca

SEQ ID NO: 1971140 - DNA, 18 bp, Homo sapiens
aacgagcactggccagag

SEQ ID NO: 1971141 - DNA, 18 bp, Homo sapiens
aacgcaaagggctgaaag

SEQ ID NO: 1971142 - DNA, 12 bp, Homo sapiens
aacgcacaggaa

SEQ ID NO: 1971143 - DNA, 22 bp, Homo sapiens
aacgcagaggcggaaaccttgc

SEQ ID NO: 1971144 - DNA, 13 bp, Homo sapiens
aacgcctgagccc

SEQ ID NO: 1971145 - DNA, 19 bp, Homo sapiens
aacgcctgagcccagggag

SEQ ID NO: 1971146 - DNA, 21 bp, Homo sapiens
aacgcctgcttgtccctgccc

SEQ ID NO: 1971147 - DNA, 18 bp, Homo sapiens
aacggtcccccctcactc

SEQ ID NO: 1971148 - DNA, 13 bp, Homo sapiens
aacgtattttaaa

SEQ ID NO: 1971149 - DNA, 19 bp, Homo sapiens
aacgtgggtatttcctgct

SEQ ID NO: 1971150 - DNA, 22 bp, Homo sapiens
aacgtgggtatttcctgctaca

SEQ ID NO: 1971151 - DNA, 16 bp, Homo sapiens
aacgttaaaagacagt

SEQ ID NO: 1971152 - DNA, 17 bp, Homo sapiens
aacgttaaaagacagtg

SEQ ID NO: 1971153 - DNA, 15 bp, Homo sapiens
aacgttgaccccttt

SEQ ID NO: 1971154 - DNA, 20 bp, Homo sapiens
aacgttgacccctttccccc

SEQ ID NO: 1971155 - DNA, 14 bp, Homo sapiens
aactaaatatatgt

SEQ ID NO: 1971156 - DNA, 14 bp, Homo sapiens
aactaataaaagca

SEQ ID NO: 1971157 - DNA, 20 bp, Homo sapiens
aactacaaagctgaagaaaa

SEQ ID NO: 1971158 - DNA, 16 bp, Homo sapiens
aactacactaataaat

SEQ ID NO: 1971159 - DNA, 13 bp, Homo sapiens
aactactgtaatt

SEQ ID NO: 1971160 - DNA, 20 bp, Homo sapiens
aactactgtaattaagtgca

SEQ ID NO: 1971161 - DNA, 18 bp, Homo sapiens
aactactttttatactcc

SEQ ID NO: 1971162 - DNA, 20 bp, Homo sapiens
aactagaggtgagaaattta

SEQ ID NO: 1971163 - DNA, 22 bp, Homo sapiens
aactagaggtgagaaatttaaa

SEQ ID NO: 1971164 - DNA, 17 bp, Homo sapiens
aactagatctcctattt

SEQ ID NO: 1971165 - DNA, 22 bp, Homo sapiens
aactagatctcctgtaattttg

SEQ ID NO: 1971166 - DNA, 14 bp, Homo sapiens
aactagccaaggct

SEQ ID NO: 1971167 - DNA, 14 bp, Homo sapiens
aactaggacctcat

SEQ ID NO: 1971168 - DNA, 15 bp, Homo sapiens
aactagtcctttact

SEQ ID NO: 1971169 - DNA, 13 bp, Homo sapiens
aactagtttaatt

SEQ ID NO: 1971170 - DNA, 16 bp, Homo sapiens
aactagtttccagtgg

SEQ ID NO: 1971171 - DNA, 17 bp, Homo sapiens
aactataaactactgta

SEQ ID NO: 1971172 - DNA, 19 bp, Homo sapiens
aactataaactactgtaat

SEQ ID NO: 1971173 - DNA, 22 bp, Homo sapiens
aactatccaattaaaattaagg

SEQ ID NO: 1971174 - DNA, 18 bp, Homo sapiens
aactatgatatggtaaaa

SEQ ID NO: 1971175 - DNA, 18 bp, Homo sapiens
aactatgatcacagtgac

SEQ ID NO: 1971176 - DNA, 16 bp, Homo sapiens
aactatggttcccaat

SEQ ID NO: 1971177 - DNA, 20 bp, Homo sapiens
aactatggttcccaataaaa

SEQ ID NO: 1971178 - DNA, 22 bp, Homo sapiens
aactatggttcccaataaaagt

SEQ ID NO: 1971179 - DNA, 22 bp, Homo sapiens
aactatgtgatgttaactatta

SEQ ID NO: 1971180 - DNA, 17 bp, Homo sapiens
aactattaaagtgccat

SEQ ID NO: 1971181 - DNA, 19 bp, Homo sapiens
aactatttgtctttcagga

SEQ ID NO: 1971182 - DNA, 15 bp, Homo sapiens
aactcaaaatatttg

SEQ ID NO: 1971183 - DNA, 13 bp, Homo sapiens
aactcaatatttt

SEQ ID NO: 1971184 - DNA, 14 bp, Homo sapiens
aactcaatattttc

SEQ ID NO: 1971185 - DNA, 20 bp, Homo sapiens
aactcaatattttccatgaa

SEQ ID NO: 1971186 - DNA, 17 bp, Homo sapiens
aactcactcttatgaaa

SEQ ID NO: 1971187 - DNA, 22 bp, Homo sapiens
aactcactgctcaagaagacat

SEQ ID NO: 1971188 - DNA, 22 bp, Homo sapiens
aactcagagcccctccctgcta

SEQ ID NO: 1971189 - DNA, 14 bp, Homo sapiens
aactcagagcctcc

SEQ ID NO: 1971190 - DNA, 14 bp, Homo sapiens
aactcatcataaaa

SEQ ID NO: 1971191 - DNA, 17 bp, Homo sapiens
aactcatcataaaataa

SEQ ID NO: 1971192 - DNA, 18 bp, Homo sapiens
aactcatcataaaataaa

SEQ ID NO: 1971193 - DNA, 17 bp, Homo sapiens
aactcatctgtcaccaa

SEQ ID NO: 1971194 - DNA, 17 bp, Homo sapiens
aactcatctgttatcct

SEQ ID NO: 1971195 - DNA, 24 bp, Homo sapiens
aactcatttttgttttcattatct

SEQ ID NO: 1971196 - DNA, 15 bp, Homo sapiens
aactccaccaaccca

SEQ ID NO: 1971197 - DNA, 23 bp, Homo sapiens
aactccaccaacccatcagaagg

SEQ ID NO: 1971198 - DNA, 16 bp, Homo sapiens
aactccactctccttc

SEQ ID NO: 1971199 - DNA, 13 bp, Homo sapiens
aactccaggaaaa

SEQ ID NO: 1971200 - DNA, 18 bp, Homo sapiens
aactccagtctcctgaca

SEQ ID NO: 1971201 - DNA, 11 bp, Homo sapiens
aactcctcctt

SEQ ID NO: 1971202 - DNA, 17 bp, Homo sapiens
aactcctgattttgtag

SEQ ID NO: 1971203 - DNA, 16 bp, Homo sapiens
tgtcctctcgagccca

SEQ ID NO: 1971204 - DNA, 23 bp, Homo sapiens
tgtcctcttgctcaaaaatctgt

SEQ ID NO: 1971205 - DNA, 22 bp, Homo sapiens
tgtcctctttactcccttcctg

SEQ ID NO: 1971206 - DNA, 12 bp, Homo sapiens
tgtcctgccttg

SEQ ID NO: 1971207 - DNA, 11 bp, Homo sapiens
tgtcctgctgt

SEQ ID NO: 1971208 - DNA, 12 bp, Homo sapiens
tgtcctgggagt

SEQ ID NO: 1971209 - DNA, 18 bp, Homo sapiens
tgtcctggtacagcaggg

SEQ ID NO: 1971210 - DNA, 20 bp, Homo sapiens
tgtcctgtagaggttttgtt

SEQ ID NO: 1971211 - DNA, 22 bp, Homo sapiens
tgtccttccctgcatttctgag

SEQ ID NO: 1971212 - DNA, 13 bp, Homo sapiens
tgtccttgcacct

SEQ ID NO: 1971213 - DNA, 17 bp, Homo sapiens
tgtccttggggcacagt

SEQ ID NO: 1971214 - DNA, 14 bp, Homo sapiens
tgtcgattagactg

SEQ ID NO: 1971215 - DNA, 14 bp, Homo sapiens
tgtcgcccagtctg

SEQ ID NO: 1971216 - DNA, 15 bp, Homo sapiens
tgtcgccccaggccc

SEQ ID NO: 1971217 - DNA, 13 bp, Homo sapiens
tgtcgcctctgca

SEQ ID NO: 1971218 - DNA, 14 bp, Homo sapiens
tgtcgcctctgcat

SEQ ID NO: 1971219 - DNA, 14 bp, Homo sapiens
tgtcgcctgccccc

SEQ ID NO: 1971220 - DNA, 16 bp, Homo sapiens
tgtcgcctgcccccag

SEQ ID NO: 1971221 - DNA, 18 bp, Homo sapiens
tgtcgctgggctgtgggt

SEQ ID NO: 1971222 - DNA, 23 bp, Homo sapiens
tgtcgtagccaaggtgggctgag

SEQ ID NO: 1971223 - DNA, 13 bp, Homo sapiens
tgtctaaaaacac

SEQ ID NO: 1971224 - DNA, 22 bp, Homo sapiens
tgtctaagagatctggtcaaag

SEQ ID NO: 1971225 - DNA, 18 bp, Homo sapiens
tgtctataatggaaacat

SEQ ID NO: 1971226 - DNA, 16 bp, Homo sapiens
tgtctattctgagcct

SEQ ID NO: 1971227 - DNA, 17 bp, Homo sapiens
tgtctattctgagcctt

SEQ ID NO: 1971228 - DNA, 18 bp, Homo sapiens
tgtctattctgagccttg

SEQ ID NO: 1971229 - DNA, 19 bp, Homo sapiens
tgtctattctgagccttga

SEQ ID NO: 1971230 - DNA, 17 bp, Homo sapiens
tgtctcaagagggcact

SEQ ID NO: 1971231 - DNA, 19 bp, Homo sapiens
tgtctcaagctcttcctta

SEQ ID NO: 1971232 - DNA, 14 bp, Homo sapiens
tgtctcacagacgc

SEQ ID NO: 1971233 - DNA, 14 bp, Homo sapiens
tgtctcacatggga

SEQ ID NO: 1971234 - DNA, 16 bp, Homo sapiens
tgtctcagcctcctca

SEQ ID NO: 1971235 - DNA, 17 bp, Homo sapiens
tgtctcagcctcctcag

SEQ ID NO: 1971236 - DNA, 18 bp, Homo sapiens
tgtctccaggatggtgca

SEQ ID NO: 1971237 - DNA, 14 bp, Homo sapiens
tgtctccctggggt

SEQ ID NO: 1971238 - DNA, 14 bp, Homo sapiens
tgtctcgtctcctg

SEQ ID NO: 1971239 - DNA, 18 bp, Homo sapiens
tgtctctagtttctttct

SEQ ID NO: 1971240 - DNA, 13 bp, Homo sapiens
tgtctctcagaat

SEQ ID NO: 1971241 - DNA, 22 bp, Homo sapiens
tgtctctcccaccccggcctcc

SEQ ID NO: 1971242 - DNA, 16 bp, Homo sapiens
tgtctctgcatctcat

SEQ ID NO: 1971243 - DNA, 13 bp, Homo sapiens
tgtctctgctctt

SEQ ID NO: 1971244 - DNA, 14 bp, Homo sapiens
tgtctctgctcttg

SEQ ID NO: 1971245 - DNA, 17 bp, Homo sapiens
tgtctctgctcttgcct

SEQ ID NO: 1971246 - DNA, 12 bp, Homo sapiens
tgtctctgtccc

SEQ ID NO: 1971247 - DNA, 16 bp, Homo sapiens
tgtctctgtccctcac

SEQ ID NO: 1971248 - DNA, 23 bp, Homo sapiens
tgtctctgtccctcactgccttc

SEQ ID NO: 1971249 - DNA, 16 bp, Homo sapiens
tgtctcttcctctgtt

SEQ ID NO: 1971250 - DNA, 22 bp, Homo sapiens
tgtctctttaatgtcacaggca

SEQ ID NO: 1971251 - DNA, 16 bp, Homo sapiens
tgtctgaagtcactgc

SEQ ID NO: 1971252 - DNA, 17 bp, Homo sapiens
tgtctgaagtcactgca

SEQ ID NO: 1971253 - DNA, 14 bp, Homo sapiens
tgtctgcacccagg

SEQ ID NO: 1971254 - DNA, 14 bp, Homo sapiens
tgtctgccacagag

SEQ ID NO: 1971255 - DNA, 18 bp, Homo sapiens
tgtctgccagccagcagc

SEQ ID NO: 1971256 - DNA, 19 bp, Homo sapiens
tgtctgccagccagcagcc

SEQ ID NO: 1971257 - DNA, 14 bp, Homo sapiens
tgtctgcttctgtc

SEQ ID NO: 1971258 - DNA, 16 bp, Homo sapiens
tgtctggaagctgagc

SEQ ID NO: 1971259 - DNA, 15 bp, Homo sapiens
tgtctggctgtacgt

SEQ ID NO: 1971260 - DNA, 18 bp, Homo sapiens
tgtctggggaccctgtag

SEQ ID NO: 1971261 - DNA, 15 bp, Homo sapiens
tgtctggttttaaca

SEQ ID NO: 1971262 - DNA, 22 bp, Homo sapiens
tgtctggttttaacaatttcct

SEQ ID NO: 1971263 - DNA, 15 bp, Homo sapiens
tgtctgtacacgtgt

SEQ ID NO: 1971264 - DNA, 11 bp, Homo sapiens
tgtctgtcacc

SEQ ID NO: 1971265 - DNA, 24 bp, Homo sapiens
tgtctgtcaccagctatctgtcat

SEQ ID NO: 1971266 - DNA, 14 bp, Homo sapiens
tgtctgtctgtccc

SEQ ID NO: 1971267 - DNA, 15 bp, Homo sapiens
tgtctgtctgtctgt

SEQ ID NO: 1971268 - DNA, 15 bp, Homo sapiens
tgtctgtgcagctgc

SEQ ID NO: 1971269 - DNA, 15 bp, Homo sapiens
tgtctgtgtcagcct

SEQ ID NO: 1971270 - DNA, 22 bp, Homo sapiens
tgtctgtttcaatgacctgtat

SEQ ID NO: 1971271 - DNA, 16 bp, Homo sapiens
tgtctgtttgttctct

SEQ ID NO: 1971272 - DNA, 12 bp, Homo sapiens
tgtcttaattaa

SEQ ID NO: 1971273 - DNA, 22 bp, Homo sapiens
tgtcttcagcctctccaggcac

SEQ ID NO: 1971274 - DNA, 23 bp, Homo sapiens
tgtcttcatttcattgtatgatg

SEQ ID NO: 1971275 - DNA, 21 bp, Homo sapiens
tgtcttccaaccccagctggc

SEQ ID NO: 1971276 - DNA, 12 bp, Homo sapiens
tgtcttccataa

SEQ ID NO: 1971277 - DNA, 13 bp, Homo sapiens
tgtcttccataat

SEQ ID NO: 1971278 - DNA, 17 bp, Homo sapiens
tgtcttccataatgtat

SEQ ID NO: 1971279 - DNA, 20 bp, Homo sapiens
tgtcttcctagtatattagt

SEQ ID NO: 1971280 - DNA, 10 bp, Homo sapiens
tgtcttcctc

SEQ ID NO: 1971281 - DNA, 18 bp, Homo sapiens
tgtcttgcaatggcagcc
